United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 10

SEQ ID NO: 404612 - DNA, 16 bp, M. musculus
gaagggggataaaatt

SEQ ID NO: 404613 - DNA, 16 bp, M. musculus
gaagggtattgtttct

SEQ ID NO: 404614 - DNA, 16 bp, M. musculus
gaagggtccagatcca

SEQ ID NO: 404615 - DNA, 41 bp, M. musculus
gaagggtgcagttgtgaaggtgttcacctctgagataacct

SEQ ID NO: 404616 - DNA, 16 bp, M. musculus
gaagggtgttatttcc

SEQ ID NO: 404617 - DNA, 16 bp, M. musculus
gaaggtacaatgtatc

SEQ ID NO: 404618 - DNA, 16 bp, M. musculus
gaaggtacagcctcag

SEQ ID NO: 404619 - DNA, 16 bp, M. musculus
gaaggtagagaaagca

SEQ ID NO: 404620 - DNA, 16 bp, M. musculus
gaaggtcaagaagaag

SEQ ID NO: 404621 - DNA, 16 bp, M. musculus
gaaggtcaaggttatc

SEQ ID NO: 404622 - DNA, 16 bp, M. musculus
gaaggtcagaagaagg

SEQ ID NO: 404623 - DNA, 16 bp, M. musculus
gaaggtcagaagacag

SEQ ID NO: 404624 - DNA, 16 bp, M. musculus
gaaggtcagaagttca

SEQ ID NO: 404625 - DNA, 16 bp, M. musculus
gaaggtcagaggtcag

SEQ ID NO: 404626 - DNA, 16 bp, M. musculus
gaaggtcaggaagcag

SEQ ID NO: 404627 - DNA, 16 bp, M. musculus
gaaggtccagagttca

SEQ ID NO: 404628 - DNA, 16 bp, M. musculus
gaaggtcctggacaga

SEQ ID NO: 404629 - DNA, 16 bp, M. musculus
gaaggtcctgggcaga

SEQ ID NO: 404630 - DNA, 16 bp, M. musculus
gaaggtcctgtgttca

SEQ ID NO: 404631 - DNA, 17 bp, M. musculus
gaaggtctgacagaact

SEQ ID NO: 404632 - DNA, 16 bp, M. musculus
gaaggtgaaggtgaag

SEQ ID NO: 404633 - DNA, 16 bp, M. musculus
gaaggtgaccttgaac

SEQ ID NO: 404634 - DNA, 16 bp, M. musculus
gaaggtgcagcaatgg

SEQ ID NO: 404635 - DNA, 16 bp, M. musculus
gaaggtggactgggag

SEQ ID NO: 404636 - DNA, 16 bp, M. musculus
gaaggtggagctgaag

SEQ ID NO: 404637 - DNA, 16 bp, M. musculus
gaaggtggaggcagaa

SEQ ID NO: 404638 - DNA, 16 bp, M. musculus
gaaggtggaggcaggg

SEQ ID NO: 404639 - DNA, 16 bp, M. musculus
gaaggtggcctcttca

SEQ ID NO: 404640 - DNA, 19 bp, M. musculus
gaaggtggctggttgtctg

SEQ ID NO: 404641 - DNA, 16 bp, M. musculus
gaaggtgtcctttgcc

SEQ ID NO: 404642 - DNA, 16 bp, M. musculus
gaaggtgttggatccc

SEQ ID NO: 404643 - DNA, 16 bp, M. musculus
gaaggtgtttatcagt

SEQ ID NO: 404644 - DNA, 16 bp, M. musculus
gaaggttccatgaggt

SEQ ID NO: 404645 - DNA, 16 bp, M. musculus
gaaggttgtgagctac

SEQ ID NO: 404646 - DNA, 16 bp, M. musculus
gaaggttttattccag

SEQ ID NO: 404647 - DNA, 16 bp, M. musculus
gaaggtttttaatgac

SEQ ID NO: 404648 - DNA, 16 bp, M. musculus
gaagtaaaagttaacc

SEQ ID NO: 404649 - DNA, 16 bp, M. musculus
gaagtaaaatggagct

SEQ ID NO: 404650 - DNA, 16 bp, M. musculus
gaagtaacaacaaaat

SEQ ID NO: 404651 - DNA, 16 bp, M. musculus
gaagtaagaaagtatt

SEQ ID NO: 404652 - DNA, 16 bp, M. musculus
gaagtacttcctcctt

SEQ ID NO: 404653 - DNA, 16 bp, M. musculus
gaagtagaagcagaag

SEQ ID NO: 404654 - DNA, 16 bp, M. musculus
gaagtagaagcaggaa

SEQ ID NO: 404655 - DNA, 16 bp, M. musculus
gaagtagaaggaactc

SEQ ID NO: 404656 - DNA, 19 bp, M. musculus
gaagtagcaacaaaaataa

SEQ ID NO: 404657 - DNA, 16 bp, M. musculus
gaagtagctggaaata

SEQ ID NO: 404658 - DNA, 16 bp, M. musculus
gaagtagggaaaagct

SEQ ID NO: 404659 - DNA, 16 bp, M. musculus
gaagtataatccaaat

SEQ ID NO: 404660 - DNA, 16 bp, M. musculus
gaagtatatgaaaact

SEQ ID NO: 404661 - DNA, 16 bp, M. musculus
gaagtatgtcactgtg

SEQ ID NO: 404662 - DNA, 16 bp, M. musculus
gaagtattttttaaaa

SEQ ID NO: 404663 - DNA, 16 bp, M. musculus
gaagtcaaagaacaac

SEQ ID NO: 404664 - DNA, 16 bp, M. musculus
gaagtcaagacagcag

SEQ ID NO: 404665 - DNA, 16 bp, M. musculus
gaagtcaagacaggaa

SEQ ID NO: 404666 - DNA, 16 bp, M. musculus
gaagtcaaggcaagaa

SEQ ID NO: 404667 - DNA, 16 bp, M. musculus
gaagtcaaggcaggaa

SEQ ID NO: 404668 - DNA, 16 bp, M. musculus
gaagtcacagcaggaa

SEQ ID NO: 404669 - DNA, 16 bp, M. musculus
gaagtcactcctcttg

SEQ ID NO: 404670 - DNA, 16 bp, M. musculus
gaagtcacttgatata

SEQ ID NO: 404671 - DNA, 16 bp, M. musculus
gaagtcagaaatccac

SEQ ID NO: 404672 - DNA, 16 bp, M. musculus
gaagtcagaacaggaa

SEQ ID NO: 404673 - DNA, 16 bp, M. musculus
gaagtcagaactggaa

SEQ ID NO: 404674 - DNA, 16 bp, M. musculus
gaagtcagaagacagc

SEQ ID NO: 404675 - DNA, 16 bp, M. musculus
gaagtcagaagagggc

SEQ ID NO: 404676 - DNA, 16 bp, M. musculus
gaagtcagagcaggag

SEQ ID NO: 404677 - DNA, 16 bp, M. musculus
gaagtcagaggaccac

SEQ ID NO: 404678 - DNA, 16 bp, M. musculus
gaagtcagagggcagc

SEQ ID NO: 404679 - DNA, 16 bp, M. musculus
gaagtcaggacaagaa

SEQ ID NO: 404680 - DNA, 16 bp, M. musculus
gaagtcaggctccagg

SEQ ID NO: 404681 - DNA, 16 bp, M. musculus
gaagtcagggaagaaa

SEQ ID NO: 404682 - DNA, 16 bp, M. musculus
gaagtcagggcaggga

SEQ ID NO: 404683 - DNA, 16 bp, M. musculus
gaagtcagtttcccag

SEQ ID NO: 404684 - DNA, 16 bp, M. musculus
gaagtccaaagtgtgg

SEQ ID NO: 404685 - DNA, 16 bp, M. musculus
gaagtcctgagttcaa

SEQ ID NO: 404686 - DNA, 16 bp, M. musculus
gaagtccttgtcacct

SEQ ID NO: 404687 - DNA, 16 bp, M. musculus
gaagtctctgaaactg

SEQ ID NO: 404688 - DNA, 16 bp, M. musculus
gaagtctctgtggagg

SEQ ID NO: 404689 - DNA, 16 bp, M. musculus
gaagtctgcattaaac

SEQ ID NO: 404690 - DNA, 16 bp, M. musculus
gaagtgaaagatcttt

SEQ ID NO: 404691 - DNA, 16 bp, M. musculus
gaagtgaagtgccagg

SEQ ID NO: 404692 - DNA, 16 bp, M. musculus
gaagtgacaaggaagc

SEQ ID NO: 404693 - DNA, 16 bp, M. musculus
gaagtgagaagaccca

SEQ ID NO: 404694 - DNA, 16 bp, M. musculus
gaagtgagaatctcag

SEQ ID NO: 404695 - DNA, 16 bp, M. musculus
gaagtgcaccttgaag

SEQ ID NO: 404696 - DNA, 16 bp, M. musculus
gaagtgcagccagtgc

SEQ ID NO: 404697 - DNA, 16 bp, M. musculus
gaagtgctgcccagtg

SEQ ID NO: 404698 - DNA, 16 bp, M. musculus
gaagtggaagcagaag

SEQ ID NO: 404699 - DNA, 16 bp, M. musculus
gaagtggagatgactc

SEQ ID NO: 404700 - DNA, 16 bp, M. musculus
gaagtggaggcagaaa

SEQ ID NO: 404701 - DNA, 17 bp, M. musculus
gaagtggaggctgagct

SEQ ID NO: 404702 - DNA, 17 bp, M. musculus
gaagtggatgatcacag

SEQ ID NO: 404703 - DNA, 16 bp, M. musculus
gaagtggcactattag

SEQ ID NO: 404704 - DNA, 16 bp, M. musculus
gaagtggcccagccat

SEQ ID NO: 404705 - DNA, 16 bp, M. musculus
gaagtgggaatgggtg

SEQ ID NO: 404706 - DNA, 16 bp, M. musculus
gaagtgggagtgtgtg

SEQ ID NO: 404707 - DNA, 16 bp, M. musculus
gaagtggtctctacag

SEQ ID NO: 404708 - DNA, 16 bp, M. musculus
gaagtggtggcacaca

SEQ ID NO: 404709 - DNA, 16 bp, M. musculus
gaagtggtggcaggaa

SEQ ID NO: 404710 - DNA, 16 bp, M. musculus
gaagtgtaaggcaaat

SEQ ID NO: 404711 - DNA, 16 bp, M. musculus
gaagtgtccttcatca

SEQ ID NO: 404712 - DNA, 16 bp, M. musculus
gaagtgtccttgtggt

SEQ ID NO: 404713 - DNA, 16 bp, M. musculus
gaagtgtctgtctttg

SEQ ID NO: 404714 - DNA, 16 bp, M. musculus
gaagtgtgccactggg

SEQ ID NO: 404715 - DNA, 16 bp, M. musculus
gaagtgtggagcagag

SEQ ID NO: 404716 - DNA, 16 bp, M. musculus
gaagtgtggtggtttg

SEQ ID NO: 404717 - DNA, 16 bp, M. musculus
gaagtgtgtcactgtg

SEQ ID NO: 404718 - DNA, 16 bp, M. musculus
gaagtgtgtccctggg

SEQ ID NO: 404719 - DNA, 16 bp, M. musculus
gaagtgttccttctgt

SEQ ID NO: 404720 - DNA, 16 bp, M. musculus
gaagtgttcttctata

SEQ ID NO: 404721 - DNA, 16 bp, M. musculus
gaagtgtttgccagtg

SEQ ID NO: 404722 - DNA, 16 bp, M. musculus
gaagtgttttttgaga

SEQ ID NO: 404723 - DNA, 16 bp, M. musculus
gaagttaagaaacaaa

SEQ ID NO: 404724 - DNA, 16 bp, M. musculus
gaagttatttttaaaa

SEQ ID NO: 404725 - DNA, 16 bp, M. musculus
gaagttatttttttct

SEQ ID NO: 404726 - DNA, 16 bp, M. musculus
gaagttcaagaagaag

SEQ ID NO: 404727 - DNA, 16 bp, M. musculus
gaagttcaaggtcatc

SEQ ID NO: 404728 - DNA, 16 bp, M. musculus
gaagttcaagtgacca

SEQ ID NO: 404729 - DNA, 16 bp, M. musculus
gaagttccagagacct

SEQ ID NO: 404730 - DNA, 16 bp, M. musculus
gaagttctctgctgtg

SEQ ID NO: 404731 - DNA, 33 bp, M. musculus
gaagttctgcccactgtgaagatttcccttcac

SEQ ID NO: 404732 - DNA, 16 bp, M. musculus
gaagttcttttactgt

SEQ ID NO: 404733 - DNA, 16 bp, M. musculus
gaagttgaggaggaag

SEQ ID NO: 404734 - DNA, 16 bp, M. musculus
gaagttgctcaaatgc

SEQ ID NO: 404735 - DNA, 16 bp, M. musculus
gaagttgctgggaatt

SEQ ID NO: 404736 - DNA, 16 bp, M. musculus
gaagttggagagatgg

SEQ ID NO: 404737 - DNA, 16 bp, M. musculus
gaagttgtcagaacag

SEQ ID NO: 404738 - DNA, 16 bp, M. musculus
gaagtttcaaaaaagc

SEQ ID NO: 404739 - DNA, 16 bp, M. musculus
gaagtttcctttttca

SEQ ID NO: 404740 - DNA, 16 bp, M. musculus
gaagtttctagacaga

SEQ ID NO: 404741 - DNA, 16 bp, M. musculus
gaagtttgaagccagc

SEQ ID NO: 404742 - DNA, 16 bp, M. musculus
gaagttttggatgctt

SEQ ID NO: 404743 - DNA, 16 bp, M. musculus
gaagtttttaaaatat

SEQ ID NO: 404744 - DNA, 16 bp, M. musculus
gaataaaacagcaatg

SEQ ID NO: 404745 - DNA, 16 bp, M. musculus
gaataaaaccatacaa

SEQ ID NO: 404746 - DNA, 16 bp, M. musculus
gaataaaaggtgtgtg

SEQ ID NO: 404747 - DNA, 16 bp, M. musculus
gaataaaatcaatttt

SEQ ID NO: 404748 - DNA, 16 bp, M. musculus
gaataaacccttcctc

SEQ ID NO: 404749 - DNA, 16 bp, M. musculus
gaataaagatgctatg

SEQ ID NO: 404750 - DNA, 16 bp, M. musculus
gaataaagcaatccaa

SEQ ID NO: 404751 - DNA, 16 bp, M. musculus
gaataaatctcctttt

SEQ ID NO: 404752 - DNA, 16 bp, M. musculus
gaataaccttgaactt

SEQ ID NO: 404753 - DNA, 16 bp, M. musculus
gaataagaaaaaacct

SEQ ID NO: 404754 - DNA, 16 bp, M. musculus
gaataagaaggagcca

SEQ ID NO: 404755 - DNA, 16 bp, M. musculus
gaataagcttggccca

SEQ ID NO: 404756 - DNA, 17 bp, M. musculus
gaataataatcctccct

SEQ ID NO: 404757 - DNA, 16 bp, M. musculus
gaataataatcctctc

SEQ ID NO: 404758 - DNA, 16 bp, M. musculus
gaataatttgaagagt

SEQ ID NO: 404759 - DNA, 16 bp, M. musculus
gaatacaagctgtgtg

SEQ ID NO: 404760 - DNA, 16 bp, M. musculus
gaatacaggcttttga

SEQ ID NO: 404761 - DNA, 16 bp, M. musculus
gaatacatgctgtgtg

SEQ ID NO: 404762 - DNA, 16 bp, M. musculus
gaatacattgcatgat

SEQ ID NO: 404763 - DNA, 16 bp, M. musculus
gaatacattggtttct

SEQ ID NO: 404764 - DNA, 16 bp, M. musculus
gaatactacctaactc

SEQ ID NO: 404765 - DNA, 16 bp, M. musculus
gaatactatttagcta

SEQ ID NO: 404766 - DNA, 16 bp, M. musculus
gaatactgactcccag

SEQ ID NO: 404767 - DNA, 16 bp, M. musculus
gaatactggcttctag

SEQ ID NO: 404768 - DNA, 16 bp, M. musculus
gaatactttgctttct

SEQ ID NO: 404769 - DNA, 16 bp, M. musculus
gaatagaagatccaga

SEQ ID NO: 404770 - DNA, 16 bp, M. musculus
gaatagaatgtgccca

SEQ ID NO: 404771 - DNA, 16 bp, M. musculus
gaatagaggagaacaa

SEQ ID NO: 404772 - DNA, 16 bp, M. musculus
gaatagctgagaaaca

SEQ ID NO: 404773 - DNA, 16 bp, M. musculus
gaatagtatttgaaat

SEQ ID NO: 404774 - DNA, 16 bp, M. musculus
gaatagttcttttgtt

SEQ ID NO: 404775 - DNA, 16 bp, M. musculus
gaatagtttgtgtaga

SEQ ID NO: 404776 - DNA, 16 bp, M. musculus
gaatagttttagctat

SEQ ID NO: 404777 - DNA, 16 bp, M. musculus
gaatagtttttgctac

SEQ ID NO: 404778 - DNA, 16 bp, M. musculus
gaatataaatgcaaaa

SEQ ID NO: 404779 - DNA, 16 bp, M. musculus
gaatataattgaagac

SEQ ID NO: 404780 - DNA, 16 bp, M. musculus
gaatatacatttttct

SEQ ID NO: 404781 - DNA, 16 bp, M. musculus
gaatataccctcttct

SEQ ID NO: 404782 - DNA, 16 bp, M. musculus
gaatatatatgtatat

SEQ ID NO: 404783 - DNA, 16 bp, M. musculus
gaatatatgtatatac

SEQ ID NO: 404784 - DNA, 16 bp, M. musculus
gaatatatgtatatat

SEQ ID NO: 404785 - DNA, 16 bp, M. musculus
gaatatatttcttaat

SEQ ID NO: 404786 - DNA, 16 bp, M. musculus
gaatatcaatggaaaa

SEQ ID NO: 404787 - DNA, 16 bp, M. musculus
gaatatcataaattca

SEQ ID NO: 404788 - DNA, 16 bp, M. musculus
gaatatccacttctgt

SEQ ID NO: 404789 - DNA, 18 bp, M. musculus
gaatatcgatgcaaaaat

SEQ ID NO: 404790 - DNA, 16 bp, M. musculus
gaatatcttctgagaa

SEQ ID NO: 404791 - DNA, 16 bp, M. musculus
gaatatgagtaccctg

SEQ ID NO: 404792 - DNA, 16 bp, M. musculus
gaatatgatggtttgt

SEQ ID NO: 404793 - DNA, 16 bp, M. musculus
gaatatgcttgaccca

SEQ ID NO: 404794 - DNA, 16 bp, M. musculus
gaatatggagcctgaa

SEQ ID NO: 404795 - DNA, 16 bp, M. musculus
gaatatggagtataaa

SEQ ID NO: 404796 - DNA, 16 bp, M. musculus
gaatatggctgccctt

SEQ ID NO: 404797 - DNA, 16 bp, M. musculus
gaatatgttctagctg

SEQ ID NO: 404798 - DNA, 16 bp, M. musculus
gaatattagtaagtgg

SEQ ID NO: 404799 - DNA, 16 bp, M. musculus
gaatattgactggctt

SEQ ID NO: 404800 - DNA, 16 bp, M. musculus
gaatattttgtatgtt

SEQ ID NO: 404801 - DNA, 16 bp, M. musculus
gaatcaaaagcagccc

SEQ ID NO: 404802 - DNA, 16 bp, M. musculus
gaatcaaacccaggtc

SEQ ID NO: 404803 - DNA, 16 bp, M. musculus
gaatcaaacctgggtc

SEQ ID NO: 404804 - DNA, 16 bp, M. musculus
gaatcaaagacctcaa

SEQ ID NO: 404805 - DNA, 16 bp, M. musculus
gaatcaaatagaagag

SEQ ID NO: 404806 - DNA, 16 bp, M. musculus
gaatcaagaggcagtc

SEQ ID NO: 404807 - DNA, 16 bp, M. musculus
gaatcaagatgtagaa

SEQ ID NO: 404808 - DNA, 16 bp, M. musculus
gaatcaatgaaaagtt

SEQ ID NO: 404809 - DNA, 16 bp, M. musculus
gaatcacaagatcaca

SEQ ID NO: 404810 - DNA, 19 bp, M. musculus
gaatcacagagggtcttgt

SEQ ID NO: 404811 - DNA, 16 bp, M. musculus
gaatcaccatgcctgg

SEQ ID NO: 404812 - DNA, 16 bp, M. musculus
gaatcaccatttctga

SEQ ID NO: 404813 - DNA, 16 bp, M. musculus
gaatcacgagaggaac

SEQ ID NO: 404814 - DNA, 16 bp, M. musculus
gaatcagaagatggtc

SEQ ID NO: 404815 - DNA, 16 bp, M. musculus
gaatcagatgaagaat

SEQ ID NO: 404816 - DNA, 16 bp, M. musculus
gaatcagatgcagata

SEQ ID NO: 404817 - DNA, 16 bp, M. musculus
gaatcagccttttcag

SEQ ID NO: 404818 - DNA, 16 bp, M. musculus
gaatcaggagctgtca

SEQ ID NO: 404819 - DNA, 41 bp, M. musculus
gaatcagggcccctgttatgattcctcagcggtctccagtg

SEQ ID NO: 404820 - DNA, 16 bp, M. musculus
gaatcagttctctcct

SEQ ID NO: 404821 - DNA, 16 bp, M. musculus
gaatcatactgtaaat

SEQ ID NO: 404822 - DNA, 16 bp, M. musculus
gaatcatcagaaccca

SEQ ID NO: 404823 - DNA, 16 bp, M. musculus
gaatcatggctccagc

SEQ ID NO: 404824 - DNA, 16 bp, M. musculus
gaatcattaaagaaaa

SEQ ID NO: 404825 - DNA, 16 bp, M. musculus
gaatcattaagaaata

SEQ ID NO: 404826 - DNA, 16 bp, M. musculus
gaatccaaaacatttg

SEQ ID NO: 404827 - DNA, 16 bp, M. musculus
gaatccaagaacacat

SEQ ID NO: 404828 - DNA, 16 bp, M. musculus
gaatccaagaacccat

SEQ ID NO: 404829 - DNA, 16 bp, M. musculus
gaatccaagaatatat

SEQ ID NO: 404830 - DNA, 16 bp, M. musculus
gaatccacactggatc

SEQ ID NO: 404831 - DNA, 16 bp, M. musculus
gaatccagacccagca

SEQ ID NO: 404832 - DNA, 16 bp, M. musculus
gaatccatcatgattg

SEQ ID NO: 404833 - DNA, 16 bp, M. musculus
gaatccatctggccct

SEQ ID NO: 404834 - DNA, 16 bp, M. musculus
gaatcccacccttcaa

SEQ ID NO: 404835 - DNA, 16 bp, M. musculus
gaatcccagcacttag

SEQ ID NO: 404836 - DNA, 22 bp, M. musculus
gaatcctactaacaggaaccaa

SEQ ID NO: 404837 - DNA, 16 bp, M. musculus
gaatcctcaggtggga

SEQ ID NO: 404838 - DNA, 16 bp, M. musculus
gaatcctcctgtctct

SEQ ID NO: 404839 - DNA, 16 bp, M. musculus
gaatcctttggcagaa

SEQ ID NO: 404840 - DNA, 16 bp, M. musculus
gaatcgaacctgggtc

SEQ ID NO: 404841 - DNA, 16 bp, M. musculus
gaatctaatgagatga

SEQ ID NO: 404842 - DNA, 16 bp, M. musculus
gaatctatacattgct

SEQ ID NO: 404843 - DNA, 16 bp, M. musculus
gaatctcaagtgcaga

SEQ ID NO: 404844 - DNA, 16 bp, M. musculus
gaatctcacacaataa

SEQ ID NO: 404845 - DNA, 16 bp, M. musculus
gaatctcactaagaag

SEQ ID NO: 404846 - DNA, 16 bp, M. musculus
gaatctcagaagagac

SEQ ID NO: 404847 - DNA, 16 bp, M. musculus
gaatctcagtgtccca

SEQ ID NO: 404848 - DNA, 16 bp, M. musculus
gaatctccctgggaag

SEQ ID NO: 404849 - DNA, 16 bp, M. musculus
gaatctcttgagttca

SEQ ID NO: 404850 - DNA, 16 bp, M. musculus
gaatctctttctttag

SEQ ID NO: 404851 - DNA, 16 bp, M. musculus
gaatctgaaggcagga

SEQ ID NO: 404852 - DNA, 16 bp, M. musculus
gaatctgatgccttct

SEQ ID NO: 404853 - DNA, 16 bp, M. musculus
gaatctggaagaaaag

SEQ ID NO: 404854 - DNA, 16 bp, M. musculus
gaatctgtagatggct

SEQ ID NO: 404855 - DNA, 16 bp, M. musculus
gaatcttcactccctt

SEQ ID NO: 404856 - DNA, 16 bp, M. musculus
gaatcttctcaagacc

SEQ ID NO: 404857 - DNA, 16 bp, M. musculus
gaatcttctgaggcaa

SEQ ID NO: 404858 - DNA, 17 bp, M. musculus
gaatcttctgcggcaaa

SEQ ID NO: 404859 - DNA, 16 bp, M. musculus
gaatctttcctaaaat

SEQ ID NO: 404860 - DNA, 16 bp, M. musculus
gaatgaaaggaaatat

SEQ ID NO: 404861 - DNA, 16 bp, M. musculus
gaatgaacctagtttg

SEQ ID NO: 404862 - DNA, 16 bp, M. musculus
gaatgaagaatttcaa

SEQ ID NO: 404863 - DNA, 16 bp, M. musculus
gaatgaagacatagaa

SEQ ID NO: 404864 - DNA, 16 bp, M. musculus
gaatgaagatattcaa

SEQ ID NO: 404865 - DNA, 16 bp, M. musculus
gaatgacatggttcct

SEQ ID NO: 404866 - DNA, 16 bp, M. musculus
gaatgaccctttcaca

SEQ ID NO: 404867 - DNA, 16 bp, M. musculus
gaatgagaaaatatca

SEQ ID NO: 404868 - DNA, 16 bp, M. musculus
gaatgagaatggaccc

SEQ ID NO: 404869 - DNA, 16 bp, M. musculus
gaatgataattttgat

SEQ ID NO: 404870 - DNA, 16 bp, M. musculus
gaatgatcattttgat

SEQ ID NO: 404871 - DNA, 16 bp, M. musculus
gaatgcaatgtggaaa

SEQ ID NO: 404872 - DNA, 16 bp, M. musculus
gaatgcaggtcctctg

SEQ ID NO: 404873 - DNA, 16 bp, M. musculus
gaatgccagaagttct

SEQ ID NO: 404874 - DNA, 16 bp, M. musculus
gaatgccaggcaagca

SEQ ID NO: 404875 - DNA, 16 bp, M. musculus
gaatgccatatccagg

SEQ ID NO: 404876 - DNA, 16 bp, M. musculus
gaatgccctggaactg

SEQ ID NO: 404877 - DNA, 16 bp, M. musculus
gaatgcctctgcctcc

SEQ ID NO: 404878 - DNA, 16 bp, M. musculus
gaatgctgactgctct

SEQ ID NO: 404879 - DNA, 16 bp, M. musculus
gaatgctggaggcctg

SEQ ID NO: 404880 - DNA, 16 bp, M. musculus
gaatgctggtgctcag

SEQ ID NO: 404881 - DNA, 16 bp, M. musculus
gaatgcttgcctggca

SEQ ID NO: 404882 - DNA, 16 bp, M. musculus
gaatggaaaatgcaaa

SEQ ID NO: 404883 - DNA, 16 bp, M. musculus
gaatggaaatctgaag

SEQ ID NO: 404884 - DNA, 16 bp, M. musculus
gaatggaagggtccag

SEQ ID NO: 404885 - DNA, 16 bp, M. musculus
gaatggacagatggat

SEQ ID NO: 404886 - DNA, 16 bp, M. musculus
gaatggagcagaaact

SEQ ID NO: 404887 - DNA, 16 bp, M. musculus
gaatggagtcaaccag

SEQ ID NO: 404888 - DNA, 16 bp, M. musculus
gaatggataaacaaaa

SEQ ID NO: 404889 - DNA, 16 bp, M. musculus
gaatggatacagaaca

SEQ ID NO: 404890 - DNA, 16 bp, M. musculus
gaatggatagatggat

SEQ ID NO: 404891 - DNA, 16 bp, M. musculus
gaatggatcaattagc

SEQ ID NO: 404892 - DNA, 16 bp, M. musculus
gaatggatcattttgc

SEQ ID NO: 404893 - DNA, 16 bp, M. musculus
gaatggcagagaagga

SEQ ID NO: 404894 - DNA, 51 bp, M. musculus
gaatggcagcgttttgcacgttctgtagagacaccaatggaaaactggaat

SEQ ID NO: 404895 - DNA, 20 bp, M. musculus
gaatggccaactttcaatgt

SEQ ID NO: 404896 - DNA, 16 bp, M. musculus
gaatggctcccacagg

SEQ ID NO: 404897 - DNA, 16 bp, M. musculus
gaatggctgagaagca

SEQ ID NO: 404898 - DNA, 16 bp, M. musculus
gaatgggagttacaga

SEQ ID NO: 404899 - DNA, 16 bp, M. musculus
gaatggggaagaaaat

SEQ ID NO: 404900 - DNA, 16 bp, M. musculus
gaatggggcagaggaa

SEQ ID NO: 404901 - DNA, 16 bp, M. musculus
gaatggggccacccac

SEQ ID NO: 404902 - DNA, 16 bp, M. musculus
gaatggtaccacccac

SEQ ID NO: 404903 - DNA, 16 bp, M. musculus
gaatggtcaacataaa

SEQ ID NO: 404904 - DNA, 16 bp, M. musculus
gaatggtgccacccac

SEQ ID NO: 404905 - DNA, 16 bp, M. musculus
gaatggtgccacccat

SEQ ID NO: 404906 - DNA, 16 bp, M. musculus
gaatggtggcacatgc

SEQ ID NO: 404907 - DNA, 16 bp, M. musculus
gaatggttgagaagca

SEQ ID NO: 404908 - DNA, 16 bp, M. musculus
gaatggttgtgagcca

SEQ ID NO: 404909 - DNA, 16 bp, M. musculus
gaatgtaaatgaaata

SEQ ID NO: 404910 - DNA, 16 bp, M. musculus
gaatgtatgtctgtgt

SEQ ID NO: 404911 - DNA, 16 bp, M. musculus
gaatgtcaggaccagg

SEQ ID NO: 404912 - DNA, 16 bp, M. musculus
gaatgtccaagaagca

SEQ ID NO: 404913 - DNA, 16 bp, M. musculus
gaatgtggagaaaaag

SEQ ID NO: 404914 - DNA, 16 bp, M. musculus
gaatgtggagaaagaa

SEQ ID NO: 404915 - DNA, 16 bp, M. musculus
gaatgtggagaaaggg

SEQ ID NO: 404916 - DNA, 16 bp, M. musculus
gaatgtggggttagtg

SEQ ID NO: 404917 - DNA, 16 bp, M. musculus
gaatgtgggtgccctt

SEQ ID NO: 404918 - DNA, 17 bp, M. musculus
gaatgtgtgtggactct

SEQ ID NO: 404919 - DNA, 17 bp, M. musculus
gaatgtgtgtgtgtgtc

SEQ ID NO: 404920 - DNA, 16 bp, M. musculus
gaatgtgtgtttatgt

SEQ ID NO: 404921 - DNA, 16 bp, M. musculus
gaatgtgttttcatgc

SEQ ID NO: 404922 - DNA, 16 bp, M. musculus
gaatgttatggtttgt

SEQ ID NO: 404923 - DNA, 16 bp, M. musculus
gaatgttccaaggtct

SEQ ID NO: 404924 - DNA, 16 bp, M. musculus
gaatgttgttcagttt

SEQ ID NO: 404925 - DNA, 16 bp, M. musculus
gaatgtttacatgtat

SEQ ID NO: 404926 - DNA, 16 bp, M. musculus
gaatgtttccagcctc

SEQ ID NO: 404927 - DNA, 16 bp, M. musculus
gaatgtttggtcatta

SEQ ID NO: 404928 - DNA, 16 bp, M. musculus
gaatgttttgcttgat

SEQ ID NO: 404929 - DNA, 16 bp, M. musculus
gaatgttttgttaaag

SEQ ID NO: 404930 - DNA, 16 bp, M. musculus
gaatgtttttcagttt

SEQ ID NO: 404931 - DNA, 16 bp, M. musculus
gaattaaaacttcttt

SEQ ID NO: 404932 - DNA, 16 bp, M. musculus
gaattaaaggcatgca

SEQ ID NO: 404933 - DNA, 16 bp, M. musculus
gaattaaaggcatgta

SEQ ID NO: 404934 - DNA, 16 bp, M. musculus
gaattaaaggtgtatg

SEQ ID NO: 404935 - DNA, 16 bp, M. musculus
gaattaaataaagtca

SEQ ID NO: 404936 - DNA, 16 bp, M. musculus
gaattaacacacacac

SEQ ID NO: 404937 - DNA, 16 bp, M. musculus
gaattaacatcaaata

SEQ ID NO: 404938 - DNA, 16 bp, M. musculus
gaattaagaatctgtg

SEQ ID NO: 404939 - DNA, 16 bp, M. musculus
gaattaagaggtgtgg

SEQ ID NO: 404940 - DNA, 16 bp, M. musculus
gaattaatatttttga

SEQ ID NO: 404941 - DNA, 16 bp, M. musculus
gaattaatgaaattct

SEQ ID NO: 404942 - DNA, 16 bp, M. musculus
gaattacaaatattga

SEQ ID NO: 404943 - DNA, 16 bp, M. musculus
gaattacaggtggttg

SEQ ID NO: 404944 - DNA, 16 bp, M. musculus
gaattacaggtgtgta

SEQ ID NO: 404945 - DNA, 16 bp, M. musculus
gaattacatgaaaaca

SEQ ID NO: 404946 - DNA, 16 bp, M. musculus
gaattagaaatttgtc

SEQ ID NO: 404947 - DNA, 16 bp, M. musculus
gaattagggaaggttg

SEQ ID NO: 404948 - DNA, 16 bp, M. musculus
gaattatgctggtcta

SEQ ID NO: 404949 - DNA, 16 bp, M. musculus
gaattattttcatttt

SEQ ID NO: 404950 - DNA, 16 bp, M. musculus
gaattcaagaacacat

SEQ ID NO: 404951 - DNA, 16 bp, M. musculus
gaattcaagaagatgg

SEQ ID NO: 404952 - DNA, 16 bp, M. musculus
gaattcaagagatgga

SEQ ID NO: 404953 - DNA, 16 bp, M. musculus
gaattcaaggccagct

SEQ ID NO: 404954 - DNA, 16 bp, M. musculus
gaattcaaggccctta

SEQ ID NO: 404955 - DNA, 16 bp, M. musculus
gaattcaaggtcatct

SEQ ID NO: 404956 - DNA, 16 bp, M. musculus
gaattcacactgtaga

SEQ ID NO: 404957 - DNA, 16 bp, M. musculus
gaattcagatcccagc

SEQ ID NO: 404958 - DNA, 17 bp, M. musculus
gaattcatgaaattcct

SEQ ID NO: 404959 - DNA, 16 bp, M. musculus
gaattcattatgtagc

SEQ ID NO: 404960 - DNA, 16 bp, M. musculus
gaattccagaagattg

SEQ ID NO: 404961 - DNA, 16 bp, M. musculus
gaattccaggacagtc

SEQ ID NO: 404962 - DNA, 16 bp, M. musculus
gaattccaggccagtg

SEQ ID NO: 404963 - DNA, 16 bp, M. musculus
gaattccagggcagcc

SEQ ID NO: 404964 - DNA, 16 bp, M. musculus
gaattcctggacagcc

SEQ ID NO: 404965 - DNA, 16 bp, M. musculus
gaattctcaaaagaga

SEQ ID NO: 404966 - DNA, 16 bp, M. musculus
gaattctgcaataaac

SEQ ID NO: 404967 - DNA, 16 bp, M. musculus
gaattctgcagtaaaa

SEQ ID NO: 404968 - DNA, 16 bp, M. musculus
gaattctgcattaaaa

SEQ ID NO: 404969 - DNA, 16 bp, M. musculus
gaattctgcctgcctc

SEQ ID NO: 404970 - DNA, 16 bp, M. musculus
gaattctgtggaagag

SEQ ID NO: 404971 - DNA, 16 bp, M. musculus
gaattctgttttgttt

SEQ ID NO: 404972 - DNA, 16 bp, M. musculus
gaattctttacagaat

SEQ ID NO: 404973 - DNA, 16 bp, M. musculus
gaattctttgtttagc

SEQ ID NO: 404974 - DNA, 19 bp, M. musculus
gaattgaacccaggtcctc

SEQ ID NO: 404975 - DNA, 16 bp, M. musculus
gaattgaacctctgga

SEQ ID NO: 404976 - DNA, 16 bp, M. musculus
gaattgaactcaggat

SEQ ID NO: 404977 - DNA, 16 bp, M. musculus
gaattgaacttaggat

SEQ ID NO: 404978 - DNA, 16 bp, M. musculus
gaattgaagattcaga

SEQ ID NO: 404979 - DNA, 16 bp, M. musculus
gaattgaataaagtga

SEQ ID NO: 404980 - DNA, 16 bp, M. musculus
gaattgcccagttctt

SEQ ID NO: 404981 - DNA, 16 bp, M. musculus
gaattgctctgcttgg

SEQ ID NO: 404982 - DNA, 16 bp, M. musculus
gaattgctctggctaa

SEQ ID NO: 404983 - DNA, 26 bp, M. musculus
gaattggaaggctcaccagtgaccct

SEQ ID NO: 404984 - DNA, 16 bp, M. musculus
gaattggaattacaga

SEQ ID NO: 404985 - DNA, 16 bp, M. musculus
gaattgggaaagggga

SEQ ID NO: 404986 - DNA, 16 bp, M. musculus
gaattggttctcttct

SEQ ID NO: 404987 - DNA, 16 bp, M. musculus
gaattgtaaatatttt

SEQ ID NO: 404988 - DNA, 16 bp, M. musculus
gaattgtggccttgtt

SEQ ID NO: 404989 - DNA, 16 bp, M. musculus
gaattgtgtgtgtgtg

SEQ ID NO: 404990 - DNA, 16 bp, M. musculus
gaatttaaaacatttt

SEQ ID NO: 404991 - DNA, 16 bp, M. musculus
gaatttattatctcta

SEQ ID NO: 404992 - DNA, 16 bp, M. musculus
gaatttcaagtactgt

SEQ ID NO: 404993 - DNA, 16 bp, M. musculus
gaatttcagaacattg

SEQ ID NO: 404994 - DNA, 16 bp, M. musculus
gaatttcagataaaca

SEQ ID NO: 404995 - DNA, 16 bp, M. musculus
gaatttcaggcataga

SEQ ID NO: 404996 - DNA, 18 bp, M. musculus
gaatttcataaattcatt

SEQ ID NO: 404997 - DNA, 16 bp, M. musculus
gaatttcatatattca

SEQ ID NO: 404998 - DNA, 16 bp, M. musculus
gaatttcatgaagaca

SEQ ID NO: 404999 - DNA, 16 bp, M. musculus
gaatttcatttctttt

SEQ ID NO: 405000 - DNA, 16 bp, M. musculus
gaatttcctcagttga

SEQ ID NO: 405001 - DNA, 16 bp, M. musculus
gaatttctggttttgt

SEQ ID NO: 405002 - DNA, 16 bp, M. musculus
gaatttctgttgtttt

SEQ ID NO: 405003 - DNA, 16 bp, M. musculus
gaatttctttccattt

SEQ ID NO: 405004 - DNA, 16 bp, M. musculus
gaatttcttttctagt

SEQ ID NO: 405005 - DNA, 16 bp, M. musculus
gaatttgaaaccagcc

SEQ ID NO: 405006 - DNA, 16 bp, M. musculus
gaatttgaactccaga

SEQ ID NO: 405007 - DNA, 16 bp, M. musculus
gaatttgaagccagct

SEQ ID NO: 405008 - DNA, 16 bp, M. musculus
gaatttgaagtcagcc

SEQ ID NO: 405009 - DNA, 16 bp, M. musculus
gaatttgagagagaga

SEQ ID NO: 405010 - DNA, 16 bp, M. musculus
gaatttgcaaatttct

SEQ ID NO: 405011 - DNA, 16 bp, M. musculus
gaatttgcttttgttt

SEQ ID NO: 405012 - DNA, 16 bp, M. musculus
gaatttggaaaacaaa

SEQ ID NO: 405013 - DNA, 16 bp, M. musculus
gaatttggggtccaag

SEQ ID NO: 405014 - DNA, 17 bp, M. musculus
gaatttgtacaatcaca

SEQ ID NO: 405015 - DNA, 16 bp, M. musculus
gaatttgtagagtcca

SEQ ID NO: 405016 - DNA, 16 bp, M. musculus
gaattttagtttcttt

SEQ ID NO: 405017 - DNA, 16 bp, M. musculus
gaattttatcatgaag

SEQ ID NO: 405018 - DNA, 16 bp, M. musculus
gaattttccatttatt

SEQ ID NO: 405019 - DNA, 16 bp, M. musculus
gaattttctggtggaa

SEQ ID NO: 405020 - DNA, 16 bp, M. musculus
gaattttgatggtgat

SEQ ID NO: 405021 - DNA, 16 bp, M. musculus
gaattttgattggaat

SEQ ID NO: 405022 - DNA, 16 bp, M. musculus
gaattttggtttcttt

SEQ ID NO: 405023 - DNA, 16 bp, M. musculus
gaattttgtgcttcct

SEQ ID NO: 405024 - DNA, 16 bp, M. musculus
gaatttttaatcttag

SEQ ID NO: 405025 - DNA, 16 bp, M. musculus
gaatttttagatttaa

SEQ ID NO: 405026 - DNA, 16 bp, M. musculus
gaatttttgatcatag

SEQ ID NO: 405027 - DNA, 16 bp, M. musculus
gaattttttgacacaa

SEQ ID NO: 405028 - DNA, 16 bp, M. musculus
gaatttttttaaagat

SEQ ID NO: 405029 - DNA, 16 bp, M. musculus
gaatttttttcttaat

SEQ ID NO: 405030 - DNA, 16 bp, M. musculus
gacaaaaaagcaagtt

SEQ ID NO: 405031 - DNA, 16 bp, M. musculus
gacaaaaaggccacca

SEQ ID NO: 405032 - DNA, 16 bp, M. musculus
gacaaaaagtggaaca

SEQ ID NO: 405033 - DNA, 16 bp, M. musculus
gacaaaaatgaagcag

SEQ ID NO: 405034 - DNA, 16 bp, M. musculus
gacaaaaccaagttta

SEQ ID NO: 405035 - DNA, 16 bp, M. musculus
gacaaaaccacattta

SEQ ID NO: 405036 - DNA, 16 bp, M. musculus
gacaaaaccagattta

SEQ ID NO: 405037 - DNA, 33 bp, M. musculus
gacaaaacccaagagtgctggttgtgtctggta

SEQ ID NO: 405038 - DNA, 18 bp, M. musculus
gacaaaaggatggaccat

SEQ ID NO: 405039 - DNA, 16 bp, M. musculus
gacaaaatggagaaga

SEQ ID NO: 405040 - DNA, 16 bp, M. musculus
gacaaaatgtggagca

SEQ ID NO: 405041 - DNA, 16 bp, M. musculus
gacaaaattcagagct

SEQ ID NO: 405042 - DNA, 16 bp, M. musculus
gacaaaatttggaact

SEQ ID NO: 405043 - DNA, 16 bp, M. musculus
gacaaacacacaggca

SEQ ID NO: 405044 - DNA, 16 bp, M. musculus
gacaaacagactgaga

SEQ ID NO: 405045 - DNA, 16 bp, M. musculus
gacaaacagagagaca

SEQ ID NO: 405046 - DNA, 16 bp, M. musculus
gacaaacaggacaatt

SEQ ID NO: 405047 - DNA, 16 bp, M. musculus
gacaaactgaagcagc

SEQ ID NO: 405048 - DNA, 16 bp, M. musculus
gacaaagaatccaaaa

SEQ ID NO: 405049 - DNA, 16 bp, M. musculus
gacaaagacagagacc

SEQ ID NO: 405050 - DNA, 16 bp, M. musculus
gacaaagacagagact

SEQ ID NO: 405051 - DNA, 16 bp, M. musculus
gacaaagatagaacag

SEQ ID NO: 405052 - DNA, 16 bp, M. musculus
gacaaagggacagaga

SEQ ID NO: 405053 - DNA, 16 bp, M. musculus
gacaaagtacccaagg

SEQ ID NO: 405054 - DNA, 16 bp, M. musculus
gacaaagttcagaact

SEQ ID NO: 405055 - DNA, 16 bp, M. musculus
gacaaagttcagagta

SEQ ID NO: 405056 - DNA, 16 bp, M. musculus
gacaaagtttggagat

SEQ ID NO: 405057 - DNA, 16 bp, M. musculus
gacaaagtttggagca

SEQ ID NO: 405058 - DNA, 16 bp, M. musculus
gacaaagtttggggct

SEQ ID NO: 405059 - DNA, 16 bp, M. musculus
gacaaatacagagata

SEQ ID NO: 405060 - DNA, 16 bp, M. musculus
gacaaatagatgactt

SEQ ID NO: 405061 - DNA, 16 bp, M. musculus
gacaaatgggaccaca

SEQ ID NO: 405062 - DNA, 16 bp, M. musculus
gacaaattgtggagca

SEQ ID NO: 405063 - DNA, 16 bp, M. musculus
gacaacaaagggagat

SEQ ID NO: 405064 - DNA, 16 bp, M. musculus
gacaacaaatggaggt

SEQ ID NO: 405065 - DNA, 16 bp, M. musculus
gacaacagacagacag

SEQ ID NO: 405066 - DNA, 16 bp, M. musculus
gacaacagcagcagca

SEQ ID NO: 405067 - DNA, 16 bp, M. musculus
gacaacagcagctcct

SEQ ID NO: 405068 - DNA, 16 bp, M. musculus
gacaacatgaagctca

SEQ ID NO: 405069 - DNA, 16 bp, M. musculus
gacaacattgcataca

SEQ ID NO: 405070 - DNA, 16 bp, M. musculus
gacaacatttggagct

SEQ ID NO: 405071 - DNA, 16 bp, M. musculus
gacaaccaagaacagc

SEQ ID NO: 405072 - DNA, 16 bp, M. musculus
gacaaccaagaagagc

SEQ ID NO: 405073 - DNA, 16 bp, M. musculus
gacaaccacagctgct

SEQ ID NO: 405074 - DNA, 17 bp, M. musculus
gacaaccagccaccttc

SEQ ID NO: 405075 - DNA, 16 bp, M. musculus
gacaaccagggccaca

SEQ ID NO: 405076 - DNA, 16 bp, M. musculus
gacaacgtgtggagca

SEQ ID NO: 405077 - DNA, 16 bp, M. musculus
gacaacttccaggagt

SEQ ID NO: 405078 - DNA, 16 bp, M. musculus
gacaactttgtgcagt

SEQ ID NO: 405079 - DNA, 16 bp, M. musculus
gacaacttttaggagt

SEQ ID NO: 405080 - DNA, 16 bp, M. musculus
gacaacttttgggagt

SEQ ID NO: 405081 - DNA, 16 bp, M. musculus
gacaagaaaaggctgc

SEQ ID NO: 405082 - DNA, 16 bp, M. musculus
gacaagaacatcaagt

SEQ ID NO: 405083 - DNA, 16 bp, M. musculus
gacaagaatgaaggag

SEQ ID NO: 405084 - DNA, 16 bp, M. musculus
gacaagacacacacac

SEQ ID NO: 405085 - DNA, 16 bp, M. musculus
gacaagaccatcctct

SEQ ID NO: 405086 - DNA, 16 bp, M. musculus
gacaagagaaaacatt

SEQ ID NO: 405087 - DNA, 16 bp, M. musculus
gacaagagagacagag

SEQ ID NO: 405088 - DNA, 16 bp, M. musculus
gacaagatctatgcat

SEQ ID NO: 405089 - DNA, 16 bp, M. musculus
gacaagcactgagcat

SEQ ID NO: 405090 - DNA, 16 bp, M. musculus
gacaagcactgtacca

SEQ ID NO: 405091 - DNA, 16 bp, M. musculus
gacaagcatgctgatc

SEQ ID NO: 405092 - DNA, 16 bp, M. musculus
gacaagcccagagtcc

SEQ ID NO: 405093 - DNA, 16 bp, M. musculus
gacaagctccagccag

SEQ ID NO: 405094 - DNA, 16 bp, M. musculus
gacaaggaagtggaga

SEQ ID NO: 405095 - DNA, 16 bp, M. musculus
gacaaggacaaggaca

SEQ ID NO: 405096 - DNA, 16 bp, M. musculus
gacaaggatgctcact

SEQ ID NO: 405097 - DNA, 16 bp, M. musculus
gacaaggatttttgcc

SEQ ID NO: 405098 - DNA, 16 bp, M. musculus
gacaaggctgcctact

SEQ ID NO: 405099 - DNA, 16 bp, M. musculus
gacaagggagctgaaa

SEQ ID NO: 405100 - DNA, 16 bp, M. musculus
gacaaggggcagcctc

SEQ ID NO: 405101 - DNA, 16 bp, M. musculus
gacaagggtgcccact

SEQ ID NO: 405102 - DNA, 16 bp, M. musculus
gacaaggtctccctat

SEQ ID NO: 405103 - DNA, 16 bp, M. musculus
gacaaggttgtgattg

SEQ ID NO: 405104 - DNA, 16 bp, M. musculus
gacaatatcatcctga

SEQ ID NO: 405105 - DNA, 72 bp, M. musculus
gacaatcaaggagactttgaccaaattaacgcttgcaactggcactagagactgggtactcctacttccctt

SEQ ID NO: 405106 - DNA, 16 bp, M. musculus
gacaatcctcctgcct

SEQ ID NO: 405107 - DNA, 16 bp, M. musculus
gacaatgtgcagagag

SEQ ID NO: 405108 - DNA, 16 bp, M. musculus
gacaattaaaactaac

SEQ ID NO: 405109 - DNA, 16 bp, M. musculus
gacaattaaagctaac

SEQ ID NO: 405110 - DNA, 16 bp, M. musculus
gacaattgatactggt

SEQ ID NO: 405111 - DNA, 16 bp, M. musculus
gacaattttttttctt

SEQ ID NO: 405112 - DNA, 16 bp, M. musculus
gacacaaaaccagcca

SEQ ID NO: 405113 - DNA, 16 bp, M. musculus
gacacacaaacacatc

SEQ ID NO: 405114 - DNA, 17 bp, M. musculus
gacacacacacatatat

SEQ ID NO: 405115 - DNA, 16 bp, M. musculus
gacacacacaggagag

SEQ ID NO: 405116 - DNA, 16 bp, M. musculus
gacacacacatacata

SEQ ID NO: 405117 - DNA, 16 bp, M. musculus
gacacacacatgcaca

SEQ ID NO: 405118 - DNA, 16 bp, M. musculus
gacacacactacacac

SEQ ID NO: 405119 - DNA, 16 bp, M. musculus
gacacacagacacaga

SEQ ID NO: 405120 - DNA, 16 bp, M. musculus
gacacacagacaccca

SEQ ID NO: 405121 - DNA, 16 bp, M. musculus
gacacacagatgcaca

SEQ ID NO: 405122 - DNA, 16 bp, M. musculus
gacacacaggcttaca

SEQ ID NO: 405123 - DNA, 16 bp, M. musculus
gacacacatacacaca

SEQ ID NO: 405124 - DNA, 16 bp, M. musculus
gacacacatagagaga

SEQ ID NO: 405125 - DNA, 16 bp, M. musculus
gacacacatagataca

SEQ ID NO: 405126 - DNA, 16 bp, M. musculus
gacacacatggacaga

SEQ ID NO: 405127 - DNA, 16 bp, M. musculus
gacacaccagaaggag

SEQ ID NO: 405128 - DNA, 16 bp, M. musculus
gacacaccagagaagg

SEQ ID NO: 405129 - DNA, 16 bp, M. musculus
gacacacctaagatca

SEQ ID NO: 405130 - DNA, 16 bp, M. musculus
gacacacctattccaa

SEQ ID NO: 405131 - DNA, 16 bp, M. musculus
gacacacctccaacaa

SEQ ID NO: 405132 - DNA, 16 bp, M. musculus
gacacactgaaactaa

SEQ ID NO: 405133 - DNA, 16 bp, M. musculus
gacacactgcagcttc

SEQ ID NO: 405134 - DNA, 16 bp, M. musculus
gacacacttattccaa

SEQ ID NO: 405135 - DNA, 16 bp, M. musculus
gacacactttcttcaa

SEQ ID NO: 405136 - DNA, 16 bp, M. musculus
gacacagaagccatgg

SEQ ID NO: 405137 - DNA, 16 bp, M. musculus
gacacagacaatgcca

SEQ ID NO: 405138 - DNA, 16 bp, M. musculus
gacacagacactgtac

SEQ ID NO: 405139 - DNA, 16 bp, M. musculus
gacacagagaaagaca

SEQ ID NO: 405140 - DNA, 16 bp, M. musculus
gacacagagacagaaa

SEQ ID NO: 405141 - DNA, 16 bp, M. musculus
gacacagagagagtgc

SEQ ID NO: 405142 - DNA, 16 bp, M. musculus
gacacagagaggaaga

SEQ ID NO: 405143 - DNA, 16 bp, M. musculus
gacacagaggcaggaa

SEQ ID NO: 405144 - DNA, 16 bp, M. musculus
gacacagaggcaggag

SEQ ID NO: 405145 - DNA, 16 bp, M. musculus
gacacagaggcaggca

SEQ ID NO: 405146 - DNA, 16 bp, M. musculus
gacacagatatttaca

SEQ ID NO: 405147 - DNA, 16 bp, M. musculus
gacacagcaggacagg

SEQ ID NO: 405148 - DNA, 16 bp, M. musculus
gacacagctctggagg

SEQ ID NO: 405149 - DNA, 16 bp, M. musculus
gacacaggacttggag

SEQ ID NO: 405150 - DNA, 16 bp, M. musculus
gacacaggaggagctg

SEQ ID NO: 405151 - DNA, 16 bp, M. musculus
gacacaggcaggcaga

SEQ ID NO: 405152 - DNA, 16 bp, M. musculus
gacacaggctggggtt

SEQ ID NO: 405153 - DNA, 17 bp, M. musculus
gacacagggcaggagag

SEQ ID NO: 405154 - DNA, 16 bp, M. musculus
gacacagggcccagag

SEQ ID NO: 405155 - DNA, 16 bp, M. musculus
gacacaggggaaaatt

SEQ ID NO: 405156 - DNA, 16 bp, M. musculus
gacacaggtgtgaaag

SEQ ID NO: 405157 - DNA, 16 bp, M. musculus
gacacagtctcctgct

SEQ ID NO: 405158 - DNA, 16 bp, M. musculus
gacacagtgaaactaa

SEQ ID NO: 405159 - DNA, 16 bp, M. musculus
gacacagtgctggaga

SEQ ID NO: 405160 - DNA, 16 bp, M. musculus
gacacagtgtgaccag

SEQ ID NO: 405161 - DNA, 16 bp, M. musculus
gacacatacacagaca

SEQ ID NO: 405162 - DNA, 17 bp, M. musculus
gacacatgcacacacat

SEQ ID NO: 405163 - DNA, 16 bp, M. musculus
gacacatgcctttgat

SEQ ID NO: 405164 - DNA, 16 bp, M. musculus
gacacatggctgaagc

SEQ ID NO: 405165 - DNA, 16 bp, M. musculus
gacacatgtcagacac

SEQ ID NO: 405166 - DNA, 16 bp, M. musculus
gacacatttaaaaaaa

SEQ ID NO: 405167 - DNA, 16 bp, M. musculus
gacacatttttttttt

SEQ ID NO: 405168 - DNA, 16 bp, M. musculus
gacaccacaacaggat

SEQ ID NO: 405169 - DNA, 16 bp, M. musculus
gacaccagcctggtct

SEQ ID NO: 405170 - DNA, 16 bp, M. musculus
gacaccaggaccaagg

SEQ ID NO: 405171 - DNA, 16 bp, M. musculus
gacaccatcaacaaga

SEQ ID NO: 405172 - DNA, 16 bp, M. musculus
gacaccatgaattttg

SEQ ID NO: 405173 - DNA, 16 bp, M. musculus
gacaccatgacaaagg

SEQ ID NO: 405174 - DNA, 16 bp, M. musculus
gacaccatgatcatgg

SEQ ID NO: 405175 - DNA, 16 bp, M. musculus
gacaccatggccatgg

SEQ ID NO: 405176 - DNA, 16 bp, M. musculus
gacaccattgcatatg

SEQ ID NO: 405177 - DNA, 16 bp, M. musculus
gacaccattgcttaca

SEQ ID NO: 405178 - DNA, 16 bp, M. musculus
gacacccaaaggtttt

SEQ ID NO: 405179 - DNA, 16 bp, M. musculus
gacacccacagccaaa

SEQ ID NO: 405180 - DNA, 16 bp, M. musculus
gacaccccagaagaga

SEQ ID NO: 405181 - DNA, 16 bp, M. musculus
gacacccccaaggacc

SEQ ID NO: 405182 - DNA, 16 bp, M. musculus
gacacccccaagggcc

SEQ ID NO: 405183 - DNA, 16 bp, M. musculus
gacaccctcaagggcc

SEQ ID NO: 405184 - DNA, 16 bp, M. musculus
gacaccctcacagaca

SEQ ID NO: 405185 - DNA, 16 bp, M. musculus
gacaccctctcctggt

SEQ ID NO: 405186 - DNA, 16 bp, M. musculus
gacacccttcacagta

SEQ ID NO: 405187 - DNA, 16 bp, M. musculus
gacacccttcctccaa

SEQ ID NO: 405188 - DNA, 16 bp, M. musculus
gacacctatcctctgg

SEQ ID NO: 405189 - DNA, 16 bp, M. musculus
gacacctgccctgcaa

SEQ ID NO: 405190 - DNA, 16 bp, M. musculus
gacaccttcatgcctt

SEQ ID NO: 405191 - DNA, 16 bp, M. musculus
gacacctttaatccta

SEQ ID NO: 405192 - DNA, 16 bp, M. musculus
gacacctttagctcct

SEQ ID NO: 405193 - DNA, 16 bp, M. musculus
gacacgagtggacctg

SEQ ID NO: 405194 - DNA, 47 bp, M. musculus
gacacgtccgaggcgaaggagaatgctccttaagagggacggggttt

SEQ ID NO: 405195 - DNA, 16 bp, M. musculus
gacactagtgcatatg

SEQ ID NO: 405196 - DNA, 16 bp, M. musculus
gacactatgaatgata

SEQ ID NO: 405197 - DNA, 16 bp, M. musculus
gacactattacatatg

SEQ ID NO: 405198 - DNA, 16 bp, M. musculus
gacactcaaaaccagc

SEQ ID NO: 405199 - DNA, 16 bp, M. musculus
gacactgaaggaatga

SEQ ID NO: 405200 - DNA, 16 bp, M. musculus
gacactgagcaagaga

SEQ ID NO: 405201 - DNA, 16 bp, M. musculus
gacactgaggaaatcc

SEQ ID NO: 405202 - DNA, 16 bp, M. musculus
gacactgccaataaga

SEQ ID NO: 405203 - DNA, 16 bp, M. musculus
gacactgcctggcctg

SEQ ID NO: 405204 - DNA, 17 bp, M. musculus
gacactgcctggcctgg

SEQ ID NO: 405205 - DNA, 16 bp, M. musculus
gacactgctggcttct

SEQ ID NO: 405206 - DNA, 16 bp, M. musculus
gacactggagagatgg

SEQ ID NO: 405207 - DNA, 16 bp, M. musculus
gacactggagttacca

SEQ ID NO: 405208 - DNA, 16 bp, M. musculus
gacactggcaaagcct

SEQ ID NO: 405209 - DNA, 16 bp, M. musculus
gacactgtcaagagga

SEQ ID NO: 405210 - DNA, 16 bp, M. musculus
gacactgtctccaaaa

SEQ ID NO: 405211 - DNA, 16 bp, M. musculus
gacactgtgaataaga

SEQ ID NO: 405212 - DNA, 16 bp, M. musculus
gacactgtgctcagtc

SEQ ID NO: 405213 - DNA, 16 bp, M. musculus
gacactgtggtctgga

SEQ ID NO: 405214 - DNA, 16 bp, M. musculus
gacactgtgttgcttt

SEQ ID NO: 405215 - DNA, 16 bp, M. musculus
gacacttgccaccaaa

SEQ ID NO: 405216 - DNA, 16 bp, M. musculus
gacacttgtgactttg

SEQ ID NO: 405217 - DNA, 16 bp, M. musculus
gacactttgacccttc

SEQ ID NO: 405218 - DNA, 16 bp, M. musculus
gacagaaaaactggta

SEQ ID NO: 405219 - DNA, 16 bp, M. musculus
gacagaaagaccagct

SEQ ID NO: 405220 - DNA, 16 bp, M. musculus
gacagaaagggagtgg

SEQ ID NO: 405221 - DNA, 16 bp, M. musculus
gacagaagaagctgac

SEQ ID NO: 405222 - DNA, 16 bp, M. musculus
gacagaagacagagag

SEQ ID NO: 405223 - DNA, 16 bp, M. musculus
gacagaagagaagccc

SEQ ID NO: 405224 - DNA, 16 bp, M. musculus
gacagaagagggcatc

SEQ ID NO: 405225 - DNA, 16 bp, M. musculus
gacagaagcagctgac

SEQ ID NO: 405226 - DNA, 16 bp, M. musculus
gacagaagccagagac

SEQ ID NO: 405227 - DNA, 16 bp, M. musculus
gacagaagcctggcat

SEQ ID NO: 405228 - DNA, 16 bp, M. musculus
gacagaagctggaaag

SEQ ID NO: 405229 - DNA, 16 bp, M. musculus
gacagaaggaaaatgg

SEQ ID NO: 405230 - DNA, 16 bp, M. musculus
gacagaaggacagaga

SEQ ID NO: 405231 - DNA, 16 bp, M. musculus
gacagaatgagaagac

SEQ ID NO: 405232 - DNA, 16 bp, M. musculus
gacagaatttgagtat

SEQ ID NO: 405233 - DNA, 16 bp, M. musculus
gacagacaaataaata

SEQ ID NO: 405234 - DNA, 16 bp, M. musculus
gacagacacacagagg

SEQ ID NO: 405235 - DNA, 16 bp, M. musculus
gacagacacagaaaca

SEQ ID NO: 405236 - DNA, 16 bp, M. musculus
gacagacacagagaca

SEQ ID NO: 405237 - DNA, 16 bp, M. musculus
gacagacacagagaga

SEQ ID NO: 405238 - DNA, 16 bp, M. musculus
gacagacactgcctca

SEQ ID NO: 405239 - DNA, 16 bp, M. musculus
gacagacagaaggcag

SEQ ID NO: 405240 - DNA, 16 bp, M. musculus
gacagacagacaagaa

SEQ ID NO: 405241 - DNA, 16 bp, M. musculus
gacagacagacaagga

SEQ ID NO: 405242 - DNA, 16 bp, M. musculus
gacagacagacaccaa

SEQ ID NO: 405243 - DNA, 16 bp, M. musculus
gacagacagacagacc

SEQ ID NO: 405244 - DNA, 16 bp, M. musculus
gacagacagacccaga

SEQ ID NO: 405245 - DNA, 16 bp, M. musculus
gacagacagacggaca

SEQ ID NO: 405246 - DNA, 16 bp, M. musculus
gacagacagacggacg

SEQ ID NO: 405247 - DNA, 16 bp, M. musculus
gacagacagactcaga

SEQ ID NO: 405248 - DNA, 16 bp, M. musculus
gacagacagagagacc

SEQ ID NO: 405249 - DNA, 16 bp, M. musculus
gacagacagataaaat

SEQ ID NO: 405250 - DNA, 16 bp, M. musculus
gacagacagatccctg

SEQ ID NO: 405251 - DNA, 16 bp, M. musculus
gacagacagcagacag

SEQ ID NO: 405252 - DNA, 16 bp, M. musculus
gacagacagcagcatg

SEQ ID NO: 405253 - DNA, 16 bp, M. musculus
gacagacagcagtggt

SEQ ID NO: 405254 - DNA, 16 bp, M. musculus
gacagacaggcagaaa

SEQ ID NO: 405255 - DNA, 16 bp, M. musculus
gacagacagggacaga

SEQ ID NO: 405256 - DNA, 16 bp, M. musculus
gacagacagggagaga

SEQ ID NO: 405257 - DNA, 16 bp, M. musculus
gacagacagggataca

SEQ ID NO: 405258 - DNA, 16 bp, M. musculus
gacagacagggctaca

SEQ ID NO: 405259 - DNA, 16 bp, M. musculus
gacagacatgcaggca

SEQ ID NO: 405260 - DNA, 16 bp, M. musculus
gacagacggatggatg

SEQ ID NO: 405261 - DNA, 16 bp, M. musculus
gacagactcacacaga

SEQ ID NO: 405262 - DNA, 16 bp, M. musculus
gacagactctgtctca

SEQ ID NO: 405263 - DNA, 16 bp, M. musculus
gacagactgatagaca

SEQ ID NO: 405264 - DNA, 16 bp, M. musculus
gacagagaaacagaca

SEQ ID NO: 405265 - DNA, 16 bp, M. musculus
gacagagaaggacaga

SEQ ID NO: 405266 - DNA, 16 bp, M. musculus
gacagagaaggagaca

SEQ ID NO: 405267 - DNA, 16 bp, M. musculus
gacagagacaaagagg

SEQ ID NO: 405268 - DNA, 16 bp, M. musculus
gacagagacaagacag

SEQ ID NO: 405269 - DNA, 16 bp, M. musculus
gacagagacactgaga

SEQ ID NO: 405270 - DNA, 16 bp, M. musculus
gacagagacagacaca

SEQ ID NO: 405271 - DNA, 16 bp, M. musculus
gacagagacagagaag

SEQ ID NO: 405272 - DNA, 16 bp, M. musculus
gacagagacagagata

SEQ ID NO: 405273 - DNA, 16 bp, M. musculus
gacagagacaggagga

SEQ ID NO: 405274 - DNA, 16 bp, M. musculus
gacagagacatagaca

SEQ ID NO: 405275 - DNA, 16 bp, M. musculus
gacagagactcccaaa

SEQ ID NO: 405276 - DNA, 16 bp, M. musculus
gacagagagaactctg

SEQ ID NO: 405277 - DNA, 16 bp, M. musculus
gacagagagaccaaga

SEQ ID NO: 405278 - DNA, 16 bp, M. musculus
gacagagagagaagca

SEQ ID NO: 405279 - DNA, 16 bp, M. musculus
gacagagagagagaat

SEQ ID NO: 405280 - DNA, 16 bp, M. musculus
gacagagagagtcaga

SEQ ID NO: 405281 - DNA, 16 bp, M. musculus
gacagagagagtgaga

SEQ ID NO: 405282 - DNA, 16 bp, M. musculus
gacagagaggaacaga

SEQ ID NO: 405283 - DNA, 16 bp, M. musculus
gacagagaggaagaca

SEQ ID NO: 405284 - DNA, 16 bp, M. musculus
gacagagaggcagaaa

SEQ ID NO: 405285 - DNA, 16 bp, M. musculus
gacagagatacagaga

SEQ ID NO: 405286 - DNA, 16 bp, M. musculus
gacagagatagacaga

SEQ ID NO: 405287 - DNA, 16 bp, M. musculus
gacagagatggaaaga

SEQ ID NO: 405288 - DNA, 16 bp, M. musculus
gacagagatggagagg

SEQ ID NO: 405289 - DNA, 16 bp, M. musculus
gacagagcagagactg

SEQ ID NO: 405290 - DNA, 16 bp, M. musculus
gacagagctggagaag

SEQ ID NO: 405291 - DNA, 16 bp, M. musculus
gacagaggcagaagaa

SEQ ID NO: 405292 - DNA, 16 bp, M. musculus
gacagaggcagcaggg

SEQ ID NO: 405293 - DNA, 16 bp, M. musculus
gacagagggacagaag

SEQ ID NO: 405294 - DNA, 16 bp, M. musculus
gacagagtcagacaga

SEQ ID NO: 405295 - DNA, 16 bp, M. musculus
gacagagtcagagtca

SEQ ID NO: 405296 - DNA, 16 bp, M. musculus
gacagagtctctctgt

SEQ ID NO: 405297 - DNA, 16 bp, M. musculus
gacagatactggaaac

SEQ ID NO: 405298 - DNA, 16 bp, M. musculus
gacagatcacaccagg

SEQ ID NO: 405299 - DNA, 16 bp, M. musculus
gacagatcacagaaac

SEQ ID NO: 405300 - DNA, 16 bp, M. musculus
gacagatcctggaaac

SEQ ID NO: 405301 - DNA, 16 bp, M. musculus
gacagatgcacaccca

SEQ ID NO: 405302 - DNA, 16 bp, M. musculus
gacagatggacagaca

SEQ ID NO: 405303 - DNA, 16 bp, M. musculus
gacagatggacagagg

SEQ ID NO: 405304 - DNA, 16 bp, M. musculus
gacagatggacagatg

SEQ ID NO: 405305 - DNA, 16 bp, M. musculus
gacagatggacggatg

SEQ ID NO: 405306 - DNA, 16 bp, M. musculus
gacagatggataaaga

SEQ ID NO: 405307 - DNA, 16 bp, M. musculus
gacagatggatctctg

SEQ ID NO: 405308 - DNA, 16 bp, M. musculus
gacagatgtcatccag

SEQ ID NO: 405309 - DNA, 16 bp, M. musculus
gacagattaaggaact

SEQ ID NO: 405310 - DNA, 16 bp, M. musculus
gacagattctggaaac

SEQ ID NO: 405311 - DNA, 16 bp, M. musculus
gacagattgtggaaac

SEQ ID NO: 405312 - DNA, 16 bp, M. musculus
gacagatttttttaaa

SEQ ID NO: 405313 - DNA, 16 bp, M. musculus
gacagcaacagtgtat

SEQ ID NO: 405314 - DNA, 16 bp, M. musculus
gacagcaaggccagct

SEQ ID NO: 405315 - DNA, 16 bp, M. musculus
gacagcacagtggagg

SEQ ID NO: 405316 - DNA, 16 bp, M. musculus
gacagcagagatggag

SEQ ID NO: 405317 - DNA, 16 bp, M. musculus
gacagcagaggctggc

SEQ ID NO: 405318 - DNA, 16 bp, M. musculus
gacagcagatgctgga

SEQ ID NO: 405319 - DNA, 16 bp, M. musculus
gacagcagcagcagtg

SEQ ID NO: 405320 - DNA, 16 bp, M. musculus
gacagcaggaagcagc

SEQ ID NO: 405321 - DNA, 16 bp, M. musculus
gacagcaggcagcagg

SEQ ID NO: 405322 - DNA, 16 bp, M. musculus
gacagcagtatggtgg

SEQ ID NO: 405323 - DNA, 16 bp, M. musculus
gacagcatggtctaca

SEQ ID NO: 405324 - DNA, 16 bp, M. musculus
gacagcattatggaag

SEQ ID NO: 405325 - DNA, 16 bp, M. musculus
gacagcattctgtctg

SEQ ID NO: 405326 - DNA, 16 bp, M. musculus
gacagccaaatttcag

SEQ ID NO: 405327 - DNA, 16 bp, M. musculus
gacagccaagactaca

SEQ ID NO: 405328 - DNA, 16 bp, M. musculus
gacagccaaggcaaca

SEQ ID NO: 405329 - DNA, 16 bp, M. musculus
gacagccaaggctatg

SEQ ID NO: 405330 - DNA, 16 bp, M. musculus
gacagccacattcatt

SEQ ID NO: 405331 - DNA, 16 bp, M. musculus
gacagccagacagcca

SEQ ID NO: 405332 - DNA, 16 bp, M. musculus
gacagccagagataca

SEQ ID NO: 405333 - DNA, 16 bp, M. musculus
gacagccagcagggct

SEQ ID NO: 405334 - DNA, 16 bp, M. musculus
gacagccagcgctaca

SEQ ID NO: 405335 - DNA, 16 bp, M. musculus
gacagccagggcaaca

SEQ ID NO: 405336 - DNA, 16 bp, M. musculus
gacagccagggctctg

SEQ ID NO: 405337 - DNA, 16 bp, M. musculus
gacagccagggcttca

SEQ ID NO: 405338 - DNA, 16 bp, M. musculus
gacagccattctaggc

SEQ ID NO: 405339 - DNA, 16 bp, M. musculus
gacagccatttttact

SEQ ID NO: 405340 - DNA, 16 bp, M. musculus
gacagccggccaccat

SEQ ID NO: 405341 - DNA, 16 bp, M. musculus
gacagcctggactaca

SEQ ID NO: 405342 - DNA, 16 bp, M. musculus
gacagcctgggccaca

SEQ ID NO: 405343 - DNA, 16 bp, M. musculus
gacagcctggtctact

SEQ ID NO: 405344 - DNA, 16 bp, M. musculus
gacagctagagctaca

SEQ ID NO: 405345 - DNA, 16 bp, M. musculus
gacagctcacaaccat

SEQ ID NO: 405346 - DNA, 16 bp, M. musculus
gacagctcacaactgt

SEQ ID NO: 405347 - DNA, 16 bp, M. musculus
gacagctctctctgct

SEQ ID NO: 405348 - DNA, 16 bp, M. musculus
gacagctgacaaattt

SEQ ID NO: 405349 - DNA, 16 bp, M. musculus
gacagctgggcatggt

SEQ ID NO: 405350 - DNA, 16 bp, M. musculus
gacagctgtgagctgt

SEQ ID NO: 405351 - DNA, 16 bp, M. musculus
gacagcttctggaaga

SEQ ID NO: 405352 - DNA, 16 bp, M. musculus
gacaggaaccaagtgt

SEQ ID NO: 405353 - DNA, 16 bp, M. musculus
gacaggaacctggtgt

SEQ ID NO: 405354 - DNA, 16 bp, M. musculus
gacaggaagaattctg

SEQ ID NO: 405355 - DNA, 16 bp, M. musculus
gacaggaagattgctg

SEQ ID NO: 405356 - DNA, 16 bp, M. musculus
gacaggaagcaggagt

SEQ ID NO: 405357 - DNA, 16 bp, M. musculus
gacaggaatctgacat

SEQ ID NO: 405358 - DNA, 16 bp, M. musculus
gacaggacaggacagg

SEQ ID NO: 405359 - DNA, 16 bp, M. musculus
gacaggaccagctgct

SEQ ID NO: 405360 - DNA, 16 bp, M. musculus
gacaggagacagagaa

SEQ ID NO: 405361 - DNA, 16 bp, M. musculus
gacaggagacaggaga

SEQ ID NO: 405362 - DNA, 16 bp, M. musculus
gacaggagccagggac

SEQ ID NO: 405363 - DNA, 16 bp, M. musculus
gacaggagcctgacat

SEQ ID NO: 405364 - DNA, 16 bp, M. musculus
gacaggagcctggtac

SEQ ID NO: 405365 - DNA, 16 bp, M. musculus
gacaggagcctggtgt

SEQ ID NO: 405366 - DNA, 16 bp, M. musculus
gacaggaggaattctg

SEQ ID NO: 405367 - DNA, 16 bp, M. musculus
gacaggaggacccctg

SEQ ID NO: 405368 - DNA, 16 bp, M. musculus
gacaggaggatcacta

SEQ ID NO: 405369 - DNA, 16 bp, M. musculus
gacaggaggattacaa

SEQ ID NO: 405370 - DNA, 16 bp, M. musculus
gacaggaggccggaga

SEQ ID NO: 405371 - DNA, 16 bp, M. musculus
gacaggaggctccctg

SEQ ID NO: 405372 - DNA, 16 bp, M. musculus
gacaggaggctggaga

SEQ ID NO: 405373 - DNA, 16 bp, M. musculus
gacaggagggtccctg

SEQ ID NO: 405374 - DNA, 16 bp, M. musculus
gacaggatctcactgt

SEQ ID NO: 405375 - DNA, 16 bp, M. musculus
gacaggatctcatgta

SEQ ID NO: 405376 - DNA, 16 bp, M. musculus
gacaggatctcctgta

SEQ ID NO: 405377 - DNA, 16 bp, M. musculus
gacaggatctctctct

SEQ ID NO: 405378 - DNA, 16 bp, M. musculus
gacaggatctctctgt

SEQ ID NO: 405379 - DNA, 16 bp, M. musculus
gacaggatttctctct

SEQ ID NO: 405380 - DNA, 16 bp, M. musculus
gacaggatttttctgt

SEQ ID NO: 405381 - DNA, 16 bp, M. musculus
gacaggcagacagata

SEQ ID NO: 405382 - DNA, 16 bp, M. musculus
gacaggcaggcagaga

SEQ ID NO: 405383 - DNA, 16 bp, M. musculus
gacaggctccagacag

SEQ ID NO: 405384 - DNA, 16 bp, M. musculus
gacaggcttcctttag

SEQ ID NO: 405385 - DNA, 16 bp, M. musculus
gacaggctttgaggtt

SEQ ID NO: 405386 - DNA, 16 bp, M. musculus
gacagggaaggcatgg

SEQ ID NO: 405387 - DNA, 16 bp, M. musculus
gacagggaagtaggag

SEQ ID NO: 405388 - DNA, 16 bp, M. musculus
gacagggacagagaca

SEQ ID NO: 405389 - DNA, 16 bp, M. musculus
gacagggacagagaga

SEQ ID NO: 405390 - DNA, 16 bp, M. musculus
gacagggacagggaga

SEQ ID NO: 405391 - DNA, 16 bp, M. musculus
gacagggagatggaga

SEQ ID NO: 405392 - DNA, 16 bp, M. musculus
gacagggaggtgggag

SEQ ID NO: 405393 - DNA, 16 bp, M. musculus
gacagggccaatggca

SEQ ID NO: 405394 - DNA, 16 bp, M. musculus
gacagggcctggagag

SEQ ID NO: 405395 - DNA, 16 bp, M. musculus
gacagggctgcccact

SEQ ID NO: 405396 - DNA, 16 bp, M. musculus
gacagggtctcaatgt

SEQ ID NO: 405397 - DNA, 16 bp, M. musculus
gacagggtctcactac

SEQ ID NO: 405398 - DNA, 16 bp, M. musculus
gacagggtctcattgt

SEQ ID NO: 405399 - DNA, 16 bp, M. musculus
gacagggtctttctat

SEQ ID NO: 405400 - DNA, 16 bp, M. musculus
gacagggttctctgtg

SEQ ID NO: 405401 - DNA, 16 bp, M. musculus
gacagggtttatctgt

SEQ ID NO: 405402 - DNA, 16 bp, M. musculus
gacagggtttctatgt

SEQ ID NO: 405403 - DNA, 66 bp, M. musculus
gacaggtccaagcgcgtggagttgacctgaagtctcaattcccgaaggatctgttcaaattcagcc

SEQ ID NO: 405404 - DNA, 16 bp, M. musculus
gacaggtgaaagaatg

SEQ ID NO: 405405 - DNA, 16 bp, M. musculus
gacaggtggatcaatg

SEQ ID NO: 405406 - DNA, 16 bp, M. musculus
gacagtaaagaacatc

SEQ ID NO: 405407 - DNA, 16 bp, M. musculus
gacagtacatcttcat

SEQ ID NO: 405408 - DNA, 16 bp, M. musculus
gacagtcccacagtcc

SEQ ID NO: 405409 - DNA, 16 bp, M. musculus
gacagtcccacggtcc

SEQ ID NO: 405410 - DNA, 16 bp, M. musculus
gacagtctgaagcagc

SEQ ID NO: 405411 - DNA, 16 bp, M. musculus
gacagtctgctcctgg

SEQ ID NO: 405412 - DNA, 16 bp, M. musculus
gacagtgacagagaca

SEQ ID NO: 405413 - DNA, 16 bp, M. musculus
gacagtgacagaggct

SEQ ID NO: 405414 - DNA, 16 bp, M. musculus
gacagtgagacagaca

SEQ ID NO: 405415 - DNA, 16 bp, M. musculus
gacagtgagagagaca

SEQ ID NO: 405416 - DNA, 16 bp, M. musculus
gacagtgaggcaggag

SEQ ID NO: 405417 - DNA, 16 bp, M. musculus
gacagtgatttttttt

SEQ ID NO: 405418 - DNA, 16 bp, M. musculus
gacagtggtggtggtg

SEQ ID NO: 405419 - DNA, 16 bp, M. musculus
gacagtgtactcacat

SEQ ID NO: 405420 - DNA, 16 bp, M. musculus
gacagtgtattcacat

SEQ ID NO: 405421 - DNA, 16 bp, M. musculus
gacagttctgctgtgc

SEQ ID NO: 405422 - DNA, 16 bp, M. musculus
gacagttgtgaactgt

SEQ ID NO: 405423 - DNA, 16 bp, M. musculus
gacagtttaaatttta

SEQ ID NO: 405424 - DNA, 16 bp, M. musculus
gacagttttcagaaaa

SEQ ID NO: 405425 - DNA, 16 bp, M. musculus
gacataaaactaacca

SEQ ID NO: 405426 - DNA, 16 bp, M. musculus
gacataaagaaatcaa

SEQ ID NO: 405427 - DNA, 16 bp, M. musculus
gacataaagctggacc

SEQ ID NO: 405428 - DNA, 16 bp, M. musculus
gacataaatccacaca

SEQ ID NO: 405429 - DNA, 16 bp, M. musculus
gacataaatgaatgca

SEQ ID NO: 405430 - DNA, 16 bp, M. musculus
gacatacacatgcatg

SEQ ID NO: 405431 - DNA, 16 bp, M. musculus
gacatacatacacaca

SEQ ID NO: 405432 - DNA, 16 bp, M. musculus
gacatagaagcagaca

SEQ ID NO: 405433 - DNA, 16 bp, M. musculus
gacatagacaaacaga

SEQ ID NO: 405434 - DNA, 16 bp, M. musculus
gacatagctgtctctt

SEQ ID NO: 405435 - DNA, 16 bp, M. musculus
gacatagtggcacaca

SEQ ID NO: 405436 - DNA, 16 bp, M. musculus
gacatatatatgtgtg

SEQ ID NO: 405437 - DNA, 16 bp, M. musculus
gacatatgtgtgtgtg

SEQ ID NO: 405438 - DNA, 16 bp, M. musculus
gacatcaagaaggtct

SEQ ID NO: 405439 - DNA, 16 bp, M. musculus
gacatcaagggaatgg

SEQ ID NO: 405440 - DNA, 16 bp, M. musculus
gacatcactgggaggg

SEQ ID NO: 405441 - DNA, 16 bp, M. musculus
gacatcagaagggaag

SEQ ID NO: 405442 - DNA, 16 bp, M. musculus
gacatcagacatggaa

SEQ ID NO: 405443 - DNA, 16 bp, M. musculus
gacatcaggagttcag

SEQ ID NO: 405444 - DNA, 16 bp, M. musculus
gacatcatgaccaaag

SEQ ID NO: 405445 - DNA, 16 bp, M. musculus
gacatcattaattttg

SEQ ID NO: 405446 - DNA, 16 bp, M. musculus
gacatcattgggaaga

SEQ ID NO: 405447 - DNA, 16 bp, M. musculus
gacatccccttgagct

SEQ ID NO: 405448 - DNA, 16 bp, M. musculus
gacatcctcatggaaa

SEQ ID NO: 405449 - DNA, 16 bp, M. musculus
gacatcctcctgtgcc

SEQ ID NO: 405450 - DNA, 19 bp, M. musculus
gacatcggagcaacggaca

SEQ ID NO: 405451 - DNA, 16 bp, M. musculus
gacatctctttcttta

SEQ ID NO: 405452 - DNA, 16 bp, M. musculus
gacatctgcccaggat

SEQ ID NO: 405453 - DNA, 16 bp, M. musculus
gacatctggcactgac

SEQ ID NO: 405454 - DNA, 16 bp, M. musculus
gacatctgggttgttt

SEQ ID NO: 405455 - DNA, 16 bp, M. musculus
gacatcttctgggtat

SEQ ID NO: 405456 - DNA, 16 bp, M. musculus
gacatgaactctgggg

SEQ ID NO: 405457 - DNA, 16 bp, M. musculus
gacatgagttcaaatc

SEQ ID NO: 405458 - DNA, 26 bp, M. musculus
gacatgatctccctcaaagagaagtg

SEQ ID NO: 405459 - DNA, 16 bp, M. musculus
gacatgatgctagaga

SEQ ID NO: 405460 - DNA, 16 bp, M. musculus
gacatgcattcaggca

SEQ ID NO: 405461 - DNA, 16 bp, M. musculus
gacatgctgctggaga

SEQ ID NO: 405462 - DNA, 16 bp, M. musculus
gacatgcttgagttcc

SEQ ID NO: 405463 - DNA, 16 bp, M. musculus
gacatggaaaaatcaa

SEQ ID NO: 405464 - DNA, 16 bp, M. musculus
gacatggaaagagaaa

SEQ ID NO: 405465 - DNA, 16 bp, M. musculus
gacatggaagagagaa

SEQ ID NO: 405466 - DNA, 16 bp, M. musculus
gacatggaaggaagga

SEQ ID NO: 405467 - DNA, 16 bp, M. musculus
gacatggacatggaca

SEQ ID NO: 405468 - DNA, 16 bp, M. musculus
gacatggagctggaga

SEQ ID NO: 405469 - DNA, 16 bp, M. musculus
gacatggaggaggagg

SEQ ID NO: 405470 - DNA, 16 bp, M. musculus
gacatggagggcatca

SEQ ID NO: 405471 - DNA, 16 bp, M. musculus
gacatggcagtctcta

SEQ ID NO: 405472 - DNA, 16 bp, M. musculus
gacatggccagggcta

SEQ ID NO: 405473 - DNA, 16 bp, M. musculus
gacatgggcaaagctg

SEQ ID NO: 405474 - DNA, 16 bp, M. musculus
gacatgggctatcctc

SEQ ID NO: 405475 - DNA, 16 bp, M. musculus
gacatgggctctgggg

SEQ ID NO: 405476 - DNA, 16 bp, M. musculus
gacatggggcctggag

SEQ ID NO: 405477 - DNA, 16 bp, M. musculus
gacatggtctcactgt

SEQ ID NO: 405478 - DNA, 16 bp, M. musculus
gacatggtgctggagg

SEQ ID NO: 405479 - DNA, 16 bp, M. musculus
gacatgtctacagtct

SEQ ID NO: 405480 - DNA, 16 bp, M. musculus
gacatgtgagccactg

SEQ ID NO: 405481 - DNA, 17 bp, M. musculus
gacatgtgagccgctgg

SEQ ID NO: 405482 - DNA, 16 bp, M. musculus
gacatgtgagctgctg

SEQ ID NO: 405483 - DNA, 16 bp, M. musculus
gacatgtgctgaggca

SEQ ID NO: 405484 - DNA, 16 bp, M. musculus
gacatgtggatctctg

SEQ ID NO: 405485 - DNA, 16 bp, M. musculus
gacattagatgaaatg

SEQ ID NO: 405486 - DNA, 16 bp, M. musculus
gacattcccctgtact

SEQ ID NO: 405487 - DNA, 16 bp, M. musculus
gacattccttcctgca

SEQ ID NO: 405488 - DNA, 16 bp, M. musculus
gacattctctctctct

SEQ ID NO: 405489 - DNA, 16 bp, M. musculus
gacattctctttcttt

SEQ ID NO: 405490 - DNA, 16 bp, M. musculus
gacatttaagaactca

SEQ ID NO: 405491 - DNA, 16 bp, M. musculus
gacatttaattttttt

SEQ ID NO: 405492 - DNA, 16 bp, M. musculus
gacatttcaccagaga

SEQ ID NO: 405493 - DNA, 16 bp, M. musculus
gacatttcttattcaa

SEQ ID NO: 405494 - DNA, 16 bp, M. musculus
gacatttgcacccaac

SEQ ID NO: 405495 - DNA, 16 bp, M. musculus
gacatttgtgagccac

SEQ ID NO: 405496 - DNA, 16 bp, M. musculus
gacattttatattcaa

SEQ ID NO: 405497 - DNA, 16 bp, M. musculus
gacattttcagagaca

SEQ ID NO: 405498 - DNA, 16 bp, M. musculus
gacattttctttcttt

SEQ ID NO: 405499 - DNA, 16 bp, M. musculus
gacattttcttttctt

SEQ ID NO: 405500 - DNA, 16 bp, M. musculus
gacatttttatacatg

SEQ ID NO: 405501 - DNA, 16 bp, M. musculus
gacatttttatttaaa

SEQ ID NO: 405502 - DNA, 16 bp, M. musculus
gaccaaaagcaatgta

SEQ ID NO: 405503 - DNA, 16 bp, M. musculus
gaccaaagaagctgaa

SEQ ID NO: 405504 - DNA, 16 bp, M. musculus
gaccaaagcaattctt

SEQ ID NO: 405505 - DNA, 16 bp, M. musculus
gaccaaagtgtgggtg

SEQ ID NO: 405506 - DNA, 16 bp, M. musculus
gaccaaagtttggttc

SEQ ID NO: 405507 - DNA, 16 bp, M. musculus
gaccaaatccacaaca

SEQ ID NO: 405508 - DNA, 16 bp, M. musculus
gaccaacagaatcaat

SEQ ID NO: 405509 - DNA, 16 bp, M. musculus
gaccaactaggagtct

SEQ ID NO: 405510 - DNA, 16 bp, M. musculus
gaccaagaaaactctt

SEQ ID NO: 405511 - DNA, 17 bp, M. musculus
gaccaagaagcaaattg

SEQ ID NO: 405512 - DNA, 16 bp, M. musculus
gaccaagaagcagaga

SEQ ID NO: 405513 - DNA, 16 bp, M. musculus
gaccaagagatggact

SEQ ID NO: 405514 - DNA, 16 bp, M. musculus
gaccaagagcctctcc

SEQ ID NO: 405515 - DNA, 16 bp, M. musculus
gaccaagagcctcttc

SEQ ID NO: 405516 - DNA, 16 bp, M. musculus
gaccaagatggcgact

SEQ ID NO: 405517 - DNA, 16 bp, M. musculus
gaccaagcagggcaga

SEQ ID NO: 405518 - DNA, 16 bp, M. musculus
gaccaaggaactcact

SEQ ID NO: 405519 - DNA, 16 bp, M. musculus
gaccaaggagacccag

SEQ ID NO: 405520 - DNA, 16 bp, M. musculus
gaccaaggcagaagga

SEQ ID NO: 405521 - DNA, 16 bp, M. musculus
gaccaaggcctctcct

SEQ ID NO: 405522 - DNA, 16 bp, M. musculus
gaccaagggctgctcc

SEQ ID NO: 405523 - DNA, 16 bp, M. musculus
gaccaaggtgactctt

SEQ ID NO: 405524 - DNA, 16 bp, M. musculus
gaccaatcagtttaaa

SEQ ID NO: 405525 - DNA, 16 bp, M. musculus
gaccaatggaaaagaa

SEQ ID NO: 405526 - DNA, 16 bp, M. musculus
gaccaatttccctttt

SEQ ID NO: 405527 - DNA, 16 bp, M. musculus
gaccacaaacctggaa

SEQ ID NO: 405528 - DNA, 16 bp, M. musculus
gaccacacacacacat

SEQ ID NO: 405529 - DNA, 16 bp, M. musculus
gaccacacagagacta

SEQ ID NO: 405530 - DNA, 16 bp, M. musculus
gaccacacctacttca

SEQ ID NO: 405531 - DNA, 16 bp, M. musculus
gaccacacctcctcca

SEQ ID NO: 405532 - DNA, 16 bp, M. musculus
gaccacactggccttg

SEQ ID NO: 405533 - DNA, 16 bp, M. musculus
gaccacagaaattcaa

SEQ ID NO: 405534 - DNA, 16 bp, M. musculus
gaccacagagactgcc

SEQ ID NO: 405535 - DNA, 16 bp, M. musculus
gaccacagcttctgtg

SEQ ID NO: 405536 - DNA, 16 bp, M. musculus
gaccacagggccccca

SEQ ID NO: 405537 - DNA, 17 bp, M. musculus
gaccacatggtggctca

SEQ ID NO: 405538 - DNA, 16 bp, M. musculus
gaccaccaaggagcca

SEQ ID NO: 405539 - DNA, 18 bp, M. musculus
gaccaccagtccttctaa

SEQ ID NO: 405540 - DNA, 16 bp, M. musculus
gaccacccagaactcc

SEQ ID NO: 405541 - DNA, 16 bp, M. musculus
gaccacctgtggacag

SEQ ID NO: 405542 - DNA, 16 bp, M. musculus
gaccactaaacagaca

SEQ ID NO: 405543 - DNA, 21 bp, M. musculus
gaccactcaccatcatcagaa

SEQ ID NO: 405544 - DNA, 16 bp, M. musculus
gaccactcagacacag

SEQ ID NO: 405545 - DNA, 16 bp, M. musculus
gaccactcctgagatg

SEQ ID NO: 405546 - DNA, 16 bp, M. musculus
gaccactgaaccatct

SEQ ID NO: 405547 - DNA, 16 bp, M. musculus
gaccactggctgctct

SEQ ID NO: 405548 - DNA, 16 bp, M. musculus
gaccacttggcatcat

SEQ ID NO: 405549 - DNA, 16 bp, M. musculus
gaccagaaaaaaattc

SEQ ID NO: 405550 - DNA, 16 bp, M. musculus
gaccagaaagaaattc

SEQ ID NO: 405551 - DNA, 16 bp, M. musculus
gaccagaaagcaagtt

SEQ ID NO: 405552 - DNA, 16 bp, M. musculus
gaccagaggctgggat

SEQ ID NO: 405553 - DNA, 16 bp, M. musculus
gaccagcaagctccag

SEQ ID NO: 405554 - DNA, 17 bp, M. musculus
gaccagcagggctatat

SEQ ID NO: 405555 - DNA, 16 bp, M. musculus
gaccagccacacgatg

SEQ ID NO: 405556 - DNA, 16 bp, M. musculus
gaccagccagtgtatg

SEQ ID NO: 405557 - DNA, 16 bp, M. musculus
gaccagcccagagatg

SEQ ID NO: 405558 - DNA, 16 bp, M. musculus
gaccagcctggactat

SEQ ID NO: 405559 - DNA, 16 bp, M. musculus
gaccagcctggtccac

SEQ ID NO: 405560 - DNA, 16 bp, M. musculus
gaccagcctggtctat

SEQ ID NO: 405561 - DNA, 16 bp, M. musculus
gaccagctctctcctt

SEQ ID NO: 405562 - DNA, 16 bp, M. musculus
gaccagctgaaacaac

SEQ ID NO: 405563 - DNA, 16 bp, M. musculus
gaccagctgcctcaca

SEQ ID NO: 405564 - DNA, 16 bp, M. musculus
gaccagctgcctcatg

SEQ ID NO: 405565 - DNA, 16 bp, M. musculus
gaccagctgcctcctg

SEQ ID NO: 405566 - DNA, 16 bp, M. musculus
gaccaggaaagaaatt

SEQ ID NO: 405567 - DNA, 16 bp, M. musculus
gaccaggaagagggag

SEQ ID NO: 405568 - DNA, 16 bp, M. musculus
gaccaggccaaggtgg

SEQ ID NO: 405569 - DNA, 16 bp, M. musculus
gaccaggctagaggag

SEQ ID NO: 405570 - DNA, 16 bp, M. musculus
gaccaggctatctgtg

SEQ ID NO: 405571 - DNA, 16 bp, M. musculus
gaccaggctggccaca

SEQ ID NO: 405572 - DNA, 16 bp, M. musculus
gaccaggctggctcca

SEQ ID NO: 405573 - DNA, 16 bp, M. musculus
gaccaggctggcttcc

SEQ ID NO: 405574 - DNA, 16 bp, M. musculus
gaccaggctggcttta

SEQ ID NO: 405575 - DNA, 16 bp, M. musculus
gaccaggctggctttt

SEQ ID NO: 405576 - DNA, 16 bp, M. musculus
gaccaggctgggctct

SEQ ID NO: 405577 - DNA, 16 bp, M. musculus
gaccaggggctggaga

SEQ ID NO: 405578 - DNA, 16 bp, M. musculus
gaccagggtggcttca

SEQ ID NO: 405579 - DNA, 16 bp, M. musculus
gaccaggtgtggtggt

SEQ ID NO: 405580 - DNA, 16 bp, M. musculus
gaccaggttgtctcct

SEQ ID NO: 405581 - DNA, 16 bp, M. musculus
gaccagtcagatgagt

SEQ ID NO: 405582 - DNA, 16 bp, M. musculus
gaccagtctagtctac

SEQ ID NO: 405583 - DNA, 16 bp, M. musculus
gaccagtgggacccag

SEQ ID NO: 405584 - DNA, 36 bp, M. musculus
gaccagtgtcgctctgtgagggatataaagggcaga

SEQ ID NO: 405585 - DNA, 16 bp, M. musculus
gaccatcatggcagag

SEQ ID NO: 405586 - DNA, 16 bp, M. musculus
gaccatccagaaactg

SEQ ID NO: 405587 - DNA, 16 bp, M. musculus
gaccatccagggactg

SEQ ID NO: 405588 - DNA, 16 bp, M. musculus
gaccatcctctactac

SEQ ID NO: 405589 - DNA, 16 bp, M. musculus
gaccatgctggcctct

SEQ ID NO: 405590 - DNA, 16 bp, M. musculus
gaccatggaggaatgc

SEQ ID NO: 405591 - DNA, 16 bp, M. musculus
gaccatggaggggtgc

SEQ ID NO: 405592 - DNA, 16 bp, M. musculus
gaccatgggaccatct

SEQ ID NO: 405593 - DNA, 16 bp, M. musculus
gaccatgtaggtttta

SEQ ID NO: 405594 - DNA, 16 bp, M. musculus
gaccatgtctgcctgc

SEQ ID NO: 405595 - DNA, 16 bp, M. musculus
gaccattacagaaaac

SEQ ID NO: 405596 - DNA, 16 bp, M. musculus
gacccaacaagtagct

SEQ ID NO: 405597 - DNA, 16 bp, M. musculus
gacccaacttgggatc

SEQ ID NO: 405598 - DNA, 16 bp, M. musculus
gacccacaggttgaga

SEQ ID NO: 405599 - DNA, 16 bp, M. musculus
gacccacataatggaa

SEQ ID NO: 405600 - DNA, 16 bp, M. musculus
gacccacatggagacc

SEQ ID NO: 405601 - DNA, 16 bp, M. musculus
gacccacatggtagga

SEQ ID NO: 405602 - DNA, 16 bp, M. musculus
gacccaccccataatc

SEQ ID NO: 405603 - DNA, 16 bp, M. musculus
gacccactccttcctg

SEQ ID NO: 405604 - DNA, 16 bp, M. musculus
gacccactgagccatc

SEQ ID NO: 405605 - DNA, 16 bp, M. musculus
gacccactgagtccag

SEQ ID NO: 405606 - DNA, 16 bp, M. musculus
gacccagacccagacc

SEQ ID NO: 405607 - DNA, 16 bp, M. musculus
gacccagagcccagaa

SEQ ID NO: 405608 - DNA, 16 bp, M. musculus
gacccagatattgctg

SEQ ID NO: 405609 - DNA, 16 bp, M. musculus
gacccagatgtggccc

SEQ ID NO: 405610 - DNA, 16 bp, M. musculus
gacccagcagacccaa

SEQ ID NO: 405611 - DNA, 16 bp, M. musculus
gacccagctataccac

SEQ ID NO: 405612 - DNA, 16 bp, M. musculus
gacccaggaagacaaa

SEQ ID NO: 405613 - DNA, 107 bp, M. musculus
gacccaggaagcagtcagagaggcgacccaggaagacccacaagggtggacctgcgtgccgcctccgacttcctattaatgcctcaaatgagtattcagccggtgcc

SEQ ID NO: 405614 - DNA, 16 bp, M. musculus
gacccagggagtggca

SEQ ID NO: 405615 - DNA, 16 bp, M. musculus
gacccagggagtgggg

SEQ ID NO: 405616 - DNA, 16 bp, M. musculus
gacccagggctccagc

SEQ ID NO: 405617 - DNA, 16 bp, M. musculus
gacccaggttcaggtc

SEQ ID NO: 405618 - DNA, 16 bp, M. musculus
gacccatcaggaaaag

SEQ ID NO: 405619 - DNA, 16 bp, M. musculus
gacccatctttccagc

SEQ ID NO: 405620 - DNA, 16 bp, M. musculus
gacccatggcagagtg

SEQ ID NO: 405621 - DNA, 16 bp, M. musculus
gaccccacagtctgaa

SEQ ID NO: 405622 - DNA, 16 bp, M. musculus
gaccccagcatgctgg

SEQ ID NO: 405623 - DNA, 16 bp, M. musculus
gaccccagccctttga

SEQ ID NO: 405624 - DNA, 16 bp, M. musculus
gaccccatctcaaaat

SEQ ID NO: 405625 - DNA, 16 bp, M. musculus
gaccccattctgtcct

SEQ ID NO: 405626 - DNA, 16 bp, M. musculus
gacccccaagaactca

SEQ ID NO: 405627 - DNA, 16 bp, M. musculus
gacccccaatggagga

SEQ ID NO: 405628 - DNA, 16 bp, M. musculus
gaccccctgagtgaac

SEQ ID NO: 405629 - DNA, 16 bp, M. musculus
gaccccctggagctcc

SEQ ID NO: 405630 - DNA, 16 bp, M. musculus
gacccctcagagctct

SEQ ID NO: 405631 - DNA, 16 bp, M. musculus
gacccctgctgttgaa

SEQ ID NO: 405632 - DNA, 16 bp, M. musculus
gaccccttgtcagagg

SEQ ID NO: 405633 - DNA, 16 bp, M. musculus
gacccctttacctcct

SEQ ID NO: 405634 - DNA, 16 bp, M. musculus
gaccccttttcaggct

SEQ ID NO: 405635 - DNA, 16 bp, M. musculus
gacccgcctgcctctg

SEQ ID NO: 405636 - DNA, 16 bp, M. musculus
gacccgtggaaaggcc

SEQ ID NO: 405637 - DNA, 16 bp, M. musculus
gaccctccagaagagg

SEQ ID NO: 405638 - DNA, 16 bp, M. musculus
gaccctctcacatcaa

SEQ ID NO: 405639 - DNA, 16 bp, M. musculus
gaccctctggaagagc

SEQ ID NO: 405640 - DNA, 16 bp, M. musculus
gaccctgaagggacag

SEQ ID NO: 405641 - DNA, 16 bp, M. musculus
gaccctgagatcctga

SEQ ID NO: 405642 - DNA, 16 bp, M. musculus
gaccctgaggacagga

SEQ ID NO: 405643 - DNA, 16 bp, M. musculus
gaccctgcctcaaaag

SEQ ID NO: 405644 - DNA, 16 bp, M. musculus
gaccctggaagagacc

SEQ ID NO: 405645 - DNA, 19 bp, M. musculus
gaccctggaagcaattgaa

SEQ ID NO: 405646 - DNA, 16 bp, M. musculus
gaccctggtcaggcag

SEQ ID NO: 405647 - DNA, 16 bp, M. musculus
gaccctgtctcacaga

SEQ ID NO: 405648 - DNA, 17 bp, M. musculus
gaccctgtctccaaaac

SEQ ID NO: 405649 - DNA, 16 bp, M. musculus
gaccctgtctctgaaa

SEQ ID NO: 405650 - DNA, 16 bp, M. musculus
gaccctgtgccacagc

SEQ ID NO: 405651 - DNA, 16 bp, M. musculus
gaccctgtggaaaaac

SEQ ID NO: 405652 - DNA, 16 bp, M. musculus
gaccctgtgtcaaaga

SEQ ID NO: 405653 - DNA, 16 bp, M. musculus
gaccctgtgttccacc

SEQ ID NO: 405654 - DNA, 16 bp, M. musculus
gacccttgagacattc

SEQ ID NO: 405655 - DNA, 18 bp, M. musculus
gaccgaaaggggcttgtg

SEQ ID NO: 405656 - DNA, 17 bp, M. musculus
gaccgaactcaaaatgt

SEQ ID NO: 405657 - DNA, 16 bp, M. musculus
gaccgtttgcttggaa

SEQ ID NO: 405658 - DNA, 16 bp, M. musculus
gacctaaaagagattt

SEQ ID NO: 405659 - DNA, 16 bp, M. musculus
gacctaaagctgtatt

SEQ ID NO: 405660 - DNA, 16 bp, M. musculus
gacctaagtttggttc

SEQ ID NO: 405661 - DNA, 16 bp, M. musculus
gacctaatgctgtact

SEQ ID NO: 405662 - DNA, 16 bp, M. musculus
gacctagcaaacacat

SEQ ID NO: 405663 - DNA, 16 bp, M. musculus
gacctcaaagccagcc

SEQ ID NO: 405664 - DNA, 16 bp, M. musculus
gacctcaaagcccagc

SEQ ID NO: 405665 - DNA, 16 bp, M. musculus
gacctcaagctgtacc

SEQ ID NO: 405666 - DNA, 16 bp, M. musculus
gacctcacagccagag

SEQ ID NO: 405667 - DNA, 24 bp, M. musculus
gacctcacggaccagcccctccca

SEQ ID NO: 405668 - DNA, 16 bp, M. musculus
gacctcagagatctgc

SEQ ID NO: 405669 - DNA, 16 bp, M. musculus
gacctcagcataaaac

SEQ ID NO: 405670 - DNA, 16 bp, M. musculus
gacctcagggccagct

SEQ ID NO: 405671 - DNA, 16 bp, M. musculus
gacctcaggtggctct

SEQ ID NO: 405672 - DNA, 16 bp, M. musculus
gacctcagtgagagag

SEQ ID NO: 405673 - DNA, 16 bp, M. musculus
gacctccaagatctct

SEQ ID NO: 405674 - DNA, 16 bp, M. musculus
gacctccacaggcaca

SEQ ID NO: 405675 - DNA, 16 bp, M. musculus
gacctccacaggcact

SEQ ID NO: 405676 - DNA, 16 bp, M. musculus
gacctccacaggtgtg

SEQ ID NO: 405677 - DNA, 16 bp, M. musculus
gacctccacctgtgag

SEQ ID NO: 405678 - DNA, 16 bp, M. musculus
gacctcctcctaataa

SEQ ID NO: 405679 - DNA, 16 bp, M. musculus
gacctcctggagctgg

SEQ ID NO: 405680 - DNA, 16 bp, M. musculus
gacctctcctgtgtgt

SEQ ID NO: 405681 - DNA, 16 bp, M. musculus
gacctctctcttccag

SEQ ID NO: 405682 - DNA, 16 bp, M. musculus
gacctctctgtctctg

SEQ ID NO: 405683 - DNA, 16 bp, M. musculus
gacctctcttgctgtg

SEQ ID NO: 405684 - DNA, 16 bp, M. musculus
gacctctgacctctct

SEQ ID NO: 405685 - DNA, 16 bp, M. musculus
gacctctgagggcact

SEQ ID NO: 405686 - DNA, 16 bp, M. musculus
gacctctgcaagaaca

SEQ ID NO: 405687 - DNA, 16 bp, M. musculus
gacctctgcctcaggc

SEQ ID NO: 405688 - DNA, 16 bp, M. musculus
gacctctgctccctcc

SEQ ID NO: 405689 - DNA, 16 bp, M. musculus
gacctctggaaaagca

SEQ ID NO: 405690 - DNA, 16 bp, M. musculus
gacctctggaagaggt

SEQ ID NO: 405691 - DNA, 16 bp, M. musculus
gacctctgtgagtgga

SEQ ID NO: 405692 - DNA, 16 bp, M. musculus
gacctctgtgagttca

SEQ ID NO: 405693 - DNA, 16 bp, M. musculus
gacctctgtgggcatc

SEQ ID NO: 405694 - DNA, 16 bp, M. musculus
gacctctgtgtgtttg

SEQ ID NO: 405695 - DNA, 16 bp, M. musculus
gacctcttctggtgtg

SEQ ID NO: 405696 - DNA, 16 bp, M. musculus
gacctgaaggaagaag

SEQ ID NO: 405697 - DNA, 16 bp, M. musculus
gacctgaaggagaggc

SEQ ID NO: 405698 - DNA, 16 bp, M. musculus
gacctgaattccatcc

SEQ ID NO: 405699 - DNA, 16 bp, M. musculus
gacctgacaccctctt

SEQ ID NO: 405700 - DNA, 16 bp, M. musculus
gacctgacagtcctct

SEQ ID NO: 405701 - DNA, 16 bp, M. musculus
gacctgagcttgtgcc

SEQ ID NO: 405702 - DNA, 16 bp, M. musculus
gacctgagtttaatcc

SEQ ID NO: 405703 - DNA, 16 bp, M. musculus
gacctgagtttggttc

SEQ ID NO: 405704 - DNA, 16 bp, M. musculus
gacctgcagccctccc

SEQ ID NO: 405705 - DNA, 16 bp, M. musculus
gacctgcctgaactcc

SEQ ID NO: 405706 - DNA, 16 bp, M. musculus
gacctgcctgcaagat

SEQ ID NO: 405707 - DNA, 16 bp, M. musculus
gacctgctccattgct

SEQ ID NO: 405708 - DNA, 16 bp, M. musculus
gacctgctgttccagc

SEQ ID NO: 405709 - DNA, 16 bp, M. musculus
gacctggaaaggagat

SEQ ID NO: 405710 - DNA, 16 bp, M. musculus
gacctggaactctcta

SEQ ID NO: 405711 - DNA, 16 bp, M. musculus
gacctggaagcttcat

SEQ ID NO: 405712 - DNA, 16 bp, M. musculus
gacctggaagttctct

SEQ ID NO: 405713 - DNA, 16 bp, M. musculus
gacctggagaaactgc

SEQ ID NO: 405714 - DNA, 16 bp, M. musculus
gacctggagaaaggcc

SEQ ID NO: 405715 - DNA, 16 bp, M. musculus
gacctggagcctactg

SEQ ID NO: 405716 - DNA, 16 bp, M. musculus
gacctggagcctaggg

SEQ ID NO: 405717 - DNA, 16 bp, M. musculus
gacctggagctctgcc

SEQ ID NO: 405718 - DNA, 16 bp, M. musculus
gacctggaggacatca

SEQ ID NO: 405719 - DNA, 16 bp, M. musculus
gacctggatgaacaga

SEQ ID NO: 405720 - DNA, 16 bp, M. musculus
gacctggcagccatcc

SEQ ID NO: 405721 - DNA, 16 bp, M. musculus
gacctggccaccaggt

SEQ ID NO: 405722 - DNA, 41 bp, M. musculus
gacctggctacagctgctgctgattgccagatctgccaaca

SEQ ID NO: 405723 - DNA, 16 bp, M. musculus
gacctggctggcctca

SEQ ID NO: 405724 - DNA, 16 bp, M. musculus
gacctgggagatgaga

SEQ ID NO: 405725 - DNA, 16 bp, M. musculus
gacctgggtttggctc

SEQ ID NO: 405726 - DNA, 16 bp, M. musculus
gacctgtctcttccag

SEQ ID NO: 405727 - DNA, 16 bp, M. musculus
gacctgtggatcctga

SEQ ID NO: 405728 - DNA, 16 bp, M. musculus
gacctgtgggaggaca

SEQ ID NO: 405729 - DNA, 16 bp, M. musculus
gacctgtgtgtgtgtg

SEQ ID NO: 405730 - DNA, 16 bp, M. musculus
gacctgttgctggacc

SEQ ID NO: 405731 - DNA, 16 bp, M. musculus
gacctgtttggccctg

SEQ ID NO: 405732 - DNA, 16 bp, M. musculus
gacctgtttgtttgtt

SEQ ID NO: 405733 - DNA, 16 bp, M. musculus
gaccttaaatgaaatg

SEQ ID NO: 405734 - DNA, 16 bp, M. musculus
gaccttaattagcagg

SEQ ID NO: 405735 - DNA, 16 bp, M. musculus
gaccttagatgaaatg

SEQ ID NO: 405736 - DNA, 16 bp, M. musculus
gaccttaggtgactag

SEQ ID NO: 405737 - DNA, 16 bp, M. musculus
gaccttcaaagaagtt

SEQ ID NO: 405738 - DNA, 16 bp, M. musculus
gaccttcagaagggca

SEQ ID NO: 405739 - DNA, 16 bp, M. musculus
gaccttcccaaagttc

SEQ ID NO: 405740 - DNA, 18 bp, M. musculus
gaccttcggaagagcagt

SEQ ID NO: 405741 - DNA, 43 bp, M. musculus
gaccttcggaagagcagtcgggtgctcttacccactgagccat

SEQ ID NO: 405742 - DNA, 16 bp, M. musculus
gaccttctcctggccg

SEQ ID NO: 405743 - DNA, 16 bp, M. musculus
gaccttctgaagagca

SEQ ID NO: 405744 - DNA, 22 bp, M. musculus
gaccttctgtccagagatttgg

SEQ ID NO: 405745 - DNA, 16 bp, M. musculus
gaccttctgtccggag

SEQ ID NO: 405746 - DNA, 16 bp, M. musculus
gaccttcttcccttac

SEQ ID NO: 405747 - DNA, 16 bp, M. musculus
gaccttgaactctgag

SEQ ID NO: 405748 - DNA, 16 bp, M. musculus
gaccttgaacttctga

SEQ ID NO: 405749 - DNA, 16 bp, M. musculus
gaccttgaacttgaga

SEQ ID NO: 405750 - DNA, 16 bp, M. musculus
gaccttgaagttctga

SEQ ID NO: 405751 - DNA, 16 bp, M. musculus
gaccttgccttaaaaa

SEQ ID NO: 405752 - DNA, 16 bp, M. musculus
gaccttgggcaagtcc

SEQ ID NO: 405753 - DNA, 16 bp, M. musculus
gaccttggggccagct

SEQ ID NO: 405754 - DNA, 16 bp, M. musculus
gaccttgtagagactg

SEQ ID NO: 405755 - DNA, 16 bp, M. musculus
gaccttgtccaagaag

SEQ ID NO: 405756 - DNA, 17 bp, M. musculus
gaccttgtctcaaaaaa

SEQ ID NO: 405757 - DNA, 16 bp, M. musculus
gaccttgttggagaag

SEQ ID NO: 405758 - DNA, 16 bp, M. musculus
gaccttgtttgccaca

SEQ ID NO: 405759 - DNA, 16 bp, M. musculus
gacgacgacgacgaca

SEQ ID NO: 405760 - DNA, 62 bp, M. musculus
gacgagaagcagggctacgccaaaggcgtcctaacgcaaaaactgggaccttggcgtcggcc

SEQ ID NO: 405761 - DNA, 16 bp, M. musculus
gacgatgatgatggtg

SEQ ID NO: 405762 - DNA, 16 bp, M. musculus
gacgatgatggtgatg

SEQ ID NO: 405763 - DNA, 16 bp, M. musculus
gacgccctcttctgct

SEQ ID NO: 405764 - DNA, 16 bp, M. musculus
gacgccctcttctggc

SEQ ID NO: 405765 - DNA, 16 bp, M. musculus
gacgctacaacaggat

SEQ ID NO: 405766 - DNA, 16 bp, M. musculus
gacggacagacagaca

SEQ ID NO: 405767 - DNA, 16 bp, M. musculus
gacggacagacggaca

SEQ ID NO: 405768 - DNA, 16 bp, M. musculus
gacggacagacggatg

SEQ ID NO: 405769 - DNA, 16 bp, M. musculus
gacggacggacggacg

SEQ ID NO: 405770 - DNA, 16 bp, M. musculus
gacgtcctgagttcaa

SEQ ID NO: 405771 - DNA, 16 bp, M. musculus
gacgtgcaggataggg

SEQ ID NO: 405772 - DNA, 16 bp, M. musculus
gacgttggaacactgg

SEQ ID NO: 405773 - DNA, 16 bp, M. musculus
gactaaacatctgaaa

SEQ ID NO: 405774 - DNA, 16 bp, M. musculus
gactaaagcatccaca

SEQ ID NO: 405775 - DNA, 16 bp, M. musculus
gactaaaggaaagacc

SEQ ID NO: 405776 - DNA, 16 bp, M. musculus
gactaaaggtgtatgc

SEQ ID NO: 405777 - DNA, 16 bp, M. musculus
gactaacagaatcaca

SEQ ID NO: 405778 - DNA, 16 bp, M. musculus
gactaacagaccctca

SEQ ID NO: 405779 - DNA, 16 bp, M. musculus
gactaagatcaaaaac

SEQ ID NO: 405780 - DNA, 16 bp, M. musculus
gactaaggactctcac

SEQ ID NO: 405781 - DNA, 16 bp, M. musculus
gactaaggatattgaa

SEQ ID NO: 405782 - DNA, 16 bp, M. musculus
gactaaggctggtctt

SEQ ID NO: 405783 - DNA, 16 bp, M. musculus
gactacaatgtggaag

SEQ ID NO: 405784 - DNA, 16 bp, M. musculus
gactacacagagaaaa

SEQ ID NO: 405785 - DNA, 16 bp, M. musculus
gactacagaagcaaca

SEQ ID NO: 405786 - DNA, 16 bp, M. musculus
gactacagagccaaga

SEQ ID NO: 405787 - DNA, 16 bp, M. musculus
gactacatagtgagac

SEQ ID NO: 405788 - DNA, 16 bp, M. musculus
gactactactcagcta

SEQ ID NO: 405789 - DNA, 16 bp, M. musculus
gactacttaacaaacc

SEQ ID NO: 405790 - DNA, 16 bp, M. musculus
gactacttttggtgga

SEQ ID NO: 405791 - DNA, 16 bp, M. musculus
gactagaaaaggctgt

SEQ ID NO: 405792 - DNA, 16 bp, M. musculus
gactagagaaatggct

SEQ ID NO: 405793 - DNA, 16 bp, M. musculus
gactagcctggaactc

SEQ ID NO: 405794 - DNA, 18 bp, M. musculus
gactaggccatcttctga

SEQ ID NO: 405795 - DNA, 16 bp, M. musculus
gactaggctggctttg

SEQ ID NO: 405796 - DNA, 18 bp, M. musculus
gactagtgctaacaactt

SEQ ID NO: 405797 - DNA, 16 bp, M. musculus
gactagttggggtggg

SEQ ID NO: 405798 - DNA, 16 bp, M. musculus
gactagttttctttct

SEQ ID NO: 405799 - DNA, 16 bp, M. musculus
gactataccagggcct

SEQ ID NO: 405800 - DNA, 16 bp, M. musculus
gactattataaacaag

SEQ ID NO: 405801 - DNA, 16 bp, M. musculus
gactcaaactcagaaa

SEQ ID NO: 405802 - DNA, 16 bp, M. musculus
gactcaacaaagaaag

SEQ ID NO: 405803 - DNA, 16 bp, M. musculus
gactcaagcccttgga

SEQ ID NO: 405804 - DNA, 16 bp, M. musculus
gactcacagagattca

SEQ ID NO: 405805 - DNA, 16 bp, M. musculus
gactcacaggttgaaa

SEQ ID NO: 405806 - DNA, 16 bp, M. musculus
gactcagaaagacaga

SEQ ID NO: 405807 - DNA, 17 bp, M. musculus
gactcagacgaagaaga

SEQ ID NO: 405808 - DNA, 16 bp, M. musculus
gactcagagatcctcc

SEQ ID NO: 405809 - DNA, 16 bp, M. musculus
gactcagaggaggagg

SEQ ID NO: 405810 - DNA, 16 bp, M. musculus
gactcagcaaaaaact

SEQ ID NO: 405811 - DNA, 16 bp, M. musculus
gactcagccagttgct

SEQ ID NO: 405812 - DNA, 16 bp, M. musculus
gactcaggaagcagag

SEQ ID NO: 405813 - DNA, 16 bp, M. musculus
gactcaggacctttgg

SEQ ID NO: 405814 - DNA, 16 bp, M. musculus
gactcagtagttaaga

SEQ ID NO: 405815 - DNA, 16 bp, M. musculus
gactcagtctctgaga

SEQ ID NO: 405816 - DNA, 16 bp, M. musculus
gactcagttttttttt

SEQ ID NO: 405817 - DNA, 16 bp, M. musculus
gactcatatcagctgg

SEQ ID NO: 405818 - DNA, 16 bp, M. musculus
gactccaagaaaacag

SEQ ID NO: 405819 - DNA, 16 bp, M. musculus
gactccaagcccagaa

SEQ ID NO: 405820 - DNA, 16 bp, M. musculus
gactccaccccaccag

SEQ ID NO: 405821 - DNA, 16 bp, M. musculus
gactccagaaaaccaa

SEQ ID NO: 405822 - DNA, 16 bp, M. musculus
gactccagctccagga

SEQ ID NO: 405823 - DNA, 16 bp, M. musculus
gactccatccagataa

SEQ ID NO: 405824 - DNA, 16 bp, M. musculus
gactcccaggacccaa

SEQ ID NO: 405825 - DNA, 16 bp, M. musculus
gactcccaggagcctc

SEQ ID NO: 405826 - DNA, 16 bp, M. musculus
gactcccccaccaagt

SEQ ID NO: 405827 - DNA, 16 bp, M. musculus
gactccccgggccagg

SEQ ID NO: 405828 - DNA, 16 bp, M. musculus
gactcccctgcctcct

SEQ ID NO: 405829 - DNA, 16 bp, M. musculus
gactccctagtgctgg

SEQ ID NO: 405830 - DNA, 16 bp, M. musculus
gactccctcacacaga

SEQ ID NO: 405831 - DNA, 16 bp, M. musculus
gactccctcttctgga

SEQ ID NO: 405832 - DNA, 16 bp, M. musculus
gactccctgcccacct

SEQ ID NO: 405833 - DNA, 16 bp, M. musculus
gactccctggccagcc

SEQ ID NO: 405834 - DNA, 16 bp, M. musculus
gactccctggccagct

SEQ ID NO: 405835 - DNA, 16 bp, M. musculus
gactccgcagagggca

SEQ ID NO: 405836 - DNA, 16 bp, M. musculus
gactcctaaaagttgt

SEQ ID NO: 405837 - DNA, 16 bp, M. musculus
gactcctcccagttat

SEQ ID NO: 405838 - DNA, 16 bp, M. musculus
gactcctctggctcct

SEQ ID NO: 405839 - DNA, 16 bp, M. musculus
gactcctgagtgctgg

SEQ ID NO: 405840 - DNA, 16 bp, M. musculus
gactcctgccaagtgg

SEQ ID NO: 405841 - DNA, 16 bp, M. musculus
gactcggaggaggaag

SEQ ID NO: 405842 - DNA, 16 bp, M. musculus
gactcgggaggcagag

SEQ ID NO: 405843 - DNA, 16 bp, M. musculus
gactcgggctgattgg

SEQ ID NO: 405844 - DNA, 16 bp, M. musculus
gactcggtggttaaga

SEQ ID NO: 405845 - DNA, 16 bp, M. musculus
gactctaaaaattcca

SEQ ID NO: 405846 - DNA, 16 bp, M. musculus
gactctagaaaaccaa

SEQ ID NO: 405847 - DNA, 16 bp, M. musculus
gactctcatccctctg

SEQ ID NO: 405848 - DNA, 16 bp, M. musculus
gactctccatgcctca

SEQ ID NO: 405849 - DNA, 16 bp, M. musculus
gactctctaaggcagg

SEQ ID NO: 405850 - DNA, 16 bp, M. musculus
gactctgagaagttct

SEQ ID NO: 405851 - DNA, 16 bp, M. musculus
gactctgagcatccac

SEQ ID NO: 405852 - DNA, 16 bp, M. musculus
gactctgaggagctct

SEQ ID NO: 405853 - DNA, 16 bp, M. musculus
gactctgcctcaaaaa

SEQ ID NO: 405854 - DNA, 16 bp, M. musculus
gactctgcctccccag

SEQ ID NO: 405855 - DNA, 16 bp, M. musculus
gactctgctggcaagg

SEQ ID NO: 405856 - DNA, 16 bp, M. musculus
gactctgggcctggct

SEQ ID NO: 405857 - DNA, 16 bp, M. musculus
gactctgtcttaaaaa

SEQ ID NO: 405858 - DNA, 16 bp, M. musculus
gactctgtgctgccct

SEQ ID NO: 405859 - DNA, 16 bp, M. musculus
gactcttacagaagaa

SEQ ID NO: 405860 - DNA, 16 bp, M. musculus
gactcttcataacttc

SEQ ID NO: 405861 - DNA, 16 bp, M. musculus
gactcttctctttgtc

SEQ ID NO: 405862 - DNA, 16 bp, M. musculus
gactcttgtgactttg

SEQ ID NO: 405863 - DNA, 16 bp, M. musculus
gactcttgtggaagaa

SEQ ID NO: 405864 - DNA, 16 bp, M. musculus
gactctttagagttta

SEQ ID NO: 405865 - DNA, 16 bp, M. musculus
gactctttctcaaaaa

SEQ ID NO: 405866 - DNA, 16 bp, M. musculus
gactctttgactaaag

SEQ ID NO: 405867 - DNA, 16 bp, M. musculus
gactctttggacaagg

SEQ ID NO: 405868 - DNA, 16 bp, M. musculus
gactcttttcctcctg

SEQ ID NO: 405869 - DNA, 16 bp, M. musculus
gactgaactcagattg

SEQ ID NO: 405870 - DNA, 16 bp, M. musculus
gactgaactcaggcca

SEQ ID NO: 405871 - DNA, 16 bp, M. musculus
gactgaagaagctgaa

SEQ ID NO: 405872 - DNA, 16 bp, M. musculus
gactgaagaggagaag

SEQ ID NO: 405873 - DNA, 16 bp, M. musculus
gactgaagcacccaca

SEQ ID NO: 405874 - DNA, 16 bp, M. musculus
gactgaaggaaaggac

SEQ ID NO: 405875 - DNA, 16 bp, M. musculus
gactgaaggaactgaa

SEQ ID NO: 405876 - DNA, 16 bp, M. musculus
gactgaaggagctggg

SEQ ID NO: 405877 - DNA, 16 bp, M. musculus
gactgaaggcaaattt

SEQ ID NO: 405878 - DNA, 16 bp, M. musculus
gactgaatctctgaaa

SEQ ID NO: 405879 - DNA, 16 bp, M. musculus
gactgacctgaagaga

SEQ ID NO: 405880 - DNA, 16 bp, M. musculus
gactgactccatgaca

SEQ ID NO: 405881 - DNA, 16 bp, M. musculus
gactgactgacagaca

SEQ ID NO: 405882 - DNA, 16 bp, M. musculus
gactgactgactgact

SEQ ID NO: 405883 - DNA, 16 bp, M. musculus
gactgactgctcttcc

SEQ ID NO: 405884 - DNA, 16 bp, M. musculus
gactgagacagaaaca

SEQ ID NO: 405885 - DNA, 16 bp, M. musculus
gactgagaggagagga

SEQ ID NO: 405886 - DNA, 16 bp, M. musculus
gactgagcagctactg

SEQ ID NO: 405887 - DNA, 16 bp, M. musculus
gactgagcctctgaac

SEQ ID NO: 405888 - DNA, 16 bp, M. musculus
gactgagcctggggac

SEQ ID NO: 405889 - DNA, 16 bp, M. musculus
gactgaggaagacact

SEQ ID NO: 405890 - DNA, 16 bp, M. musculus
gactgaggcaggcaga

SEQ ID NO: 405891 - DNA, 41 bp, M. musculus
gactgagtaactgctagatccttggacttccattcacagct

SEQ ID NO: 405892 - DNA, 16 bp, M. musculus
gactgagtcagcactc

SEQ ID NO: 405893 - DNA, 16 bp, M. musculus
gactgagttcagttcc

SEQ ID NO: 405894 - DNA, 16 bp, M. musculus
gactgagtttcctgtg

SEQ ID NO: 405895 - DNA, 16 bp, M. musculus
gactgatagagcctct

SEQ ID NO: 405896 - DNA, 16 bp, M. musculus
gactgatggccacaca

SEQ ID NO: 405897 - DNA, 16 bp, M. musculus
gactgatttaaaatca

SEQ ID NO: 405898 - DNA, 16 bp, M. musculus
gactgcaaattgatcc

SEQ ID NO: 405899 - DNA, 16 bp, M. musculus
gactgcacagagaaat

SEQ ID NO: 405900 - DNA, 16 bp, M. musculus
gactgcactccagaag

SEQ ID NO: 405901 - DNA, 16 bp, M. musculus
gactgcactgcctgca

SEQ ID NO: 405902 - DNA, 16 bp, M. musculus
gactgcagaagcaaca

SEQ ID NO: 405903 - DNA, 16 bp, M. musculus
gactgcagccaggaga

SEQ ID NO: 405904 - DNA, 16 bp, M. musculus
gactgcagtgggcctg

SEQ ID NO: 405905 - DNA, 16 bp, M. musculus
gactgcagtgggcgtg

SEQ ID NO: 405906 - DNA, 40 bp, M. musculus
gactgccaacaaggtactcgggccctgttacaaaccctag

SEQ ID NO: 405907 - DNA, 16 bp, M. musculus
gactgccacatccagg

SEQ ID NO: 405908 - DNA, 16 bp, M. musculus
gactgccatctgctct

SEQ ID NO: 405909 - DNA, 16 bp, M. musculus
gactgccatgagtttg

SEQ ID NO: 405910 - DNA, 16 bp, M. musculus
gactgcccacctgggg

SEQ ID NO: 405911 - DNA, 16 bp, M. musculus
gactgccttttggagt

SEQ ID NO: 405912 - DNA, 16 bp, M. musculus
gactgctatgaacata

SEQ ID NO: 405913 - DNA, 16 bp, M. musculus
gactgctattaggtcc

SEQ ID NO: 405914 - DNA, 16 bp, M. musculus
gactgctcttccagaa

SEQ ID NO: 405915 - DNA, 16 bp, M. musculus
gactgctgctcttcca

SEQ ID NO: 405916 - DNA, 16 bp, M. musculus
gactgctgggattaaa

SEQ ID NO: 405917 - DNA, 16 bp, M. musculus
gactgctgtgacacac

SEQ ID NO: 405918 - DNA, 16 bp, M. musculus
gactgctttttcagag

SEQ ID NO: 405919 - DNA, 16 bp, M. musculus
gactggaaggaactgg

SEQ ID NO: 405920 - DNA, 16 bp, M. musculus
gactggaagggatttg

SEQ ID NO: 405921 - DNA, 16 bp, M. musculus
gactggaattcaaaca

SEQ ID NO: 405922 - DNA, 16 bp, M. musculus
gactggacattgtgaa

SEQ ID NO: 405923 - DNA, 16 bp, M. musculus
gactggaccaccaacc

SEQ ID NO: 405924 - DNA, 16 bp, M. musculus
gactggaccagaaaaa

SEQ ID NO: 405925 - DNA, 16 bp, M. musculus
gactggagaccagcct

SEQ ID NO: 405926 - DNA, 16 bp, M. musculus
gactggagagactgct

SEQ ID NO: 405927 - DNA, 17 bp, M. musculus
gactggagagatggctt

SEQ ID NO: 405928 - DNA, 16 bp, M. musculus
gactggagtgagcaga

SEQ ID NO: 405929 - DNA, 16 bp, M. musculus
gactggatctggatga

SEQ ID NO: 405930 - DNA, 24 bp, M. musculus
gactggcaaacgattgtaaaagcc

SEQ ID NO: 405931 - DNA, 16 bp, M. musculus
gactggcctggaactc

SEQ ID NO: 405932 - DNA, 16 bp, M. musculus
gactggccttaaactc

SEQ ID NO: 405933 - DNA, 16 bp, M. musculus
gactggccttaaactt

SEQ ID NO: 405934 - DNA, 16 bp, M. musculus
gactggctggccaatg

SEQ ID NO: 405935 - DNA, 16 bp, M. musculus
gactggcttggaactc

SEQ ID NO: 405936 - DNA, 16 bp, M. musculus
gactgggaaaggattt

SEQ ID NO: 405937 - DNA, 16 bp, M. musculus
gactgggaagaaagaa

SEQ ID NO: 405938 - DNA, 16 bp, M. musculus
gactgggatgtaaagt

SEQ ID NO: 405939 - DNA, 16 bp, M. musculus
gactgggccctcctac

SEQ ID NO: 405940 - DNA, 16 bp, M. musculus
gactggggagatggtt

SEQ ID NO: 405941 - DNA, 16 bp, M. musculus
gactggggatgtagct

SEQ ID NO: 405942 - DNA, 16 bp, M. musculus
gactggggtattgctg

SEQ ID NO: 405943 - DNA, 16 bp, M. musculus
gactgggtctctctat

SEQ ID NO: 405944 - DNA, 16 bp, M. musculus
gactgggtctgactga

SEQ ID NO: 405945 - DNA, 16 bp, M. musculus
gactggtcttcaatag

SEQ ID NO: 405946 - DNA, 16 bp, M. musculus
gactggtgtgaggagg

SEQ ID NO: 405947 - DNA, 16 bp, M. musculus
gactggtgtgagttgg

SEQ ID NO: 405948 - DNA, 16 bp, M. musculus
gactgtagctcagtgg

SEQ ID NO: 405949 - DNA, 19 bp, M. musculus
gactgtagctgtcttcaga

SEQ ID NO: 405950 - DNA, 17 bp, M. musculus
gactgtagtaaaagctg

SEQ ID NO: 405951 - DNA, 16 bp, M. musculus
gactgtcccacccagg

SEQ ID NO: 405952 - DNA, 16 bp, M. musculus
gactgtcccacctggg

SEQ ID NO: 405953 - DNA, 16 bp, M. musculus
gactgtcccctgagag

SEQ ID NO: 405954 - DNA, 16 bp, M. musculus
gactgtcctcaggcag

SEQ ID NO: 405955 - DNA, 16 bp, M. musculus
gactgtcctgaaactt

SEQ ID NO: 405956 - DNA, 16 bp, M. musculus
gactgtgctttcccac

SEQ ID NO: 405957 - DNA, 16 bp, M. musculus
gactgtggaaggactt

SEQ ID NO: 405958 - DNA, 16 bp, M. musculus
gactgtggaaggattt

SEQ ID NO: 405959 - DNA, 16 bp, M. musculus
gactgtggagatggct

SEQ ID NO: 405960 - DNA, 16 bp, M. musculus
gactgtgggactgtcc

SEQ ID NO: 405961 - DNA, 16 bp, M. musculus
gactgtgggatgggaa

SEQ ID NO: 405962 - DNA, 16 bp, M. musculus
gactgtgggcctgaga

SEQ ID NO: 405963 - DNA, 16 bp, M. musculus
gactgtggtcagcaga

SEQ ID NO: 405964 - DNA, 16 bp, M. musculus
gactgtgtgccacact

SEQ ID NO: 405965 - DNA, 16 bp, M. musculus
gactgtgtgtctgtgt

SEQ ID NO: 405966 - DNA, 16 bp, M. musculus
gactgttagccatgcc

SEQ ID NO: 405967 - DNA, 16 bp, M. musculus
gactgttcagatcatt

SEQ ID NO: 405968 - DNA, 16 bp, M. musculus
gactgttcctccagag

SEQ ID NO: 405969 - DNA, 16 bp, M. musculus
gactgttcttctgaag

SEQ ID NO: 405970 - DNA, 17 bp, M. musculus
gacttaagtgtggacac

SEQ ID NO: 405971 - DNA, 16 bp, M. musculus
gacttaatgattcttt

SEQ ID NO: 405972 - DNA, 16 bp, M. musculus
gacttacagacacatg

SEQ ID NO: 405973 - DNA, 16 bp, M. musculus
gacttattttatgtat

SEQ ID NO: 405974 - DNA, 16 bp, M. musculus
gacttcaaatcccagc

SEQ ID NO: 405975 - DNA, 16 bp, M. musculus
gacttcagaaaagcaa

SEQ ID NO: 405976 - DNA, 16 bp, M. musculus
gacttcagaaaatcca

SEQ ID NO: 405977 - DNA, 16 bp, M. musculus
gacttcagcccagaaa

SEQ ID NO: 405978 - DNA, 16 bp, M. musculus
gacttcatgaaatttt

SEQ ID NO: 405979 - DNA, 16 bp, M. musculus
gacttccaacccaaag

SEQ ID NO: 405980 - DNA, 16 bp, M. musculus
gacttccaggtcccag

SEQ ID NO: 405981 - DNA, 16 bp, M. musculus
gacttccccacctggg

SEQ ID NO: 405982 - DNA, 16 bp, M. musculus
gacttcccttaatgat

SEQ ID NO: 405983 - DNA, 16 bp, M. musculus
gacttcctccaacaag

SEQ ID NO: 405984 - DNA, 16 bp, M. musculus
gacttcctccagcaag

SEQ ID NO: 405985 - DNA, 16 bp, M. musculus
gacttcctccagtgat

SEQ ID NO: 405986 - DNA, 16 bp, M. musculus
gacttcctccttccca

SEQ ID NO: 405987 - DNA, 16 bp, M. musculus
gacttcctctactctg

SEQ ID NO: 405988 - DNA, 16 bp, M. musculus
gacttcctgacttcct

SEQ ID NO: 405989 - DNA, 16 bp, M. musculus
gacttcctgctggagg

SEQ ID NO: 405990 - DNA, 16 bp, M. musculus
gacttcctggaggagg

SEQ ID NO: 405991 - DNA, 16 bp, M. musculus
gacttcctgttcctct

SEQ ID NO: 405992 - DNA, 16 bp, M. musculus
gacttcctttagtgat

SEQ ID NO: 405993 - DNA, 16 bp, M. musculus
gacttctctccagaga

SEQ ID NO: 405994 - DNA, 16 bp, M. musculus
gacttctgcatcagct

SEQ ID NO: 405995 - DNA, 16 bp, M. musculus
gacttcttcctttctg

SEQ ID NO: 405996 - DNA, 16 bp, M. musculus
gacttctttctttcca

SEQ ID NO: 405997 - DNA, 16 bp, M. musculus
gacttgaaaactttat

SEQ ID NO: 405998 - DNA, 16 bp, M. musculus
gacttgaaaatggaaa

SEQ ID NO: 405999 - DNA, 16 bp, M. musculus
gacttgaattcctgat

SEQ ID NO: 406000 - DNA, 16 bp, M. musculus
gacttgagcagaggcc

SEQ ID NO: 406001 - DNA, 16 bp, M. musculus
gacttgagctttgtac

SEQ ID NO: 406002 - DNA, 16 bp, M. musculus
gacttgagttcaatcc

SEQ ID NO: 406003 - DNA, 16 bp, M. musculus
gacttgatgctccagg

SEQ ID NO: 406004 - DNA, 16 bp, M. musculus
gacttgatgtgccagg

SEQ ID NO: 406005 - DNA, 16 bp, M. musculus
gacttgatgtgctggg

SEQ ID NO: 406006 - DNA, 16 bp, M. musculus
gacttgctctctcctg

SEQ ID NO: 406007 - DNA, 16 bp, M. musculus
gacttgctggaggaag

SEQ ID NO: 406008 - DNA, 16 bp, M. musculus
gacttgctttgtgact

SEQ ID NO: 406009 - DNA, 16 bp, M. musculus
gacttggaactcactg

SEQ ID NO: 406010 - DNA, 16 bp, M. musculus
gacttggaggagagga

SEQ ID NO: 406011 - DNA, 19 bp, M. musculus
gacttggaggaggaagcag

SEQ ID NO: 406012 - DNA, 16 bp, M. musculus
gacttggctgcagtcc

SEQ ID NO: 406013 - DNA, 16 bp, M. musculus
gacttgggaccttcca

SEQ ID NO: 406014 - DNA, 16 bp, M. musculus
gacttgggaggaagag

SEQ ID NO: 406015 - DNA, 16 bp, M. musculus
gacttggtggcaaatg

SEQ ID NO: 406016 - DNA, 16 bp, M. musculus
gacttggtggccaagg

SEQ ID NO: 406017 - DNA, 16 bp, M. musculus
gacttggtgtccaaag

SEQ ID NO: 406018 - DNA, 16 bp, M. musculus
gacttggtgtctgtgt

SEQ ID NO: 406019 - DNA, 16 bp, M. musculus
gacttgttcaaggtca

SEQ ID NO: 406020 - DNA, 16 bp, M. musculus
gacttgtttgtataat

SEQ ID NO: 406021 - DNA, 16 bp, M. musculus
gactttaagaaggaca

SEQ ID NO: 406022 - DNA, 19 bp, M. musculus
gactttaagaaggacataa

SEQ ID NO: 406023 - DNA, 16 bp, M. musculus
gactttaatctcagca

SEQ ID NO: 406024 - DNA, 16 bp, M. musculus
gactttaatgactgct

SEQ ID NO: 406025 - DNA, 16 bp, M. musculus
gactttaattaggaaa

SEQ ID NO: 406026 - DNA, 16 bp, M. musculus
gactttagaatttaat

SEQ ID NO: 406027 - DNA, 16 bp, M. musculus
gactttagtacaagga

SEQ ID NO: 406028 - DNA, 16 bp, M. musculus
gactttcctggaactc

SEQ ID NO: 406029 - DNA, 16 bp, M. musculus
gactttctagttgaca

SEQ ID NO: 406030 - DNA, 16 bp, M. musculus
gactttgaactcacaa

SEQ ID NO: 406031 - DNA, 16 bp, M. musculus
gactttgaactcatga

SEQ ID NO: 406032 - DNA, 16 bp, M. musculus
gactttgaatctttca

SEQ ID NO: 406033 - DNA, 16 bp, M. musculus
gactttgaggcttcaa

SEQ ID NO: 406034 - DNA, 16 bp, M. musculus
gactttgagtcatttg

SEQ ID NO: 406035 - DNA, 16 bp, M. musculus
gactttggatttggaa

SEQ ID NO: 406036 - DNA, 16 bp, M. musculus
gactttggggatagca

SEQ ID NO: 406037 - DNA, 16 bp, M. musculus
gactttgtagaccagg

SEQ ID NO: 406038 - DNA, 16 bp, M. musculus
gactttgtctccaact

SEQ ID NO: 406039 - DNA, 16 bp, M. musculus
gactttgttggaggaa

SEQ ID NO: 406040 - DNA, 16 bp, M. musculus
gacttttaaaaataat

SEQ ID NO: 406041 - DNA, 16 bp, M. musculus
gacttttaaaaatata

SEQ ID NO: 406042 - DNA, 16 bp, M. musculus
gacttttaacattttt

SEQ ID NO: 406043 - DNA, 16 bp, M. musculus
gacttttactttttat

SEQ ID NO: 406044 - DNA, 16 bp, M. musculus
gacttttgagagttta

SEQ ID NO: 406045 - DNA, 16 bp, M. musculus
gacttttgattgctgg

SEQ ID NO: 406046 - DNA, 30 bp, M. musculus
gacttttgcaggagcaccagggaagcatat

SEQ ID NO: 406047 - DNA, 16 bp, M. musculus
gacttttggaataaca

SEQ ID NO: 406048 - DNA, 16 bp, M. musculus
gacttttgtgttttct

SEQ ID NO: 406049 - DNA, 16 bp, M. musculus
gactttttaaaaaatt

SEQ ID NO: 406050 - DNA, 28 bp, M. musculus
gactttttagagtttaatgaaaatgaag

SEQ ID NO: 406051 - DNA, 16 bp, M. musculus
gactttttgaagttta

SEQ ID NO: 406052 - DNA, 16 bp, M. musculus
gactttttgttgttgt

SEQ ID NO: 406053 - DNA, 16 bp, M. musculus
gacttttttgataact

SEQ ID NO: 406054 - DNA, 16 bp, M. musculus
gagaaaaaaaatgttt

SEQ ID NO: 406055 - DNA, 16 bp, M. musculus
gagaaaaaccaataca

SEQ ID NO: 406056 - DNA, 16 bp, M. musculus
gagaaaaactcaaagc

SEQ ID NO: 406057 - DNA, 16 bp, M. musculus
gagaaaaatgtttatt

SEQ ID NO: 406058 - DNA, 16 bp, M. musculus
gagaaaacacctccat

SEQ ID NO: 406059 - DNA, 16 bp, M. musculus
gagaaaacattgacac

SEQ ID NO: 406060 - DNA, 16 bp, M. musculus
gagaaaaccaactctc

SEQ ID NO: 406061 - DNA, 16 bp, M. musculus
gagaaaacgcctccat

SEQ ID NO: 406062 - DNA, 16 bp, M. musculus
gagaaaactggtctcc

SEQ ID NO: 406063 - DNA, 16 bp, M. musculus
gagaaaacttcctgaa

SEQ ID NO: 406064 - DNA, 16 bp, M. musculus
gagaaaaggactgaag

SEQ ID NO: 406065 - DNA, 16 bp, M. musculus
gagaaaagggtttatt

SEQ ID NO: 406066 - DNA, 16 bp, M. musculus
gagaaaagtgaagatg

SEQ ID NO: 406067 - DNA, 16 bp, M. musculus
gagaaaagttcctgaa

SEQ ID NO: 406068 - DNA, 16 bp, M. musculus
gagaaaataagtttta

SEQ ID NO: 406069 - DNA, 16 bp, M. musculus
gagaaaatatttattt

SEQ ID NO: 406070 - DNA, 16 bp, M. musculus
gagaaaatatttgaaa

SEQ ID NO: 406071 - DNA, 16 bp, M. musculus
gagaaaatatttttat

SEQ ID NO: 406072 - DNA, 17 bp, M. musculus
gagaaaatcaacaagat

SEQ ID NO: 406073 - DNA, 16 bp, M. musculus
gagaaaatcaatgaga

SEQ ID NO: 406074 - DNA, 16 bp, M. musculus
gagaaaatcatcaaga

SEQ ID NO: 406075 - DNA, 16 bp, M. musculus
gagaaaatgaagacaa

SEQ ID NO: 406076 - DNA, 27 bp, M. musculus
gagaaaatgcctatgaagaaagtttaa

SEQ ID NO: 406077 - DNA, 16 bp, M. musculus
gagaaaatttggaatc

SEQ ID NO: 406078 - DNA, 16 bp, M. musculus
gagaaacaaagatatt

SEQ ID NO: 406079 - DNA, 16 bp, M. musculus
gagaaacacacagaca

SEQ ID NO: 406080 - DNA, 16 bp, M. musculus
gagaaacactttaaaa

SEQ ID NO: 406081 - DNA, 16 bp, M. musculus
gagaaacagaggcaga

SEQ ID NO: 406082 - DNA, 16 bp, M. musculus
gagaaaccagattgaa

SEQ ID NO: 406083 - DNA, 16 bp, M. musculus
gagaaacccatggctc

SEQ ID NO: 406084 - DNA, 16 bp, M. musculus
gagaaaccctgtcagg

SEQ ID NO: 406085 - DNA, 16 bp, M. musculus
gagaaaccgttcttga

SEQ ID NO: 406086 - DNA, 16 bp, M. musculus
gagaaactctgtctgg

SEQ ID NO: 406087 - DNA, 16 bp, M. musculus
gagaaactgaaggaaa

SEQ ID NO: 406088 - DNA, 16 bp, M. musculus
gagaaactgagacaga

SEQ ID NO: 406089 - DNA, 16 bp, M. musculus
gagaaactgaggaaga

SEQ ID NO: 406090 - DNA, 16 bp, M. musculus
gagaaactggctgaaa

SEQ ID NO: 406091 - DNA, 16 bp, M. musculus
gagaaactggctgaga

SEQ ID NO: 406092 - DNA, 16 bp, M. musculus
gagaaactgtattaaa

SEQ ID NO: 406093 - DNA, 16 bp, M. musculus
gagaaacttctagaaa

SEQ ID NO: 406094 - DNA, 16 bp, M. musculus
gagaaacttctttttg

SEQ ID NO: 406095 - DNA, 16 bp, M. musculus
gagaaacttgaagcaa

SEQ ID NO: 406096 - DNA, 16 bp, M. musculus
gagaaacttgaagcag

SEQ ID NO: 406097 - DNA, 16 bp, M. musculus
gagaaactttgtctca

SEQ ID NO: 406098 - DNA, 16 bp, M. musculus
gagaaagaaaccctag

SEQ ID NO: 406099 - DNA, 16 bp, M. musculus
gagaaagaaatgtgtt

SEQ ID NO: 406100 - DNA, 16 bp, M. musculus
gagaaagaactgaaga

SEQ ID NO: 406101 - DNA, 16 bp, M. musculus
gagaaagaactgagag

SEQ ID NO: 406102 - DNA, 16 bp, M. musculus
gagaaagaagaacact

SEQ ID NO: 406103 - DNA, 16 bp, M. musculus
gagaaagactgagaga

SEQ ID NO: 406104 - DNA, 16 bp, M. musculus
gagaaagcactgaagg

SEQ ID NO: 406105 - DNA, 16 bp, M. musculus
gagaaagcagacagag

SEQ ID NO: 406106 - DNA, 16 bp, M. musculus
gagaaagcagccaagg

SEQ ID NO: 406107 - DNA, 16 bp, M. musculus
gagaaagccagaggaa

SEQ ID NO: 406108 - DNA, 16 bp, M. musculus
gagaaagccatgggga

SEQ ID NO: 406109 - DNA, 16 bp, M. musculus
gagaaaggacccaagt

SEQ ID NO: 406110 - DNA, 16 bp, M. musculus
gagaaaggagccaagg

SEQ ID NO: 406111 - DNA, 16 bp, M. musculus
gagaaaggagcttgag

SEQ ID NO: 406112 - DNA, 16 bp, M. musculus
gagaaaggcagagagt

SEQ ID NO: 406113 - DNA, 16 bp, M. musculus
gagaaaggcaggcagg

SEQ ID NO: 406114 - DNA, 16 bp, M. musculus
gagaaaggcctgaagg

SEQ ID NO: 406115 - DNA, 16 bp, M. musculus
gagaaaggctggaaaa

SEQ ID NO: 406116 - DNA, 16 bp, M. musculus
gagaaagggcccaagg

SEQ ID NO: 406117 - DNA, 16 bp, M. musculus
gagaaaggggaattca

SEQ ID NO: 406118 - DNA, 16 bp, M. musculus
gagaaagggtttgttt

SEQ ID NO: 406119 - DNA, 16 bp, M. musculus
gagaaaggtctgaagg

SEQ ID NO: 406120 - DNA, 16 bp, M. musculus
gagaaagtaccatgag

SEQ ID NO: 406121 - DNA, 16 bp, M. musculus
gagaaagtgagctgag

SEQ ID NO: 406122 - DNA, 16 bp, M. musculus
gagaaagttctggaaa

SEQ ID NO: 406123 - DNA, 16 bp, M. musculus
gagaaatagctcagca

SEQ ID NO: 406124 - DNA, 16 bp, M. musculus
gagaaatctgatgtaa

SEQ ID NO: 406125 - DNA, 16 bp, M. musculus
gagaaatgagtgtgtg

SEQ ID NO: 406126 - DNA, 16 bp, M. musculus
gagaaatgcaaaacaa

SEQ ID NO: 406127 - DNA, 16 bp, M. musculus
gagaaatggcccagca

SEQ ID NO: 406128 - DNA, 16 bp, M. musculus
gagaaatggctcagtg

SEQ ID NO: 406129 - DNA, 16 bp, M. musculus
gagaaattaaaatttt

SEQ ID NO: 406130 - DNA, 16 bp, M. musculus
gagaaattaacaacaa

SEQ ID NO: 406131 - DNA, 16 bp, M. musculus
gagaaattgctcagtg

SEQ ID NO: 406132 - DNA, 16 bp, M. musculus
gagaacaaagtgggga

SEQ ID NO: 406133 - DNA, 16 bp, M. musculus
gagaacaactgaggaa

SEQ ID NO: 406134 - DNA, 16 bp, M. musculus
gagaacaagagagctg

SEQ ID NO: 406135 - DNA, 16 bp, M. musculus
gagaacaagtttgatg

SEQ ID NO: 406136 - DNA, 16 bp, M. musculus
gagaacacaaatgaca

SEQ ID NO: 406137 - DNA, 16 bp, M. musculus
gagaacacatggaggg

SEQ ID NO: 406138 - DNA, 16 bp, M. musculus
gagaacagaaagaaat

SEQ ID NO: 406139 - DNA, 16 bp, M. musculus
gagaacagaacagaac

SEQ ID NO: 406140 - DNA, 16 bp, M. musculus
gagaacagacacatgg

SEQ ID NO: 406141 - DNA, 16 bp, M. musculus
gagaacatcatggaag

SEQ ID NO: 406142 - DNA, 16 bp, M. musculus
gagaacatggcccaga

SEQ ID NO: 406143 - DNA, 16 bp, M. musculus
gagaacatttgaaatg

SEQ ID NO: 406144 - DNA, 16 bp, M. musculus
gagaaccaaataacct

SEQ ID NO: 406145 - DNA, 16 bp, M. musculus
gagaaccaactccttc

SEQ ID NO: 406146 - DNA, 16 bp, M. musculus
gagaaccactggccta

SEQ ID NO: 406147 - DNA, 16 bp, M. musculus
gagaaccagcagtctc

SEQ ID NO: 406148 - DNA, 16 bp, M. musculus
gagaaccaggagttca

SEQ ID NO: 406149 - DNA, 16 bp, M. musculus
gagaaccagtcagcaa

SEQ ID NO: 406150 - DNA, 16 bp, M. musculus
gagaaccagtcagcag

SEQ ID NO: 406151 - DNA, 16 bp, M. musculus
gagaacctggaggtca

SEQ ID NO: 406152 - DNA, 16 bp, M. musculus
gagaacctgtctcaaa

SEQ ID NO: 406153 - DNA, 16 bp, M. musculus
gagaaccttctacttc

SEQ ID NO: 406154 - DNA, 16 bp, M. musculus
gagaacgcaaatgcca

SEQ ID NO: 406155 - DNA, 16 bp, M. musculus
gagaactcacaaaaag

SEQ ID NO: 406156 - DNA, 16 bp, M. musculus
gagaactcagctctgg

SEQ ID NO: 406157 - DNA, 16 bp, M. musculus
gagaactctctgttca

SEQ ID NO: 406158 - DNA, 16 bp, M. musculus
gagaactgacttcaca

SEQ ID NO: 406159 - DNA, 16 bp, M. musculus
gagaactgctctttct

SEQ ID NO: 406160 - DNA, 16 bp, M. musculus
gagaactgctgtttta

SEQ ID NO: 406161 - DNA, 16 bp, M. musculus
gagaacttgtctccaa

SEQ ID NO: 406162 - DNA, 16 bp, M. musculus
gagaagaaaaccaaat

SEQ ID NO: 406163 - DNA, 16 bp, M. musculus
gagaagaaagaaatca

SEQ ID NO: 406164 - DNA, 16 bp, M. musculus
gagaagaaagcattca

SEQ ID NO: 406165 - DNA, 16 bp, M. musculus
gagaagaaagggttta

SEQ ID NO: 406166 - DNA, 16 bp, M. musculus
gagaagaacgaagacc

SEQ ID NO: 406167 - DNA, 16 bp, M. musculus
gagaagaagccagaag

SEQ ID NO: 406168 - DNA, 16 bp, M. musculus
gagaagaagctgagaa

SEQ ID NO: 406169 - DNA, 16 bp, M. musculus
gagaagaagctgagag

SEQ ID NO: 406170 - DNA, 16 bp, M. musculus
gagaagaaggtgtatc

SEQ ID NO: 406171 - DNA, 16 bp, M. musculus
gagaagaatctgaccg

SEQ ID NO: 406172 - DNA, 16 bp, M. musculus
gagaagacagagacag

SEQ ID NO: 406173 - DNA, 16 bp, M. musculus
gagaagaccaaacctg

SEQ ID NO: 406174 - DNA, 16 bp, M. musculus
gagaagacctgggaca

SEQ ID NO: 406175 - DNA, 18 bp, M. musculus
gagaagactagagcctgg

SEQ ID NO: 406176 - DNA, 16 bp, M. musculus
gagaagactatttctc

SEQ ID NO: 406177 - DNA, 16 bp, M. musculus
gagaagagactgagaa

SEQ ID NO: 406178 - DNA, 16 bp, M. musculus
gagaagagactgagag

SEQ ID NO: 406179 - DNA, 16 bp, M. musculus
gagaagagcctcaaac

SEQ ID NO: 406180 - DNA, 16 bp, M. musculus
gagaagaggcaggcag

SEQ ID NO: 406181 - DNA, 16 bp, M. musculus
gagaagagggaacctc

SEQ ID NO: 406182 - DNA, 16 bp, M. musculus
gagaagaggggctggg

SEQ ID NO: 406183 - DNA, 16 bp, M. musculus
gagaagagtcccttgg

SEQ ID NO: 406184 - DNA, 16 bp, M. musculus
gagaagagtgtgtgtg

SEQ ID NO: 406185 - DNA, 16 bp, M. musculus
gagaagagtttctgct

SEQ ID NO: 406186 - DNA, 16 bp, M. musculus
gagaagatatcatgag

SEQ ID NO: 406187 - DNA, 16 bp, M. musculus
gagaagatgaagacag

SEQ ID NO: 406188 - DNA, 16 bp, M. musculus
gagaagatgagaatga

SEQ ID NO: 406189 - DNA, 16 bp, M. musculus
gagaagatgcacctaa

SEQ ID NO: 406190 - DNA, 16 bp, M. musculus
gagaagatgctcctaa

SEQ ID NO: 406191 - DNA, 16 bp, M. musculus
gagaagatgctgagag

SEQ ID NO: 406192 - DNA, 16 bp, M. musculus
gagaagatggctcagc

SEQ ID NO: 406193 - DNA, 16 bp, M. musculus
gagaagatggctcagt

SEQ ID NO: 406194 - DNA, 16 bp, M. musculus
gagaagattaaagact

SEQ ID NO: 406195 - DNA, 16 bp, M. musculus
gagaagcacctgaaga

SEQ ID NO: 406196 - DNA, 16 bp, M. musculus
gagaagcactcctcca

SEQ ID NO: 406197 - DNA, 16 bp, M. musculus
gagaagcagaagcagg

SEQ ID NO: 406198 - DNA, 16 bp, M. musculus
gagaagcagaggcagg

SEQ ID NO: 406199 - DNA, 16 bp, M. musculus
gagaagcagcagcagc

SEQ ID NO: 406200 - DNA, 16 bp, M. musculus
gagaagcagctggcag

SEQ ID NO: 406201 - DNA, 16 bp, M. musculus
gagaagcaggcagagg

SEQ ID NO: 406202 - DNA, 16 bp, M. musculus
gagaagccaagagaag

SEQ ID NO: 406203 - DNA, 16 bp, M. musculus
gagaagccacaagtag

SEQ ID NO: 406204 - DNA, 16 bp, M. musculus
gagaagccagagaagg

SEQ ID NO: 406205 - DNA, 16 bp, M. musculus
gagaagccttaatttc

SEQ ID NO: 406206 - DNA, 16 bp, M. musculus
gagaagctagagaaag

SEQ ID NO: 406207 - DNA, 16 bp, M. musculus
gagaagctagggaaag

SEQ ID NO: 406208 - DNA, 16 bp, M. musculus
gagaagctcaagaggg

SEQ ID NO: 406209 - DNA, 16 bp, M. musculus
gagaagctccacccag

SEQ ID NO: 406210 - DNA, 16 bp, M. musculus
gagaagctctgccaga

SEQ ID NO: 406211 - DNA, 16 bp, M. musculus
gagaagctgaagcagg

SEQ ID NO: 406212 - DNA, 16 bp, M. musculus
gagaagctgagagaag

SEQ ID NO: 406213 - DNA, 16 bp, M. musculus
gagaagctgagagaga

SEQ ID NO: 406214 - DNA, 16 bp, M. musculus
gagaagctgaggcaag

SEQ ID NO: 406215 - DNA, 16 bp, M. musculus
gagaagctgaggcagg

SEQ ID NO: 406216 - DNA, 16 bp, M. musculus
gagaagctgagtgaca

SEQ ID NO: 406217 - DNA, 16 bp, M. musculus
gagaagctgagtgtaa

SEQ ID NO: 406218 - DNA, 16 bp, M. musculus
gagaagctgctggccc

SEQ ID NO: 406219 - DNA, 16 bp, M. musculus
gagaagctggagagag

SEQ ID NO: 406220 - DNA, 16 bp, M. musculus
gagaagctggaggaag

SEQ ID NO: 406221 - DNA, 16 bp, M. musculus
gagaagctgggacagg

SEQ ID NO: 406222 - DNA, 16 bp, M. musculus
gagaagctgggggaag

SEQ ID NO: 406223 - DNA, 16 bp, M. musculus
gagaagcttcctcctg

SEQ ID NO: 406224 - DNA, 16 bp, M. musculus
gagaaggaaccagaag

SEQ ID NO: 406225 - DNA, 16 bp, M. musculus
gagaaggaactgagag

SEQ ID NO: 406226 - DNA, 16 bp, M. musculus
gagaaggaagctgaga

SEQ ID NO: 406227 - DNA, 16 bp, M. musculus
gagaaggagaagcagc

SEQ ID NO: 406228 - DNA, 16 bp, M. musculus
gagaaggagcaggagc

SEQ ID NO: 406229 - DNA, 16 bp, M. musculus
gagaaggagccagaaa

SEQ ID NO: 406230 - DNA, 16 bp, M. musculus
gagaaggagctcagag

SEQ ID NO: 406231 - DNA, 16 bp, M. musculus
gagaaggagctgagag

SEQ ID NO: 406232 - DNA, 16 bp, M. musculus
gagaaggatctggtgt

SEQ ID NO: 406233 - DNA, 16 bp, M. musculus
gagaaggcacagtgag

SEQ ID NO: 406234 - DNA, 16 bp, M. musculus
gagaaggcagcccagc

SEQ ID NO: 406235 - DNA, 16 bp, M. musculus
gagaaggcaggcagag

SEQ ID NO: 406236 - DNA, 16 bp, M. musculus
gagaaggctcttcaac

SEQ ID NO: 406237 - DNA, 16 bp, M. musculus
gagaaggctgcccact

SEQ ID NO: 406238 - DNA, 16 bp, M. musculus
gagaaggctgtttctc

SEQ ID NO: 406239 - DNA, 16 bp, M. musculus
gagaagggaagcttat

SEQ ID NO: 406240 - DNA, 16 bp, M. musculus
gagaagggagatcctg

SEQ ID NO: 406241 - DNA, 16 bp, M. musculus
gagaagggcacctggg

SEQ ID NO: 406242 - DNA, 16 bp, M. musculus
gagaaggggaggcctc

SEQ ID NO: 406243 - DNA, 16 bp, M. musculus
gagaaggggctgggcc

SEQ ID NO: 406244 - DNA, 16 bp, M. musculus
gagaagggtctcaaag

SEQ ID NO: 406245 - DNA, 16 bp, M. musculus
gagaagggtgaccctg

SEQ ID NO: 406246 - DNA, 16 bp, M. musculus
gagaagggtgtgtgtg

SEQ ID NO: 406247 - DNA, 16 bp, M. musculus
gagaaggtggactata

SEQ ID NO: 406248 - DNA, 16 bp, M. musculus
gagaaggttctggaaa

SEQ ID NO: 406249 - DNA, 16 bp, M. musculus
gagaagtacctgaaaa

SEQ ID NO: 406250 - DNA, 16 bp, M. musculus
gagaagtagaggcagg

SEQ ID NO: 406251 - DNA, 16 bp, M. musculus
gagaagtcaggacagg

SEQ ID NO: 406252 - DNA, 16 bp, M. musculus
gagaagtcagggcagg

SEQ ID NO: 406253 - DNA, 16 bp, M. musculus
gagaagtctctggatg

SEQ ID NO: 406254 - DNA, 16 bp, M. musculus
gagaagtgttcctctt

SEQ ID NO: 406255 - DNA, 16 bp, M. musculus
gagaagttcagaccaa

SEQ ID NO: 406256 - DNA, 16 bp, M. musculus
gagaagttggagaagg

SEQ ID NO: 406257 - DNA, 16 bp, M. musculus
gagaataaaagacacc

SEQ ID NO: 406258 - DNA, 16 bp, M. musculus
gagaatagattttgct

SEQ ID NO: 406259 - DNA, 16 bp, M. musculus
gagaatatgatcaaaa

SEQ ID NO: 406260 - DNA, 16 bp, M. musculus
gagaatcaggatggac

SEQ ID NO: 406261 - DNA, 16 bp, M. musculus
gagaatcccatggaaa

SEQ ID NO: 406262 - DNA, 16 bp, M. musculus
gagaatctgagttcag

SEQ ID NO: 406263 - DNA, 16 bp, M. musculus
gagaatctggaggcca

SEQ ID NO: 406264 - DNA, 16 bp, M. musculus
gagaatctggatgaaa

SEQ ID NO: 406265 - DNA, 16 bp, M. musculus
gagaatctgtctcaaa

SEQ ID NO: 406266 - DNA, 16 bp, M. musculus
gagaatgaagactgaa

SEQ ID NO: 406267 - DNA, 16 bp, M. musculus
gagaatgaaggcattt

SEQ ID NO: 406268 - DNA, 16 bp, M. musculus
gagaatgagaagaagc

SEQ ID NO: 406269 - DNA, 16 bp, M. musculus
gagaatgccaaagctc

SEQ ID NO: 406270 - DNA, 16 bp, M. musculus
gagaatggctaagata

SEQ ID NO: 406271 - DNA, 16 bp, M. musculus
gagaatgtatgtgtgt

SEQ ID NO: 406272 - DNA, 16 bp, M. musculus
gagaatgtcagatctc

SEQ ID NO: 406273 - DNA, 16 bp, M. musculus
gagaatgtggagaaaa

SEQ ID NO: 406274 - DNA, 16 bp, M. musculus
gagaatgtggggaaaa

SEQ ID NO: 406275 - DNA, 16 bp, M. musculus
gagaatgtgtccttgt

SEQ ID NO: 406276 - DNA, 16 bp, M. musculus
gagaatgtgtgtgtgt

SEQ ID NO: 406277 - DNA, 16 bp, M. musculus
gagaattaaaacttct

SEQ ID NO: 406278 - DNA, 16 bp, M. musculus
gagaattctcaaaaag

SEQ ID NO: 406279 - DNA, 16 bp, M. musculus
gagaattctttattca

SEQ ID NO: 406280 - DNA, 16 bp, M. musculus
gagaattgctctttcc

SEQ ID NO: 406281 - DNA, 61 bp, M. musculus
gagaattggtcctcttgtgaatctcccgctccacctgtagtccccacttcgggaggtgcca

SEQ ID NO: 406282 - DNA, 16 bp, M. musculus
gagaatttcatgtatg

SEQ ID NO: 406283 - DNA, 16 bp, M. musculus
gagaatttctgagttc

SEQ ID NO: 406284 - DNA, 16 bp, M. musculus
gagaatttctttttaa

SEQ ID NO: 406285 - DNA, 16 bp, M. musculus
gagaattttatatatg

SEQ ID NO: 406286 - DNA, 16 bp, M. musculus
gagaattttatatgtg

SEQ ID NO: 406287 - DNA, 18 bp, M. musculus
gagaattttgaagaccca

SEQ ID NO: 406288 - DNA, 16 bp, M. musculus
gagacaaagaatggag

SEQ ID NO: 406289 - DNA, 16 bp, M. musculus
gagacaaagagacaca

SEQ ID NO: 406290 - DNA, 16 bp, M. musculus
gagacaaaggatggac

SEQ ID NO: 406291 - DNA, 16 bp, M. musculus
gagacaaagttggagc

SEQ ID NO: 406292 - DNA, 22 bp, M. musculus
gagacaaagtttggagctgagg

SEQ ID NO: 406293 - DNA, 16 bp, M. musculus
gagacaacatttggag

SEQ ID NO: 406294 - DNA, 16 bp, M. musculus
gagacaacttcctgaa

SEQ ID NO: 406295 - DNA, 16 bp, M. musculus
gagacaacttcttgaa

SEQ ID NO: 406296 - DNA, 16 bp, M. musculus
gagacaagaacaacac

SEQ ID NO: 406297 - DNA, 16 bp, M. musculus
gagacaagagagacag

SEQ ID NO: 406298 - DNA, 16 bp, M. musculus
gagacaagagctctgg

SEQ ID NO: 406299 - DNA, 16 bp, M. musculus
gagacaagatttcact

SEQ ID NO: 406300 - DNA, 16 bp, M. musculus
gagacaagcctgggct

SEQ ID NO: 406301 - DNA, 16 bp, M. musculus
gagacaagctggagta

SEQ ID NO: 406302 - DNA, 16 bp, M. musculus
gagacaaggcctcact

SEQ ID NO: 406303 - DNA, 16 bp, M. musculus
gagacaaggtctctct

SEQ ID NO: 406304 - DNA, 16 bp, M. musculus
gagacaaggtcttcct

SEQ ID NO: 406305 - DNA, 16 bp, M. musculus
gagacaaggttttact

SEQ ID NO: 406306 - DNA, 16 bp, M. musculus
gagacaagttgtagag

SEQ ID NO: 406307 - DNA, 16 bp, M. musculus
gagacacaagctcttg

SEQ ID NO: 406308 - DNA, 16 bp, M. musculus
gagacacacagagaca

SEQ ID NO: 406309 - DNA, 16 bp, M. musculus
gagacacacagagaga

SEQ ID NO: 406310 - DNA, 16 bp, M. musculus
gagacacaccctgtag

SEQ ID NO: 406311 - DNA, 16 bp, M. musculus
gagacacacctctggg

SEQ ID NO: 406312 - DNA, 16 bp, M. musculus
gagacacagacataca

SEQ ID NO: 406313 - DNA, 16 bp, M. musculus
gagacacagagaaaat

SEQ ID NO: 406314 - DNA, 16 bp, M. musculus
gagacacagagatgca

SEQ ID NO: 406315 - DNA, 16 bp, M. musculus
gagacacagctctgtg

SEQ ID NO: 406316 - DNA, 16 bp, M. musculus
gagacacagctcttgg

SEQ ID NO: 406317 - DNA, 16 bp, M. musculus
gagacacatgaggata

SEQ ID NO: 406318 - DNA, 16 bp, M. musculus
gagacacatttttttt

SEQ ID NO: 406319 - DNA, 16 bp, M. musculus
gagacaccaggaccaa

SEQ ID NO: 406320 - DNA, 16 bp, M. musculus
gagacaccatgaccac

SEQ ID NO: 406321 - DNA, 16 bp, M. musculus
gagacaccatgactgt

SEQ ID NO: 406322 - DNA, 16 bp, M. musculus
gagacactatctcaaa

SEQ ID NO: 406323 - DNA, 16 bp, M. musculus
gagacactgagcctgg

SEQ ID NO: 406324 - DNA, 16 bp, M. musculus
gagacagaaacagata

SEQ ID NO: 406325 - DNA, 16 bp, M. musculus
gagacagaaagagtgt

SEQ ID NO: 406326 - DNA, 16 bp, M. musculus
gagacagaagacagag

SEQ ID NO: 406327 - DNA, 16 bp, M. musculus
gagacagaagcagcag

SEQ ID NO: 406328 - DNA, 16 bp, M. musculus
gagacagaatctctct

SEQ ID NO: 406329 - DNA, 16 bp, M. musculus
gagacagacaagagag

SEQ ID NO: 406330 - DNA, 16 bp, M. musculus
gagacagacacacaga

SEQ ID NO: 406331 - DNA, 16 bp, M. musculus
gagacagacacagaca

SEQ ID NO: 406332 - DNA, 16 bp, M. musculus
gagacagacagaaaca

SEQ ID NO: 406333 - DNA, 16 bp, M. musculus
gagacagacagaggag

SEQ ID NO: 406334 - DNA, 16 bp, M. musculus
gagacagacaggaaga

SEQ ID NO: 406335 - DNA, 16 bp, M. musculus
gagacagacatgtaga

SEQ ID NO: 406336 - DNA, 16 bp, M. musculus
gagacagagaagacag

SEQ ID NO: 406337 - DNA, 16 bp, M. musculus
gagacagagaaggaca

SEQ ID NO: 406338 - DNA, 16 bp, M. musculus
gagacagagaatcaga

SEQ ID NO: 406339 - DNA, 16 bp, M. musculus
gagacagagaatgaga

SEQ ID NO: 406340 - DNA, 16 bp, M. musculus
gagacagagacaagag

SEQ ID NO: 406341 - DNA, 16 bp, M. musculus
gagacagagacagagg

SEQ ID NO: 406342 - DNA, 16 bp, M. musculus
gagacagagagaaaat

SEQ ID NO: 406343 - DNA, 16 bp, M. musculus
gagacagagagaaatg

SEQ ID NO: 406344 - DNA, 16 bp, M. musculus
gagacagagagaataa

SEQ ID NO: 406345 - DNA, 16 bp, M. musculus
gagacagagagacata

SEQ ID NO: 406346 - DNA, 16 bp, M. musculus
gagacagagagagagt

SEQ ID NO: 406347 - DNA, 16 bp, M. musculus
gagacagagagagcca

SEQ ID NO: 406348 - DNA, 16 bp, M. musculus
gagacagagaggtcaa

SEQ ID NO: 406349 - DNA, 16 bp, M. musculus
gagacagagatgcaga

SEQ ID NO: 406350 - DNA, 16 bp, M. musculus
gagacagagcctctca

SEQ ID NO: 406351 - DNA, 16 bp, M. musculus
gagacagagcctgagc

SEQ ID NO: 406352 - DNA, 16 bp, M. musculus
gagacagagctctggg

SEQ ID NO: 406353 - DNA, 16 bp, M. musculus
gagacagaggaagaca

SEQ ID NO: 406354 - DNA, 16 bp, M. musculus
gagacagaggcaagca

SEQ ID NO: 406355 - DNA, 16 bp, M. musculus
gagacagaggcagagg

SEQ ID NO: 406356 - DNA, 16 bp, M. musculus
gagacagaggcagatg

SEQ ID NO: 406357 - DNA, 16 bp, M. musculus
gagacagaggcaggac

SEQ ID NO: 406358 - DNA, 16 bp, M. musculus
gagacagagtctcttg

SEQ ID NO: 406359 - DNA, 16 bp, M. musculus
gagacagagtttctgt

SEQ ID NO: 406360 - DNA, 16 bp, M. musculus
gagacagagtttggag

SEQ ID NO: 406361 - DNA, 16 bp, M. musculus
gagacagatctctgag

SEQ ID NO: 406362 - DNA, 16 bp, M. musculus
gagacagatgaagata

SEQ ID NO: 406363 - DNA, 16 bp, M. musculus
gagacagatggagaga

SEQ ID NO: 406364 - DNA, 16 bp, M. musculus
gagacagcaagggaag

SEQ ID NO: 406365 - DNA, 16 bp, M. musculus
gagacagcaataccag

SEQ ID NO: 406366 - DNA, 16 bp, M. musculus
gagacagcacaagtcc

SEQ ID NO: 406367 - DNA, 16 bp, M. musculus
gagacagcagatgctg

SEQ ID NO: 406368 - DNA, 16 bp, M. musculus
gagacagcatctcact

SEQ ID NO: 406369 - DNA, 16 bp, M. musculus
gagacagccatatcag

SEQ ID NO: 406370 - DNA, 16 bp, M. musculus
gagacagccattgctg

SEQ ID NO: 406371 - DNA, 16 bp, M. musculus
gagacagccctggaga

SEQ ID NO: 406372 - DNA, 16 bp, M. musculus
gagacagctacagtgt

SEQ ID NO: 406373 - DNA, 16 bp, M. musculus
gagacagctataacag

SEQ ID NO: 406374 - DNA, 16 bp, M. musculus
gagacagctatatcag

SEQ ID NO: 406375 - DNA, 16 bp, M. musculus
gagacagctcagtcag

SEQ ID NO: 406376 - DNA, 16 bp, M. musculus
gagacagctctctctc

SEQ ID NO: 406377 - DNA, 16 bp, M. musculus
gagacagctgtaccag

SEQ ID NO: 406378 - DNA, 16 bp, M. musculus
gagacagcttcctgaa

SEQ ID NO: 406379 - DNA, 16 bp, M. musculus
gagacaggaaaaccct

SEQ ID NO: 406380 - DNA, 16 bp, M. musculus
gagacaggaactcact

SEQ ID NO: 406381 - DNA, 16 bp, M. musculus
gagacaggaactgaag

SEQ ID NO: 406382 - DNA, 16 bp, M. musculus
gagacaggactcagag

SEQ ID NO: 406383 - DNA, 16 bp, M. musculus
gagacaggagagaaac

SEQ ID NO: 406384 - DNA, 16 bp, M. musculus
gagacaggaggattcc

SEQ ID NO: 406385 - DNA, 16 bp, M. musculus
gagacaggatctctgg

SEQ ID NO: 406386 - DNA, 16 bp, M. musculus
gagacaggatttctcc

SEQ ID NO: 406387 - DNA, 16 bp, M. musculus
gagacaggcaaatccc

SEQ ID NO: 406388 - DNA, 16 bp, M. musculus
gagacaggcacagaga

SEQ ID NO: 406389 - DNA, 16 bp, M. musculus
gagacaggcagagaaa

SEQ ID NO: 406390 - DNA, 16 bp, M. musculus
gagacaggccctgttt

SEQ ID NO: 406391 - DNA, 16 bp, M. musculus
gagacaggctgcagag

SEQ ID NO: 406392 - DNA, 16 bp, M. musculus
gagacagggaaacaga

SEQ ID NO: 406393 - DNA, 16 bp, M. musculus
gagacagggacagaga

SEQ ID NO: 406394 - DNA, 16 bp, M. musculus
gagacagggacaggga

SEQ ID NO: 406395 - DNA, 16 bp, M. musculus
gagacagggggatttc

SEQ ID NO: 406396 - DNA, 16 bp, M. musculus
gagacaggggttctct

SEQ ID NO: 406397 - DNA, 16 bp, M. musculus
gagacagggtctcaca

SEQ ID NO: 406398 - DNA, 16 bp, M. musculus
gagacagggtctcatt

SEQ ID NO: 406399 - DNA, 16 bp, M. musculus
gagacagggtctccct

SEQ ID NO: 406400 - DNA, 16 bp, M. musculus
gagacagggtctgact

SEQ ID NO: 406401 - DNA, 16 bp, M. musculus
gagacagggtcttgct

SEQ ID NO: 406402 - DNA, 16 bp, M. musculus
gagacagggttgctct

SEQ ID NO: 406403 - DNA, 16 bp, M. musculus
gagacagggtttctat

SEQ ID NO: 406404 - DNA, 16 bp, M. musculus
gagacagggtttctca

SEQ ID NO: 406405 - DNA, 16 bp, M. musculus
gagacagggtttctcc

SEQ ID NO: 406406 - DNA, 18 bp, M. musculus
gagacagggtttctctgg

SEQ ID NO: 406407 - DNA, 17 bp, M. musculus
gagacaggtggatctct

SEQ ID NO: 406408 - DNA, 16 bp, M. musculus
gagacagtccctgctc

SEQ ID NO: 406409 - DNA, 16 bp, M. musculus
gagacagtgagacaga

SEQ ID NO: 406410 - DNA, 16 bp, M. musculus
gagacagtgggcagcc

SEQ ID NO: 406411 - DNA, 16 bp, M. musculus
gagacagtttcctgaa

SEQ ID NO: 406412 - DNA, 16 bp, M. musculus
gagacatagtttctct

SEQ ID NO: 406413 - DNA, 16 bp, M. musculus
gagacatcaacccacc

SEQ ID NO: 406414 - DNA, 16 bp, M. musculus
gagacatccctccagc

SEQ ID NO: 406415 - DNA, 16 bp, M. musculus
gagacatgagctctga

SEQ ID NO: 406416 - DNA, 16 bp, M. musculus
gagacatggctcagtg

SEQ ID NO: 406417 - DNA, 16 bp, M. musculus
gagacatgggtccctc

SEQ ID NO: 406418 - DNA, 16 bp, M. musculus
gagacatgtcattttt

SEQ ID NO: 406419 - DNA, 16 bp, M. musculus
gagacattttctcaac

SEQ ID NO: 406420 - DNA, 16 bp, M. musculus
gagacatttttaaaag

SEQ ID NO: 406421 - DNA, 16 bp, M. musculus
gagaccaagacaaaga

SEQ ID NO: 406422 - DNA, 16 bp, M. musculus
gagaccaagcaaagag

SEQ ID NO: 406423 - DNA, 16 bp, M. musculus
gagaccacagatgcca

SEQ ID NO: 406424 - DNA, 16 bp, M. musculus
gagaccacctccagca

SEQ ID NO: 406425 - DNA, 16 bp, M. musculus
gagaccacctggggtg

SEQ ID NO: 406426 - DNA, 16 bp, M. musculus
gagaccagaagatggc

SEQ ID NO: 406427 - DNA, 16 bp, M. musculus
gagaccagacaagaca

SEQ ID NO: 406428 - DNA, 16 bp, M. musculus
gagaccagagaacaac

SEQ ID NO: 406429 - DNA, 16 bp, M. musculus
gagaccagcctagtct

SEQ ID NO: 406430 - DNA, 16 bp, M. musculus
gagaccagcctgttct

SEQ ID NO: 406431 - DNA, 16 bp, M. musculus
gagaccagcttgggct

SEQ ID NO: 406432 - DNA, 16 bp, M. musculus
gagaccaggctggcct

SEQ ID NO: 406433 - DNA, 16 bp, M. musculus
gagaccatcacagaaa

SEQ ID NO: 406434 - DNA, 16 bp, M. musculus
gagaccatgctgaggt

SEQ ID NO: 406435 - DNA, 16 bp, M. musculus
gagaccatgtcttaaa

SEQ ID NO: 406436 - DNA, 16 bp, M. musculus
gagaccattacagaaa

SEQ ID NO: 406437 - DNA, 16 bp, M. musculus
gagacccacagccaca

SEQ ID NO: 406438 - DNA, 16 bp, M. musculus
gagacccagagagcag

SEQ ID NO: 406439 - DNA, 16 bp, M. musculus
gagacccctctgtacc

SEQ ID NO: 406440 - DNA, 16 bp, M. musculus
gagacccctgcccagg

SEQ ID NO: 406441 - DNA, 17 bp, M. musculus
gagaccccttagaactt

SEQ ID NO: 406442 - DNA, 16 bp, M. musculus
gagaccctatcccaaa

SEQ ID NO: 406443 - DNA, 16 bp, M. musculus
gagaccctatctcaac

SEQ ID NO: 406444 - DNA, 16 bp, M. musculus
gagaccctatttcaaa

SEQ ID NO: 406445 - DNA, 16 bp, M. musculus
gagaccctcactgcct

SEQ ID NO: 406446 - DNA, 16 bp, M. musculus
gagaccctcctcctgg

SEQ ID NO: 406447 - DNA, 16 bp, M. musculus
gagaccctgagttcaa

SEQ ID NO: 406448 - DNA, 16 bp, M. musculus
gagaccctgattccca

SEQ ID NO: 406449 - DNA, 16 bp, M. musculus
gagaccctgccacaaa

SEQ ID NO: 406450 - DNA, 16 bp, M. musculus
gagaccctgcttcaaa

SEQ ID NO: 406451 - DNA, 16 bp, M. musculus
gagaccctggctcaaa

SEQ ID NO: 406452 - DNA, 16 bp, M. musculus
gagaccctggctcaga

SEQ ID NO: 406453 - DNA, 16 bp, M. musculus
gagaccctgtcataaa

SEQ ID NO: 406454 - DNA, 16 bp, M. musculus
gagaccctgtccccaa

SEQ ID NO: 406455 - DNA, 16 bp, M. musculus
gagaccctgtctaaaa

SEQ ID NO: 406456 - DNA, 16 bp, M. musculus
gagaccctgtctcaaa

SEQ ID NO: 406457 - DNA, 16 bp, M. musculus
gagaccctgtctcagg

SEQ ID NO: 406458 - DNA, 16 bp, M. musculus
gagaccctgtctgaaa

SEQ ID NO: 406459 - DNA, 16 bp, M. musculus
gagaccctgtcttcaa

SEQ ID NO: 406460 - DNA, 16 bp, M. musculus
gagaccctgtgtcaga

SEQ ID NO: 406461 - DNA, 16 bp, M. musculus
gagaccctgtttcaaa

SEQ ID NO: 406462 - DNA, 16 bp, M. musculus
gagaccgtgggttcga

SEQ ID NO: 406463 - DNA, 16 bp, M. musculus
gagacctcaaagccag

SEQ ID NO: 406464 - DNA, 16 bp, M. musculus
gagacctctgagttca

SEQ ID NO: 406465 - DNA, 16 bp, M. musculus
gagacctgcctgcttc

SEQ ID NO: 406466 - DNA, 16 bp, M. musculus
gagacctgctcttttc

SEQ ID NO: 406467 - DNA, 16 bp, M. musculus
gagacctgtctcaaaa

SEQ ID NO: 406468 - DNA, 16 bp, M. musculus
gagaccttgataggaa

SEQ ID NO: 406469 - DNA, 16 bp, M. musculus
gagaccttgcctcaat

SEQ ID NO: 406470 - DNA, 16 bp, M. musculus
gagaccttgcttcaaa

SEQ ID NO: 406471 - DNA, 16 bp, M. musculus
gagaccttgtcacaaa

SEQ ID NO: 406472 - DNA, 16 bp, M. musculus
gagaccttgtctaaaa

SEQ ID NO: 406473 - DNA, 16 bp, M. musculus
gagaccttgtctcaga

SEQ ID NO: 406474 - DNA, 16 bp, M. musculus
gagacggagacagaga

SEQ ID NO: 406475 - DNA, 16 bp, M. musculus
gagactaaagaaatga

SEQ ID NO: 406476 - DNA, 16 bp, M. musculus
gagactagaagagggc

SEQ ID NO: 406477 - DNA, 16 bp, M. musculus
gagactaggcaggggc

SEQ ID NO: 406478 - DNA, 16 bp, M. musculus
gagactatctcaaaaa

SEQ ID NO: 406479 - DNA, 16 bp, M. musculus
gagactatgaaatcca

SEQ ID NO: 406480 - DNA, 16 bp, M. musculus
gagactatgccaatgc

SEQ ID NO: 406481 - DNA, 32 bp, M. musculus
gagactcaatttccataaaatgcttaagtaag

SEQ ID NO: 406482 - DNA, 16 bp, M. musculus
gagactcacattaatt

SEQ ID NO: 406483 - DNA, 16 bp, M. musculus
gagactcagaagagag

SEQ ID NO: 406484 - DNA, 16 bp, M. musculus
gagactcaggagagaa

SEQ ID NO: 406485 - DNA, 16 bp, M. musculus
gagactcccttgagga

SEQ ID NO: 406486 - DNA, 16 bp, M. musculus
gagactcctggtcctc

SEQ ID NO: 406487 - DNA, 16 bp, M. musculus
gagactctaaaaacca

SEQ ID NO: 406488 - DNA, 16 bp, M. musculus
gagactctaaaagcca

SEQ ID NO: 406489 - DNA, 16 bp, M. musculus
gagactctcaggaccc

SEQ ID NO: 406490 - DNA, 16 bp, M. musculus
gagactctctcttcca

SEQ ID NO: 406491 - DNA, 16 bp, M. musculus
gagactctgcctcaaa

SEQ ID NO: 406492 - DNA, 16 bp, M. musculus
gagactctgctggcaa

SEQ ID NO: 406493 - DNA, 16 bp, M. musculus
gagactctgcttcaaa

SEQ ID NO: 406494 - DNA, 16 bp, M. musculus
gagactctggctcaaa

SEQ ID NO: 406495 - DNA, 16 bp, M. musculus
gagactctgggcctgg

SEQ ID NO: 406496 - DNA, 16 bp, M. musculus
gagactctgtcacaaa

SEQ ID NO: 406497 - DNA, 16 bp, M. musculus
gagactctgtctcaca

SEQ ID NO: 406498 - DNA, 16 bp, M. musculus
gagactgaagcagcag

SEQ ID NO: 406499 - DNA, 16 bp, M. musculus
gagactgaagcaggag

SEQ ID NO: 406500 - DNA, 16 bp, M. musculus
gagactgagccaccaa

SEQ ID NO: 406501 - DNA, 16 bp, M. musculus
gagactgagctgcaca

SEQ ID NO: 406502 - DNA, 16 bp, M. musculus
gagactgaggaaatgg

SEQ ID NO: 406503 - DNA, 16 bp, M. musculus
gagactgaggaaggag

SEQ ID NO: 406504 - DNA, 16 bp, M. musculus
gagactgaggctggag

SEQ ID NO: 406505 - DNA, 16 bp, M. musculus
gagactgccccacctt

SEQ ID NO: 406506 - DNA, 16 bp, M. musculus
gagactgctctgacca

SEQ ID NO: 406507 - DNA, 16 bp, M. musculus
gagactgctgctcttc

SEQ ID NO: 406508 - DNA, 16 bp, M. musculus
gagactggaggcccag

SEQ ID NO: 406509 - DNA, 16 bp, M. musculus
gagactgggaagagag

SEQ ID NO: 406510 - DNA, 16 bp, M. musculus
gagactgggcctggct

SEQ ID NO: 406511 - DNA, 16 bp, M. musculus
gagactggggtgttga

SEQ ID NO: 406512 - DNA, 16 bp, M. musculus
gagactgtctcaaaaa

SEQ ID NO: 406513 - DNA, 16 bp, M. musculus
gagactgtctcaaaac

SEQ ID NO: 406514 - DNA, 16 bp, M. musculus
gagactgtgaaagact

SEQ ID NO: 406515 - DNA, 16 bp, M. musculus
gagactgtgcctcaaa

SEQ ID NO: 406516 - DNA, 16 bp, M. musculus
gagactgtggaaactg

SEQ ID NO: 406517 - DNA, 16 bp, M. musculus
gagactgtggcaacat

SEQ ID NO: 406518 - DNA, 16 bp, M. musculus
gagactgtgttccaga

SEQ ID NO: 406519 - DNA, 16 bp, M. musculus
gagacttaaaattctt

SEQ ID NO: 406520 - DNA, 16 bp, M. musculus
gagacttacaaaaggc

SEQ ID NO: 406521 - DNA, 16 bp, M. musculus
gagacttcctcttgga

SEQ ID NO: 406522 - DNA, 16 bp, M. musculus
gagagaaaaaatattg

SEQ ID NO: 406523 - DNA, 16 bp, M. musculus
gagagaaaatgcacct

SEQ ID NO: 406524 - DNA, 16 bp, M. musculus
gagagaaacagacaca

SEQ ID NO: 406525 - DNA, 16 bp, M. musculus
gagagaaaccctgtct

SEQ ID NO: 406526 - DNA, 16 bp, M. musculus
gagagaaagaaagtgt

SEQ ID NO: 406527 - DNA, 16 bp, M. musculus
gagagaaagagagacc

SEQ ID NO: 406528 - DNA, 16 bp, M. musculus
gagagaaagcaagctg

SEQ ID NO: 406529 - DNA, 16 bp, M. musculus
gagagaaataatggag

SEQ ID NO: 406530 - DNA, 16 bp, M. musculus
gagagaaatagacaga

SEQ ID NO: 406531 - DNA, 16 bp, M. musculus
gagagaaccaacttca

SEQ ID NO: 406532 - DNA, 16 bp, M. musculus
gagagaactgactcta

SEQ ID NO: 406533 - DNA, 16 bp, M. musculus
gagagaactgacttct

SEQ ID NO: 406534 - DNA, 16 bp, M. musculus
gagagaactgattctc

SEQ ID NO: 406535 - DNA, 16 bp, M. musculus
gagagaagaaaagcta

SEQ ID NO: 406536 - DNA, 16 bp, M. musculus
gagagaagaatctatt

SEQ ID NO: 406537 - DNA, 16 bp, M. musculus
gagagaagcaggagca

SEQ ID NO: 406538 - DNA, 16 bp, M. musculus
gagagaagcccagagg

SEQ ID NO: 406539 - DNA, 16 bp, M. musculus
gagagaagctgaggag

SEQ ID NO: 406540 - DNA, 16 bp, M. musculus
gagagaagctggaagc

SEQ ID NO: 406541 - DNA, 16 bp, M. musculus
gagagaagctggattg

SEQ ID NO: 406542 - DNA, 16 bp, M. musculus
gagagaagtaatggag

SEQ ID NO: 406543 - DNA, 16 bp, M. musculus
gagagaagtgagaggt

SEQ ID NO: 406544 - DNA, 16 bp, M. musculus
gagagaatcagagaga

SEQ ID NO: 406545 - DNA, 16 bp, M. musculus
gagagaatgtgtatgt

SEQ ID NO: 406546 - DNA, 16 bp, M. musculus
gagagaatgttttgct

SEQ ID NO: 406547 - DNA, 16 bp, M. musculus
gagagaattctgggaa

SEQ ID NO: 406548 - DNA, 16 bp, M. musculus
gagagacaaaggcaga

SEQ ID NO: 406549 - DNA, 16 bp, M. musculus
gagagacacagagaag

SEQ ID NO: 406550 - DNA, 16 bp, M. musculus
gagagacacagagagg

SEQ ID NO: 406551 - DNA, 16 bp, M. musculus
gagagacacatagaga

SEQ ID NO: 406552 - DNA, 17 bp, M. musculus
gagagacagacagagag

SEQ ID NO: 406553 - DNA, 16 bp, M. musculus
gagagacagagacagg

SEQ ID NO: 406554 - DNA, 16 bp, M. musculus
gagagacagagagcac

SEQ ID NO: 406555 - DNA, 16 bp, M. musculus
gagagacagagcctga

SEQ ID NO: 406556 - DNA, 16 bp, M. musculus
gagagacagaggtggg

SEQ ID NO: 406557 - DNA, 16 bp, M. musculus
gagagacagctatatc

SEQ ID NO: 406558 - DNA, 16 bp, M. musculus
gagagacagctcaggg

SEQ ID NO: 406559 - DNA, 16 bp, M. musculus
gagagacagctcagtg

SEQ ID NO: 406560 - DNA, 16 bp, M. musculus
gagagacagctctgtg

SEQ ID NO: 406561 - DNA, 16 bp, M. musculus
gagagacaggcaggca

SEQ ID NO: 406562 - DNA, 16 bp, M. musculus
gagagacaggtagatc

SEQ ID NO: 406563 - DNA, 16 bp, M. musculus
gagagacagtccttgg

SEQ ID NO: 406564 - DNA, 16 bp, M. musculus
gagagacccagtctca

SEQ ID NO: 406565 - DNA, 16 bp, M. musculus
gagagaccctacctca

SEQ ID NO: 406566 - DNA, 16 bp, M. musculus
gagagaccctgccaga

SEQ ID NO: 406567 - DNA, 16 bp, M. musculus
gagagaccctgtctcg

SEQ ID NO: 406568 - DNA, 16 bp, M. musculus
gagagaccctgtcttt

SEQ ID NO: 406569 - DNA, 16 bp, M. musculus
gagagacctcatctca

SEQ ID NO: 406570 - DNA, 16 bp, M. musculus
gagagacctgactcct

SEQ ID NO: 406571 - DNA, 16 bp, M. musculus
gagagaccttcctcct

SEQ ID NO: 406572 - DNA, 16 bp, M. musculus
gagagaccttgtcaca

SEQ ID NO: 406573 - DNA, 33 bp, M. musculus
gagagactcaatttccataaaatgcttaagtaa

SEQ ID NO: 406574 - DNA, 16 bp, M. musculus
gagagactctgcctca

SEQ ID NO: 406575 - DNA, 16 bp, M. musculus
gagagactctgggctt

SEQ ID NO: 406576 - DNA, 16 bp, M. musculus
gagagactgggaggag

SEQ ID NO: 406577 - DNA, 16 bp, M. musculus
gagagagaaatggagc

SEQ ID NO: 406578 - DNA, 16 bp, M. musculus
gagagagaacatgcag

SEQ ID NO: 406579 - DNA, 16 bp, M. musculus
gagagagaactgagaa

SEQ ID NO: 406580 - DNA, 16 bp, M. musculus
gagagagaagcacaga

SEQ ID NO: 406581 - DNA, 16 bp, M. musculus
gagagagaagcaggca

SEQ ID NO: 406582 - DNA, 16 bp, M. musculus
gagagagaagctgaga

SEQ ID NO: 406583 - DNA, 16 bp, M. musculus
gagagagaatatgaac

SEQ ID NO: 406584 - DNA, 16 bp, M. musculus
gagagagaatgaatct

SEQ ID NO: 406585 - DNA, 16 bp, M. musculus
gagagagacacacaca

SEQ ID NO: 406586 - DNA, 16 bp, M. musculus
gagagagacacagaga

SEQ ID NO: 406587 - DNA, 16 bp, M. musculus
gagagagacagagaca

SEQ ID NO: 406588 - DNA, 16 bp, M. musculus
gagagagacagtgaca

SEQ ID NO: 406589 - DNA, 16 bp, M. musculus
gagagagaccggccat

SEQ ID NO: 406590 - DNA, 37 bp, M. musculus
gagagagactcaatttccataaaatgcttaagtaaga

SEQ ID NO: 406591 - DNA, 16 bp, M. musculus
gagagagactcagaga

SEQ ID NO: 406592 - DNA, 16 bp, M. musculus
gagagagagaaaactt

SEQ ID NO: 406593 - DNA, 16 bp, M. musculus
gagagagagaaaagct

SEQ ID NO: 406594 - DNA, 16 bp, M. musculus
gagagagagaaaatgt

SEQ ID NO: 406595 - DNA, 16 bp, M. musculus
gagagagagaaaccag

SEQ ID NO: 406596 - DNA, 16 bp, M. musculus
gagagagagaaactca

SEQ ID NO: 406597 - DNA, 16 bp, M. musculus
gagagagagaaactga

SEQ ID NO: 406598 - DNA, 16 bp, M. musculus
gagagagagaaacttc

SEQ ID NO: 406599 - DNA, 16 bp, M. musculus
gagagagagaaaggct

SEQ ID NO: 406600 - DNA, 16 bp, M. musculus
gagagagagaaatgtc

SEQ ID NO: 406601 - DNA, 16 bp, M. musculus
gagagagagaacaacc

SEQ ID NO: 406602 - DNA, 16 bp, M. musculus
gagagagagaacatcc

SEQ ID NO: 406603 - DNA, 16 bp, M. musculus
gagagagagaacatct

SEQ ID NO: 406604 - DNA, 16 bp, M. musculus
gagagagagaacgagc

SEQ ID NO: 406605 - DNA, 16 bp, M. musculus
gagagagagaacgcac

SEQ ID NO: 406606 - DNA, 16 bp, M. musculus
gagagagagaactaac

SEQ ID NO: 406607 - DNA, 16 bp, M. musculus
gagagagagaagagct

SEQ ID NO: 406608 - DNA, 16 bp, M. musculus
gagagagagaagatca

SEQ ID NO: 406609 - DNA, 16 bp, M. musculus
gagagagagaagctgg

SEQ ID NO: 406610 - DNA, 16 bp, M. musculus
gagagagagaatatgg

SEQ ID NO: 406611 - DNA, 16 bp, M. musculus
gagagagagaatattt

SEQ ID NO: 406612 - DNA, 16 bp, M. musculus
gagagagagaatctca

SEQ ID NO: 406613 - DNA, 16 bp, M. musculus
gagagagagaatgaac

SEQ ID NO: 406614 - DNA, 16 bp, M. musculus
gagagagagaatgcag

SEQ ID NO: 406615 - DNA, 16 bp, M. musculus
gagagagagaatgttt

SEQ ID NO: 406616 - DNA, 16 bp, M. musculus
gagagagagaattcca

SEQ ID NO: 406617 - DNA, 16 bp, M. musculus
gagagagagaccagag

SEQ ID NO: 406618 - DNA, 16 bp, M. musculus
gagagagagactcaga

SEQ ID NO: 406619 - DNA, 16 bp, M. musculus
gagagagagactgggc

SEQ ID NO: 406620 - DNA, 16 bp, M. musculus
gagagagagactgggg

SEQ ID NO: 406621 - DNA, 16 bp, M. musculus
gagagagagagaaatt

SEQ ID NO: 406622 - DNA, 16 bp, M. musculus
gagagagagagaagcc

SEQ ID NO: 406623 - DNA, 16 bp, M. musculus
gagagagagagacata

SEQ ID NO: 406624 - DNA, 16 bp, M. musculus
gagagagagagacttg

SEQ ID NO: 406625 - DNA, 16 bp, M. musculus
gagagagagagagact

SEQ ID NO: 406626 - DNA, 18 bp, M. musculus
gagagagagagagatctt

SEQ ID NO: 406627 - DNA, 16 bp, M. musculus
gagagagagagagcac

SEQ ID NO: 406628 - DNA, 16 bp, M. musculus
gagagagagagagcca

SEQ ID NO: 406629 - DNA, 16 bp, M. musculus
gagagagagagagccc

SEQ ID NO: 406630 - DNA, 16 bp, M. musculus
gagagagagagagcta

SEQ ID NO: 406631 - DNA, 16 bp, M. musculus
gagagagagagaggcc

SEQ ID NO: 406632 - DNA, 16 bp, M. musculus
gagagagagagaggtc

SEQ ID NO: 406633 - DNA, 16 bp, M. musculus
gagagagagagatcag

SEQ ID NO: 406634 - DNA, 16 bp, M. musculus
gagagagagagatgct

SEQ ID NO: 406635 - DNA, 16 bp, M. musculus
gagagagagagatggc

SEQ ID NO: 406636 - DNA, 16 bp, M. musculus
gagagagagagattat

SEQ ID NO: 406637 - DNA, 16 bp, M. musculus
gagagagagagattca

SEQ ID NO: 406638 - DNA, 17 bp, M. musculus
gagagagagagattgag

SEQ ID NO: 406639 - DNA, 16 bp, M. musculus
gagagagagagatttg

SEQ ID NO: 406640 - DNA, 16 bp, M. musculus
gagagagagagcaagc

SEQ ID NO: 406641 - DNA, 16 bp, M. musculus
gagagagagagcacac

SEQ ID NO: 406642 - DNA, 16 bp, M. musculus
gagagagagagcacat

SEQ ID NO: 406643 - DNA, 16 bp, M. musculus
gagagagagagcacga

SEQ ID NO: 406644 - DNA, 16 bp, M. musculus
gagagagagagcagac

SEQ ID NO: 406645 - DNA, 16 bp, M. musculus
gagagagagagcatgc

SEQ ID NO: 406646 - DNA, 16 bp, M. musculus
gagagagagagcatgg

SEQ ID NO: 406647 - DNA, 16 bp, M. musculus
gagagagagagccagg

SEQ ID NO: 406648 - DNA, 16 bp, M. musculus
gagagagagagcctgg

SEQ ID NO: 406649 - DNA, 16 bp, M. musculus
gagagagagagcgcga

SEQ ID NO: 406650 - DNA, 16 bp, M. musculus
gagagagagagctccc

SEQ ID NO: 406651 - DNA, 16 bp, M. musculus
gagagagagaggatgc

SEQ ID NO: 406652 - DNA, 16 bp, M. musculus
gagagagagaggctag

SEQ ID NO: 406653 - DNA, 16 bp, M. musculus
gagagagagaggctgg

SEQ ID NO: 406654 - DNA, 16 bp, M. musculus
gagagagagaggttga

SEQ ID NO: 406655 - DNA, 16 bp, M. musculus
gagagagagagtgagt

SEQ ID NO: 406656 - DNA, 16 bp, M. musculus
gagagagagagtgtga

SEQ ID NO: 406657 - DNA, 16 bp, M. musculus
gagagagagagtgttt

SEQ ID NO: 406658 - DNA, 16 bp, M. musculus
gagagagagatctaaa

SEQ ID NO: 406659 - DNA, 16 bp, M. musculus
gagagagagatggaca

SEQ ID NO: 406660 - DNA, 16 bp, M. musculus
gagagagagatggcag

SEQ ID NO: 406661 - DNA, 16 bp, M. musculus
gagagagagatttcca

SEQ ID NO: 406662 - DNA, 16 bp, M. musculus
gagagagagatttgat

SEQ ID NO: 406663 - DNA, 16 bp, M. musculus
gagagagagcaagcat

SEQ ID NO: 406664 - DNA, 16 bp, M. musculus
gagagagagcgagagc

SEQ ID NO: 406665 - DNA, 16 bp, M. musculus
gagagagagcgagctg

SEQ ID NO: 406666 - DNA, 16 bp, M. musculus
gagagagagcgagctt

SEQ ID NO: 406667 - DNA, 16 bp, M. musculus
gagagagagctgagag

SEQ ID NO: 406668 - DNA, 16 bp, M. musculus
gagagagaggagagct

SEQ ID NO: 406669 - DNA, 16 bp, M. musculus
gagagagagtatgaga

SEQ ID NO: 406670 - DNA, 16 bp, M. musculus
gagagagattgagaaa

SEQ ID NO: 406671 - DNA, 16 bp, M. musculus
gagagagcaagctaga

SEQ ID NO: 406672 - DNA, 16 bp, M. musculus
gagagagcaggctgag

SEQ ID NO: 406673 - DNA, 16 bp, M. musculus
gagagagccaacccct

SEQ ID NO: 406674 - DNA, 16 bp, M. musculus
gagagagccatatcag

SEQ ID NO: 406675 - DNA, 16 bp, M. musculus
gagagagcctgtctcc

SEQ ID NO: 406676 - DNA, 16 bp, M. musculus
gagagagcgagagagc

SEQ ID NO: 406677 - DNA, 16 bp, M. musculus
gagagagcgagagcgc

SEQ ID NO: 406678 - DNA, 16 bp, M. musculus
gagagagcgagcaagc

SEQ ID NO: 406679 - DNA, 16 bp, M. musculus
gagagagcgagcgagc

SEQ ID NO: 406680 - DNA, 16 bp, M. musculus
gagagagctgactccc

SEQ ID NO: 406681 - DNA, 16 bp, M. musculus
gagagaggcaagagca

SEQ ID NO: 406682 - DNA, 16 bp, M. musculus
gagagaggcacagccg

SEQ ID NO: 406683 - DNA, 16 bp, M. musculus
gagagaggcacagctg

SEQ ID NO: 406684 - DNA, 16 bp, M. musculus
gagagaggcagagaca

SEQ ID NO: 406685 - DNA, 16 bp, M. musculus
gagagaggcagagagc

SEQ ID NO: 406686 - DNA, 16 bp, M. musculus
gagagaggctagagag

SEQ ID NO: 406687 - DNA, 16 bp, M. musculus
gagagagggaactgga

SEQ ID NO: 406688 - DNA, 16 bp, M. musculus
gagagagggctcagag

SEQ ID NO: 406689 - DNA, 16 bp, M. musculus
gagagagggctggaga

SEQ ID NO: 406690 - DNA, 16 bp, M. musculus
gagagagtatttaaaa

SEQ ID NO: 406691 - DNA, 16 bp, M. musculus
gagagagtcagaaaga

SEQ ID NO: 406692 - DNA, 16 bp, M. musculus
gagagagtcagagaga

SEQ ID NO: 406693 - DNA, 16 bp, M. musculus
gagagagtcagatccc

SEQ ID NO: 406694 - DNA, 16 bp, M. musculus
gagagagtgtgtgtgc

SEQ ID NO: 406695 - DNA, 16 bp, M. musculus
gagagagtgtgtgtgt

SEQ ID NO: 406696 - DNA, 16 bp, M. musculus
gagagagttctacatc

SEQ ID NO: 406697 - DNA, 16 bp, M. musculus
gagagagttttttttt

SEQ ID NO: 406698 - DNA, 16 bp, M. musculus
gagagataacaacaga

SEQ ID NO: 406699 - DNA, 16 bp, M. musculus
gagagatacagagaca

SEQ ID NO: 406700 - DNA, 16 bp, M. musculus
gagagatacagagaga

SEQ ID NO: 406701 - DNA, 16 bp, M. musculus
gagagatcatggccat

SEQ ID NO: 406702 - DNA, 16 bp, M. musculus
gagagatcctgtctca

SEQ ID NO: 406703 - DNA, 16 bp, M. musculus
gagagatcctgtctcc

SEQ ID NO: 406704 - DNA, 16 bp, M. musculus
gagagatctacctgcc

SEQ ID NO: 406705 - DNA, 16 bp, M. musculus
gagagatctctccatt

SEQ ID NO: 406706 - DNA, 16 bp, M. musculus
gagagatgacagagag

SEQ ID NO: 406707 - DNA, 16 bp, M. musculus
gagagatgactcagtt

SEQ ID NO: 406708 - DNA, 16 bp, M. musculus
gagagatgactgagca

SEQ ID NO: 406709 - DNA, 16 bp, M. musculus
gagagatgatctaaaa

SEQ ID NO: 406710 - DNA, 16 bp, M. musculus
gagagatgcacagaga

SEQ ID NO: 406711 - DNA, 16 bp, M. musculus
gagagatggcccagcc

SEQ ID NO: 406712 - DNA, 16 bp, M. musculus
gagagatggctagatg

SEQ ID NO: 406713 - DNA, 16 bp, M. musculus
gagagatggctcaggt

SEQ ID NO: 406714 - DNA, 16 bp, M. musculus
gagagatggctctgct

SEQ ID NO: 406715 - DNA, 16 bp, M. musculus
gagagatggctggaga

SEQ ID NO: 406716 - DNA, 16 bp, M. musculus
gagagatgggtcagtg

SEQ ID NO: 406717 - DNA, 16 bp, M. musculus
gagagatggtcccacc

SEQ ID NO: 406718 - DNA, 16 bp, M. musculus
gagagatggttctgca

SEQ ID NO: 406719 - DNA, 16 bp, M. musculus
gagagatgtctcagtg

SEQ ID NO: 406720 - DNA, 16 bp, M. musculus
gagagattctgtctca

SEQ ID NO: 406721 - DNA, 16 bp, M. musculus
gagagattgaaagaga

SEQ ID NO: 406722 - DNA, 16 bp, M. musculus
gagagattgaggaaga

SEQ ID NO: 406723 - DNA, 16 bp, M. musculus
gagagatttcagagct

SEQ ID NO: 406724 - DNA, 16 bp, M. musculus
gagagcaagctgagca

SEQ ID NO: 406725 - DNA, 16 bp, M. musculus
gagagcaaggagaggc

SEQ ID NO: 406726 - DNA, 16 bp, M. musculus
gagagcaaggaggagc

SEQ ID NO: 406727 - DNA, 16 bp, M. musculus
gagagcaaggaggagt

SEQ ID NO: 406728 - DNA, 16 bp, M. musculus
gagagcaagtcagtaa

SEQ ID NO: 406729 - DNA, 16 bp, M. musculus
gagagcacaaagaaac

SEQ ID NO: 406730 - DNA, 16 bp, M. musculus
gagagcacagaggctg

SEQ ID NO: 406731 - DNA, 16 bp, M. musculus
gagagcacagccagag

SEQ ID NO: 406732 - DNA, 16 bp, M. musculus
gagagcacttactgct

SEQ ID NO: 406733 - DNA, 16 bp, M. musculus
gagagcagagaagcag

SEQ ID NO: 406734 - DNA, 16 bp, M. musculus
gagagcagagccagag

SEQ ID NO: 406735 - DNA, 16 bp, M. musculus
gagagcagatgctggt

SEQ ID NO: 406736 - DNA, 16 bp, M. musculus
gagagcagccagcggg

SEQ ID NO: 406737 - DNA, 16 bp, M. musculus
gagagcagccatgagg

SEQ ID NO: 406738 - DNA, 16 bp, M. musculus
gagagcagccatggcc

SEQ ID NO: 406739 - DNA, 16 bp, M. musculus
gagagcagctgaggct

SEQ ID NO: 406740 - DNA, 16 bp, M. musculus
gagagcaggagaactg

SEQ ID NO: 406741 - DNA, 16 bp, M. musculus
gagagcagtcagtgct

SEQ ID NO: 406742 - DNA, 17 bp, M. musculus
gagagcatcatcaggca

SEQ ID NO: 406743 - DNA, 16 bp, M. musculus
gagagcatcttcaaca

SEQ ID NO: 406744 - DNA, 16 bp, M. musculus
gagagcatgagaagag

SEQ ID NO: 406745 - DNA, 16 bp, M. musculus
gagagccagagagcca

SEQ ID NO: 406746 - DNA, 16 bp, M. musculus
gagagccagagagctt

SEQ ID NO: 406747 - DNA, 16 bp, M. musculus
gagagccagagccaga

SEQ ID NO: 406748 - DNA, 16 bp, M. musculus
gagagcccagcccatt

SEQ ID NO: 406749 - DNA, 16 bp, M. musculus
gagagcccagtccatt

SEQ ID NO: 406750 - DNA, 16 bp, M. musculus
gagagcctcagggagc

SEQ ID NO: 406751 - DNA, 16 bp, M. musculus
gagagcctcctcctag

SEQ ID NO: 406752 - DNA, 16 bp, M. musculus
gagagcctggagagat

SEQ ID NO: 406753 - DNA, 16 bp, M. musculus
gagagcgagagagagc

SEQ ID NO: 406754 - DNA, 16 bp, M. musculus
gagagctatgagtttt

SEQ ID NO: 406755 - DNA, 16 bp, M. musculus
gagagctcacaaaaag

SEQ ID NO: 406756 - DNA, 16 bp, M. musculus
gagagctggcctgcag

SEQ ID NO: 406757 - DNA, 16 bp, M. musculus
gagagctggctctgcc

SEQ ID NO: 406758 - DNA, 16 bp, M. musculus
gagagctgggagagct

SEQ ID NO: 406759 - DNA, 16 bp, M. musculus
gagagctgggatcaaa

SEQ ID NO: 406760 - DNA, 16 bp, M. musculus
gagagctggtctccaa

SEQ ID NO: 406761 - DNA, 16 bp, M. musculus
gagagctgtgagctgc

SEQ ID NO: 406762 - DNA, 16 bp, M. musculus
gagagctgtttcactg

SEQ ID NO: 406763 - DNA, 16 bp, M. musculus
gagagcttgccctggt

SEQ ID NO: 406764 - DNA, 16 bp, M. musculus
gagaggaaactggaaa

SEQ ID NO: 406765 - DNA, 16 bp, M. musculus
gagaggaaagcaatca

SEQ ID NO: 406766 - DNA, 16 bp, M. musculus
gagaggaaatacagag

SEQ ID NO: 406767 - DNA, 16 bp, M. musculus
gagaggaacttgaagc

SEQ ID NO: 406768 - DNA, 16 bp, M. musculus
gagaggaagctgagag

SEQ ID NO: 406769 - DNA, 16 bp, M. musculus
gagaggacacagaaga

SEQ ID NO: 406770 - DNA, 16 bp, M. musculus
gagaggacacagagga

SEQ ID NO: 406771 - DNA, 16 bp, M. musculus
gagaggacagagcagg

SEQ ID NO: 406772 - DNA, 16 bp, M. musculus
gagaggacccagccca

SEQ ID NO: 406773 - DNA, 16 bp, M. musculus
gagaggactcagcagt

SEQ ID NO: 406774 - DNA, 16 bp, M. musculus
gagaggactggactgc

SEQ ID NO: 406775 - DNA, 16 bp, M. musculus
gagaggagagagactg

SEQ ID NO: 406776 - DNA, 16 bp, M. musculus
gagaggaggaagctgc

SEQ ID NO: 406777 - DNA, 16 bp, M. musculus
gagaggatctgggaag

SEQ ID NO: 406778 - DNA, 16 bp, M. musculus
gagaggatgcagagaa

SEQ ID NO: 406779 - DNA, 16 bp, M. musculus
gagaggatgttttgct

SEQ ID NO: 406780 - DNA, 16 bp, M. musculus
gagaggattattattc

SEQ ID NO: 406781 - DNA, 16 bp, M. musculus
gagaggcaaaggcagg

SEQ ID NO: 406782 - DNA, 16 bp, M. musculus
gagaggcaagtgcaag

SEQ ID NO: 406783 - DNA, 16 bp, M. musculus
gagaggcacagagagg

SEQ ID NO: 406784 - DNA, 16 bp, M. musculus
gagaggcagaactgga

SEQ ID NO: 406785 - DNA, 16 bp, M. musculus
gagaggcagaagcaag

SEQ ID NO: 406786 - DNA, 16 bp, M. musculus
gagaggcagaagcagg

SEQ ID NO: 406787 - DNA, 16 bp, M. musculus
gagaggcagacacaca

SEQ ID NO: 406788 - DNA, 16 bp, M. musculus
gagaggcagagagcag

SEQ ID NO: 406789 - DNA, 16 bp, M. musculus
gagaggcagagatgga

SEQ ID NO: 406790 - DNA, 16 bp, M. musculus
gagaggcagagccagg

SEQ ID NO: 406791 - DNA, 16 bp, M. musculus
gagaggcagaggcaag

SEQ ID NO: 406792 - DNA, 16 bp, M. musculus
gagaggcagaggcaga

SEQ ID NO: 406793 - DNA, 16 bp, M. musculus
gagaggcaggagacca

SEQ ID NO: 406794 - DNA, 16 bp, M. musculus
gagaggcaggcagagc

SEQ ID NO: 406795 - DNA, 16 bp, M. musculus
gagaggcatggcagag

SEQ ID NO: 406796 - DNA, 17 bp, M. musculus
gagaggcatgtctcaca

SEQ ID NO: 406797 - DNA, 16 bp, M. musculus
gagaggccaaggaagg

SEQ ID NO: 406798 - DNA, 16 bp, M. musculus
gagaggccaggagaag

SEQ ID NO: 406799 - DNA, 16 bp, M. musculus
gagaggccatctgatt

SEQ ID NO: 406800 - DNA, 16 bp, M. musculus
gagaggccatgaaagg

SEQ ID NO: 406801 - DNA, 16 bp, M. musculus
gagaggccccggagct

SEQ ID NO: 406802 - DNA, 16 bp, M. musculus
gagaggcccgggtcag

SEQ ID NO: 406803 - DNA, 16 bp, M. musculus
gagaggccctgactca

SEQ ID NO: 406804 - DNA, 16 bp, M. musculus
gagaggccctgtctgt

SEQ ID NO: 406805 - DNA, 16 bp, M. musculus
gagaggcccttgggcc

SEQ ID NO: 406806 - DNA, 16 bp, M. musculus
gagaggcctgctcttt

SEQ ID NO: 406807 - DNA, 16 bp, M. musculus
gagaggcctttggtcc

SEQ ID NO: 406808 - DNA, 16 bp, M. musculus
gagaggctctgtcaga

SEQ ID NO: 406809 - DNA, 16 bp, M. musculus
gagaggctgaacctgt

SEQ ID NO: 406810 - DNA, 16 bp, M. musculus
gagaggctgagaaagg

SEQ ID NO: 406811 - DNA, 16 bp, M. musculus
gagaggctgagaggct

SEQ ID NO: 406812 - DNA, 16 bp, M. musculus
gagaggctgaggcagg

SEQ ID NO: 406813 - DNA, 16 bp, M. musculus
gagaggctgcacaggc

SEQ ID NO: 406814 - DNA, 16 bp, M. musculus
gagaggctggccagga

SEQ ID NO: 406815 - DNA, 16 bp, M. musculus
gagaggcttcacccag

SEQ ID NO: 406816 - DNA, 16 bp, M. musculus
gagaggcttctaaaaa

SEQ ID NO: 406817 - DNA, 16 bp, M. musculus
gagagggaaagtcagt

SEQ ID NO: 406818 - DNA, 16 bp, M. musculus
gagagggaacttgaag

SEQ ID NO: 406819 - DNA, 16 bp, M. musculus
gagagggacgagggcc

SEQ ID NO: 406820 - DNA, 16 bp, M. musculus
gagagggagagcaagc

SEQ ID NO: 406821 - DNA, 16 bp, M. musculus
gagagggagaggctgg

SEQ ID NO: 406822 - DNA, 16 bp, M. musculus
gagagggagcgccaga

SEQ ID NO: 406823 - DNA, 16 bp, M. musculus
gagagggcatcagatc

SEQ ID NO: 406824 - DNA, 16 bp, M. musculus
gagagggctggtgaga

SEQ ID NO: 406825 - DNA, 16 bp, M. musculus
gagaggggcctgagga

SEQ ID NO: 406826 - DNA, 16 bp, M. musculus
gagaggtagaggcaag

SEQ ID NO: 406827 - DNA, 16 bp, M. musculus
gagaggtagaggcagg

SEQ ID NO: 406828 - DNA, 16 bp, M. musculus
gagaggtggagacagg

SEQ ID NO: 406829 - DNA, 16 bp, M. musculus
gagaggtggctcagca

SEQ ID NO: 406830 - DNA, 16 bp, M. musculus
gagaggtgggaggcag

SEQ ID NO: 406831 - DNA, 16 bp, M. musculus
gagaggtggtcctccc

SEQ ID NO: 406832 - DNA, 16 bp, M. musculus
gagaggtttaaagtat

SEQ ID NO: 406833 - DNA, 16 bp, M. musculus
gagagtcactctcaga

SEQ ID NO: 406834 - DNA, 16 bp, M. musculus
gagagtcctttgggga

SEQ ID NO: 406835 - DNA, 16 bp, M. musculus
gagagtctacagcctc

SEQ ID NO: 406836 - DNA, 16 bp, M. musculus
gagagtctgaagacag

SEQ ID NO: 406837 - DNA, 16 bp, M. musculus
gagagtgagaaggagc

SEQ ID NO: 406838 - DNA, 16 bp, M. musculus
gagagtgagcaaggag

SEQ ID NO: 406839 - DNA, 16 bp, M. musculus
gagagtgaggactaca

SEQ ID NO: 406840 - DNA, 16 bp, M. musculus
gagagtgattcagcag

SEQ ID NO: 406841 - DNA, 16 bp, M. musculus
gagagtgggaaagctg

SEQ ID NO: 406842 - DNA, 16 bp, M. musculus
gagagtgggagaaata

SEQ ID NO: 406843 - DNA, 16 bp, M. musculus
gagagtgggcagcctt

SEQ ID NO: 406844 - DNA, 16 bp, M. musculus
gagagtgtatgtgtgt

SEQ ID NO: 406845 - DNA, 16 bp, M. musculus
gagagtgtgtatgtga

SEQ ID NO: 406846 - DNA, 16 bp, M. musculus
gagagtgtgtgtgtga

SEQ ID NO: 406847 - DNA, 16 bp, M. musculus
gagagtgtgtgtgtgc

SEQ ID NO: 406848 - DNA, 16 bp, M. musculus
gagagtgtgtgtgtgt

SEQ ID NO: 406849 - DNA, 16 bp, M. musculus
gagagttccaggacag

SEQ ID NO: 406850 - DNA, 16 bp, M. musculus
gagagttctatgtctg

SEQ ID NO: 406851 - DNA, 16 bp, M. musculus
gagagttggtgggcag

SEQ ID NO: 406852 - DNA, 16 bp, M. musculus
gagagtttctcttgga

SEQ ID NO: 406853 - DNA, 16 bp, M. musculus
gagagtttggctggtt

SEQ ID NO: 406854 - DNA, 16 bp, M. musculus
gagataaagaaatgca

SEQ ID NO: 406855 - DNA, 17 bp, M. musculus
gagataagatgcaaagt

SEQ ID NO: 406856 - DNA, 16 bp, M. musculus
gagatacacagtgaga

SEQ ID NO: 406857 - DNA, 16 bp, M. musculus
gagatagaaacccaag

SEQ ID NO: 406858 - DNA, 22 bp, M. musculus
gagatagaaaccctaggaaaga

SEQ ID NO: 406859 - DNA, 17 bp, M. musculus
gagatagaagtttctga

SEQ ID NO: 406860 - DNA, 16 bp, M. musculus
gagatagaattgctca

SEQ ID NO: 406861 - DNA, 16 bp, M. musculus
gagatagagacagaaa

SEQ ID NO: 406862 - DNA, 16 bp, M. musculus
gagatagagtctctct

SEQ ID NO: 406863 - DNA, 16 bp, M. musculus
gagatagctcagcaga

SEQ ID NO: 406864 - DNA, 18 bp, M. musculus
gagatataaacaagaaga

SEQ ID NO: 406865 - DNA, 16 bp, M. musculus
gagatataagagacaa

SEQ ID NO: 406866 - DNA, 17 bp, M. musculus
gagatatatagatatag

SEQ ID NO: 406867 - DNA, 33 bp, M. musculus
gagatatcatgagcctctagatttcaaagtaat

SEQ ID NO: 406868 - DNA, 16 bp, M. musculus
gagatattaatctcca

SEQ ID NO: 406869 - DNA, 16 bp, M. musculus
gagatattagggacca

SEQ ID NO: 406870 - DNA, 16 bp, M. musculus
gagatatttgcctgtt

SEQ ID NO: 406871 - DNA, 16 bp, M. musculus
gagatatttttgaagg

SEQ ID NO: 406872 - DNA, 16 bp, M. musculus
gagatcacaggtgtgt

SEQ ID NO: 406873 - DNA, 16 bp, M. musculus
gagatcaccactccct

SEQ ID NO: 406874 - DNA, 16 bp, M. musculus
gagatcaccagctgaa

SEQ ID NO: 406875 - DNA, 16 bp, M. musculus
gagatcagaggacaac

SEQ ID NO: 406876 - DNA, 16 bp, M. musculus
gagatcagaggacagt

SEQ ID NO: 406877 - DNA, 16 bp, M. musculus
gagatcagcctggtct

SEQ ID NO: 406878 - DNA, 16 bp, M. musculus
gagatccaagatttcc

SEQ ID NO: 406879 - DNA, 16 bp, M. musculus
gagatccacctgctct

SEQ ID NO: 406880 - DNA, 16 bp, M. musculus
gagatccagctgaaag

SEQ ID NO: 406881 - DNA, 16 bp, M. musculus
gagatccaggacagcc

SEQ ID NO: 406882 - DNA, 16 bp, M. musculus
gagatccagttgtaag

SEQ ID NO: 406883 - DNA, 16 bp, M. musculus
gagatccatgccatga

SEQ ID NO: 406884 - DNA, 16 bp, M. musculus
gagatccatttgcctc

SEQ ID NO: 406885 - DNA, 16 bp, M. musculus
gagatcctcctgtctc

SEQ ID NO: 406886 - DNA, 16 bp, M. musculus
gagatcctgaagcttt

SEQ ID NO: 406887 - DNA, 16 bp, M. musculus
gagatcctgcagctct

SEQ ID NO: 406888 - DNA, 16 bp, M. musculus
gagatcctgcctcaga

SEQ ID NO: 406889 - DNA, 16 bp, M. musculus
gagatcctggatgtgt

SEQ ID NO: 406890 - DNA, 16 bp, M. musculus
gagatcctggggtttg

SEQ ID NO: 406891 - DNA, 16 bp, M. musculus
gagatcctgtctcaga

SEQ ID NO: 406892 - DNA, 16 bp, M. musculus
gagatcctgtttcaaa

SEQ ID NO: 406893 - DNA, 16 bp, M. musculus
gagatccttctgcctc

SEQ ID NO: 406894 - DNA, 16 bp, M. musculus
gagatccttctgtctc

SEQ ID NO: 406895 - DNA, 44 bp, M. musculus
gagatcctttcggtattccagaagccgataccagctcgacatga

SEQ ID NO: 406896 - DNA, 16 bp, M. musculus
gagatcgtgggttcga

SEQ ID NO: 406897 - DNA, 16 bp, M. musculus
gagatctcagaaaatg

SEQ ID NO: 406898 - DNA, 16 bp, M. musculus
gagatctcagaagatg

SEQ ID NO: 406899 - DNA, 16 bp, M. musculus
gagatctccatggaaa

SEQ ID NO: 406900 - DNA, 16 bp, M. musculus
gagatctgacactctc

SEQ ID NO: 406901 - DNA, 16 bp, M. musculus
gagatctgattgcctc

SEQ ID NO: 406902 - DNA, 16 bp, M. musculus
gagatctgccagagcc

SEQ ID NO: 406903 - DNA, 16 bp, M. musculus
gagatctgcctcccaa

SEQ ID NO: 406904 - DNA, 16 bp, M. musculus
gagatctgcctgcctt

SEQ ID NO: 406905 - DNA, 19 bp, M. musculus
gagatctgcttgcctctgc

SEQ ID NO: 406906 - DNA, 16 bp, M. musculus
gagatctgggttcttt

SEQ ID NO: 406907 - DNA, 16 bp, M. musculus
gagatctggtgccctc

SEQ ID NO: 406908 - DNA, 16 bp, M. musculus
gagatctgtccatctt

SEQ ID NO: 406909 - DNA, 16 bp, M. musculus
gagatcttcttcgatt

SEQ ID NO: 406910 - DNA, 16 bp, M. musculus
gagatcttcttgtctc

SEQ ID NO: 406911 - DNA, 16 bp, M. musculus
gagatctttgatccac

SEQ ID NO: 406912 - DNA, 16 bp, M. musculus
gagatgaaaaggatcc

SEQ ID NO: 406913 - DNA, 16 bp, M. musculus
gagatgaaatcttctg

SEQ ID NO: 406914 - DNA, 16 bp, M. musculus
gagatgaagatggagc

SEQ ID NO: 406915 - DNA, 16 bp, M. musculus
gagatgacatcttctg

SEQ ID NO: 406916 - DNA, 16 bp, M. musculus
gagatgactcagtggg

SEQ ID NO: 406917 - DNA, 16 bp, M. musculus
gagatgactttgaact

SEQ ID NO: 406918 - DNA, 16 bp, M. musculus
gagatgagacaaaagg

SEQ ID NO: 406919 - DNA, 16 bp, M. musculus
gagatgaggaggatga

SEQ ID NO: 406920 - DNA, 16 bp, M. musculus
gagatgagtgtgtggc

SEQ ID NO: 406921 - DNA, 16 bp, M. musculus
gagatgatgatgatga

SEQ ID NO: 406922 - DNA, 16 bp, M. musculus
gagatgatggtgatga

SEQ ID NO: 406923 - DNA, 16 bp, M. musculus
gagatgatgtctcaaa

SEQ ID NO: 406924 - DNA, 16 bp, M. musculus
gagatgcaaatcaaaa

SEQ ID NO: 406925 - DNA, 16 bp, M. musculus
gagatgcacctgaaaa

SEQ ID NO: 406926 - DNA, 17 bp, M. musculus
gagatgcccatgaacgt

SEQ ID NO: 406927 - DNA, 16 bp, M. musculus
gagatgcctcagaggt

SEQ ID NO: 406928 - DNA, 16 bp, M. musculus
gagatgctgagaaggt

SEQ ID NO: 406929 - DNA, 16 bp, M. musculus
gagatgctgcctcaaa

SEQ ID NO: 406930 - DNA, 16 bp, M. musculus
gagatgctggtgagga

SEQ ID NO: 406931 - DNA, 16 bp, M. musculus
gagatggaacctcagg

SEQ ID NO: 406932 - DNA, 16 bp, M. musculus
gagatggaagacagaa

SEQ ID NO: 406933 - DNA, 16 bp, M. musculus
gagatggagacagaga

SEQ ID NO: 406934 - DNA, 16 bp, M. musculus
gagatggagacaggag

SEQ ID NO: 406935 - DNA, 16 bp, M. musculus
gagatggagatggaga

SEQ ID NO: 406936 - DNA, 16 bp, M. musculus
gagatggagcaagata

SEQ ID NO: 406937 - DNA, 16 bp, M. musculus
gagatggaggcagaag

SEQ ID NO: 406938 - DNA, 16 bp, M. musculus
gagatggaggccagcc

SEQ ID NO: 406939 - DNA, 16 bp, M. musculus
gagatggatgacagtg

SEQ ID NO: 406940 - DNA, 16 bp, M. musculus
gagatggcccagcagg

SEQ ID NO: 406941 - DNA, 16 bp, M. musculus
gagatggctcagagtt

SEQ ID NO: 406942 - DNA, 16 bp, M. musculus
gagatggctcagatgt

SEQ ID NO: 406943 - DNA, 16 bp, M. musculus
gagatggctcagcagg

SEQ ID NO: 406944 - DNA, 21 bp, M. musculus
gagatggctcagtgggtaagg

SEQ ID NO: 406945 - DNA, 16 bp, M. musculus
gagatggctcatctgt

SEQ ID NO: 406946 - DNA, 16 bp, M. musculus
gagatggctccaccca

SEQ ID NO: 406947 - DNA, 16 bp, M. musculus
gagatggctccgtggt

SEQ ID NO: 406948 - DNA, 16 bp, M. musculus
gagatgggattttagg

SEQ ID NO: 406949 - DNA, 16 bp, M. musculus
gagatgggtgtgtggc

SEQ ID NO: 406950 - DNA, 16 bp, M. musculus
gagatggtgctggaga

SEQ ID NO: 406951 - DNA, 16 bp, M. musculus
gagatgtaagcaataa

SEQ ID NO: 406952 - DNA, 16 bp, M. musculus
gagatgtagctcagtg

SEQ ID NO: 406953 - DNA, 16 bp, M. musculus
gagatgtcagagccat

SEQ ID NO: 406954 - DNA, 16 bp, M. musculus
gagatgtcagagctgt

SEQ ID NO: 406955 - DNA, 16 bp, M. musculus
gagatgtcccaggagg

SEQ ID NO: 406956 - DNA, 16 bp, M. musculus
gagatgtggctcagca

SEQ ID NO: 406957 - DNA, 16 bp, M. musculus
gagatgtggtcttgtt

SEQ ID NO: 406958 - DNA, 16 bp, M. musculus
gagatgtgtttttaaa

SEQ ID NO: 406959 - DNA, 16 bp, M. musculus
gagattaaagatgtgt

SEQ ID NO: 406960 - DNA, 16 bp, M. musculus
gagattacaggcatgt

SEQ ID NO: 406961 - DNA, 16 bp, M. musculus
gagattaccagatgtc

SEQ ID NO: 406962 - DNA, 16 bp, M. musculus
gagattatgaaagcta

SEQ ID NO: 406963 - DNA, 16 bp, M. musculus
gagattccctcctctc

SEQ ID NO: 406964 - DNA, 16 bp, M. musculus
gagattgagaaagaca

SEQ ID NO: 406965 - DNA, 16 bp, M. musculus
gagattgtgcagggtt

SEQ ID NO: 406966 - DNA, 16 bp, M. musculus
gagattgtgttgttta

SEQ ID NO: 406967 - DNA, 16 bp, M. musculus
gagatttctcagttga

SEQ ID NO: 406968 - DNA, 16 bp, M. musculus
gagatttctgagttca

SEQ ID NO: 406969 - DNA, 16 bp, M. musculus
gagatttctttttctt

SEQ ID NO: 406970 - DNA, 16 bp, M. musculus
gagatttcttttttta

SEQ ID NO: 406971 - DNA, 16 bp, M. musculus
gagatttgtagcagct

SEQ ID NO: 406972 - DNA, 16 bp, M. musculus
gagattttcctgcctc

SEQ ID NO: 406973 - DNA, 16 bp, M. musculus
gagatttttgtaggaa

SEQ ID NO: 406974 - DNA, 16 bp, M. musculus
gagatttttttaaaat

SEQ ID NO: 406975 - DNA, 16 bp, M. musculus
gagatttttttaaatg

SEQ ID NO: 406976 - DNA, 16 bp, M. musculus
gagatttttttttcct

SEQ ID NO: 406977 - DNA, 17 bp, M. musculus
gagcaaaaggcttcaac

SEQ ID NO: 406978 - DNA, 16 bp, M. musculus
gagcaaacccagggct

SEQ ID NO: 406979 - DNA, 16 bp, M. musculus
gagcaaagaggaaata

SEQ ID NO: 406980 - DNA, 16 bp, M. musculus
gagcaaatatgaagat

SEQ ID NO: 406981 - DNA, 16 bp, M. musculus
gagcaacaatgtcaac

SEQ ID NO: 406982 - DNA, 16 bp, M. musculus
gagcaacagagagaga

SEQ ID NO: 406983 - DNA, 16 bp, M. musculus
gagcaacagaggaaga

SEQ ID NO: 406984 - DNA, 21 bp, M. musculus
gagcaaccagtgctcttaacc

SEQ ID NO: 406985 - DNA, 16 bp, M. musculus
gagcaagagagcaagg

SEQ ID NO: 406986 - DNA, 16 bp, M. musculus
gagcaagagagccaga

SEQ ID NO: 406987 - DNA, 16 bp, M. musculus
gagcaagagagtgagg

SEQ ID NO: 406988 - DNA, 16 bp, M. musculus
gagcaagagcaagagc

SEQ ID NO: 406989 - DNA, 16 bp, M. musculus
gagcaagagcaagagg

SEQ ID NO: 406990 - DNA, 16 bp, M. musculus
gagcaagagccagagc

SEQ ID NO: 406991 - DNA, 16 bp, M. musculus
gagcaagagcgagagc

SEQ ID NO: 406992 - DNA, 16 bp, M. musculus
gagcaagaggaacatt

SEQ ID NO: 406993 - DNA, 16 bp, M. musculus
gagcaagaggaagatg

SEQ ID NO: 406994 - DNA, 16 bp, M. musculus
gagcaagcaagcaagc

SEQ ID NO: 406995 - DNA, 16 bp, M. musculus
gagcaagcaaggctgg

SEQ ID NO: 406996 - DNA, 16 bp, M. musculus
gagcaagcagagactg

SEQ ID NO: 406997 - DNA, 16 bp, M. musculus
gagcaagcagggttga

SEQ ID NO: 406998 - DNA, 16 bp, M. musculus
gagcaagccaagagga

SEQ ID NO: 406999 - DNA, 16 bp, M. musculus
gagcaagccacagaga

SEQ ID NO: 407000 - DNA, 16 bp, M. musculus
gagcaagccacaggga

SEQ ID NO: 407001 - DNA, 16 bp, M. musculus
gagcaagccagaagaa

SEQ ID NO: 407002 - DNA, 16 bp, M. musculus
gagcaagccaggagga

SEQ ID NO: 407003 - DNA, 16 bp, M. musculus
gagcaagcctcccagg

SEQ ID NO: 407004 - DNA, 16 bp, M. musculus
gagcaagcgagcgagc

SEQ ID NO: 407005 - DNA, 16 bp, M. musculus
gagcaaggactgaagg

SEQ ID NO: 407006 - DNA, 16 bp, M. musculus
gagcaagtatctctgt

SEQ ID NO: 407007 - DNA, 16 bp, M. musculus
gagcaagtcatgagga

SEQ ID NO: 407008 - DNA, 16 bp, M. musculus
gagcaagttcctggac

SEQ ID NO: 407009 - DNA, 16 bp, M. musculus
gagcaagtttcaggac

SEQ ID NO: 407010 - DNA, 16 bp, M. musculus
gagcaattgagaaaga

SEQ ID NO: 407011 - DNA, 16 bp, M. musculus
gagcacactctgcagg

SEQ ID NO: 407012 - DNA, 16 bp, M. musculus
gagcacagaagctgtg

SEQ ID NO: 407013 - DNA, 16 bp, M. musculus
gagcacagaggcagtg

SEQ ID NO: 407014 - DNA, 16 bp, M. musculus
gagcacagcttctttg

SEQ ID NO: 407015 - DNA, 16 bp, M. musculus
gagcacaggatcccca

SEQ ID NO: 407016 - DNA, 16 bp, M. musculus
gagcacaggccacaga

SEQ ID NO: 407017 - DNA, 16 bp, M. musculus
gagcacaggctcccca

SEQ ID NO: 407018 - DNA, 16 bp, M. musculus
gagcacaggggaaatt

SEQ ID NO: 407019 - DNA, 16 bp, M. musculus
gagcacagtggctgtg

SEQ ID NO: 407020 - DNA, 16 bp, M. musculus
gagcacatactgcttt

SEQ ID NO: 407021 - DNA, 16 bp, M. musculus
gagcacatgtgtgtgc

SEQ ID NO: 407022 - DNA, 16 bp, M. musculus
gagcaccagcattcat

SEQ ID NO: 407023 - DNA, 16 bp, M. musculus
gagcacccaaagaaac

SEQ ID NO: 407024 - DNA, 16 bp, M. musculus
gagcaccctcttggag

SEQ ID NO: 407025 - DNA, 16 bp, M. musculus
gagcaccttccaggcc

SEQ ID NO: 407026 - DNA, 16 bp, M. musculus
gagcacgcgcgcgcgc

SEQ ID NO: 407027 - DNA, 16 bp, M. musculus
gagcacggggtcccca

SEQ ID NO: 407028 - DNA, 16 bp, M. musculus
gagcactcactgctct

SEQ ID NO: 407029 - DNA, 16 bp, M. musculus
gagcactcatgtacat

SEQ ID NO: 407030 - DNA, 16 bp, M. musculus
gagcactctgccagag

SEQ ID NO: 407031 - DNA, 16 bp, M. musculus
gagcactcttccattg

SEQ ID NO: 407032 - DNA, 16 bp, M. musculus
gagcactgagtcagag

SEQ ID NO: 407033 - DNA, 16 bp, M. musculus
gagcactgagtttact

SEQ ID NO: 407034 - DNA, 16 bp, M. musculus
gagcactgctgctctt

SEQ ID NO: 407035 - DNA, 16 bp, M. musculus
gagcactggagctctg

SEQ ID NO: 407036 - DNA, 16 bp, M. musculus
gagcactggatcctct

SEQ ID NO: 407037 - DNA, 18 bp, M. musculus
gagcactggctactcttc

SEQ ID NO: 407038 - DNA, 16 bp, M. musculus
gagcactggctgcctt

SEQ ID NO: 407039 - DNA, 16 bp, M. musculus
gagcactggctgctca

SEQ ID NO: 407040 - DNA, 16 bp, M. musculus
gagcacttaccccagc

SEQ ID NO: 407041 - DNA, 16 bp, M. musculus
gagcacttactgcttt

SEQ ID NO: 407042 - DNA, 16 bp, M. musculus
gagcacttgcctagca

SEQ ID NO: 407043 - DNA, 16 bp, M. musculus
gagcactttttttttt

SEQ ID NO: 407044 - DNA, 16 bp, M. musculus
gagcagaaactgaaag

SEQ ID NO: 407045 - DNA, 16 bp, M. musculus
gagcagaaactgaagg

SEQ ID NO: 407046 - DNA, 16 bp, M. musculus
gagcagaagagctggc

SEQ ID NO: 407047 - DNA, 16 bp, M. musculus
gagcagaagctgaagg

SEQ ID NO: 407048 - DNA, 16 bp, M. musculus
gagcagaatgccaact

SEQ ID NO: 407049 - DNA, 16 bp, M. musculus
gagcagactgagcaag

SEQ ID NO: 407050 - DNA, 16 bp, M. musculus
gagcagagaatgaagg

SEQ ID NO: 407051 - DNA, 16 bp, M. musculus
gagcagagacagaagg

SEQ ID NO: 407052 - DNA, 16 bp, M. musculus
gagcagagactcaagg

SEQ ID NO: 407053 - DNA, 16 bp, M. musculus
gagcagagactgatgg

SEQ ID NO: 407054 - DNA, 16 bp, M. musculus
gagcagagactgcagg

SEQ ID NO: 407055 - DNA, 16 bp, M. musculus
gagcagagactggagg

SEQ ID NO: 407056 - DNA, 16 bp, M. musculus
gagcagagagagacag

SEQ ID NO: 407057 - DNA, 16 bp, M. musculus
gagcagagaggcagag

SEQ ID NO: 407058 - DNA, 16 bp, M. musculus
gagcagagcagagaga

SEQ ID NO: 407059 - DNA, 16 bp, M. musculus
gagcagagcagagcaa

SEQ ID NO: 407060 - DNA, 16 bp, M. musculus
gagcagagcagctgag

SEQ ID NO: 407061 - DNA, 16 bp, M. musculus
gagcagagccatgagg

SEQ ID NO: 407062 - DNA, 16 bp, M. musculus
gagcagagcctgaaag

SEQ ID NO: 407063 - DNA, 16 bp, M. musculus
gagcagagctggagag

SEQ ID NO: 407064 - DNA, 16 bp, M. musculus
gagcagaggcccagct

SEQ ID NO: 407065 - DNA, 16 bp, M. musculus
gagcagagggagtggg

SEQ ID NO: 407066 - DNA, 16 bp, M. musculus
gagcagagggccctcc

SEQ ID NO: 407067 - DNA, 16 bp, M. musculus
gagcagaggtcctaaa

SEQ ID NO: 407068 - DNA, 16 bp, M. musculus
gagcagagttgaccag

SEQ ID NO: 407069 - DNA, 16 bp, M. musculus
gagcagatgcagaaaa

SEQ ID NO: 407070 - DNA, 16 bp, M. musculus
gagcagatgcagaggc

SEQ ID NO: 407071 - DNA, 16 bp, M. musculus
gagcagcaagcaccct

SEQ ID NO: 407072 - DNA, 16 bp, M. musculus
gagcagcacacactct

SEQ ID NO: 407073 - DNA, 16 bp, M. musculus
gagcagcagagagaaa

SEQ ID NO: 407074 - DNA, 16 bp, M. musculus
gagcagcagatgctct

SEQ ID NO: 407075 - DNA, 16 bp, M. musculus
gagcagcagcaacagc

SEQ ID NO: 407076 - DNA, 18 bp, M. musculus
gagcagcagcagcagcaa

SEQ ID NO: 407077 - DNA, 19 bp, M. musculus
gagcagcagcagcagcagt

SEQ ID NO: 407078 - DNA, 16 bp, M. musculus
gagcagcagcagcagg

SEQ ID NO: 407079 - DNA, 16 bp, M. musculus
gagcagcagcagcagt

SEQ ID NO: 407080 - DNA, 16 bp, M. musculus
gagcagcagcaggagc

SEQ ID NO: 407081 - DNA, 16 bp, M. musculus
gagcagcagccagtgc

SEQ ID NO: 407082 - DNA, 16 bp, M. musculus
gagcagcagccattag

SEQ ID NO: 407083 - DNA, 16 bp, M. musculus
gagcagcagctgagag

SEQ ID NO: 407084 - DNA, 16 bp, M. musculus
gagcagcagtatggaa

SEQ ID NO: 407085 - DNA, 16 bp, M. musculus
gagcagccagtgctgc

SEQ ID NO: 407086 - DNA, 16 bp, M. musculus
gagcagccatgtgggt

SEQ ID NO: 407087 - DNA, 16 bp, M. musculus
gagcagcccagataaa

SEQ ID NO: 407088 - DNA, 16 bp, M. musculus
gagcagcccagcccct

SEQ ID NO: 407089 - DNA, 16 bp, M. musculus
gagcagccctgaagga

SEQ ID NO: 407090 - DNA, 16 bp, M. musculus
gagcagccggtgctct

SEQ ID NO: 407091 - DNA, 16 bp, M. musculus
gagcagcctcagtgag

SEQ ID NO: 407092 - DNA, 16 bp, M. musculus
gagcagccttcagatg

SEQ ID NO: 407093 - DNA, 17 bp, M. musculus
gagcagctcaaagaggc

SEQ ID NO: 407094 - DNA, 16 bp, M. musculus
gagcagctcacaacca

SEQ ID NO: 407095 - DNA, 16 bp, M. musculus
gagcagctgacccctg

SEQ ID NO: 407096 - DNA, 16 bp, M. musculus
gagcagctggggacag

SEQ ID NO: 407097 - DNA, 16 bp, M. musculus
gagcaggaactcaagg

SEQ ID NO: 407098 - DNA, 16 bp, M. musculus
gagcaggaagacagga

SEQ ID NO: 407099 - DNA, 16 bp, M. musculus
gagcaggaagctaaga

SEQ ID NO: 407100 - DNA, 16 bp, M. musculus
gagcaggaagctgaga

SEQ ID NO: 407101 - DNA, 16 bp, M. musculus
gagcaggacacagaga

SEQ ID NO: 407102 - DNA, 16 bp, M. musculus
gagcaggagaagcagg

SEQ ID NO: 407103 - DNA, 16 bp, M. musculus
gagcaggagagcagga

SEQ ID NO: 407104 - DNA, 16 bp, M. musculus
gagcaggagagctgcc

SEQ ID NO: 407105 - DNA, 16 bp, M. musculus
gagcaggagcagcagc

SEQ ID NO: 407106 - DNA, 16 bp, M. musculus
gagcaggagctgagag

SEQ ID NO: 407107 - DNA, 16 bp, M. musculus
gagcaggagctgatac

SEQ ID NO: 407108 - DNA, 16 bp, M. musculus
gagcaggaggaagagc

SEQ ID NO: 407109 - DNA, 16 bp, M. musculus
gagcaggaggaggaac

SEQ ID NO: 407110 - DNA, 16 bp, M. musculus
gagcaggaggcagctg

SEQ ID NO: 407111 - DNA, 16 bp, M. musculus
gagcaggatggaggga

SEQ ID NO: 407112 - DNA, 16 bp, M. musculus
gagcaggcagagcaag

SEQ ID NO: 407113 - DNA, 16 bp, M. musculus
gagcaggctggtcttg

SEQ ID NO: 407114 - DNA, 16 bp, M. musculus
gagcaggcttgacttg

SEQ ID NO: 407115 - DNA, 16 bp, M. musculus
gagcagggcagtggga

SEQ ID NO: 407116 - DNA, 16 bp, M. musculus
gagcagggcagtgggg

SEQ ID NO: 407117 - DNA, 16 bp, M. musculus
gagcagggtggggtga

SEQ ID NO: 407118 - DNA, 16 bp, M. musculus
gagcaggtgagggagc

SEQ ID NO: 407119 - DNA, 16 bp, M. musculus
gagcaggtgtccttct

SEQ ID NO: 407120 - DNA, 16 bp, M. musculus
gagcagtagacagcag

SEQ ID NO: 407121 - DNA, 16 bp, M. musculus
gagcagtagctgagag

SEQ ID NO: 407122 - DNA, 16 bp, M. musculus
gagcagtatgtactct

SEQ ID NO: 407123 - DNA, 16 bp, M. musculus
gagcagtcagcacaga

SEQ ID NO: 407124 - DNA, 16 bp, M. musculus
gagcagtcagtgcttc

SEQ ID NO: 407125 - DNA, 16 bp, M. musculus
gagcagtctgtgctct

SEQ ID NO: 407126 - DNA, 16 bp, M. musculus
gagcagtggtggcaca

SEQ ID NO: 407127 - DNA, 16 bp, M. musculus
gagcagttagagaaag

SEQ ID NO: 407128 - DNA, 16 bp, M. musculus
gagcagttctcaacct

SEQ ID NO: 407129 - DNA, 16 bp, M. musculus
gagcagttggacaaca

SEQ ID NO: 407130 - DNA, 16 bp, M. musculus
gagcagtttctggatg

SEQ ID NO: 407131 - DNA, 16 bp, M. musculus
gagcataatgcatatg

SEQ ID NO: 407132 - DNA, 16 bp, M. musculus
gagcatagatgttcac

SEQ ID NO: 407133 - DNA, 16 bp, M. musculus
gagcatcaccaacaga

SEQ ID NO: 407134 - DNA, 16 bp, M. musculus
gagcatccagagactg

SEQ ID NO: 407135 - DNA, 16 bp, M. musculus
gagcatcctctgcaca

SEQ ID NO: 407136 - DNA, 16 bp, M. musculus
gagcatcctggcttat

SEQ ID NO: 407137 - DNA, 17 bp, M. musculus
gagcatcctgtgcacag

SEQ ID NO: 407138 - DNA, 16 bp, M. musculus
gagcatcctttgggta

SEQ ID NO: 407139 - DNA, 16 bp, M. musculus
gagcatcgattgttgc

SEQ ID NO: 407140 - DNA, 18 bp, M. musculus
gagcatctgcaggagaca

SEQ ID NO: 407141 - DNA, 16 bp, M. musculus
gagcatctgcatctgt

SEQ ID NO: 407142 - DNA, 16 bp, M. musculus
gagcatcttgtaaggc

SEQ ID NO: 407143 - DNA, 16 bp, M. musculus
gagcatgaccttgaac

SEQ ID NO: 407144 - DNA, 16 bp, M. musculus
gagcatgaggaggagg

SEQ ID NO: 407145 - DNA, 16 bp, M. musculus
gagcatgaggcagctg

SEQ ID NO: 407146 - DNA, 16 bp, M. musculus
gagcatggcagtgtct

SEQ ID NO: 407147 - DNA, 16 bp, M. musculus
gagcatggctcactgt

SEQ ID NO: 407148 - DNA, 16 bp, M. musculus
gagcatggtggcacac

SEQ ID NO: 407149 - DNA, 16 bp, M. musculus
gagcatgtgggcagca

SEQ ID NO: 407150 - DNA, 16 bp, M. musculus
gagcatgtgtcaatgg

SEQ ID NO: 407151 - DNA, 16 bp, M. musculus
gagcatgtgtccctct

SEQ ID NO: 407152 - DNA, 16 bp, M. musculus
gagcattacctggcag

SEQ ID NO: 407153 - DNA, 16 bp, M. musculus
gagcattcattataca

SEQ ID NO: 407154 - DNA, 16 bp, M. musculus
gagcatttctccctgg

SEQ ID NO: 407155 - DNA, 16 bp, M. musculus
gagcatttgctgctct

SEQ ID NO: 407156 - DNA, 16 bp, M. musculus
gagccaaataaaccct

SEQ ID NO: 407157 - DNA, 16 bp, M. musculus
gagccaaatggattta

SEQ ID NO: 407158 - DNA, 16 bp, M. musculus
gagccaactctccagc

SEQ ID NO: 407159 - DNA, 16 bp, M. musculus
gagccaagaagtggga

SEQ ID NO: 407160 - DNA, 16 bp, M. musculus
gagccaaggaggctcc

SEQ ID NO: 407161 - DNA, 16 bp, M. musculus
gagccaatgccctctt

SEQ ID NO: 407162 - DNA, 16 bp, M. musculus
gagccacacacgtgct

SEQ ID NO: 407163 - DNA, 16 bp, M. musculus
gagccacagacttcta

SEQ ID NO: 407164 - DNA, 16 bp, M. musculus
gagccacatccccagt

SEQ ID NO: 407165 - DNA, 16 bp, M. musculus
gagccaccaaccagaa

SEQ ID NO: 407166 - DNA, 16 bp, M. musculus
gagccaccacgcctgg

SEQ ID NO: 407167 - DNA, 16 bp, M. musculus
gagccaccactgccct

SEQ ID NO: 407168 - DNA, 16 bp, M. musculus
gagccaccagaaggaa

SEQ ID NO: 407169 - DNA, 16 bp, M. musculus
gagccaccatgtatgt

SEQ ID NO: 407170 - DNA, 16 bp, M. musculus
gagccacccctccagc

SEQ ID NO: 407171 - DNA, 16 bp, M. musculus
gagccacctcccctgc

SEQ ID NO: 407172 - DNA, 16 bp, M. musculus
gagccacctcctcagc

SEQ ID NO: 407173 - DNA, 16 bp, M. musculus
gagccacctctctggc

SEQ ID NO: 407174 - DNA, 16 bp, M. musculus
gagccactatggaaat

SEQ ID NO: 407175 - DNA, 16 bp, M. musculus
gagccactgctctaga

SEQ ID NO: 407176 - DNA, 16 bp, M. musculus
gagccactgggcctgg

SEQ ID NO: 407177 - DNA, 16 bp, M. musculus
gagccagaacagctga

SEQ ID NO: 407178 - DNA, 16 bp, M. musculus
gagccagaagagggag

SEQ ID NO: 407179 - DNA, 16 bp, M. musculus
gagccagaagagggtg

SEQ ID NO: 407180 - DNA, 16 bp, M. musculus
gagccagaagctggaa

SEQ ID NO: 407181 - DNA, 16 bp, M. musculus
gagccagagacaggag

SEQ ID NO: 407182 - DNA, 16 bp, M. musculus
gagccagagagaaaga

SEQ ID NO: 407183 - DNA, 19 bp, M. musculus
gagccagagagcaagagag

SEQ ID NO: 407184 - DNA, 16 bp, M. musculus
gagccagagcaagcag

SEQ ID NO: 407185 - DNA, 16 bp, M. musculus
gagccagaggaacaga

SEQ ID NO: 407186 - DNA, 16 bp, M. musculus
gagccagaggaacagg

SEQ ID NO: 407187 - DNA, 16 bp, M. musculus
gagccagaggaccaag

SEQ ID NO: 407188 - DNA, 16 bp, M. musculus
gagccagaggaccaga

SEQ ID NO: 407189 - DNA, 16 bp, M. musculus
gagccagaggagcagg

SEQ ID NO: 407190 - DNA, 16 bp, M. musculus
gagccagaggtccagg

SEQ ID NO: 407191 - DNA, 16 bp, M. musculus
gagccagcagcaggga

SEQ ID NO: 407192 - DNA, 16 bp, M. musculus
gagccagccagagcct

SEQ ID NO: 407193 - DNA, 16 bp, M. musculus
gagccagccagtaagc

SEQ ID NO: 407194 - DNA, 16 bp, M. musculus
gagccagctctgcagc

SEQ ID NO: 407195 - DNA, 16 bp, M. musculus
gagccaggagaagctg

SEQ ID NO: 407196 - DNA, 16 bp, M. musculus
gagccaggcacagtgg

SEQ ID NO: 407197 - DNA, 16 bp, M. musculus
gagccaggcagtggtg

SEQ ID NO: 407198 - DNA, 16 bp, M. musculus
gagccaggcatggtgg

SEQ ID NO: 407199 - DNA, 16 bp, M. musculus
gagccaggccatgttt

SEQ ID NO: 407200 - DNA, 16 bp, M. musculus
gagccagggagccagg

SEQ ID NO: 407201 - DNA, 16 bp, M. musculus
gagccaggggtggtgg

SEQ ID NO: 407202 - DNA, 16 bp, M. musculus
gagccaggtctccagc

SEQ ID NO: 407203 - DNA, 16 bp, M. musculus
gagccatctcaccaaa

SEQ ID NO: 407204 - DNA, 16 bp, M. musculus
gagccatctcactggc

SEQ ID NO: 407205 - DNA, 16 bp, M. musculus
gagccatctcccagcc

SEQ ID NO: 407206 - DNA, 16 bp, M. musculus
gagccatctccccaac

SEQ ID NO: 407207 - DNA, 16 bp, M. musculus
gagccatctccccagc

SEQ ID NO: 407208 - DNA, 16 bp, M. musculus
gagccatctccttggc

SEQ ID NO: 407209 - DNA, 16 bp, M. musculus
gagccatctctcaaac

SEQ ID NO: 407210 - DNA, 16 bp, M. musculus
gagccatctctccaag

SEQ ID NO: 407211 - DNA, 16 bp, M. musculus
gagccatctctctagg

SEQ ID NO: 407212 - DNA, 16 bp, M. musculus
gagccatctctctggt

SEQ ID NO: 407213 - DNA, 16 bp, M. musculus
gagccatctcttcagg

SEQ ID NO: 407214 - DNA, 16 bp, M. musculus
gagccatctcttcagt

SEQ ID NO: 407215 - DNA, 16 bp, M. musculus
gagccatctcttctgc

SEQ ID NO: 407216 - DNA, 16 bp, M. musculus
gagccatctgtaaata

SEQ ID NO: 407217 - DNA, 16 bp, M. musculus
gagccatcttagatct

SEQ ID NO: 407218 - DNA, 16 bp, M. musculus
gagccatcttccttcc

SEQ ID NO: 407219 - DNA, 16 bp, M. musculus
gagccatcttgctggt

SEQ ID NO: 407220 - DNA, 16 bp, M. musculus
gagccatgggtgcctc

SEQ ID NO: 407221 - DNA, 16 bp, M. musculus
gagccatgtttccagc

SEQ ID NO: 407222 - DNA, 16 bp, M. musculus
gagccattcttattca

SEQ ID NO: 407223 - DNA, 16 bp, M. musculus
gagccatttccccagc

SEQ ID NO: 407224 - DNA, 16 bp, M. musculus
gagccatttctccatc

SEQ ID NO: 407225 - DNA, 16 bp, M. musculus
gagcccacagaggcca

SEQ ID NO: 407226 - DNA, 16 bp, M. musculus
gagcccagaagctcag

SEQ ID NO: 407227 - DNA, 16 bp, M. musculus
gagcccagcagaggcc

SEQ ID NO: 407228 - DNA, 16 bp, M. musculus
gagcccagcataactg

SEQ ID NO: 407229 - DNA, 16 bp, M. musculus
gagcccaggagcccag

SEQ ID NO: 407230 - DNA, 16 bp, M. musculus
gagcccagtgctttcc

SEQ ID NO: 407231 - DNA, 16 bp, M. musculus
gagcccattacagatg

SEQ ID NO: 407232 - DNA, 16 bp, M. musculus
gagccccagaactggc

SEQ ID NO: 407233 - DNA, 16 bp, M. musculus
gagcccctagaactgg

SEQ ID NO: 407234 - DNA, 16 bp, M. musculus
gagcccctcagaggac

SEQ ID NO: 407235 - DNA, 16 bp, M. musculus
gagcccctggagctgg

SEQ ID NO: 407236 - DNA, 16 bp, M. musculus
gagcccggcgtggtgg

SEQ ID NO: 407237 - DNA, 16 bp, M. musculus
gagccctctctccaga

SEQ ID NO: 407238 - DNA, 16 bp, M. musculus
gagccctggctgtcct

SEQ ID NO: 407239 - DNA, 16 bp, M. musculus
gagcccttccttctgc

SEQ ID NO: 407240 - DNA, 16 bp, M. musculus
gagcccttgcctagca

SEQ ID NO: 407241 - DNA, 17 bp, M. musculus
gagccgagatgagagat

SEQ ID NO: 407242 - DNA, 16 bp, M. musculus
gagccgagccgagccg

SEQ ID NO: 407243 - DNA, 16 bp, M. musculus
gagccgatgggctgca

SEQ ID NO: 407244 - DNA, 22 bp, M. musculus
gagccggagccggagccggagc

SEQ ID NO: 407245 - DNA, 16 bp, M. musculus
gagccgggcagtggtg

SEQ ID NO: 407246 - DNA, 16 bp, M. musculus
gagccgtgcacgtggt

SEQ ID NO: 407247 - DNA, 16 bp, M. musculus
gagccgtgtgtgtgtg

SEQ ID NO: 407248 - DNA, 16 bp, M. musculus
gagcctagaggacgac

SEQ ID NO: 407249 - DNA, 16 bp, M. musculus
gagcctatggggccat

SEQ ID NO: 407250 - DNA, 16 bp, M. musculus
gagcctcagctgcttt

SEQ ID NO: 407251 - DNA, 16 bp, M. musculus
gagcctcctcctggct

SEQ ID NO: 407252 - DNA, 16 bp, M. musculus
gagcctcctgcctcag

SEQ ID NO: 407253 - DNA, 16 bp, M. musculus
gagcctcgggctacct

SEQ ID NO: 407254 - DNA, 16 bp, M. musculus
gagcctctcagaaaac

SEQ ID NO: 407255 - DNA, 16 bp, M. musculus
gagcctctcagagaac

SEQ ID NO: 407256 - DNA, 16 bp, M. musculus
gagcctctgcctcctg

SEQ ID NO: 407257 - DNA, 16 bp, M. musculus
gagcctctggatttca

SEQ ID NO: 407258 - DNA, 16 bp, M. musculus
gagcctctgggagcca

SEQ ID NO: 407259 - DNA, 16 bp, M. musculus
gagcctgaaaaataca

SEQ ID NO: 407260 - DNA, 16 bp, M. musculus
gagcctgaacaggcca

SEQ ID NO: 407261 - DNA, 16 bp, M. musculus
gagcctgaagcagctg

SEQ ID NO: 407262 - DNA, 16 bp, M. musculus
gagcctgacaacctga

SEQ ID NO: 407263 - DNA, 16 bp, M. musculus
gagcctgactgtgctc

SEQ ID NO: 407264 - DNA, 16 bp, M. musculus
gagcctgagcctgagc

SEQ ID NO: 407265 - DNA, 16 bp, M. musculus
gagcctgagctgttgg

SEQ ID NO: 407266 - DNA, 16 bp, M. musculus
gagcctgaggaaaaca

SEQ ID NO: 407267 - DNA, 16 bp, M. musculus
gagcctgaggacctga

SEQ ID NO: 407268 - DNA, 16 bp, M. musculus
gagcctgaggccagcc

SEQ ID NO: 407269 - DNA, 16 bp, M. musculus
gagcctgcagcagtgc

SEQ ID NO: 407270 - DNA, 16 bp, M. musculus
gagcctgcctgcagag

SEQ ID NO: 407271 - DNA, 16 bp, M. musculus
gagcctgctgacagga

SEQ ID NO: 407272 - DNA, 16 bp, M. musculus
gagcctggaagatatg

SEQ ID NO: 407273 - DNA, 16 bp, M. musculus
gagcctggagctaggc

SEQ ID NO: 407274 - DNA, 16 bp, M. musculus
gagcctggagctcacc

SEQ ID NO: 407275 - DNA, 16 bp, M. musculus
gagcctggcaaataca

SEQ ID NO: 407276 - DNA, 16 bp, M. musculus
gagcctgggctggcat

SEQ ID NO: 407277 - DNA, 16 bp, M. musculus
gagcctgggtcctctg

SEQ ID NO: 407278 - DNA, 16 bp, M. musculus
gagcctgggtcttctg

SEQ ID NO: 407279 - DNA, 16 bp, M. musculus
gagcctggtctacaga

SEQ ID NO: 407280 - DNA, 16 bp, M. musculus
gagcctggtgtggctg

SEQ ID NO: 407281 - DNA, 16 bp, M. musculus
gagcctggtgtggtgg

SEQ ID NO: 407282 - DNA, 16 bp, M. musculus
gagcctgtccctcctg

SEQ ID NO: 407283 - DNA, 16 bp, M. musculus
gagcctgtcctttctg

SEQ ID NO: 407284 - DNA, 16 bp, M. musculus
gagcctgtgacagtga

SEQ ID NO: 407285 - DNA, 16 bp, M. musculus
gagcctgtgagcctgt

SEQ ID NO: 407286 - DNA, 16 bp, M. musculus
gagcctgtggaggcca

SEQ ID NO: 407287 - DNA, 16 bp, M. musculus
gagcctgtgggagaca

SEQ ID NO: 407288 - DNA, 16 bp, M. musculus
gagcctgtgtccttct

SEQ ID NO: 407289 - DNA, 16 bp, M. musculus
gagccttcccaggacc

SEQ ID NO: 407290 - DNA, 16 bp, M. musculus
gagccttccttgagga

SEQ ID NO: 407291 - DNA, 16 bp, M. musculus
gagccttctcaccagc

SEQ ID NO: 407292 - DNA, 16 bp, M. musculus
gagccttctccccagc

SEQ ID NO: 407293 - DNA, 16 bp, M. musculus
gagccttgaattcatt

SEQ ID NO: 407294 - DNA, 16 bp, M. musculus
gagccttgatcagagt

SEQ ID NO: 407295 - DNA, 16 bp, M. musculus
gagcctttggtgacct

SEQ ID NO: 407296 - DNA, 16 bp, M. musculus
gagccttttattggac

SEQ ID NO: 407297 - DNA, 16 bp, M. musculus
gagcgagcaagcgagc

SEQ ID NO: 407298 - DNA, 16 bp, M. musculus
gagcgagcgagcgaga

SEQ ID NO: 407299 - DNA, 16 bp, M. musculus
gagcgagcgagcgagc

SEQ ID NO: 407300 - DNA, 16 bp, M. musculus
gagcgcagagcaagag

SEQ ID NO: 407301 - DNA, 16 bp, M. musculus
gagctaaaatccactt

SEQ ID NO: 407302 - DNA, 17 bp, M. musculus
gagctaaccagtacccc

SEQ ID NO: 407303 - DNA, 16 bp, M. musculus
gagctaagaacagaat

SEQ ID NO: 407304 - DNA, 16 bp, M. musculus
gagctaagcaaagaat

SEQ ID NO: 407305 - DNA, 16 bp, M. musculus
gagctaagtcaagttt

SEQ ID NO: 407306 - DNA, 16 bp, M. musculus
gagctaattgccctca

SEQ ID NO: 407307 - DNA, 16 bp, M. musculus
gagctacaaagtgaga

SEQ ID NO: 407308 - DNA, 16 bp, M. musculus
gagctacaatccagaa

SEQ ID NO: 407309 - DNA, 16 bp, M. musculus
gagctacacacagaaa

SEQ ID NO: 407310 - DNA, 16 bp, M. musculus
gagctacacagaaacc

SEQ ID NO: 407311 - DNA, 16 bp, M. musculus
gagctacataaagaga

SEQ ID NO: 407312 - DNA, 16 bp, M. musculus
gagctacatagtgaga

SEQ ID NO: 407313 - DNA, 16 bp, M. musculus
gagctacatcctcaac

SEQ ID NO: 407314 - DNA, 16 bp, M. musculus
gagctactcagagaaa

SEQ ID NO: 407315 - DNA, 16 bp, M. musculus
gagctagaaagggcaa

SEQ ID NO: 407316 - DNA, 17 bp, M. musculus
gagctagagaaagtagc

SEQ ID NO: 407317 - DNA, 16 bp, M. musculus
gagctagagttacaga

SEQ ID NO: 407318 - DNA, 16 bp, M. musculus
gagctagagtttcagg

SEQ ID NO: 407319 - DNA, 16 bp, M. musculus
gagctagtttcaggac

SEQ ID NO: 407320 - DNA, 16 bp, M. musculus
gagctataggcaatta

SEQ ID NO: 407321 - DNA, 16 bp, M. musculus
gagctatatccccagc

SEQ ID NO: 407322 - DNA, 16 bp, M. musculus
gagctatccagagaaa

SEQ ID NO: 407323 - DNA, 16 bp, M. musculus
gagctatctctcaagc

SEQ ID NO: 407324 - DNA, 16 bp, M. musculus
gagctattggagttct

SEQ ID NO: 407325 - DNA, 16 bp, M. musculus
gagctatttctccagc

SEQ ID NO: 407326 - DNA, 35 bp, M. musculus
gagctcaaactttgctttaattgtggcaaaccagg

SEQ ID NO: 407327 - DNA, 16 bp, M. musculus
gagctcacagcagctg

SEQ ID NO: 407328 - DNA, 16 bp, M. musculus
gagctcacatctcaaa

SEQ ID NO: 407329 - DNA, 16 bp, M. musculus
gagctcacatcttgat

SEQ ID NO: 407330 - DNA, 16 bp, M. musculus
gagctcactatgtaga

SEQ ID NO: 407331 - DNA, 16 bp, M. musculus
gagctcactctataga

SEQ ID NO: 407332 - DNA, 16 bp, M. musculus
gagctcagagaatccc

SEQ ID NO: 407333 - DNA, 16 bp, M. musculus
gagctcagatcccagc

SEQ ID NO: 407334 - DNA, 16 bp, M. musculus
gagctcagatccccag

SEQ ID NO: 407335 - DNA, 16 bp, M. musculus
gagctcagatcctcag

SEQ ID NO: 407336 - DNA, 16 bp, M. musculus
gagctcaggagcctca

SEQ ID NO: 407337 - DNA, 16 bp, M. musculus
gagctcaggcaagctc

SEQ ID NO: 407338 - DNA, 16 bp, M. musculus
gagctcagggaacccc

SEQ ID NO: 407339 - DNA, 16 bp, M. musculus
gagctcagggaccctg

SEQ ID NO: 407340 - DNA, 16 bp, M. musculus
gagctcagttctcagc

SEQ ID NO: 407341 - DNA, 16 bp, M. musculus
gagctcatgtctctgg

SEQ ID NO: 407342 - DNA, 16 bp, M. musculus
gagctccagaccagcc

SEQ ID NO: 407343 - DNA, 16 bp, M. musculus
gagctccagactgctg

SEQ ID NO: 407344 - DNA, 16 bp, M. musculus
gagctccagctccagc

SEQ ID NO: 407345 - DNA, 16 bp, M. musculus
gagctccaggccaaca

SEQ ID NO: 407346 - DNA, 16 bp, M. musculus
gagctccaggccagcc

SEQ ID NO: 407347 - DNA, 16 bp, M. musculus
gagctccaggctagcc

SEQ ID NO: 407348 - DNA, 16 bp, M. musculus
gagctcccagaaacta

SEQ ID NO: 407349 - DNA, 16 bp, M. musculus
gagctccccctgccac

SEQ ID NO: 407350 - DNA, 16 bp, M. musculus
gagctccctgggactg

SEQ ID NO: 407351 - DNA, 16 bp, M. musculus
gagctccctggggtcc

SEQ ID NO: 407352 - DNA, 16 bp, M. musculus
gagctccggactgaca

SEQ ID NO: 407353 - DNA, 16 bp, M. musculus
gagctccgggtactgg

SEQ ID NO: 407354 - DNA, 16 bp, M. musculus
gagctccgtaattaaa

SEQ ID NO: 407355 - DNA, 16 bp, M. musculus
gagctcctaaacctga

SEQ ID NO: 407356 - DNA, 16 bp, M. musculus
gagctcctggttcagt

SEQ ID NO: 407357 - DNA, 16 bp, M. musculus
gagctctcagacactg

SEQ ID NO: 407358 - DNA, 16 bp, M. musculus
gagctctctccccagc

SEQ ID NO: 407359 - DNA, 16 bp, M. musculus
gagctctgaaatctct

SEQ ID NO: 407360 - DNA, 16 bp, M. musculus
gagctctggctgttct

SEQ ID NO: 407361 - DNA, 16 bp, M. musculus
gagctctgggtggtca

SEQ ID NO: 407362 - DNA, 16 bp, M. musculus
gagctctgtgagttca

SEQ ID NO: 407363 - DNA, 16 bp, M. musculus
gagctctgtgagtttg

SEQ ID NO: 407364 - DNA, 16 bp, M. musculus
gagctctgtgtgtgtg

SEQ ID NO: 407365 - DNA, 18 bp, M. musculus
gagctctgtgttcctgaa

SEQ ID NO: 407366 - DNA, 16 bp, M. musculus
gagctcttgacactag

SEQ ID NO: 407367 - DNA, 16 bp, M. musculus
gagctctttggcatga

SEQ ID NO: 407368 - DNA, 16 bp, M. musculus
gagctgaaagagaaga

SEQ ID NO: 407369 - DNA, 16 bp, M. musculus
gagctgaaatcaacca

SEQ ID NO: 407370 - DNA, 16 bp, M. musculus
gagctgaagcagaggc

SEQ ID NO: 407371 - DNA, 16 bp, M. musculus
gagctgaagcggtttg

SEQ ID NO: 407372 - DNA, 16 bp, M. musculus
gagctgaaggagcttg

SEQ ID NO: 407373 - DNA, 16 bp, M. musculus
gagctgaaggggcttt

SEQ ID NO: 407374 - DNA, 16 bp, M. musculus
gagctgaaggtgtctg

SEQ ID NO: 407375 - DNA, 16 bp, M. musculus
gagctgaaggtgtttg

SEQ ID NO: 407376 - DNA, 16 bp, M. musculus
gagctgaatgtgaaga

SEQ ID NO: 407377 - DNA, 16 bp, M. musculus
gagctgacctcacact

SEQ ID NO: 407378 - DNA, 16 bp, M. musculus
gagctgactggccaat

SEQ ID NO: 407379 - DNA, 16 bp, M. musculus
gagctgagaacagaat

SEQ ID NO: 407380 - DNA, 16 bp, M. musculus
gagctgagaatggagt

SEQ ID NO: 407381 - DNA, 16 bp, M. musculus
gagctgagacaaaaag

SEQ ID NO: 407382 - DNA, 16 bp, M. musculus
gagctgagacccagac

SEQ ID NO: 407383 - DNA, 16 bp, M. musculus
gagctgagagagagag

SEQ ID NO: 407384 - DNA, 16 bp, M. musculus
gagctgagattaaagg

SEQ ID NO: 407385 - DNA, 16 bp, M. musculus
gagctgagctgagctg

SEQ ID NO: 407386 - DNA, 16 bp, M. musculus
gagctgaggacagaac

SEQ ID NO: 407387 - DNA, 16 bp, M. musculus
gagctgaggaccgaac

SEQ ID NO: 407388 - DNA, 16 bp, M. musculus
gagctgaggagctgag

SEQ ID NO: 407389 - DNA, 16 bp, M. musculus
gagctgaggcagaagg

SEQ ID NO: 407390 - DNA, 16 bp, M. musculus
gagctgaggcagaggc

SEQ ID NO: 407391 - DNA, 16 bp, M. musculus
gagctgaggcaggaag

SEQ ID NO: 407392 - DNA, 16 bp, M. musculus
gagctgatgaagaagc

SEQ ID NO: 407393 - DNA, 16 bp, M. musculus
gagctgatgccgaggc

SEQ ID NO: 407394 - DNA, 16 bp, M. musculus
gagctgatgttgcatt

SEQ ID NO: 407395 - DNA, 16 bp, M. musculus
gagctgattgtaaaca

SEQ ID NO: 407396 - DNA, 17 bp, M. musculus
gagctgcagattcagag

SEQ ID NO: 407397 - DNA, 16 bp, M. musculus
gagctgcagcctcctc

SEQ ID NO: 407398 - DNA, 16 bp, M. musculus
gagctgcaggccagcc

SEQ ID NO: 407399 - DNA, 16 bp, M. musculus
gagctgcaggctctga

SEQ ID NO: 407400 - DNA, 16 bp, M. musculus
gagctgcaggggtttg

SEQ ID NO: 407401 - DNA, 16 bp, M. musculus
gagctgcatccccagc

SEQ ID NO: 407402 - DNA, 16 bp, M. musculus
gagctgcatttgtcag

SEQ ID NO: 407403 - DNA, 16 bp, M. musculus
gagctgcccagcatgg

SEQ ID NO: 407404 - DNA, 16 bp, M. musculus
gagctgccgctgcctg

SEQ ID NO: 407405 - DNA, 16 bp, M. musculus
gagctgccgctgctga

SEQ ID NO: 407406 - DNA, 16 bp, M. musculus
gagctgcctcagaagc

SEQ ID NO: 407407 - DNA, 16 bp, M. musculus
gagctgcctgcaggct

SEQ ID NO: 407408 - DNA, 16 bp, M. musculus
gagctgcctgcttctg

SEQ ID NO: 407409 - DNA, 16 bp, M. musculus
gagctgctgaagagcc

SEQ ID NO: 407410 - DNA, 16 bp, M. musculus
gagctgctgctgctga

SEQ ID NO: 407411 - DNA, 16 bp, M. musculus
gagctgctgctgctgc

SEQ ID NO: 407412 - DNA, 16 bp, M. musculus
gagctgctgctgggag

SEQ ID NO: 407413 - DNA, 16 bp, M. musculus
gagctgctgttgccct

SEQ ID NO: 407414 - DNA, 16 bp, M. musculus
gagctgcttcttcctc

SEQ ID NO: 407415 - DNA, 16 bp, M. musculus
gagctggaacctggag

SEQ ID NO: 407416 - DNA, 16 bp, M. musculus
gagctggacatggtgg

SEQ ID NO: 407417 - DNA, 16 bp, M. musculus
gagctggagaaacagc

SEQ ID NO: 407418 - DNA, 16 bp, M. musculus
gagctggagacatggc

SEQ ID NO: 407419 - DNA, 16 bp, M. musculus
gagctggagaccagcc

SEQ ID NO: 407420 - DNA, 16 bp, M. musculus
gagctggagagacagc

SEQ ID NO: 407421 - DNA, 16 bp, M. musculus
gagctggagagatgct

SEQ ID NO: 407422 - DNA, 16 bp, M. musculus
gagctggagaggcagc

SEQ ID NO: 407423 - DNA, 16 bp, M. musculus
gagctggagatgagac

SEQ ID NO: 407424 - DNA, 16 bp, M. musculus
gagctggagcaagcag

SEQ ID NO: 407425 - DNA, 16 bp, M. musculus
gagctggagcgatggc

SEQ ID NO: 407426 - DNA, 16 bp, M. musculus
gagctggagctacaga

SEQ ID NO: 407427 - DNA, 16 bp, M. musculus
gagctggagctacagg

SEQ ID NO: 407428 - DNA, 16 bp, M. musculus
gagctggaggcagaag

SEQ ID NO: 407429 - DNA, 16 bp, M. musculus
gagctggaggccagcc

SEQ ID NO: 407430 - DNA, 16 bp, M. musculus
gagctggagttaacag

SEQ ID NO: 407431 - DNA, 16 bp, M. musculus
gagctggagttacaaa

SEQ ID NO: 407432 - DNA, 16 bp, M. musculus
gagctggagttacaga

SEQ ID NO: 407433 - DNA, 16 bp, M. musculus
gagctggcaagatggc

SEQ ID NO: 407434 - DNA, 16 bp, M. musculus
gagctggccccagggt

SEQ ID NO: 407435 - DNA, 16 bp, M. musculus
gagctggccctgccct

SEQ ID NO: 407436 - DNA, 16 bp, M. musculus
gagctggccctgctgg

SEQ ID NO: 407437 - DNA, 16 bp, M. musculus
gagctggctcaggggt

SEQ ID NO: 407438 - DNA, 16 bp, M. musculus
gagctggctcagtagt

SEQ ID NO: 407439 - DNA, 16 bp, M. musculus
gagctggctgtggtgg

SEQ ID NO: 407440 - DNA, 16 bp, M. musculus
gagctgggaagaccac

SEQ ID NO: 407441 - DNA, 16 bp, M. musculus
gagctgggagctggga

SEQ ID NO: 407442 - DNA, 16 bp, M. musculus
gagctgggaggcagag

SEQ ID NO: 407443 - DNA, 16 bp, M. musculus
gagctgggattaaagg

SEQ ID NO: 407444 - DNA, 16 bp, M. musculus
gagctgggcatggtgg

SEQ ID NO: 407445 - DNA, 16 bp, M. musculus
gagctgggccctcccc

SEQ ID NO: 407446 - DNA, 16 bp, M. musculus
gagctgggcctggtgg

SEQ ID NO: 407447 - DNA, 16 bp, M. musculus
gagctgggcgtggtgg

SEQ ID NO: 407448 - DNA, 16 bp, M. musculus
gagctggggtgagctg

SEQ ID NO: 407449 - DNA, 16 bp, M. musculus
gagctggggttacaga

SEQ ID NO: 407450 - DNA, 16 bp, M. musculus
gagctgggtgaagaga

SEQ ID NO: 407451 - DNA, 16 bp, M. musculus
gagctggtcagcccac

SEQ ID NO: 407452 - DNA, 16 bp, M. musculus
gagctggtcctggtgg

SEQ ID NO: 407453 - DNA, 16 bp, M. musculus
gagctggtgaaggaag

SEQ ID NO: 407454 - DNA, 16 bp, M. musculus
gagctggtgccctgag

SEQ ID NO: 407455 - DNA, 16 bp, M. musculus
gagctggtgcctacat

SEQ ID NO: 407456 - DNA, 16 bp, M. musculus
gagctggttctggggt

SEQ ID NO: 407457 - DNA, 16 bp, M. musculus
gagctgtaaagtgtcc

SEQ ID NO: 407458 - DNA, 16 bp, M. musculus
gagctgtattaaaggg

SEQ ID NO: 407459 - DNA, 16 bp, M. musculus
gagctgtctccagccc

SEQ ID NO: 407460 - DNA, 16 bp, M. musculus
gagctgtgtcactggg

SEQ ID NO: 407461 - DNA, 16 bp, M. musculus
gagctgtgtctccagc

SEQ ID NO: 407462 - DNA, 16 bp, M. musculus
gagctgttctaccaga

SEQ ID NO: 407463 - DNA, 16 bp, M. musculus
gagctgttctcagaaa

SEQ ID NO: 407464 - DNA, 16 bp, M. musculus
gagcttaatgggccat

SEQ ID NO: 407465 - DNA, 16 bp, M. musculus
gagcttaccagcagag

SEQ ID NO: 407466 - DNA, 16 bp, M. musculus
gagcttattctgctga

SEQ ID NO: 407467 - DNA, 16 bp, M. musculus
gagcttcaaagaagac

SEQ ID NO: 407468 - DNA, 16 bp, M. musculus
gagcttcaattgagaa

SEQ ID NO: 407469 - DNA, 16 bp, M. musculus
gagcttcacgtggtct

SEQ ID NO: 407470 - DNA, 16 bp, M. musculus
gagcttcaggaagtcc

SEQ ID NO: 407471 - DNA, 16 bp, M. musculus
gagcttcaggccagcc

SEQ ID NO: 407472 - DNA, 16 bp, M. musculus
gagcttccagggacta

SEQ ID NO: 407473 - DNA, 16 bp, M. musculus
gagcttcctgaagctc

SEQ ID NO: 407474 - DNA, 16 bp, M. musculus
gagcttcctgcctctg

SEQ ID NO: 407475 - DNA, 16 bp, M. musculus
gagcttccttcttcca

SEQ ID NO: 407476 - DNA, 16 bp, M. musculus
gagcttctcagaggac

SEQ ID NO: 407477 - DNA, 16 bp, M. musculus
gagcttctcagccatt

SEQ ID NO: 407478 - DNA, 16 bp, M. musculus
gagcttctggggcagc

SEQ ID NO: 407479 - DNA, 16 bp, M. musculus
gagcttgaagcagaaa

SEQ ID NO: 407480 - DNA, 16 bp, M. musculus
gagcttgaggccagcc

SEQ ID NO: 407481 - DNA, 16 bp, M. musculus
gagcttgccgccctat

SEQ ID NO: 407482 - DNA, 16 bp, M. musculus
gagcttgctaacagga

SEQ ID NO: 407483 - DNA, 16 bp, M. musculus
gagcttgctgacagga

SEQ ID NO: 407484 - DNA, 16 bp, M. musculus
gagcttgctggcagga

SEQ ID NO: 407485 - DNA, 16 bp, M. musculus
gagcttggagagatgg

SEQ ID NO: 407486 - DNA, 16 bp, M. musculus
gagcttggccacacca

SEQ ID NO: 407487 - DNA, 20 bp, M. musculus
gagcttggcgcgctgtccct

SEQ ID NO: 407488 - DNA, 16 bp, M. musculus
gagcttggggaatcct

SEQ ID NO: 407489 - DNA, 16 bp, M. musculus
gagcttggggagtctt

SEQ ID NO: 407490 - DNA, 19 bp, M. musculus
gagcttgggggacctctca

SEQ ID NO: 407491 - DNA, 16 bp, M. musculus
gagcttgggtcctctg

SEQ ID NO: 407492 - DNA, 16 bp, M. musculus
gagcttgtgtctcttg

SEQ ID NO: 407493 - DNA, 16 bp, M. musculus
gagcttgttcctccag

SEQ ID NO: 407494 - DNA, 16 bp, M. musculus
gagcttgttcctctag

SEQ ID NO: 407495 - DNA, 16 bp, M. musculus
gagctttaaaaaaaaa

SEQ ID NO: 407496 - DNA, 16 bp, M. musculus
gagctttgaagtttca

SEQ ID NO: 407497 - DNA, 16 bp, M. musculus
gagctttgaggtttta

SEQ ID NO: 407498 - DNA, 16 bp, M. musculus
gagctttgtacaaaga

SEQ ID NO: 407499 - DNA, 16 bp, M. musculus
gagctttgtacagaga

SEQ ID NO: 407500 - DNA, 16 bp, M. musculus
gagctttgttgttgtt

SEQ ID NO: 407501 - DNA, 16 bp, M. musculus
gagcttttaagttctg

SEQ ID NO: 407502 - DNA, 16 bp, M. musculus
gagcttttgctatcct

SEQ ID NO: 407503 - DNA, 16 bp, M. musculus
gagcttttgtccccac

SEQ ID NO: 407504 - DNA, 16 bp, M. musculus
gaggaaaaccaaggga

SEQ ID NO: 407505 - DNA, 16 bp, M. musculus
gaggaaaagctgtgtg

SEQ ID NO: 407506 - DNA, 16 bp, M. musculus
gaggaaaaggcagatg

SEQ ID NO: 407507 - DNA, 16 bp, M. musculus
gaggaaactaagaaag

SEQ ID NO: 407508 - DNA, 16 bp, M. musculus
gaggaaagagtttatt

SEQ ID NO: 407509 - DNA, 16 bp, M. musculus
gaggaaaggatttatt

SEQ ID NO: 407510 - DNA, 16 bp, M. musculus
gaggaaagggtttagt

SEQ ID NO: 407511 - DNA, 16 bp, M. musculus
gaggaaagggtttatt

SEQ ID NO: 407512 - DNA, 16 bp, M. musculus
gaggaaagggtttgtt

SEQ ID NO: 407513 - DNA, 16 bp, M. musculus
gaggaaatacctccat

SEQ ID NO: 407514 - DNA, 16 bp, M. musculus
gaggaaatctcaactg

SEQ ID NO: 407515 - DNA, 16 bp, M. musculus
gaggaaatgaataaat

SEQ ID NO: 407516 - DNA, 16 bp, M. musculus
gaggaaatgtctccat

SEQ ID NO: 407517 - DNA, 16 bp, M. musculus
gaggaacatgaagtaa

SEQ ID NO: 407518 - DNA, 16 bp, M. musculus
gaggaaccatcaaact

SEQ ID NO: 407519 - DNA, 16 bp, M. musculus
gaggaaccctcctcca

SEQ ID NO: 407520 - DNA, 16 bp, M. musculus
gaggaactagagaaag

SEQ ID NO: 407521 - DNA, 16 bp, M. musculus
gaggaactcagagcta

SEQ ID NO: 407522 - DNA, 16 bp, M. musculus
gaggaactggagaaag

SEQ ID NO: 407523 - DNA, 16 bp, M. musculus
gaggaactgggggagg

SEQ ID NO: 407524 - DNA, 16 bp, M. musculus
gaggaactgggtttga

SEQ ID NO: 407525 - DNA, 16 bp, M. musculus
gaggaactgtatgaaa

SEQ ID NO: 407526 - DNA, 17 bp, M. musculus
gaggaactgtattaaaa

SEQ ID NO: 407527 - DNA, 16 bp, M. musculus
gaggaagaaactgaag

SEQ ID NO: 407528 - DNA, 16 bp, M. musculus
gaggaagaacaaaaat

SEQ ID NO: 407529 - DNA, 16 bp, M. musculus
gaggaagaactgaagg

SEQ ID NO: 407530 - DNA, 16 bp, M. musculus
gaggaagaagcagctc

SEQ ID NO: 407531 - DNA, 16 bp, M. musculus
gaggaagaagcaggtg

SEQ ID NO: 407532 - DNA, 16 bp, M. musculus
gaggaagaaggactga

SEQ ID NO: 407533 - DNA, 16 bp, M. musculus
gaggaagacacctgat

SEQ ID NO: 407534 - DNA, 16 bp, M. musculus
gaggaagacagtgact

SEQ ID NO: 407535 - DNA, 16 bp, M. musculus
gaggaagagaagccag

SEQ ID NO: 407536 - DNA, 16 bp, M. musculus
gaggaagaggaacact

SEQ ID NO: 407537 - DNA, 16 bp, M. musculus
gaggaagaggaagctg

SEQ ID NO: 407538 - DNA, 16 bp, M. musculus
gaggaagaggaagtca

SEQ ID NO: 407539 - DNA, 16 bp, M. musculus
gaggaagaggagccag

SEQ ID NO: 407540 - DNA, 16 bp, M. musculus
gaggaagaggatgatg

SEQ ID NO: 407541 - DNA, 16 bp, M. musculus
gaggaagcacaaaatc

SEQ ID NO: 407542 - DNA, 16 bp, M. musculus
gaggaagcacccaagg

SEQ ID NO: 407543 - DNA, 16 bp, M. musculus
gaggaagcagcagcag

SEQ ID NO: 407544 - DNA, 16 bp, M. musculus
gaggaagcaggacatc

SEQ ID NO: 407545 - DNA, 16 bp, M. musculus
gaggaagcaggagctg

SEQ ID NO: 407546 - DNA, 16 bp, M. musculus
gaggaagccctgagtg

SEQ ID NO: 407547 - DNA, 16 bp, M. musculus
gaggaagctgaggcag

SEQ ID NO: 407548 - DNA, 16 bp, M. musculus
gaggaagctgcagttg

SEQ ID NO: 407549 - DNA, 16 bp, M. musculus
gaggaagctggagaga

SEQ ID NO: 407550 - DNA, 16 bp, M. musculus
gaggaaggaagaccaa

SEQ ID NO: 407551 - DNA, 16 bp, M. musculus
gaggaaggacagagac

SEQ ID NO: 407552 - DNA, 16 bp, M. musculus
gaggaaggagccagag

SEQ ID NO: 407553 - DNA, 16 bp, M. musculus
gaggaaggagctgaag

SEQ ID NO: 407554 - DNA, 16 bp, M. musculus
gaggaaggagctggag

SEQ ID NO: 407555 - DNA, 16 bp, M. musculus
gaggaaggattgcagg

SEQ ID NO: 407556 - DNA, 16 bp, M. musculus
gaggaaggatttattt

SEQ ID NO: 407557 - DNA, 16 bp, M. musculus
gaggaaggcagagaca

SEQ ID NO: 407558 - DNA, 16 bp, M. musculus
gaggaagggaaaccag

SEQ ID NO: 407559 - DNA, 16 bp, M. musculus
gaggaagggactggga

SEQ ID NO: 407560 - DNA, 16 bp, M. musculus
gaggaagggctggaga

SEQ ID NO: 407561 - DNA, 16 bp, M. musculus
gaggaagtcagggcag

SEQ ID NO: 407562 - DNA, 16 bp, M. musculus
gaggaagtggaggcag

SEQ ID NO: 407563 - DNA, 16 bp, M. musculus
gaggaagtgggcagcc

SEQ ID NO: 407564 - DNA, 16 bp, M. musculus
gaggaagtggtccaat

SEQ ID NO: 407565 - DNA, 16 bp, M. musculus
gaggaagttcatcact

SEQ ID NO: 407566 - DNA, 16 bp, M. musculus
gaggaagtttctctga

SEQ ID NO: 407567 - DNA, 16 bp, M. musculus
gaggaatacttaatgg

SEQ ID NO: 407568 - DNA, 16 bp, M. musculus
gaggaatctcttttct

SEQ ID NO: 407569 - DNA, 16 bp, M. musculus
gaggaatggattaaaa

SEQ ID NO: 407570 - DNA, 16 bp, M. musculus
gaggaatgtgctgtct

SEQ ID NO: 407571 - DNA, 16 bp, M. musculus
gaggaatgttctttac

SEQ ID NO: 407572 - DNA, 16 bp, M. musculus
gaggaattagagaaag

SEQ ID NO: 407573 - DNA, 16 bp, M. musculus
gaggaattctgacaca

SEQ ID NO: 407574 - DNA, 16 bp, M. musculus
gaggaattggtgtggt

SEQ ID NO: 407575 - DNA, 16 bp, M. musculus
gaggaatttaagaagg

SEQ ID NO: 407576 - DNA, 16 bp, M. musculus
gaggacaacctgggct

SEQ ID NO: 407577 - DNA, 16 bp, M. musculus
gaggacaactttgggg

SEQ ID NO: 407578 - DNA, 16 bp, M. musculus
gaggacaaggaggaca

SEQ ID NO: 407579 - DNA, 16 bp, M. musculus
gaggacacacacacag

SEQ ID NO: 407580 - DNA, 16 bp, M. musculus
gaggacacagagacag

SEQ ID NO: 407581 - DNA, 16 bp, M. musculus
gaggacacaggtttga

SEQ ID NO: 407582 - DNA, 16 bp, M. musculus
gaggacaccaagaaaa

SEQ ID NO: 407583 - DNA, 16 bp, M. musculus
gaggacacgaagcctt

SEQ ID NO: 407584 - DNA, 17 bp, M. musculus
gaggacacggtgtgggt

SEQ ID NO: 407585 - DNA, 16 bp, M. musculus
gaggacactgagaaca

SEQ ID NO: 407586 - DNA, 16 bp, M. musculus
gaggacagaagaggac

SEQ ID NO: 407587 - DNA, 16 bp, M. musculus
gaggacagacagacag

SEQ ID NO: 407588 - DNA, 16 bp, M. musculus
gaggacagagacagac

SEQ ID NO: 407589 - DNA, 16 bp, M. musculus
gaggacagagcaagag

SEQ ID NO: 407590 - DNA, 16 bp, M. musculus
gaggacagagcagcag

SEQ ID NO: 407591 - DNA, 16 bp, M. musculus
gaggacagcctgctct

SEQ ID NO: 407592 - DNA, 16 bp, M. musculus
gaggacagcctggcct

SEQ ID NO: 407593 - DNA, 16 bp, M. musculus
gaggacagctgcagtg

SEQ ID NO: 407594 - DNA, 16 bp, M. musculus
gaggacagggtttatt

SEQ ID NO: 407595 - DNA, 16 bp, M. musculus
gaggacatcaagaaga

SEQ ID NO: 407596 - DNA, 17 bp, M. musculus
gaggacatcaagaaggt

SEQ ID NO: 407597 - DNA, 16 bp, M. musculus
gaggacatcagatctt

SEQ ID NO: 407598 - DNA, 16 bp, M. musculus
gaggacatgaagaagg

SEQ ID NO: 407599 - DNA, 16 bp, M. musculus
gaggacatgaccacag

SEQ ID NO: 407600 - DNA, 16 bp, M. musculus
gaggacatgaccactc

SEQ ID NO: 407601 - DNA, 16 bp, M. musculus
gaggacatgtgtcact

SEQ ID NO: 407602 - DNA, 36 bp, M. musculus
gaggaccacaggctgtggccctgggggacgccctgg

SEQ ID NO: 407603 - DNA, 16 bp, M. musculus
gaggaccagagttcaa

SEQ ID NO: 407604 - DNA, 16 bp, M. musculus
gaggaccaggatgtct

SEQ ID NO: 407605 - DNA, 16 bp, M. musculus
gaggaccaggctggcc

SEQ ID NO: 407606 - DNA, 16 bp, M. musculus
gaggaccatggagctg

SEQ ID NO: 407607 - DNA, 16 bp, M. musculus
gaggaccctagttcaa

SEQ ID NO: 407608 - DNA, 16 bp, M. musculus
gaggaccctgtgttcc

SEQ ID NO: 407609 - DNA, 16 bp, M. musculus
gaggaccggagttcag

SEQ ID NO: 407610 - DNA, 16 bp, M. musculus
gaggacctaactgagg

SEQ ID NO: 407611 - DNA, 16 bp, M. musculus
gaggacctcagggaag

SEQ ID NO: 407612 - DNA, 16 bp, M. musculus
gaggacctctggaaga

SEQ ID NO: 407613 - DNA, 16 bp, M. musculus
gaggacctgaattcag

SEQ ID NO: 407614 - DNA, 16 bp, M. musculus
gaggacctgaatttga

SEQ ID NO: 407615 - DNA, 16 bp, M. musculus
gaggacctgagtgtgg

SEQ ID NO: 407616 - DNA, 16 bp, M. musculus
gaggacctgagttcaa

SEQ ID NO: 407617 - DNA, 22 bp, M. musculus
gaggacctgagttcagttccca

SEQ ID NO: 407618 - DNA, 16 bp, M. musculus
gaggacctgagttcca

SEQ ID NO: 407619 - DNA, 16 bp, M. musculus
gaggacctgagtttgg

SEQ ID NO: 407620 - DNA, 16 bp, M. musculus
gaggacctgatgcaga

SEQ ID NO: 407621 - DNA, 16 bp, M. musculus
gaggacctggcttcag

SEQ ID NO: 407622 - DNA, 16 bp, M. musculus
gaggacctgggagaag

SEQ ID NO: 407623 - DNA, 16 bp, M. musculus
gaggacctgggaggaa

SEQ ID NO: 407624 - DNA, 16 bp, M. musculus
gaggacctgggttcac

SEQ ID NO: 407625 - DNA, 16 bp, M. musculus
gaggacctgggttcga

SEQ ID NO: 407626 - DNA, 16 bp, M. musculus
gaggacctgggtttga

SEQ ID NO: 407627 - DNA, 16 bp, M. musculus
gaggacctgggtttgc

SEQ ID NO: 407628 - DNA, 16 bp, M. musculus
gaggacctgtgtttgg

SEQ ID NO: 407629 - DNA, 16 bp, M. musculus
gaggactctccacgcc

SEQ ID NO: 407630 - DNA, 16 bp, M. musculus
gaggactggaatttgg

SEQ ID NO: 407631 - DNA, 16 bp, M. musculus
gaggactgtggtgccc

SEQ ID NO: 407632 - DNA, 16 bp, M. musculus
gaggacttaagccttt

SEQ ID NO: 407633 - DNA, 16 bp, M. musculus
gaggacttcaagaagg

SEQ ID NO: 407634 - DNA, 16 bp, M. musculus
gaggacttcagggtct

SEQ ID NO: 407635 - DNA, 16 bp, M. musculus
gaggacttctgggtct

SEQ ID NO: 407636 - DNA, 16 bp, M. musculus
gaggacttgaatttgg

SEQ ID NO: 407637 - DNA, 16 bp, M. musculus
gaggactttaagaagg

SEQ ID NO: 407638 - DNA, 17 bp, M. musculus
gaggactttgaaagttg

SEQ ID NO: 407639 - DNA, 16 bp, M. musculus
gaggactttgcctcag

SEQ ID NO: 407640 - DNA, 16 bp, M. musculus
gaggagaaactggaaa

SEQ ID NO: 407641 - DNA, 16 bp, M. musculus
gaggagaaactgggaa

SEQ ID NO: 407642 - DNA, 16 bp, M. musculus
gaggagaaagttggga

SEQ ID NO: 407643 - DNA, 16 bp, M. musculus
gaggagaagatggcag

SEQ ID NO: 407644 - DNA, 16 bp, M. musculus
gaggagaagccctagg

SEQ ID NO: 407645 - DNA, 16 bp, M. musculus
gaggagaagctgagag

SEQ ID NO: 407646 - DNA, 16 bp, M. musculus
gaggagaatcttctct

SEQ ID NO: 407647 - DNA, 16 bp, M. musculus
gaggagacagatgtgg

SEQ ID NO: 407648 - DNA, 16 bp, M. musculus
gaggagacaggagaat

SEQ ID NO: 407649 - DNA, 16 bp, M. musculus
gaggagacagggatga

SEQ ID NO: 407650 - DNA, 16 bp, M. musculus
gaggagactgcaggat

SEQ ID NO: 407651 - DNA, 16 bp, M. musculus
gaggagactggagaga

SEQ ID NO: 407652 - DNA, 16 bp, M. musculus
gaggagagcttgccag

SEQ ID NO: 407653 - DNA, 16 bp, M. musculus
gaggagaggaccttgg

SEQ ID NO: 407654 - DNA, 16 bp, M. musculus
gaggagaggatcttgg

SEQ ID NO: 407655 - DNA, 16 bp, M. musculus
gaggagaggcccatgg

SEQ ID NO: 407656 - DNA, 17 bp, M. musculus
gaggagaggccctctgt

SEQ ID NO: 407657 - DNA, 16 bp, M. musculus
gaggagagtgacccca

SEQ ID NO: 407658 - DNA, 16 bp, M. musculus
gaggagatggagacag

SEQ ID NO: 407659 - DNA, 16 bp, M. musculus
gaggagatggctctgt

SEQ ID NO: 407660 - DNA, 16 bp, M. musculus
gaggagatgtacagag

SEQ ID NO: 407661 - DNA, 16 bp, M. musculus
gaggagatgtggcctt

SEQ ID NO: 407662 - DNA, 16 bp, M. musculus
gaggagcaagctccag

SEQ ID NO: 407663 - DNA, 16 bp, M. musculus
gaggagcacacctggc

SEQ ID NO: 407664 - DNA, 16 bp, M. musculus
gaggagcagagagcct

SEQ ID NO: 407665 - DNA, 16 bp, M. musculus
gaggagcagatggcag

SEQ ID NO: 407666 - DNA, 16 bp, M. musculus
gaggagcagcagcagg

SEQ ID NO: 407667 - DNA, 16 bp, M. musculus
gaggagcagcccttgg

SEQ ID NO: 407668 - DNA, 16 bp, M. musculus
gaggagcaggagcaag

SEQ ID NO: 407669 - DNA, 16 bp, M. musculus
gaggagccaccagact

SEQ ID NO: 407670 - DNA, 16 bp, M. musculus
gaggagccagaggaaa

SEQ ID NO: 407671 - DNA, 16 bp, M. musculus
gaggagccagaggagc

SEQ ID NO: 407672 - DNA, 16 bp, M. musculus
gaggagcccgaggaaa

SEQ ID NO: 407673 - DNA, 16 bp, M. musculus
gaggagccgggcgtgg

SEQ ID NO: 407674 - DNA, 16 bp, M. musculus
gaggagcctgaggaaa

SEQ ID NO: 407675 - DNA, 16 bp, M. musculus
gaggagctagaaaaaa

SEQ ID NO: 407676 - DNA, 16 bp, M. musculus
gaggagctagagagat

SEQ ID NO: 407677 - DNA, 16 bp, M. musculus
gaggagctagagcaag

SEQ ID NO: 407678 - DNA, 16 bp, M. musculus
gaggagctagtgaaag

SEQ ID NO: 407679 - DNA, 16 bp, M. musculus
gaggagctcgagaaag

SEQ ID NO: 407680 - DNA, 16 bp, M. musculus
gaggagctgaaagttc

SEQ ID NO: 407681 - DNA, 16 bp, M. musculus
gaggagctgagaggag

SEQ ID NO: 407682 - DNA, 16 bp, M. musculus
gaggagctgaggcagg

SEQ ID NO: 407683 - DNA, 16 bp, M. musculus
gaggagctgagggagg

SEQ ID NO: 407684 - DNA, 16 bp, M. musculus
gaggagctggagagat

SEQ ID NO: 407685 - DNA, 16 bp, M. musculus
gaggagctggaggaag

SEQ ID NO: 407686 - DNA, 16 bp, M. musculus
gaggagctggctcagt

SEQ ID NO: 407687 - DNA, 16 bp, M. musculus
gaggagctgggaagag

SEQ ID NO: 407688 - DNA, 16 bp, M. musculus
gaggagctgggaggaa

SEQ ID NO: 407689 - DNA, 16 bp, M. musculus
gaggagctgggaggag

SEQ ID NO: 407690 - DNA, 16 bp, M. musculus
gaggagctgggagttc

SEQ ID NO: 407691 - DNA, 16 bp, M. musculus
gaggagctggggagga

SEQ ID NO: 407692 - DNA, 16 bp, M. musculus
gaggaggaaagggttt

SEQ ID NO: 407693 - DNA, 16 bp, M. musculus
gaggaggaaatggttt

SEQ ID NO: 407694 - DNA, 16 bp, M. musculus
gaggaggaactggaga

SEQ ID NO: 407695 - DNA, 16 bp, M. musculus
gaggaggaagcagcag

SEQ ID NO: 407696 - DNA, 17 bp, M. musculus
gaggaggaagcagctca

SEQ ID NO: 407697 - DNA, 16 bp, M. musculus
gaggaggaagccacca

SEQ ID NO: 407698 - DNA, 22 bp, M. musculus
gaggaggaaggcgaattagctt

SEQ ID NO: 407699 - DNA, 16 bp, M. musculus
gaggaggaagtgacca

SEQ ID NO: 407700 - DNA, 16 bp, M. musculus
gaggaggaatggaatg

SEQ ID NO: 407701 - DNA, 16 bp, M. musculus
gaggaggagagactgg

SEQ ID NO: 407702 - DNA, 16 bp, M. musculus
gaggaggagcagaagc

SEQ ID NO: 407703 - DNA, 16 bp, M. musculus
gaggaggagctgagag

SEQ ID NO: 407704 - DNA, 16 bp, M. musculus
gaggaggagctggagg

SEQ ID NO: 407705 - DNA, 16 bp, M. musculus
gaggaggagctgggag

SEQ ID NO: 407706 - DNA, 16 bp, M. musculus
gaggaggaggaacagc

SEQ ID NO: 407707 - DNA, 16 bp, M. musculus
gaggaggaggagacca

SEQ ID NO: 407708 - DNA, 16 bp, M. musculus
gaggaggaggagactg

SEQ ID NO: 407709 - DNA, 16 bp, M. musculus
gaggaggaggagatct

SEQ ID NO: 407710 - DNA, 16 bp, M. musculus
gaggaggaggagctga

SEQ ID NO: 407711 - DNA, 16 bp, M. musculus
gaggaggaggagctgg

SEQ ID NO: 407712 - DNA, 16 bp, M. musculus
gaggaggaggaggcta

SEQ ID NO: 407713 - DNA, 16 bp, M. musculus
gaggaggaggatgacc

SEQ ID NO: 407714 - DNA, 16 bp, M. musculus
gaggaggaggctgagg

SEQ ID NO: 407715 - DNA, 16 bp, M. musculus
gaggaggaggctgcag

SEQ ID NO: 407716 - DNA, 16 bp, M. musculus
gaggaggaggctgtgg

SEQ ID NO: 407717 - DNA, 28 bp, M. musculus
gaggaggagttcaataatcaagtggata

SEQ ID NO: 407718 - DNA, 16 bp, M. musculus
gaggaggcagaaaaat

SEQ ID NO: 407719 - DNA, 16 bp, M. musculus
gaggaggcagagacag

SEQ ID NO: 407720 - DNA, 16 bp, M. musculus
gaggaggcctggggag

SEQ ID NO: 407721 - DNA, 16 bp, M. musculus
gaggaggctgaggcag

SEQ ID NO: 407722 - DNA, 16 bp, M. musculus
gaggaggctgcagctc

SEQ ID NO: 407723 - DNA, 16 bp, M. musculus
gaggaggctggaggga

SEQ ID NO: 407724 - DNA, 16 bp, M. musculus
gaggagggcaggctgc

SEQ ID NO: 407725 - DNA, 16 bp, M. musculus
gaggagggccaggcag

SEQ ID NO: 407726 - DNA, 16 bp, M. musculus
gaggagggtgactctg

SEQ ID NO: 407727 - DNA, 16 bp, M. musculus
gaggagggtttcaaag

SEQ ID NO: 407728 - DNA, 16 bp, M. musculus
gaggaggtatgggatg

SEQ ID NO: 407729 - DNA, 16 bp, M. musculus
gaggaggtgaagctgc

SEQ ID NO: 407730 - DNA, 16 bp, M. musculus
gaggaggtgcctagtc

SEQ ID NO: 407731 - DNA, 16 bp, M. musculus
gaggagtcagttctct

SEQ ID NO: 407732 - DNA, 16 bp, M. musculus
gaggagtgagagaagt

SEQ ID NO: 407733 - DNA, 16 bp, M. musculus
gaggagtggacagcag

SEQ ID NO: 407734 - DNA, 16 bp, M. musculus
gaggagtggccttgtt

SEQ ID NO: 407735 - DNA, 16 bp, M. musculus
gaggagtgttcctttt

SEQ ID NO: 407736 - DNA, 16 bp, M. musculus
gaggagttagagaaag

SEQ ID NO: 407737 - DNA, 16 bp, M. musculus
gaggagttagagaagg

SEQ ID NO: 407738 - DNA, 16 bp, M. musculus
gaggagttcttactca

SEQ ID NO: 407739 - DNA, 16 bp, M. musculus
gaggagttttatttta

SEQ ID NO: 407740 - DNA, 16 bp, M. musculus
gaggatatcatttgaa

SEQ ID NO: 407741 - DNA, 16 bp, M. musculus
gaggatcaaaagttca

SEQ ID NO: 407742 - DNA, 16 bp, M. musculus
gaggatcagaagttga

SEQ ID NO: 407743 - DNA, 16 bp, M. musculus
gaggatcagctccacc

SEQ ID NO: 407744 - DNA, 16 bp, M. musculus
gaggatcaggagctca

SEQ ID NO: 407745 - DNA, 16 bp, M. musculus
gaggatcccagaagat

SEQ ID NO: 407746 - DNA, 16 bp, M. musculus
gaggatccctggggct

SEQ ID NO: 407747 - DNA, 16 bp, M. musculus
gaggatcgggagttca

SEQ ID NO: 407748 - DNA, 16 bp, M. musculus
gaggatctctttgagt

SEQ ID NO: 407749 - DNA, 16 bp, M. musculus
gaggatctgagttcaa

SEQ ID NO: 407750 - DNA, 16 bp, M. musculus
gaggatctgggaggag

SEQ ID NO: 407751 - DNA, 16 bp, M. musculus
gaggatgaagagttca

SEQ ID NO: 407752 - DNA, 16 bp, M. musculus
gaggatgacagaggag

SEQ ID NO: 407753 - DNA, 16 bp, M. musculus
gaggatgaccttgtgg

SEQ ID NO: 407754 - DNA, 16 bp, M. musculus
gaggatgaggatgatg

SEQ ID NO: 407755 - DNA, 16 bp, M. musculus
gaggatgaggcaggag

SEQ ID NO: 407756 - DNA, 16 bp, M. musculus
gaggatgcacttagtc

SEQ ID NO: 407757 - DNA, 16 bp, M. musculus
gaggatgcagagaaag

SEQ ID NO: 407758 - DNA, 16 bp, M. musculus
gaggatgcccttgtca

SEQ ID NO: 407759 - DNA, 16 bp, M. musculus
gaggatgctctgctaa

SEQ ID NO: 407760 - DNA, 16 bp, M. musculus
gaggatgctgagaaga

SEQ ID NO: 407761 - DNA, 16 bp, M. musculus
gaggatgctgagaagg

SEQ ID NO: 407762 - DNA, 16 bp, M. musculus
gaggatgctgggaatt

SEQ ID NO: 407763 - DNA, 16 bp, M. musculus
gaggatgctttgctga

SEQ ID NO: 407764 - DNA, 16 bp, M. musculus
gaggatggaggcctgg

SEQ ID NO: 407765 - DNA, 16 bp, M. musculus
gaggatggcattgtct

SEQ ID NO: 407766 - DNA, 16 bp, M. musculus
gaggatgggactggga

SEQ ID NO: 407767 - DNA, 16 bp, M. musculus
gaggatgggctttgag

SEQ ID NO: 407768 - DNA, 16 bp, M. musculus
gaggatgtcctagtca

SEQ ID NO: 407769 - DNA, 16 bp, M. musculus
gaggatgtgaagaaag

SEQ ID NO: 407770 - DNA, 16 bp, M. musculus
gaggatgtgagttcaa

SEQ ID NO: 407771 - DNA, 16 bp, M. musculus
gaggatgtggagaaag

SEQ ID NO: 407772 - DNA, 16 bp, M. musculus
gaggatgtggctcagt

SEQ ID NO: 407773 - DNA, 16 bp, M. musculus
gaggatgtgtgaatct

SEQ ID NO: 407774 - DNA, 16 bp, M. musculus
gaggattctgggaagg

SEQ ID NO: 407775 - DNA, 16 bp, M. musculus
gaggattgcctcatct

SEQ ID NO: 407776 - DNA, 16 bp, M. musculus
gaggattgtcagcaaa

SEQ ID NO: 407777 - DNA, 16 bp, M. musculus
gaggatttttgagttt

SEQ ID NO: 407778 - DNA, 16 bp, M. musculus
gaggcaaaagcaggtg

SEQ ID NO: 407779 - DNA, 16 bp, M. musculus
gaggcaaagaaagatg

SEQ ID NO: 407780 - DNA, 16 bp, M. musculus
gaggcaaaggcagagg

SEQ ID NO: 407781 - DNA, 16 bp, M. musculus
gaggcaaaggcaggag

SEQ ID NO: 407782 - DNA, 16 bp, M. musculus
gaggcaaaggcaggta

SEQ ID NO: 407783 - DNA, 17 bp, M. musculus
gaggcaaagtttggagc

SEQ ID NO: 407784 - DNA, 16 bp, M. musculus
gaggcaaattctggga

SEQ ID NO: 407785 - DNA, 16 bp, M. musculus
gaggcaagaggactgt

SEQ ID NO: 407786 - DNA, 16 bp, M. musculus
gaggcaagaggatctt

SEQ ID NO: 407787 - DNA, 16 bp, M. musculus
gaggcaagcagatctg

SEQ ID NO: 407788 - DNA, 16 bp, M. musculus
gaggcaagcagcccct

SEQ ID NO: 407789 - DNA, 16 bp, M. musculus
gaggcaagcctgagct

SEQ ID NO: 407790 - DNA, 17 bp, M. musculus
gaggcaagctctcctct

SEQ ID NO: 407791 - DNA, 16 bp, M. musculus
gaggcaagggcaaaaa

SEQ ID NO: 407792 - DNA, 16 bp, M. musculus
gaggcaagggcaggtg

SEQ ID NO: 407793 - DNA, 16 bp, M. musculus
gaggcaagtgctctac

SEQ ID NO: 407794 - DNA, 17 bp, M. musculus
gaggcaagtggatttct

SEQ ID NO: 407795 - DNA, 16 bp, M. musculus
gaggcaatctctggat

SEQ ID NO: 407796 - DNA, 16 bp, M. musculus
gaggcacacagagaga

SEQ ID NO: 407797 - DNA, 16 bp, M. musculus
gaggcacacgccttta

SEQ ID NO: 407798 - DNA, 16 bp, M. musculus
gaggcacagaggcaga

SEQ ID NO: 407799 - DNA, 16 bp, M. musculus
gaggcacctagagaca

SEQ ID NO: 407800 - DNA, 16 bp, M. musculus
gaggcagaaacagaag

SEQ ID NO: 407801 - DNA, 16 bp, M. musculus
gaggcagaaacaggag

SEQ ID NO: 407802 - DNA, 16 bp, M. musculus
gaggcagaaccagaac

SEQ ID NO: 407803 - DNA, 16 bp, M. musculus
gaggcagaactagaga

SEQ ID NO: 407804 - DNA, 16 bp, M. musculus
gaggcagaactggagg

SEQ ID NO: 407805 - DNA, 16 bp, M. musculus
gaggcagaagaaggtg

SEQ ID NO: 407806 - DNA, 16 bp, M. musculus
gaggcagaagaatcag

SEQ ID NO: 407807 - DNA, 16 bp, M. musculus
gaggcagaagaggcag

SEQ ID NO: 407808 - DNA, 16 bp, M. musculus
gaggcagaagcagaag

SEQ ID NO: 407809 - DNA, 16 bp, M. musculus
gaggcagaagcaggaa

SEQ ID NO: 407810 - DNA, 16 bp, M. musculus
gaggcagaagcaggct

SEQ ID NO: 407811 - DNA, 16 bp, M. musculus
gaggcagaagcaggtg

SEQ ID NO: 407812 - DNA, 16 bp, M. musculus
gaggcagaagcagttg

SEQ ID NO: 407813 - DNA, 16 bp, M. musculus
gaggcagaagcatgca

SEQ ID NO: 407814 - DNA, 16 bp, M. musculus
gaggcagaagcatgtg

SEQ ID NO: 407815 - DNA, 16 bp, M. musculus
gaggcagaagcctcac

SEQ ID NO: 407816 - DNA, 16 bp, M. musculus
gaggcagaagctggag

SEQ ID NO: 407817 - DNA, 16 bp, M. musculus
gaggcagaaggactgc

SEQ ID NO: 407818 - DNA, 16 bp, M. musculus
gaggcagaaggatcag

SEQ ID NO: 407819 - DNA, 16 bp, M. musculus
gaggcagaatcaggag

SEQ ID NO: 407820 - DNA, 16 bp, M. musculus
gaggcagacaaagtga

SEQ ID NO: 407821 - DNA, 16 bp, M. musculus
gaggcagacacagaga

SEQ ID NO: 407822 - DNA, 16 bp, M. musculus
gaggcagagaaagcag

SEQ ID NO: 407823 - DNA, 16 bp, M. musculus
gaggcagagaaaggca

SEQ ID NO: 407824 - DNA, 16 bp, M. musculus
gaggcagagacagaca

SEQ ID NO: 407825 - DNA, 16 bp, M. musculus
gaggcagagacagctg

SEQ ID NO: 407826 - DNA, 16 bp, M. musculus
gaggcagagacaggaa

SEQ ID NO: 407827 - DNA, 16 bp, M. musculus
gaggcagagaccatgg

SEQ ID NO: 407828 - DNA, 16 bp, M. musculus
gaggcagagagacagg

SEQ ID NO: 407829 - DNA, 16 bp, M. musculus
gaggcagagagaggca

SEQ ID NO: 407830 - DNA, 16 bp, M. musculus
gaggcagagagcagag

SEQ ID NO: 407831 - DNA, 16 bp, M. musculus
gaggcagagaggcaag

SEQ ID NO: 407832 - DNA, 16 bp, M. musculus
gaggcagagataggta

SEQ ID NO: 407833 - DNA, 16 bp, M. musculus
gaggcagagataggtg

SEQ ID NO: 407834 - DNA, 16 bp, M. musculus
gaggcagagccaggag

SEQ ID NO: 407835 - DNA, 16 bp, M. musculus
gaggcagaggaggtgg

SEQ ID NO: 407836 - DNA, 16 bp, M. musculus
gaggcagaggatggcc

SEQ ID NO: 407837 - DNA, 16 bp, M. musculus
gaggcagaggcaaagg

SEQ ID NO: 407838 - DNA, 16 bp, M. musculus
gaggcagaggcacgca

SEQ ID NO: 407839 - DNA, 16 bp, M. musculus
gaggcagaggcagaca

SEQ ID NO: 407840 - DNA, 16 bp, M. musculus
gaggcagaggcagagt

SEQ ID NO: 407841 - DNA, 16 bp, M. musculus
gaggcagaggcagatg

SEQ ID NO: 407842 - DNA, 28 bp, M. musculus
gaggcagaggcaggcggatttctgagtt

SEQ ID NO: 407843 - DNA, 16 bp, M. musculus
gaggcagaggcagtca

SEQ ID NO: 407844 - DNA, 16 bp, M. musculus
gaggcagaggcagttg

SEQ ID NO: 407845 - DNA, 16 bp, M. musculus
gaggcagaggccaagg

SEQ ID NO: 407846 - DNA, 16 bp, M. musculus
gaggcagaggccagag

SEQ ID NO: 407847 - DNA, 16 bp, M. musculus
gaggcagaggcgggca

SEQ ID NO: 407848 - DNA, 16 bp, M. musculus
gaggcagaggctgcag

SEQ ID NO: 407849 - DNA, 16 bp, M. musculus
gaggcagaggctggag

SEQ ID NO: 407850 - DNA, 16 bp, M. musculus
gaggcagaggctggct

SEQ ID NO: 407851 - DNA, 16 bp, M. musculus
gaggcagaggctgggg

SEQ ID NO: 407852 - DNA, 16 bp, M. musculus
gaggcagagggatcag

SEQ ID NO: 407853 - DNA, 16 bp, M. musculus
gaggcagaggtagaag

SEQ ID NO: 407854 - DNA, 16 bp, M. musculus
gaggcagaggtagagg

SEQ ID NO: 407855 - DNA, 16 bp, M. musculus
gaggcagaggtagatg

SEQ ID NO: 407856 - DNA, 16 bp, M. musculus
gaggcagaggtggcag

SEQ ID NO: 407857 - DNA, 16 bp, M. musculus
gaggcagagtcagggg

SEQ ID NO: 407858 - DNA, 16 bp, M. musculus
gaggcagagtttgagg

SEQ ID NO: 407859 - DNA, 16 bp, M. musculus
gaggcagatgcaggag

SEQ ID NO: 407860 - DNA, 16 bp, M. musculus
gaggcagatggatccc

SEQ ID NO: 407861 - DNA, 18 bp, M. musculus
gaggcagatggatctctg

SEQ ID NO: 407862 - DNA, 16 bp, M. musculus
gaggcagatgtttgca

SEQ ID NO: 407863 - DNA, 16 bp, M. musculus
gaggcagcaggatcag

SEQ ID NO: 407864 - DNA, 16 bp, M. musculus
gaggcagcccctgctc

SEQ ID NO: 407865 - DNA, 16 bp, M. musculus
gaggcagctggtcaca

SEQ ID NO: 407866 - DNA, 16 bp, M. musculus
gaggcagctttcatta

SEQ ID NO: 407867 - DNA, 16 bp, M. musculus
gaggcaggaagatcag

SEQ ID NO: 407868 - DNA, 16 bp, M. musculus
gaggcaggaagatctt

SEQ ID NO: 407869 - DNA, 16 bp, M. musculus
gaggcaggaaggaccc

SEQ ID NO: 407870 - DNA, 16 bp, M. musculus
gaggcaggagaagcag

SEQ ID NO: 407871 - DNA, 16 bp, M. musculus
gaggcaggagaatgac

SEQ ID NO: 407872 - DNA, 16 bp, M. musculus
gaggcaggagcagatg

SEQ ID NO: 407873 - DNA, 16 bp, M. musculus
gaggcaggagcaggtg

SEQ ID NO: 407874 - DNA, 16 bp, M. musculus
gaggcaggagccatgg

SEQ ID NO: 407875 - DNA, 16 bp, M. musculus
gaggcaggagctcatg

SEQ ID NO: 407876 - DNA, 16 bp, M. musculus
gaggcaggagctgaca

SEQ ID NO: 407877 - DNA, 16 bp, M. musculus
gaggcaggagctggag

SEQ ID NO: 407878 - DNA, 16 bp, M. musculus
gaggcaggaggacctc

SEQ ID NO: 407879 - DNA, 16 bp, M. musculus
gaggcaggaggatccc

SEQ ID NO: 407880 - DNA, 16 bp, M. musculus
gaggcaggaggatccg

SEQ ID NO: 407881 - DNA, 16 bp, M. musculus
gaggcaggaggatgag

SEQ ID NO: 407882 - DNA, 16 bp, M. musculus
gaggcaggaggattga

SEQ ID NO: 407883 - DNA, 16 bp, M. musculus
gaggcaggagggtcag

SEQ ID NO: 407884 - DNA, 16 bp, M. musculus
gaggcaggaggtgatg

SEQ ID NO: 407885 - DNA, 16 bp, M. musculus
gaggcaggaggttcag

SEQ ID NO: 407886 - DNA, 16 bp, M. musculus
gaggcaggagtgagtg

SEQ ID NO: 407887 - DNA, 16 bp, M. musculus
gaggcaggagtgggag

SEQ ID NO: 407888 - DNA, 16 bp, M. musculus
gaggcaggagttgatg

SEQ ID NO: 407889 - DNA, 16 bp, M. musculus
gaggcaggatgatcag

SEQ ID NO: 407890 - DNA, 16 bp, M. musculus
gaggcaggcagatcac

SEQ ID NO: 407891 - DNA, 24 bp, M. musculus
gaggcaggcagatttctgagttcg

SEQ ID NO: 407892 - DNA, 16 bp, M. musculus
gaggcaggcaggcagg

SEQ ID NO: 407893 - DNA, 16 bp, M. musculus
gaggcaggcggatctc

SEQ ID NO: 407894 - DNA, 16 bp, M. musculus
gaggcagggaagggtg

SEQ ID NO: 407895 - DNA, 16 bp, M. musculus
gaggcagggacaggtg

SEQ ID NO: 407896 - DNA, 16 bp, M. musculus
gaggcagggccacctg

SEQ ID NO: 407897 - DNA, 16 bp, M. musculus
gaggcagggggatcac

SEQ ID NO: 407898 - DNA, 16 bp, M. musculus
gaggcagggggatcag

SEQ ID NO: 407899 - DNA, 16 bp, M. musculus
gaggcagggggatctt

SEQ ID NO: 407900 - DNA, 16 bp, M. musculus
gaggcagggggattcc

SEQ ID NO: 407901 - DNA, 16 bp, M. musculus
gaggcagggtctttct

SEQ ID NO: 407902 - DNA, 16 bp, M. musculus
gaggcagttaagctgt

SEQ ID NO: 407903 - DNA, 16 bp, M. musculus
gaggcataaaatttat

SEQ ID NO: 407904 - DNA, 16 bp, M. musculus
gaggcatttcctcagg

SEQ ID NO: 407905 - DNA, 16 bp, M. musculus
gaggcattttctcagt

SEQ ID NO: 407906 - DNA, 16 bp, M. musculus
gaggcattttcttagt

SEQ ID NO: 407907 - DNA, 16 bp, M. musculus
gaggccaacttgggct

SEQ ID NO: 407908 - DNA, 16 bp, M. musculus
gaggccaacttggtct

SEQ ID NO: 407909 - DNA, 17 bp, M. musculus
gaggccaagcagcaagc

SEQ ID NO: 407910 - DNA, 16 bp, M. musculus
gaggccaagcagcccc

SEQ ID NO: 407911 - DNA, 16 bp, M. musculus
gaggccaagctggtct

SEQ ID NO: 407912 - DNA, 16 bp, M. musculus
gaggccaaggcaggtg

SEQ ID NO: 407913 - DNA, 16 bp, M. musculus
gaggccacagttaccc

SEQ ID NO: 407914 - DNA, 16 bp, M. musculus
gaggccacggagcagt

SEQ ID NO: 407915 - DNA, 16 bp, M. musculus
gaggccagaagacagc

SEQ ID NO: 407916 - DNA, 18 bp, M. musculus
gaggccagaagagggcgc

SEQ ID NO: 407917 - DNA, 16 bp, M. musculus
gaggccagaagagggt

SEQ ID NO: 407918 - DNA, 16 bp, M. musculus
gaggccagaagatggc

SEQ ID NO: 407919 - DNA, 16 bp, M. musculus
gaggccagaaggaggc

SEQ ID NO: 407920 - DNA, 16 bp, M. musculus
gaggccagaagtcaat

SEQ ID NO: 407921 - DNA, 16 bp, M. musculus
gaggccagacaagcca

SEQ ID NO: 407922 - DNA, 16 bp, M. musculus
gaggccagacaaggaa

SEQ ID NO: 407923 - DNA, 16 bp, M. musculus
gaggccagacaaggtg

SEQ ID NO: 407924 - DNA, 16 bp, M. musculus
gaggccagactgggct

SEQ ID NO: 407925 - DNA, 16 bp, M. musculus
gaggccagagaagggt

SEQ ID NO: 407926 - DNA, 16 bp, M. musculus
gaggccagagaggcca

SEQ ID NO: 407927 - DNA, 16 bp, M. musculus
gaggccagagagggtg

SEQ ID NO: 407928 - DNA, 16 bp, M. musculus
gaggccagagatcaac

SEQ ID NO: 407929 - DNA, 16 bp, M. musculus
gaggccagaggagagt

SEQ ID NO: 407930 - DNA, 16 bp, M. musculus
gaggccagaggtcaac

SEQ ID NO: 407931 - DNA, 16 bp, M. musculus
gaggccagaggtcacc

SEQ ID NO: 407932 - DNA, 16 bp, M. musculus
gaggccagaggtcagt

SEQ ID NO: 407933 - DNA, 16 bp, M. musculus
gaggccagaggtgttg

SEQ ID NO: 407934 - DNA, 16 bp, M. musculus
gaggccagataaggca

SEQ ID NO: 407935 - DNA, 16 bp, M. musculus
gaggccagcaagaaca

SEQ ID NO: 407936 - DNA, 16 bp, M. musculus
gaggccagccaaggct

SEQ ID NO: 407937 - DNA, 16 bp, M. musculus
gaggccagccatgaac

SEQ ID NO: 407938 - DNA, 16 bp, M. musculus
gaggccagcctacaga

SEQ ID NO: 407939 - DNA, 16 bp, M. musculus
gaggccagcctgaact

SEQ ID NO: 407940 - DNA, 16 bp, M. musculus
gaggccagcctgagct

SEQ ID NO: 407941 - DNA, 17 bp, M. musculus
gaggccagcctgagcta

SEQ ID NO: 407942 - DNA, 16 bp, M. musculus
gaggccagcctgggac

SEQ ID NO: 407943 - DNA, 16 bp, M. musculus
gaggccagcctgggct

SEQ ID NO: 407944 - DNA, 16 bp, M. musculus
gaggccagcctggggt

SEQ ID NO: 407945 - DNA, 16 bp, M. musculus
gaggccagcctggttt

SEQ ID NO: 407946 - DNA, 16 bp, M. musculus
gaggccagcctgttct

SEQ ID NO: 407947 - DNA, 16 bp, M. musculus
gaggccagcgccatct

SEQ ID NO: 407948 - DNA, 16 bp, M. musculus
gaggccagcttgggtt

SEQ ID NO: 407949 - DNA, 16 bp, M. musculus
gaggccaggccaggca

SEQ ID NO: 407950 - DNA, 16 bp, M. musculus
gaggccaggctgagct

SEQ ID NO: 407951 - DNA, 16 bp, M. musculus
gaggccaggctggcct

SEQ ID NO: 407952 - DNA, 16 bp, M. musculus
gaggccagggaaggcc

SEQ ID NO: 407953 - DNA, 16 bp, M. musculus
gaggccagtagagggc

SEQ ID NO: 407954 - DNA, 16 bp, M. musculus
gaggccagtctgagct

SEQ ID NO: 407955 - DNA, 16 bp, M. musculus
gaggccatggagaagt

SEQ ID NO: 407956 - DNA, 16 bp, M. musculus
gaggccatggaggaac

SEQ ID NO: 407957 - DNA, 16 bp, M. musculus
gaggccatggaggaag

SEQ ID NO: 407958 - DNA, 16 bp, M. musculus
gaggccatggaggagg

SEQ ID NO: 407959 - DNA, 16 bp, M. musculus
gaggccatggaggagt

SEQ ID NO: 407960 - DNA, 16 bp, M. musculus
gaggccatggagggac

SEQ ID NO: 407961 - DNA, 16 bp, M. musculus
gaggccatggatttga

SEQ ID NO: 407962 - DNA, 16 bp, M. musculus
gaggcccaacaagcag

SEQ ID NO: 407963 - DNA, 20 bp, M. musculus
gaggcccaattcagagatca

SEQ ID NO: 407964 - DNA, 16 bp, M. musculus
gaggcccagctcaaga

SEQ ID NO: 407965 - DNA, 16 bp, M. musculus
gaggcccagcttcagg

SEQ ID NO: 407966 - DNA, 16 bp, M. musculus
gaggcccattagtctt

SEQ ID NO: 407967 - DNA, 21 bp, M. musculus
gaggccccaacttgataagga

SEQ ID NO: 407968 - DNA, 16 bp, M. musculus
gaggcccctcccttta

SEQ ID NO: 407969 - DNA, 16 bp, M. musculus
gaggcccctgggctga

SEQ ID NO: 407970 - DNA, 16 bp, M. musculus
gaggcccctggtcctg

SEQ ID NO: 407971 - DNA, 16 bp, M. musculus
gaggccccttgttctt

SEQ ID NO: 407972 - DNA, 16 bp, M. musculus
gaggccctaggtttga

SEQ ID NO: 407973 - DNA, 16 bp, M. musculus
gaggccctccaggtcc

SEQ ID NO: 407974 - DNA, 16 bp, M. musculus
gaggccctgggttcaa

SEQ ID NO: 407975 - DNA, 16 bp, M. musculus
gaggccctgggtttga

SEQ ID NO: 407976 - DNA, 16 bp, M. musculus
gaggccctgtctgtga

SEQ ID NO: 407977 - DNA, 16 bp, M. musculus
gaggcccttggtcatg

SEQ ID NO: 407978 - DNA, 16 bp, M. musculus
gaggcccttggtgctg

SEQ ID NO: 407979 - DNA, 16 bp, M. musculus
gaggccgaggccgagg

SEQ ID NO: 407980 - DNA, 146 bp, M. musculus
gaggcctatcgcaggtacactccttatgaccctgaggacccagggcaagaaaccaatgtgtctatgtcattcatctggcagtctgccccggatatcgggcgaaagttagagcggttagaagatttaaagagcaagaccttaggaga

SEQ ID NO: 407981 - DNA, 16 bp, M. musculus
gaggcctgcctgcctc

SEQ ID NO: 407982 - DNA, 16 bp, M. musculus
gaggcctgcctgctct

SEQ ID NO: 407983 - DNA, 16 bp, M. musculus
gaggcctgggcagctt

SEQ ID NO: 407984 - DNA, 16 bp, M. musculus
gaggcctgttcttttc

SEQ ID NO: 407985 - DNA, 16 bp, M. musculus
gaggccttcagactgt

SEQ ID NO: 407986 - DNA, 16 bp, M. musculus
gaggccttgggttcaa

SEQ ID NO: 407987 - DNA, 16 bp, M. musculus
gaggccttgggtttga

SEQ ID NO: 407988 - DNA, 16 bp, M. musculus
gaggcgcagaggcaga

SEQ ID NO: 407989 - DNA, 16 bp, M. musculus
gaggcggctcagtggt

SEQ ID NO: 407990 - DNA, 16 bp, M. musculus
gaggcgggacttttag

SEQ ID NO: 407991 - DNA, 16 bp, M. musculus
gaggcgggcagtgagg

SEQ ID NO: 407992 - DNA, 16 bp, M. musculus
gaggctaaggcagaag

SEQ ID NO: 407993 - DNA, 16 bp, M. musculus
gaggctaaggcaggag

SEQ ID NO: 407994 - DNA, 16 bp, M. musculus
gaggctaaggcaggca

SEQ ID NO: 407995 - DNA, 16 bp, M. musculus
gaggctagagagatgg

SEQ ID NO: 407996 - DNA, 16 bp, M. musculus
gaggctagcctggtgt

SEQ ID NO: 407997 - DNA, 16 bp, M. musculus
gaggctatgaatttga

SEQ ID NO: 407998 - DNA, 16 bp, M. musculus
gaggctcacagtcatc

SEQ ID NO: 407999 - DNA, 16 bp, M. musculus
gaggctcagagagatg

SEQ ID NO: 408000 - DNA, 16 bp, M. musculus
gaggctccaagacctg

SEQ ID NO: 408001 - DNA, 16 bp, M. musculus
gaggctccaccaagca

SEQ ID NO: 408002 - DNA, 16 bp, M. musculus
gaggctccagggagtc

SEQ ID NO: 408003 - DNA, 16 bp, M. musculus
gaggctcccaggaacc

SEQ ID NO: 408004 - DNA, 16 bp, M. musculus
gaggctcccgccgccg

SEQ ID NO: 408005 - DNA, 16 bp, M. musculus
gaggctctcagagtct

SEQ ID NO: 408006 - DNA, 16 bp, M. musculus
gaggctctgccaatca

SEQ ID NO: 408007 - DNA, 16 bp, M. musculus
gaggctctggagagag

SEQ ID NO: 408008 - DNA, 16 bp, M. musculus
gaggctctggcagagc

SEQ ID NO: 408009 - DNA, 16 bp, M. musculus
gaggctctgtggctct

SEQ ID NO: 408010 - DNA, 16 bp, M. musculus
gaggctgaaaacattt

SEQ ID NO: 408011 - DNA, 16 bp, M. musculus
gaggctgaaacaggag

SEQ ID NO: 408012 - DNA, 16 bp, M. musculus
gaggctgaaccaccaa

SEQ ID NO: 408013 - DNA, 16 bp, M. musculus
gaggctgaagcaggaa

SEQ ID NO: 408014 - DNA, 16 bp, M. musculus
gaggctgaagcaggag

SEQ ID NO: 408015 - DNA, 16 bp, M. musculus
gaggctgaaggaatga

SEQ ID NO: 408016 - DNA, 16 bp, M. musculus
gaggctgaaggaggag

SEQ ID NO: 408017 - DNA, 16 bp, M. musculus
gaggctgacacaggag

SEQ ID NO: 408018 - DNA, 16 bp, M. musculus
gaggctgagaaagaag

SEQ ID NO: 408019 - DNA, 16 bp, M. musculus
gaggctgagacaagag

SEQ ID NO: 408020 - DNA, 16 bp, M. musculus
gaggctgagacagagg

SEQ ID NO: 408021 - DNA, 16 bp, M. musculus
gaggctgagacaggat

SEQ ID NO: 408022 - DNA, 16 bp, M. musculus
gaggctgagaccagag

SEQ ID NO: 408023 - DNA, 16 bp, M. musculus
gaggctgagctcagag

SEQ ID NO: 408024 - DNA, 16 bp, M. musculus
gaggctgaggaaagag

SEQ ID NO: 408025 - DNA, 16 bp, M. musculus
gaggctgaggaagaag

SEQ ID NO: 408026 - DNA, 16 bp, M. musculus
gaggctgaggaaggag

SEQ ID NO: 408027 - DNA, 16 bp, M. musculus
gaggctgaggaggaag

SEQ ID NO: 408028 - DNA, 16 bp, M. musculus
gaggctgaggaggagg

SEQ ID NO: 408029 - DNA, 16 bp, M. musculus
gaggctgaggagggag

SEQ ID NO: 408030 - DNA, 16 bp, M. musculus
gaggctgaggcaagag

SEQ ID NO: 408031 - DNA, 16 bp, M. musculus
gaggctgaggcagaag

SEQ ID NO: 408032 - DNA, 16 bp, M. musculus
gaggctgaggcagagg

SEQ ID NO: 408033 - DNA, 16 bp, M. musculus
gaggctgaggcagcag

SEQ ID NO: 408034 - DNA, 16 bp, M. musculus
gaggctgaggcaggaa

SEQ ID NO: 408035 - DNA, 16 bp, M. musculus
gaggctgaggccacct

SEQ ID NO: 408036 - DNA, 16 bp, M. musculus
gaggctgaggccagag

SEQ ID NO: 408037 - DNA, 16 bp, M. musculus
gaggctgaggctgaga

SEQ ID NO: 408038 - DNA, 16 bp, M. musculus
gaggctgaggctggag

SEQ ID NO: 408039 - DNA, 16 bp, M. musculus
gaggctgaggctgggg

SEQ ID NO: 408040 - DNA, 16 bp, M. musculus
gaggctgagggagaag

SEQ ID NO: 408041 - DNA, 16 bp, M. musculus
gaggctgaggtaagag

SEQ ID NO: 408042 - DNA, 16 bp, M. musculus
gaggctgaggtggaag

SEQ ID NO: 408043 - DNA, 16 bp, M. musculus
gaggctgatgcagaag

SEQ ID NO: 408044 - DNA, 16 bp, M. musculus
gaggctgatgcaggag

SEQ ID NO: 408045 - DNA, 16 bp, M. musculus
gaggctgcagagatgg

SEQ ID NO: 408046 - DNA, 16 bp, M. musculus
gaggctgcagcaggag

SEQ ID NO: 408047 - DNA, 16 bp, M. musculus
gaggctgcctggggct

SEQ ID NO: 408048 - DNA, 16 bp, M. musculus
gaggctgctggggaag

SEQ ID NO: 408049 - DNA, 16 bp, M. musculus
gaggctgcttcagatt

SEQ ID NO: 408050 - DNA, 16 bp, M. musculus
gaggctggaagagggc

SEQ ID NO: 408051 - DNA, 16 bp, M. musculus
gaggctggacagatgg

SEQ ID NO: 408052 - DNA, 16 bp, M. musculus
gaggctggagaggagg

SEQ ID NO: 408053 - DNA, 16 bp, M. musculus
gaggctggagagttgg

SEQ ID NO: 408054 - DNA, 16 bp, M. musculus
gaggctggagcagaag

SEQ ID NO: 408055 - DNA, 16 bp, M. musculus
gaggctggagctgtat

SEQ ID NO: 408056 - DNA, 16 bp, M. musculus
gaggctggaggacagc

SEQ ID NO: 408057 - DNA, 16 bp, M. musculus
gaggctggaggatcag

SEQ ID NO: 408058 - DNA, 16 bp, M. musculus
gaggctggaggatttc

SEQ ID NO: 408059 - DNA, 16 bp, M. musculus
gaggctggagggatgg

SEQ ID NO: 408060 - DNA, 16 bp, M. musculus
gaggctggctggctgg

SEQ ID NO: 408061 - DNA, 16 bp, M. musculus
gaggctgggaacctgg

SEQ ID NO: 408062 - DNA, 16 bp, M. musculus
gaggctggggagatgg

SEQ ID NO: 408063 - DNA, 16 bp, M. musculus
gaggctggggaggctg

SEQ ID NO: 408064 - DNA, 16 bp, M. musculus
gaggctggggcagaag

SEQ ID NO: 408065 - DNA, 16 bp, M. musculus
gaggctggtcccaaga

SEQ ID NO: 408066 - DNA, 18 bp, M. musculus
gaggctggtcttgaactc

SEQ ID NO: 408067 - DNA, 16 bp, M. musculus
gaggctgtcagatctc

SEQ ID NO: 408068 - DNA, 16 bp, M. musculus
gaggctgtggagcact

SEQ ID NO: 408069 - DNA, 16 bp, M. musculus
gaggctgtggaggatg

SEQ ID NO: 408070 - DNA, 16 bp, M. musculus
gaggctgtgttccaga

SEQ ID NO: 408071 - DNA, 16 bp, M. musculus
gaggcttgagagatgg

SEQ ID NO: 408072 - DNA, 16 bp, M. musculus
gaggcttttccctaat

SEQ ID NO: 408073 - DNA, 16 bp, M. musculus
gagggaaaaatatcag

SEQ ID NO: 408074 - DNA, 16 bp, M. musculus
gagggaaactaagctc

SEQ ID NO: 408075 - DNA, 16 bp, M. musculus
gagggaaaggtggtcc

SEQ ID NO: 408076 - DNA, 16 bp, M. musculus
gagggaagacagacag

SEQ ID NO: 408077 - DNA, 16 bp, M. musculus
gagggaagacctggaa

SEQ ID NO: 408078 - DNA, 16 bp, M. musculus
gagggaagcatggcag

SEQ ID NO: 408079 - DNA, 16 bp, M. musculus
gagggaagggaagctg

SEQ ID NO: 408080 - DNA, 16 bp, M. musculus
gagggaatcctggaga

SEQ ID NO: 408081 - DNA, 16 bp, M. musculus
gagggacacacacaca

SEQ ID NO: 408082 - DNA, 16 bp, M. musculus
gagggacatctgcatt

SEQ ID NO: 408083 - DNA, 16 bp, M. musculus
gagggaccaggaaagg

SEQ ID NO: 408084 - DNA, 16 bp, M. musculus
gagggacccatggtgc

SEQ ID NO: 408085 - DNA, 16 bp, M. musculus
gagggacccatggttc

SEQ ID NO: 408086 - DNA, 16 bp, M. musculus
gagggacctggaggga

SEQ ID NO: 408087 - DNA, 16 bp, M. musculus
gagggactgagaggag

SEQ ID NO: 408088 - DNA, 16 bp, M. musculus
gagggactggaaggag

SEQ ID NO: 408089 - DNA, 16 bp, M. musculus
gagggagaagaaatca

SEQ ID NO: 408090 - DNA, 16 bp, M. musculus
gagggagacagagata

SEQ ID NO: 408091 - DNA, 16 bp, M. musculus
gagggagacagaggca

SEQ ID NO: 408092 - DNA, 16 bp, M. musculus
gagggagaggctggag

SEQ ID NO: 408093 - DNA, 16 bp, M. musculus
gagggagattccacaa

SEQ ID NO: 408094 - DNA, 16 bp, M. musculus
gagggagcagagcctg

SEQ ID NO: 408095 - DNA, 16 bp, M. musculus
gagggaggagaagctg

SEQ ID NO: 408096 - DNA, 16 bp, M. musculus
gagggaggctgaggag

SEQ ID NO: 408097 - DNA, 16 bp, M. musculus
gagggagggagaactg

SEQ ID NO: 408098 - DNA, 16 bp, M. musculus
gagggagggagacaca

SEQ ID NO: 408099 - DNA, 16 bp, M. musculus
gagggaggggagacta

SEQ ID NO: 408100 - DNA, 16 bp, M. musculus
gagggagtcagatcct

SEQ ID NO: 408101 - DNA, 16 bp, M. musculus
gagggataaaagaatc

SEQ ID NO: 408102 - DNA, 16 bp, M. musculus
gagggatggggctgcc

SEQ ID NO: 408103 - DNA, 16 bp, M. musculus
gagggatgtggccacc

SEQ ID NO: 408104 - DNA, 16 bp, M. musculus
gagggcaactttgtgg

SEQ ID NO: 408105 - DNA, 16 bp, M. musculus
gagggcacagagtcag

SEQ ID NO: 408106 - DNA, 16 bp, M. musculus
gagggcacagggacaa

SEQ ID NO: 408107 - DNA, 16 bp, M. musculus
gagggcacatgggatg

SEQ ID NO: 408108 - DNA, 16 bp, M. musculus
gagggcactggacccc

SEQ ID NO: 408109 - DNA, 16 bp, M. musculus
gagggcactggattct

SEQ ID NO: 408110 - DNA, 16 bp, M. musculus
gagggcagccatggcc

SEQ ID NO: 408111 - DNA, 16 bp, M. musculus
gagggcagcctggact

SEQ ID NO: 408112 - DNA, 16 bp, M. musculus
gagggcagcctgggtt

SEQ ID NO: 408113 - DNA, 16 bp, M. musculus
gagggcaggagagctg

SEQ ID NO: 408114 - DNA, 16 bp, M. musculus
gagggcaggtctgtgg

SEQ ID NO: 408115 - DNA, 17 bp, M. musculus
gagggcatggaaggcca

SEQ ID NO: 408116 - DNA, 16 bp, M. musculus
gagggcattggattcc

SEQ ID NO: 408117 - DNA, 17 bp, M. musculus
gagggccaagaagtggg

SEQ ID NO: 408118 - DNA, 16 bp, M. musculus
gagggccagcaccagg

SEQ ID NO: 408119 - DNA, 16 bp, M. musculus
gagggccaggaaaatg

SEQ ID NO: 408120 - DNA, 16 bp, M. musculus
gagggccaggagaaag

SEQ ID NO: 408121 - DNA, 16 bp, M. musculus
gagggcctgagtgtga

SEQ ID NO: 408122 - DNA, 16 bp, M. musculus
gagggcctgagtttgg

SEQ ID NO: 408123 - DNA, 16 bp, M. musculus
gagggcctggtgcaga

SEQ ID NO: 408124 - DNA, 16 bp, M. musculus
gagggcctgtgttcag

SEQ ID NO: 408125 - DNA, 16 bp, M. musculus
gagggcgtcatcctga

SEQ ID NO: 408126 - DNA, 16 bp, M. musculus
gagggctcacctgtga

SEQ ID NO: 408127 - DNA, 16 bp, M. musculus
gagggctcaggctctg

SEQ ID NO: 408128 - DNA, 16 bp, M. musculus
gagggctcagtgggta

SEQ ID NO: 408129 - DNA, 16 bp, M. musculus
gagggctctgaaatag

SEQ ID NO: 408130 - DNA, 16 bp, M. musculus
gagggctctgactgcc

SEQ ID NO: 408131 - DNA, 16 bp, M. musculus
gagggctgctagcaga

SEQ ID NO: 408132 - DNA, 16 bp, M. musculus
gagggctggaaagatg

SEQ ID NO: 408133 - DNA, 16 bp, M. musculus
gagggctggagaaatg

SEQ ID NO: 408134 - DNA, 16 bp, M. musculus
gagggctgtgtgtgca

SEQ ID NO: 408135 - DNA, 16 bp, M. musculus
gaggggaaactgggaa

SEQ ID NO: 408136 - DNA, 16 bp, M. musculus
gaggggaacctgattt

SEQ ID NO: 408137 - DNA, 16 bp, M. musculus
gaggggaagtggacac

SEQ ID NO: 408138 - DNA, 16 bp, M. musculus
gaggggagactgggaa

SEQ ID NO: 408139 - DNA, 16 bp, M. musculus
gaggggagactgggag

SEQ ID NO: 408140 - DNA, 19 bp, M. musculus
gaggggataacatttgaaa

SEQ ID NO: 408141 - DNA, 16 bp, M. musculus
gaggggcaacatttgg

SEQ ID NO: 408142 - DNA, 16 bp, M. musculus
gaggggcagtctctgg

SEQ ID NO: 408143 - DNA, 16 bp, M. musculus
gaggggcatccgggtt

SEQ ID NO: 408144 - DNA, 16 bp, M. musculus
gaggggctgcctggga

SEQ ID NO: 408145 - DNA, 16 bp, M. musculus
gaggggctggaaggag

SEQ ID NO: 408146 - DNA, 16 bp, M. musculus
gaggggctggagagag

SEQ ID NO: 408147 - DNA, 16 bp, M. musculus
gaggggctggaggaag

SEQ ID NO: 408148 - DNA, 16 bp, M. musculus
gaggggctgggagaga

SEQ ID NO: 408149 - DNA, 16 bp, M. musculus
gaggggcttggggcgt

SEQ ID NO: 408150 - DNA, 16 bp, M. musculus
gagggggctggagaga

SEQ ID NO: 408151 - DNA, 16 bp, M. musculus
gaggggtcctggtctg

SEQ ID NO: 408152 - DNA, 16 bp, M. musculus
gagggtagaccaggag

SEQ ID NO: 408153 - DNA, 16 bp, M. musculus
gagggtcaagagttca

SEQ ID NO: 408154 - DNA, 16 bp, M. musculus
gagggtcaggaaaatg

SEQ ID NO: 408155 - DNA, 16 bp, M. musculus
gagggtcctgtgagga

SEQ ID NO: 408156 - DNA, 16 bp, M. musculus
gagggtgaagatccag

SEQ ID NO: 408157 - DNA, 16 bp, M. musculus
gagggtgaccctgaac

SEQ ID NO: 408158 - DNA, 16 bp, M. musculus
gagggtgactttgaac

SEQ ID NO: 408159 - DNA, 16 bp, M. musculus
gagggtgcttcccctc

SEQ ID NO: 408160 - DNA, 16 bp, M. musculus
gagggtgtcagatccc

SEQ ID NO: 408161 - DNA, 16 bp, M. musculus
gagggtgttggatctc

SEQ ID NO: 408162 - DNA, 16 bp, M. musculus
gagggtgttggatgcc

SEQ ID NO: 408163 - DNA, 16 bp, M. musculus
gagggtgtttttcaga

SEQ ID NO: 408164 - DNA, 16 bp, M. musculus
gagggttagaagttca

SEQ ID NO: 408165 - DNA, 16 bp, M. musculus
gagggtttctctgtgt

SEQ ID NO: 408166 - DNA, 16 bp, M. musculus
gagggtttttttttct

SEQ ID NO: 408167 - DNA, 16 bp, M. musculus
gaggtagaaagagcaa

SEQ ID NO: 408168 - DNA, 16 bp, M. musculus
gaggtagaagcaggag

SEQ ID NO: 408169 - DNA, 16 bp, M. musculus
gaggtagaggcagagg

SEQ ID NO: 408170 - DNA, 16 bp, M. musculus
gaggtagaggcaggtg

SEQ ID NO: 408171 - DNA, 16 bp, M. musculus
gaggtagaggtagaga

SEQ ID NO: 408172 - DNA, 49 bp, M. musculus
gaggtagatgtgttttctcaacaagtttctaagtctattaacctggcca

SEQ ID NO: 408173 - DNA, 16 bp, M. musculus
gaggtagccagattag

SEQ ID NO: 408174 - DNA, 16 bp, M. musculus
gaggtagctcagtggt

SEQ ID NO: 408175 - DNA, 16 bp, M. musculus
gaggtcaaaggaatac

SEQ ID NO: 408176 - DNA, 16 bp, M. musculus
gaggtcaagcagaaca

SEQ ID NO: 408177 - DNA, 16 bp, M. musculus
gaggtcaagctggtgc

SEQ ID NO: 408178 - DNA, 16 bp, M. musculus
gaggtcaaggccagcc

SEQ ID NO: 408179 - DNA, 16 bp, M. musculus
gaggtcagaaaaggca

SEQ ID NO: 408180 - DNA, 16 bp, M. musculus
gaggtcagaagaaaac

SEQ ID NO: 408181 - DNA, 16 bp, M. musculus
gaggtcagaagagggc

SEQ ID NO: 408182 - DNA, 16 bp, M. musculus
gaggtcagaagggggc

SEQ ID NO: 408183 - DNA, 16 bp, M. musculus
gaggtcagagacaact

SEQ ID NO: 408184 - DNA, 16 bp, M. musculus
gaggtcagaggaaaac

SEQ ID NO: 408185 - DNA, 16 bp, M. musculus
gaggtcagaggtcaac

SEQ ID NO: 408186 - DNA, 16 bp, M. musculus
gaggtcagaggtcagc

SEQ ID NO: 408187 - DNA, 16 bp, M. musculus
gaggtcagcctcagct

SEQ ID NO: 408188 - DNA, 16 bp, M. musculus
gaggtcagcctggtgt

SEQ ID NO: 408189 - DNA, 16 bp, M. musculus
gaggtcaggagagaga

SEQ ID NO: 408190 - DNA, 16 bp, M. musculus
gaggtcaggagagggc

SEQ ID NO: 408191 - DNA, 16 bp, M. musculus
gaggtcagtgaagtca

SEQ ID NO: 408192 - DNA, 16 bp, M. musculus
gaggtcatcagatcct

SEQ ID NO: 408193 - DNA, 16 bp, M. musculus
gaggtccagagttcaa

SEQ ID NO: 408194 - DNA, 16 bp, M. musculus
gaggtccaggatgctg

SEQ ID NO: 408195 - DNA, 16 bp, M. musculus
gaggtccaggttcagt

SEQ ID NO: 408196 - DNA, 16 bp, M. musculus
gaggtcccaagttcaa

SEQ ID NO: 408197 - DNA, 16 bp, M. musculus
gaggtcccgagttcaa

SEQ ID NO: 408198 - DNA, 16 bp, M. musculus
gaggtccggagttcaa

SEQ ID NO: 408199 - DNA, 16 bp, M. musculus
gaggtcctaagttcaa

SEQ ID NO: 408200 - DNA, 16 bp, M. musculus
gaggtcctgaattcaa

SEQ ID NO: 408201 - DNA, 16 bp, M. musculus
gaggtcctgagttcaa

SEQ ID NO: 408202 - DNA, 16 bp, M. musculus
gaggtcctgtgttcaa

SEQ ID NO: 408203 - DNA, 16 bp, M. musculus
gaggtccttttattgt

SEQ ID NO: 408204 - DNA, 16 bp, M. musculus
gaggtctcaggggtcc

SEQ ID NO: 408205 - DNA, 16 bp, M. musculus
gaggtctctcttccca

SEQ ID NO: 408206 - DNA, 16 bp, M. musculus
gaggtctggaaactgt

SEQ ID NO: 408207 - DNA, 17 bp, M. musculus
gaggtctggcttgtgaa

SEQ ID NO: 408208 - DNA, 16 bp, M. musculus
gaggtctgttttgtga

SEQ ID NO: 408209 - DNA, 16 bp, M. musculus
gaggtctttgatctac

SEQ ID NO: 408210 - DNA, 16 bp, M. musculus
gaggtgaaagactctc

SEQ ID NO: 408211 - DNA, 16 bp, M. musculus
gaggtgaacaccttca

SEQ ID NO: 408212 - DNA, 16 bp, M. musculus
gaggtgaaggcagagg

SEQ ID NO: 408213 - DNA, 16 bp, M. musculus
gaggtgaagtctccaa

SEQ ID NO: 408214 - DNA, 16 bp, M. musculus
gaggtgacagcagcat

SEQ ID NO: 408215 - DNA, 16 bp, M. musculus
gaggtgaccctccctg

SEQ ID NO: 408216 - DNA, 16 bp, M. musculus
gaggtgactttgagaa

SEQ ID NO: 408217 - DNA, 16 bp, M. musculus
gaggtgatggtggcaa

SEQ ID NO: 408218 - DNA, 16 bp, M. musculus
gaggtgcatgccttta

SEQ ID NO: 408219 - DNA, 16 bp, M. musculus
gaggtgcctccttgcc

SEQ ID NO: 408220 - DNA, 16 bp, M. musculus
gaggtgctggagagat

SEQ ID NO: 408221 - DNA, 16 bp, M. musculus
gaggtgctgggaagaa

SEQ ID NO: 408222 - DNA, 16 bp, M. musculus
gaggtggaaactcagg

SEQ ID NO: 408223 - DNA, 16 bp, M. musculus
gaggtggaagcaagag

SEQ ID NO: 408224 - DNA, 16 bp, M. musculus
gaggtggactttgagg

SEQ ID NO: 408225 - DNA, 16 bp, M. musculus
gaggtggagacagaag

SEQ ID NO: 408226 - DNA, 16 bp, M. musculus
gaggtggagacagagg

SEQ ID NO: 408227 - DNA, 16 bp, M. musculus
gaggtggaggcaaaag

SEQ ID NO: 408228 - DNA, 16 bp, M. musculus
gaggtggaggcagaag

SEQ ID NO: 408229 - DNA, 16 bp, M. musculus
gaggtggaggcagagg

SEQ ID NO: 408230 - DNA, 16 bp, M. musculus
gaggtggaggcaggtg

SEQ ID NO: 408231 - DNA, 16 bp, M. musculus
gaggtggaggctggag

SEQ ID NO: 408232 - DNA, 16 bp, M. musculus
gaggtggcaccatctt

SEQ ID NO: 408233 - DNA, 16 bp, M. musculus
gaggtggctcagctgt

SEQ ID NO: 408234 - DNA, 16 bp, M. musculus
gaggtggctcagtggc

SEQ ID NO: 408235 - DNA, 16 bp, M. musculus
gaggtggctcagtggg

SEQ ID NO: 408236 - DNA, 16 bp, M. musculus
gaggtggcttagtggg

SEQ ID NO: 408237 - DNA, 16 bp, M. musculus
gaggtgggaagaccca

SEQ ID NO: 408238 - DNA, 16 bp, M. musculus
gaggtgggacagtgtc

SEQ ID NO: 408239 - DNA, 16 bp, M. musculus
gaggtgggactttgag

SEQ ID NO: 408240 - DNA, 16 bp, M. musculus
gaggtgggaggcagag

SEQ ID NO: 408241 - DNA, 16 bp, M. musculus
gaggtggggacaggag

SEQ ID NO: 408242 - DNA, 16 bp, M. musculus
gaggtggtctcttcag

SEQ ID NO: 408243 - DNA, 16 bp, M. musculus
gaggtggtctctttag

SEQ ID NO: 408244 - DNA, 16 bp, M. musculus
gaggtgtgatgtgtgc

SEQ ID NO: 408245 - DNA, 16 bp, M. musculus
gaggtgtgggatgtga

SEQ ID NO: 408246 - DNA, 16 bp, M. musculus
gaggtgtgtcaccagg

SEQ ID NO: 408247 - DNA, 16 bp, M. musculus
gaggtgtgtgccacca

SEQ ID NO: 408248 - DNA, 16 bp, M. musculus
gaggtgtgtggccttg

SEQ ID NO: 408249 - DNA, 16 bp, M. musculus
gaggtgttgagaagaa

SEQ ID NO: 408250 - DNA, 16 bp, M. musculus
gaggttaaaggacaac

SEQ ID NO: 408251 - DNA, 16 bp, M. musculus
gaggttaagagtactg

SEQ ID NO: 408252 - DNA, 16 bp, M. musculus
gaggttagatgtggct

SEQ ID NO: 408253 - DNA, 16 bp, M. musculus
gaggttcctcaggaaa

SEQ ID NO: 408254 - DNA, 16 bp, M. musculus
gaggttcctctgaaaa

SEQ ID NO: 408255 - DNA, 16 bp, M. musculus
gaggttctgtgcctgg

SEQ ID NO: 408256 - DNA, 16 bp, M. musculus
gaggttgaaacaggag

SEQ ID NO: 408257 - DNA, 16 bp, M. musculus
gaggttgaagcattaa

SEQ ID NO: 408258 - DNA, 16 bp, M. musculus
gaggttgagacaggaa

SEQ ID NO: 408259 - DNA, 16 bp, M. musculus
gaggttgagacaggag

SEQ ID NO: 408260 - DNA, 16 bp, M. musculus
gaggttgaggcaggag

SEQ ID NO: 408261 - DNA, 16 bp, M. musculus
gaggtttaaagatttc

SEQ ID NO: 408262 - DNA, 16 bp, M. musculus
gaggtttcaaaagcct

SEQ ID NO: 408263 - DNA, 16 bp, M. musculus
gaggtttcagaggaaa

SEQ ID NO: 408264 - DNA, 16 bp, M. musculus
gaggtttcagtccatg

SEQ ID NO: 408265 - DNA, 16 bp, M. musculus
gagtaaaatctggagt

SEQ ID NO: 408266 - DNA, 16 bp, M. musculus
gagtaaaattgacttc

SEQ ID NO: 408267 - DNA, 16 bp, M. musculus
gagtaaattcgtgcca

SEQ ID NO: 408268 - DNA, 16 bp, M. musculus
gagtaactcaaagatg

SEQ ID NO: 408269 - DNA, 16 bp, M. musculus
gagtaactgtggcttc

SEQ ID NO: 408270 - DNA, 16 bp, M. musculus
gagtaagctcaccctt

SEQ ID NO: 408271 - DNA, 16 bp, M. musculus
gagtaagttctaggac

SEQ ID NO: 408272 - DNA, 16 bp, M. musculus
gagtacacggtagctg

SEQ ID NO: 408273 - DNA, 16 bp, M. musculus
gagtacaggcagctgg

SEQ ID NO: 408274 - DNA, 16 bp, M. musculus
gagtacattgttgcta

SEQ ID NO: 408275 - DNA, 18 bp, M. musculus
gagtaccaggaaggcata

SEQ ID NO: 408276 - DNA, 16 bp, M. musculus
gagtacgaggccagcc

SEQ ID NO: 408277 - DNA, 16 bp, M. musculus
gagtagaagagaatga

SEQ ID NO: 408278 - DNA, 16 bp, M. musculus
gagtagaggagaatga

SEQ ID NO: 408279 - DNA, 16 bp, M. musculus
gagtaggtgtagcctt

SEQ ID NO: 408280 - DNA, 16 bp, M. musculus
gagtagtatgtgctct

SEQ ID NO: 408281 - DNA, 16 bp, M. musculus
gagtataacttcttga

SEQ ID NO: 408282 - DNA, 17 bp, M. musculus
gagtatatacagattaa

SEQ ID NO: 408283 - DNA, 16 bp, M. musculus
gagtatatatatgtgt

SEQ ID NO: 408284 - DNA, 16 bp, M. musculus
gagtatatatcatgtg

SEQ ID NO: 408285 - DNA, 16 bp, M. musculus
gagtatgtgaatgtgt

SEQ ID NO: 408286 - DNA, 16 bp, M. musculus
gagtatgtggagaaag

SEQ ID NO: 408287 - DNA, 16 bp, M. musculus
gagtatgtgtggtgtg

SEQ ID NO: 408288 - DNA, 16 bp, M. musculus
gagtatgtgtttgtgt

SEQ ID NO: 408289 - DNA, 16 bp, M. musculus
gagtcaccacaacatg

SEQ ID NO: 408290 - DNA, 16 bp, M. musculus
gagtcaccacagcatg

SEQ ID NO: 408291 - DNA, 16 bp, M. musculus
gagtcactggagagaa

SEQ ID NO: 408292 - DNA, 16 bp, M. musculus
gagtcagaaagacaaa

SEQ ID NO: 408293 - DNA, 16 bp, M. musculus
gagtcagaagcaggag

SEQ ID NO: 408294 - DNA, 16 bp, M. musculus
gagtcagagacacact

SEQ ID NO: 408295 - DNA, 16 bp, M. musculus
gagtcagaggaagaaa

SEQ ID NO: 408296 - DNA, 16 bp, M. musculus
gagtcagaggagatgg

SEQ ID NO: 408297 - DNA, 16 bp, M. musculus
gagtcagaggcagggg

SEQ ID NO: 408298 - DNA, 19 bp, M. musculus
gagtcagagtcagagtcag

SEQ ID NO: 408299 - DNA, 16 bp, M. musculus
gagtcagatctcatta

SEQ ID NO: 408300 - DNA, 16 bp, M. musculus
gagtcagatgtcatta

SEQ ID NO: 408301 - DNA, 16 bp, M. musculus
gagtcagcagcagcag

SEQ ID NO: 408302 - DNA, 16 bp, M. musculus
gagtcagcagtgcaca

SEQ ID NO: 408303 - DNA, 16 bp, M. musculus
gagtcagctctctcct

SEQ ID NO: 408304 - DNA, 16 bp, M. musculus
gagtcagctctctctt

SEQ ID NO: 408305 - DNA, 17 bp, M. musculus
gagtcaggtgcctgaca

SEQ ID NO: 408306 - DNA, 16 bp, M. musculus
gagtcagttctctcct

SEQ ID NO: 408307 - DNA, 16 bp, M. musculus
gagtcatcagaaagga

SEQ ID NO: 408308 - DNA, 16 bp, M. musculus
gagtcatctcactggc

SEQ ID NO: 408309 - DNA, 16 bp, M. musculus
gagtcatctcctcagc

SEQ ID NO: 408310 - DNA, 16 bp, M. musculus
gagtcatctcgccagc

SEQ ID NO: 408311 - DNA, 16 bp, M. musculus
gagtcatctctccagc

SEQ ID NO: 408312 - DNA, 16 bp, M. musculus
gagtcatctctgcagc

SEQ ID NO: 408313 - DNA, 16 bp, M. musculus
gagtcatctgtccagc

SEQ ID NO: 408314 - DNA, 16 bp, M. musculus
gagtcatttgaaagga

SEQ ID NO: 408315 - DNA, 16 bp, M. musculus
gagtcattttcttcag

SEQ ID NO: 408316 - DNA, 16 bp, M. musculus
gagtcatttttctttg

SEQ ID NO: 408317 - DNA, 16 bp, M. musculus
gagtccaacctggtct

SEQ ID NO: 408318 - DNA, 18 bp, M. musculus
gagtccactatgagggga

SEQ ID NO: 408319 - DNA, 16 bp, M. musculus
gagtccagcctgggct

SEQ ID NO: 408320 - DNA, 16 bp, M. musculus
gagtccagtctcatcc

SEQ ID NO: 408321 - DNA, 16 bp, M. musculus
gagtccagttttctct

SEQ ID NO: 408322 - DNA, 16 bp, M. musculus
gagtcccaacaaatgg

SEQ ID NO: 408323 - DNA, 16 bp, M. musculus
gagtcccaaggaagtg

SEQ ID NO: 408324 - DNA, 16 bp, M. musculus
gagtcccaccatttgt

SEQ ID NO: 408325 - DNA, 16 bp, M. musculus
gagtcccaggccagcc

SEQ ID NO: 408326 - DNA, 16 bp, M. musculus
gagtcccagtctcaga

SEQ ID NO: 408327 - DNA, 16 bp, M. musculus
gagtccctgaagagag

SEQ ID NO: 408328 - DNA, 16 bp, M. musculus
gagtccctgagctcca

SEQ ID NO: 408329 - DNA, 16 bp, M. musculus
gagtccctggagctgg

SEQ ID NO: 408330 - DNA, 16 bp, M. musculus
gagtccctgtctcaaa

SEQ ID NO: 408331 - DNA, 16 bp, M. musculus
gagtcctagtggtcag

SEQ ID NO: 408332 - DNA, 16 bp, M. musculus
gagtcctctgcaagag

SEQ ID NO: 408333 - DNA, 16 bp, M. musculus
gagtcctctggtggaa

SEQ ID NO: 408334 - DNA, 16 bp, M. musculus
gagtcctggaaccaaa

SEQ ID NO: 408335 - DNA, 16 bp, M. musculus
gagtcctgtgatccat

SEQ ID NO: 408336 - DNA, 16 bp, M. musculus
gagtccttcccccacc

SEQ ID NO: 408337 - DNA, 16 bp, M. musculus
gagtccttggcttgac

SEQ ID NO: 408338 - DNA, 16 bp, M. musculus
gagtccttggtctggt

SEQ ID NO: 408339 - DNA, 16 bp, M. musculus
gagtcggaggccagcc

SEQ ID NO: 408340 - DNA, 16 bp, M. musculus
gagtctatgagggcca

SEQ ID NO: 408341 - DNA, 16 bp, M. musculus
gagtctatgggggcca

SEQ ID NO: 408342 - DNA, 16 bp, M. musculus
gagtctcaccatgtgt

SEQ ID NO: 408343 - DNA, 16 bp, M. musculus
gagtctcatatagccc

SEQ ID NO: 408344 - DNA, 16 bp, M. musculus
gagtctccacaagata

SEQ ID NO: 408345 - DNA, 16 bp, M. musculus
gagtctcctcctggct

SEQ ID NO: 408346 - DNA, 16 bp, M. musculus
gagtctcctgacaccc

SEQ ID NO: 408347 - DNA, 16 bp, M. musculus
gagtctcctttctctg

SEQ ID NO: 408348 - DNA, 16 bp, M. musculus
gagtctctcagaggac

SEQ ID NO: 408349 - DNA, 16 bp, M. musculus
gagtctctcctcccat

SEQ ID NO: 408350 - DNA, 17 bp, M. musculus
gagtctctctcatccca

SEQ ID NO: 408351 - DNA, 16 bp, M. musculus
gagtctgaagccagcc

SEQ ID NO: 408352 - DNA, 16 bp, M. musculus
gagtctgaagtcagct

SEQ ID NO: 408353 - DNA, 16 bp, M. musculus
gagtctgagaccagcc

SEQ ID NO: 408354 - DNA, 16 bp, M. musculus
gagtctgaggaaaagg

SEQ ID NO: 408355 - DNA, 16 bp, M. musculus
gagtctgagggaggag

SEQ ID NO: 408356 - DNA, 16 bp, M. musculus
gagtctgagtctgagt

SEQ ID NO: 408357 - DNA, 16 bp, M. musculus
gagtctgcctgcccag

SEQ ID NO: 408358 - DNA, 16 bp, M. musculus
gagtctggggagatgg

SEQ ID NO: 408359 - DNA, 16 bp, M. musculus
gagtctgtccttcctg

SEQ ID NO: 408360 - DNA, 16 bp, M. musculus
gagtctgtctcaaaac

SEQ ID NO: 408361 - DNA, 17 bp, M. musculus
gagtctgttccaagttc

SEQ ID NO: 408362 - DNA, 16 bp, M. musculus
gagtctgttctctcct

SEQ ID NO: 408363 - DNA, 17 bp, M. musculus
gagtcttactgtgtagc

SEQ ID NO: 408364 - DNA, 16 bp, M. musculus
gagtcttcattttcat

SEQ ID NO: 408365 - DNA, 16 bp, M. musculus
gagtcttccattttgt

SEQ ID NO: 408366 - DNA, 16 bp, M. musculus
gagtcttctctccagc

SEQ ID NO: 408367 - DNA, 16 bp, M. musculus
gagtcttctggaagag

SEQ ID NO: 408368 - DNA, 16 bp, M. musculus
gagtcttgctgtgtag

SEQ ID NO: 408369 - DNA, 16 bp, M. musculus
gagtgaaaccctgtct

SEQ ID NO: 408370 - DNA, 16 bp, M. musculus
gagtgaacacagctct

SEQ ID NO: 408371 - DNA, 16 bp, M. musculus
gagtgaagtaacccag

SEQ ID NO: 408372 - DNA, 16 bp, M. musculus
gagtgacagagcagga

SEQ ID NO: 408373 - DNA, 16 bp, M. musculus
gagtgacagaggaaga

SEQ ID NO: 408374 - DNA, 16 bp, M. musculus
gagtgacatgtcctag

SEQ ID NO: 408375 - DNA, 16 bp, M. musculus
gagtgaccatggcctg

SEQ ID NO: 408376 - DNA, 16 bp, M. musculus
gagtgaccctttcaca

SEQ ID NO: 408377 - DNA, 16 bp, M. musculus
gagtgagacagcgagc

SEQ ID NO: 408378 - DNA, 32 bp, M. musculus
gagtgagaggcccagggttcgggggagatata

SEQ ID NO: 408379 - DNA, 34 bp, M. musculus
gagtgagaggcccagggttcgggggagatataaa

SEQ ID NO: 408380 - DNA, 18 bp, M. musculus
gagtgagagtccctccct

SEQ ID NO: 408381 - DNA, 16 bp, M. musculus
gagtgagataacacag

SEQ ID NO: 408382 - DNA, 16 bp, M. musculus
gagtgagcgagcgagc

SEQ ID NO: 408383 - DNA, 16 bp, M. musculus
gagtgaggacctggag

SEQ ID NO: 408384 - DNA, 16 bp, M. musculus
gagtgagggtctccct

SEQ ID NO: 408385 - DNA, 16 bp, M. musculus
gagtgagtgagtgtgt

SEQ ID NO: 408386 - DNA, 16 bp, M. musculus
gagtgagttaactcag

SEQ ID NO: 408387 - DNA, 17 bp, M. musculus
gagtgagttccagaaca

SEQ ID NO: 408388 - DNA, 16 bp, M. musculus
gagtgagttccaggag

SEQ ID NO: 408389 - DNA, 16 bp, M. musculus
gagtgagttctttctg

SEQ ID NO: 408390 - DNA, 16 bp, M. musculus
gagtgcacagcctcta

SEQ ID NO: 408391 - DNA, 16 bp, M. musculus
gagtgcagagattaaa

SEQ ID NO: 408392 - DNA, 16 bp, M. musculus
gagtgcaggtgcccac

SEQ ID NO: 408393 - DNA, 16 bp, M. musculus
gagtgcctactatgtg

SEQ ID NO: 408394 - DNA, 16 bp, M. musculus
gagtgcctgcctagca

SEQ ID NO: 408395 - DNA, 16 bp, M. musculus
gagtgcctggggccag

SEQ ID NO: 408396 - DNA, 16 bp, M. musculus
gagtgctaggattaga

SEQ ID NO: 408397 - DNA, 16 bp, M. musculus
gagtgctccataacct

SEQ ID NO: 408398 - DNA, 16 bp, M. musculus
gagtgctggcattaaa

SEQ ID NO: 408399 - DNA, 16 bp, M. musculus
gagtgctgggaactga

SEQ ID NO: 408400 - DNA, 16 bp, M. musculus
gagtgctgggattaac

SEQ ID NO: 408401 - DNA, 16 bp, M. musculus
gagtgctgggattaga

SEQ ID NO: 408402 - DNA, 16 bp, M. musculus
gagtgctgggtttaaa

SEQ ID NO: 408403 - DNA, 16 bp, M. musculus
gagtgcttacctagca

SEQ ID NO: 408404 - DNA, 16 bp, M. musculus
gagtgcttgcccagca

SEQ ID NO: 408405 - DNA, 16 bp, M. musculus
gagtggaatagctggg

SEQ ID NO: 408406 - DNA, 16 bp, M. musculus
gagtggaatatgatgg

SEQ ID NO: 408407 - DNA, 16 bp, M. musculus
gagtggagcagagaca

SEQ ID NO: 408408 - DNA, 16 bp, M. musculus
gagtggagctgaaggg

SEQ ID NO: 408409 - DNA, 16 bp, M. musculus
gagtggatccagaggg

SEQ ID NO: 408410 - DNA, 20 bp, M. musculus
gagtggcactgactactgct

SEQ ID NO: 408411 - DNA, 16 bp, M. musculus
gagtggcagaaaaagt

SEQ ID NO: 408412 - DNA, 16 bp, M. musculus
gagtggcattattagg

SEQ ID NO: 408413 - DNA, 16 bp, M. musculus
gagtggccagagcact

SEQ ID NO: 408414 - DNA, 16 bp, M. musculus
gagtggccagtgctct

SEQ ID NO: 408415 - DNA, 16 bp, M. musculus
gagtgggaatgcctgg

SEQ ID NO: 408416 - DNA, 16 bp, M. musculus
gagtgggaggcagggc

SEQ ID NO: 408417 - DNA, 16 bp, M. musculus
gagtgggggacttttg

SEQ ID NO: 408418 - DNA, 16 bp, M. musculus
gagtgggggtccccga

SEQ ID NO: 408419 - DNA, 16 bp, M. musculus
gagtgggtcaaaggct

SEQ ID NO: 408420 - DNA, 16 bp, M. musculus
gagtgggtcagaggct

SEQ ID NO: 408421 - DNA, 16 bp, M. musculus
gagtgggtggaggaac

SEQ ID NO: 408422 - DNA, 16 bp, M. musculus
gagtgggtgtggcctt

SEQ ID NO: 408423 - DNA, 16 bp, M. musculus
gagtggtatagctggg

SEQ ID NO: 408424 - DNA, 16 bp, M. musculus
gagtggttcctggata

SEQ ID NO: 408425 - DNA, 16 bp, M. musculus
gagtggttctcaacct

SEQ ID NO: 408426 - DNA, 16 bp, M. musculus
gagtggttgtacaaat

SEQ ID NO: 408427 - DNA, 16 bp, M. musculus
gagtgtaatgaaaatg

SEQ ID NO: 408428 - DNA, 16 bp, M. musculus
gagtgtaatgaatgtg

SEQ ID NO: 408429 - DNA, 16 bp, M. musculus
gagtgtaggcttttgt

SEQ ID NO: 408430 - DNA, 16 bp, M. musculus
gagtgtatatatatat

SEQ ID NO: 408431 - DNA, 16 bp, M. musculus
gagtgtatgagtgtgt

SEQ ID NO: 408432 - DNA, 16 bp, M. musculus
gagtgtatgtgaatgt

SEQ ID NO: 408433 - DNA, 16 bp, M. musculus
gagtgtatgtgtgtga

SEQ ID NO: 408434 - DNA, 21 bp, M. musculus
gagtgtctgaagacaactaca

SEQ ID NO: 408435 - DNA, 16 bp, M. musculus
gagtgtgacctgagag

SEQ ID NO: 408436 - DNA, 16 bp, M. musculus
gagtgtgagtgtgtgt

SEQ ID NO: 408437 - DNA, 16 bp, M. musculus
gagtgtgcctgtgtgt

SEQ ID NO: 408438 - DNA, 16 bp, M. musculus
gagtgtggaatacaga

SEQ ID NO: 408439 - DNA, 16 bp, M. musculus
gagtgtggctcagtgg

SEQ ID NO: 408440 - DNA, 16 bp, M. musculus
gagtgtgggagagctg

SEQ ID NO: 408441 - DNA, 16 bp, M. musculus
gagtgtggtggcacac

SEQ ID NO: 408442 - DNA, 16 bp, M. musculus
gagtgtggtggtacac

SEQ ID NO: 408443 - DNA, 16 bp, M. musculus
gagtgtgtatatgagt

SEQ ID NO: 408444 - DNA, 16 bp, M. musculus
gagtgtgtggactaca

SEQ ID NO: 408445 - DNA, 16 bp, M. musculus
gagtgtgtgtatgtat

SEQ ID NO: 408446 - DNA, 16 bp, M. musculus
gagtgtgtgtgtgcat

SEQ ID NO: 408447 - DNA, 16 bp, M. musculus
gagtgtgtgtgtgtgc

SEQ ID NO: 408448 - DNA, 16 bp, M. musculus
gagtgtgttttgctgg

SEQ ID NO: 408449 - DNA, 16 bp, M. musculus
gagtgttctgtctgca

SEQ ID NO: 408450 - DNA, 16 bp, M. musculus
gagtgttcttctttct

SEQ ID NO: 408451 - DNA, 16 bp, M. musculus
gagtgttttcctgaag

SEQ ID NO: 408452 - DNA, 16 bp, M. musculus
gagtgttttgtagatg

SEQ ID NO: 408453 - DNA, 16 bp, M. musculus
gagttaaaaaaaaatc

SEQ ID NO: 408454 - DNA, 16 bp, M. musculus
gagttaaaaacaaaca

SEQ ID NO: 408455 - DNA, 16 bp, M. musculus
gagttaacattttctt

SEQ ID NO: 408456 - DNA, 16 bp, M. musculus
gagttaagaaagcatg

SEQ ID NO: 408457 - DNA, 16 bp, M. musculus
gagttaagaggccagc

SEQ ID NO: 408458 - DNA, 16 bp, M. musculus
gagttaattatcacca

SEQ ID NO: 408459 - DNA, 16 bp, M. musculus
gagttacacaaagata

SEQ ID NO: 408460 - DNA, 16 bp, M. musculus
gagttacagacagtag

SEQ ID NO: 408461 - DNA, 16 bp, M. musculus
gagttacagacagtca

SEQ ID NO: 408462 - DNA, 31 bp, M. musculus
gagttacagagacaaagtttggagctgagat

SEQ ID NO: 408463 - DNA, 16 bp, M. musculus
gagttacagagacagt

SEQ ID NO: 408464 - DNA, 16 bp, M. musculus
gagttacagatgatgg

SEQ ID NO: 408465 - DNA, 16 bp, M. musculus
gagttagaaaatctag

SEQ ID NO: 408466 - DNA, 16 bp, M. musculus
gagttagagaaaggag

SEQ ID NO: 408467 - DNA, 16 bp, M. musculus
gagttagagaaaggat

SEQ ID NO: 408468 - DNA, 16 bp, M. musculus
gagttagctcagtggt

SEQ ID NO: 408469 - DNA, 16 bp, M. musculus
gagttaggatctttct

SEQ ID NO: 408470 - DNA, 16 bp, M. musculus
gagttaggattttttt

SEQ ID NO: 408471 - DNA, 16 bp, M. musculus
gagttagttggcctta

SEQ ID NO: 408472 - DNA, 16 bp, M. musculus
gagttataaagggcaa

SEQ ID NO: 408473 - DNA, 31 bp, M. musculus
gagttattaaagttcttcttgatgtcctcta

SEQ ID NO: 408474 - DNA, 16 bp, M. musculus
gagttattacttacta

SEQ ID NO: 408475 - DNA, 16 bp, M. musculus
gagttcaaagccagcc

SEQ ID NO: 408476 - DNA, 20 bp, M. musculus
gagttcaaagccagcctggg

SEQ ID NO: 408477 - DNA, 16 bp, M. musculus
gagttcaaatcccaag

SEQ ID NO: 408478 - DNA, 16 bp, M. musculus
gagttcaactcccagg

SEQ ID NO: 408479 - DNA, 16 bp, M. musculus
gagttcaagaacagct

SEQ ID NO: 408480 - DNA, 16 bp, M. musculus
gagttcaagaccagca

SEQ ID NO: 408481 - DNA, 16 bp, M. musculus
gagttcaagatcagcc

SEQ ID NO: 408482 - DNA, 16 bp, M. musculus
gagttcaagcctagcc

SEQ ID NO: 408483 - DNA, 16 bp, M. musculus
gagttcaaggccacct

SEQ ID NO: 408484 - DNA, 20 bp, M. musculus
gagttcaaggccagcttgga

SEQ ID NO: 408485 - DNA, 16 bp, M. musculus
gagttcaaggccattt

SEQ ID NO: 408486 - DNA, 16 bp, M. musculus
gagttcaaggcccagc

SEQ ID NO: 408487 - DNA, 16 bp, M. musculus
gagttcaaggctagct

SEQ ID NO: 408488 - DNA, 16 bp, M. musculus
gagttcaaggtcatct

SEQ ID NO: 408489 - DNA, 16 bp, M. musculus
gagttcaatccctgag

SEQ ID NO: 408490 - DNA, 16 bp, M. musculus
gagttcaatccctgga

SEQ ID NO: 408491 - DNA, 16 bp, M. musculus
gagttcaatgacagcc

SEQ ID NO: 408492 - DNA, 16 bp, M. musculus
gagttcaatgccagct

SEQ ID NO: 408493 - DNA, 16 bp, M. musculus
gagttcaattcccagt

SEQ ID NO: 408494 - DNA, 16 bp, M. musculus
gagttcacactgacag

SEQ ID NO: 408495 - DNA, 16 bp, M. musculus
gagttcacttcccagc

SEQ ID NO: 408496 - DNA, 16 bp, M. musculus
gagttcagaggacagc

SEQ ID NO: 408497 - DNA, 16 bp, M. musculus
gagttcagatctccag

SEQ ID NO: 408498 - DNA, 19 bp, M. musculus
gagttcaggaatgcattct

SEQ ID NO: 408499 - DNA, 16 bp, M. musculus
gagttcaggcaatgca

SEQ ID NO: 408500 - DNA, 16 bp, M. musculus
gagttcagggttatcc

SEQ ID NO: 408501 - DNA, 16 bp, M. musculus
gagttcagttcccagg

SEQ ID NO: 408502 - DNA, 16 bp, M. musculus
gagttcatatgagcct

SEQ ID NO: 408503 - DNA, 16 bp, M. musculus
gagttcatcaaaagac

SEQ ID NO: 408504 - DNA, 16 bp, M. musculus
gagttcatcctcagct

SEQ ID NO: 408505 - DNA, 16 bp, M. musculus
gagttcatcctggtag

SEQ ID NO: 408506 - DNA, 16 bp, M. musculus
gagttcatcttgatag

SEQ ID NO: 408507 - DNA, 16 bp, M. musculus
gagttccaagacagtc

SEQ ID NO: 408508 - DNA, 16 bp, M. musculus
gagttccaagtcagcc

SEQ ID NO: 408509 - DNA, 16 bp, M. musculus
gagttccacaacagcc

SEQ ID NO: 408510 - DNA, 16 bp, M. musculus
gagttccacatctgga

SEQ ID NO: 408511 - DNA, 16 bp, M. musculus
gagttccagaaaagcc

SEQ ID NO: 408512 - DNA, 16 bp, M. musculus
gagttccagaagagcc

SEQ ID NO: 408513 - DNA, 16 bp, M. musculus
gagttccagacagcca

SEQ ID NO: 408514 - DNA, 16 bp, M. musculus
gagttccagaccaacc

SEQ ID NO: 408515 - DNA, 16 bp, M. musculus
gagttccagactagct

SEQ ID NO: 408516 - DNA, 16 bp, M. musculus
gagttccagcccagcc

SEQ ID NO: 408517 - DNA, 16 bp, M. musculus
gagttccaggaaagct

SEQ ID NO: 408518 - DNA, 16 bp, M. musculus
gagttccaggaaggcc

SEQ ID NO: 408519 - DNA, 16 bp, M. musculus
gagttccaggacagag

SEQ ID NO: 408520 - DNA, 16 bp, M. musculus
gagttccaggacagct

SEQ ID NO: 408521 - DNA, 16 bp, M. musculus
gagttccaggacatca

SEQ ID NO: 408522 - DNA, 16 bp, M. musculus
gagttccaggaccgcc

SEQ ID NO: 408523 - DNA, 16 bp, M. musculus
gagttccaggccagcc

SEQ ID NO: 408524 - DNA, 16 bp, M. musculus
gagttccaggccaggc

SEQ ID NO: 408525 - DNA, 16 bp, M. musculus
gagttccaggccagtc

SEQ ID NO: 408526 - DNA, 18 bp, M. musculus
gagttccaggccagtcag

SEQ ID NO: 408527 - DNA, 16 bp, M. musculus
gagttccagggacagc

SEQ ID NO: 408528 - DNA, 16 bp, M. musculus
gagttccagggcagcc

SEQ ID NO: 408529 - DNA, 16 bp, M. musculus
gagttccagggcagtc

SEQ ID NO: 408530 - DNA, 16 bp, M. musculus
gagttccaggtcagct

SEQ ID NO: 408531 - DNA, 16 bp, M. musculus
gagttccaggtgagcc

SEQ ID NO: 408532 - DNA, 16 bp, M. musculus
gagttccatccctaga

SEQ ID NO: 408533 - DNA, 16 bp, M. musculus
gagttcctatcccctc

SEQ ID NO: 408534 - DNA, 16 bp, M. musculus
gagttcctcctggagg

SEQ ID NO: 408535 - DNA, 16 bp, M. musculus
gagttcctctttgaag

SEQ ID NO: 408536 - DNA, 16 bp, M. musculus
gagttcctgaacagcc

SEQ ID NO: 408537 - DNA, 16 bp, M. musculus
gagttcctgcccagac

SEQ ID NO: 408538 - DNA, 16 bp, M. musculus
gagttcctggccagcc

SEQ ID NO: 408539 - DNA, 16 bp, M. musculus
gagttcctggtgaaga

SEQ ID NO: 408540 - DNA, 16 bp, M. musculus
gagttcctgtcttgat

SEQ ID NO: 408541 - DNA, 16 bp, M. musculus
gagttcctgttctgac

SEQ ID NO: 408542 - DNA, 16 bp, M. musculus
gagttccttctgcttc

SEQ ID NO: 408543 - DNA, 16 bp, M. musculus
gagttccttgatccac

SEQ ID NO: 408544 - DNA, 16 bp, M. musculus
gagttccttggagcaa

SEQ ID NO: 408545 - DNA, 16 bp, M. musculus
gagttcctttgtgatt

SEQ ID NO: 408546 - DNA, 17 bp, M. musculus
gagttcgaggccagtct

SEQ ID NO: 408547 - DNA, 16 bp, M. musculus
gagttcgaggtcagct

SEQ ID NO: 408548 - DNA, 16 bp, M. musculus
gagttcgattcccagg

SEQ ID NO: 408549 - DNA, 16 bp, M. musculus
gagttcgtcaaaagac

SEQ ID NO: 408550 - DNA, 16 bp, M. musculus
gagttctaagccagcc

SEQ ID NO: 408551 - DNA, 16 bp, M. musculus
gagttctacatcctca

SEQ ID NO: 408552 - DNA, 17 bp, M. musculus
gagttctagatcttcat

SEQ ID NO: 408553 - DNA, 16 bp, M. musculus
gagttctaggccaacc

SEQ ID NO: 408554 - DNA, 16 bp, M. musculus
gagttctaggccagcc

SEQ ID NO: 408555 - DNA, 16 bp, M. musculus
gagttctaggctagcc

SEQ ID NO: 408556 - DNA, 16 bp, M. musculus
gagttctaggttagcc

SEQ ID NO: 408557 - DNA, 16 bp, M. musculus
gagttctctggaagag

SEQ ID NO: 408558 - DNA, 16 bp, M. musculus
gagttctctggggacc

SEQ ID NO: 408559 - DNA, 16 bp, M. musculus
gagttctgggacagct

SEQ ID NO: 408560 - DNA, 16 bp, M. musculus
gagttctgtggtggaa

SEQ ID NO: 408561 - DNA, 16 bp, M. musculus
gagttcttcaccccct

SEQ ID NO: 408562 - DNA, 16 bp, M. musculus
gagttcttgccttggc

SEQ ID NO: 408563 - DNA, 16 bp, M. musculus
gagttctttctatatt

SEQ ID NO: 408564 - DNA, 16 bp, M. musculus
gagttgaaggggtctg

SEQ ID NO: 408565 - DNA, 16 bp, M. musculus
gagttgacctgaatga

SEQ ID NO: 408566 - DNA, 16 bp, M. musculus
gagttgactggagtga

SEQ ID NO: 408567 - DNA, 16 bp, M. musculus
gagttgatcctgtgcc

SEQ ID NO: 408568 - DNA, 16 bp, M. musculus
gagttgcagagatgaa

SEQ ID NO: 408569 - DNA, 16 bp, M. musculus
gagttgcaggccagcc

SEQ ID NO: 408570 - DNA, 16 bp, M. musculus
gagttgccatgtggat

SEQ ID NO: 408571 - DNA, 16 bp, M. musculus
gagttgccttggtcac

SEQ ID NO: 408572 - DNA, 16 bp, M. musculus
gagttgccttgtccag

SEQ ID NO: 408573 - DNA, 16 bp, M. musculus
gagttgctccaaagaa

SEQ ID NO: 408574 - DNA, 16 bp, M. musculus
gagttgctggcagtga

SEQ ID NO: 408575 - DNA, 16 bp, M. musculus
gagttgcttctctcct

SEQ ID NO: 408576 - DNA, 16 bp, M. musculus
gagttggaatcccagg

SEQ ID NO: 408577 - DNA, 16 bp, M. musculus
gagttggaattacagg

SEQ ID NO: 408578 - DNA, 16 bp, M. musculus
gagttggagaaggaac

SEQ ID NO: 408579 - DNA, 16 bp, M. musculus
gagttggagaccagcc

SEQ ID NO: 408580 - DNA, 16 bp, M. musculus
gagttggaggcaggag

SEQ ID NO: 408581 - DNA, 16 bp, M. musculus
gagttggatttttgat

SEQ ID NO: 408582 - DNA, 16 bp, M. musculus
gagttggctgtggcct

SEQ ID NO: 408583 - DNA, 26 bp, M. musculus
gagttgggagccacatatgatagaga

SEQ ID NO: 408584 - DNA, 16 bp, M. musculus
gagttgggttcccagc

SEQ ID NO: 408585 - DNA, 16 bp, M. musculus
gagttggttctctcct

SEQ ID NO: 408586 - DNA, 16 bp, M. musculus
gagttgttggccaaaa

SEQ ID NO: 408587 - DNA, 16 bp, M. musculus
gagtttaaggaacaca

SEQ ID NO: 408588 - DNA, 16 bp, M. musculus
gagtttaaggccatcc

SEQ ID NO: 408589 - DNA, 16 bp, M. musculus
gagtttaatgaaaatg

SEQ ID NO: 408590 - DNA, 16 bp, M. musculus
gagtttagatccccag

SEQ ID NO: 408591 - DNA, 16 bp, M. musculus
gagtttatattccctg

SEQ ID NO: 408592 - DNA, 17 bp, M. musculus
gagtttatgaaattcct

SEQ ID NO: 408593 - DNA, 16 bp, M. musculus
gagtttatgtgcacca

SEQ ID NO: 408594 - DNA, 16 bp, M. musculus
gagtttattttggttc

SEQ ID NO: 408595 - DNA, 16 bp, M. musculus
gagtttcaagtcagcc

SEQ ID NO: 408596 - DNA, 16 bp, M. musculus
gagtttcaatgtaatt

SEQ ID NO: 408597 - DNA, 16 bp, M. musculus
gagtttcagaccagcc

SEQ ID NO: 408598 - DNA, 16 bp, M. musculus
gagtttcagagacagg

SEQ ID NO: 408599 - DNA, 16 bp, M. musculus
gagtttcaggacagct

SEQ ID NO: 408600 - DNA, 17 bp, M. musculus
gagtttcaggacagtca

SEQ ID NO: 408601 - DNA, 16 bp, M. musculus
gagtttcaggccagcc

SEQ ID NO: 408602 - DNA, 16 bp, M. musculus
gagtttcaggccagtc

SEQ ID NO: 408603 - DNA, 16 bp, M. musculus
gagtttcaggctagcc

SEQ ID NO: 408604 - DNA, 16 bp, M. musculus
gagtttcaggtcagcc

SEQ ID NO: 408605 - DNA, 16 bp, M. musculus
gagtttcaggtcagtc

SEQ ID NO: 408606 - DNA, 16 bp, M. musculus
gagtttccagttttgt

SEQ ID NO: 408607 - DNA, 16 bp, M. musculus
gagtttctcagaggac

SEQ ID NO: 408608 - DNA, 16 bp, M. musculus
gagtttctcttcattt

SEQ ID NO: 408609 - DNA, 16 bp, M. musculus
gagtttctgatcctcc

SEQ ID NO: 408610 - DNA, 16 bp, M. musculus
gagtttctggagtcca

SEQ ID NO: 408611 - DNA, 16 bp, M. musculus
gagtttctttacatgt

SEQ ID NO: 408612 - DNA, 16 bp, M. musculus
gagtttgaaaccaacc

SEQ ID NO: 408613 - DNA, 16 bp, M. musculus
gagtttgaaagggcaa

SEQ ID NO: 408614 - DNA, 16 bp, M. musculus
gagtttgaatcccaga

SEQ ID NO: 408615 - DNA, 16 bp, M. musculus
gagtttgactatttcc

SEQ ID NO: 408616 - DNA, 16 bp, M. musculus
gagtttgagccagaag

SEQ ID NO: 408617 - DNA, 16 bp, M. musculus
gagtttgagctcagcc

SEQ ID NO: 408618 - DNA, 19 bp, M. musculus
gagtttgaggccagcctat

SEQ ID NO: 408619 - DNA, 20 bp, M. musculus
gagtttgaggccagcctggg

SEQ ID NO: 408620 - DNA, 16 bp, M. musculus
gagtttgaggcccacc

SEQ ID NO: 408621 - DNA, 16 bp, M. musculus
gagtttgaggctaact

SEQ ID NO: 408622 - DNA, 16 bp, M. musculus
gagtttgaggtcagct

SEQ ID NO: 408623 - DNA, 16 bp, M. musculus
gagtttgaggttagcc

SEQ ID NO: 408624 - DNA, 16 bp, M. musculus
gagtttgatcccagga

SEQ ID NO: 408625 - DNA, 16 bp, M. musculus
gagtttgatccccagt

SEQ ID NO: 408626 - DNA, 16 bp, M. musculus
gagtttgatccctagc

SEQ ID NO: 408627 - DNA, 16 bp, M. musculus
gagtttgatccctggg

SEQ ID NO: 408628 - DNA, 16 bp, M. musculus
gagtttgatccttggg

SEQ ID NO: 408629 - DNA, 16 bp, M. musculus
gagtttgattcccagg

SEQ ID NO: 408630 - DNA, 16 bp, M. musculus
gagtttgcagccagcc

SEQ ID NO: 408631 - DNA, 16 bp, M. musculus
gagtttgcctagctgg

SEQ ID NO: 408632 - DNA, 16 bp, M. musculus
gagtttgctgacagga

SEQ ID NO: 408633 - DNA, 16 bp, M. musculus
gagtttgctggccagc

SEQ ID NO: 408634 - DNA, 16 bp, M. musculus
gagtttggatcccaga

SEQ ID NO: 408635 - DNA, 16 bp, M. musculus
gagtttggatccccag

SEQ ID NO: 408636 - DNA, 16 bp, M. musculus
gagtttggatgcccag

SEQ ID NO: 408637 - DNA, 16 bp, M. musculus
gagtttggtgtctgta

SEQ ID NO: 408638 - DNA, 16 bp, M. musculus
gagtttggtttccagc

SEQ ID NO: 408639 - DNA, 16 bp, M. musculus
gagtttgtaggctttt

SEQ ID NO: 408640 - DNA, 16 bp, M. musculus
gagtttgtgcatgtgt

SEQ ID NO: 408641 - DNA, 16 bp, M. musculus
gagtttgtgtatgtgt

SEQ ID NO: 408642 - DNA, 16 bp, M. musculus
gagtttgtttatataa

SEQ ID NO: 408643 - DNA, 16 bp, M. musculus
gagtttgttttctcct

SEQ ID NO: 408644 - DNA, 16 bp, M. musculus
gagttttgacaaagaa

SEQ ID NO: 408645 - DNA, 16 bp, M. musculus
gagtttttaaaatata

SEQ ID NO: 408646 - DNA, 16 bp, M. musculus
gagtttttcctttatt

SEQ ID NO: 408647 - DNA, 16 bp, M. musculus
gataaaacagaaacac

SEQ ID NO: 408648 - DNA, 16 bp, M. musculus
gataaaagacacagac

SEQ ID NO: 408649 - DNA, 16 bp, M. musculus
gataaaagcactgtgg

SEQ ID NO: 408650 - DNA, 16 bp, M. musculus
gataaaataacctctg

SEQ ID NO: 408651 - DNA, 16 bp, M. musculus
gataaaatattctgta

SEQ ID NO: 408652 - DNA, 16 bp, M. musculus
gataaaatattttgta

SEQ ID NO: 408653 - DNA, 16 bp, M. musculus
gataaaatctggactg

SEQ ID NO: 408654 - DNA, 16 bp, M. musculus
gataaaatgatctgta

SEQ ID NO: 408655 - DNA, 16 bp, M. musculus
gataaaatgttttata

SEQ ID NO: 408656 - DNA, 16 bp, M. musculus
gataaacagcttcagg

SEQ ID NO: 408657 - DNA, 16 bp, M. musculus
gataaagaaaacatgg

SEQ ID NO: 408658 - DNA, 16 bp, M. musculus
gataaagaaaatttgg

SEQ ID NO: 408659 - DNA, 16 bp, M. musculus
gataaagaaactggag

SEQ ID NO: 408660 - DNA, 16 bp, M. musculus
gataaagaaactgtgg

SEQ ID NO: 408661 - DNA, 16 bp, M. musculus
gataaagagacagaga

SEQ ID NO: 408662 - DNA, 16 bp, M. musculus
gataaagatcaaagga

SEQ ID NO: 408663 - DNA, 16 bp, M. musculus
gataaagatggagaag

SEQ ID NO: 408664 - DNA, 16 bp, M. musculus
gataaaggaaatgtgg

SEQ ID NO: 408665 - DNA, 16 bp, M. musculus
gataaaggcacttgct

SEQ ID NO: 408666 - DNA, 16 bp, M. musculus
gataaagtggggaaaa

SEQ ID NO: 408667 - DNA, 16 bp, M. musculus
gataaataaataaatc

SEQ ID NO: 408668 - DNA, 16 bp, M. musculus
gataacaggagcttgg

SEQ ID NO: 408669 - DNA, 16 bp, M. musculus
gataaccaactggtgt

SEQ ID NO: 408670 - DNA, 16 bp, M. musculus
gataaccagatggaga

SEQ ID NO: 408671 - DNA, 16 bp, M. musculus
gataaccagatggtaa

SEQ ID NO: 408672 - DNA, 16 bp, M. musculus
gataaccttgaactcc

SEQ ID NO: 408673 - DNA, 16 bp, M. musculus
gataactccagctatg

SEQ ID NO: 408674 - DNA, 16 bp, M. musculus
gataactgccagtttt

SEQ ID NO: 408675 - DNA, 16 bp, M. musculus
gataactgtagcttgt

SEQ ID NO: 408676 - DNA, 23 bp, M. musculus
gataagaaagcaattggcaatgg

SEQ ID NO: 408677 - DNA, 16 bp, M. musculus
gataagaacaccaacc

SEQ ID NO: 408678 - DNA, 16 bp, M. musculus
gataagaagagatcac

SEQ ID NO: 408679 - DNA, 16 bp, M. musculus
gataagataagataag

SEQ ID NO: 408680 - DNA, 16 bp, M. musculus
gataagcccttagcca

SEQ ID NO: 408681 - DNA, 16 bp, M. musculus
gataagctgcaagatg

SEQ ID NO: 408682 - DNA, 16 bp, M. musculus
gataaggaactgtggg

SEQ ID NO: 408683 - DNA, 16 bp, M. musculus
gataagtgtgtgtgtg

SEQ ID NO: 408684 - DNA, 16 bp, M. musculus
gataataatgatgatg

SEQ ID NO: 408685 - DNA, 16 bp, M. musculus
gataatcatggactaa

SEQ ID NO: 408686 - DNA, 16 bp, M. musculus
gataatctcttgtgca

SEQ ID NO: 408687 - DNA, 16 bp, M. musculus
gataatgaggctctgt

SEQ ID NO: 408688 - DNA, 16 bp, M. musculus
gataatggacctgcct

SEQ ID NO: 408689 - DNA, 16 bp, M. musculus
gataatggactaacct

SEQ ID NO: 408690 - DNA, 16 bp, M. musculus
gataatttctttattt

SEQ ID NO: 408691 - DNA, 16 bp, M. musculus
gatacaaatgaattta

SEQ ID NO: 408692 - DNA, 16 bp, M. musculus
gatacaacctacagac

SEQ ID NO: 408693 - DNA, 16 bp, M. musculus
gatacaagccttgtga

SEQ ID NO: 408694 - DNA, 16 bp, M. musculus
gatacaatattgaaag

SEQ ID NO: 408695 - DNA, 16 bp, M. musculus
gatacaatgtgaccag

SEQ ID NO: 408696 - DNA, 16 bp, M. musculus
gatacaattcacagat

SEQ ID NO: 408697 - DNA, 16 bp, M. musculus
gatacaatttcttaaa

SEQ ID NO: 408698 - DNA, 16 bp, M. musculus
gatacaatttgaaaaa

SEQ ID NO: 408699 - DNA, 16 bp, M. musculus
gatacacacacacaca

SEQ ID NO: 408700 - DNA, 16 bp, M. musculus
gatacacacatgtata

SEQ ID NO: 408701 - DNA, 16 bp, M. musculus
gatacacagacacaca

SEQ ID NO: 408702 - DNA, 16 bp, M. musculus
gatacacagtgagacc

SEQ ID NO: 408703 - DNA, 16 bp, M. musculus
gatacactgaaattta

SEQ ID NO: 408704 - DNA, 16 bp, M. musculus
gatacagaaaacatgg

SEQ ID NO: 408705 - DNA, 16 bp, M. musculus
gatacagaactctcag

SEQ ID NO: 408706 - DNA, 16 bp, M. musculus
gatacagacagagaga

SEQ ID NO: 408707 - DNA, 16 bp, M. musculus
gatacagagacagaaa

SEQ ID NO: 408708 - DNA, 16 bp, M. musculus
gatacagagacccaca

SEQ ID NO: 408709 - DNA, 16 bp, M. musculus
gatacagagagagaca

SEQ ID NO: 408710 - DNA, 16 bp, M. musculus
gatacagattggaaag

SEQ ID NO: 408711 - DNA, 16 bp, M. musculus
gatacaggactgttta

SEQ ID NO: 408712 - DNA, 16 bp, M. musculus
gatacaggaggagctg

SEQ ID NO: 408713 - DNA, 16 bp, M. musculus
gatacagttcacaaac

SEQ ID NO: 408714 - DNA, 16 bp, M. musculus
gatacatgaaaccctg

SEQ ID NO: 408715 - DNA, 16 bp, M. musculus
gatacatgatgtgaaa

SEQ ID NO: 408716 - DNA, 16 bp, M. musculus
gatacatgctctacta

SEQ ID NO: 408717 - DNA, 17 bp, M. musculus
gatacatgggacaattt

SEQ ID NO: 408718 - DNA, 16 bp, M. musculus
gatacattaatattaa

SEQ ID NO: 408719 - DNA, 16 bp, M. musculus
gatacattgaaactaa

SEQ ID NO: 408720 - DNA, 16 bp, M. musculus
gatacccagagaaacc

SEQ ID NO: 408721 - DNA, 16 bp, M. musculus
gatacccagggcagca

SEQ ID NO: 408722 - DNA, 16 bp, M. musculus
gatacccatcagaggc

SEQ ID NO: 408723 - DNA, 16 bp, M. musculus
gataccctccagatct

SEQ ID NO: 408724 - DNA, 16 bp, M. musculus
gataccctggagctgg

SEQ ID NO: 408725 - DNA, 16 bp, M. musculus
gataccggggcagatg

SEQ ID NO: 408726 - DNA, 16 bp, M. musculus
gatacctgctgaggaa

SEQ ID NO: 408727 - DNA, 16 bp, M. musculus
gataccttagaagata

SEQ ID NO: 408728 - DNA, 16 bp, M. musculus
gatactatgtccattt

SEQ ID NO: 408729 - DNA, 16 bp, M. musculus
gatactcacagccaag

SEQ ID NO: 408730 - DNA, 16 bp, M. musculus
gatactctgtgtgtgt

SEQ ID NO: 408731 - DNA, 16 bp, M. musculus
gatacttctaaattga

SEQ ID NO: 408732 - DNA, 16 bp, M. musculus
gatactttataaagaa

SEQ ID NO: 408733 - DNA, 16 bp, M. musculus
gatacttttaatgact

SEQ ID NO: 408734 - DNA, 16 bp, M. musculus
gatacttttacttctt

SEQ ID NO: 408735 - DNA, 16 bp, M. musculus
gatagaaacatagata

SEQ ID NO: 408736 - DNA, 17 bp, M. musculus
gatagaaaccctatgaa

SEQ ID NO: 408737 - DNA, 16 bp, M. musculus
gatagaaatgggtcaa

SEQ ID NO: 408738 - DNA, 16 bp, M. musculus
gatagaacacttgcct

SEQ ID NO: 408739 - DNA, 16 bp, M. musculus
gatagaatgcttgcct

SEQ ID NO: 408740 - DNA, 16 bp, M. musculus
gatagacagaagctgg

SEQ ID NO: 408741 - DNA, 16 bp, M. musculus
gatagacagagacaaa

SEQ ID NO: 408742 - DNA, 16 bp, M. musculus
gatagagacaaagaga

SEQ ID NO: 408743 - DNA, 16 bp, M. musculus
gatagagagacagagg

SEQ ID NO: 408744 - DNA, 16 bp, M. musculus
gatagagagagagtgg

SEQ ID NO: 408745 - DNA, 16 bp, M. musculus
gatagagatagatgat

SEQ ID NO: 408746 - DNA, 16 bp, M. musculus
gatagagcccacagtc

SEQ ID NO: 408747 - DNA, 16 bp, M. musculus
gatagaggtagataga

SEQ ID NO: 408748 - DNA, 16 bp, M. musculus
gatagataagatagat

SEQ ID NO: 408749 - DNA, 16 bp, M. musculus
gatagatacataaata

SEQ ID NO: 408750 - DNA, 16 bp, M. musculus
gatagatacatagaaa

SEQ ID NO: 408751 - DNA, 16 bp, M. musculus
gatagatacatagata

SEQ ID NO: 408752 - DNA, 16 bp, M. musculus
gatagatagatatgac

SEQ ID NO: 408753 - DNA, 16 bp, M. musculus
gatagatgaatggata

SEQ ID NO: 408754 - DNA, 16 bp, M. musculus
gatagcaagggctaca

SEQ ID NO: 408755 - DNA, 16 bp, M. musculus
gatagcagccagacac

SEQ ID NO: 408756 - DNA, 16 bp, M. musculus
gatagccgggcagtgg

SEQ ID NO: 408757 - DNA, 16 bp, M. musculus
gatagcctctttttct

SEQ ID NO: 408758 - DNA, 16 bp, M. musculus
gatagctcagtagtta

SEQ ID NO: 408759 - DNA, 16 bp, M. musculus
gatagctcagtgggta

SEQ ID NO: 408760 - DNA, 30 bp, M. musculus
gatagcttgctgttggcatcctgtggaagg

SEQ ID NO: 408761 - DNA, 16 bp, M. musculus
gatagctttggaaatg

SEQ ID NO: 408762 - DNA, 16 bp, M. musculus
gataggaggcccccaa

SEQ ID NO: 408763 - DNA, 16 bp, M. musculus
gataggatccatggga

SEQ ID NO: 408764 - DNA, 16 bp, M. musculus
gataggatttaaaaca

SEQ ID NO: 408765 - DNA, 16 bp, M. musculus
gataggcctgccttca

SEQ ID NO: 408766 - DNA, 20 bp, M. musculus
gataggggactaatatccaa

SEQ ID NO: 408767 - DNA, 16 bp, M. musculus
gatagggtttttctgt

SEQ ID NO: 408768 - DNA, 34 bp, M. musculus
gataggtaaagatcctttcccaatctgttggtgg

SEQ ID NO: 408769 - DNA, 16 bp, M. musculus
gataggttgcatggga

SEQ ID NO: 408770 - DNA, 16 bp, M. musculus
gatagtccatcttttc

SEQ ID NO: 408771 - DNA, 16 bp, M. musculus
gatagtctctatatag

SEQ ID NO: 408772 - DNA, 16 bp, M. musculus
gatagtgatgatgatg

SEQ ID NO: 408773 - DNA, 16 bp, M. musculus
gatagtgatgatggtg

SEQ ID NO: 408774 - DNA, 16 bp, M. musculus
gatataattttaagaa

SEQ ID NO: 408775 - DNA, 16 bp, M. musculus
gatatacagagaaacc

SEQ ID NO: 408776 - DNA, 16 bp, M. musculus
gatatacattatcatt

SEQ ID NO: 408777 - DNA, 16 bp, M. musculus
gatatagatatatata

SEQ ID NO: 408778 - DNA, 16 bp, M. musculus
gatatagctcagtggt

SEQ ID NO: 408779 - DNA, 16 bp, M. musculus
gatatataagggattg

SEQ ID NO: 408780 - DNA, 16 bp, M. musculus
gatatatattttccca

SEQ ID NO: 408781 - DNA, 16 bp, M. musculus
gatatatgcacacata

SEQ ID NO: 408782 - DNA, 16 bp, M. musculus
gatatatgtatatgta

SEQ ID NO: 408783 - DNA, 16 bp, M. musculus
gatatatgtccagaag

SEQ ID NO: 408784 - DNA, 16 bp, M. musculus
gatatcaacctgcctt

SEQ ID NO: 408785 - DNA, 16 bp, M. musculus
gatatcagaaaatgga

SEQ ID NO: 408786 - DNA, 16 bp, M. musculus
gatatcagtgggagga

SEQ ID NO: 408787 - DNA, 16 bp, M. musculus
gatatcccagagacct

SEQ ID NO: 408788 - DNA, 16 bp, M. musculus
gatatcccatttaggg

SEQ ID NO: 408789 - DNA, 16 bp, M. musculus
gatatcctgcatatct

SEQ ID NO: 408790 - DNA, 16 bp, M. musculus
gatatctgtgagttca

SEQ ID NO: 408791 - DNA, 16 bp, M. musculus
gatatcttctttattt

SEQ ID NO: 408792 - DNA, 16 bp, M. musculus
gatatggaacaacaaa

SEQ ID NO: 408793 - DNA, 16 bp, M. musculus
gatatggaacttgaag

SEQ ID NO: 408794 - DNA, 16 bp, M. musculus
gatatggatatggata

SEQ ID NO: 408795 - DNA, 16 bp, M. musculus
gatatggcaggctcta

SEQ ID NO: 408796 - DNA, 16 bp, M. musculus
gatatggcagtctcta

SEQ ID NO: 408797 - DNA, 16 bp, M. musculus
gatatgggtacaggag

SEQ ID NO: 408798 - DNA, 16 bp, M. musculus
gatatgtagcagagga

SEQ ID NO: 408799 - DNA, 16 bp, M. musculus
gatatgtcaacatttt

SEQ ID NO: 408800 - DNA, 16 bp, M. musculus
gatatgtgactcctgt

SEQ ID NO: 408801 - DNA, 27 bp, M. musculus
gatatgtgctaacctctcaaaagtgta

SEQ ID NO: 408802 - DNA, 16 bp, M. musculus
gatatgtttggtggag

SEQ ID NO: 408803 - DNA, 16 bp, M. musculus
gatattaaaatgtcta

SEQ ID NO: 408804 - DNA, 16 bp, M. musculus
gatattagaatggcta

SEQ ID NO: 408805 - DNA, 16 bp, M. musculus
gatattagccctctat

SEQ ID NO: 408806 - DNA, 16 bp, M. musculus
gatattagtcctttgt

SEQ ID NO: 408807 - DNA, 16 bp, M. musculus
gatattattgatacat

SEQ ID NO: 408808 - DNA, 16 bp, M. musculus
gatattcataagggta

SEQ ID NO: 408809 - DNA, 16 bp, M. musculus
gatattcctgagatag

SEQ ID NO: 408810 - DNA, 16 bp, M. musculus
gatattctcaagatcc

SEQ ID NO: 408811 - DNA, 16 bp, M. musculus
gatattgaatgtttct

SEQ ID NO: 408812 - DNA, 16 bp, M. musculus
gatattgacacaacag

SEQ ID NO: 408813 - DNA, 16 bp, M. musculus
gatattgctgttcttc

SEQ ID NO: 408814 - DNA, 16 bp, M. musculus
gatattggagatgcca

SEQ ID NO: 408815 - DNA, 16 bp, M. musculus
gatattggatatttta

SEQ ID NO: 408816 - DNA, 16 bp, M. musculus
gatattggtacagaaa

SEQ ID NO: 408817 - DNA, 16 bp, M. musculus
gatatttgcccagaag

SEQ ID NO: 408818 - DNA, 16 bp, M. musculus
gatatttgcctctgtg

SEQ ID NO: 408819 - DNA, 16 bp, M. musculus
gatatttgctggccat

SEQ ID NO: 408820 - DNA, 16 bp, M. musculus
gatattttcatcattt

SEQ ID NO: 408821 - DNA, 16 bp, M. musculus
gatattttctggctct

SEQ ID NO: 408822 - DNA, 16 bp, M. musculus
gatatttttaaaggat

SEQ ID NO: 408823 - DNA, 16 bp, M. musculus
gatattttttcttcat

SEQ ID NO: 408824 - DNA, 16 bp, M. musculus
gatcaaaagttcaagg

SEQ ID NO: 408825 - DNA, 16 bp, M. musculus
gatcaaagaaatacaa

SEQ ID NO: 408826 - DNA, 16 bp, M. musculus
gatcaaagacctcaat

SEQ ID NO: 408827 - DNA, 16 bp, M. musculus
gatcaaaggcctgtgc

SEQ ID NO: 408828 - DNA, 16 bp, M. musculus
gatcaaaggtgtgggc

SEQ ID NO: 408829 - DNA, 16 bp, M. musculus
gatcaaagtgtccaca

SEQ ID NO: 408830 - DNA, 16 bp, M. musculus
gatcaacaagctgaag

SEQ ID NO: 408831 - DNA, 16 bp, M. musculus
gatcaacagcaatgtg

SEQ ID NO: 408832 - DNA, 16 bp, M. musculus
gatcaacattatgaac

SEQ ID NO: 408833 - DNA, 16 bp, M. musculus
gatcaagaaccaattg

SEQ ID NO: 408834 - DNA, 16 bp, M. musculus
gatcaagaagtcaagg

SEQ ID NO: 408835 - DNA, 16 bp, M. musculus
gatcaagagttcaagg

SEQ ID NO: 408836 - DNA, 16 bp, M. musculus
gatcaagagttcaggg

SEQ ID NO: 408837 - DNA, 16 bp, M. musculus
gatcaagatgtggaac

SEQ ID NO: 408838 - DNA, 16 bp, M. musculus
gatcaagcccagggct

SEQ ID NO: 408839 - DNA, 16 bp, M. musculus
gatcaagctcaggtca

SEQ ID NO: 408840 - DNA, 17 bp, M. musculus
gatcaaggacctccaca

SEQ ID NO: 408841 - DNA, 16 bp, M. musculus
gatcaaggatctccac

SEQ ID NO: 408842 - DNA, 16 bp, M. musculus
gatcaaggccaatgtt

SEQ ID NO: 408843 - DNA, 16 bp, M. musculus
gatcaaggggaaaagg

SEQ ID NO: 408844 - DNA, 16 bp, M. musculus
gatcaagtatggggag

SEQ ID NO: 408845 - DNA, 16 bp, M. musculus
gatcaatggcatagaa

SEQ ID NO: 408846 - DNA, 16 bp, M. musculus
gatcacaagttcaaag

SEQ ID NO: 408847 - DNA, 16 bp, M. musculus
gatcacagagccccca

SEQ ID NO: 408848 - DNA, 16 bp, M. musculus
gatcacaggatcacag

SEQ ID NO: 408849 - DNA, 16 bp, M. musculus
gatcacaggattccag

SEQ ID NO: 408850 - DNA, 16 bp, M. musculus
gatcacaggcctgtgc

SEQ ID NO: 408851 - DNA, 16 bp, M. musculus
gatcacaggctcacag

SEQ ID NO: 408852 - DNA, 16 bp, M. musculus
gatcacatccaaagac

SEQ ID NO: 408853 - DNA, 16 bp, M. musculus
gatcacctggggcatg

SEQ ID NO: 408854 - DNA, 16 bp, M. musculus
gatcacctggggtgga

SEQ ID NO: 408855 - DNA, 16 bp, M. musculus
gatcacttgagcccag

SEQ ID NO: 408856 - DNA, 16 bp, M. musculus
gatcagaaagaaaaca

SEQ ID NO: 408857 - DNA, 16 bp, M. musculus
gatcagaagctcaagg

SEQ ID NO: 408858 - DNA, 16 bp, M. musculus
gatcagaagttcaaga

SEQ ID NO: 408859 - DNA, 16 bp, M. musculus
gatcagaggacaactt

SEQ ID NO: 408860 - DNA, 16 bp, M. musculus
gatcagaggacagcct

SEQ ID NO: 408861 - DNA, 16 bp, M. musculus
gatcagaggataactt

SEQ ID NO: 408862 - DNA, 16 bp, M. musculus
gatcagcatgcctgtc

SEQ ID NO: 408863 - DNA, 16 bp, M. musculus
gatcagcctgtctctg

SEQ ID NO: 408864 - DNA, 16 bp, M. musculus
gatcagcttcttcatt

SEQ ID NO: 408865 - DNA, 18 bp, M. musculus
gatcaggaattcaaggcc

SEQ ID NO: 408866 - DNA, 16 bp, M. musculus
gatcaggaggtcctgg

SEQ ID NO: 408867 - DNA, 16 bp, M. musculus
gatcaggagttaaagg

SEQ ID NO: 408868 - DNA, 16 bp, M. musculus
gatcaggagttcaagg

SEQ ID NO: 408869 - DNA, 17 bp, M. musculus
gatcaggagttcaaggc

SEQ ID NO: 408870 - DNA, 16 bp, M. musculus
gatcaggagttcgagg

SEQ ID NO: 408871 - DNA, 16 bp, M. musculus
gatcaggagtttgagg

SEQ ID NO: 408872 - DNA, 16 bp, M. musculus
gatcaggatgtaaagt

SEQ ID NO: 408873 - DNA, 16 bp, M. musculus
gatcaggctgacctca

SEQ ID NO: 408874 - DNA, 16 bp, M. musculus
gatcagggctggagag

SEQ ID NO: 408875 - DNA, 16 bp, M. musculus
gatcaggggctggaga

SEQ ID NO: 408876 - DNA, 16 bp, M. musculus
gatcagtgaagatgtg

SEQ ID NO: 408877 - DNA, 16 bp, M. musculus
gatcagtgccttgctc

SEQ ID NO: 408878 - DNA, 16 bp, M. musculus
gatcagtgccttgttc

SEQ ID NO: 408879 - DNA, 16 bp, M. musculus
gatcatccatcataat

SEQ ID NO: 408880 - DNA, 16 bp, M. musculus
gatcatcctgcacaaa

SEQ ID NO: 408881 - DNA, 16 bp, M. musculus
gatcatctgaccaaaa

SEQ ID NO: 408882 - DNA, 16 bp, M. musculus
gatcatcttcaagatt

SEQ ID NO: 408883 - DNA, 16 bp, M. musculus
gatcatggacttccac

SEQ ID NO: 408884 - DNA, 16 bp, M. musculus
gatcatgggaacagaa

SEQ ID NO: 408885 - DNA, 16 bp, M. musculus
gatcatgtcttcattt

SEQ ID NO: 408886 - DNA, 16 bp, M. musculus
gatcatgtggagagtc

SEQ ID NO: 408887 - DNA, 16 bp, M. musculus
gatcatgtggttttgg

SEQ ID NO: 408888 - DNA, 16 bp, M. musculus
gatcatgtttttgttt

SEQ ID NO: 408889 - DNA, 16 bp, M. musculus
gatcatttctgcccat

SEQ ID NO: 408890 - DNA, 16 bp, M. musculus
gatccaaaggcagcaa

SEQ ID NO: 408891 - DNA, 16 bp, M. musculus
gatccaaaggcagcca

SEQ ID NO: 408892 - DNA, 16 bp, M. musculus
gatccaatgccctctt

SEQ ID NO: 408893 - DNA, 16 bp, M. musculus
gatccacaaagaaaaa

SEQ ID NO: 408894 - DNA, 17 bp, M. musculus
gatccacaacaatggcc

SEQ ID NO: 408895 - DNA, 16 bp, M. musculus
gatccacaggcagcag

SEQ ID NO: 408896 - DNA, 16 bp, M. musculus
gatccacaggcaggca

SEQ ID NO: 408897 - DNA, 20 bp, M. musculus
gatccacctacctctgcctc

SEQ ID NO: 408898 - DNA, 16 bp, M. musculus
gatccacctacttctg

SEQ ID NO: 408899 - DNA, 16 bp, M. musculus
gatccacctcctgagt

SEQ ID NO: 408900 - DNA, 18 bp, M. musculus
gatccacctgtctctgcc

SEQ ID NO: 408901 - DNA, 16 bp, M. musculus
gatccacctgtttctg

SEQ ID NO: 408902 - DNA, 16 bp, M. musculus
gatccactgccctctt

SEQ ID NO: 408903 - DNA, 16 bp, M. musculus
gatccacttcctccag

SEQ ID NO: 408904 - DNA, 16 bp, M. musculus
gatccacttgcctcag

SEQ ID NO: 408905 - DNA, 16 bp, M. musculus
gatccagaaatacctc

SEQ ID NO: 408906 - DNA, 16 bp, M. musculus
gatccagatgcagaac

SEQ ID NO: 408907 - DNA, 16 bp, M. musculus
gatccatccaatggct

SEQ ID NO: 408908 - DNA, 16 bp, M. musculus
gatccatccttacttg

SEQ ID NO: 408909 - DNA, 16 bp, M. musculus
gatccatccttttgtc

SEQ ID NO: 408910 - DNA, 16 bp, M. musculus
gatccatctctgcagc

SEQ ID NO: 408911 - DNA, 16 bp, M. musculus
gatcccacaaggtggc

SEQ ID NO: 408912 - DNA, 16 bp, M. musculus
gatcccacccaactaa

SEQ ID NO: 408913 - DNA, 16 bp, M. musculus
gatcccagaacccaca

SEQ ID NO: 408914 - DNA, 16 bp, M. musculus
gatcccagaatcccag

SEQ ID NO: 408915 - DNA, 16 bp, M. musculus
gatcccagagacagct

SEQ ID NO: 408916 - DNA, 16 bp, M. musculus
gatcccagcagaggca

SEQ ID NO: 408917 - DNA, 16 bp, M. musculus
gatcccagcatccatg

SEQ ID NO: 408918 - DNA, 16 bp, M. musculus
gatcccattacagata

SEQ ID NO: 408919 - DNA, 23 bp, M. musculus
gatcccattacagatggttgtaa

SEQ ID NO: 408920 - DNA, 16 bp, M. musculus
gatcccattacaggtg

SEQ ID NO: 408921 - DNA, 16 bp, M. musculus
gatcccattagccaaa

SEQ ID NO: 408922 - DNA, 16 bp, M. musculus
gatccccaatggagaa

SEQ ID NO: 408923 - DNA, 16 bp, M. musculus
gatccccagaaccaca

SEQ ID NO: 408924 - DNA, 16 bp, M. musculus
gatccccagttggtgg

SEQ ID NO: 408925 - DNA, 16 bp, M. musculus
gatcccccggagctgg

SEQ ID NO: 408926 - DNA, 16 bp, M. musculus
gatccccctgcctcag

SEQ ID NO: 408927 - DNA, 16 bp, M. musculus
gatccccgggtgcggc

SEQ ID NO: 408928 - DNA, 16 bp, M. musculus
gatcccctcagctcct

SEQ ID NO: 408929 - DNA, 16 bp, M. musculus
gatcccctgaaattgg

SEQ ID NO: 408930 - DNA, 16 bp, M. musculus
gatcccctgcctctgc

SEQ ID NO: 408931 - DNA, 16 bp, M. musculus
gatcccctggtgctgg

SEQ ID NO: 408932 - DNA, 16 bp, M. musculus
gatccctctgcctctc

SEQ ID NO: 408933 - DNA, 16 bp, M. musculus
gatccctctggagctg

SEQ ID NO: 408934 - DNA, 16 bp, M. musculus
gatccctggaatccac

SEQ ID NO: 408935 - DNA, 16 bp, M. musculus
gatccctttatagatg

SEQ ID NO: 408936 - DNA, 16 bp, M. musculus
gatccgcctgcctctg

SEQ ID NO: 408937 - DNA, 16 bp, M. musculus
gatcctaagattctgg

SEQ ID NO: 408938 - DNA, 16 bp, M. musculus
gatcctacactagcaa

SEQ ID NO: 408939 - DNA, 16 bp, M. musculus
gatcctagatagtttt

SEQ ID NO: 408940 - DNA, 16 bp, M. musculus
gatcctcactggcaca

SEQ ID NO: 408941 - DNA, 16 bp, M. musculus
gatcctcaggtggggt

SEQ ID NO: 408942 - DNA, 16 bp, M. musculus
gatcctccagcctcca

SEQ ID NO: 408943 - DNA, 16 bp, M. musculus
gatcctcctgactctg

SEQ ID NO: 408944 - DNA, 16 bp, M. musculus
gatcctcctgcttcct

SEQ ID NO: 408945 - DNA, 16 bp, M. musculus
gatcctcctggctcca

SEQ ID NO: 408946 - DNA, 16 bp, M. musculus
gatcctcctgtctctg

SEQ ID NO: 408947 - DNA, 16 bp, M. musculus
gatcctcctgtttctg

SEQ ID NO: 408948 - DNA, 16 bp, M. musculus
gatcctctgcaaaagc

SEQ ID NO: 408949 - DNA, 16 bp, M. musculus
gatcctctgggactgg

SEQ ID NO: 408950 - DNA, 16 bp, M. musculus
gatcctgaaaacagaa

SEQ ID NO: 408951 - DNA, 16 bp, M. musculus
gatcctgaagaaatca

SEQ ID NO: 408952 - DNA, 16 bp, M. musculus
gatcctgagtttgagg

SEQ ID NO: 408953 - DNA, 16 bp, M. musculus
gatcctgctgcctcag

SEQ ID NO: 408954 - DNA, 16 bp, M. musculus
gatcctggacatatgt

SEQ ID NO: 408955 - DNA, 16 bp, M. musculus
gatcctggaggtggga

SEQ ID NO: 408956 - DNA, 16 bp, M. musculus
gatcctgggtgtgcta

SEQ ID NO: 408957 - DNA, 16 bp, M. musculus
gatcctgggttcaatc

SEQ ID NO: 408958 - DNA, 16 bp, M. musculus
gatcctgtgccacagt

SEQ ID NO: 408959 - DNA, 16 bp, M. musculus
gatcctgtttcaaaat

SEQ ID NO: 408960 - DNA, 16 bp, M. musculus
gatcctgtttcccttt

SEQ ID NO: 408961 - DNA, 16 bp, M. musculus
gatccttcctcagagg

SEQ ID NO: 408962 - DNA, 16 bp, M. musculus
gatccttctgcctcag

SEQ ID NO: 408963 - DNA, 16 bp, M. musculus
gatccttctgcctctg

SEQ ID NO: 408964 - DNA, 16 bp, M. musculus
gatccttctgcttctg

SEQ ID NO: 408965 - DNA, 16 bp, M. musculus
gatcctttcctgtgga

SEQ ID NO: 408966 - DNA, 16 bp, M. musculus
gatcggaagttcaagg

SEQ ID NO: 408967 - DNA, 16 bp, M. musculus
gatctaaacagtctta

SEQ ID NO: 408968 - DNA, 16 bp, M. musculus
gatctacagaatatgg

SEQ ID NO: 408969 - DNA, 16 bp, M. musculus
gatctacctgcctgcc

SEQ ID NO: 408970 - DNA, 16 bp, M. musculus
gatctagagaaagtac

SEQ ID NO: 408971 - DNA, 16 bp, M. musculus
gatctatctgcctgtc

SEQ ID NO: 408972 - DNA, 16 bp, M. musculus
gatctatgagtgtagc

SEQ ID NO: 408973 - DNA, 16 bp, M. musculus
gatctatttccaactt

SEQ ID NO: 408974 - DNA, 16 bp, M. musculus
gatctcactatgtagc

SEQ ID NO: 408975 - DNA, 16 bp, M. musculus
gatctcactgtgtatc

SEQ ID NO: 408976 - DNA, 16 bp, M. musculus
gatctcagagtttgag

SEQ ID NO: 408977 - DNA, 16 bp, M. musculus
gatctcagcactcagg

SEQ ID NO: 408978 - DNA, 16 bp, M. musculus
gatctccatgagttca

SEQ ID NO: 408979 - DNA, 16 bp, M. musculus
gatctccttaaggatg

SEQ ID NO: 408980 - DNA, 16 bp, M. musculus
gatctccttttcctca

SEQ ID NO: 408981 - DNA, 16 bp, M. musculus
gatctctaccaatcct

SEQ ID NO: 408982 - DNA, 16 bp, M. musculus
gatctctatgagttca

SEQ ID NO: 408983 - DNA, 16 bp, M. musculus
gatctctcagacactg

SEQ ID NO: 408984 - DNA, 16 bp, M. musculus
gatctctcctgaattt

SEQ ID NO: 408985 - DNA, 16 bp, M. musculus
gatctctctccctctc

SEQ ID NO: 408986 - DNA, 16 bp, M. musculus
gatctctctgagttca

SEQ ID NO: 408987 - DNA, 16 bp, M. musculus
gatctctctgtggttt

SEQ ID NO: 408988 - DNA, 16 bp, M. musculus
gatctctgaattcaag

SEQ ID NO: 408989 - DNA, 16 bp, M. musculus
gatctctgagtctgag

SEQ ID NO: 408990 - DNA, 16 bp, M. musculus
gatctctgagttcagg

SEQ ID NO: 408991 - DNA, 16 bp, M. musculus
gatctctggcccagcc

SEQ ID NO: 408992 - DNA, 16 bp, M. musculus
gatctctggctggaac

SEQ ID NO: 408993 - DNA, 16 bp, M. musculus
gatctctgggtttgag

SEQ ID NO: 408994 - DNA, 16 bp, M. musculus
gatctctgtgagcctg

SEQ ID NO: 408995 - DNA, 16 bp, M. musculus
gatctctgtgagtctg

SEQ ID NO: 408996 - DNA, 16 bp, M. musculus
gatctctgtgagttca

SEQ ID NO: 408997 - DNA, 16 bp, M. musculus
gatctctgtgagttcc

SEQ ID NO: 408998 - DNA, 16 bp, M. musculus
gatctctgtgagttta

SEQ ID NO: 408999 - DNA, 16 bp, M. musculus
gatctctgtgagtttg

SEQ ID NO: 409000 - DNA, 16 bp, M. musculus
gatctctgtgagtttt

SEQ ID NO: 409001 - DNA, 16 bp, M. musculus
gatctcttcaggttcc

SEQ ID NO: 409002 - DNA, 16 bp, M. musculus
gatctcttcctagaag

SEQ ID NO: 409003 - DNA, 16 bp, M. musculus
gatctcttgagttgga

SEQ ID NO: 409004 - DNA, 16 bp, M. musculus
gatctctttcctagat

SEQ ID NO: 409005 - DNA, 16 bp, M. musculus
gatctgaactcaggtc

SEQ ID NO: 409006 - DNA, 16 bp, M. musculus
gatctgaactctggtc

SEQ ID NO: 409007 - DNA, 16 bp, M. musculus
gatctgaagaaacaag

SEQ ID NO: 409008 - DNA, 16 bp, M. musculus
gatctgacaccctcat

SEQ ID NO: 409009 - DNA, 16 bp, M. musculus
gatctgatgccctctg

SEQ ID NO: 409010 - DNA, 16 bp, M. musculus
gatctgatgggtttag

SEQ ID NO: 409011 - DNA, 16 bp, M. musculus
gatctgcaggaagcag

SEQ ID NO: 409012 - DNA, 16 bp, M. musculus
gatctgcatctgcagc

SEQ ID NO: 409013 - DNA, 16 bp, M. musculus
gatctgcatgtacagt

SEQ ID NO: 409014 - DNA, 16 bp, M. musculus
gatctgcctctctctg

SEQ ID NO: 409015 - DNA, 16 bp, M. musculus
gatctgcctgcctttc

SEQ ID NO: 409016 - DNA, 16 bp, M. musculus
gatctgcctgcctttt

SEQ ID NO: 409017 - DNA, 16 bp, M. musculus
gatctgccttcctctg

SEQ ID NO: 409018 - DNA, 16 bp, M. musculus
gatctgcttgcctctt

SEQ ID NO: 409019 - DNA, 16 bp, M. musculus
gatctggaaaaggatt

SEQ ID NO: 409020 - DNA, 16 bp, M. musculus
gatctggaattacagg

SEQ ID NO: 409021 - DNA, 16 bp, M. musculus
gatctggacctgggtg

SEQ ID NO: 409022 - DNA, 16 bp, M. musculus
gatctggagttacagg

SEQ ID NO: 409023 - DNA, 16 bp, M. musculus
gatctggatgggaagg

SEQ ID NO: 409024 - DNA, 16 bp, M. musculus
gatctggatttaaaag

SEQ ID NO: 409025 - DNA, 16 bp, M. musculus
gatctggctgtctctg

SEQ ID NO: 409026 - DNA, 16 bp, M. musculus
gatctgggcctgagtg

SEQ ID NO: 409027 - DNA, 16 bp, M. musculus
gatctgggggagagag

SEQ ID NO: 409028 - DNA, 16 bp, M. musculus
gatctgtatgacaaaa

SEQ ID NO: 409029 - DNA, 16 bp, M. musculus
gatctgtctgtctcca

SEQ ID NO: 409030 - DNA, 16 bp, M. musculus
gatctgtctgtctttg

SEQ ID NO: 409031 - DNA, 16 bp, M. musculus
gatctgtggaagagca

SEQ ID NO: 409032 - DNA, 16 bp, M. musculus
gatcttacagcacaag

SEQ ID NO: 409033 - DNA, 16 bp, M. musculus
gatcttactctgtaga

SEQ ID NO: 409034 - DNA, 16 bp, M. musculus
gatcttagaaaatgga

SEQ ID NO: 409035 - DNA, 16 bp, M. musculus
gatcttataaattaca

SEQ ID NO: 409036 - DNA, 16 bp, M. musculus
gatcttatcaagatag

SEQ ID NO: 409037 - DNA, 16 bp, M. musculus
gatcttatggagacat

SEQ ID NO: 409038 - DNA, 16 bp, M. musculus
gatcttcaataacaag

SEQ ID NO: 409039 - DNA, 16 bp, M. musculus
gatcttcagagatcct

SEQ ID NO: 409040 - DNA, 16 bp, M. musculus
gatcttcccacctcaa

SEQ ID NO: 409041 - DNA, 16 bp, M. musculus
gatcttcctgccttgg

SEQ ID NO: 409042 - DNA, 16 bp, M. musculus
gatcttcctgcttcag

SEQ ID NO: 409043 - DNA, 16 bp, M. musculus
gatcttcctgtccctg

SEQ ID NO: 409044 - DNA, 16 bp, M. musculus
gatcttctgcaagagc

SEQ ID NO: 409045 - DNA, 16 bp, M. musculus
gatcttgaacattttt

SEQ ID NO: 409046 - DNA, 16 bp, M. musculus
gatcttgatgaaagag

SEQ ID NO: 409047 - DNA, 16 bp, M. musculus
gatcttgcagaggact

SEQ ID NO: 409048 - DNA, 16 bp, M. musculus
gatcttgctctgtagc

SEQ ID NO: 409049 - DNA, 16 bp, M. musculus
gatcttggggtacaga

SEQ ID NO: 409050 - DNA, 16 bp, M. musculus
gatcttgtctttaaaa

SEQ ID NO: 409051 - DNA, 16 bp, M. musculus
gatcttgttggaggag

SEQ ID NO: 409052 - DNA, 16 bp, M. musculus
gatctttcacttgctt

SEQ ID NO: 409053 - DNA, 16 bp, M. musculus
gatctttcatttcctt

SEQ ID NO: 409054 - DNA, 16 bp, M. musculus
gatctttccagaactt

SEQ ID NO: 409055 - DNA, 16 bp, M. musculus
gatctttctgtggctt

SEQ ID NO: 409056 - DNA, 16 bp, M. musculus
gatctttgcttgttgt

SEQ ID NO: 409057 - DNA, 16 bp, M. musculus
gatctttgtgagctca

SEQ ID NO: 409058 - DNA, 16 bp, M. musculus
gatcttttgcattttg

SEQ ID NO: 409059 - DNA, 16 bp, M. musculus
gatcttttggagggca

SEQ ID NO: 409060 - DNA, 16 bp, M. musculus
gatctttttgcacttt

SEQ ID NO: 409061 - DNA, 16 bp, M. musculus
gatgaaaagatggacc

SEQ ID NO: 409062 - DNA, 16 bp, M. musculus
gatgaaaatgaagatt

SEQ ID NO: 409063 - DNA, 16 bp, M. musculus
gatgaaacaaaaggca

SEQ ID NO: 409064 - DNA, 16 bp, M. musculus
gatgaaacccagggct

SEQ ID NO: 409065 - DNA, 16 bp, M. musculus
gatgaaaggatgttct

SEQ ID NO: 409066 - DNA, 16 bp, M. musculus
gatgaaataaactctt

SEQ ID NO: 409067 - DNA, 16 bp, M. musculus
gatgaaatgcctaaca

SEQ ID NO: 409068 - DNA, 16 bp, M. musculus
gatgaaattccctaca

SEQ ID NO: 409069 - DNA, 16 bp, M. musculus
gatgaacaacaatatc

SEQ ID NO: 409070 - DNA, 16 bp, M. musculus
gatgaacagcaaagtg

SEQ ID NO: 409071 - DNA, 23 bp, M. musculus
gatgaacagcagtgtggaagtgt

SEQ ID NO: 409072 - DNA, 16 bp, M. musculus
gatgaacatggtaact

SEQ ID NO: 409073 - DNA, 16 bp, M. musculus
gatgaagaaaccaaag

SEQ ID NO: 409074 - DNA, 16 bp, M. musculus
gatgaagaaactaagg

SEQ ID NO: 409075 - DNA, 16 bp, M. musculus
gatgaagaaactgaag

SEQ ID NO: 409076 - DNA, 16 bp, M. musculus
gatgaagaaattccca

SEQ ID NO: 409077 - DNA, 16 bp, M. musculus
gatgaagaagatgatg

SEQ ID NO: 409078 - DNA, 16 bp, M. musculus
gatgaagagatggttc

SEQ ID NO: 409079 - DNA, 16 bp, M. musculus
gatgaagatatttact

SEQ ID NO: 409080 - DNA, 16 bp, M. musculus
gatgaagatgaagaca

SEQ ID NO: 409081 - DNA, 16 bp, M. musculus
gatgaagatgaagatg

SEQ ID NO: 409082 - DNA, 16 bp, M. musculus
gatgaagatgaaggcc

SEQ ID NO: 409083 - DNA, 16 bp, M. musculus
gatgaagatgatgatg

SEQ ID NO: 409084 - DNA, 16 bp, M. musculus
gatgaagatgatggtg

SEQ ID NO: 409085 - DNA, 16 bp, M. musculus
gatgaagatgctcatc

SEQ ID NO: 409086 - DNA, 16 bp, M. musculus
gatgaagatgtagcac

SEQ ID NO: 409087 - DNA, 16 bp, M. musculus
gatgaagccaagacaa

SEQ ID NO: 409088 - DNA, 16 bp, M. musculus
gatgaagctgctcctg

SEQ ID NO: 409089 - DNA, 16 bp, M. musculus
gatgaagctgtagaac

SEQ ID NO: 409090 - DNA, 16 bp, M. musculus
gatgaaggacttagct

SEQ ID NO: 409091 - DNA, 16 bp, M. musculus
gatgaaggagctagag

SEQ ID NO: 409092 - DNA, 16 bp, M. musculus
gatgaaggattctttg

SEQ ID NO: 409093 - DNA, 16 bp, M. musculus
gatgaaggcaggaaga

SEQ ID NO: 409094 - DNA, 16 bp, M. musculus
gatgaaggccaggaag

SEQ ID NO: 409095 - DNA, 16 bp, M. musculus
gatgaaggcccaaagc

SEQ ID NO: 409096 - DNA, 16 bp, M. musculus
gatgaaggcctgaagg

SEQ ID NO: 409097 - DNA, 16 bp, M. musculus
gatgaagtctctctgg

SEQ ID NO: 409098 - DNA, 16 bp, M. musculus
gatgaataagaaatta

SEQ ID NO: 409099 - DNA, 16 bp, M. musculus
gatgaatatggatcta

SEQ ID NO: 409100 - DNA, 16 bp, M. musculus
gatgaatcagagaaaa

SEQ ID NO: 409101 - DNA, 16 bp, M. musculus
gatgaatcagagaaat

SEQ ID NO: 409102 - DNA, 17 bp, M. musculus
gatgaatctgccaattg

SEQ ID NO: 409103 - DNA, 16 bp, M. musculus
gatgaatgaagaaatg

SEQ ID NO: 409104 - DNA, 17 bp, M. musculus
gatgaatgaatgaatgg

SEQ ID NO: 409105 - DNA, 16 bp, M. musculus
gatgaattatcaccac

SEQ ID NO: 409106 - DNA, 16 bp, M. musculus
gatgaatttacagatt

SEQ ID NO: 409107 - DNA, 16 bp, M. musculus
gatgaatttgagaatt

SEQ ID NO: 409108 - DNA, 16 bp, M. musculus
gatgaatttgcttctt

SEQ ID NO: 409109 - DNA, 16 bp, M. musculus
gatgacaaaaggcaaa

SEQ ID NO: 409110 - DNA, 16 bp, M. musculus
gatgacaactcttcat

SEQ ID NO: 409111 - DNA, 16 bp, M. musculus
gatgacaatgaagatt

SEQ ID NO: 409112 - DNA, 16 bp, M. musculus
gatgacaatgacaatg

SEQ ID NO: 409113 - DNA, 17 bp, M. musculus
gatgacagactaggcca

SEQ ID NO: 409114 - DNA, 16 bp, M. musculus
gatgacagtggggtgt

SEQ ID NO: 409115 - DNA, 16 bp, M. musculus
gatgacatcaagaagg

SEQ ID NO: 409116 - DNA, 16 bp, M. musculus
gatgacatcacccaca

SEQ ID NO: 409117 - DNA, 16 bp, M. musculus
gatgaccaagtaggcc

SEQ ID NO: 409118 - DNA, 16 bp, M. musculus
gatgaccagcaaagaa

SEQ ID NO: 409119 - DNA, 16 bp, M. musculus
gatgaccccataggaa

SEQ ID NO: 409120 - DNA, 16 bp, M. musculus
gatgacctggatttga

SEQ ID NO: 409121 - DNA, 16 bp, M. musculus
gatgaccttgaactcg

SEQ ID NO: 409122 - DNA, 16 bp, M. musculus
gatgaccttgaacttt

SEQ ID NO: 409123 - DNA, 16 bp, M. musculus
gatgacctttctttca

SEQ ID NO: 409124 - DNA, 16 bp, M. musculus
gatgacgacgatgatg

SEQ ID NO: 409125 - DNA, 16 bp, M. musculus
gatgactgtcagcatc

SEQ ID NO: 409126 - DNA, 16 bp, M. musculus
gatgactgtgagcatc

SEQ ID NO: 409127 - DNA, 16 bp, M. musculus
gatgactttgaactcc

SEQ ID NO: 409128 - DNA, 16 bp, M. musculus
gatgacttttccttca

SEQ ID NO: 409129 - DNA, 16 bp, M. musculus
gatgagaaaacagagg

SEQ ID NO: 409130 - DNA, 16 bp, M. musculus
gatgagaaagaagatt

SEQ ID NO: 409131 - DNA, 16 bp, M. musculus
gatgagaagacctggg

SEQ ID NO: 409132 - DNA, 16 bp, M. musculus
gatgagaagagacagt

SEQ ID NO: 409133 - DNA, 16 bp, M. musculus
gatgagaaggaagatt

SEQ ID NO: 409134 - DNA, 16 bp, M. musculus
gatgagaatgaaaatt

SEQ ID NO: 409135 - DNA, 16 bp, M. musculus
gatgagaatgaagact

SEQ ID NO: 409136 - DNA, 16 bp, M. musculus
gatgagaatgaagatc

SEQ ID NO: 409137 - DNA, 23 bp, M. musculus
gatgagaatgaagattttcaact

SEQ ID NO: 409138 - DNA, 16 bp, M. musculus
gatgagacagaaggaa

SEQ ID NO: 409139 - DNA, 16 bp, M. musculus
gatgagagagactcaa

SEQ ID NO: 409140 - DNA, 37 bp, M. musculus
gatgagagagactcaacgatcattgatcagcccttgc

SEQ ID NO: 409141 - DNA, 16 bp, M. musculus
gatgagagaggggtgt

SEQ ID NO: 409142 - DNA, 16 bp, M. musculus
gatgagcagagactct

SEQ ID NO: 409143 - DNA, 16 bp, M. musculus
gatgagcatgaagtgc

SEQ ID NO: 409144 - DNA, 16 bp, M. musculus
gatgagccatctgtaa

SEQ ID NO: 409145 - DNA, 16 bp, M. musculus
gatgagcctggaagga

SEQ ID NO: 409146 - DNA, 16 bp, M. musculus
gatgaggaagagtcag

SEQ ID NO: 409147 - DNA, 16 bp, M. musculus
gatgaggagggtgacc

SEQ ID NO: 409148 - DNA, 16 bp, M. musculus
gatgaggatgaggaag

SEQ ID NO: 409149 - DNA, 16 bp, M. musculus
gatgaggcagatgagg

SEQ ID NO: 409150 - DNA, 16 bp, M. musculus
gatgaggcaggcagag

SEQ ID NO: 409151 - DNA, 16 bp, M. musculus
gatgaggccacaggtg

SEQ ID NO: 409152 - DNA, 16 bp, M. musculus
gatgaggctctgggag

SEQ ID NO: 409153 - DNA, 16 bp, M. musculus
gatgagtggatgggtg

SEQ ID NO: 409154 - DNA, 16 bp, M. musculus
gatgagtgggtggccc

SEQ ID NO: 409155 - DNA, 16 bp, M. musculus
gatgataaaggatgtt

SEQ ID NO: 409156 - DNA, 16 bp, M. musculus
gatgatacatacatac

SEQ ID NO: 409157 - DNA, 16 bp, M. musculus
gatgatactaaaattt

SEQ ID NO: 409158 - DNA, 16 bp, M. musculus
gatgatcaggagttca

SEQ ID NO: 409159 - DNA, 16 bp, M. musculus
gatgatcattttgttg

SEQ ID NO: 409160 - DNA, 16 bp, M. musculus
gatgatgaagaagaag

SEQ ID NO: 409161 - DNA, 16 bp, M. musculus
gatgatgaagatgatg

SEQ ID NO: 409162 - DNA, 20 bp, M. musculus
gatgatgaagctgacctaga

SEQ ID NO: 409163 - DNA, 16 bp, M. musculus
gatgatgacaacgatg

SEQ ID NO: 409164 - DNA, 16 bp, M. musculus
gatgatgacagtgatg

SEQ ID NO: 409165 - DNA, 16 bp, M. musculus
gatgatgacgacgaca

SEQ ID NO: 409166 - DNA, 16 bp, M. musculus
gatgatgacgatgacg

SEQ ID NO: 409167 - DNA, 16 bp, M. musculus
gatgatgacgatgata

SEQ ID NO: 409168 - DNA, 16 bp, M. musculus
gatgatgacgatgatg

SEQ ID NO: 409169 - DNA, 16 bp, M. musculus
gatgatgagatgatga

SEQ ID NO: 409170 - DNA, 16 bp, M. musculus
gatgatgatagtaata

SEQ ID NO: 409171 - DNA, 18 bp, M. musculus
gatgatgatgataataat

SEQ ID NO: 409172 - DNA, 16 bp, M. musculus
gatgatgatgatcatg

SEQ ID NO: 409173 - DNA, 16 bp, M. musculus
gatgatgatgatgaaa

SEQ ID NO: 409174 - DNA, 16 bp, M. musculus
gatgatgatgatgaat

SEQ ID NO: 409175 - DNA, 16 bp, M. musculus
gatgatgatgatgagt

SEQ ID NO: 409176 - DNA, 16 bp, M. musculus
gatgatgatgatgcag

SEQ ID NO: 409177 - DNA, 16 bp, M. musculus
gatgatgatgatgtat

SEQ ID NO: 409178 - DNA, 16 bp, M. musculus
gatgatgatggaggac

SEQ ID NO: 409179 - DNA, 16 bp, M. musculus
gatgatgatggtagtg

SEQ ID NO: 409180 - DNA, 16 bp, M. musculus
gatgatgatgtgatga

SEQ ID NO: 409181 - DNA, 16 bp, M. musculus
gatgatgatgttgatg

SEQ ID NO: 409182 - DNA, 16 bp, M. musculus
gatgatgccctacagg

SEQ ID NO: 409183 - DNA, 16 bp, M. musculus
gatgatgctccaacat

SEQ ID NO: 409184 - DNA, 16 bp, M. musculus
gatgatgctgatgatg

SEQ ID NO: 409185 - DNA, 16 bp, M. musculus
gatgatggaaacagaa

SEQ ID NO: 409186 - DNA, 16 bp, M. musculus
gatgatggcaaggatg

SEQ ID NO: 409187 - DNA, 16 bp, M. musculus
gatgatggcttccagt

SEQ ID NO: 409188 - DNA, 17 bp, M. musculus
gatgatggggaatgtgg

SEQ ID NO: 409189 - DNA, 16 bp, M. musculus
gatgatggtagaagat

SEQ ID NO: 409190 - DNA, 16 bp, M. musculus
gatgatggtgatgaca

SEQ ID NO: 409191 - DNA, 16 bp, M. musculus
gatgatggtgatggtg

SEQ ID NO: 409192 - DNA, 16 bp, M. musculus
gatgatgttgatgatg

SEQ ID NO: 409193 - DNA, 16 bp, M. musculus
gatgattaagaatgtt

SEQ ID NO: 409194 - DNA, 16 bp, M. musculus
gatgattaatttcttg

SEQ ID NO: 409195 - DNA, 16 bp, M. musculus
gatgattgatatggga

SEQ ID NO: 409196 - DNA, 16 bp, M. musculus
gatgattgtgagccac

SEQ ID NO: 409197 - DNA, 16 bp, M. musculus
gatgatttggcgggaa

SEQ ID NO: 409198 - DNA, 16 bp, M. musculus
gatgattttctaaaca

SEQ ID NO: 409199 - DNA, 16 bp, M. musculus
gatgatttttgtgctt

SEQ ID NO: 409200 - DNA, 16 bp, M. musculus
gatgcaacatgaccag

SEQ ID NO: 409201 - DNA, 16 bp, M. musculus
gatgcaaggaaggaga

SEQ ID NO: 409202 - DNA, 16 bp, M. musculus
gatgcacacttttaat

SEQ ID NO: 409203 - DNA, 16 bp, M. musculus
gatgcaccagaagaag

SEQ ID NO: 409204 - DNA, 16 bp, M. musculus
gatgcactccaggtcc

SEQ ID NO: 409205 - DNA, 16 bp, M. musculus
gatgcagacaatgcca

SEQ ID NO: 409206 - DNA, 16 bp, M. musculus
gatgcagacacctaca

SEQ ID NO: 409207 - DNA, 16 bp, M. musculus
gatgcagacatccaca

SEQ ID NO: 409208 - DNA, 16 bp, M. musculus
gatgcagagacaggca

SEQ ID NO: 409209 - DNA, 16 bp, M. musculus
gatgcagagaccaaca

SEQ ID NO: 409210 - DNA, 16 bp, M. musculus
gatgcagagagagaca

SEQ ID NO: 409211 - DNA, 16 bp, M. musculus
gatgcagagatccaca

SEQ ID NO: 409212 - DNA, 16 bp, M. musculus
gatgcagaggctatgg

SEQ ID NO: 409213 - DNA, 16 bp, M. musculus
gatgcagatatttgta

SEQ ID NO: 409214 - DNA, 16 bp, M. musculus
gatgcagctcagctgg

SEQ ID NO: 409215 - DNA, 16 bp, M. musculus
gatgcagctgcttttg

SEQ ID NO: 409216 - DNA, 17 bp, M. musculus
gatgcaggcaagctaac

SEQ ID NO: 409217 - DNA, 16 bp, M. musculus
gatgcaggcaaggatg

SEQ ID NO: 409218 - DNA, 16 bp, M. musculus
gatgcagtccacagaa

SEQ ID NO: 409219 - DNA, 16 bp, M. musculus
gatgcagtgtgaccag

SEQ ID NO: 409220 - DNA, 16 bp, M. musculus
gatgcatccatttgcc

SEQ ID NO: 409221 - DNA, 16 bp, M. musculus
gatgcatggatggatg

SEQ ID NO: 409222 - DNA, 16 bp, M. musculus
gatgccaacaaaagct

SEQ ID NO: 409223 - DNA, 16 bp, M. musculus
gatgccaagaagagct

SEQ ID NO: 409224 - DNA, 16 bp, M. musculus
gatgccaagaagtcct

SEQ ID NO: 409225 - DNA, 16 bp, M. musculus
gatgccacaacatacc

SEQ ID NO: 409226 - DNA, 16 bp, M. musculus
gatgccacagttccag

SEQ ID NO: 409227 - DNA, 16 bp, M. musculus
gatgccagaaaaggca

SEQ ID NO: 409228 - DNA, 16 bp, M. musculus
gatgccagaaaaggcc

SEQ ID NO: 409229 - DNA, 16 bp, M. musculus
gatgccagaagagagc

SEQ ID NO: 409230 - DNA, 16 bp, M. musculus
gatgccagacaatgcc

SEQ ID NO: 409231 - DNA, 16 bp, M. musculus
gatgccagagaaggcc

SEQ ID NO: 409232 - DNA, 16 bp, M. musculus
gatgccagataaggta

SEQ ID NO: 409233 - DNA, 16 bp, M. musculus
gatgccagcctggttt

SEQ ID NO: 409234 - DNA, 16 bp, M. musculus
gatgccagggccagga

SEQ ID NO: 409235 - DNA, 16 bp, M. musculus
gatgcccaacaagacc

SEQ ID NO: 409236 - DNA, 16 bp, M. musculus
gatgcccactctctcc

SEQ ID NO: 409237 - DNA, 16 bp, M. musculus
gatgcccaggtgaggg

SEQ ID NO: 409238 - DNA, 16 bp, M. musculus
gatgcccataaacata

SEQ ID NO: 409239 - DNA, 16 bp, M. musculus
gatgcccatcaacaga

SEQ ID NO: 409240 - DNA, 16 bp, M. musculus
gatgccccaccatgac

SEQ ID NO: 409241 - DNA, 16 bp, M. musculus
gatgccctcttctggg

SEQ ID NO: 409242 - DNA, 16 bp, M. musculus
gatgccctggagctga

SEQ ID NO: 409243 - DNA, 16 bp, M. musculus
gatgccctggagctgg

SEQ ID NO: 409244 - DNA, 16 bp, M. musculus
gatgcccttgcatttg

SEQ ID NO: 409245 - DNA, 16 bp, M. musculus
gatgcccttggaggcc

SEQ ID NO: 409246 - DNA, 16 bp, M. musculus
gatgcctcccaggact

SEQ ID NO: 409247 - DNA, 16 bp, M. musculus
gatgcctctcaacaga

SEQ ID NO: 409248 - DNA, 16 bp, M. musculus
gatgcctctggctgta

SEQ ID NO: 409249 - DNA, 16 bp, M. musculus
gatgccttctactttg

SEQ ID NO: 409250 - DNA, 16 bp, M. musculus
gatgcgggtgggcaaa

SEQ ID NO: 409251 - DNA, 16 bp, M. musculus
gatgcgtctgaagaca

SEQ ID NO: 409252 - DNA, 16 bp, M. musculus
gatgctagagtggtga

SEQ ID NO: 409253 - DNA, 16 bp, M. musculus
gatgctagtctcttct

SEQ ID NO: 409254 - DNA, 16 bp, M. musculus
gatgctatacagacac

SEQ ID NO: 409255 - DNA, 16 bp, M. musculus
gatgctatgatgtact

SEQ ID NO: 409256 - DNA, 16 bp, M. musculus
gatgctcacagccatt

SEQ ID NO: 409257 - DNA, 16 bp, M. musculus
gatgctcacagtcatc

SEQ ID NO: 409258 - DNA, 16 bp, M. musculus
gatgctcacattcagc

SEQ ID NO: 409259 - DNA, 16 bp, M. musculus
gatgctcacattcatc

SEQ ID NO: 409260 - DNA, 16 bp, M. musculus
gatgctcactttgaca

SEQ ID NO: 409261 - DNA, 16 bp, M. musculus
gatgctccagagaagg

SEQ ID NO: 409262 - DNA, 16 bp, M. musculus
gatgctctcagtcagc

SEQ ID NO: 409263 - DNA, 16 bp, M. musculus
gatgctctcctctggc

SEQ ID NO: 409264 - DNA, 16 bp, M. musculus
gatgctctcttctgga

SEQ ID NO: 409265 - DNA, 16 bp, M. musculus
gatgctctcttctggc

SEQ ID NO: 409266 - DNA, 16 bp, M. musculus
gatgctctttcagagg

SEQ ID NO: 409267 - DNA, 16 bp, M. musculus
gatgctgacaaagcat

SEQ ID NO: 409268 - DNA, 16 bp, M. musculus
gatgctgagaactgaa

SEQ ID NO: 409269 - DNA, 16 bp, M. musculus
gatgctgaggaagcat

SEQ ID NO: 409270 - DNA, 16 bp, M. musculus
gatgctgaggatgctg

SEQ ID NO: 409271 - DNA, 16 bp, M. musculus
gatgctgaggcagaag

SEQ ID NO: 409272 - DNA, 16 bp, M. musculus
gatgctgatgcttgca

SEQ ID NO: 409273 - DNA, 16 bp, M. musculus
gatgctgccattttcc

SEQ ID NO: 409274 - DNA, 16 bp, M. musculus
gatgctgccctgctcc

SEQ ID NO: 409275 - DNA, 16 bp, M. musculus
gatgctgctgctgctg

SEQ ID NO: 409276 - DNA, 16 bp, M. musculus
gatgctggagatgcca

SEQ ID NO: 409277 - DNA, 16 bp, M. musculus
gatgctggaggagcca

SEQ ID NO: 409278 - DNA, 16 bp, M. musculus
gatgctggaggctgag

SEQ ID NO: 409279 - DNA, 16 bp, M. musculus
gatgctggccaggatg

SEQ ID NO: 409280 - DNA, 16 bp, M. musculus
gatgctggcgatgatg

SEQ ID NO: 409281 - DNA, 16 bp, M. musculus
gatgctgggaactgac

SEQ ID NO: 409282 - DNA, 16 bp, M. musculus
gatgctgggattacag

SEQ ID NO: 409283 - DNA, 16 bp, M. musculus
gatgctggggagatgg

SEQ ID NO: 409284 - DNA, 16 bp, M. musculus
gatgctggggaggatg

SEQ ID NO: 409285 - DNA, 16 bp, M. musculus
gatgctggggatgctg

SEQ ID NO: 409286 - DNA, 16 bp, M. musculus
gatgctggtcttttct

SEQ ID NO: 409287 - DNA, 16 bp, M. musculus
gatgctggtgtggatg

SEQ ID NO: 409288 - DNA, 16 bp, M. musculus
gatgctgtcatgctct

SEQ ID NO: 409289 - DNA, 16 bp, M. musculus
gatgctgtgctctgtg

SEQ ID NO: 409290 - DNA, 16 bp, M. musculus
gatgctgtttccttgg

SEQ ID NO: 409291 - DNA, 16 bp, M. musculus
gatgcttgcagccaac

SEQ ID NO: 409292 - DNA, 16 bp, M. musculus
gatgcttgttgggcct

SEQ ID NO: 409293 - DNA, 16 bp, M. musculus
gatgcttttccttaca

SEQ ID NO: 409294 - DNA, 16 bp, M. musculus
gatgctttttaaaaaa

SEQ ID NO: 409295 - DNA, 16 bp, M. musculus
gatggaaaagaacaaa

SEQ ID NO: 409296 - DNA, 16 bp, M. musculus
gatggaaagagacaga

SEQ ID NO: 409297 - DNA, 16 bp, M. musculus
gatggaaccccaggtg

SEQ ID NO: 409298 - DNA, 16 bp, M. musculus
gatggaacgcagggcc

SEQ ID NO: 409299 - DNA, 16 bp, M. musculus
gatggaagagagactc

SEQ ID NO: 409300 - DNA, 16 bp, M. musculus
gatggaagtagttaca

SEQ ID NO: 409301 - DNA, 16 bp, M. musculus
gatggaataggctttc

SEQ ID NO: 409302 - DNA, 16 bp, M. musculus
gatggaattttcaaaa

SEQ ID NO: 409303 - DNA, 16 bp, M. musculus
gatggacagatggaca

SEQ ID NO: 409304 - DNA, 16 bp, M. musculus
gatggaccatgcagag

SEQ ID NO: 409305 - DNA, 16 bp, M. musculus
gatggacctgcagggc

SEQ ID NO: 409306 - DNA, 16 bp, M. musculus
gatggacctggagagc

SEQ ID NO: 409307 - DNA, 16 bp, M. musculus
gatggactatgatctg

SEQ ID NO: 409308 - DNA, 16 bp, M. musculus
gatggactccagaaaa

SEQ ID NO: 409309 - DNA, 16 bp, M. musculus
gatggactgggagggg

SEQ ID NO: 409310 - DNA, 16 bp, M. musculus
gatggactgtatcccc

SEQ ID NO: 409311 - DNA, 16 bp, M. musculus
gatggagaaaccagag

SEQ ID NO: 409312 - DNA, 16 bp, M. musculus
gatggagaagctagag

SEQ ID NO: 409313 - DNA, 16 bp, M. musculus
gatggagacaccctca

SEQ ID NO: 409314 - DNA, 16 bp, M. musculus
gatggagacagaggag

SEQ ID NO: 409315 - DNA, 16 bp, M. musculus
gatggagagatggaga

SEQ ID NO: 409316 - DNA, 16 bp, M. musculus
gatggagatggagata

SEQ ID NO: 409317 - DNA, 16 bp, M. musculus
gatggagcaggagcag

SEQ ID NO: 409318 - DNA, 16 bp, M. musculus
gatggagctcagagag

SEQ ID NO: 409319 - DNA, 16 bp, M. musculus
gatggagctgagagtt

SEQ ID NO: 409320 - DNA, 16 bp, M. musculus
gatggagctgctgctg

SEQ ID NO: 409321 - DNA, 16 bp, M. musculus
gatggaggagctgaga

SEQ ID NO: 409322 - DNA, 16 bp, M. musculus
gatggaggcaggctgg

SEQ ID NO: 409323 - DNA, 16 bp, M. musculus
gatggagggacagagg

SEQ ID NO: 409324 - DNA, 29 bp, M. musculus
gatggaggttatgcttgggctcagcaaca

SEQ ID NO: 409325 - DNA, 16 bp, M. musculus
gatggatagacagaca

SEQ ID NO: 409326 - DNA, 16 bp, M. musculus
gatggatagatggatg

SEQ ID NO: 409327 - DNA, 16 bp, M. musculus
gatggatagatgggtg

SEQ ID NO: 409328 - DNA, 16 bp, M. musculus
gatggatcactgggta

SEQ ID NO: 409329 - DNA, 16 bp, M. musculus
gatggatgaacagatg

SEQ ID NO: 409330 - DNA, 16 bp, M. musculus
gatggatgacagacag

SEQ ID NO: 409331 - DNA, 16 bp, M. musculus
gatggatggacagatg

SEQ ID NO: 409332 - DNA, 16 bp, M. musculus
gatggatggactgatg

SEQ ID NO: 409333 - DNA, 16 bp, M. musculus
gatggatggagagatg

SEQ ID NO: 409334 - DNA, 16 bp, M. musculus
gatggatggatgatgg

SEQ ID NO: 409335 - DNA, 16 bp, M. musculus
gatggatggatggatg

SEQ ID NO: 409336 - DNA, 16 bp, M. musculus
gatggatggatgggtg

SEQ ID NO: 409337 - DNA, 16 bp, M. musculus
gatggatggtcatttt

SEQ ID NO: 409338 - DNA, 16 bp, M. musculus
gatggatgttctttac

SEQ ID NO: 409339 - DNA, 16 bp, M. musculus
gatggcaagaaataat

SEQ ID NO: 409340 - DNA, 16 bp, M. musculus
gatggcacaacccaca

SEQ ID NO: 409341 - DNA, 16 bp, M. musculus
gatggcacagtggtta

SEQ ID NO: 409342 - DNA, 16 bp, M. musculus
gatggcaccacccaca

SEQ ID NO: 409343 - DNA, 16 bp, M. musculus
gatggcaccactcaca

SEQ ID NO: 409344 - DNA, 16 bp, M. musculus
gatggcaccatccaca

SEQ ID NO: 409345 - DNA, 16 bp, M. musculus
gatggcagagcagagg

SEQ ID NO: 409346 - DNA, 16 bp, M. musculus
gatggcagaggacatc

SEQ ID NO: 409347 - DNA, 16 bp, M. musculus
gatggcagtggtggtg

SEQ ID NO: 409348 - DNA, 16 bp, M. musculus
gatggcattggaaatg

SEQ ID NO: 409349 - DNA, 16 bp, M. musculus
gatggccacagaatga

SEQ ID NO: 409350 - DNA, 42 bp, M. musculus
gatggccccaaagtatggggactaagactgtaccgatccaca

SEQ ID NO: 409351 - DNA, 16 bp, M. musculus
gatggccgactagacc

SEQ ID NO: 409352 - DNA, 16 bp, M. musculus
gatggcctggaactca

SEQ ID NO: 409353 - DNA, 16 bp, M. musculus
gatggcctggaactta

SEQ ID NO: 409354 - DNA, 16 bp, M. musculus
gatggcctggaattca

SEQ ID NO: 409355 - DNA, 16 bp, M. musculus
gatggcctggtcagtc

SEQ ID NO: 409356 - DNA, 16 bp, M. musculus
gatggcctgtgttctg

SEQ ID NO: 409357 - DNA, 16 bp, M. musculus
gatggcgatgatgatg

SEQ ID NO: 409358 - DNA, 16 bp, M. musculus
gatggcgcatgccttt

SEQ ID NO: 409359 - DNA, 16 bp, M. musculus
gatggctcaatagtta

SEQ ID NO: 409360 - DNA, 16 bp, M. musculus
gatggctcaatggtaa

SEQ ID NO: 409361 - DNA, 16 bp, M. musculus
gatggctcacaactat

SEQ ID NO: 409362 - DNA, 16 bp, M. musculus
gatggctcacagccac

SEQ ID NO: 409363 - DNA, 16 bp, M. musculus
gatggctcagagcact

SEQ ID NO: 409364 - DNA, 16 bp, M. musculus
gatggctcagagggga

SEQ ID NO: 409365 - DNA, 26 bp, M. musculus
gatggctcagcagttaagagcactgg

SEQ ID NO: 409366 - DNA, 16 bp, M. musculus
gatggctcagtaggaa

SEQ ID NO: 409367 - DNA, 16 bp, M. musculus
gatggctcagtgagga

SEQ ID NO: 409368 - DNA, 16 bp, M. musculus
gatggctcctgcagat

SEQ ID NO: 409369 - DNA, 16 bp, M. musculus
gatggctctctcacct

SEQ ID NO: 409370 - DNA, 16 bp, M. musculus
gatggctctgtgctgc

SEQ ID NO: 409371 - DNA, 16 bp, M. musculus
gatggctgtgaaccat

SEQ ID NO: 409372 - DNA, 16 bp, M. musculus
gatggctttgaacttc

SEQ ID NO: 409373 - DNA, 16 bp, M. musculus
gatggcttttctttca

SEQ ID NO: 409374 - DNA, 16 bp, M. musculus
gatggcttttgctccc

SEQ ID NO: 409375 - DNA, 16 bp, M. musculus
gatgggaaaccaggaa

SEQ ID NO: 409376 - DNA, 16 bp, M. musculus
gatgggaaatcaggaa

SEQ ID NO: 409377 - DNA, 16 bp, M. musculus
gatgggaaccccacag

SEQ ID NO: 409378 - DNA, 16 bp, M. musculus
gatgggaagcagagac

SEQ ID NO: 409379 - DNA, 16 bp, M. musculus
gatgggactggagaga

SEQ ID NO: 409380 - DNA, 34 bp, M. musculus
gatgggacttggaggggtactctgacattcagag

SEQ ID NO: 409381 - DNA, 16 bp, M. musculus
gatgggagaaatctca

SEQ ID NO: 409382 - DNA, 16 bp, M. musculus
gatgggagatcctttc

SEQ ID NO: 409383 - DNA, 16 bp, M. musculus
gatgggatgagagaga

SEQ ID NO: 409384 - DNA, 16 bp, M. musculus
gatgggcagaagcaca

SEQ ID NO: 409385 - DNA, 16 bp, M. musculus
gatgggcctctgggca

SEQ ID NO: 409386 - DNA, 16 bp, M. musculus
gatgggcctgctgctg

SEQ ID NO: 409387 - DNA, 16 bp, M. musculus
gatggggccacccact

SEQ ID NO: 409388 - DNA, 16 bp, M. musculus
gatggggctgccatcc

SEQ ID NO: 409389 - DNA, 16 bp, M. musculus
gatggggctggagaaa

SEQ ID NO: 409390 - DNA, 16 bp, M. musculus
gatggggctggggaga

SEQ ID NO: 409391 - DNA, 16 bp, M. musculus
gatgggggctggagag

SEQ ID NO: 409392 - DNA, 16 bp, M. musculus
gatgggggtttccaga

SEQ ID NO: 409393 - DNA, 16 bp, M. musculus
gatggggtagatgttg

SEQ ID NO: 409394 - DNA, 16 bp, M. musculus
gatgggtctggaggat

SEQ ID NO: 409395 - DNA, 16 bp, M. musculus
gatgggtctgtgggct

SEQ ID NO: 409396 - DNA, 16 bp, M. musculus
gatgggtggatggatg

SEQ ID NO: 409397 - DNA, 16 bp, M. musculus
gatggtaatagactga

SEQ ID NO: 409398 - DNA, 16 bp, M. musculus
gatggtaccacccaca

SEQ ID NO: 409399 - DNA, 16 bp, M. musculus
gatggtcatgagccac

SEQ ID NO: 409400 - DNA, 17 bp, M. musculus
gatggtccatccttttg

SEQ ID NO: 409401 - DNA, 18 bp, M. musculus
gatggtcccacccacaag

SEQ ID NO: 409402 - DNA, 16 bp, M. musculus
gatggtccgtcctttc

SEQ ID NO: 409403 - DNA, 21 bp, M. musculus
gatggtccttcgtgatttttt

SEQ ID NO: 409404 - DNA, 16 bp, M. musculus
gatggtctcacccaca

SEQ ID NO: 409405 - DNA, 16 bp, M. musculus
gatggtcttgaactcc

SEQ ID NO: 409406 - DNA, 16 bp, M. musculus
gatggtgatgatgacg

SEQ ID NO: 409407 - DNA, 16 bp, M. musculus
gatggtgatgatggtg

SEQ ID NO: 409408 - DNA, 16 bp, M. musculus
gatggtgatgctgatg

SEQ ID NO: 409409 - DNA, 16 bp, M. musculus
gatggtgatggtgatg

SEQ ID NO: 409410 - DNA, 16 bp, M. musculus
gatggtgccacctcag

SEQ ID NO: 409411 - DNA, 16 bp, M. musculus
gatggtgccgcccaca

SEQ ID NO: 409412 - DNA, 16 bp, M. musculus
gatggtgctgtccaca

SEQ ID NO: 409413 - DNA, 16 bp, M. musculus
gatggtggtggcagtg

SEQ ID NO: 409414 - DNA, 16 bp, M. musculus
gatggtggtggtgcac

SEQ ID NO: 409415 - DNA, 16 bp, M. musculus
gatggtgtctgtgttt

SEQ ID NO: 409416 - DNA, 16 bp, M. musculus
gatggtgtggaagatg

SEQ ID NO: 409417 - DNA, 16 bp, M. musculus
gatggtgttctcacct

SEQ ID NO: 409418 - DNA, 17 bp, M. musculus
gatggtgttttgcattt

SEQ ID NO: 409419 - DNA, 16 bp, M. musculus
gatggttatgagccac

SEQ ID NO: 409420 - DNA, 16 bp, M. musculus
gatggttcaaaatatg

SEQ ID NO: 409421 - DNA, 16 bp, M. musculus
gatggttcacaagaag

SEQ ID NO: 409422 - DNA, 16 bp, M. musculus
gatggttcagaggata

SEQ ID NO: 409423 - DNA, 16 bp, M. musculus
gatggttctgagccac

SEQ ID NO: 409424 - DNA, 16 bp, M. musculus
gatggttctttgaaaa

SEQ ID NO: 409425 - DNA, 16 bp, M. musculus
gatggttgtaaaccac

SEQ ID NO: 409426 - DNA, 16 bp, M. musculus
gatggttgtaagctac

SEQ ID NO: 409427 - DNA, 16 bp, M. musculus
gatggttgtaagctgc

SEQ ID NO: 409428 - DNA, 16 bp, M. musculus
gatggttgtgaaccac

SEQ ID NO: 409429 - DNA, 16 bp, M. musculus
gatggttgtgaatcac

SEQ ID NO: 409430 - DNA, 16 bp, M. musculus
gatggttgtgacccac

SEQ ID NO: 409431 - DNA, 16 bp, M. musculus
gatggttgtgagccat

SEQ ID NO: 409432 - DNA, 16 bp, M. musculus
gatggttgtgagccgc

SEQ ID NO: 409433 - DNA, 16 bp, M. musculus
gatggttgttagctgc

SEQ ID NO: 409434 - DNA, 16 bp, M. musculus
gatggttttgaaccac

SEQ ID NO: 409435 - DNA, 46 bp, M. musculus
gatggttttgtgtagggcccctatgcttgcacactggggatcagac

SEQ ID NO: 409436 - DNA, 16 bp, M. musculus
gatggttttgttcact

SEQ ID NO: 409437 - DNA, 16 bp, M. musculus
gatgtaaagtaaatga

SEQ ID NO: 409438 - DNA, 16 bp, M. musculus
gatgtaaagtggataa

SEQ ID NO: 409439 - DNA, 16 bp, M. musculus
gatgtaattgaacaaa

SEQ ID NO: 409440 - DNA, 16 bp, M. musculus
gatgtaatttttaaaa

SEQ ID NO: 409441 - DNA, 16 bp, M. musculus
gatgtacttcctccag

SEQ ID NO: 409442 - DNA, 16 bp, M. musculus
gatgtagaaccctcag

SEQ ID NO: 409443 - DNA, 16 bp, M. musculus
gatgtagaactcttag

SEQ ID NO: 409444 - DNA, 16 bp, M. musculus
gatgtagagctctcag

SEQ ID NO: 409445 - DNA, 16 bp, M. musculus
gatgtagaggtcatgg

SEQ ID NO: 409446 - DNA, 16 bp, M. musculus
gatgtagctgctagag

SEQ ID NO: 409447 - DNA, 16 bp, M. musculus
gatgtatctggagaat

SEQ ID NO: 409448 - DNA, 16 bp, M. musculus
gatgtatgctttaaaa

SEQ ID NO: 409449 - DNA, 16 bp, M. musculus
gatgtatgtatgcatg

SEQ ID NO: 409450 - DNA, 16 bp, M. musculus
gatgtatgtgagtaca

SEQ ID NO: 409451 - DNA, 16 bp, M. musculus
gatgtattcgcctagc

SEQ ID NO: 409452 - DNA, 16 bp, M. musculus
gatgtcaaaaaagaaa

SEQ ID NO: 409453 - DNA, 16 bp, M. musculus
gatgtcaaagcactct

SEQ ID NO: 409454 - DNA, 16 bp, M. musculus
gatgtcactagcaact

SEQ ID NO: 409455 - DNA, 16 bp, M. musculus
gatgtcactgttagca

SEQ ID NO: 409456 - DNA, 16 bp, M. musculus
gatgtcagatgccctg

SEQ ID NO: 409457 - DNA, 18 bp, M. musculus
gatgtcagcgccatcttg

SEQ ID NO: 409458 - DNA, 16 bp, M. musculus
gatgtcagctgagaca

SEQ ID NO: 409459 - DNA, 16 bp, M. musculus
gatgtcagggaaaaga

SEQ ID NO: 409460 - DNA, 16 bp, M. musculus
gatgtccatgttctct

SEQ ID NO: 409461 - DNA, 16 bp, M. musculus
gatgtccccaccccct

SEQ ID NO: 409462 - DNA, 16 bp, M. musculus
gatgtccccacctccc

SEQ ID NO: 409463 - DNA, 16 bp, M. musculus
gatgtcccggctggca

SEQ ID NO: 409464 - DNA, 16 bp, M. musculus
gatgtccctcagctga

SEQ ID NO: 409465 - DNA, 16 bp, M. musculus
gatgtcctcctctggc

SEQ ID NO: 409466 - DNA, 16 bp, M. musculus
gatgtctatgagttca

SEQ ID NO: 409467 - DNA, 16 bp, M. musculus
gatgtctcctgtaggg

SEQ ID NO: 409468 - DNA, 16 bp, M. musculus
gatgtctcttcacaga

SEQ ID NO: 409469 - DNA, 16 bp, M. musculus
gatgtcttgggatctt

SEQ ID NO: 409470 - DNA, 16 bp, M. musculus
gatgtgaacatcagca

SEQ ID NO: 409471 - DNA, 16 bp, M. musculus
gatgtgaagaaagagg

SEQ ID NO: 409472 - DNA, 17 bp, M. musculus
gatgtgaagatatttgt

SEQ ID NO: 409473 - DNA, 22 bp, M. musculus
gatgtgagacatgcaaatgagg

SEQ ID NO: 409474 - DNA, 16 bp, M. musculus
gatgtgaggagatgga

SEQ ID NO: 409475 - DNA, 16 bp, M. musculus
gatgtgagttcagttc

SEQ ID NO: 409476 - DNA, 16 bp, M. musculus
gatgtgatttctgttc

SEQ ID NO: 409477 - DNA, 16 bp, M. musculus
gatgtgcagggacaaa

SEQ ID NO: 409478 - DNA, 16 bp, M. musculus
gatgtgcctgcctttg

SEQ ID NO: 409479 - DNA, 16 bp, M. musculus
gatgtgcctgtctctg

SEQ ID NO: 409480 - DNA, 16 bp, M. musculus
gatgtgcttacagata

SEQ ID NO: 409481 - DNA, 16 bp, M. musculus
gatgtgcttttggtga

SEQ ID NO: 409482 - DNA, 16 bp, M. musculus
gatgtggaacaaggga

SEQ ID NO: 409483 - DNA, 16 bp, M. musculus
gatgtggaactctcag

SEQ ID NO: 409484 - DNA, 16 bp, M. musculus
gatgtggaatccgacc

SEQ ID NO: 409485 - DNA, 16 bp, M. musculus
gatgtggagaaagagg

SEQ ID NO: 409486 - DNA, 16 bp, M. musculus
gatgtggagaaagcat

SEQ ID NO: 409487 - DNA, 16 bp, M. musculus
gatgtggagagccgtg

SEQ ID NO: 409488 - DNA, 16 bp, M. musculus
gatgtggagcagacag

SEQ ID NO: 409489 - DNA, 16 bp, M. musculus
gatgtggccttgttgg

SEQ ID NO: 409490 - DNA, 16 bp, M. musculus
gatgtggctcagctgg

SEQ ID NO: 409491 - DNA, 16 bp, M. musculus
gatgtgggaggaccta

SEQ ID NO: 409492 - DNA, 16 bp, M. musculus
gatgtgggtgctagga

SEQ ID NO: 409493 - DNA, 16 bp, M. musculus
gatgtggtagcacaca

SEQ ID NO: 409494 - DNA, 16 bp, M. musculus
gatgtggttgctggga

SEQ ID NO: 409495 - DNA, 16 bp, M. musculus
gatgtgtctcctgctt

SEQ ID NO: 409496 - DNA, 16 bp, M. musculus
gatgtgtgcctgtaat

SEQ ID NO: 409497 - DNA, 16 bp, M. musculus
gatgtgtggacagaga

SEQ ID NO: 409498 - DNA, 16 bp, M. musculus
gatgtgtggacagagg

SEQ ID NO: 409499 - DNA, 16 bp, M. musculus
gatgtgttcttggatc

SEQ ID NO: 409500 - DNA, 16 bp, M. musculus
gatgtgtttctggatt

SEQ ID NO: 409501 - DNA, 16 bp, M. musculus
gatgtgttttcatttt

SEQ ID NO: 409502 - DNA, 16 bp, M. musculus
gatgtgttttcctggt

SEQ ID NO: 409503 - DNA, 16 bp, M. musculus
gatgttacttactgac

SEQ ID NO: 409504 - DNA, 16 bp, M. musculus
gatgttagagatgtca

SEQ ID NO: 409505 - DNA, 16 bp, M. musculus
gatgttagagtctgag

SEQ ID NO: 409506 - DNA, 16 bp, M. musculus
gatgttcaaagtcctt

SEQ ID NO: 409507 - DNA, 16 bp, M. musculus
gatgttcagaattcag

SEQ ID NO: 409508 - DNA, 16 bp, M. musculus
gatgttcatagcagcc

SEQ ID NO: 409509 - DNA, 16 bp, M. musculus
gatgttccatcctttc

SEQ ID NO: 409510 - DNA, 16 bp, M. musculus
gatgttctacaaactc

SEQ ID NO: 409511 - DNA, 16 bp, M. musculus
gatgttctctatggag

SEQ ID NO: 409512 - DNA, 16 bp, M. musculus
gatgttctcttctggt

SEQ ID NO: 409513 - DNA, 16 bp, M. musculus
gatgttgaacaatttt

SEQ ID NO: 409514 - DNA, 16 bp, M. musculus
gatgttgctttccact

SEQ ID NO: 409515 - DNA, 16 bp, M. musculus
gatgtttccaagactt

SEQ ID NO: 409516 - DNA, 16 bp, M. musculus
gatgtttgggataatg

SEQ ID NO: 409517 - DNA, 16 bp, M. musculus
gatgttttctttttcc

SEQ ID NO: 409518 - DNA, 16 bp, M. musculus
gatgtttttttaaaaa

SEQ ID NO: 409519 - DNA, 16 bp, M. musculus
gattaaaagcatgtac

SEQ ID NO: 409520 - DNA, 16 bp, M. musculus
gattaaaagtgtgaac

SEQ ID NO: 409521 - DNA, 16 bp, M. musculus
gattaaaagtgtgcac

SEQ ID NO: 409522 - DNA, 17 bp, M. musculus
gattaaagaactccaca

SEQ ID NO: 409523 - DNA, 16 bp, M. musculus
gattaaagatgtgggc

SEQ ID NO: 409524 - DNA, 16 bp, M. musculus
gattaaagcaaaaaca

SEQ ID NO: 409525 - DNA, 16 bp, M. musculus
gattaaaggactgtgc

SEQ ID NO: 409526 - DNA, 16 bp, M. musculus
gattaaaggagtgtac

SEQ ID NO: 409527 - DNA, 16 bp, M. musculus
gattaaaggcatgcat

SEQ ID NO: 409528 - DNA, 16 bp, M. musculus
gattaaaggtgtgcac

SEQ ID NO: 409529 - DNA, 16 bp, M. musculus
gattaaaggtgtgccc

SEQ ID NO: 409530 - DNA, 16 bp, M. musculus
gattaaaggtgtggga

SEQ ID NO: 409531 - DNA, 16 bp, M. musculus
gattaaatgtgtgtgc

SEQ ID NO: 409532 - DNA, 16 bp, M. musculus
gattaataagatacca

SEQ ID NO: 409533 - DNA, 16 bp, M. musculus
gattaatgtgtttggc

SEQ ID NO: 409534 - DNA, 17 bp, M. musculus
gattacaacatccagaa

SEQ ID NO: 409535 - DNA, 16 bp, M. musculus
gattacaggcatgtac

SEQ ID NO: 409536 - DNA, 16 bp, M. musculus
gattacaggtatgagc

SEQ ID NO: 409537 - DNA, 16 bp, M. musculus
gattaccaaataaacc

SEQ ID NO: 409538 - DNA, 16 bp, M. musculus
gattactcttccagag

SEQ ID NO: 409539 - DNA, 16 bp, M. musculus
gattagaaggtgtgac

SEQ ID NO: 409540 - DNA, 16 bp, M. musculus
gattagaggcctgggc

SEQ ID NO: 409541 - DNA, 23 bp, M. musculus
gattagatctactgttcctaaaa

SEQ ID NO: 409542 - DNA, 16 bp, M. musculus
gattagattatattaa

SEQ ID NO: 409543 - DNA, 16 bp, M. musculus
gattaggaggtgtgga

SEQ ID NO: 409544 - DNA, 16 bp, M. musculus
gattaggtaaagagta

SEQ ID NO: 409545 - DNA, 16 bp, M. musculus
gattataagtgtgtgc

SEQ ID NO: 409546 - DNA, 16 bp, M. musculus
gattatacaatgtctt

SEQ ID NO: 409547 - DNA, 16 bp, M. musculus
gattatagtttcagag

SEQ ID NO: 409548 - DNA, 16 bp, M. musculus
gattatctcaagtgct

SEQ ID NO: 409549 - DNA, 16 bp, M. musculus
gattatgaatttgagg

SEQ ID NO: 409550 - DNA, 16 bp, M. musculus
gattatggaaacagaa

SEQ ID NO: 409551 - DNA, 16 bp, M. musculus
gattatgggatggacc

SEQ ID NO: 409552 - DNA, 16 bp, M. musculus
gattattgtagattga

SEQ ID NO: 409553 - DNA, 16 bp, M. musculus
gattatttcaatattc

SEQ ID NO: 409554 - DNA, 16 bp, M. musculus
gattattttctgcctt

SEQ ID NO: 409555 - DNA, 16 bp, M. musculus
gattattttcttcatt

SEQ ID NO: 409556 - DNA, 16 bp, M. musculus
gattcaatccctagca

SEQ ID NO: 409557 - DNA, 16 bp, M. musculus
gattcagaactgcagt

SEQ ID NO: 409558 - DNA, 16 bp, M. musculus
gattcaggcatggtgg

SEQ ID NO: 409559 - DNA, 16 bp, M. musculus
gattcagtgtatctgg

SEQ ID NO: 409560 - DNA, 16 bp, M. musculus
gattcagttcccagca

SEQ ID NO: 409561 - DNA, 16 bp, M. musculus
gattcataatagtagc

SEQ ID NO: 409562 - DNA, 16 bp, M. musculus
gattcatattctctct

SEQ ID NO: 409563 - DNA, 16 bp, M. musculus
gattcatggaaagata

SEQ ID NO: 409564 - DNA, 16 bp, M. musculus
gattcatgtgtggtgt

SEQ ID NO: 409565 - DNA, 16 bp, M. musculus
gattccaatctctgtt

SEQ ID NO: 409566 - DNA, 16 bp, M. musculus
gattccaccccacacc

SEQ ID NO: 409567 - DNA, 16 bp, M. musculus
gattccatagagaaaa

SEQ ID NO: 409568 - DNA, 16 bp, M. musculus
gattccattgatcaac

SEQ ID NO: 409569 - DNA, 16 bp, M. musculus
gattcccctcttctgt

SEQ ID NO: 409570 - DNA, 16 bp, M. musculus
gattcccctggaactg

SEQ ID NO: 409571 - DNA, 16 bp, M. musculus
gattccctcctttcag

SEQ ID NO: 409572 - DNA, 16 bp, M. musculus
gattccgggatcctgt

SEQ ID NO: 409573 - DNA, 16 bp, M. musculus
gattcctattgaagat

SEQ ID NO: 409574 - DNA, 16 bp, M. musculus
gattcctttacagatg

SEQ ID NO: 409575 - DNA, 16 bp, M. musculus
gattctaagagtcaga

SEQ ID NO: 409576 - DNA, 16 bp, M. musculus
gattctagatgaaatt

SEQ ID NO: 409577 - DNA, 16 bp, M. musculus
gattctatttctttag

SEQ ID NO: 409578 - DNA, 16 bp, M. musculus
gattctcagcaccaca

SEQ ID NO: 409579 - DNA, 16 bp, M. musculus
gattctcagcacccat

SEQ ID NO: 409580 - DNA, 16 bp, M. musculus
gattctcagcctgtgg

SEQ ID NO: 409581 - DNA, 16 bp, M. musculus
gattctcagctcaaag

SEQ ID NO: 409582 - DNA, 16 bp, M. musculus
gattctcctgtctcag

SEQ ID NO: 409583 - DNA, 16 bp, M. musculus
gattctctcatccctg

SEQ ID NO: 409584 - DNA, 16 bp, M. musculus
gattctctcttctatg

SEQ ID NO: 409585 - DNA, 16 bp, M. musculus
gattctctggaagtgg

SEQ ID NO: 409586 - DNA, 16 bp, M. musculus
gattctctggagtcta

SEQ ID NO: 409587 - DNA, 16 bp, M. musculus
gattctcttgcttcag

SEQ ID NO: 409588 - DNA, 16 bp, M. musculus
gattctggcagagaag

SEQ ID NO: 409589 - DNA, 16 bp, M. musculus
gattctgggatcctat

SEQ ID NO: 409590 - DNA, 16 bp, M. musculus
gattctggttcattgg

SEQ ID NO: 409591 - DNA, 16 bp, M. musculus
gattctggtttgttgt

SEQ ID NO: 409592 - DNA, 16 bp, M. musculus
gattctgtgcaaatga

SEQ ID NO: 409593 - DNA, 31 bp, M. musculus
gattcttacgtttgcctttcgccatctggta

SEQ ID NO: 409594 - DNA, 16 bp, M. musculus
gattcttaggagacag

SEQ ID NO: 409595 - DNA, 16 bp, M. musculus
gattcttcctggcaat

SEQ ID NO: 409596 - DNA, 16 bp, M. musculus
gattctttatattgtt

SEQ ID NO: 409597 - DNA, 16 bp, M. musculus
gattctttggagctga

SEQ ID NO: 409598 - DNA, 16 bp, M. musculus
gattctttgtaaagtt

SEQ ID NO: 409599 - DNA, 16 bp, M. musculus
gattctttgtacagtt

SEQ ID NO: 409600 - DNA, 16 bp, M. musculus
gattgaaaaagctgaa

SEQ ID NO: 409601 - DNA, 16 bp, M. musculus
gattgaacctagagcc

SEQ ID NO: 409602 - DNA, 16 bp, M. musculus
gattgaacctctgaaa

SEQ ID NO: 409603 - DNA, 16 bp, M. musculus
gattgaactcaggtct

SEQ ID NO: 409604 - DNA, 16 bp, M. musculus
gattgaatttttgaca

SEQ ID NO: 409605 - DNA, 16 bp, M. musculus
gattgacacagacttc

SEQ ID NO: 409606 - DNA, 16 bp, M. musculus
gattgagaaccactgt

SEQ ID NO: 409607 - DNA, 16 bp, M. musculus
gattgagacagatgca

SEQ ID NO: 409608 - DNA, 16 bp, M. musculus
gattgagctgctgctg

SEQ ID NO: 409609 - DNA, 16 bp, M. musculus
gattgatttttgcttt

SEQ ID NO: 409610 - DNA, 16 bp, M. musculus
gattgcagaggcaaag

SEQ ID NO: 409611 - DNA, 16 bp, M. musculus
gattgcattgcatctg

SEQ ID NO: 409612 - DNA, 16 bp, M. musculus
gattgccacaagtttg

SEQ ID NO: 409613 - DNA, 16 bp, M. musculus
gattgctcaatggtta

SEQ ID NO: 409614 - DNA, 16 bp, M. musculus
gattgctcagcttgct

SEQ ID NO: 409615 - DNA, 16 bp, M. musculus
gattgctctgaccact

SEQ ID NO: 409616 - DNA, 16 bp, M. musculus
gattgctctttctaat

SEQ ID NO: 409617 - DNA, 16 bp, M. musculus
gattgctgagttcaag

SEQ ID NO: 409618 - DNA, 16 bp, M. musculus
gattgctgggattaaa

SEQ ID NO: 409619 - DNA, 16 bp, M. musculus
gattgcttcaagtttt

SEQ ID NO: 409620 - DNA, 16 bp, M. musculus
gattgctttcagcaag

SEQ ID NO: 409621 - DNA, 16 bp, M. musculus
gattgctttcttcttt

SEQ ID NO: 409622 - DNA, 17 bp, M. musculus
gattggagggtcttgga

SEQ ID NO: 409623 - DNA, 16 bp, M. musculus
gattggattggagcag

SEQ ID NO: 409624 - DNA, 17 bp, M. musculus
gattggattggggcagg

SEQ ID NO: 409625 - DNA, 16 bp, M. musculus
gattggcatgatcaat

SEQ ID NO: 409626 - DNA, 16 bp, M. musculus
gattggcctgtgggca

SEQ ID NO: 409627 - DNA, 16 bp, M. musculus
gattggctgtgggtct

SEQ ID NO: 409628 - DNA, 16 bp, M. musculus
gattggtcttaaaggt

SEQ ID NO: 409629 - DNA, 16 bp, M. musculus
gattggttatgcacta

SEQ ID NO: 409630 - DNA, 29 bp, M. musculus
gattggttatgcatgggttatgcttacca

SEQ ID NO: 409631 - DNA, 16 bp, M. musculus
gattggttcacaagaa

SEQ ID NO: 409632 - DNA, 16 bp, M. musculus
gattggttctaatgct

SEQ ID NO: 409633 - DNA, 16 bp, M. musculus
gattgtaggcatgtgc

SEQ ID NO: 409634 - DNA, 16 bp, M. musculus
gattgtattttcctat

SEQ ID NO: 409635 - DNA, 16 bp, M. musculus
gattgtccatacagcc

SEQ ID NO: 409636 - DNA, 16 bp, M. musculus
gattgtcctggaactc

SEQ ID NO: 409637 - DNA, 16 bp, M. musculus
gattgtgaactggaaa

SEQ ID NO: 409638 - DNA, 17 bp, M. musculus
gattgtgaagattctgt

SEQ ID NO: 409639 - DNA, 16 bp, M. musculus
gattgtgttttcttgt

SEQ ID NO: 409640 - DNA, 16 bp, M. musculus
gattgtttccaacttc

SEQ ID NO: 409641 - DNA, 16 bp, M. musculus
gattgttttattcaat

SEQ ID NO: 409642 - DNA, 16 bp, M. musculus
gattgttttcagtttc

SEQ ID NO: 409643 - DNA, 16 bp, M. musculus
gatttaaggtccactc

SEQ ID NO: 409644 - DNA, 16 bp, M. musculus
gatttagtaaaagaag

SEQ ID NO: 409645 - DNA, 17 bp, M. musculus
gatttattaaagtcctt

SEQ ID NO: 409646 - DNA, 16 bp, M. musculus
gatttattcatttaat

SEQ ID NO: 409647 - DNA, 16 bp, M. musculus
gatttattctggctca

SEQ ID NO: 409648 - DNA, 16 bp, M. musculus
gatttatttattcatt

SEQ ID NO: 409649 - DNA, 16 bp, M. musculus
gatttatttgggctca

SEQ ID NO: 409650 - DNA, 16 bp, M. musculus
gatttatttgggctta

SEQ ID NO: 409651 - DNA, 16 bp, M. musculus
gatttcaaggccagcc

SEQ ID NO: 409652 - DNA, 16 bp, M. musculus
gatttcacctcagtaa

SEQ ID NO: 409653 - DNA, 16 bp, M. musculus
gatttcagaaagaact

SEQ ID NO: 409654 - DNA, 16 bp, M. musculus
gatttcagcctgagtt

SEQ ID NO: 409655 - DNA, 16 bp, M. musculus
gatttcaggatcccag

SEQ ID NO: 409656 - DNA, 16 bp, M. musculus
gatttcatctgcattt

SEQ ID NO: 409657 - DNA, 16 bp, M. musculus
gatttcatcttacacc

SEQ ID NO: 409658 - DNA, 16 bp, M. musculus
gatttcattcttcttt

SEQ ID NO: 409659 - DNA, 16 bp, M. musculus
gatttccaattttctg

SEQ ID NO: 409660 - DNA, 16 bp, M. musculus
gatttccacctgcatg

SEQ ID NO: 409661 - DNA, 16 bp, M. musculus
gatttccagaatgttt

SEQ ID NO: 409662 - DNA, 16 bp, M. musculus
gatttccagaggggaa

SEQ ID NO: 409663 - DNA, 19 bp, M. musculus
gatttccagagtggttgta

SEQ ID NO: 409664 - DNA, 16 bp, M. musculus
gatttccagcatccac

SEQ ID NO: 409665 - DNA, 16 bp, M. musculus
gatttccctgatgact

SEQ ID NO: 409666 - DNA, 16 bp, M. musculus
gatttcctcctgtccc

SEQ ID NO: 409667 - DNA, 16 bp, M. musculus
gatttcctttgatgat

SEQ ID NO: 409668 - DNA, 16 bp, M. musculus
gatttcgcccctgatt

SEQ ID NO: 409669 - DNA, 16 bp, M. musculus
gatttctccatgtcct

SEQ ID NO: 409670 - DNA, 16 bp, M. musculus
gatttctctgtgtagt

SEQ ID NO: 409671 - DNA, 16 bp, M. musculus
gatttctgagtacaag

SEQ ID NO: 409672 - DNA, 16 bp, M. musculus
gatttctgagttcaag

SEQ ID NO: 409673 - DNA, 16 bp, M. musculus
gatttctgcattcaag

SEQ ID NO: 409674 - DNA, 16 bp, M. musculus
gatttctgtgagttca

SEQ ID NO: 409675 - DNA, 16 bp, M. musculus
gatttctgtgagtttg

SEQ ID NO: 409676 - DNA, 17 bp, M. musculus
gatttctttcctaggtt

SEQ ID NO: 409677 - DNA, 16 bp, M. musculus
gatttgaactcaaaac

SEQ ID NO: 409678 - DNA, 16 bp, M. musculus
gatttgaactcaggat

SEQ ID NO: 409679 - DNA, 16 bp, M. musculus
gatttgaagtttttat

SEQ ID NO: 409680 - DNA, 16 bp, M. musculus
gatttgaatatgcttg

SEQ ID NO: 409681 - DNA, 16 bp, M. musculus
gatttgagatacaaac

SEQ ID NO: 409682 - DNA, 16 bp, M. musculus
gatttgatggagacat

SEQ ID NO: 409683 - DNA, 16 bp, M. musculus
gatttgatgtgccagg

SEQ ID NO: 409684 - DNA, 16 bp, M. musculus
gatttgcatgggacca

SEQ ID NO: 409685 - DNA, 16 bp, M. musculus
gatttgctgaaggagg

SEQ ID NO: 409686 - DNA, 16 bp, M. musculus
gatttggaaaggattt

SEQ ID NO: 409687 - DNA, 16 bp, M. musculus
gatttggttctctcct

SEQ ID NO: 409688 - DNA, 16 bp, M. musculus
gatttgtttcctcttt

SEQ ID NO: 409689 - DNA, 16 bp, M. musculus
gattttaaaagagaaa

SEQ ID NO: 409690 - DNA, 16 bp, M. musculus
gattttaaacttaaag

SEQ ID NO: 409691 - DNA, 16 bp, M. musculus
gattttaaatcagaat

SEQ ID NO: 409692 - DNA, 16 bp, M. musculus
gattttaagaaagaca

SEQ ID NO: 409693 - DNA, 16 bp, M. musculus
gattttacctgtgatg

SEQ ID NO: 409694 - DNA, 16 bp, M. musculus
gattttatatatgtgt

SEQ ID NO: 409695 - DNA, 16 bp, M. musculus
gattttatctgatatt

SEQ ID NO: 409696 - DNA, 16 bp, M. musculus
gattttattaaaaaca

SEQ ID NO: 409697 - DNA, 16 bp, M. musculus
gattttcaaattaaaa

SEQ ID NO: 409698 - DNA, 16 bp, M. musculus
gattttcaaccaaaag

SEQ ID NO: 409699 - DNA, 16 bp, M. musculus
gattttcaacttgaag

SEQ ID NO: 409700 - DNA, 16 bp, M. musculus
gattttcacatattga

SEQ ID NO: 409701 - DNA, 16 bp, M. musculus
gattttcatttcccta

SEQ ID NO: 409702 - DNA, 16 bp, M. musculus
gattttccctttgatg

SEQ ID NO: 409703 - DNA, 16 bp, M. musculus
gattttcctgttgcag

SEQ ID NO: 409704 - DNA, 18 bp, M. musculus
gattttctcaaagaacca

SEQ ID NO: 409705 - DNA, 16 bp, M. musculus
gattttctgaaaggac

SEQ ID NO: 409706 - DNA, 16 bp, M. musculus
gattttctggaatcca

SEQ ID NO: 409707 - DNA, 16 bp, M. musculus
gattttctggctttca

SEQ ID NO: 409708 - DNA, 16 bp, M. musculus
gattttgaaaataaag

SEQ ID NO: 409709 - DNA, 16 bp, M. musculus
gattttgaatctgaat

SEQ ID NO: 409710 - DNA, 16 bp, M. musculus
gattttgtcaaatact

SEQ ID NO: 409711 - DNA, 16 bp, M. musculus
gattttgttatggatg

SEQ ID NO: 409712 - DNA, 16 bp, M. musculus
gatttttaaaaaatct

SEQ ID NO: 409713 - DNA, 16 bp, M. musculus
gatttttaaaaatcta

SEQ ID NO: 409714 - DNA, 16 bp, M. musculus
gatttttaaaacaaaa

SEQ ID NO: 409715 - DNA, 16 bp, M. musculus
gatttttaaaagagat

SEQ ID NO: 409716 - DNA, 16 bp, M. musculus
gatttttaaaaggaca

SEQ ID NO: 409717 - DNA, 16 bp, M. musculus
gatttttagccaaaat

SEQ ID NO: 409718 - DNA, 16 bp, M. musculus
gatttttcccaaagga

SEQ ID NO: 409719 - DNA, 16 bp, M. musculus
gatttttctatgtagc

SEQ ID NO: 409720 - DNA, 16 bp, M. musculus
gatttttctttttaaa

SEQ ID NO: 409721 - DNA, 16 bp, M. musculus
gatttttgacaaagaa

SEQ ID NO: 409722 - DNA, 16 bp, M. musculus
gatttttgatgaagaa

SEQ ID NO: 409723 - DNA, 16 bp, M. musculus
gatttttgctgaaagg

SEQ ID NO: 409724 - DNA, 16 bp, M. musculus
gatttttgtcaacttg

SEQ ID NO: 409725 - DNA, 16 bp, M. musculus
gatttttgtgctttct

SEQ ID NO: 409726 - DNA, 16 bp, M. musculus
gatttttttaattagg

SEQ ID NO: 409727 - DNA, 16 bp, M. musculus
gatttttttccccctg

SEQ ID NO: 409728 - DNA, 16 bp, M. musculus
gatttttttcctcctt

SEQ ID NO: 409729 - DNA, 16 bp, M. musculus
gatttttttcctttga

SEQ ID NO: 409730 - DNA, 16 bp, M. musculus
gattttttttaaaggt

SEQ ID NO: 409731 - DNA, 16 bp, M. musculus
gattttttttattaca

SEQ ID NO: 409732 - DNA, 16 bp, M. musculus
gattttttttccccct

SEQ ID NO: 409733 - DNA, 16 bp, M. musculus
gattttttttctcagt

SEQ ID NO: 409734 - DNA, 16 bp, M. musculus
gattttttttttcaaa

SEQ ID NO: 409735 - DNA, 16 bp, M. musculus
gattttttttttcaac

SEQ ID NO: 409736 - DNA, 16 bp, M. musculus
gattttttttttccca

SEQ ID NO: 409737 - DNA, 16 bp, M. musculus
gcaaaaagaagctttt

SEQ ID NO: 409738 - DNA, 16 bp, M. musculus
gcaaaaagctcctaac

SEQ ID NO: 409739 - DNA, 16 bp, M. musculus
gcaaaaataattttat

SEQ ID NO: 409740 - DNA, 16 bp, M. musculus
gcaaaaatcatcaata

SEQ ID NO: 409741 - DNA, 16 bp, M. musculus
gcaaaaattcttaata

SEQ ID NO: 409742 - DNA, 16 bp, M. musculus
gcaaaacacatgaaag

SEQ ID NO: 409743 - DNA, 16 bp, M. musculus
gcaaaacaccatccaa

SEQ ID NO: 409744 - DNA, 16 bp, M. musculus
gcaaaacacccagaca

SEQ ID NO: 409745 - DNA, 16 bp, M. musculus
gcaaaacacttgaaac

SEQ ID NO: 409746 - DNA, 16 bp, M. musculus
gcaaaacattcattca

SEQ ID NO: 409747 - DNA, 16 bp, M. musculus
gcaaaactttcagtca

SEQ ID NO: 409748 - DNA, 16 bp, M. musculus
gcaaaagacaatgtca

SEQ ID NO: 409749 - DNA, 16 bp, M. musculus
gcaaaagagtcagaca

SEQ ID NO: 409750 - DNA, 16 bp, M. musculus
gcaaaagcagccagtg

SEQ ID NO: 409751 - DNA, 16 bp, M. musculus
gcaaaaggagatcaag

SEQ ID NO: 409752 - DNA, 16 bp, M. musculus
gcaaaatccatgatgt

SEQ ID NO: 409753 - DNA, 16 bp, M. musculus
gcaaaatctaaaaagt

SEQ ID NO: 409754 - DNA, 16 bp, M. musculus
gcaaaatgcaaagaga

SEQ ID NO: 409755 - DNA, 16 bp, M. musculus
gcaaaatggctcagtg

SEQ ID NO: 409756 - DNA, 16 bp, M. musculus
gcaaacacagacacac

SEQ ID NO: 409757 - DNA, 16 bp, M. musculus
gcaaacacaggtgaaa

SEQ ID NO: 409758 - DNA, 17 bp, M. musculus
gcaaacacagtagtgga

SEQ ID NO: 409759 - DNA, 16 bp, M. musculus
gcaaacactctgccaa

SEQ ID NO: 409760 - DNA, 16 bp, M. musculus
gcaaacagacagacag

SEQ ID NO: 409761 - DNA, 16 bp, M. musculus
gcaaacagtgcctgag

SEQ ID NO: 409762 - DNA, 16 bp, M. musculus
gcaaaccactcataca

SEQ ID NO: 409763 - DNA, 16 bp, M. musculus
gcaaaccagtggccaa

SEQ ID NO: 409764 - DNA, 16 bp, M. musculus
gcaaacccctccagct

SEQ ID NO: 409765 - DNA, 16 bp, M. musculus
gcaaacctgtaggagg

SEQ ID NO: 409766 - DNA, 17 bp, M. musculus
gcaaacgctgctgcttt

SEQ ID NO: 409767 - DNA, 16 bp, M. musculus
gcaaacggtctgaaga

SEQ ID NO: 409768 - DNA, 16 bp, M. musculus
gcaaactgcaagaggt

SEQ ID NO: 409769 - DNA, 16 bp, M. musculus
gcaaactgcttcagct

SEQ ID NO: 409770 - DNA, 16 bp, M. musculus
gcaaactggctagcta

SEQ ID NO: 409771 - DNA, 16 bp, M. musculus
gcaaacttccaaagga

SEQ ID NO: 409772 - DNA, 16 bp, M. musculus
gcaaactttatatatc

SEQ ID NO: 409773 - DNA, 16 bp, M. musculus
gcaaactttgtatgtc

SEQ ID NO: 409774 - DNA, 16 bp, M. musculus
gcaaagacaagcagat

SEQ ID NO: 409775 - DNA, 16 bp, M. musculus
gcaaagacaagtggat

SEQ ID NO: 409776 - DNA, 16 bp, M. musculus
gcaaagaccaccttct

SEQ ID NO: 409777 - DNA, 16 bp, M. musculus
gcaaagagtttcaagg

SEQ ID NO: 409778 - DNA, 16 bp, M. musculus
gcaaagcagctgaggc

SEQ ID NO: 409779 - DNA, 16 bp, M. musculus
gcaaagcatcctttca

SEQ ID NO: 409780 - DNA, 16 bp, M. musculus
gcaaagccctcccggg

SEQ ID NO: 409781 - DNA, 16 bp, M. musculus
gcaaagccctgggttc

SEQ ID NO: 409782 - DNA, 16 bp, M. musculus
gcaaagccctttgtta

SEQ ID NO: 409783 - DNA, 17 bp, M. musculus
gcaaagcctggaatcca

SEQ ID NO: 409784 - DNA, 16 bp, M. musculus
gcaaaggaggctggga

SEQ ID NO: 409785 - DNA, 16 bp, M. musculus
gcaaaggcagaggcag

SEQ ID NO: 409786 - DNA, 16 bp, M. musculus
gcaaaggcaggcagag

SEQ ID NO: 409787 - DNA, 16 bp, M. musculus
gcaaaggcaggtggat

SEQ ID NO: 409788 - DNA, 16 bp, M. musculus
gcaaaggccagaagag

SEQ ID NO: 409789 - DNA, 16 bp, M. musculus
gcaaaggccctggggc

SEQ ID NO: 409790 - DNA, 16 bp, M. musculus
gcaaaggctacactcc

SEQ ID NO: 409791 - DNA, 16 bp, M. musculus
gcaaaggctttgctga

SEQ ID NO: 409792 - DNA, 16 bp, M. musculus
gcaaagggcactgtca

SEQ ID NO: 409793 - DNA, 16 bp, M. musculus
gcaaagggcagattct

SEQ ID NO: 409794 - DNA, 16 bp, M. musculus
gcaaaggtgcttgctg

SEQ ID NO: 409795 - DNA, 16 bp, M. musculus
gcaaaggttaatgtct

SEQ ID NO: 409796 - DNA, 16 bp, M. musculus
gcaaatagagatattt

SEQ ID NO: 409797 - DNA, 16 bp, M. musculus
gcaaatatttcaaaat

SEQ ID NO: 409798 - DNA, 16 bp, M. musculus
gcaaatcaaaacaaac

SEQ ID NO: 409799 - DNA, 16 bp, M. musculus
gcaaatgagtgggtct

SEQ ID NO: 409800 - DNA, 16 bp, M. musculus
gcaaatgcaagggcag

SEQ ID NO: 409801 - DNA, 16 bp, M. musculus
gcaaatgctttaccca

SEQ ID NO: 409802 - DNA, 16 bp, M. musculus
gcaaatgctttactga

SEQ ID NO: 409803 - DNA, 16 bp, M. musculus
gcaaatgctttatcca

SEQ ID NO: 409804 - DNA, 16 bp, M. musculus
gcaaatggatataacc

SEQ ID NO: 409805 - DNA, 16 bp, M. musculus
gcaaatggatctctga

SEQ ID NO: 409806 - DNA, 16 bp, M. musculus
gcaaatggatgtattt

SEQ ID NO: 409807 - DNA, 16 bp, M. musculus
gcaaattctctctctc

SEQ ID NO: 409808 - DNA, 16 bp, M. musculus
gcaaattctgggaaaa

SEQ ID NO: 409809 - DNA, 16 bp, M. musculus
gcaaattgtatattat

SEQ ID NO: 409810 - DNA, 16 bp, M. musculus
gcaaattttatcttgt

SEQ ID NO: 409811 - DNA, 16 bp, M. musculus
gcaacaaaaataattg

SEQ ID NO: 409812 - DNA, 16 bp, M. musculus
gcaacaaacaggtaga

SEQ ID NO: 409813 - DNA, 16 bp, M. musculus
gcaacaacagcaataa

SEQ ID NO: 409814 - DNA, 97 bp, M. musculus
gcaacaagcatggagctttgaaatgcttacaggtcagggtatatggacaaacaatcaattaggatacccagtgcaggtctatgatcaaattaatcag

SEQ ID NO: 409815 - DNA, 16 bp, M. musculus
gcaacacaaacaacat

SEQ ID NO: 409816 - DNA, 16 bp, M. musculus
gcaacagaaaagtaac

SEQ ID NO: 409817 - DNA, 16 bp, M. musculus
gcaacagaaagcaaat

SEQ ID NO: 409818 - DNA, 16 bp, M. musculus
gcaacagaatacaaca

SEQ ID NO: 409819 - DNA, 16 bp, M. musculus
gcaacagagtcagaga

SEQ ID NO: 409820 - DNA, 16 bp, M. musculus
gcaacagatggagacc

SEQ ID NO: 409821 - DNA, 16 bp, M. musculus
gcaacagcagcaacaa

SEQ ID NO: 409822 - DNA, 16 bp, M. musculus
gcaacagcagctcctt

SEQ ID NO: 409823 - DNA, 16 bp, M. musculus
gcaacaggattaaggt

SEQ ID NO: 409824 - DNA, 16 bp, M. musculus
gcaacagggtttctct

SEQ ID NO: 409825 - DNA, 16 bp, M. musculus
gcaacagtaaaaattg

SEQ ID NO: 409826 - DNA, 16 bp, M. musculus
gcaacagtggcacaaa

SEQ ID NO: 409827 - DNA, 16 bp, M. musculus
gcaacatgggttcaac

SEQ ID NO: 409828 - DNA, 19 bp, M. musculus
gcaaccactgactgctgaa

SEQ ID NO: 409829 - DNA, 16 bp, M. musculus
gcaaccaggccttggg

SEQ ID NO: 409830 - DNA, 16 bp, M. musculus
gcaaccagtgctccta

SEQ ID NO: 409831 - DNA, 16 bp, M. musculus
gcaaccccaggaagtg

SEQ ID NO: 409832 - DNA, 16 bp, M. musculus
gcaacccctgtgaaag

SEQ ID NO: 409833 - DNA, 18 bp, M. musculus
gcaaccctctgagtttat

SEQ ID NO: 409834 - DNA, 16 bp, M. musculus
gcaacctcgggaggta

SEQ ID NO: 409835 - DNA, 16 bp, M. musculus
gcaacgaatcaggagc

SEQ ID NO: 409836 - DNA, 16 bp, M. musculus
gcaactccagttccag

SEQ ID NO: 409837 - DNA, 16 bp, M. musculus
gcaactctcttgggct

SEQ ID NO: 409838 - DNA, 16 bp, M. musculus
gcaactctgtgtgtgt

SEQ ID NO: 409839 - DNA, 16 bp, M. musculus
gcaactgaggaagaca

SEQ ID NO: 409840 - DNA, 16 bp, M. musculus
gcaactgcataggaag

SEQ ID NO: 409841 - DNA, 16 bp, M. musculus
gcaacttataaaagaa

SEQ ID NO: 409842 - DNA, 16 bp, M. musculus
gcaacttccagaaaaa

SEQ ID NO: 409843 - DNA, 16 bp, M. musculus
gcaactttatttacca

SEQ ID NO: 409844 - DNA, 16 bp, M. musculus
gcaagaaaaatcagtg

SEQ ID NO: 409845 - DNA, 16 bp, M. musculus
gcaagaaagtgatcct

SEQ ID NO: 409846 - DNA, 16 bp, M. musculus
gcaagaacaagaaagc

SEQ ID NO: 409847 - DNA, 16 bp, M. musculus
gcaagaacaagtgctt

SEQ ID NO: 409848 - DNA, 16 bp, M. musculus
gcaagaacctggaggc

SEQ ID NO: 409849 - DNA, 16 bp, M. musculus
gcaagaacttcaagta

SEQ ID NO: 409850 - DNA, 16 bp, M. musculus
gcaagaacttgaagca

SEQ ID NO: 409851 - DNA, 17 bp, M. musculus
gcaagaagagagctttc

SEQ ID NO: 409852 - DNA, 16 bp, M. musculus
gcaagaagataagaaa

SEQ ID NO: 409853 - DNA, 16 bp, M. musculus
gcaagaagcaagagag

SEQ ID NO: 409854 - DNA, 16 bp, M. musculus
gcaagaagcagagaga

SEQ ID NO: 409855 - DNA, 16 bp, M. musculus
gcaagaagcagctgga

SEQ ID NO: 409856 - DNA, 16 bp, M. musculus
gcaagaagccaccaga

SEQ ID NO: 409857 - DNA, 16 bp, M. musculus
gcaagaagctgctgga

SEQ ID NO: 409858 - DNA, 16 bp, M. musculus
gcaagacatctgtcca

SEQ ID NO: 409859 - DNA, 16 bp, M. musculus
gcaagaccgaggggcc

SEQ ID NO: 409860 - DNA, 16 bp, M. musculus
gcaagaccttgtctca

SEQ ID NO: 409861 - DNA, 16 bp, M. musculus
gcaagactttgtctca

SEQ ID NO: 409862 - DNA, 16 bp, M. musculus
gcaagagaagccagtg

SEQ ID NO: 409863 - DNA, 16 bp, M. musculus
gcaagagagatgaaga

SEQ ID NO: 409864 - DNA, 16 bp, M. musculus
gcaagagaggaactag

SEQ ID NO: 409865 - DNA, 16 bp, M. musculus
gcaagagcaacaggtg

SEQ ID NO: 409866 - DNA, 16 bp, M. musculus
gcaagagcacccacat

SEQ ID NO: 409867 - DNA, 16 bp, M. musculus
gcaagagcagcagcag

SEQ ID NO: 409868 - DNA, 16 bp, M. musculus
gcaagagcagcagtgc

SEQ ID NO: 409869 - DNA, 16 bp, M. musculus
gcaagagcagccaggg

SEQ ID NO: 409870 - DNA, 16 bp, M. musculus
gcaagaggagagcttt

SEQ ID NO: 409871 - DNA, 16 bp, M. musculus
gcaagaggcaagtgca

SEQ ID NO: 409872 - DNA, 16 bp, M. musculus
gcaagagggcaagaga

SEQ ID NO: 409873 - DNA, 18 bp, M. musculus
gcaagagtgcaagagaga

SEQ ID NO: 409874 - DNA, 16 bp, M. musculus
gcaagatcccacccag

SEQ ID NO: 409875 - DNA, 16 bp, M. musculus
gcaagatgaatgagct

SEQ ID NO: 409876 - DNA, 16 bp, M. musculus
gcaagatgaccatttt

SEQ ID NO: 409877 - DNA, 16 bp, M. musculus
gcaagatggctctgtg

SEQ ID NO: 409878 - DNA, 16 bp, M. musculus
gcaagatggcttagtg

SEQ ID NO: 409879 - DNA, 16 bp, M. musculus
gcaagcaagcaagaga

SEQ ID NO: 409880 - DNA, 16 bp, M. musculus
gcaagcaataaagctt

SEQ ID NO: 409881 - DNA, 16 bp, M. musculus
gcaagcacaagaacat

SEQ ID NO: 409882 - DNA, 16 bp, M. musculus
gcaagcacaaggacct

SEQ ID NO: 409883 - DNA, 16 bp, M. musculus
gcaagcaccctaccaa

SEQ ID NO: 409884 - DNA, 16 bp, M. musculus
gcaagcacctttaccc

SEQ ID NO: 409885 - DNA, 16 bp, M. musculus
gcaagcacctttcccc

SEQ ID NO: 409886 - DNA, 16 bp, M. musculus
gcaagcacctttccct

SEQ ID NO: 409887 - DNA, 16 bp, M. musculus
gcaagcactccaccaa

SEQ ID NO: 409888 - DNA, 16 bp, M. musculus
gcaagcactctaccac

SEQ ID NO: 409889 - DNA, 16 bp, M. musculus
gcaagcactctaccag

SEQ ID NO: 409890 - DNA, 16 bp, M. musculus
gcaagcactcttacct

SEQ ID NO: 409891 - DNA, 16 bp, M. musculus
gcaagcactgtaccac

SEQ ID NO: 409892 - DNA, 16 bp, M. musculus
gcaagcactttgctga

SEQ ID NO: 409893 - DNA, 16 bp, M. musculus
gcaagcacttttaact

SEQ ID NO: 409894 - DNA, 16 bp, M. musculus
gcaagcagcagcagca

SEQ ID NO: 409895 - DNA, 16 bp, M. musculus
gcaagcaggcaggcag

SEQ ID NO: 409896 - DNA, 19 bp, M. musculus
gcaagcaggcgaaggagca

SEQ ID NO: 409897 - DNA, 16 bp, M. musculus
gcaagcatgaagccct

SEQ ID NO: 409898 - DNA, 16 bp, M. musculus
gcaagcatgacacaca

SEQ ID NO: 409899 - DNA, 16 bp, M. musculus
gcaagcattttgccaa

SEQ ID NO: 409900 - DNA, 16 bp, M. musculus
gcaagccaagggaagc

SEQ ID NO: 409901 - DNA, 16 bp, M. musculus
gcaagccagggaaagc

SEQ ID NO: 409902 - DNA, 19 bp, M. musculus
gcaagccagtgaagaacat

SEQ ID NO: 409903 - DNA, 16 bp, M. musculus
gcaagccagtgagtag

SEQ ID NO: 409904 - DNA, 18 bp, M. musculus
gcaagcccaaggccctgg

SEQ ID NO: 409905 - DNA, 16 bp, M. musculus
gcaagcccatagccaa

SEQ ID NO: 409906 - DNA, 16 bp, M. musculus
gcaagccccagttaaa

SEQ ID NO: 409907 - DNA, 16 bp, M. musculus
gcaagcccttgttggc

SEQ ID NO: 409908 - DNA, 16 bp, M. musculus
gcaagcctaacagagt

SEQ ID NO: 409909 - DNA, 16 bp, M. musculus
gcaagcctgagaacct

SEQ ID NO: 409910 - DNA, 16 bp, M. musculus
gcaagcctgggctaca

SEQ ID NO: 409911 - DNA, 16 bp, M. musculus
gcaagctccaggaatc

SEQ ID NO: 409912 - DNA, 16 bp, M. musculus
gcaagctgagcaaggc

SEQ ID NO: 409913 - DNA, 16 bp, M. musculus
gcaagctgccatgtgg

SEQ ID NO: 409914 - DNA, 16 bp, M. musculus
gcaagctgggaaggaa

SEQ ID NO: 409915 - DNA, 16 bp, M. musculus
gcaagctgtcctctga

SEQ ID NO: 409916 - DNA, 16 bp, M. musculus
gcaagcttgaggccag

SEQ ID NO: 409917 - DNA, 16 bp, M. musculus
gcaagcttgtacagcc

SEQ ID NO: 409918 - DNA, 16 bp, M. musculus
gcaaggaaatgatgaa

SEQ ID NO: 409919 - DNA, 16 bp, M. musculus
gcaaggacaagaacat

SEQ ID NO: 409920 - DNA, 16 bp, M. musculus
gcaaggacatccacat

SEQ ID NO: 409921 - DNA, 16 bp, M. musculus
gcaaggacccccacag

SEQ ID NO: 409922 - DNA, 16 bp, M. musculus
gcaaggagaaccaatg

SEQ ID NO: 409923 - DNA, 16 bp, M. musculus
gcaaggatgaccttga

SEQ ID NO: 409924 - DNA, 16 bp, M. musculus
gcaaggatggggagaa

SEQ ID NO: 409925 - DNA, 16 bp, M. musculus
gcaaggatgtggagaa

SEQ ID NO: 409926 - DNA, 16 bp, M. musculus
gcaaggatgtggagga

SEQ ID NO: 409927 - DNA, 16 bp, M. musculus
gcaaggcagcatccag

SEQ ID NO: 409928 - DNA, 16 bp, M. musculus
gcaaggcagtaagcaa

SEQ ID NO: 409929 - DNA, 16 bp, M. musculus
gcaaggcatgctggga

SEQ ID NO: 409930 - DNA, 16 bp, M. musculus
gcaaggccaagggcct

SEQ ID NO: 409931 - DNA, 16 bp, M. musculus
gcaaggccctgggttc

SEQ ID NO: 409932 - DNA, 16 bp, M. musculus
gcaagggacactgtca

SEQ ID NO: 409933 - DNA, 16 bp, M. musculus
gcaagggcaaaaacat

SEQ ID NO: 409934 - DNA, 16 bp, M. musculus
gcaagggcagccacaa

SEQ ID NO: 409935 - DNA, 16 bp, M. musculus
gcaagggccaagaagt

SEQ ID NO: 409936 - DNA, 16 bp, M. musculus
gcaaggggcagcccta

SEQ ID NO: 409937 - DNA, 16 bp, M. musculus
gcaagggtgtgtgtgt

SEQ ID NO: 409938 - DNA, 16 bp, M. musculus
gcaaggtacagaaaat

SEQ ID NO: 409939 - DNA, 16 bp, M. musculus
gcaaggtcaaggccag

SEQ ID NO: 409940 - DNA, 16 bp, M. musculus
gcaaggtttctctgtg

SEQ ID NO: 409941 - DNA, 16 bp, M. musculus
gcaagtactctaccag

SEQ ID NO: 409942 - DNA, 16 bp, M. musculus
gcaagtactctgccac

SEQ ID NO: 409943 - DNA, 16 bp, M. musculus
gcaagtatgaggacct

SEQ ID NO: 409944 - DNA, 16 bp, M. musculus
gcaagtatgtggtgga

SEQ ID NO: 409945 - DNA, 16 bp, M. musculus
gcaagtccaaggccag

SEQ ID NO: 409946 - DNA, 17 bp, M. musculus
gcaagtccagtgggcct

SEQ ID NO: 409947 - DNA, 16 bp, M. musculus
gcaagtccttcagcca

SEQ ID NO: 409948 - DNA, 16 bp, M. musculus
gcaagtgaatgcttat

SEQ ID NO: 409949 - DNA, 16 bp, M. musculus
gcaagtgagtttcctg

SEQ ID NO: 409950 - DNA, 16 bp, M. musculus
gcaagtgcaagaccat

SEQ ID NO: 409951 - DNA, 16 bp, M. musculus
gcaagtgccatccctg

SEQ ID NO: 409952 - DNA, 16 bp, M. musculus
gcaagtgccttcacct

SEQ ID NO: 409953 - DNA, 16 bp, M. musculus
gcaagtgcctttaact

SEQ ID NO: 409954 - DNA, 16 bp, M. musculus
gcaagtgcttaattgt

SEQ ID NO: 409955 - DNA, 16 bp, M. musculus
gcaagtggatttctga

SEQ ID NO: 409956 - DNA, 16 bp, M. musculus
gcaagttcaaagccag

SEQ ID NO: 409957 - DNA, 16 bp, M. musculus
gcaagttcaagaccaa

SEQ ID NO: 409958 - DNA, 16 bp, M. musculus
gcaagttcaagaccag

SEQ ID NO: 409959 - DNA, 16 bp, M. musculus
gcaagttcaaggccac

SEQ ID NO: 409960 - DNA, 16 bp, M. musculus
gcaagttccaagccag

SEQ ID NO: 409961 - DNA, 16 bp, M. musculus
gcaagttccagaatag

SEQ ID NO: 409962 - DNA, 16 bp, M. musculus
gcaagttccagggcag

SEQ ID NO: 409963 - DNA, 16 bp, M. musculus
gcaagttgaaaatgaa

SEQ ID NO: 409964 - DNA, 16 bp, M. musculus
gcaagttgccctttct

SEQ ID NO: 409965 - DNA, 16 bp, M. musculus
gcaagttggagaagaa

SEQ ID NO: 409966 - DNA, 16 bp, M. musculus
gcaagttggagagaaa

SEQ ID NO: 409967 - DNA, 16 bp, M. musculus
gcaagttgttctttga

SEQ ID NO: 409968 - DNA, 16 bp, M. musculus
gcaagtttgaagccag

SEQ ID NO: 409969 - DNA, 16 bp, M. musculus
gcaagtttgaggccag

SEQ ID NO: 409970 - DNA, 16 bp, M. musculus
gcaagtttgaggctag

SEQ ID NO: 409971 - DNA, 16 bp, M. musculus
gcaataaaaatatttt

SEQ ID NO: 409972 - DNA, 16 bp, M. musculus
gcaataaagaaaacac

SEQ ID NO: 409973 - DNA, 16 bp, M. musculus
gcaatacaaaaggaat

SEQ ID NO: 409974 - DNA, 16 bp, M. musculus
gcaatacagagaaacc

SEQ ID NO: 409975 - DNA, 16 bp, M. musculus
gcaatagaggaagaca

SEQ ID NO: 409976 - DNA, 16 bp, M. musculus
gcaatagctgagagct

SEQ ID NO: 409977 - DNA, 16 bp, M. musculus
gcaatattttgctgaa

SEQ ID NO: 409978 - DNA, 16 bp, M. musculus
gcaatcaaggcaggaa

SEQ ID NO: 409979 - DNA, 16 bp, M. musculus
gcaatcagacaacaaa

SEQ ID NO: 409980 - DNA, 16 bp, M. musculus
gcaatcctcctgcctc

SEQ ID NO: 409981 - DNA, 16 bp, M. musculus
gcaatcctctgctgta

SEQ ID NO: 409982 - DNA, 16 bp, M. musculus
gcaatgaaaacacaac

SEQ ID NO: 409983 - DNA, 16 bp, M. musculus
gcaatgaagaagtgtt

SEQ ID NO: 409984 - DNA, 16 bp, M. musculus
gcaatgagaagaccaa

SEQ ID NO: 409985 - DNA, 16 bp, M. musculus
gcaatgatgatgatga

SEQ ID NO: 409986 - DNA, 16 bp, M. musculus
gcaatgccttgtgctg

SEQ ID NO: 409987 - DNA, 16 bp, M. musculus
gcaatgctagtctatt

SEQ ID NO: 409988 - DNA, 16 bp, M. musculus
gcaatggaaacttcct

SEQ ID NO: 409989 - DNA, 16 bp, M. musculus
gcaatggaggagtgtt

SEQ ID NO: 409990 - DNA, 16 bp, M. musculus
gcaatggtgtcatcac

SEQ ID NO: 409991 - DNA, 16 bp, M. musculus
gcaatgttccttctgt

SEQ ID NO: 409992 - DNA, 25 bp, M. musculus
gcaatgttctcaaggaaacgaggga

SEQ ID NO: 409993 - DNA, 16 bp, M. musculus
gcaattcccatcaaaa

SEQ ID NO: 409994 - DNA, 16 bp, M. musculus
gcaattctttgcatat

SEQ ID NO: 409995 - DNA, 16 bp, M. musculus
gcaattgagagtttgg

SEQ ID NO: 409996 - DNA, 16 bp, M. musculus
gcaattgaggaagaca

SEQ ID NO: 409997 - DNA, 16 bp, M. musculus
gcaattgatgtcccag

SEQ ID NO: 409998 - DNA, 16 bp, M. musculus
gcaattgggaagcaga

SEQ ID NO: 409999 - DNA, 16 bp, M. musculus
gcaatttgaaaacaaa

SEQ ID NO: 410000 - DNA, 17 bp, M. musculus
gcaatttgccgagctgc

SEQ ID NO: 410001 - DNA, 16 bp, M. musculus
gcaattttaacttcaa

SEQ ID NO: 410002 - DNA, 16 bp, M. musculus
gcacaaacacacatgc

SEQ ID NO: 410003 - DNA, 16 bp, M. musculus
gcacaaacacagacac

SEQ ID NO: 410004 - DNA, 16 bp, M. musculus
gcacaaacctttaatc

SEQ ID NO: 410005 - DNA, 16 bp, M. musculus
gcacaaagaaactgtg

SEQ ID NO: 410006 - DNA, 16 bp, M. musculus
gcacaaagacctgagt

SEQ ID NO: 410007 - DNA, 16 bp, M. musculus
gcacaaagtaaaagtg

SEQ ID NO: 410008 - DNA, 16 bp, M. musculus
gcacaaatacacaaat

SEQ ID NO: 410009 - DNA, 16 bp, M. musculus
gcacaacaaacctcac

SEQ ID NO: 410010 - DNA, 16 bp, M. musculus
gcacaactggaagtta

SEQ ID NO: 410011 - DNA, 16 bp, M. musculus
gcacaactggtggcta

SEQ ID NO: 410012 - DNA, 16 bp, M. musculus
gcacaagaacagaatc

SEQ ID NO: 410013 - DNA, 16 bp, M. musculus
gcacaagagagcaaga

SEQ ID NO: 410014 - DNA, 16 bp, M. musculus
gcacaaggccctgggt

SEQ ID NO: 410015 - DNA, 16 bp, M. musculus
gcacaaggccctggtt

SEQ ID NO: 410016 - DNA, 16 bp, M. musculus
gcacaattttcaagaa

SEQ ID NO: 410017 - DNA, 16 bp, M. musculus
gcacacacaaacacat

SEQ ID NO: 410018 - DNA, 16 bp, M. musculus
gcacacacaagcacac

SEQ ID NO: 410019 - DNA, 16 bp, M. musculus
gcacacacacaagcac

SEQ ID NO: 410020 - DNA, 16 bp, M. musculus
gcacacacacacactc

SEQ ID NO: 410021 - DNA, 16 bp, M. musculus
gcacacacacacatgc

SEQ ID NO: 410022 - DNA, 16 bp, M. musculus
gcacacacacactcac

SEQ ID NO: 410023 - DNA, 16 bp, M. musculus
gcacacacacagacac

SEQ ID NO: 410024 - DNA, 16 bp, M. musculus
gcacacacacatgcac

SEQ ID NO: 410025 - DNA, 16 bp, M. musculus
gcacacacacgcacgc

SEQ ID NO: 410026 - DNA, 16 bp, M. musculus
gcacacacagacagac

SEQ ID NO: 410027 - DNA, 16 bp, M. musculus
gcacacacaggctcac

SEQ ID NO: 410028 - DNA, 16 bp, M. musculus
gcacacacatacacac

SEQ ID NO: 410029 - DNA, 16 bp, M. musculus
gcacacacatagacac

SEQ ID NO: 410030 - DNA, 16 bp, M. musculus
gcacacacatgataca

SEQ ID NO: 410031 - DNA, 16 bp, M. musculus
gcacacacatggtaca

SEQ ID NO: 410032 - DNA, 16 bp, M. musculus
gcacacaccagcagct

SEQ ID NO: 410033 - DNA, 16 bp, M. musculus
gcacacacctctgatc

SEQ ID NO: 410034 - DNA, 16 bp, M. musculus
gcacacacctttcatc

SEQ ID NO: 410035 - DNA, 16 bp, M. musculus
gcacacacgcacacac

SEQ ID NO: 410036 - DNA, 16 bp, M. musculus
gcacacacgcacgcac

SEQ ID NO: 410037 - DNA, 16 bp, M. musculus
gcacacacgcgcgcgc

SEQ ID NO: 410038 - DNA, 16 bp, M. musculus
gcacacactcacacac

SEQ ID NO: 410039 - DNA, 16 bp, M. musculus
gcacacacttgcacac

SEQ ID NO: 410040 - DNA, 16 bp, M. musculus
gcacacagacacatac

SEQ ID NO: 410041 - DNA, 16 bp, M. musculus
gcacacagcacagctg

SEQ ID NO: 410042 - DNA, 16 bp, M. musculus
gcacacagcagcagca

SEQ ID NO: 410043 - DNA, 16 bp, M. musculus
gcacacagccatctgt

SEQ ID NO: 410044 - DNA, 16 bp, M. musculus
gcacacagtaggtgct

SEQ ID NO: 410045 - DNA, 16 bp, M. musculus
gcacacatacacacat

SEQ ID NO: 410046 - DNA, 16 bp, M. musculus
gcacacatataccaca

SEQ ID NO: 410047 - DNA, 16 bp, M. musculus
gcacacatctgtaatc

SEQ ID NO: 410048 - DNA, 16 bp, M. musculus
gcacacatgaacacat

SEQ ID NO: 410049 - DNA, 16 bp, M. musculus
gcacacatgcacacat

SEQ ID NO: 410050 - DNA, 16 bp, M. musculus
gcacacatgcgcacac

SEQ ID NO: 410051 - DNA, 16 bp, M. musculus
gcacacatgtgagtgt

SEQ ID NO: 410052 - DNA, 16 bp, M. musculus
gcacacatgtgtgcac

SEQ ID NO: 410053 - DNA, 16 bp, M. musculus
gcacacattccagagg

SEQ ID NO: 410054 - DNA, 16 bp, M. musculus
gcacaccataacatca

SEQ ID NO: 410055 - DNA, 16 bp, M. musculus
gcacacccttaatccc

SEQ ID NO: 410056 - DNA, 16 bp, M. musculus
gcacacctgagagctc

SEQ ID NO: 410057 - DNA, 16 bp, M. musculus
gcacacctggctattg

SEQ ID NO: 410058 - DNA, 16 bp, M. musculus
gcacacctgtcatccc

SEQ ID NO: 410059 - DNA, 16 bp, M. musculus
gcacacctgtgagaga

SEQ ID NO: 410060 - DNA, 20 bp, M. musculus
gcacacctttaatctcagca

SEQ ID NO: 410061 - DNA, 16 bp, M. musculus
gcacaccttttatccc

SEQ ID NO: 410062 - DNA, 16 bp, M. musculus
gcacacgcacacacac

SEQ ID NO: 410063 - DNA, 16 bp, M. musculus
gcacacgcgcgcgcgc

SEQ ID NO: 410064 - DNA, 16 bp, M. musculus
gcacacgctcacacac

SEQ ID NO: 410065 - DNA, 16 bp, M. musculus
gcacacgtgcacacac

SEQ ID NO: 410066 - DNA, 16 bp, M. musculus
gcacactaggcaagca

SEQ ID NO: 410067 - DNA, 16 bp, M. musculus
gcacactcacactcac

SEQ ID NO: 410068 - DNA, 16 bp, M. musculus
gcacactcactcacac

SEQ ID NO: 410069 - DNA, 16 bp, M. musculus
gcacactgagccatct

SEQ ID NO: 410070 - DNA, 16 bp, M. musculus
gcacactgtcctctga

SEQ ID NO: 410071 - DNA, 16 bp, M. musculus
gcacagaactaaacag

SEQ ID NO: 410072 - DNA, 16 bp, M. musculus
gcacagaattactgca

SEQ ID NO: 410073 - DNA, 16 bp, M. musculus
gcacagacagacacac

SEQ ID NO: 410074 - DNA, 16 bp, M. musculus
gcacagacagacagac

SEQ ID NO: 410075 - DNA, 16 bp, M. musculus
gcacagacaggcagat

SEQ ID NO: 410076 - DNA, 16 bp, M. musculus
gcacagacatacatgt

SEQ ID NO: 410077 - DNA, 16 bp, M. musculus
gcacagactgaaagac

SEQ ID NO: 410078 - DNA, 16 bp, M. musculus
gcacagagacaggcag

SEQ ID NO: 410079 - DNA, 16 bp, M. musculus
gcacagagagagagag

SEQ ID NO: 410080 - DNA, 16 bp, M. musculus
gcacagaggacattta

SEQ ID NO: 410081 - DNA, 16 bp, M. musculus
gcacagaggctgtgtt

SEQ ID NO: 410082 - DNA, 16 bp, M. musculus
gcacagatgtgtgtgt

SEQ ID NO: 410083 - DNA, 16 bp, M. musculus
gcacagcacagcgcag

SEQ ID NO: 410084 - DNA, 16 bp, M. musculus
gcacagcagaagccag

SEQ ID NO: 410085 - DNA, 16 bp, M. musculus
gcacagcagaggccag

SEQ ID NO: 410086 - DNA, 16 bp, M. musculus
gcacagcagcaggcag

SEQ ID NO: 410087 - DNA, 16 bp, M. musculus
gcacagcaggtggctc

SEQ ID NO: 410088 - DNA, 16 bp, M. musculus
gcacagccctcagaca

SEQ ID NO: 410089 - DNA, 16 bp, M. musculus
gcacagctgctgtgag

SEQ ID NO: 410090 - DNA, 29 bp, M. musculus
gcacaggaaggcaggcatctctggttgta

SEQ ID NO: 410091 - DNA, 16 bp, M. musculus
gcacaggagaaatttt

SEQ ID NO: 410092 - DNA, 16 bp, M. musculus
gcacaggaggagctga

SEQ ID NO: 410093 - DNA, 16 bp, M. musculus
gcacaggcagagcctc

SEQ ID NO: 410094 - DNA, 16 bp, M. musculus
gcacaggcaggaggat

SEQ ID NO: 410095 - DNA, 16 bp, M. musculus
gcacaggcctgcaatc

SEQ ID NO: 410096 - DNA, 16 bp, M. musculus
gcacaggctggcctgg

SEQ ID NO: 410097 - DNA, 16 bp, M. musculus
gcacaggctggccttg

SEQ ID NO: 410098 - DNA, 16 bp, M. musculus
gcacagggacacacac

SEQ ID NO: 410099 - DNA, 16 bp, M. musculus
gcacagggtcagctct

SEQ ID NO: 410100 - DNA, 18 bp, M. musculus
gcacagggtccccaatgg

SEQ ID NO: 410101 - DNA, 16 bp, M. musculus
gcacagtgcctggcac

SEQ ID NO: 410102 - DNA, 16 bp, M. musculus
gcacagtgcttgccta

SEQ ID NO: 410103 - DNA, 16 bp, M. musculus
gcacagtggtctgcac

SEQ ID NO: 410104 - DNA, 16 bp, M. musculus
gcacagtggtgcacac

SEQ ID NO: 410105 - DNA, 16 bp, M. musculus
gcacagtggttctcaa

SEQ ID NO: 410106 - DNA, 16 bp, M. musculus
gcacagttcactttct

SEQ ID NO: 410107 - DNA, 16 bp, M. musculus
gcacagtttgtacact

SEQ ID NO: 410108 - DNA, 16 bp, M. musculus
gcacatacacaggcac

SEQ ID NO: 410109 - DNA, 16 bp, M. musculus
gcacatacacatgcac

SEQ ID NO: 410110 - DNA, 16 bp, M. musculus
gcacatacacatgcat

SEQ ID NO: 410111 - DNA, 16 bp, M. musculus
gcacatacccacacac

SEQ ID NO: 410112 - DNA, 16 bp, M. musculus
gcacatacctgtaatt

SEQ ID NO: 410113 - DNA, 16 bp, M. musculus
gcacatagtaggtatt

SEQ ID NO: 410114 - DNA, 16 bp, M. musculus
gcacatagtaggtgct

SEQ ID NO: 410115 - DNA, 16 bp, M. musculus
gcacatatatatatat

SEQ ID NO: 410116 - DNA, 16 bp, M. musculus
gcacatatgtgtgcat

SEQ ID NO: 410117 - DNA, 16 bp, M. musculus
gcacatcacacacaca

SEQ ID NO: 410118 - DNA, 16 bp, M. musculus
gcacatcccattttgc

SEQ ID NO: 410119 - DNA, 16 bp, M. musculus
gcacatcctatcctgc

SEQ ID NO: 410120 - DNA, 16 bp, M. musculus
gcacatctgtgatcca

SEQ ID NO: 410121 - DNA, 16 bp, M. musculus
gcacatgcacacacac

SEQ ID NO: 410122 - DNA, 16 bp, M. musculus
gcacatgcacagatta

SEQ ID NO: 410123 - DNA, 16 bp, M. musculus
gcacatgcacgcacac

SEQ ID NO: 410124 - DNA, 16 bp, M. musculus
gcacatgccttcaatc

SEQ ID NO: 410125 - DNA, 16 bp, M. musculus
gcacatggcatgatcc

SEQ ID NO: 410126 - DNA, 16 bp, M. musculus
gcacatggtgcacaga

SEQ ID NO: 410127 - DNA, 17 bp, M. musculus
gcacatggtggctcaca

SEQ ID NO: 410128 - DNA, 16 bp, M. musculus
gcacatgtgcacatgt

SEQ ID NO: 410129 - DNA, 16 bp, M. musculus
gcacatgtggagatca

SEQ ID NO: 410130 - DNA, 19 bp, M. musculus
gcacatgtggcttcccaca

SEQ ID NO: 410131 - DNA, 16 bp, M. musculus
gcacatgtgtgcatgc

SEQ ID NO: 410132 - DNA, 16 bp, M. musculus
gcacatttaaaaaaaa

SEQ ID NO: 410133 - DNA, 16 bp, M. musculus
gcacatttttcatcca

SEQ ID NO: 410134 - DNA, 16 bp, M. musculus
gcaccaagtgctcttc

SEQ ID NO: 410135 - DNA, 16 bp, M. musculus
gcaccaccacacctgc

SEQ ID NO: 410136 - DNA, 16 bp, M. musculus
gcaccaccacagccag

SEQ ID NO: 410137 - DNA, 16 bp, M. musculus
gcaccaccacagcctg

SEQ ID NO: 410138 - DNA, 16 bp, M. musculus
gcaccaccaccacctg

SEQ ID NO: 410139 - DNA, 16 bp, M. musculus
gcaccaccacctcctg

SEQ ID NO: 410140 - DNA, 16 bp, M. musculus
gcaccaccactgccag

SEQ ID NO: 410141 - DNA, 16 bp, M. musculus
gcaccaccactgccct

SEQ ID NO: 410142 - DNA, 16 bp, M. musculus
gcaccaccagaaccca

SEQ ID NO: 410143 - DNA, 16 bp, M. musculus
gcaccaccatcaccac

SEQ ID NO: 410144 - DNA, 16 bp, M. musculus
gcaccaccattcccag

SEQ ID NO: 410145 - DNA, 16 bp, M. musculus
gcaccactaccacctg

SEQ ID NO: 410146 - DNA, 16 bp, M. musculus
gcaccactatgcctgg

SEQ ID NO: 410147 - DNA, 16 bp, M. musculus
gcaccactgttgcctt

SEQ ID NO: 410148 - DNA, 16 bp, M. musculus
gcaccagaagaaggca

SEQ ID NO: 410149 - DNA, 16 bp, M. musculus
gcaccagaagaggatg

SEQ ID NO: 410150 - DNA, 16 bp, M. musculus
gcaccagatgccctgg

SEQ ID NO: 410151 - DNA, 16 bp, M. musculus
gcaccagcacagagcc

SEQ ID NO: 410152 - DNA, 16 bp, M. musculus
gcaccagcaccagggc

SEQ ID NO: 410153 - DNA, 16 bp, M. musculus
gcaccaggaagtgaaa

SEQ ID NO: 410154 - DNA, 16 bp, M. musculus
gcaccaggaagtggaa

SEQ ID NO: 410155 - DNA, 16 bp, M. musculus
gcaccaggaggcagag

SEQ ID NO: 410156 - DNA, 16 bp, M. musculus
gcaccaggcacacaca

SEQ ID NO: 410157 - DNA, 16 bp, M. musculus
gcaccagggaggcaga

SEQ ID NO: 410158 - DNA, 16 bp, M. musculus
gcaccaggtacacatg

SEQ ID NO: 410159 - DNA, 16 bp, M. musculus
gcaccaggtggaggca

SEQ ID NO: 410160 - DNA, 16 bp, M. musculus
gcaccaggtggctcag

SEQ ID NO: 410161 - DNA, 16 bp, M. musculus
gcaccatgacagcctg

SEQ ID NO: 410162 - DNA, 16 bp, M. musculus
gcaccatgatcaaggc

SEQ ID NO: 410163 - DNA, 16 bp, M. musculus
gcaccatgatgctggc

SEQ ID NO: 410164 - DNA, 16 bp, M. musculus
gcaccatgcctacctg

SEQ ID NO: 410165 - DNA, 16 bp, M. musculus
gcaccatgcctgcatg

SEQ ID NO: 410166 - DNA, 16 bp, M. musculus
gcaccatgccttcctg

SEQ ID NO: 410167 - DNA, 20 bp, M. musculus
gcaccatgtggttgctggga

SEQ ID NO: 410168 - DNA, 16 bp, M. musculus
gcaccattccctaggc

SEQ ID NO: 410169 - DNA, 16 bp, M. musculus
gcaccatttttgaaaa

SEQ ID NO: 410170 - DNA, 16 bp, M. musculus
gcacccaaagaaacat

SEQ ID NO: 410171 - DNA, 16 bp, M. musculus
gcacccaaagaggttc

SEQ ID NO: 410172 - DNA, 16 bp, M. musculus
gcacccacacagtgac

SEQ ID NO: 410173 - DNA, 16 bp, M. musculus
gcacccacatgaaagc

SEQ ID NO: 410174 - DNA, 16 bp, M. musculus
gcacccacatggtgga

SEQ ID NO: 410175 - DNA, 16 bp, M. musculus
gcacccagagctgatc

SEQ ID NO: 410176 - DNA, 16 bp, M. musculus
gcaccccctggagtca

SEQ ID NO: 410177 - DNA, 16 bp, M. musculus
gcaccctcacacacac

SEQ ID NO: 410178 - DNA, 16 bp, M. musculus
gcaccctctcaggagc

SEQ ID NO: 410179 - DNA, 16 bp, M. musculus
gcaccgcaccgcaccg

SEQ ID NO: 410180 - DNA, 16 bp, M. musculus
gcaccgccatgcctgg

SEQ ID NO: 410181 - DNA, 16 bp, M. musculus
gcaccgggcagtggtg

SEQ ID NO: 410182 - DNA, 16 bp, M. musculus
gcaccgtctgctcttc

SEQ ID NO: 410183 - DNA, 16 bp, M. musculus
gcaccgtgtctgcctg

SEQ ID NO: 410184 - DNA, 16 bp, M. musculus
gcacctacatggtggc

SEQ ID NO: 410185 - DNA, 16 bp, M. musculus
gcacctagacctataa

SEQ ID NO: 410186 - DNA, 16 bp, M. musculus
gcacctcatggaactt

SEQ ID NO: 410187 - DNA, 16 bp, M. musculus
gcacctccagcaacac

SEQ ID NO: 410188 - DNA, 16 bp, M. musculus
gcacctcccacagtgg

SEQ ID NO: 410189 - DNA, 16 bp, M. musculus
gcacctgaaaaaattt

SEQ ID NO: 410190 - DNA, 16 bp, M. musculus
gcacctgagattcctg

SEQ ID NO: 410191 - DNA, 16 bp, M. musculus
gcacctgagattctcc

SEQ ID NO: 410192 - DNA, 16 bp, M. musculus
gcacctgcacacacac

SEQ ID NO: 410193 - DNA, 16 bp, M. musculus
gcacctgcacatacat

SEQ ID NO: 410194 - DNA, 16 bp, M. musculus
gcacctgcacctgcac

SEQ ID NO: 410195 - DNA, 16 bp, M. musculus
gcacctgggactttct

SEQ ID NO: 410196 - DNA, 16 bp, M. musculus
gcacctgggagagcca

SEQ ID NO: 410197 - DNA, 16 bp, M. musculus
gcaccttccatgcaag

SEQ ID NO: 410198 - DNA, 16 bp, M. musculus
gcaccttccatgccag

SEQ ID NO: 410199 - DNA, 16 bp, M. musculus
gcaccttcccctccag

SEQ ID NO: 410200 - DNA, 16 bp, M. musculus
gcaccttctgtttcta

SEQ ID NO: 410201 - DNA, 16 bp, M. musculus
gcaccttgacaacaca

SEQ ID NO: 410202 - DNA, 16 bp, M. musculus
gcaccttgcctgcctg

SEQ ID NO: 410203 - DNA, 16 bp, M. musculus
gcacctttaccctctg

SEQ ID NO: 410204 - DNA, 16 bp, M. musculus
gcacctttacctgctg

SEQ ID NO: 410205 - DNA, 16 bp, M. musculus
gcacctttatttttct

SEQ ID NO: 410206 - DNA, 16 bp, M. musculus
gcacctttccccactg

SEQ ID NO: 410207 - DNA, 16 bp, M. musculus
gcacgcacacacgcac

SEQ ID NO: 410208 - DNA, 16 bp, M. musculus
gcacgcacgcacacac

SEQ ID NO: 410209 - DNA, 16 bp, M. musculus
gcacgcacgcacgcac

SEQ ID NO: 410210 - DNA, 16 bp, M. musculus
gcacgcacgcacgcgc

SEQ ID NO: 410211 - DNA, 16 bp, M. musculus
gcacgcacgcacgtac

SEQ ID NO: 410212 - DNA, 16 bp, M. musculus
gcacgcacgcactcac

SEQ ID NO: 410213 - DNA, 16 bp, M. musculus
gcacgcacgcgcacac

SEQ ID NO: 410214 - DNA, 16 bp, M. musculus
gcacgcatgtggtgca

SEQ ID NO: 410215 - DNA, 20 bp, M. musculus
gcacgcctttaatgccagca

SEQ ID NO: 410216 - DNA, 16 bp, M. musculus
gcacgcgcacgcacgc

SEQ ID NO: 410217 - DNA, 16 bp, M. musculus
gcacgcgcacgcgcac

SEQ ID NO: 410218 - DNA, 16 bp, M. musculus
gcacgtggaaggcaga

SEQ ID NO: 410219 - DNA, 16 bp, M. musculus
gcactaaggaagcaga

SEQ ID NO: 410220 - DNA, 16 bp, M. musculus
gcactaagtgccctca

SEQ ID NO: 410221 - DNA, 16 bp, M. musculus
gcactactgggaggtg

SEQ ID NO: 410222 - DNA, 16 bp, M. musculus
gcactattgggaggtg

SEQ ID NO: 410223 - DNA, 16 bp, M. musculus
gcactcaaacacacac

SEQ ID NO: 410224 - DNA, 16 bp, M. musculus
gcactcacatggtaca

SEQ ID NO: 410225 - DNA, 16 bp, M. musculus
gcactcacgtgcacat

SEQ ID NO: 410226 - DNA, 16 bp, M. musculus
gcactcactgcctttg

SEQ ID NO: 410227 - DNA, 16 bp, M. musculus
gcactcagaaggcaaa

SEQ ID NO: 410228 - DNA, 16 bp, M. musculus
gcactcagaattctca

SEQ ID NO: 410229 - DNA, 16 bp, M. musculus
gcactcaggacgcaga

SEQ ID NO: 410230 - DNA, 16 bp, M. musculus
gcactcaggagacagg

SEQ ID NO: 410231 - DNA, 16 bp, M. musculus
gcactcaggagagcag

SEQ ID NO: 410232 - DNA, 17 bp, M. musculus
gcactcaggaggctaag

SEQ ID NO: 410233 - DNA, 16 bp, M. musculus
gcactcatgagctcac

SEQ ID NO: 410234 - DNA, 16 bp, M. musculus
gcactcctccacagcc

SEQ ID NO: 410235 - DNA, 16 bp, M. musculus
gcactcctgtgtggct

SEQ ID NO: 410236 - DNA, 16 bp, M. musculus
gcactctctgcagaca

SEQ ID NO: 410237 - DNA, 16 bp, M. musculus
gcactctgcatcttat

SEQ ID NO: 410238 - DNA, 16 bp, M. musculus
gcactctggagaggca

SEQ ID NO: 410239 - DNA, 16 bp, M. musculus
gcactgaagaggctga

SEQ ID NO: 410240 - DNA, 16 bp, M. musculus
gcactgagaaggcaga

SEQ ID NO: 410241 - DNA, 17 bp, M. musculus
gcactgaggaggcagaa

SEQ ID NO: 410242 - DNA, 16 bp, M. musculus
gcactgagggacagta

SEQ ID NO: 410243 - DNA, 16 bp, M. musculus
gcactgattgctcttg

SEQ ID NO: 410244 - DNA, 16 bp, M. musculus
gcactgattgcttttc

SEQ ID NO: 410245 - DNA, 16 bp, M. musculus
gcactgcacacacaca

SEQ ID NO: 410246 - DNA, 16 bp, M. musculus
gcactgcagaggcaga

SEQ ID NO: 410247 - DNA, 16 bp, M. musculus
gcactgcagaggcagg

SEQ ID NO: 410248 - DNA, 16 bp, M. musculus
gcactgcagtagaaag

SEQ ID NO: 410249 - DNA, 16 bp, M. musculus
gcactgcctcagaagc

SEQ ID NO: 410250 - DNA, 16 bp, M. musculus
gcactgcctgcctccc

SEQ ID NO: 410251 - DNA, 16 bp, M. musculus
gcactgctgctcttcc

SEQ ID NO: 410252 - DNA, 16 bp, M. musculus
gcactgctttctttgt

SEQ ID NO: 410253 - DNA, 16 bp, M. musculus
gcactggagaagtagc

SEQ ID NO: 410254 - DNA, 16 bp, M. musculus
gcactggagaggcaga

SEQ ID NO: 410255 - DNA, 16 bp, M. musculus
gcactggagaggctga

SEQ ID NO: 410256 - DNA, 16 bp, M. musculus
gcactggagcagcagc

SEQ ID NO: 410257 - DNA, 16 bp, M. musculus
gcactggcagagcttc

SEQ ID NO: 410258 - DNA, 16 bp, M. musculus
gcactggccgctcttc

SEQ ID NO: 410259 - DNA, 17 bp, M. musculus
gcactggctactgctgg

SEQ ID NO: 410260 - DNA, 16 bp, M. musculus
gcactggctgcccttg

SEQ ID NO: 410261 - DNA, 16 bp, M. musculus
gcactggctgctctgg

SEQ ID NO: 410262 - DNA, 16 bp, M. musculus
gcactggctgctcttg

SEQ ID NO: 410263 - DNA, 16 bp, M. musculus
gcactggcttctcttc

SEQ ID NO: 410264 - DNA, 16 bp, M. musculus
gcactgggaggagcta

SEQ ID NO: 410265 - DNA, 16 bp, M. musculus
gcactgggaggctgag

SEQ ID NO: 410266 - DNA, 16 bp, M. musculus
gcactgggaggtggag

SEQ ID NO: 410267 - DNA, 16 bp, M. musculus
gcactgggcactgggc

SEQ ID NO: 410268 - DNA, 16 bp, M. musculus
gcactgggcatggtgg

SEQ ID NO: 410269 - DNA, 22 bp, M. musculus
gcactgggcgactctgtgcctc

SEQ ID NO: 410270 - DNA, 16 bp, M. musculus
gcactggggaagcaga

SEQ ID NO: 410271 - DNA, 16 bp, M. musculus
gcactggggctggaga

SEQ ID NO: 410272 - DNA, 16 bp, M. musculus
gcactgtggcatgtgt

SEQ ID NO: 410273 - DNA, 16 bp, M. musculus
gcactgtgtgtgtgtg

SEQ ID NO: 410274 - DNA, 16 bp, M. musculus
gcactgtttgggaagg

SEQ ID NO: 410275 - DNA, 16 bp, M. musculus
gcacttccttgggact

SEQ ID NO: 410276 - DNA, 16 bp, M. musculus
gcacttctgaaggtcc

SEQ ID NO: 410277 - DNA, 16 bp, M. musculus
gcacttgagagacaga

SEQ ID NO: 410278 - DNA, 16 bp, M. musculus
gcacttgggaaacagg

SEQ ID NO: 410279 - DNA, 16 bp, M. musculus
gcacttgggaaactga

SEQ ID NO: 410280 - DNA, 16 bp, M. musculus
gcacttgggaggcaca

SEQ ID NO: 410281 - DNA, 16 bp, M. musculus
gcacttgggaggcata

SEQ ID NO: 410282 - DNA, 16 bp, M. musculus
gcacttgggaggccag

SEQ ID NO: 410283 - DNA, 16 bp, M. musculus
gcacttgtaataaagc

SEQ ID NO: 410284 - DNA, 16 bp, M. musculus
gcacttgtcactactg

SEQ ID NO: 410285 - DNA, 16 bp, M. musculus
gcacttgtgaggtaga

SEQ ID NO: 410286 - DNA, 16 bp, M. musculus
gcacttgttgctcttg

SEQ ID NO: 410287 - DNA, 16 bp, M. musculus
gcagaaaaaaatggaa

SEQ ID NO: 410288 - DNA, 16 bp, M. musculus
gcagaaaaagtatttg

SEQ ID NO: 410289 - DNA, 16 bp, M. musculus
gcagaaaaataagtaa

SEQ ID NO: 410290 - DNA, 16 bp, M. musculus
gcagaaaatgaaggaa

SEQ ID NO: 410291 - DNA, 16 bp, M. musculus
gcagaaacaaccagca

SEQ ID NO: 410292 - DNA, 16 bp, M. musculus
gcagaaacagaagcag

SEQ ID NO: 410293 - DNA, 16 bp, M. musculus
gcagaaacagcagcaa

SEQ ID NO: 410294 - DNA, 16 bp, M. musculus
gcagaaacaggaagtg

SEQ ID NO: 410295 - DNA, 16 bp, M. musculus
gcagaaaccacagagg

SEQ ID NO: 410296 - DNA, 16 bp, M. musculus
gcagaaacccagaggc

SEQ ID NO: 410297 - DNA, 16 bp, M. musculus
gcagaaactcaaggca

SEQ ID NO: 410298 - DNA, 16 bp, M. musculus
gcagaaactgaaacag

SEQ ID NO: 410299 - DNA, 16 bp, M. musculus
gcagaaactgcttccc

SEQ ID NO: 410300 - DNA, 16 bp, M. musculus
gcagaaaggatggaaa

SEQ ID NO: 410301 - DNA, 16 bp, M. musculus
gcagaaaggccagaga

SEQ ID NO: 410302 - DNA, 16 bp, M. musculus
gcagaaagtggatgag

SEQ ID NO: 410303 - DNA, 16 bp, M. musculus
gcagaaataatggaaa

SEQ ID NO: 410304 - DNA, 16 bp, M. musculus
gcagaaatcatggagg

SEQ ID NO: 410305 - DNA, 16 bp, M. musculus
gcagaaatgactcaga

SEQ ID NO: 410306 - DNA, 16 bp, M. musculus
gcagaacctctcaggg

SEQ ID NO: 410307 - DNA, 16 bp, M. musculus
gcagaacctgaaggaa

SEQ ID NO: 410308 - DNA, 16 bp, M. musculus
gcagaactatcagaat

SEQ ID NO: 410309 - DNA, 16 bp, M. musculus
gcagaactgagtgact

SEQ ID NO: 410310 - DNA, 16 bp, M. musculus
gcagaactgggagact

SEQ ID NO: 410311 - DNA, 16 bp, M. musculus
gcagaagacggcctag

SEQ ID NO: 410312 - DNA, 16 bp, M. musculus
gcagaagagagaacag

SEQ ID NO: 410313 - DNA, 16 bp, M. musculus
gcagaagagagatagg

SEQ ID NO: 410314 - DNA, 16 bp, M. musculus
gcagaagagaggcagg

SEQ ID NO: 410315 - DNA, 16 bp, M. musculus
gcagaagaggaggcag

SEQ ID NO: 410316 - DNA, 16 bp, M. musculus
gcagaagaggaggtga

SEQ ID NO: 410317 - DNA, 16 bp, M. musculus
gcagaagaggaggtgg

SEQ ID NO: 410318 - DNA, 16 bp, M. musculus
gcagaagaggcagaag

SEQ ID NO: 410319 - DNA, 16 bp, M. musculus
gcagaagagggcagag

SEQ ID NO: 410320 - DNA, 16 bp, M. musculus
gcagaagagggcatca

SEQ ID NO: 410321 - DNA, 16 bp, M. musculus
gcagaagataccatag

SEQ ID NO: 410322 - DNA, 16 bp, M. musculus
gcagaagatgaaggcc

SEQ ID NO: 410323 - DNA, 16 bp, M. musculus
gcagaagatggcctca

SEQ ID NO: 410324 - DNA, 16 bp, M. musculus
gcagaagcaagagggt

SEQ ID NO: 410325 - DNA, 16 bp, M. musculus
gcagaagcacaaagcc

SEQ ID NO: 410326 - DNA, 16 bp, M. musculus
gcagaagcagaaagct

SEQ ID NO: 410327 - DNA, 16 bp, M. musculus
gcagaagcagaagcag

SEQ ID NO: 410328 - DNA, 16 bp, M. musculus
gcagaagcagaggcag

SEQ ID NO: 410329 - DNA, 16 bp, M. musculus
gcagaagcagcaacag

SEQ ID NO: 410330 - DNA, 16 bp, M. musculus
gcagaagcaggagcag

SEQ ID NO: 410331 - DNA, 16 bp, M. musculus
gcagaagcaggaggat

SEQ ID NO: 410332 - DNA, 16 bp, M. musculus
gcagaagcaggcaaat

SEQ ID NO: 410333 - DNA, 16 bp, M. musculus
gcagaagcaggtggct

SEQ ID NO: 410334 - DNA, 16 bp, M. musculus
gcagaagcatacactg

SEQ ID NO: 410335 - DNA, 16 bp, M. musculus
gcagaagccacagagc

SEQ ID NO: 410336 - DNA, 16 bp, M. musculus
gcagaagccagagacc

SEQ ID NO: 410337 - DNA, 16 bp, M. musculus
gcagaagccatagagg

SEQ ID NO: 410338 - DNA, 16 bp, M. musculus
gcagaagccatggagg

SEQ ID NO: 410339 - DNA, 16 bp, M. musculus
gcagaagcccttaaag

SEQ ID NO: 410340 - DNA, 16 bp, M. musculus
gcagaagccgtggagg

SEQ ID NO: 410341 - DNA, 16 bp, M. musculus
gcagaagctgaggcag

SEQ ID NO: 410342 - DNA, 16 bp, M. musculus
gcagaagctggtggat

SEQ ID NO: 410343 - DNA, 16 bp, M. musculus
gcagaagctttgtaat

SEQ ID NO: 410344 - DNA, 16 bp, M. musculus
gcagaaggattgtaag

SEQ ID NO: 410345 - DNA, 16 bp, M. musculus
gcagaaggccctgggt

SEQ ID NO: 410346 - DNA, 16 bp, M. musculus
gcagaaggtggagaga

SEQ ID NO: 410347 - DNA, 16 bp, M. musculus
gcagaagtcagaggcc

SEQ ID NO: 410348 - DNA, 16 bp, M. musculus
gcagaagtcagttctc

SEQ ID NO: 410349 - DNA, 16 bp, M. musculus
gcagaagtgacacagc

SEQ ID NO: 410350 - DNA, 16 bp, M. musculus
gcagaagtggaattag

SEQ ID NO: 410351 - DNA, 16 bp, M. musculus
gcagaagtggcaagaa

SEQ ID NO: 410352 - DNA, 16 bp, M. musculus
gcagaagtggtggtgt

SEQ ID NO: 410353 - DNA, 16 bp, M. musculus
gcagaagtgtgtgtgt

SEQ ID NO: 410354 - DNA, 16 bp, M. musculus
gcagaagttgtattcc

SEQ ID NO: 410355 - DNA, 16 bp, M. musculus
gcagaatattggcttc

SEQ ID NO: 410356 - DNA, 16 bp, M. musculus
gcagaatgtaaagtga

SEQ ID NO: 410357 - DNA, 16 bp, M. musculus
gcagaattcctccatg

SEQ ID NO: 410358 - DNA, 16 bp, M. musculus
gcagaattctatcaaa

SEQ ID NO: 410359 - DNA, 16 bp, M. musculus
gcagacaagctgatga

SEQ ID NO: 410360 - DNA, 16 bp, M. musculus
gcagacaagctggtga

SEQ ID NO: 410361 - DNA, 16 bp, M. musculus
gcagacaaggagaaga

SEQ ID NO: 410362 - DNA, 16 bp, M. musculus
gcagacacaggcagat

SEQ ID NO: 410363 - DNA, 16 bp, M. musculus
gcagacacagtgctgg

SEQ ID NO: 410364 - DNA, 16 bp, M. musculus
gcagacacccccacag

SEQ ID NO: 410365 - DNA, 16 bp, M. musculus
gcagacactattgcat

SEQ ID NO: 410366 - DNA, 18 bp, M. musculus
gcagacagacagacagaa

SEQ ID NO: 410367 - DNA, 16 bp, M. musculus
gcagacagacaggagc

SEQ ID NO: 410368 - DNA, 16 bp, M. musculus
gcagacaggagaagac

SEQ ID NO: 410369 - DNA, 16 bp, M. musculus
gcagacaggagagctg

SEQ ID NO: 410370 - DNA, 16 bp, M. musculus
gcagacaggcagacaa

SEQ ID NO: 410371 - DNA, 16 bp, M. musculus
gcagacagggaccaaa

SEQ ID NO: 410372 - DNA, 16 bp, M. musculus
gcagacatgcccacag

SEQ ID NO: 410373 - DNA, 16 bp, M. musculus
gcagacatggcactgg

SEQ ID NO: 410374 - DNA, 16 bp, M. musculus
gcagacatggtgctga

SEQ ID NO: 410375 - DNA, 16 bp, M. musculus
gcagaccacatgaagc

SEQ ID NO: 410376 - DNA, 16 bp, M. musculus
gcagaccagtcctcta

SEQ ID NO: 410377 - DNA, 16 bp, M. musculus
gcagaccccttttcag

SEQ ID NO: 410378 - DNA, 16 bp, M. musculus
gcagacctgggagaca

SEQ ID NO: 410379 - DNA, 21 bp, M. musculus
gcagactaaattcctaagttc

SEQ ID NO: 410380 - DNA, 16 bp, M. musculus
gcagactacactggag

SEQ ID NO: 410381 - DNA, 16 bp, M. musculus
gcagactcaggagaga

SEQ ID NO: 410382 - DNA, 16 bp, M. musculus
gcagactctaagagaa

SEQ ID NO: 410383 - DNA, 16 bp, M. musculus
gcagactggagctgaa

SEQ ID NO: 410384 - DNA, 16 bp, M. musculus
gcagactgttgagaag

SEQ ID NO: 410385 - DNA, 16 bp, M. musculus
gcagactttattatac

SEQ ID NO: 410386 - DNA, 16 bp, M. musculus
gcagagaaacaggaag

SEQ ID NO: 410387 - DNA, 17 bp, M. musculus
gcagagaaaccctgtct

SEQ ID NO: 410388 - DNA, 16 bp, M. musculus
gcagagaacagagaag

SEQ ID NO: 410389 - DNA, 16 bp, M. musculus
gcagagaagaggaagc

SEQ ID NO: 410390 - DNA, 16 bp, M. musculus
gcagagaagctgctga

SEQ ID NO: 410391 - DNA, 16 bp, M. musculus
gcagagacaaagtttg

SEQ ID NO: 410392 - DNA, 16 bp, M. musculus
gcagagacaagaatga

SEQ ID NO: 410393 - DNA, 16 bp, M. musculus
gcagagacaagtggat

SEQ ID NO: 410394 - DNA, 16 bp, M. musculus
gcagagacagcaggat

SEQ ID NO: 410395 - DNA, 16 bp, M. musculus
gcagagacagccagat

SEQ ID NO: 410396 - DNA, 16 bp, M. musculus
gcagagacaggaggat

SEQ ID NO: 410397 - DNA, 16 bp, M. musculus
gcagagacaggaggct

SEQ ID NO: 410398 - DNA, 16 bp, M. musculus
gcagagacagggaaag

SEQ ID NO: 410399 - DNA, 16 bp, M. musculus
gcagagacaggtaaat

SEQ ID NO: 410400 - DNA, 16 bp, M. musculus
gcagagaccacagagg

SEQ ID NO: 410401 - DNA, 16 bp, M. musculus
gcagagaccacagcca

SEQ ID NO: 410402 - DNA, 16 bp, M. musculus
gcagagactgaaggag

SEQ ID NO: 410403 - DNA, 16 bp, M. musculus
gcagagactgaaggca

SEQ ID NO: 410404 - DNA, 16 bp, M. musculus
gcagagactgacagaa

SEQ ID NO: 410405 - DNA, 16 bp, M. musculus
gcagagactgagggga

SEQ ID NO: 410406 - DNA, 16 bp, M. musculus
gcagagactgggggaa

SEQ ID NO: 410407 - DNA, 16 bp, M. musculus
gcagagactgtgggaa

SEQ ID NO: 410408 - DNA, 16 bp, M. musculus
gcagagagaacaggaa

SEQ ID NO: 410409 - DNA, 16 bp, M. musculus
gcagagagaagccaga

SEQ ID NO: 410410 - DNA, 16 bp, M. musculus
gcagagagacacacag

SEQ ID NO: 410411 - DNA, 16 bp, M. musculus
gcagagagacaggcag

SEQ ID NO: 410412 - DNA, 16 bp, M. musculus
gcagagagagacagac

SEQ ID NO: 410413 - DNA, 16 bp, M. musculus
gcagagagagctctga

SEQ ID NO: 410414 - DNA, 16 bp, M. musculus
gcagagagaggagcag

SEQ ID NO: 410415 - DNA, 16 bp, M. musculus
gcagagagaggcagag

SEQ ID NO: 410416 - DNA, 16 bp, M. musculus
gcagagagatgcagag

SEQ ID NO: 410417 - DNA, 16 bp, M. musculus
gcagagagcagagaca

SEQ ID NO: 410418 - DNA, 16 bp, M. musculus
gcagagagcagagctg

SEQ ID NO: 410419 - DNA, 16 bp, M. musculus
gcagagaggaacagag

SEQ ID NO: 410420 - DNA, 16 bp, M. musculus
gcagagaggaggcaga

SEQ ID NO: 410421 - DNA, 16 bp, M. musculus
gcagagagtgaaggaa

SEQ ID NO: 410422 - DNA, 16 bp, M. musculus
gcagagatcctgagtt

SEQ ID NO: 410423 - DNA, 16 bp, M. musculus
gcagagatggctcagg

SEQ ID NO: 410424 - DNA, 16 bp, M. musculus
gcagagatggctgcac

SEQ ID NO: 410425 - DNA, 16 bp, M. musculus
gcagagatgggcagat

SEQ ID NO: 410426 - DNA, 16 bp, M. musculus
gcagagcaattcagtc

SEQ ID NO: 410427 - DNA, 16 bp, M. musculus
gcagagcacttgcctg

SEQ ID NO: 410428 - DNA, 16 bp, M. musculus
gcagagcagaatgggg

SEQ ID NO: 410429 - DNA, 16 bp, M. musculus
gcagagcagagagaag

SEQ ID NO: 410430 - DNA, 16 bp, M. musculus
gcagagcagagcaaag

SEQ ID NO: 410431 - DNA, 16 bp, M. musculus
gcagagcagagcagaa

SEQ ID NO: 410432 - DNA, 16 bp, M. musculus
gcagagcagatggcag

SEQ ID NO: 410433 - DNA, 16 bp, M. musculus
gcagagcagctaaggc

SEQ ID NO: 410434 - DNA, 16 bp, M. musculus
gcagagcaggaacctg

SEQ ID NO: 410435 - DNA, 16 bp, M. musculus
gcagagcagggcagag

SEQ ID NO: 410436 - DNA, 16 bp, M. musculus
gcagagcatcatggga

SEQ ID NO: 410437 - DNA, 16 bp, M. musculus
gcagagccagagccag

SEQ ID NO: 410438 - DNA, 16 bp, M. musculus
gcagagccagcagggc

SEQ ID NO: 410439 - DNA, 16 bp, M. musculus
gcagagccaggtggat

SEQ ID NO: 410440 - DNA, 16 bp, M. musculus
gcagagcccagaagag

SEQ ID NO: 410441 - DNA, 16 bp, M. musculus
gcagagcctaaaggaa

SEQ ID NO: 410442 - DNA, 16 bp, M. musculus
gcagagcctctcaaaa

SEQ ID NO: 410443 - DNA, 16 bp, M. musculus
gcagagcctcttggga

SEQ ID NO: 410444 - DNA, 16 bp, M. musculus
gcagagcctgaagaaa

SEQ ID NO: 410445 - DNA, 16 bp, M. musculus
gcagagccttgctgtt

SEQ ID NO: 410446 - DNA, 16 bp, M. musculus
gcagagcctttcagag

SEQ ID NO: 410447 - DNA, 16 bp, M. musculus
gcagagctgagctgag

SEQ ID NO: 410448 - DNA, 16 bp, M. musculus
gcagagctggaaaagt

SEQ ID NO: 410449 - DNA, 16 bp, M. musculus
gcagaggaagatggat

SEQ ID NO: 410450 - DNA, 16 bp, M. musculus
gcagaggaagccctga

SEQ ID NO: 410451 - DNA, 16 bp, M. musculus
gcagaggaaggtggat

SEQ ID NO: 410452 - DNA, 16 bp, M. musculus
gcagaggaccaggttt

SEQ ID NO: 410453 - DNA, 16 bp, M. musculus
gcagaggacccaggct

SEQ ID NO: 410454 - DNA, 16 bp, M. musculus
gcagaggacccaggtt

SEQ ID NO: 410455 - DNA, 16 bp, M. musculus
gcagaggacccagttt

SEQ ID NO: 410456 - DNA, 16 bp, M. musculus
gcagaggacctggttc

SEQ ID NO: 410457 - DNA, 16 bp, M. musculus
gcagaggactgttggg

SEQ ID NO: 410458 - DNA, 16 bp, M. musculus
gcagaggacttcctgg

SEQ ID NO: 410459 - DNA, 16 bp, M. musculus
gcagaggagacagagg

SEQ ID NO: 410460 - DNA, 16 bp, M. musculus
gcagaggaggagaaac

SEQ ID NO: 410461 - DNA, 16 bp, M. musculus
gcagaggaggcagaga

SEQ ID NO: 410462 - DNA, 16 bp, M. musculus
gcagaggaggtctgtg

SEQ ID NO: 410463 - DNA, 16 bp, M. musculus
gcagaggatccaggtt

SEQ ID NO: 410464 - DNA, 16 bp, M. musculus
gcagaggatgaccttg

SEQ ID NO: 410465 - DNA, 16 bp, M. musculus
gcagaggatggaggcc

SEQ ID NO: 410466 - DNA, 16 bp, M. musculus
gcagaggatggtctag

SEQ ID NO: 410467 - DNA, 16 bp, M. musculus
gcagaggcaaaaagac

SEQ ID NO: 410468 - DNA, 16 bp, M. musculus
gcagaggcaagaggag

SEQ ID NO: 410469 - DNA, 16 bp, M. musculus
gcagaggcaagcaggt

SEQ ID NO: 410470 - DNA, 16 bp, M. musculus
gcagaggcacaggcac

SEQ ID NO: 410471 - DNA, 16 bp, M. musculus
gcagaggcacaggcag

SEQ ID NO: 410472 - DNA, 16 bp, M. musculus
gcagaggcagaaggct

SEQ ID NO: 410473 - DNA, 16 bp, M. musculus
gcagaggcagaggaag

SEQ ID NO: 410474 - DNA, 16 bp, M. musculus
gcagaggcagaggtgg

SEQ ID NO: 410475 - DNA, 16 bp, M. musculus
gcagaggcagatggat

SEQ ID NO: 410476 - DNA, 16 bp, M. musculus
gcagaggcagcagatt

SEQ ID NO: 410477 - DNA, 16 bp, M. musculus
gcagaggcagcagcag

SEQ ID NO: 410478 - DNA, 16 bp, M. musculus
gcagaggcagccagat

SEQ ID NO: 410479 - DNA, 16 bp, M. musculus
gcagaggcagctgaag

SEQ ID NO: 410480 - DNA, 16 bp, M. musculus
gcagaggcaggaagaa

SEQ ID NO: 410481 - DNA, 16 bp, M. musculus
gcagaggcaggaagag

SEQ ID NO: 410482 - DNA, 16 bp, M. musculus
gcagaggcaggacgat

SEQ ID NO: 410483 - DNA, 16 bp, M. musculus
gcagaggcaggagact

SEQ ID NO: 410484 - DNA, 16 bp, M. musculus
gcagaggcaggaggat

SEQ ID NO: 410485 - DNA, 16 bp, M. musculus
gcagaggcaggcacag

SEQ ID NO: 410486 - DNA, 16 bp, M. musculus
gcagaggcaggcacat

SEQ ID NO: 410487 - DNA, 16 bp, M. musculus
gcagaggcaggcagag

SEQ ID NO: 410488 - DNA, 16 bp, M. musculus
gcagaggcaggcgggt

SEQ ID NO: 410489 - DNA, 18 bp, M. musculus
gcagaggcaggctgatct

SEQ ID NO: 410490 - DNA, 16 bp, M. musculus
gcagaggcaggtagct

SEQ ID NO: 410491 - DNA, 16 bp, M. musculus
gcagaggcaggtgggg

SEQ ID NO: 410492 - DNA, 16 bp, M. musculus
gcagaggcaggtgtat

SEQ ID NO: 410493 - DNA, 16 bp, M. musculus
gcagaggcagtggcag

SEQ ID NO: 410494 - DNA, 16 bp, M. musculus
gcagaggcagttggat

SEQ ID NO: 410495 - DNA, 16 bp, M. musculus
gcagaggccaaggagg

SEQ ID NO: 410496 - DNA, 16 bp, M. musculus
gcagaggccacaagag

SEQ ID NO: 410497 - DNA, 16 bp, M. musculus
gcagaggccacagagg

SEQ ID NO: 410498 - DNA, 16 bp, M. musculus
gcagaggccagaagag

SEQ ID NO: 410499 - DNA, 17 bp, M. musculus
gcagaggccagaagaga

SEQ ID NO: 410500 - DNA, 16 bp, M. musculus
gcagaggccagaggac

SEQ ID NO: 410501 - DNA, 16 bp, M. musculus
gcagaggccagaggca

SEQ ID NO: 410502 - DNA, 16 bp, M. musculus
gcagaggccagagggg

SEQ ID NO: 410503 - DNA, 16 bp, M. musculus
gcagaggccagatgag

SEQ ID NO: 410504 - DNA, 16 bp, M. musculus
gcagaggccagggagg

SEQ ID NO: 410505 - DNA, 16 bp, M. musculus
gcagaggccatcaagg

SEQ ID NO: 410506 - DNA, 16 bp, M. musculus
gcagaggccatcgagg

SEQ ID NO: 410507 - DNA, 16 bp, M. musculus
gcagaggccatggaga

SEQ ID NO: 410508 - DNA, 16 bp, M. musculus
gcagaggccatggatg

SEQ ID NO: 410509 - DNA, 16 bp, M. musculus
gcagaggccctggagg

SEQ ID NO: 410510 - DNA, 16 bp, M. musculus
gcagaggccgtggaga

SEQ ID NO: 410511 - DNA, 16 bp, M. musculus
gcagaggccgtggagg

SEQ ID NO: 410512 - DNA, 16 bp, M. musculus
gcagaggcgcagaggc

SEQ ID NO: 410513 - DNA, 16 bp, M. musculus
gcagaggcggcagagg

SEQ ID NO: 410514 - DNA, 16 bp, M. musculus
gcagaggctatggagg

SEQ ID NO: 410515 - DNA, 16 bp, M. musculus
gcagaggctgcaaggg

SEQ ID NO: 410516 - DNA, 16 bp, M. musculus
gcagaggctggaagag

SEQ ID NO: 410517 - DNA, 16 bp, M. musculus
gcagaggctggaggat

SEQ ID NO: 410518 - DNA, 16 bp, M. musculus
gcagaggctggcagat

SEQ ID NO: 410519 - DNA, 16 bp, M. musculus
gcagaggctgggggat

SEQ ID NO: 410520 - DNA, 16 bp, M. musculus
gcagaggctggtggat

SEQ ID NO: 410521 - DNA, 16 bp, M. musculus
gcagaggctgtggagg

SEQ ID NO: 410522 - DNA, 16 bp, M. musculus
gcagagggaaaaccag

SEQ ID NO: 410523 - DNA, 16 bp, M. musculus
gcagagggaggcggat

SEQ ID NO: 410524 - DNA, 16 bp, M. musculus
gcagagggatgaagat

SEQ ID NO: 410525 - DNA, 16 bp, M. musculus
gcagaggggaaacctg

SEQ ID NO: 410526 - DNA, 16 bp, M. musculus
gcagaggggcaggcag

SEQ ID NO: 410527 - DNA, 16 bp, M. musculus
gcagaggtaggtggat

SEQ ID NO: 410528 - DNA, 16 bp, M. musculus
gcagaggtagtggaaa

SEQ ID NO: 410529 - DNA, 16 bp, M. musculus
gcagaggtcagaggat

SEQ ID NO: 410530 - DNA, 16 bp, M. musculus
gcagaggtcctaaaag

SEQ ID NO: 410531 - DNA, 16 bp, M. musculus
gcagaggtggaggaaa

SEQ ID NO: 410532 - DNA, 16 bp, M. musculus
gcagaggttctcaacc

SEQ ID NO: 410533 - DNA, 16 bp, M. musculus
gcagagtaccttccta

SEQ ID NO: 410534 - DNA, 16 bp, M. musculus
gcagagtagagctggc

SEQ ID NO: 410535 - DNA, 16 bp, M. musculus
gcagagtctctcagga

SEQ ID NO: 410536 - DNA, 16 bp, M. musculus
gcagagtggggagagc

SEQ ID NO: 410537 - DNA, 16 bp, M. musculus
gcagagtgtgtgtgtg

SEQ ID NO: 410538 - DNA, 16 bp, M. musculus
gcagagttccaggcca

SEQ ID NO: 410539 - DNA, 16 bp, M. musculus
gcagagtttctctgtg

SEQ ID NO: 410540 - DNA, 16 bp, M. musculus
gcagataaaacaccca

SEQ ID NO: 410541 - DNA, 16 bp, M. musculus
gcagataaaagggaag

SEQ ID NO: 410542 - DNA, 16 bp, M. musculus
gcagatatatatgcag

SEQ ID NO: 410543 - DNA, 16 bp, M. musculus
gcagatatttacatta

SEQ ID NO: 410544 - DNA, 16 bp, M. musculus
gcagatcacctacagg

SEQ ID NO: 410545 - DNA, 16 bp, M. musculus
gcagatcaggctggcc

SEQ ID NO: 410546 - DNA, 16 bp, M. musculus
gcagatctcagagttc

SEQ ID NO: 410547 - DNA, 16 bp, M. musculus
gcagatctctgaattc

SEQ ID NO: 410548 - DNA, 16 bp, M. musculus
gcagatctctgatttt

SEQ ID NO: 410549 - DNA, 16 bp, M. musculus
gcagatcttgactgga

SEQ ID NO: 410550 - DNA, 16 bp, M. musculus
gcagatgaggcagatg

SEQ ID NO: 410551 - DNA, 16 bp, M. musculus
gcagatgcaccagaag

SEQ ID NO: 410552 - DNA, 16 bp, M. musculus
gcagatgcaggtgaat

SEQ ID NO: 410553 - DNA, 16 bp, M. musculus
gcagatgcatgcagcc

SEQ ID NO: 410554 - DNA, 16 bp, M. musculus
gcagatgccaacaaga

SEQ ID NO: 410555 - DNA, 16 bp, M. musculus
gcagatgctcacagcc

SEQ ID NO: 410556 - DNA, 16 bp, M. musculus
gcagatgctggcaaag

SEQ ID NO: 410557 - DNA, 16 bp, M. musculus
gcagatgctggcgagc

SEQ ID NO: 410558 - DNA, 16 bp, M. musculus
gcagatggagaagatg

SEQ ID NO: 410559 - DNA, 16 bp, M. musculus
gcagatggatctcttg

SEQ ID NO: 410560 - DNA, 16 bp, M. musculus
gcagatggatggacct

SEQ ID NO: 410561 - DNA, 16 bp, M. musculus
gcagatggatgtgaca

SEQ ID NO: 410562 - DNA, 16 bp, M. musculus
gcagatggatttctgt

SEQ ID NO: 410563 - DNA, 19 bp, M. musculus
gcagattatttgtttacca

SEQ ID NO: 410564 - DNA, 16 bp, M. musculus
gcagattccacaggga

SEQ ID NO: 410565 - DNA, 16 bp, M. musculus
gcagattgctgagttc

SEQ ID NO: 410566 - DNA, 16 bp, M. musculus
gcagattgctttttct

SEQ ID NO: 410567 - DNA, 16 bp, M. musculus
gcagattgtatcttgt

SEQ ID NO: 410568 - DNA, 16 bp, M. musculus
gcagcaaaacagatca

SEQ ID NO: 410569 - DNA, 16 bp, M. musculus
gcagcaaaattctgga

SEQ ID NO: 410570 - DNA, 16 bp, M. musculus
gcagcaaacaccttta

SEQ ID NO: 410571 - DNA, 16 bp, M. musculus
gcagcaacaacagaaa

SEQ ID NO: 410572 - DNA, 16 bp, M. musculus
gcagcaagcagcaagc

SEQ ID NO: 410573 - DNA, 16 bp, M. musculus
gcagcaagcaggcaga

SEQ ID NO: 410574 - DNA, 16 bp, M. musculus
gcagcaagggctttta

SEQ ID NO: 410575 - DNA, 17 bp, M. musculus
gcagcaaggtcaaggtc

SEQ ID NO: 410576 - DNA, 16 bp, M. musculus
gcagcaagtgctctga

SEQ ID NO: 410577 - DNA, 16 bp, M. musculus
gcagcaatagaaaccc

SEQ ID NO: 410578 - DNA, 16 bp, M. musculus
gcagcaatgaacatag

SEQ ID NO: 410579 - DNA, 16 bp, M. musculus
gcagcaatggaggagt

SEQ ID NO: 410580 - DNA, 16 bp, M. musculus
gcagcacaaactggac

SEQ ID NO: 410581 - DNA, 16 bp, M. musculus
gcagcacaggccagga

SEQ ID NO: 410582 - DNA, 16 bp, M. musculus
gcagcaccttccatgg

SEQ ID NO: 410583 - DNA, 16 bp, M. musculus
gcagcactattcacaa

SEQ ID NO: 410584 - DNA, 16 bp, M. musculus
gcagcactcaggaaag

SEQ ID NO: 410585 - DNA, 16 bp, M. musculus
gcagcactcccaactc

SEQ ID NO: 410586 - DNA, 16 bp, M. musculus
gcagcactctggaggc

SEQ ID NO: 410587 - DNA, 16 bp, M. musculus
gcagcactggggaggc

SEQ ID NO: 410588 - DNA, 16 bp, M. musculus
gcagcagaactctgca

SEQ ID NO: 410589 - DNA, 16 bp, M. musculus
gcagcagaagcaacag

SEQ ID NO: 410590 - DNA, 16 bp, M. musculus
gcagcagaagcagaag

SEQ ID NO: 410591 - DNA, 16 bp, M. musculus
gcagcagaagcaggaa

SEQ ID NO: 410592 - DNA, 16 bp, M. musculus
gcagcagaaggagact

SEQ ID NO: 410593 - DNA, 16 bp, M. musculus
gcagcagacaccttta

SEQ ID NO: 410594 - DNA, 16 bp, M. musculus
gcagcagacaggcagg

SEQ ID NO: 410595 - DNA, 16 bp, M. musculus
gcagcagaggatgacc

SEQ ID NO: 410596 - DNA, 16 bp, M. musculus
gcagcagaggcagcag

SEQ ID NO: 410597 - DNA, 16 bp, M. musculus
gcagcagagtggggag

SEQ ID NO: 410598 - DNA, 16 bp, M. musculus
gcagcagatgagaaca

SEQ ID NO: 410599 - DNA, 16 bp, M. musculus
gcagcagatggcattg

SEQ ID NO: 410600 - DNA, 16 bp, M. musculus
gcagcagcaacagaat

SEQ ID NO: 410601 - DNA, 16 bp, M. musculus
gcagcagcagaagaag

SEQ ID NO: 410602 - DNA, 16 bp, M. musculus
gcagcagcagaagcag

SEQ ID NO: 410603 - DNA, 16 bp, M. musculus
gcagcagcagcaaaga

SEQ ID NO: 410604 - DNA, 16 bp, M. musculus
gcagcagcagcaacag

SEQ ID NO: 410605 - DNA, 16 bp, M. musculus
gcagcagcagcagaaa

SEQ ID NO: 410606 - DNA, 16 bp, M. musculus
gcagcagcagcagaac

SEQ ID NO: 410607 - DNA, 16 bp, M. musculus
gcagcagcagcagact

SEQ ID NO: 410608 - DNA, 16 bp, M. musculus
gcagcagcagcagagc

SEQ ID NO: 410609 - DNA, 16 bp, M. musculus
gcagcagcagcagagg

SEQ ID NO: 410610 - DNA, 16 bp, M. musculus
gcagcagcagcagcac

SEQ ID NO: 410611 - DNA, 24 bp, M. musculus
gcagcagcagcagcaggagcagca

SEQ ID NO: 410612 - DNA, 16 bp, M. musculus
gcagcagcagcagccg

SEQ ID NO: 410613 - DNA, 16 bp, M. musculus
gcagcagcagcagcta

SEQ ID NO: 410614 - DNA, 16 bp, M. musculus
gcagcagcagcagctc

SEQ ID NO: 410615 - DNA, 16 bp, M. musculus
gcagcagcagcagctg

SEQ ID NO: 410616 - DNA, 16 bp, M. musculus
gcagcagcagcaggaa

SEQ ID NO: 410617 - DNA, 16 bp, M. musculus
gcagcagcagcagtac

SEQ ID NO: 410618 - DNA, 16 bp, M. musculus
gcagcagcagcagtgc

SEQ ID NO: 410619 - DNA, 16 bp, M. musculus
gcagcagcagcagtgg

SEQ ID NO: 410620 - DNA, 16 bp, M. musculus
gcagcagcagcagttg

SEQ ID NO: 410621 - DNA, 16 bp, M. musculus
gcagcagcagcatcct

SEQ ID NO: 410622 - DNA, 16 bp, M. musculus
gcagcagcagcatctg

SEQ ID NO: 410623 - DNA, 16 bp, M. musculus
gcagcagcagccaggg

SEQ ID NO: 410624 - DNA, 16 bp, M. musculus
gcagcagcagcggtgg

SEQ ID NO: 410625 - DNA, 16 bp, M. musculus
gcagcagcagctgctg

SEQ ID NO: 410626 - DNA, 16 bp, M. musculus
gcagcagcaggagaag

SEQ ID NO: 410627 - DNA, 16 bp, M. musculus
gcagcagcaggagcaa

SEQ ID NO: 410628 - DNA, 16 bp, M. musculus
gcagcagcaggagctg

SEQ ID NO: 410629 - DNA, 16 bp, M. musculus
gcagcagcaggaggag

SEQ ID NO: 410630 - DNA, 16 bp, M. musculus
gcagcagcagtggagg

SEQ ID NO: 410631 - DNA, 16 bp, M. musculus
gcagcagcagtgggag

SEQ ID NO: 410632 - DNA, 16 bp, M. musculus
gcagcagcatggacca

SEQ ID NO: 410633 - DNA, 16 bp, M. musculus
gcagcagccaccacag

SEQ ID NO: 410634 - DNA, 16 bp, M. musculus
gcagcagccagcagct

SEQ ID NO: 410635 - DNA, 16 bp, M. musculus
gcagcagcctggagct

SEQ ID NO: 410636 - DNA, 16 bp, M. musculus
gcagcagcggcagcgg

SEQ ID NO: 410637 - DNA, 16 bp, M. musculus
gcagcagcggcagtgg

SEQ ID NO: 410638 - DNA, 16 bp, M. musculus
gcagcagctcctgctt

SEQ ID NO: 410639 - DNA, 16 bp, M. musculus
gcagcagctgccacag

SEQ ID NO: 410640 - DNA, 16 bp, M. musculus
gcagcagctgctgcag

SEQ ID NO: 410641 - DNA, 17 bp, M. musculus
gcagcagctgtagccag

SEQ ID NO: 410642 - DNA, 16 bp, M. musculus
gcagcaggaacttgag

SEQ ID NO: 410643 - DNA, 16 bp, M. musculus
gcagcaggaagagaat

SEQ ID NO: 410644 - DNA, 16 bp, M. musculus
gcagcaggagcaggaa

SEQ ID NO: 410645 - DNA, 16 bp, M. musculus
gcagcaggagcaggag

SEQ ID NO: 410646 - DNA, 16 bp, M. musculus
gcagcaggagcatgag

SEQ ID NO: 410647 - DNA, 16 bp, M. musculus
gcagcaggagctgaga

SEQ ID NO: 410648 - DNA, 16 bp, M. musculus
gcagcaggagcttgag

SEQ ID NO: 410649 - DNA, 16 bp, M. musculus
gcagcaggagtgtgag

SEQ ID NO: 410650 - DNA, 16 bp, M. musculus
gcagcaggatcagaag

SEQ ID NO: 410651 - DNA, 16 bp, M. musculus
gcagcaggcacagggc

SEQ ID NO: 410652 - DNA, 16 bp, M. musculus
gcagcaggcaggcatg

SEQ ID NO: 410653 - DNA, 16 bp, M. musculus
gcagcaggggagcagc

SEQ ID NO: 410654 - DNA, 16 bp, M. musculus
gcagcaggggcagcag

SEQ ID NO: 410655 - DNA, 16 bp, M. musculus
gcagcaggtaccttta

SEQ ID NO: 410656 - DNA, 16 bp, M. musculus
gcagcaggtaggcagg

SEQ ID NO: 410657 - DNA, 16 bp, M. musculus
gcagcagtagcagcaa

SEQ ID NO: 410658 - DNA, 16 bp, M. musculus
gcagcagtcctcctgc

SEQ ID NO: 410659 - DNA, 16 bp, M. musculus
gcagcagtgaccatgg

SEQ ID NO: 410660 - DNA, 16 bp, M. musculus
gcagcagtggcagcag

SEQ ID NO: 410661 - DNA, 16 bp, M. musculus
gcagcagtggcagtgg

SEQ ID NO: 410662 - DNA, 16 bp, M. musculus
gcagcagtggtggtgg

SEQ ID NO: 410663 - DNA, 16 bp, M. musculus
gcagcagtgttcagag

SEQ ID NO: 410664 - DNA, 16 bp, M. musculus
gcagcagttctcaacc

SEQ ID NO: 410665 - DNA, 16 bp, M. musculus
gcagcatcacacacca

SEQ ID NO: 410666 - DNA, 16 bp, M. musculus
gcagcatcagcatcag

SEQ ID NO: 410667 - DNA, 16 bp, M. musculus
gcagcatcattcttgc

SEQ ID NO: 410668 - DNA, 16 bp, M. musculus
gcagcatccagccagg

SEQ ID NO: 410669 - DNA, 16 bp, M. musculus
gcagcatcctggcagg

SEQ ID NO: 410670 - DNA, 16 bp, M. musculus
gcagcatgcaccagct

SEQ ID NO: 410671 - DNA, 16 bp, M. musculus
gcagcatgcagacaga

SEQ ID NO: 410672 - DNA, 16 bp, M. musculus
gcagcattaaaaaaaa

SEQ ID NO: 410673 - DNA, 16 bp, M. musculus
gcagcattaagaaggt

SEQ ID NO: 410674 - DNA, 16 bp, M. musculus
gcagcattaggaaagt

SEQ ID NO: 410675 - DNA, 16 bp, M. musculus
gcagcattaggaaggt

SEQ ID NO: 410676 - DNA, 16 bp, M. musculus
gcagcattgggtgagc

SEQ ID NO: 410677 - DNA, 16 bp, M. musculus
gcagccaaccaatgga

SEQ ID NO: 410678 - DNA, 16 bp, M. musculus
gcagccaaggctacac

SEQ ID NO: 410679 - DNA, 16 bp, M. musculus
gcagccaaggctacat

SEQ ID NO: 410680 - DNA, 16 bp, M. musculus
gcagccacagagaact

SEQ ID NO: 410681 - DNA, 16 bp, M. musculus
gcagccacagctgctg

SEQ ID NO: 410682 - DNA, 16 bp, M. musculus
gcagccacattctttg

SEQ ID NO: 410683 - DNA, 16 bp, M. musculus
gcagccactgtggaaa

SEQ ID NO: 410684 - DNA, 16 bp, M. musculus
gcagccagagcagcca

SEQ ID NO: 410685 - DNA, 16 bp, M. musculus
gcagccagcagccagc

SEQ ID NO: 410686 - DNA, 16 bp, M. musculus
gcagccagcagctggc

SEQ ID NO: 410687 - DNA, 16 bp, M. musculus
gcagccaggagaggac

SEQ ID NO: 410688 - DNA, 16 bp, M. musculus
gcagccaggcagccag

SEQ ID NO: 410689 - DNA, 16 bp, M. musculus
gcagccaggcagtggt

SEQ ID NO: 410690 - DNA, 16 bp, M. musculus
gcagccaggccagcag

SEQ ID NO: 410691 - DNA, 16 bp, M. musculus
gcagccagggccccct

SEQ ID NO: 410692 - DNA, 16 bp, M. musculus
gcagccagtgctccta

SEQ ID NO: 410693 - DNA, 16 bp, M. musculus
gcagccagtgctcttc

SEQ ID NO: 410694 - DNA, 16 bp, M. musculus
gcagccatcttccagt

SEQ ID NO: 410695 - DNA, 16 bp, M. musculus
gcagccatgcccagct

SEQ ID NO: 410696 - DNA, 16 bp, M. musculus
gcagccatggcagtga

SEQ ID NO: 410697 - DNA, 20 bp, M. musculus
gcagcccaattcccaacaat

SEQ ID NO: 410698 - DNA, 16 bp, M. musculus
gcagcccagctaggga

SEQ ID NO: 410699 - DNA, 16 bp, M. musculus
gcagcccaggcagaac

SEQ ID NO: 410700 - DNA, 21 bp, M. musculus
gcagcccatcgaccgagttgt

SEQ ID NO: 410701 - DNA, 16 bp, M. musculus
gcagcccattggccaa

SEQ ID NO: 410702 - DNA, 16 bp, M. musculus
gcagccccatggggga

SEQ ID NO: 410703 - DNA, 16 bp, M. musculus
gcagccctacatgctg

SEQ ID NO: 410704 - DNA, 17 bp, M. musculus
gcagccctcccacgcct

SEQ ID NO: 410705 - DNA, 16 bp, M. musculus
gcagccctcctgcctc

SEQ ID NO: 410706 - DNA, 16 bp, M. musculus
gcagccctggctggtc

SEQ ID NO: 410707 - DNA, 16 bp, M. musculus
gcagccctggttggcc

SEQ ID NO: 410708 - DNA, 17 bp, M. musculus
gcagccgggcgtggtgg

SEQ ID NO: 410709 - DNA, 16 bp, M. musculus
gcagcctagagaatgg

SEQ ID NO: 410710 - DNA, 16 bp, M. musculus
gcagcctaggctggcc

SEQ ID NO: 410711 - DNA, 16 bp, M. musculus
gcagcctcagcctcag

SEQ ID NO: 410712 - DNA, 16 bp, M. musculus
gcagcctccctgaagg

SEQ ID NO: 410713 - DNA, 16 bp, M. musculus
gcagcctcctcctctc

SEQ ID NO: 410714 - DNA, 16 bp, M. musculus
gcagcctggtccctgg

SEQ ID NO: 410715 - DNA, 16 bp, M. musculus
gcagcctggtctgcag

SEQ ID NO: 410716 - DNA, 16 bp, M. musculus
gcagcctgtggtcctc

SEQ ID NO: 410717 - DNA, 16 bp, M. musculus
gcagccttctgatgaa

SEQ ID NO: 410718 - DNA, 16 bp, M. musculus
gcagcggcagcggcag

SEQ ID NO: 410719 - DNA, 16 bp, M. musculus
gcagcggtggcacatg

SEQ ID NO: 410720 - DNA, 21 bp, M. musculus
gcagcgtcgttcttcctggcc

SEQ ID NO: 410721 - DNA, 16 bp, M. musculus
gcagcgttctgtggag

SEQ ID NO: 410722 - DNA, 18 bp, M. musculus
gcagctaaagtcaagagc

SEQ ID NO: 410723 - DNA, 16 bp, M. musculus
gcagctaacaactgtc

SEQ ID NO: 410724 - DNA, 16 bp, M. musculus
gcagctacagtgtact

SEQ ID NO: 410725 - DNA, 23 bp, M. musculus
gcagctatgcctttaattgaaca

SEQ ID NO: 410726 - DNA, 16 bp, M. musculus
gcagctatgtttgaaa

SEQ ID NO: 410727 - DNA, 16 bp, M. musculus
gcagctattgatctgg

SEQ ID NO: 410728 - DNA, 16 bp, M. musculus
gcagctcaaaactgcc

SEQ ID NO: 410729 - DNA, 16 bp, M. musculus
gcagctcaactacaca

SEQ ID NO: 410730 - DNA, 16 bp, M. musculus
gcagctcacaactgtc

SEQ ID NO: 410731 - DNA, 16 bp, M. musculus
gcagctcacaattgcc

SEQ ID NO: 410732 - DNA, 16 bp, M. musculus
gcagctccagctccag

SEQ ID NO: 410733 - DNA, 16 bp, M. musculus
gcagctccagttccag

SEQ ID NO: 410734 - DNA, 16 bp, M. musculus
gcagctgaagccagag

SEQ ID NO: 410735 - DNA, 16 bp, M. musculus
gcagctgaatgagtca

SEQ ID NO: 410736 - DNA, 16 bp, M. musculus
gcagctgactcagaca

SEQ ID NO: 410737 - DNA, 16 bp, M. musculus
gcagctgagatgaaag

SEQ ID NO: 410738 - DNA, 16 bp, M. musculus
gcagctgaggatctga

SEQ ID NO: 410739 - DNA, 16 bp, M. musculus
gcagctgatgcagagg

SEQ ID NO: 410740 - DNA, 16 bp, M. musculus
gcagctgatgctcagg

SEQ ID NO: 410741 - DNA, 16 bp, M. musculus
gcagctgatggaaaca

SEQ ID NO: 410742 - DNA, 16 bp, M. musculus
gcagctgcagcagcag

SEQ ID NO: 410743 - DNA, 16 bp, M. musculus
gcagctgcagctgctg

SEQ ID NO: 410744 - DNA, 16 bp, M. musculus
gcagctgccccaccac

SEQ ID NO: 410745 - DNA, 16 bp, M. musculus
gcagctgcctctgttc

SEQ ID NO: 410746 - DNA, 16 bp, M. musculus
gcagctgcctttgttc

SEQ ID NO: 410747 - DNA, 17 bp, M. musculus
gcagctgctgctacagc

SEQ ID NO: 410748 - DNA, 16 bp, M. musculus
gcagctgctgctcctg

SEQ ID NO: 410749 - DNA, 16 bp, M. musculus
gcagctggaaccatga

SEQ ID NO: 410750 - DNA, 16 bp, M. musculus
gcagctggacacacag

SEQ ID NO: 410751 - DNA, 16 bp, M. musculus
gcagctggactccaag

SEQ ID NO: 410752 - DNA, 16 bp, M. musculus
gcagctggagacatgg

SEQ ID NO: 410753 - DNA, 16 bp, M. musculus
gcagctggagccaagg

SEQ ID NO: 410754 - DNA, 16 bp, M. musculus
gcagctgggactgagg

SEQ ID NO: 410755 - DNA, 16 bp, M. musculus
gcagctgggaggcaga

SEQ ID NO: 410756 - DNA, 16 bp, M. musculus
gcagctgggctggcag

SEQ ID NO: 410757 - DNA, 16 bp, M. musculus
gcagctggtcacacag

SEQ ID NO: 410758 - DNA, 16 bp, M. musculus
gcagctgtgaatggaa

SEQ ID NO: 410759 - DNA, 16 bp, M. musculus
gcagctgtggcagctg

SEQ ID NO: 410760 - DNA, 16 bp, M. musculus
gcagctgtggttacct

SEQ ID NO: 410761 - DNA, 16 bp, M. musculus
gcagcttcaagtgtat

SEQ ID NO: 410762 - DNA, 16 bp, M. musculus
gcagcttccaggcaga

SEQ ID NO: 410763 - DNA, 16 bp, M. musculus
gcagcttcctgcaaga

SEQ ID NO: 410764 - DNA, 16 bp, M. musculus
gcagcttctctgggag

SEQ ID NO: 410765 - DNA, 16 bp, M. musculus
gcagcttctgaggcct

SEQ ID NO: 410766 - DNA, 16 bp, M. musculus
gcagctttccttggca

SEQ ID NO: 410767 - DNA, 16 bp, M. musculus
gcagctttgactatca

SEQ ID NO: 410768 - DNA, 16 bp, M. musculus
gcaggaaaacaggaca

SEQ ID NO: 410769 - DNA, 16 bp, M. musculus
gcaggaaataaactca

SEQ ID NO: 410770 - DNA, 16 bp, M. musculus
gcaggaacagagacaa

SEQ ID NO: 410771 - DNA, 16 bp, M. musculus
gcaggaacaggaagct

SEQ ID NO: 410772 - DNA, 16 bp, M. musculus
gcaggaacagggacag

SEQ ID NO: 410773 - DNA, 16 bp, M. musculus
gcaggaaccaactggg

SEQ ID NO: 410774 - DNA, 16 bp, M. musculus
gcaggaaccccagtga

SEQ ID NO: 410775 - DNA, 16 bp, M. musculus
gcaggaacctggaggt

SEQ ID NO: 410776 - DNA, 16 bp, M. musculus
gcaggaactcaaagca

SEQ ID NO: 410777 - DNA, 16 bp, M. musculus
gcaggaactcaaggca

SEQ ID NO: 410778 - DNA, 16 bp, M. musculus
gcaggaactcaggcag

SEQ ID NO: 410779 - DNA, 16 bp, M. musculus
gcaggaactgagacag

SEQ ID NO: 410780 - DNA, 16 bp, M. musculus
gcaggaactgcagcag

SEQ ID NO: 410781 - DNA, 16 bp, M. musculus
gcaggaactggagcag

SEQ ID NO: 410782 - DNA, 16 bp, M. musculus
gcaggaacttgaagca

SEQ ID NO: 410783 - DNA, 16 bp, M. musculus
gcaggaagaagcagag

SEQ ID NO: 410784 - DNA, 16 bp, M. musculus
gcaggaagacctgagt

SEQ ID NO: 410785 - DNA, 16 bp, M. musculus
gcaggaagagcagaag

SEQ ID NO: 410786 - DNA, 16 bp, M. musculus
gcaggaagagcaggaa

SEQ ID NO: 410787 - DNA, 16 bp, M. musculus
gcaggaagagcaggag

SEQ ID NO: 410788 - DNA, 16 bp, M. musculus
gcaggaagagtagcag

SEQ ID NO: 410789 - DNA, 16 bp, M. musculus
gcaggaagatcaagag

SEQ ID NO: 410790 - DNA, 16 bp, M. musculus
gcaggaagatcagcag

SEQ ID NO: 410791 - DNA, 16 bp, M. musculus
gcaggaagattttctt

SEQ ID NO: 410792 - DNA, 16 bp, M. musculus
gcaggaagcaaggcag

SEQ ID NO: 410793 - DNA, 16 bp, M. musculus
gcaggaagcacagcag

SEQ ID NO: 410794 - DNA, 16 bp, M. musculus
gcaggaagcaggagag

SEQ ID NO: 410795 - DNA, 16 bp, M. musculus
gcaggaagcagggcag

SEQ ID NO: 410796 - DNA, 16 bp, M. musculus
gcaggaagccctgagt

SEQ ID NO: 410797 - DNA, 16 bp, M. musculus
gcaggaagcctgggca

SEQ ID NO: 410798 - DNA, 16 bp, M. musculus
gcaggaagctgcagat

SEQ ID NO: 410799 - DNA, 16 bp, M. musculus
gcaggaagctggctga

SEQ ID NO: 410800 - DNA, 16 bp, M. musculus
gcaggaagtgctgcct

SEQ ID NO: 410801 - DNA, 16 bp, M. musculus
gcaggaataaagatgg

SEQ ID NO: 410802 - DNA, 16 bp, M. musculus
gcaggaatctctctgc

SEQ ID NO: 410803 - DNA, 16 bp, M. musculus
gcaggaatctgacatt

SEQ ID NO: 410804 - DNA, 16 bp, M. musculus
gcaggaatggaagcag

SEQ ID NO: 410805 - DNA, 16 bp, M. musculus
gcaggaatgggcccct

SEQ ID NO: 410806 - DNA, 16 bp, M. musculus
gcaggaccatggagca

SEQ ID NO: 410807 - DNA, 16 bp, M. musculus
gcaggaccctggaggc

SEQ ID NO: 410808 - DNA, 16 bp, M. musculus
gcaggacttccaggtc

SEQ ID NO: 410809 - DNA, 16 bp, M. musculus
gcaggacttgaactca

SEQ ID NO: 410810 - DNA, 16 bp, M. musculus
gcaggagaaccaggag

SEQ ID NO: 410811 - DNA, 16 bp, M. musculus
gcaggagaagcagaag

SEQ ID NO: 410812 - DNA, 16 bp, M. musculus
gcaggagaagctgaga

SEQ ID NO: 410813 - DNA, 16 bp, M. musculus
gcaggagaaggagcag

SEQ ID NO: 410814 - DNA, 16 bp, M. musculus
gcaggagaaggagctg

SEQ ID NO: 410815 - DNA, 16 bp, M. musculus
gcaggagaatcacaag

SEQ ID NO: 410816 - DNA, 16 bp, M. musculus
gcaggagaatcatgag

SEQ ID NO: 410817 - DNA, 16 bp, M. musculus
gcaggagacagaggtg

SEQ ID NO: 410818 - DNA, 16 bp, M. musculus
gcaggagagaagccct

SEQ ID NO: 410819 - DNA, 16 bp, M. musculus
gcaggagagctggccc

SEQ ID NO: 410820 - DNA, 16 bp, M. musculus
gcaggagagtgtgggt

SEQ ID NO: 410821 - DNA, 16 bp, M. musculus
gcaggagcacctgggg

SEQ ID NO: 410822 - DNA, 16 bp, M. musculus
gcaggagcagaagcag

SEQ ID NO: 410823 - DNA, 16 bp, M. musculus
gcaggagcagaggcag

SEQ ID NO: 410824 - DNA, 16 bp, M. musculus
gcaggagcagatgcag

SEQ ID NO: 410825 - DNA, 16 bp, M. musculus
gcaggagcagcagcaa

SEQ ID NO: 410826 - DNA, 16 bp, M. musculus
gcaggagcagcagcag

SEQ ID NO: 410827 - DNA, 16 bp, M. musculus
gcaggagcagcagctg

SEQ ID NO: 410828 - DNA, 16 bp, M. musculus
gcaggagcaggagaag

SEQ ID NO: 410829 - DNA, 16 bp, M. musculus
gcaggagcctgaagca

SEQ ID NO: 410830 - DNA, 16 bp, M. musculus
gcaggagcctggaggc

SEQ ID NO: 410831 - DNA, 16 bp, M. musculus
gcaggagcctgtggag

SEQ ID NO: 410832 - DNA, 16 bp, M. musculus
gcaggagctcaagcag

SEQ ID NO: 410833 - DNA, 16 bp, M. musculus
gcaggagctgaagcag

SEQ ID NO: 410834 - DNA, 16 bp, M. musculus
gcaggagctgatacag

SEQ ID NO: 410835 - DNA, 16 bp, M. musculus
gcaggagctgctgcag

SEQ ID NO: 410836 - DNA, 16 bp, M. musculus
gcaggagctggaaagg

SEQ ID NO: 410837 - DNA, 16 bp, M. musculus
gcaggagctggagcag

SEQ ID NO: 410838 - DNA, 16 bp, M. musculus
gcaggagctgggaagg

SEQ ID NO: 410839 - DNA, 16 bp, M. musculus
gcaggagctggtgcag

SEQ ID NO: 410840 - DNA, 16 bp, M. musculus
gcaggagctgtccctg

SEQ ID NO: 410841 - DNA, 16 bp, M. musculus
gcaggaggaactaagc

SEQ ID NO: 410842 - DNA, 16 bp, M. musculus
gcaggaggacaggagt

SEQ ID NO: 410843 - DNA, 16 bp, M. musculus
gcaggaggaccaagag

SEQ ID NO: 410844 - DNA, 16 bp, M. musculus
gcaggaggaccagaag

SEQ ID NO: 410845 - DNA, 16 bp, M. musculus
gcaggaggactgtgag

SEQ ID NO: 410846 - DNA, 16 bp, M. musculus
gcaggaggagcagcag

SEQ ID NO: 410847 - DNA, 16 bp, M. musculus
gcaggaggagctgagc

SEQ ID NO: 410848 - DNA, 16 bp, M. musculus
gcaggaggagctgagg

SEQ ID NO: 410849 - DNA, 16 bp, M. musculus
gcaggaggatcagaaa

SEQ ID NO: 410850 - DNA, 16 bp, M. musculus
gcaggaggatcaggaa

SEQ ID NO: 410851 - DNA, 16 bp, M. musculus
gcaggaggatctggag

SEQ ID NO: 410852 - DNA, 16 bp, M. musculus
gcaggaggattggaag

SEQ ID NO: 410853 - DNA, 16 bp, M. musculus
gcaggaggcagagcag

SEQ ID NO: 410854 - DNA, 16 bp, M. musculus
gcaggaggctcagaag

SEQ ID NO: 410855 - DNA, 16 bp, M. musculus
gcaggagggacagcag

SEQ ID NO: 410856 - DNA, 16 bp, M. musculus
gcaggaggggctgaga

SEQ ID NO: 410857 - DNA, 16 bp, M. musculus
gcaggagggtccctgc

SEQ ID NO: 410858 - DNA, 16 bp, M. musculus
gcaggagtcagaggga

SEQ ID NO: 410859 - DNA, 16 bp, M. musculus
gcaggagtgaccagga

SEQ ID NO: 410860 - DNA, 16 bp, M. musculus
gcaggagtgtgaggca

SEQ ID NO: 410861 - DNA, 24 bp, M. musculus
gcaggatcccccaattgggacctc

SEQ ID NO: 410862 - DNA, 16 bp, M. musculus
gcaggatctcatggag

SEQ ID NO: 410863 - DNA, 16 bp, M. musculus
gcaggatgagggtgca

SEQ ID NO: 410864 - DNA, 16 bp, M. musculus
gcaggatgctgaagga

SEQ ID NO: 410865 - DNA, 16 bp, M. musculus
gcaggatggctcagtg

SEQ ID NO: 410866 - DNA, 16 bp, M. musculus
gcaggatttttttttt

SEQ ID NO: 410867 - DNA, 17 bp, M. musculus
gcaggcaaaagaaggca

SEQ ID NO: 410868 - DNA, 16 bp, M. musculus
gcaggcaaaagactca

SEQ ID NO: 410869 - DNA, 16 bp, M. musculus
gcaggcaacagattta

SEQ ID NO: 410870 - DNA, 16 bp, M. musculus
gcaggcaagagagtca

SEQ ID NO: 410871 - DNA, 16 bp, M. musculus
gcaggcacacacacac

SEQ ID NO: 410872 - DNA, 16 bp, M. musculus
gcaggcacagcagaaa

SEQ ID NO: 410873 - DNA, 16 bp, M. musculus
gcaggcacaggcacag

SEQ ID NO: 410874 - DNA, 16 bp, M. musculus
gcaggcactctaccaa

SEQ ID NO: 410875 - DNA, 16 bp, M. musculus
gcaggcactggagcag

SEQ ID NO: 410876 - DNA, 16 bp, M. musculus
gcaggcactggcagag

SEQ ID NO: 410877 - DNA, 16 bp, M. musculus
gcaggcagaactctga

SEQ ID NO: 410878 - DNA, 16 bp, M. musculus
gcaggcagaagcaggc

SEQ ID NO: 410879 - DNA, 16 bp, M. musculus
gcaggcagacacaggc

SEQ ID NO: 410880 - DNA, 16 bp, M. musculus
gcaggcagagaaagca

SEQ ID NO: 410881 - DNA, 16 bp, M. musculus
gcaggcagagacagag

SEQ ID NO: 410882 - DNA, 16 bp, M. musculus
gcaggcagagacaggc

SEQ ID NO: 410883 - DNA, 16 bp, M. musculus
gcaggcagagctcaga

SEQ ID NO: 410884 - DNA, 16 bp, M. musculus
gcaggcagagtttgag

SEQ ID NO: 410885 - DNA, 16 bp, M. musculus
gcaggcagatctccat

SEQ ID NO: 410886 - DNA, 16 bp, M. musculus
gcaggcagatgcaggc

SEQ ID NO: 410887 - DNA, 16 bp, M. musculus
gcaggcagcagcagct

SEQ ID NO: 410888 - DNA, 17 bp, M. musculus
gcaggcagcaggcagca

SEQ ID NO: 410889 - DNA, 16 bp, M. musculus
gcaggcagctcacaac

SEQ ID NO: 410890 - DNA, 16 bp, M. musculus
gcaggcagctcagcag

SEQ ID NO: 410891 - DNA, 16 bp, M. musculus
gcaggcaggaagagag

SEQ ID NO: 410892 - DNA, 16 bp, M. musculus
gcaggcaggaggatca

SEQ ID NO: 410893 - DNA, 16 bp, M. musculus
gcaggcaggcaaggca

SEQ ID NO: 410894 - DNA, 16 bp, M. musculus
gcaggcaggcagaggg

SEQ ID NO: 410895 - DNA, 16 bp, M. musculus
gcaggcaggcagcagg

SEQ ID NO: 410896 - DNA, 16 bp, M. musculus
gcaggcaggcaggccg

SEQ ID NO: 410897 - DNA, 16 bp, M. musculus
gcaggcaggcagggaa

SEQ ID NO: 410898 - DNA, 16 bp, M. musculus
gcaggcagggaggcag

SEQ ID NO: 410899 - DNA, 16 bp, M. musculus
gcaggcagggcaggca

SEQ ID NO: 410900 - DNA, 16 bp, M. musculus
gcaggcaggtgtccag

SEQ ID NO: 410901 - DNA, 16 bp, M. musculus
gcaggcagtggtggtg

SEQ ID NO: 410902 - DNA, 16 bp, M. musculus
gcaggcatacatgcag

SEQ ID NO: 410903 - DNA, 16 bp, M. musculus
gcaggcatagcactgg

SEQ ID NO: 410904 - DNA, 16 bp, M. musculus
gcaggcatggcagcag

SEQ ID NO: 410905 - DNA, 16 bp, M. musculus
gcaggccactcagatc

SEQ ID NO: 410906 - DNA, 16 bp, M. musculus
gcaggccaggaagcag

SEQ ID NO: 410907 - DNA, 16 bp, M. musculus
gcaggccgagcaagcc

SEQ ID NO: 410908 - DNA, 16 bp, M. musculus
gcaggcctaccaggag

SEQ ID NO: 410909 - DNA, 16 bp, M. musculus
gcaggcctcccaggga

SEQ ID NO: 410910 - DNA, 16 bp, M. musculus
gcaggcctggaacttg

SEQ ID NO: 410911 - DNA, 16 bp, M. musculus
gcaggcctggtgctgg

SEQ ID NO: 410912 - DNA, 16 bp, M. musculus
gcaggcgctgtgttcc

SEQ ID NO: 410913 - DNA, 16 bp, M. musculus
gcaggcgtggtgctgg

SEQ ID NO: 410914 - DNA, 16 bp, M. musculus
gcaggcgtggtggcgc

SEQ ID NO: 410915 - DNA, 16 bp, M. musculus
gcaggctgagcaagcc

SEQ ID NO: 410916 - DNA, 17 bp, M. musculus
gcaggctgcagacagcc

SEQ ID NO: 410917 - DNA, 16 bp, M. musculus
gcaggctggcctcaaa

SEQ ID NO: 410918 - DNA, 16 bp, M. musculus
gcaggctggctggctg

SEQ ID NO: 410919 - DNA, 16 bp, M. musculus
gcaggctgtgcagtgt

SEQ ID NO: 410920 - DNA, 16 bp, M. musculus
gcaggctttgagggct

SEQ ID NO: 410921 - DNA, 17 bp, M. musculus
gcagggaacaggttaca

SEQ ID NO: 410922 - DNA, 16 bp, M. musculus
gcagggaagccaggtg

SEQ ID NO: 410923 - DNA, 16 bp, M. musculus
gcagggaaggtgccag

SEQ ID NO: 410924 - DNA, 16 bp, M. musculus
gcagggaaggtgcctg

SEQ ID NO: 410925 - DNA, 16 bp, M. musculus
gcagggaatgtgcaca

SEQ ID NO: 410926 - DNA, 16 bp, M. musculus
gcagggacaggggcag

SEQ ID NO: 410927 - DNA, 16 bp, M. musculus
gcagggagaaagtggg

SEQ ID NO: 410928 - DNA, 16 bp, M. musculus
gcagggagaggtgagg

SEQ ID NO: 410929 - DNA, 16 bp, M. musculus
gcagggagctgggagt

SEQ ID NO: 410930 - DNA, 16 bp, M. musculus
gcagggaggcaggcag

SEQ ID NO: 410931 - DNA, 16 bp, M. musculus
gcagggaggggcctag

SEQ ID NO: 410932 - DNA, 16 bp, M. musculus
gcagggatggggcaga

SEQ ID NO: 410933 - DNA, 16 bp, M. musculus
gcagggcaaggagcag

SEQ ID NO: 410934 - DNA, 16 bp, M. musculus
gcagggcagcaggcag

SEQ ID NO: 410935 - DNA, 16 bp, M. musculus
gcagggcaggcagcag

SEQ ID NO: 410936 - DNA, 16 bp, M. musculus
gcagggcagggtgagg

SEQ ID NO: 410937 - DNA, 16 bp, M. musculus
gcagggccacaccttc

SEQ ID NO: 410938 - DNA, 16 bp, M. musculus
gcagggccagctcacc

SEQ ID NO: 410939 - DNA, 16 bp, M. musculus
gcagggccagctctgc

SEQ ID NO: 410940 - DNA, 16 bp, M. musculus
gcagggcctgctctcc

SEQ ID NO: 410941 - DNA, 16 bp, M. musculus
gcagggcgtggtggtg

SEQ ID NO: 410942 - DNA, 16 bp, M. musculus
gcagggctacacagag

SEQ ID NO: 410943 - DNA, 16 bp, M. musculus
gcagggctactgctgc

SEQ ID NO: 410944 - DNA, 16 bp, M. musculus
gcagggctgaccggag

SEQ ID NO: 410945 - DNA, 16 bp, M. musculus
gcagggctgaggcagg

SEQ ID NO: 410946 - DNA, 16 bp, M. musculus
gcagggctggaggagg

SEQ ID NO: 410947 - DNA, 16 bp, M. musculus
gcaggggagcagcagg

SEQ ID NO: 410948 - DNA, 16 bp, M. musculus
gcaggggagttcgacc

SEQ ID NO: 410949 - DNA, 16 bp, M. musculus
gcaggggcaagtggat

SEQ ID NO: 410950 - DNA, 16 bp, M. musculus
gcaggggcagcagcag

SEQ ID NO: 410951 - DNA, 16 bp, M. musculus
gcaggggcaggcagat

SEQ ID NO: 410952 - DNA, 16 bp, M. musculus
gcaggggccatggagg

SEQ ID NO: 410953 - DNA, 16 bp, M. musculus
gcaggggctggggaga

SEQ ID NO: 410954 - DNA, 16 bp, M. musculus
gcaggggctggggctg

SEQ ID NO: 410955 - DNA, 16 bp, M. musculus
gcaggggctgtccctg

SEQ ID NO: 410956 - DNA, 16 bp, M. musculus
gcagggggagtaggga

SEQ ID NO: 410957 - DNA, 16 bp, M. musculus
gcaggggtgtgatttt

SEQ ID NO: 410958 - DNA, 16 bp, M. musculus
gcaggggtgtgtgtgt

SEQ ID NO: 410959 - DNA, 16 bp, M. musculus
gcagggtctctccctg

SEQ ID NO: 410960 - DNA, 16 bp, M. musculus
gcagggtggctcagtg

SEQ ID NO: 410961 - DNA, 16 bp, M. musculus
gcaggtaaaacactca

SEQ ID NO: 410962 - DNA, 16 bp, M. musculus
gcaggtactgaagcag

SEQ ID NO: 410963 - DNA, 16 bp, M. musculus
gcaggtagaggtgtgg

SEQ ID NO: 410964 - DNA, 16 bp, M. musculus
gcaggtagatctctgc

SEQ ID NO: 410965 - DNA, 16 bp, M. musculus
gcaggtagatctgagt

SEQ ID NO: 410966 - DNA, 16 bp, M. musculus
gcaggtatcttccttg

SEQ ID NO: 410967 - DNA, 16 bp, M. musculus
gcaggtcagagagcag

SEQ ID NO: 410968 - DNA, 16 bp, M. musculus
gcaggtcagggagcag

SEQ ID NO: 410969 - DNA, 16 bp, M. musculus
gcaggtcttttttttt

SEQ ID NO: 410970 - DNA, 16 bp, M. musculus
gcaggtgaagacagaa

SEQ ID NO: 410971 - DNA, 16 bp, M. musculus
gcaggtgagcatgcag

SEQ ID NO: 410972 - DNA, 16 bp, M. musculus
gcaggtgcaccaggat

SEQ ID NO: 410973 - DNA, 16 bp, M. musculus
gcaggtgcaggaagtg

SEQ ID NO: 410974 - DNA, 16 bp, M. musculus
gcaggtgcccacagag

SEQ ID NO: 410975 - DNA, 16 bp, M. musculus
gcaggtgcctgtggaa

SEQ ID NO: 410976 - DNA, 16 bp, M. musculus
gcaggtgctccttacc

SEQ ID NO: 410977 - DNA, 16 bp, M. musculus
gcaggtgctggagcag

SEQ ID NO: 410978 - DNA, 16 bp, M. musculus
gcaggtgctgggaatt

SEQ ID NO: 410979 - DNA, 16 bp, M. musculus
gcaggtggaggccaga

SEQ ID NO: 410980 - DNA, 16 bp, M. musculus
gcaggtggatctctgc

SEQ ID NO: 410981 - DNA, 16 bp, M. musculus
gcaggtggcaggcagt

SEQ ID NO: 410982 - DNA, 16 bp, M. musculus
gcaggtggctctgcct

SEQ ID NO: 410983 - DNA, 16 bp, M. musculus
gcaggtggtcctggat

SEQ ID NO: 410984 - DNA, 16 bp, M. musculus
gcaggtgtccagaagt

SEQ ID NO: 410985 - DNA, 16 bp, M. musculus
gcaggtgtctgcagag

SEQ ID NO: 410986 - DNA, 16 bp, M. musculus
gcaggtgtgagccacc

SEQ ID NO: 410987 - DNA, 16 bp, M. musculus
gcaggtgtgagctgcc

SEQ ID NO: 410988 - DNA, 16 bp, M. musculus
gcaggtgtgcaccacc

SEQ ID NO: 410989 - DNA, 16 bp, M. musculus
gcaggtgtggcggcag

SEQ ID NO: 410990 - DNA, 16 bp, M. musculus
gcaggtgtgtgccacc

SEQ ID NO: 410991 - DNA, 18 bp, M. musculus
gcaggttccagcagtggg

SEQ ID NO: 410992 - DNA, 16 bp, M. musculus
gcaggttcctcagaaa

SEQ ID NO: 410993 - DNA, 16 bp, M. musculus
gcaggttggggagcag

SEQ ID NO: 410994 - DNA, 16 bp, M. musculus
gcaggtttattgggaa

SEQ ID NO: 410995 - DNA, 16 bp, M. musculus
gcagtaagagagaaag

SEQ ID NO: 410996 - DNA, 16 bp, M. musculus
gcagtaagcctcagag

SEQ ID NO: 410997 - DNA, 16 bp, M. musculus
gcagtaagtgttctta

SEQ ID NO: 410998 - DNA, 16 bp, M. musculus
gcagtagcagagagct

SEQ ID NO: 410999 - DNA, 16 bp, M. musculus
gcagtagtagcagtag

SEQ ID NO: 411000 - DNA, 16 bp, M. musculus
gcagtatagggaacaa

SEQ ID NO: 411001 - DNA, 16 bp, M. musculus
gcagtatcttgaagag

SEQ ID NO: 411002 - DNA, 16 bp, M. musculus
gcagtattaggaaggt

SEQ ID NO: 411003 - DNA, 16 bp, M. musculus
gcagtattatttataa

SEQ ID NO: 411004 - DNA, 16 bp, M. musculus
gcagtcaagaactgca

SEQ ID NO: 411005 - DNA, 16 bp, M. musculus
gcagtcaggatgtaat

SEQ ID NO: 411006 - DNA, 16 bp, M. musculus
gcagtcaggccagggt

SEQ ID NO: 411007 - DNA, 16 bp, M. musculus
gcagtccaccttcttg

SEQ ID NO: 411008 - DNA, 16 bp, M. musculus
gcagtccctggatggc

SEQ ID NO: 411009 - DNA, 16 bp, M. musculus
gcagtcctcctgtctc

SEQ ID NO: 411010 - DNA, 16 bp, M. musculus
gcagtcctcctgtgtc

SEQ ID NO: 411011 - DNA, 16 bp, M. musculus
gcagtcctctgctgtt

SEQ ID NO: 411012 - DNA, 16 bp, M. musculus
gcagtctcaggtcctg

SEQ ID NO: 411013 - DNA, 16 bp, M. musculus
gcagtctgcactctta

SEQ ID NO: 411014 - DNA, 16 bp, M. musculus
gcagtctgtctgtctg

SEQ ID NO: 411015 - DNA, 16 bp, M. musculus
gcagtctgttttatgg

SEQ ID NO: 411016 - DNA, 16 bp, M. musculus
gcagtcttcctgcctc

SEQ ID NO: 411017 - DNA, 16 bp, M. musculus
gcagtcttctctggtg

SEQ ID NO: 411018 - DNA, 16 bp, M. musculus
gcagtgaaacttatag

SEQ ID NO: 411019 - DNA, 16 bp, M. musculus
gcagtgaacatggctg

SEQ ID NO: 411020 - DNA, 16 bp, M. musculus
gcagtgacaaacagaa

SEQ ID NO: 411021 - DNA, 16 bp, M. musculus
gcagtgaggagagaga

SEQ ID NO: 411022 - DNA, 16 bp, M. musculus
gcagtgaggtgggcag

SEQ ID NO: 411023 - DNA, 16 bp, M. musculus
gcagtgatggcgcatg

SEQ ID NO: 411024 - DNA, 16 bp, M. musculus
gcagtgatggtggtgg

SEQ ID NO: 411025 - DNA, 16 bp, M. musculus
gcagtgcagtgcagtg

SEQ ID NO: 411026 - DNA, 16 bp, M. musculus
gcagtgcccacagaag

SEQ ID NO: 411027 - DNA, 16 bp, M. musculus
gcagtgccctcagagg

SEQ ID NO: 411028 - DNA, 16 bp, M. musculus
gcagtgctggagagct

SEQ ID NO: 411029 - DNA, 16 bp, M. musculus
gcagtgctggggactg

SEQ ID NO: 411030 - DNA, 16 bp, M. musculus
gcagtgctgggttctg

SEQ ID NO: 411031 - DNA, 16 bp, M. musculus
gcagtgctgtgctgtg

SEQ ID NO: 411032 - DNA, 16 bp, M. musculus
gcagtgctgtgtgaca

SEQ ID NO: 411033 - DNA, 16 bp, M. musculus
gcagtggaaaaagaag

SEQ ID NO: 411034 - DNA, 16 bp, M. musculus
gcagtggcaaaagcat

SEQ ID NO: 411035 - DNA, 16 bp, M. musculus
gcagtggcactattag

SEQ ID NO: 411036 - DNA, 16 bp, M. musculus
gcagtggcagaggcag

SEQ ID NO: 411037 - DNA, 16 bp, M. musculus
gcagtggcagcagcag

SEQ ID NO: 411038 - DNA, 16 bp, M. musculus
gcagtggcagctccat

SEQ ID NO: 411039 - DNA, 16 bp, M. musculus
gcagtggcaggtggat

SEQ ID NO: 411040 - DNA, 16 bp, M. musculus
gcagtggcctcctgtg

SEQ ID NO: 411041 - DNA, 16 bp, M. musculus
gcagtgggcatgtgaa

SEQ ID NO: 411042 - DNA, 16 bp, M. musculus
gcagtggggcaggaga

SEQ ID NO: 411043 - DNA, 16 bp, M. musculus
gcagtggtcctcctgg

SEQ ID NO: 411044 - DNA, 16 bp, M. musculus
gcagtggtgatgcacg

SEQ ID NO: 411045 - DNA, 16 bp, M. musculus
gcagtggtggcacaaa

SEQ ID NO: 411046 - DNA, 16 bp, M. musculus
gcagtggtggcagcag

SEQ ID NO: 411047 - DNA, 16 bp, M. musculus
gcagtggtggtacaca

SEQ ID NO: 411048 - DNA, 16 bp, M. musculus
gcagtggtggtggtga

SEQ ID NO: 411049 - DNA, 16 bp, M. musculus
gcagtggtgtgtgtgt

SEQ ID NO: 411050 - DNA, 16 bp, M. musculus
gcagtggtgttgttta

SEQ ID NO: 411051 - DNA, 16 bp, M. musculus
gcagtggttttcaacc

SEQ ID NO: 411052 - DNA, 18 bp, M. musculus
gcagtgtaaggcagacca

SEQ ID NO: 411053 - DNA, 16 bp, M. musculus
gcagtgtgcagacaga

SEQ ID NO: 411054 - DNA, 17 bp, M. musculus
gcagtgttttggagatg

SEQ ID NO: 411055 - DNA, 16 bp, M. musculus
gcagttaaaagtactg

SEQ ID NO: 411056 - DNA, 16 bp, M. musculus
gcagttaagaacacta

SEQ ID NO: 411057 - DNA, 16 bp, M. musculus
gcagttaagagcactg

SEQ ID NO: 411058 - DNA, 16 bp, M. musculus
gcagttaagagcactt

SEQ ID NO: 411059 - DNA, 16 bp, M. musculus
gcagttagaagcagga

SEQ ID NO: 411060 - DNA, 18 bp, M. musculus
gcagttattgtcacacag

SEQ ID NO: 411061 - DNA, 16 bp, M. musculus
gcagttcacagccatc

SEQ ID NO: 411062 - DNA, 16 bp, M. musculus
gcagttcccagaaaaa

SEQ ID NO: 411063 - DNA, 16 bp, M. musculus
gcagttccccagaaaa

SEQ ID NO: 411064 - DNA, 16 bp, M. musculus
gcagttcctcagaaag

SEQ ID NO: 411065 - DNA, 16 bp, M. musculus
gcagttcctcataaaa

SEQ ID NO: 411066 - DNA, 16 bp, M. musculus
gcagttccttcagaca

SEQ ID NO: 411067 - DNA, 16 bp, M. musculus
gcagttctttcaaaca

SEQ ID NO: 411068 - DNA, 17 bp, M. musculus
gcagttgcagagtggca

SEQ ID NO: 411069 - DNA, 16 bp, M. musculus
gcagtttagttcacag

SEQ ID NO: 411070 - DNA, 17 bp, M. musculus
gcagtttattcaggaac

SEQ ID NO: 411071 - DNA, 16 bp, M. musculus
gcagtttctcctccct

SEQ ID NO: 411072 - DNA, 16 bp, M. musculus
gcagtttgacaacatg

SEQ ID NO: 411073 - DNA, 16 bp, M. musculus
gcagttttgttttgtt

SEQ ID NO: 411074 - DNA, 16 bp, M. musculus
gcataaaaagtttgca

SEQ ID NO: 411075 - DNA, 16 bp, M. musculus
gcataaacacacacat

SEQ ID NO: 411076 - DNA, 16 bp, M. musculus
gcataaatattcagaa

SEQ ID NO: 411077 - DNA, 16 bp, M. musculus
gcataagacagctttg

SEQ ID NO: 411078 - DNA, 17 bp, M. musculus
gcataagctactggtgt

SEQ ID NO: 411079 - DNA, 16 bp, M. musculus
gcataaggacctgagt

SEQ ID NO: 411080 - DNA, 16 bp, M. musculus
gcataatgttttcaag

SEQ ID NO: 411081 - DNA, 16 bp, M. musculus
gcatacaaagtgaagt

SEQ ID NO: 411082 - DNA, 16 bp, M. musculus
gcatacacacacatta

SEQ ID NO: 411083 - DNA, 16 bp, M. musculus
gcatacacagagacac

SEQ ID NO: 411084 - DNA, 16 bp, M. musculus
gcatacagagactgga

SEQ ID NO: 411085 - DNA, 16 bp, M. musculus
gcatacagaggccaga

SEQ ID NO: 411086 - DNA, 16 bp, M. musculus
gcatacatgcacatac

SEQ ID NO: 411087 - DNA, 16 bp, M. musculus
gcatacatgcatgcat

SEQ ID NO: 411088 - DNA, 17 bp, M. musculus
gcatacctttaatccca

SEQ ID NO: 411089 - DNA, 16 bp, M. musculus
gcatagatgagaatga

SEQ ID NO: 411090 - DNA, 17 bp, M. musculus
gcataggcagcagtgtg

SEQ ID NO: 411091 - DNA, 16 bp, M. musculus
gcataggcctgtaatc

SEQ ID NO: 411092 - DNA, 18 bp, M. musculus
gcatagtctcacaagaga

SEQ ID NO: 411093 - DNA, 16 bp, M. musculus
gcatagtgacacatgc

SEQ ID NO: 411094 - DNA, 16 bp, M. musculus
gcatagtgagactctg

SEQ ID NO: 411095 - DNA, 16 bp, M. musculus
gcatataaaattaact

SEQ ID NO: 411096 - DNA, 16 bp, M. musculus
gcatatacatgtgcac

SEQ ID NO: 411097 - DNA, 16 bp, M. musculus
gcatatactgaaaaga

SEQ ID NO: 411098 - DNA, 16 bp, M. musculus
gcatatatacacatgc

SEQ ID NO: 411099 - DNA, 16 bp, M. musculus
gcatatatatttagaa

SEQ ID NO: 411100 - DNA, 16 bp, M. musculus
gcatatatccaaaaga

SEQ ID NO: 411101 - DNA, 16 bp, M. musculus
gcatatatctaaaaga

SEQ ID NO: 411102 - DNA, 16 bp, M. musculus
gcatatatttatattt

SEQ ID NO: 411103 - DNA, 16 bp, M. musculus
gcatatcaaaatataa

SEQ ID NO: 411104 - DNA, 16 bp, M. musculus
gcatatcagatatcct

SEQ ID NO: 411105 - DNA, 16 bp, M. musculus
gcatatcatgtatgtt

SEQ ID NO: 411106 - DNA, 16 bp, M. musculus
gcatatggtacagtgt

SEQ ID NO: 411107 - DNA, 16 bp, M. musculus
gcatatgtagcagagc

SEQ ID NO: 411108 - DNA, 16 bp, M. musculus
gcatatgtggcagagg

SEQ ID NO: 411109 - DNA, 16 bp, M. musculus
gcatatgtgtacacac

SEQ ID NO: 411110 - DNA, 16 bp, M. musculus
gcatatgtgtgcatgt

SEQ ID NO: 411111 - DNA, 16 bp, M. musculus
gcatatgtttcaaaag

SEQ ID NO: 411112 - DNA, 16 bp, M. musculus
gcatatttggaatctg

SEQ ID NO: 411113 - DNA, 16 bp, M. musculus
gcatcaagaaaacaaa

SEQ ID NO: 411114 - DNA, 16 bp, M. musculus
gcatcaagctaggatg

SEQ ID NO: 411115 - DNA, 16 bp, M. musculus
gcatcaatgggaagag

SEQ ID NO: 411116 - DNA, 16 bp, M. musculus
gcatcaccaccaccca

SEQ ID NO: 411117 - DNA, 16 bp, M. musculus
gcatcaccaccacctg

SEQ ID NO: 411118 - DNA, 16 bp, M. musculus
gcatcaccatgcccag

SEQ ID NO: 411119 - DNA, 16 bp, M. musculus
gcatcacgtgcacaca

SEQ ID NO: 411120 - DNA, 16 bp, M. musculus
gcatcagaatgttggg

SEQ ID NO: 411121 - DNA, 16 bp, M. musculus
gcatcagagcattcac

SEQ ID NO: 411122 - DNA, 39 bp, M. musculus
gcatcagcagttaccgcaggaactgctatggcccatcaa

SEQ ID NO: 411123 - DNA, 17 bp, M. musculus
gcatcagcatcagcatc

SEQ ID NO: 411124 - DNA, 16 bp, M. musculus
gcatcagctcccatta

SEQ ID NO: 411125 - DNA, 16 bp, M. musculus
gcatcaggcaggagga

SEQ ID NO: 411126 - DNA, 16 bp, M. musculus
gcatcaggtcctgcct

SEQ ID NO: 411127 - DNA, 16 bp, M. musculus
gcatcatcagaaccca

SEQ ID NO: 411128 - DNA, 16 bp, M. musculus
gcatcatcctgaatga

SEQ ID NO: 411129 - DNA, 16 bp, M. musculus
gcatcatcctgattga

SEQ ID NO: 411130 - DNA, 16 bp, M. musculus
gcatcatgggagagct

SEQ ID NO: 411131 - DNA, 16 bp, M. musculus
gcatcattcattcatt

SEQ ID NO: 411132 - DNA, 16 bp, M. musculus
gcatccaaaaagaaac

SEQ ID NO: 411133 - DNA, 16 bp, M. musculus
gcatccacatcaggca

SEQ ID NO: 411134 - DNA, 16 bp, M. musculus
gcatccactactgtat

SEQ ID NO: 411135 - DNA, 16 bp, M. musculus
gcatccacttggagac

SEQ ID NO: 411136 - DNA, 16 bp, M. musculus
gcatccagaccaacaa

SEQ ID NO: 411137 - DNA, 16 bp, M. musculus
gcatccagtgctccta

SEQ ID NO: 411138 - DNA, 16 bp, M. musculus
gcatccagtgttctta

SEQ ID NO: 411139 - DNA, 16 bp, M. musculus
gcatcccatttactgt

SEQ ID NO: 411140 - DNA, 16 bp, M. musculus
gcatccccagtgctgg

SEQ ID NO: 411141 - DNA, 16 bp, M. musculus
gcatccccgcccccaa

SEQ ID NO: 411142 - DNA, 16 bp, M. musculus
gcatccctcagtccct

SEQ ID NO: 411143 - DNA, 16 bp, M. musculus
gcatccctggatcctg

SEQ ID NO: 411144 - DNA, 16 bp, M. musculus
gcatccctggcatctg

SEQ ID NO: 411145 - DNA, 16 bp, M. musculus
gcatccctgggatgag

SEQ ID NO: 411146 - DNA, 16 bp, M. musculus
gcatcctggcaggcat

SEQ ID NO: 411147 - DNA, 16 bp, M. musculus
gcatccttcctgctcc

SEQ ID NO: 411148 - DNA, 16 bp, M. musculus
gcatccttggaataaa

SEQ ID NO: 411149 - DNA, 16 bp, M. musculus
gcatcctttggtgatg

SEQ ID NO: 411150 - DNA, 16 bp, M. musculus
gcatcggatcccattg

SEQ ID NO: 411151 - DNA, 16 bp, M. musculus
gcatctaagaagatga

SEQ ID NO: 411152 - DNA, 16 bp, M. musculus
gcatctcagaagacag

SEQ ID NO: 411153 - DNA, 16 bp, M. musculus
gcatctccaacatcct

SEQ ID NO: 411154 - DNA, 16 bp, M. musculus
gcatctccccaggaaa

SEQ ID NO: 411155 - DNA, 16 bp, M. musculus
gcatctcctgcaggag

SEQ ID NO: 411156 - DNA, 16 bp, M. musculus
gcatctgaagacagtg

SEQ ID NO: 411157 - DNA, 16 bp, M. musculus
gcatctgatgccctct

SEQ ID NO: 411158 - DNA, 16 bp, M. musculus
gcatctgcaatcccag

SEQ ID NO: 411159 - DNA, 16 bp, M. musculus
gcatctgctgtcccct

SEQ ID NO: 411160 - DNA, 16 bp, M. musculus
gcatctggaagagtcc

SEQ ID NO: 411161 - DNA, 16 bp, M. musculus
gcatctggcagccctc

SEQ ID NO: 411162 - DNA, 16 bp, M. musculus
gcatctggcttctttc

SEQ ID NO: 411163 - DNA, 16 bp, M. musculus
gcatctgtgttctctt

SEQ ID NO: 411164 - DNA, 16 bp, M. musculus
gcatctgtgtttgtgt

SEQ ID NO: 411165 - DNA, 16 bp, M. musculus
gcatctgttatggtca

SEQ ID NO: 411166 - DNA, 16 bp, M. musculus
gcatcttccctgccag

SEQ ID NO: 411167 - DNA, 16 bp, M. musculus
gcatctttatccactg

SEQ ID NO: 411168 - DNA, 16 bp, M. musculus
gcatgaaactcaagaa

SEQ ID NO: 411169 - DNA, 19 bp, M. musculus
gcatgaaactcaagaagaa

SEQ ID NO: 411170 - DNA, 16 bp, M. musculus
gcatgaagacagagca

SEQ ID NO: 411171 - DNA, 16 bp, M. musculus
gcatgaagacctgggt

SEQ ID NO: 411172 - DNA, 16 bp, M. musculus
gcatgaaggaaaacac

SEQ ID NO: 411173 - DNA, 16 bp, M. musculus
gcatgacagaagagga

SEQ ID NO: 411174 - DNA, 16 bp, M. musculus
gcatgacagaagaggg

SEQ ID NO: 411175 - DNA, 16 bp, M. musculus
gcatgaccaccctggg

SEQ ID NO: 411176 - DNA, 16 bp, M. musculus
gcatgagaccctgagt

SEQ ID NO: 411177 - DNA, 16 bp, M. musculus
gcatgagccaccacca

SEQ ID NO: 411178 - DNA, 16 bp, M. musculus
gcatgaggacatgaat

SEQ ID NO: 411179 - DNA, 16 bp, M. musculus
gcatgaggatctgaat

SEQ ID NO: 411180 - DNA, 16 bp, M. musculus
gcatgagtgtgtgtgc

SEQ ID NO: 411181 - DNA, 16 bp, M. musculus
gcatgatggtgcacac

SEQ ID NO: 411182 - DNA, 16 bp, M. musculus
gcatgattggattgga

SEQ ID NO: 411183 - DNA, 16 bp, M. musculus
gcatgcacaaccacac

SEQ ID NO: 411184 - DNA, 16 bp, M. musculus
gcatgcacacaagcat

SEQ ID NO: 411185 - DNA, 16 bp, M. musculus
gcatgcacacacaaac

SEQ ID NO: 411186 - DNA, 16 bp, M. musculus
gcatgcacacacatgc

SEQ ID NO: 411187 - DNA, 16 bp, M. musculus
gcatgcacacacccat

SEQ ID NO: 411188 - DNA, 16 bp, M. musculus
gcatgcacactcacat

SEQ ID NO: 411189 - DNA, 16 bp, M. musculus
gcatgcacaggcacac

SEQ ID NO: 411190 - DNA, 16 bp, M. musculus
gcatgcacataccaca

SEQ ID NO: 411191 - DNA, 16 bp, M. musculus
gcatgcaccactactg

SEQ ID NO: 411192 - DNA, 18 bp, M. musculus
gcatgcacgcacacacac

SEQ ID NO: 411193 - DNA, 16 bp, M. musculus
gcatgcactaccatgc

SEQ ID NO: 411194 - DNA, 16 bp, M. musculus
gcatgcacttctgtat

SEQ ID NO: 411195 - DNA, 16 bp, M. musculus
gcatgcagaggtcaga

SEQ ID NO: 411196 - DNA, 16 bp, M. musculus
gcatgcagtgtgtgtg

SEQ ID NO: 411197 - DNA, 16 bp, M. musculus
gcatgcatatatatat

SEQ ID NO: 411198 - DNA, 16 bp, M. musculus
gcatgcatgaagtcct

SEQ ID NO: 411199 - DNA, 16 bp, M. musculus
gcatgcatgcaggcag

SEQ ID NO: 411200 - DNA, 16 bp, M. musculus
gcatgcatgcatatat

SEQ ID NO: 411201 - DNA, 16 bp, M. musculus
gcatgcatgtagaggt

SEQ ID NO: 411202 - DNA, 16 bp, M. musculus
gcatgcatgtgcgtgc

SEQ ID NO: 411203 - DNA, 16 bp, M. musculus
gcatgcatgtggtaca

SEQ ID NO: 411204 - DNA, 16 bp, M. musculus
gcatgcctgaaatccc

SEQ ID NO: 411205 - DNA, 16 bp, M. musculus
gcatgcctgcacacat

SEQ ID NO: 411206 - DNA, 16 bp, M. musculus
gcatgcctggtgccca

SEQ ID NO: 411207 - DNA, 16 bp, M. musculus
gcatgcctgtaatcct

SEQ ID NO: 411208 - DNA, 16 bp, M. musculus
gcatgcctgtgtgtgt

SEQ ID NO: 411209 - DNA, 17 bp, M. musculus
gcatgcctttaatctca

SEQ ID NO: 411210 - DNA, 16 bp, M. musculus
gcatgcgcacacatgc

SEQ ID NO: 411211 - DNA, 16 bp, M. musculus
gcatgcgccaccacca

SEQ ID NO: 411212 - DNA, 17 bp, M. musculus
gcatgcgccaccacgcc

SEQ ID NO: 411213 - DNA, 16 bp, M. musculus
gcatgcgccaccactg

SEQ ID NO: 411214 - DNA, 16 bp, M. musculus
gcatgctaggaaagca

SEQ ID NO: 411215 - DNA, 16 bp, M. musculus
gcatgctggcacatgc

SEQ ID NO: 411216 - DNA, 16 bp, M. musculus
gcatgctgggattaaa

SEQ ID NO: 411217 - DNA, 20 bp, M. musculus
gcatgcttggcagcagatgg

SEQ ID NO: 411218 - DNA, 16 bp, M. musculus
gcatggacacacacac

SEQ ID NO: 411219 - DNA, 16 bp, M. musculus
gcatggacacacacat

SEQ ID NO: 411220 - DNA, 16 bp, M. musculus
gcatggactttgaaat

SEQ ID NO: 411221 - DNA, 16 bp, M. musculus
gcatggagaactccag

SEQ ID NO: 411222 - DNA, 16 bp, M. musculus
gcatggagagttctct

SEQ ID NO: 411223 - DNA, 16 bp, M. musculus
gcatggatgagtgaca

SEQ ID NO: 411224 - DNA, 16 bp, M. musculus
gcatggcacaggagga

SEQ ID NO: 411225 - DNA, 19 bp, M. musculus
gcatggcactaactcctgc

SEQ ID NO: 411226 - DNA, 16 bp, M. musculus
gcatggcagaatccag

SEQ ID NO: 411227 - DNA, 16 bp, M. musculus
gcatggcagcacacag

SEQ ID NO: 411228 - DNA, 16 bp, M. musculus
gcatggcagcacatgc

SEQ ID NO: 411229 - DNA, 16 bp, M. musculus
gcatggcagcaggcag

SEQ ID NO: 411230 - DNA, 16 bp, M. musculus
gcatggccccctggtt

SEQ ID NO: 411231 - DNA, 16 bp, M. musculus
gcatggctgttctctg

SEQ ID NO: 411232 - DNA, 16 bp, M. musculus
gcatggggctggcatg

SEQ ID NO: 411233 - DNA, 16 bp, M. musculus
gcatggggtcctcaat

SEQ ID NO: 411234 - DNA, 16 bp, M. musculus
gcatgggtctcaagat

SEQ ID NO: 411235 - DNA, 16 bp, M. musculus
gcatggtccactgccc

SEQ ID NO: 411236 - DNA, 16 bp, M. musculus
gcatggtcttcatgtg

SEQ ID NO: 411237 - DNA, 16 bp, M. musculus
gcatggtgacaggcag

SEQ ID NO: 411238 - DNA, 16 bp, M. musculus
gcatggtgataaatat

SEQ ID NO: 411239 - DNA, 16 bp, M. musculus
gcatggtgcaggagct

SEQ ID NO: 411240 - DNA, 16 bp, M. musculus
gcatggtggaaggaga

SEQ ID NO: 411241 - DNA, 16 bp, M. musculus
gcatggtggcaaacac

SEQ ID NO: 411242 - DNA, 16 bp, M. musculus
gcatggtggctcacaa

SEQ ID NO: 411243 - DNA, 16 bp, M. musculus
gcatgtacaagaccct

SEQ ID NO: 411244 - DNA, 16 bp, M. musculus
gcatgtacacatgtga

SEQ ID NO: 411245 - DNA, 16 bp, M. musculus
gcatgtaccaccacac

SEQ ID NO: 411246 - DNA, 16 bp, M. musculus
gcatgtatgtatattt

SEQ ID NO: 411247 - DNA, 16 bp, M. musculus
gcatgtctgtaatccc

SEQ ID NO: 411248 - DNA, 16 bp, M. musculus
gcatgtctgtctctgt

SEQ ID NO: 411249 - DNA, 16 bp, M. musculus
gcatgtctgtggggaa

SEQ ID NO: 411250 - DNA, 16 bp, M. musculus
gcatgtctgtggtggg

SEQ ID NO: 411251 - DNA, 16 bp, M. musculus
gcatgtgcacacgtgc

SEQ ID NO: 411252 - DNA, 16 bp, M. musculus
gcatgtgcaccatgtg

SEQ ID NO: 411253 - DNA, 16 bp, M. musculus
gcatgtgcatgtatgt

SEQ ID NO: 411254 - DNA, 16 bp, M. musculus
gcatgtgccaccaagc

SEQ ID NO: 411255 - DNA, 16 bp, M. musculus
gcatgtgccaccacgc

SEQ ID NO: 411256 - DNA, 17 bp, M. musculus
gcatgtgccaccacgcc

SEQ ID NO: 411257 - DNA, 16 bp, M. musculus
gcatgtgccactatac

SEQ ID NO: 411258 - DNA, 16 bp, M. musculus
gcatgtgctaccatgc

SEQ ID NO: 411259 - DNA, 16 bp, M. musculus
gcatgtgctatcatgc

SEQ ID NO: 411260 - DNA, 16 bp, M. musculus
gcatgtgctgccacca

SEQ ID NO: 411261 - DNA, 16 bp, M. musculus
gcatgtggaagaatgc

SEQ ID NO: 411262 - DNA, 16 bp, M. musculus
gcatgtggatctctgt

SEQ ID NO: 411263 - DNA, 16 bp, M. musculus
gcatgtgggcatgtgc

SEQ ID NO: 411264 - DNA, 16 bp, M. musculus
gcatgtggtacacaga

SEQ ID NO: 411265 - DNA, 16 bp, M. musculus
gcatgtggtgcacaga

SEQ ID NO: 411266 - DNA, 17 bp, M. musculus
gcatgtgtatatgtgtg

SEQ ID NO: 411267 - DNA, 16 bp, M. musculus
gcatgtgtatgtgcac

SEQ ID NO: 411268 - DNA, 16 bp, M. musculus
gcatgtgtccctgtgg

SEQ ID NO: 411269 - DNA, 16 bp, M. musculus
gcatgtgtctgtgtgc

SEQ ID NO: 411270 - DNA, 16 bp, M. musculus
gcatgtgtgattacag

SEQ ID NO: 411271 - DNA, 16 bp, M. musculus
gcatgtgtgcgtgcat

SEQ ID NO: 411272 - DNA, 16 bp, M. musculus
gcatgtgtgtatgtgc

SEQ ID NO: 411273 - DNA, 16 bp, M. musculus
gcatgtgtgtctctct

SEQ ID NO: 411274 - DNA, 16 bp, M. musculus
gcatgtgtgtgcatgc

SEQ ID NO: 411275 - DNA, 16 bp, M. musculus
gcatgtgtgtgtctct

SEQ ID NO: 411276 - DNA, 16 bp, M. musculus
gcatgtgtgtgtgtgc

SEQ ID NO: 411277 - DNA, 16 bp, M. musculus
gcatgtgtgtttgtgc

SEQ ID NO: 411278 - DNA, 16 bp, M. musculus
gcatgtgttttcctgt

SEQ ID NO: 411279 - DNA, 16 bp, M. musculus
gcatgttaggcaagca

SEQ ID NO: 411280 - DNA, 16 bp, M. musculus
gcatgtttgtgtgtat

SEQ ID NO: 411281 - DNA, 16 bp, M. musculus
gcattatcagaaccaa

SEQ ID NO: 411282 - DNA, 16 bp, M. musculus
gcattcagaagaacag

SEQ ID NO: 411283 - DNA, 16 bp, M. musculus
gcattcatatatgtat

SEQ ID NO: 411284 - DNA, 16 bp, M. musculus
gcattcatgtgtgtgt

SEQ ID NO: 411285 - DNA, 16 bp, M. musculus
gcattccatgacaaaa

SEQ ID NO: 411286 - DNA, 16 bp, M. musculus
gcattcctgggatgaa

SEQ ID NO: 411287 - DNA, 16 bp, M. musculus
gcattccttccccctg

SEQ ID NO: 411288 - DNA, 20 bp, M. musculus
gcattctggggtgaagagtt

SEQ ID NO: 411289 - DNA, 16 bp, M. musculus
gcattctgtaaggcat

SEQ ID NO: 411290 - DNA, 16 bp, M. musculus
gcattgaatctggaga

SEQ ID NO: 411291 - DNA, 19 bp, M. musculus
gcattgcttaccctgcaaa

SEQ ID NO: 411292 - DNA, 16 bp, M. musculus
gcattggaagaaggaa

SEQ ID NO: 411293 - DNA, 16 bp, M. musculus
gcattgtaatgcttat

SEQ ID NO: 411294 - DNA, 16 bp, M. musculus
gcattgttcccattct

SEQ ID NO: 411295 - DNA, 16 bp, M. musculus
gcatttaatcccagca

SEQ ID NO: 411296 - DNA, 16 bp, M. musculus
gcatttaggaagctga

SEQ ID NO: 411297 - DNA, 16 bp, M. musculus
gcatttagtccaactt

SEQ ID NO: 411298 - DNA, 16 bp, M. musculus
gcatttatttctctct

SEQ ID NO: 411299 - DNA, 16 bp, M. musculus
gcatttattttagaca

SEQ ID NO: 411300 - DNA, 16 bp, M. musculus
gcatttcatctaagtc

SEQ ID NO: 411301 - DNA, 16 bp, M. musculus
gcatttctcagaccac

SEQ ID NO: 411302 - DNA, 16 bp, M. musculus
gcatttctttaaaaaa

SEQ ID NO: 411303 - DNA, 16 bp, M. musculus
gcatttctttttgaca

SEQ ID NO: 411304 - DNA, 16 bp, M. musculus
gcatttgaaatttata

SEQ ID NO: 411305 - DNA, 16 bp, M. musculus
gcatttgaatacacag

SEQ ID NO: 411306 - DNA, 16 bp, M. musculus
gcatttgcagcataga

SEQ ID NO: 411307 - DNA, 16 bp, M. musculus
gcatttgctgttcttc

SEQ ID NO: 411308 - DNA, 22 bp, M. musculus
gcatttggaagctgattatggg

SEQ ID NO: 411309 - DNA, 16 bp, M. musculus
gcatttggaggctgac

SEQ ID NO: 411310 - DNA, 16 bp, M. musculus
gcatttggatcataga

SEQ ID NO: 411311 - DNA, 16 bp, M. musculus
gcatttgggaggcagg

SEQ ID NO: 411312 - DNA, 16 bp, M. musculus
gcatttggtggctggt

SEQ ID NO: 411313 - DNA, 16 bp, M. musculus
gcatttgtgataaaaa

SEQ ID NO: 411314 - DNA, 16 bp, M. musculus
gcatttgtgtgtgttt

SEQ ID NO: 411315 - DNA, 16 bp, M. musculus
gcatttgtttcagttc

SEQ ID NO: 411316 - DNA, 16 bp, M. musculus
gcattttccattttct

SEQ ID NO: 411317 - DNA, 16 bp, M. musculus
gcattttcctacactg

SEQ ID NO: 411318 - DNA, 16 bp, M. musculus
gcattttcctcattta

SEQ ID NO: 411319 - DNA, 16 bp, M. musculus
gcattttcctgtattt

SEQ ID NO: 411320 - DNA, 16 bp, M. musculus
gcattttctacaaatg

SEQ ID NO: 411321 - DNA, 16 bp, M. musculus
gcattttcttatttaa

SEQ ID NO: 411322 - DNA, 16 bp, M. musculus
gcattttcttgatgac

SEQ ID NO: 411323 - DNA, 16 bp, M. musculus
gcattttgattggctg

SEQ ID NO: 411324 - DNA, 16 bp, M. musculus
gcattttgcattatga

SEQ ID NO: 411325 - DNA, 16 bp, M. musculus
gcattttgcattttct

SEQ ID NO: 411326 - DNA, 16 bp, M. musculus
gcattttgccttttct

SEQ ID NO: 411327 - DNA, 17 bp, M. musculus
gcattttgttgttgttg

SEQ ID NO: 411328 - DNA, 16 bp, M. musculus
gcattttttcttatga

SEQ ID NO: 411329 - DNA, 16 bp, M. musculus
gccaaaaaacggagtg

SEQ ID NO: 411330 - DNA, 16 bp, M. musculus
gccaaaaaatgagaat

SEQ ID NO: 411331 - DNA, 16 bp, M. musculus
gccaaaaagaagctca

SEQ ID NO: 411332 - DNA, 16 bp, M. musculus
gccaaaaataataaca

SEQ ID NO: 411333 - DNA, 16 bp, M. musculus
gccaaaagaaatcctt

SEQ ID NO: 411334 - DNA, 16 bp, M. musculus
gccaaaagggtcatca

SEQ ID NO: 411335 - DNA, 16 bp, M. musculus
gccaaaataaacactt

SEQ ID NO: 411336 - DNA, 16 bp, M. musculus
gccaaaataagtcttt

SEQ ID NO: 411337 - DNA, 16 bp, M. musculus
gccaaaatcccagcat

SEQ ID NO: 411338 - DNA, 16 bp, M. musculus
gccaaaccagttctgt

SEQ ID NO: 411339 - DNA, 16 bp, M. musculus
gccaaacctaaggata

SEQ ID NO: 411340 - DNA, 16 bp, M. musculus
gccaaagaaaaagcat

SEQ ID NO: 411341 - DNA, 16 bp, M. musculus
gccaaagtcaccagtc

SEQ ID NO: 411342 - DNA, 16 bp, M. musculus
gccaaataaacccttt

SEQ ID NO: 411343 - DNA, 18 bp, M. musculus
gccaaataaaccctttcc

SEQ ID NO: 411344 - DNA, 16 bp, M. musculus
gccaaatgataatgat

SEQ ID NO: 411345 - DNA, 16 bp, M. musculus
gccaaattgatgagct

SEQ ID NO: 411346 - DNA, 16 bp, M. musculus
gccaacatgcctggct

SEQ ID NO: 411347 - DNA, 16 bp, M. musculus
gccaaccaatggctgg

SEQ ID NO: 411348 - DNA, 16 bp, M. musculus
gccaaccagggctgca

SEQ ID NO: 411349 - DNA, 16 bp, M. musculus
gccaacctcagctaca

SEQ ID NO: 411350 - DNA, 16 bp, M. musculus
gccaacctgggcaact

SEQ ID NO: 411351 - DNA, 16 bp, M. musculus
gccaacctggtctgca

SEQ ID NO: 411352 - DNA, 17 bp, M. musculus
gccaactaggccatctt

SEQ ID NO: 411353 - DNA, 16 bp, M. musculus
gccaactattccctag

SEQ ID NO: 411354 - DNA, 16 bp, M. musculus
gccaagaaatggaagt

SEQ ID NO: 411355 - DNA, 16 bp, M. musculus
gccaagaagcaagagt

SEQ ID NO: 411356 - DNA, 16 bp, M. musculus
gccaagaagcagaagt

SEQ ID NO: 411357 - DNA, 16 bp, M. musculus
gccaagaagtacctaa

SEQ ID NO: 411358 - DNA, 16 bp, M. musculus
gccaagaagtgcatgt

SEQ ID NO: 411359 - DNA, 16 bp, M. musculus
gccaagaattgggagt

SEQ ID NO: 411360 - DNA, 16 bp, M. musculus
gccaagactgcacaga

SEQ ID NO: 411361 - DNA, 16 bp, M. musculus
gccaagagagagagag

SEQ ID NO: 411362 - DNA, 16 bp, M. musculus
gccaagagctccgggg

SEQ ID NO: 411363 - DNA, 16 bp, M. musculus
gccaagaggagggaag

SEQ ID NO: 411364 - DNA, 16 bp, M. musculus
gccaagataaaccttt

SEQ ID NO: 411365 - DNA, 16 bp, M. musculus
gccaagatgaagaaaa

SEQ ID NO: 411366 - DNA, 16 bp, M. musculus
gccaagatgtgcttgc

SEQ ID NO: 411367 - DNA, 16 bp, M. musculus
gccaagatgttcttag

SEQ ID NO: 411368 - DNA, 16 bp, M. musculus
gccaagccacacctgg

SEQ ID NO: 411369 - DNA, 16 bp, M. musculus
gccaagcccagtgtct

SEQ ID NO: 411370 - DNA, 16 bp, M. musculus
gccaagcctcagcttc

SEQ ID NO: 411371 - DNA, 16 bp, M. musculus
gccaagcctgaagacc

SEQ ID NO: 411372 - DNA, 16 bp, M. musculus
gccaagcctgacaact

SEQ ID NO: 411373 - DNA, 16 bp, M. musculus
gccaagcctgacagcc

SEQ ID NO: 411374 - DNA, 16 bp, M. musculus
gccaagcctgacgacc

SEQ ID NO: 411375 - DNA, 16 bp, M. musculus
gccaaggacaccacaa

SEQ ID NO: 411376 - DNA, 16 bp, M. musculus
gccaaggacatggaga

SEQ ID NO: 411377 - DNA, 16 bp, M. musculus
gccaaggatgacctta

SEQ ID NO: 411378 - DNA, 16 bp, M. musculus
gccaaggcaacagcca

SEQ ID NO: 411379 - DNA, 16 bp, M. musculus
gccaaggccaaggcca

SEQ ID NO: 411380 - DNA, 16 bp, M. musculus
gccaaggccaggaagc

SEQ ID NO: 411381 - DNA, 16 bp, M. musculus
gccaaggctacataaa

SEQ ID NO: 411382 - DNA, 16 bp, M. musculus
gccaaggctggtcttg

SEQ ID NO: 411383 - DNA, 16 bp, M. musculus
gccaaggctgtacaga

SEQ ID NO: 411384 - DNA, 16 bp, M. musculus
gccaaggggaagaagg

SEQ ID NO: 411385 - DNA, 16 bp, M. musculus
gccaaggtgagagaag

SEQ ID NO: 411386 - DNA, 16 bp, M. musculus
gccaaggtgtccccct

SEQ ID NO: 411387 - DNA, 17 bp, M. musculus
gccaaggttactgccag

SEQ ID NO: 411388 - DNA, 16 bp, M. musculus
gccaagtatggtggca

SEQ ID NO: 411389 - DNA, 16 bp, M. musculus
gccaatcagaaactgc

SEQ ID NO: 411390 - DNA, 16 bp, M. musculus
gccaatcagaatggct

SEQ ID NO: 411391 - DNA, 16 bp, M. musculus
gccaatccatcagcat

SEQ ID NO: 411392 - DNA, 16 bp, M. musculus
gccaatccatgaggat

SEQ ID NO: 411393 - DNA, 18 bp, M. musculus
gccaatcctgagttgcta

SEQ ID NO: 411394 - DNA, 16 bp, M. musculus
gccaatctgatggagg

SEQ ID NO: 411395 - DNA, 16 bp, M. musculus
gccaatgactgggcag

SEQ ID NO: 411396 - DNA, 16 bp, M. musculus
gccaatgcttttaacc

SEQ ID NO: 411397 - DNA, 16 bp, M. musculus
gccaatgcttttaact

SEQ ID NO: 411398 - DNA, 16 bp, M. musculus
gccaatgttctgacca

SEQ ID NO: 411399 - DNA, 41 bp, M. musculus
gccaattcagcatgtagggctgccctgagaggtaaaaccaa

SEQ ID NO: 411400 - DNA, 22 bp, M. musculus
gccaattcatcaatgttccaag

SEQ ID NO: 411401 - DNA, 16 bp, M. musculus
gccaattgtgccagca

SEQ ID NO: 411402 - DNA, 16 bp, M. musculus
gccacaaaacaggcct

SEQ ID NO: 411403 - DNA, 16 bp, M. musculus
gccacaacacctggct

SEQ ID NO: 411404 - DNA, 16 bp, M. musculus
gccacaagagggagcc

SEQ ID NO: 411405 - DNA, 16 bp, M. musculus
gccacaagagggcact

SEQ ID NO: 411406 - DNA, 16 bp, M. musculus
gccacaagctgctctg

SEQ ID NO: 411407 - DNA, 16 bp, M. musculus
gccacaagttccatca

SEQ ID NO: 411408 - DNA, 16 bp, M. musculus
gccacacaagtgtgag

SEQ ID NO: 411409 - DNA, 16 bp, M. musculus
gccacacatactccaa

SEQ ID NO: 411410 - DNA, 16 bp, M. musculus
gccacacccccagcct

SEQ ID NO: 411411 - DNA, 16 bp, M. musculus
gccacaccctcagccc

SEQ ID NO: 411412 - DNA, 23 bp, M. musculus
gccacaccggggggtcgatgcaa

SEQ ID NO: 411413 - DNA, 16 bp, M. musculus
gccacacctccagccc

SEQ ID NO: 411414 - DNA, 16 bp, M. musculus
gccacaccttcaaatg

SEQ ID NO: 411415 - DNA, 16 bp, M. musculus
gccacagagatggctc

SEQ ID NO: 411416 - DNA, 16 bp, M. musculus
gccacagagcctctga

SEQ ID NO: 411417 - DNA, 16 bp, M. musculus
gccacagagctacata

SEQ ID NO: 411418 - DNA, 16 bp, M. musculus
gccacagagtgagacc

SEQ ID NO: 411419 - DNA, 16 bp, M. musculus
gccacagccacagcct

SEQ ID NO: 411420 - DNA, 16 bp, M. musculus
gccacagccacagtca

SEQ ID NO: 411421 - DNA, 16 bp, M. musculus
gccacagcctggtcca

SEQ ID NO: 411422 - DNA, 16 bp, M. musculus
gccacaggcctaccag

SEQ ID NO: 411423 - DNA, 16 bp, M. musculus
gccacagtcagagaca

SEQ ID NO: 411424 - DNA, 16 bp, M. musculus
gccacagtggaagcag

SEQ ID NO: 411425 - DNA, 16 bp, M. musculus
gccacagtgtgggtgc

SEQ ID NO: 411426 - DNA, 16 bp, M. musculus
gccacatccccagcct

SEQ ID NO: 411427 - DNA, 16 bp, M. musculus
gccacatgcatgcctg

SEQ ID NO: 411428 - DNA, 16 bp, M. musculus
gccacatggctctggc

SEQ ID NO: 411429 - DNA, 16 bp, M. musculus
gccacatttgaagcaa

SEQ ID NO: 411430 - DNA, 16 bp, M. musculus
gccaccaagatggctc

SEQ ID NO: 411431 - DNA, 16 bp, M. musculus
gccaccaagccaggca

SEQ ID NO: 411432 - DNA, 16 bp, M. musculus
gccaccaagcccagcc

SEQ ID NO: 411433 - DNA, 16 bp, M. musculus
gccaccaagcccagct

SEQ ID NO: 411434 - DNA, 16 bp, M. musculus
gccaccaagcctgaag

SEQ ID NO: 411435 - DNA, 16 bp, M. musculus
gccaccacacccaact

SEQ ID NO: 411436 - DNA, 16 bp, M. musculus
gccaccacacccacct

SEQ ID NO: 411437 - DNA, 18 bp, M. musculus
gccaccacacccagctca

SEQ ID NO: 411438 - DNA, 16 bp, M. musculus
gccaccacacccagtg

SEQ ID NO: 411439 - DNA, 16 bp, M. musculus
gccaccacaccccact

SEQ ID NO: 411440 - DNA, 16 bp, M. musculus
gccaccacacccggct

SEQ ID NO: 411441 - DNA, 16 bp, M. musculus
gccaccacacctgcct

SEQ ID NO: 411442 - DNA, 16 bp, M. musculus
gccaccacacctggca

SEQ ID NO: 411443 - DNA, 16 bp, M. musculus
gccaccacacctggct

SEQ ID NO: 411444 - DNA, 16 bp, M. musculus
gccaccacactcagct

SEQ ID NO: 411445 - DNA, 16 bp, M. musculus
gccaccacagccagcc

SEQ ID NO: 411446 - DNA, 16 bp, M. musculus
gccaccacagccaggc

SEQ ID NO: 411447 - DNA, 16 bp, M. musculus
gccaccacagcctggc

SEQ ID NO: 411448 - DNA, 16 bp, M. musculus
gccaccacatctggct

SEQ ID NO: 411449 - DNA, 16 bp, M. musculus
gccaccaccaccacct

SEQ ID NO: 411450 - DNA, 16 bp, M. musculus
gccaccaccaccactg

SEQ ID NO: 411451 - DNA, 16 bp, M. musculus
gccaccaccaccctgc

SEQ ID NO: 411452 - DNA, 16 bp, M. musculus
gccaccaccacctggc

SEQ ID NO: 411453 - DNA, 16 bp, M. musculus
gccaccaccatctggc

SEQ ID NO: 411454 - DNA, 16 bp, M. musculus
gccaccacccctggct

SEQ ID NO: 411455 - DNA, 16 bp, M. musculus
gccaccaccgccaggc

SEQ ID NO: 411456 - DNA, 16 bp, M. musculus
gccaccaccgccctgc

SEQ ID NO: 411457 - DNA, 17 bp, M. musculus
gccaccaccgcctggct

SEQ ID NO: 411458 - DNA, 16 bp, M. musculus
gccaccacctcccagc

SEQ ID NO: 411459 - DNA, 16 bp, M. musculus
gccaccacctcctggc

SEQ ID NO: 411460 - DNA, 16 bp, M. musculus
gccaccacgaccggct

SEQ ID NO: 411461 - DNA, 16 bp, M. musculus
gccaccacgactggct

SEQ ID NO: 411462 - DNA, 21 bp, M. musculus
gccaccacgcataagattgga

SEQ ID NO: 411463 - DNA, 16 bp, M. musculus
gccaccacgccaggct

SEQ ID NO: 411464 - DNA, 16 bp, M. musculus
gccaccacgcccagcg

SEQ ID NO: 411465 - DNA, 16 bp, M. musculus
gccaccacgcccggca

SEQ ID NO: 411466 - DNA, 16 bp, M. musculus
gccaccacgcccggct

SEQ ID NO: 411467 - DNA, 16 bp, M. musculus
gccaccacgcctgcct

SEQ ID NO: 411468 - DNA, 16 bp, M. musculus
gccaccacgcctggct

SEQ ID NO: 411469 - DNA, 16 bp, M. musculus
gccaccacgctcggct

SEQ ID NO: 411470 - DNA, 16 bp, M. musculus
gccaccactgcccagc

SEQ ID NO: 411471 - DNA, 16 bp, M. musculus
gccaccactgccctgc

SEQ ID NO: 411472 - DNA, 16 bp, M. musculus
gccaccactgccgggc

SEQ ID NO: 411473 - DNA, 16 bp, M. musculus
gccaccactgcctagc

SEQ ID NO: 411474 - DNA, 16 bp, M. musculus
gccaccactgcctggc

SEQ ID NO: 411475 - DNA, 16 bp, M. musculus
gccaccactgcctggg

SEQ ID NO: 411476 - DNA, 16 bp, M. musculus
gccaccactgggaaga

SEQ ID NO: 411477 - DNA, 17 bp, M. musculus
gccaccagagacatggt

SEQ ID NO: 411478 - DNA, 16 bp, M. musculus
gccaccagaggaatca

SEQ ID NO: 411479 - DNA, 16 bp, M. musculus
gccaccagagtgctgg

SEQ ID NO: 411480 - DNA, 16 bp, M. musculus
gccaccagcaagtccc

SEQ ID NO: 411481 - DNA, 16 bp, M. musculus
gccaccagcagcagca

SEQ ID NO: 411482 - DNA, 16 bp, M. musculus
gccaccaggcccagct

SEQ ID NO: 411483 - DNA, 16 bp, M. musculus
gccaccagggccagct

SEQ ID NO: 411484 - DNA, 16 bp, M. musculus
gccaccaggtggcagc

SEQ ID NO: 411485 - DNA, 16 bp, M. musculus
gccaccagtgcctggc

SEQ ID NO: 411486 - DNA, 16 bp, M. musculus
gccaccatacccagct

SEQ ID NO: 411487 - DNA, 16 bp, M. musculus
gccaccatatctggct

SEQ ID NO: 411488 - DNA, 16 bp, M. musculus
gccaccatcacccagc

SEQ ID NO: 411489 - DNA, 16 bp, M. musculus
gccaccatcgcccagc

SEQ ID NO: 411490 - DNA, 16 bp, M. musculus
gccaccatgcccacct

SEQ ID NO: 411491 - DNA, 16 bp, M. musculus
gccaccatgcccagct

SEQ ID NO: 411492 - DNA, 16 bp, M. musculus
gccaccatgcccggca

SEQ ID NO: 411493 - DNA, 16 bp, M. musculus
gccaccatgcccggcc

SEQ ID NO: 411494 - DNA, 16 bp, M. musculus
gccaccatgcccggct

SEQ ID NO: 411495 - DNA, 16 bp, M. musculus
gccaccatgcctgaca

SEQ ID NO: 411496 - DNA, 16 bp, M. musculus
gccaccatgcctgact

SEQ ID NO: 411497 - DNA, 16 bp, M. musculus
gccaccatgcctggcc

SEQ ID NO: 411498 - DNA, 16 bp, M. musculus
gccaccatgcctggct

SEQ ID NO: 411499 - DNA, 16 bp, M. musculus
gccaccatgcctgttt

SEQ ID NO: 411500 - DNA, 16 bp, M. musculus
gccaccatgctgggaa

SEQ ID NO: 411501 - DNA, 16 bp, M. musculus
gccaccatgtttccca

SEQ ID NO: 411502 - DNA, 16 bp, M. musculus
gccacccacagtgggc

SEQ ID NO: 411503 - DNA, 16 bp, M. musculus
gccacccactcatctt

SEQ ID NO: 411504 - DNA, 16 bp, M. musculus
gccacccagctgccac

SEQ ID NO: 411505 - DNA, 16 bp, M. musculus
gccacccctgagcagg

SEQ ID NO: 411506 - DNA, 16 bp, M. musculus
gccacccctgcccggc

SEQ ID NO: 411507 - DNA, 16 bp, M. musculus
gccacccctgcctggc

SEQ ID NO: 411508 - DNA, 16 bp, M. musculus
gccaccctgcaatggc

SEQ ID NO: 411509 - DNA, 16 bp, M. musculus
gccaccctgcccagct

SEQ ID NO: 411510 - DNA, 16 bp, M. musculus
gccacctataactcca

SEQ ID NO: 411511 - DNA, 16 bp, M. musculus
gccacctcaccagccc

SEQ ID NO: 411512 - DNA, 16 bp, M. musculus
gccacctccagcagga

SEQ ID NO: 411513 - DNA, 16 bp, M. musculus
gccacctccccagcca

SEQ ID NO: 411514 - DNA, 16 bp, M. musculus
gccacctccccagcct

SEQ ID NO: 411515 - DNA, 16 bp, M. musculus
gccacctccccagtcc

SEQ ID NO: 411516 - DNA, 16 bp, M. musculus
gccacctctccagcac

SEQ ID NO: 411517 - DNA, 16 bp, M. musculus
gccacctctccagctg

SEQ ID NO: 411518 - DNA, 16 bp, M. musculus
gccacctctccatccc

SEQ ID NO: 411519 - DNA, 16 bp, M. musculus
gccacctctcctctgg

SEQ ID NO: 411520 - DNA, 16 bp, M. musculus
gccacctgctgtgctg

SEQ ID NO: 411521 - DNA, 16 bp, M. musculus
gccacctgcttctgcc

SEQ ID NO: 411522 - DNA, 16 bp, M. musculus
gccaccttccagacca

SEQ ID NO: 411523 - DNA, 16 bp, M. musculus
gccaccttcctgacca

SEQ ID NO: 411524 - DNA, 16 bp, M. musculus
gccacgtgggtgctgg

SEQ ID NO: 411525 - DNA, 16 bp, M. musculus
gccactacacccagct

SEQ ID NO: 411526 - DNA, 16 bp, M. musculus
gccactcagaagacag

SEQ ID NO: 411527 - DNA, 16 bp, M. musculus
gccactcccactgctg

SEQ ID NO: 411528 - DNA, 17 bp, M. musculus
gccactctcagggcctc

SEQ ID NO: 411529 - DNA, 16 bp, M. musculus
gccactctctctctct

SEQ ID NO: 411530 - DNA, 16 bp, M. musculus
gccactgagaaggaaa

SEQ ID NO: 411531 - DNA, 16 bp, M. musculus
gccactgagcatctct

SEQ ID NO: 411532 - DNA, 16 bp, M. musculus
gccactgagcctggct

SEQ ID NO: 411533 - DNA, 16 bp, M. musculus
gccactgaggctgcac

SEQ ID NO: 411534 - DNA, 16 bp, M. musculus
gccactgatttctttg

SEQ ID NO: 411535 - DNA, 16 bp, M. musculus
gccactgccaccacca

SEQ ID NO: 411536 - DNA, 16 bp, M. musculus
gccactgccactgttc

SEQ ID NO: 411537 - DNA, 16 bp, M. musculus
gccactgccctctcag

SEQ ID NO: 411538 - DNA, 16 bp, M. musculus
gccactgcctcctgag

SEQ ID NO: 411539 - DNA, 16 bp, M. musculus
gccactgcctgacaaa

SEQ ID NO: 411540 - DNA, 16 bp, M. musculus
gccactgcctggcagc

SEQ ID NO: 411541 - DNA, 16 bp, M. musculus
gccactgcgcaggcgc

SEQ ID NO: 411542 - DNA, 16 bp, M. musculus
gccactgctgacctgt

SEQ ID NO: 411543 - DNA, 16 bp, M. musculus
gccactgctgctgatt

SEQ ID NO: 411544 - DNA, 16 bp, M. musculus
gccactggcaagaaag

SEQ ID NO: 411545 - DNA, 16 bp, M. musculus
gccactggggaggcaa

SEQ ID NO: 411546 - DNA, 16 bp, M. musculus
gccactggtctggcag

SEQ ID NO: 411547 - DNA, 16 bp, M. musculus
gccactggtgaaggtg

SEQ ID NO: 411548 - DNA, 16 bp, M. musculus
gccactgtaccaatac

SEQ ID NO: 411549 - DNA, 16 bp, M. musculus
gccactgtgcccagct

SEQ ID NO: 411550 - DNA, 16 bp, M. musculus
gccactgtggaaatca

SEQ ID NO: 411551 - DNA, 16 bp, M. musculus
gccacttcagtctctg

SEQ ID NO: 411552 - DNA, 16 bp, M. musculus
gccacttcctcctcct

SEQ ID NO: 411553 - DNA, 16 bp, M. musculus
gccacttgtgccagca

SEQ ID NO: 411554 - DNA, 16 bp, M. musculus
gccactttcctggcca

SEQ ID NO: 411555 - DNA, 16 bp, M. musculus
gccagaaaagaaattt

SEQ ID NO: 411556 - DNA, 16 bp, M. musculus
gccagaaacagggcct

SEQ ID NO: 411557 - DNA, 16 bp, M. musculus
gccagaaagattttac

SEQ ID NO: 411558 - DNA, 16 bp, M. musculus
gccagaaagccccagg

SEQ ID NO: 411559 - DNA, 16 bp, M. musculus
gccagaaatacacaga

SEQ ID NO: 411560 - DNA, 16 bp, M. musculus
gccagaaattggaaat

SEQ ID NO: 411561 - DNA, 16 bp, M. musculus
gccagaacaagcaggg

SEQ ID NO: 411562 - DNA, 16 bp, M. musculus
gccagaacagttgagt

SEQ ID NO: 411563 - DNA, 16 bp, M. musculus
gccagaaccctggagg

SEQ ID NO: 411564 - DNA, 16 bp, M. musculus
gccagaacctgaccaa

SEQ ID NO: 411565 - DNA, 16 bp, M. musculus
gccagaacctggaaat

SEQ ID NO: 411566 - DNA, 16 bp, M. musculus
gccagaagaaagaatg

SEQ ID NO: 411567 - DNA, 16 bp, M. musculus
gccagaagaaagcatc

SEQ ID NO: 411568 - DNA, 16 bp, M. musculus
gccagaagaccctgga

SEQ ID NO: 411569 - DNA, 16 bp, M. musculus
gccagaagagaacatt

SEQ ID NO: 411570 - DNA, 17 bp, M. musculus
gccagaagagggcgtca

SEQ ID NO: 411571 - DNA, 16 bp, M. musculus
gccagaagagtgtgtt

SEQ ID NO: 411572 - DNA, 16 bp, M. musculus
gccagaagatgctgga

SEQ ID NO: 411573 - DNA, 16 bp, M. musculus
gccagaagcctctctg

SEQ ID NO: 411574 - DNA, 16 bp, M. musculus
gccagaagctagaaag

SEQ ID NO: 411575 - DNA, 16 bp, M. musculus
gccagaaggccttcct

SEQ ID NO: 411576 - DNA, 16 bp, M. musculus
gccagaaggtcctgga

SEQ ID NO: 411577 - DNA, 16 bp, M. musculus
gccagacaaggcagac

SEQ ID NO: 411578 - DNA, 16 bp, M. musculus
gccagacatggtgctg

SEQ ID NO: 411579 - DNA, 16 bp, M. musculus
gccagactgaactaca

SEQ ID NO: 411580 - DNA, 16 bp, M. musculus
gccagactgatctaca

SEQ ID NO: 411581 - DNA, 16 bp, M. musculus
gccagactggtctaca

SEQ ID NO: 411582 - DNA, 16 bp, M. musculus
gccagactggtttcca

SEQ ID NO: 411583 - DNA, 16 bp, M. musculus
gccagagacctgggag

SEQ ID NO: 411584 - DNA, 16 bp, M. musculus
gccagagagaaaagag

SEQ ID NO: 411585 - DNA, 16 bp, M. musculus
gccagagagatggctc

SEQ ID NO: 411586 - DNA, 16 bp, M. musculus
gccagagcaagcaggg

SEQ ID NO: 411587 - DNA, 16 bp, M. musculus
gccagagcaggtgagg

SEQ ID NO: 411588 - DNA, 16 bp, M. musculus
gccagagcagtgctgg

SEQ ID NO: 411589 - DNA, 16 bp, M. musculus
gccagagccaaaaagg

SEQ ID NO: 411590 - DNA, 16 bp, M. musculus
gccagagccaagaagc

SEQ ID NO: 411591 - DNA, 16 bp, M. musculus
gccagagccagagagc

SEQ ID NO: 411592 - DNA, 16 bp, M. musculus
gccagagcctgaccaa

SEQ ID NO: 411593 - DNA, 16 bp, M. musculus
gccagaggagagcttg

SEQ ID NO: 411594 - DNA, 16 bp, M. musculus
gccagaggcacaggtt

SEQ ID NO: 411595 - DNA, 16 bp, M. musculus
gccagaggcatcagat

SEQ ID NO: 411596 - DNA, 16 bp, M. musculus
gccagaggccagaggc

SEQ ID NO: 411597 - DNA, 16 bp, M. musculus
gccagagggatggctc

SEQ ID NO: 411598 - DNA, 16 bp, M. musculus
gccagagggccaggag

SEQ ID NO: 411599 - DNA, 16 bp, M. musculus
gccagaggtcagaggt

SEQ ID NO: 411600 - DNA, 16 bp, M. musculus
gccagagtggagtctc

SEQ ID NO: 411601 - DNA, 16 bp, M. musculus
gccagagttccggtgc

SEQ ID NO: 411602 - DNA, 16 bp, M. musculus
gccagatcctgaccaa

SEQ ID NO: 411603 - DNA, 16 bp, M. musculus
gccagatgctggggtg

SEQ ID NO: 411604 - DNA, 16 bp, M. musculus
gccagcaagaacgacg

SEQ ID NO: 411605 - DNA, 16 bp, M. musculus
gccagcaagagtgaag

SEQ ID NO: 411606 - DNA, 16 bp, M. musculus
gccagcaagatggctt

SEQ ID NO: 411607 - DNA, 16 bp, M. musculus
gccagcaagccagcaa

SEQ ID NO: 411608 - DNA, 16 bp, M. musculus
gccagcaagccccaag

SEQ ID NO: 411609 - DNA, 16 bp, M. musculus
gccagcaaggggcaga

SEQ ID NO: 411610 - DNA, 16 bp, M. musculus
gccagcacagctgctt

SEQ ID NO: 411611 - DNA, 16 bp, M. musculus
gccagcactcaggaga

SEQ ID NO: 411612 - DNA, 16 bp, M. musculus
gccagcactcaggagg

SEQ ID NO: 411613 - DNA, 16 bp, M. musculus
gccagcactctggagg

SEQ ID NO: 411614 - DNA, 16 bp, M. musculus
gccagcactgcccagc

SEQ ID NO: 411615 - DNA, 16 bp, M. musculus
gccagcagaaagaatt

SEQ ID NO: 411616 - DNA, 16 bp, M. musculus
gccagcaggaacaggg

SEQ ID NO: 411617 - DNA, 17 bp, M. musculus
gccagcaggaacaggga

SEQ ID NO: 411618 - DNA, 16 bp, M. musculus
gccagcaggagcaggg

SEQ ID NO: 411619 - DNA, 16 bp, M. musculus
gccagcaggatctctg

SEQ ID NO: 411620 - DNA, 16 bp, M. musculus
gccagcaggcaggcag

SEQ ID NO: 411621 - DNA, 16 bp, M. musculus
gccagcataagctaca

SEQ ID NO: 411622 - DNA, 16 bp, M. musculus
gccagcatcatggtgc

SEQ ID NO: 411623 - DNA, 16 bp, M. musculus
gccagcatctgctctc

SEQ ID NO: 411624 - DNA, 34 bp, M. musculus
gccagcatctgctgtcacctgaatttttgatctt

SEQ ID NO: 411625 - DNA, 16 bp, M. musculus
gccagcatcttcctcc

SEQ ID NO: 411626 - DNA, 16 bp, M. musculus
gccagcatgcctggct

SEQ ID NO: 411627 - DNA, 16 bp, M. musculus
gccagcatggcctaca

SEQ ID NO: 411628 - DNA, 16 bp, M. musculus
gccagcattctctctc

SEQ ID NO: 411629 - DNA, 16 bp, M. musculus
gccagccaaggataca

SEQ ID NO: 411630 - DNA, 16 bp, M. musculus
gccagccaatcaggaa

SEQ ID NO: 411631 - DNA, 16 bp, M. musculus
gccagccagaggagga

SEQ ID NO: 411632 - DNA, 16 bp, M. musculus
gccagccagccagagt

SEQ ID NO: 411633 - DNA, 16 bp, M. musculus
gccagccagccagcct

SEQ ID NO: 411634 - DNA, 16 bp, M. musculus
gccagccagcctaacc

SEQ ID NO: 411635 - DNA, 16 bp, M. musculus
gccagccagggccaca

SEQ ID NO: 411636 - DNA, 17 bp, M. musculus
gccagccagggctacat

SEQ ID NO: 411637 - DNA, 16 bp, M. musculus
gccagccagggctaga

SEQ ID NO: 411638 - DNA, 16 bp, M. musculus
gccagccagggctgca

SEQ ID NO: 411639 - DNA, 16 bp, M. musculus
gccagccaggggtaca

SEQ ID NO: 411640 - DNA, 16 bp, M. musculus
gccagccatcagtgga

SEQ ID NO: 411641 - DNA, 16 bp, M. musculus
gccagcccaaactact

SEQ ID NO: 411642 - DNA, 16 bp, M. musculus
gccagcccagcctact

SEQ ID NO: 411643 - DNA, 16 bp, M. musculus
gccagcccagctgctg

SEQ ID NO: 411644 - DNA, 16 bp, M. musculus
gccagcccaggccact

SEQ ID NO: 411645 - DNA, 16 bp, M. musculus
gccagcccaggcttct

SEQ ID NO: 411646 - DNA, 16 bp, M. musculus
gccagccccagcatca

SEQ ID NO: 411647 - DNA, 16 bp, M. musculus
gccagccctgggcagg

SEQ ID NO: 411648 - DNA, 16 bp, M. musculus
gccagccctttaagtt

SEQ ID NO: 411649 - DNA, 16 bp, M. musculus
gccagcctaagctaca

SEQ ID NO: 411650 - DNA, 16 bp, M. musculus
gccagcctaatctaca

SEQ ID NO: 411651 - DNA, 16 bp, M. musculus
gccagcctagccaaaa

SEQ ID NO: 411652 - DNA, 16 bp, M. musculus
gccagcctagcctact

SEQ ID NO: 411653 - DNA, 16 bp, M. musculus
gccagcctaggcaact

SEQ ID NO: 411654 - DNA, 16 bp, M. musculus
gccagcctaggctaca

SEQ ID NO: 411655 - DNA, 16 bp, M. musculus
gccagcctaggctgca

SEQ ID NO: 411656 - DNA, 16 bp, M. musculus
gccagcctctgctgtc

SEQ ID NO: 411657 - DNA, 16 bp, M. musculus
gccagcctcttctaca

SEQ ID NO: 411658 - DNA, 16 bp, M. musculus
gccagcctgagccaca

SEQ ID NO: 411659 - DNA, 16 bp, M. musculus
gccagcctgagctaca

SEQ ID NO: 411660 - DNA, 16 bp, M. musculus
gccagcctgcagcagg

SEQ ID NO: 411661 - DNA, 16 bp, M. musculus
gccagcctggaacaga

SEQ ID NO: 411662 - DNA, 16 bp, M. musculus
gccagcctggactgtg

SEQ ID NO: 411663 - DNA, 16 bp, M. musculus
gccagcctggagtaca

SEQ ID NO: 411664 - DNA, 16 bp, M. musculus
gccagcctggatgctg

SEQ ID NO: 411665 - DNA, 16 bp, M. musculus
gccagcctggcctaca

SEQ ID NO: 411666 - DNA, 16 bp, M. musculus
gccagcctgggataca

SEQ ID NO: 411667 - DNA, 16 bp, M. musculus
gccagcctgggataga

SEQ ID NO: 411668 - DNA, 16 bp, M. musculus
gccagcctgggcaact

SEQ ID NO: 411669 - DNA, 16 bp, M. musculus
gccagcctgggccaca

SEQ ID NO: 411670 - DNA, 16 bp, M. musculus
gccagcctgggctcca

SEQ ID NO: 411671 - DNA, 16 bp, M. musculus
gccagcctgggctgtg

SEQ ID NO: 411672 - DNA, 16 bp, M. musculus
gccagcctgggctttg

SEQ ID NO: 411673 - DNA, 16 bp, M. musculus
gccagcctgggtcaca

SEQ ID NO: 411674 - DNA, 16 bp, M. musculus
gccagcctgggttaca

SEQ ID NO: 411675 - DNA, 18 bp, M. musculus
gccagcctggtctacaca

SEQ ID NO: 411676 - DNA, 20 bp, M. musculus
gccagcctggtctacatagc

SEQ ID NO: 411677 - DNA, 16 bp, M. musculus
gccagcctggtctacg

SEQ ID NO: 411678 - DNA, 16 bp, M. musculus
gccagcctggtctact

SEQ ID NO: 411679 - DNA, 16 bp, M. musculus
gccagcctggtgtaca

SEQ ID NO: 411680 - DNA, 16 bp, M. musculus
gccagcctgtgctacc

SEQ ID NO: 411681 - DNA, 16 bp, M. musculus
gccagccttgaactta

SEQ ID NO: 411682 - DNA, 16 bp, M. musculus
gccagccttgaacttg

SEQ ID NO: 411683 - DNA, 16 bp, M. musculus
gccagcgccaccctgc

SEQ ID NO: 411684 - DNA, 16 bp, M. musculus
gccagctagccagcca

SEQ ID NO: 411685 - DNA, 16 bp, M. musculus
gccagctagcctggag

SEQ ID NO: 411686 - DNA, 16 bp, M. musculus
gccagctcaccagctc

SEQ ID NO: 411687 - DNA, 16 bp, M. musculus
gccagctcaggctact

SEQ ID NO: 411688 - DNA, 16 bp, M. musculus
gccagctccaggccac

SEQ ID NO: 411689 - DNA, 16 bp, M. musculus
gccagctccccagctc

SEQ ID NO: 411690 - DNA, 16 bp, M. musculus
gccagctctactctgc

SEQ ID NO: 411691 - DNA, 16 bp, M. musculus
gccagctctccagagc

SEQ ID NO: 411692 - DNA, 16 bp, M. musculus
gccagctctcccacct

SEQ ID NO: 411693 - DNA, 16 bp, M. musculus
gccagctctcctgcac

SEQ ID NO: 411694 - DNA, 16 bp, M. musculus
gccagctctgcacagc

SEQ ID NO: 411695 - DNA, 16 bp, M. musculus
gccagctctgcagccc

SEQ ID NO: 411696 - DNA, 16 bp, M. musculus
gccagctgcagacagt

SEQ ID NO: 411697 - DNA, 16 bp, M. musculus
gccagctggtacaacc

SEQ ID NO: 411698 - DNA, 16 bp, M. musculus
gccagctgtggtggtg

SEQ ID NO: 411699 - DNA, 16 bp, M. musculus
gccagctgtttctggg

SEQ ID NO: 411700 - DNA, 16 bp, M. musculus
gccagcttgaactaca

SEQ ID NO: 411701 - DNA, 16 bp, M. musculus
gccagcttggtgtaca

SEQ ID NO: 411702 - DNA, 16 bp, M. musculus
gccagcttggtttata

SEQ ID NO: 411703 - DNA, 16 bp, M. musculus
gccagctttactgtgc

SEQ ID NO: 411704 - DNA, 16 bp, M. musculus
gccagctttggctaca

SEQ ID NO: 411705 - DNA, 16 bp, M. musculus
gccaggaaaacaagag

SEQ ID NO: 411706 - DNA, 16 bp, M. musculus
gccaggaaatccagga

SEQ ID NO: 411707 - DNA, 16 bp, M. musculus
gccaggaagagactct

SEQ ID NO: 411708 - DNA, 16 bp, M. musculus
gccaggaagcaggact

SEQ ID NO: 411709 - DNA, 16 bp, M. musculus
gccaggaagcccgggg

SEQ ID NO: 411710 - DNA, 16 bp, M. musculus
gccaggaagtaggaat

SEQ ID NO: 411711 - DNA, 16 bp, M. musculus
gccaggaatcagacac

SEQ ID NO: 411712 - DNA, 16 bp, M. musculus
gccaggacactgatga

SEQ ID NO: 411713 - DNA, 16 bp, M. musculus
gccaggacagctcctg

SEQ ID NO: 411714 - DNA, 16 bp, M. musculus
gccaggacagggaagg

SEQ ID NO: 411715 - DNA, 16 bp, M. musculus
gccaggacataagtca

SEQ ID NO: 411716 - DNA, 16 bp, M. musculus
gccaggaccaaaaaat

SEQ ID NO: 411717 - DNA, 16 bp, M. musculus
gccaggagaagactgt

SEQ ID NO: 411718 - DNA, 16 bp, M. musculus
gccaggagagggtgtc

SEQ ID NO: 411719 - DNA, 16 bp, M. musculus
gccaggagatcctgga

SEQ ID NO: 411720 - DNA, 16 bp, M. musculus
gccaggagcagactgt

SEQ ID NO: 411721 - DNA, 16 bp, M. musculus
gccaggaggagactgt

SEQ ID NO: 411722 - DNA, 16 bp, M. musculus
gccaggaggtggtggc

SEQ ID NO: 411723 - DNA, 16 bp, M. musculus
gccaggattacagatg

SEQ ID NO: 411724 - DNA, 16 bp, M. musculus
gccaggcaaacactct

SEQ ID NO: 411725 - DNA, 16 bp, M. musculus
gccaggcaagcattct

SEQ ID NO: 411726 - DNA, 16 bp, M. musculus
gccaggcaagctctct

SEQ ID NO: 411727 - DNA, 16 bp, M. musculus
gccaggcagaagagga

SEQ ID NO: 411728 - DNA, 16 bp, M. musculus
gccaggcagaggtggc

SEQ ID NO: 411729 - DNA, 16 bp, M. musculus
gccaggcagcgggcac

SEQ ID NO: 411730 - DNA, 16 bp, M. musculus
gccaggcagcggtggc

SEQ ID NO: 411731 - DNA, 16 bp, M. musculus
gccaggcaggacttct

SEQ ID NO: 411732 - DNA, 16 bp, M. musculus
gccaggcagtggtggt

SEQ ID NO: 411733 - DNA, 17 bp, M. musculus
gccaggcagtgtctttg

SEQ ID NO: 411734 - DNA, 16 bp, M. musculus
gccaggcataatggca

SEQ ID NO: 411735 - DNA, 16 bp, M. musculus
gccaggccaggaggag

SEQ ID NO: 411736 - DNA, 16 bp, M. musculus
gccaggcccagtggct

SEQ ID NO: 411737 - DNA, 16 bp, M. musculus
gccaggcccagtgtgt

SEQ ID NO: 411738 - DNA, 16 bp, M. musculus
gccaggcctccccact

SEQ ID NO: 411739 - DNA, 16 bp, M. musculus
gccaggcctgcctgga

SEQ ID NO: 411740 - DNA, 16 bp, M. musculus
gccaggcctggtggct

SEQ ID NO: 411741 - DNA, 16 bp, M. musculus
gccaggcggtggtggc

SEQ ID NO: 411742 - DNA, 16 bp, M. musculus
gccaggcgtggtgatg

SEQ ID NO: 411743 - DNA, 16 bp, M. musculus
gccaggcgtggtggtg

SEQ ID NO: 411744 - DNA, 16 bp, M. musculus
gccaggctcaggtttg

SEQ ID NO: 411745 - DNA, 16 bp, M. musculus
gccaggctctgaaaga

SEQ ID NO: 411746 - DNA, 16 bp, M. musculus
gccaggctggctggct

SEQ ID NO: 411747 - DNA, 16 bp, M. musculus
gccaggctggtctcca

SEQ ID NO: 411748 - DNA, 16 bp, M. musculus
gccaggcttggtggtg

SEQ ID NO: 411749 - DNA, 16 bp, M. musculus
gccagggaaacacaga

SEQ ID NO: 411750 - DNA, 16 bp, M. musculus
gccagggaagcaagcc

SEQ ID NO: 411751 - DNA, 16 bp, M. musculus
gccagggacacacaga

SEQ ID NO: 411752 - DNA, 16 bp, M. musculus
gccagggacccctgtg

SEQ ID NO: 411753 - DNA, 17 bp, M. musculus
gccagggagtccggaat

SEQ ID NO: 411754 - DNA, 16 bp, M. musculus
gccagggcagccacat

SEQ ID NO: 411755 - DNA, 16 bp, M. musculus
gccagggccaaggagt

SEQ ID NO: 411756 - DNA, 16 bp, M. musculus
gccagggccaggaggt

SEQ ID NO: 411757 - DNA, 16 bp, M. musculus
gccagggccagggagc

SEQ ID NO: 411758 - DNA, 16 bp, M. musculus
gccagggcctgaggca

SEQ ID NO: 411759 - DNA, 16 bp, M. musculus
gccagggctacaaaat

SEQ ID NO: 411760 - DNA, 21 bp, M. musculus
gccagggctacacaaagaaac

SEQ ID NO: 411761 - DNA, 16 bp, M. musculus
gccagggctacactgt

SEQ ID NO: 411762 - DNA, 16 bp, M. musculus
gccagggctacatagc

SEQ ID NO: 411763 - DNA, 16 bp, M. musculus
gccagggctatacagt

SEQ ID NO: 411764 - DNA, 16 bp, M. musculus
gccagggctgcacagt

SEQ ID NO: 411765 - DNA, 16 bp, M. musculus
gccagggctggaaggc

SEQ ID NO: 411766 - DNA, 16 bp, M. musculus
gccagggctgtacaga

SEQ ID NO: 411767 - DNA, 16 bp, M. musculus
gccaggggcccaggag

SEQ ID NO: 411768 - DNA, 16 bp, M. musculus
gccaggtagtggtggc

SEQ ID NO: 411769 - DNA, 16 bp, M. musculus
gccaggtgcttctgct

SEQ ID NO: 411770 - DNA, 16 bp, M. musculus
gccaggtgtagtggct

SEQ ID NO: 411771 - DNA, 16 bp, M. musculus
gccaggtgtgatggtg

SEQ ID NO: 411772 - DNA, 16 bp, M. musculus
gccaggtgtggtgaca

SEQ ID NO: 411773 - DNA, 16 bp, M. musculus
gccaggtgtggtggtg

SEQ ID NO: 411774 - DNA, 16 bp, M. musculus
gccagtaaccagaaaa

SEQ ID NO: 411775 - DNA, 16 bp, M. musculus
gccagtaatttctcag

SEQ ID NO: 411776 - DNA, 16 bp, M. musculus
gccagtaggcagcact

SEQ ID NO: 411777 - DNA, 16 bp, M. musculus
gccagtatttagcatt

SEQ ID NO: 411778 - DNA, 16 bp, M. musculus
gccagtcagcctagcc

SEQ ID NO: 411779 - DNA, 16 bp, M. musculus
gccagtcagtcagcca

SEQ ID NO: 411780 - DNA, 16 bp, M. musculus
gccagtctagtctaca

SEQ ID NO: 411781 - DNA, 16 bp, M. musculus
gccagtctggactaca

SEQ ID NO: 411782 - DNA, 16 bp, M. musculus
gccagtgagatagctc

SEQ ID NO: 411783 - DNA, 16 bp, M. musculus
gccagtgagcagcatt

SEQ ID NO: 411784 - DNA, 16 bp, M. musculus
gccagtgagctccaga

SEQ ID NO: 411785 - DNA, 16 bp, M. musculus
gccagtgagctccagg

SEQ ID NO: 411786 - DNA, 16 bp, M. musculus
gccagtgcctggcaca

SEQ ID NO: 411787 - DNA, 16 bp, M. musculus
gccagtgcctggtaaa

SEQ ID NO: 411788 - DNA, 16 bp, M. musculus
gccagtgctacacaga

SEQ ID NO: 411789 - DNA, 16 bp, M. musculus
gccagtgctcctaacc

SEQ ID NO: 411790 - DNA, 16 bp, M. musculus
gccagtgctcttaact

SEQ ID NO: 411791 - DNA, 16 bp, M. musculus
gccagtgctcttagct

SEQ ID NO: 411792 - DNA, 16 bp, M. musculus
gccagtgctgccattg

SEQ ID NO: 411793 - DNA, 16 bp, M. musculus
gccagtgctgctgctg

SEQ ID NO: 411794 - DNA, 16 bp, M. musculus
gccagttaaaccagca

SEQ ID NO: 411795 - DNA, 16 bp, M. musculus
gccagttcaggctctg

SEQ ID NO: 411796 - DNA, 16 bp, M. musculus
gccagttgagacagca

SEQ ID NO: 411797 - DNA, 16 bp, M. musculus
gccataagttccacca

SEQ ID NO: 411798 - DNA, 16 bp, M. musculus
gccatacttcctgcca

SEQ ID NO: 411799 - DNA, 16 bp, M. musculus
gccatagtcacagcaa

SEQ ID NO: 411800 - DNA, 16 bp, M. musculus
gccatatcaggctcct

SEQ ID NO: 411801 - DNA, 16 bp, M. musculus
gccatatcttctgctg

SEQ ID NO: 411802 - DNA, 16 bp, M. musculus
gccatatgtgtgtgtg

SEQ ID NO: 411803 - DNA, 16 bp, M. musculus
gccatattcagcagat

SEQ ID NO: 411804 - DNA, 16 bp, M. musculus
gccatcacacttggct

SEQ ID NO: 411805 - DNA, 16 bp, M. musculus
gccatcaccgcctggc

SEQ ID NO: 411806 - DNA, 16 bp, M. musculus
gccatcactccagtcc

SEQ ID NO: 411807 - DNA, 28 bp, M. musculus
gccatcactggaaagagaggcccattgg

SEQ ID NO: 411808 - DNA, 16 bp, M. musculus
gccatcactggaagag

SEQ ID NO: 411809 - DNA, 16 bp, M. musculus
gccatcactggcaaga

SEQ ID NO: 411810 - DNA, 16 bp, M. musculus
gccatcacttggaaga

SEQ ID NO: 411811 - DNA, 16 bp, M. musculus
gccatcagtcacataa

SEQ ID NO: 411812 - DNA, 16 bp, M. musculus
gccatcatacccagct

SEQ ID NO: 411813 - DNA, 16 bp, M. musculus
gccatcatcaccatca

SEQ ID NO: 411814 - DNA, 16 bp, M. musculus
gccatcatcagaaaag

SEQ ID NO: 411815 - DNA, 16 bp, M. musculus
gccatcatcatcatca

SEQ ID NO: 411816 - DNA, 16 bp, M. musculus
gccatcattggaaaga

SEQ ID NO: 411817 - DNA, 16 bp, M. musculus
gccatcattggcaaga

SEQ ID NO: 411818 - DNA, 16 bp, M. musculus
gccatccatgggctgg

SEQ ID NO: 411819 - DNA, 16 bp, M. musculus
gccatcccaaaagctg

SEQ ID NO: 411820 - DNA, 16 bp, M. musculus
gccatcccaccagccc

SEQ ID NO: 411821 - DNA, 16 bp, M. musculus
gccatcccactggccc

SEQ ID NO: 411822 - DNA, 16 bp, M. musculus
gccatccccactcctc

SEQ ID NO: 411823 - DNA, 16 bp, M. musculus
gccatccctgtgctgg

SEQ ID NO: 411824 - DNA, 17 bp, M. musculus
gccatccgtggaaagag

SEQ ID NO: 411825 - DNA, 16 bp, M. musculus
gccatcctaggctaca

SEQ ID NO: 411826 - DNA, 16 bp, M. musculus
gccatcctcagctgca

SEQ ID NO: 411827 - DNA, 16 bp, M. musculus
gccatcctcctctaca

SEQ ID NO: 411828 - DNA, 16 bp, M. musculus
gccatcctgccaaaag

SEQ ID NO: 411829 - DNA, 16 bp, M. musculus
gccatcctgctcagcc

SEQ ID NO: 411830 - DNA, 16 bp, M. musculus
gccatcctgctctaca

SEQ ID NO: 411831 - DNA, 16 bp, M. musculus
gccatcctggactaca

SEQ ID NO: 411832 - DNA, 16 bp, M. musculus
gccatcctggtctaca

SEQ ID NO: 411833 - DNA, 16 bp, M. musculus
gccatcctggtttaca

SEQ ID NO: 411834 - DNA, 16 bp, M. musculus
gccatccttgggctgg

SEQ ID NO: 411835 - DNA, 16 bp, M. musculus
gccatctacccagccc

SEQ ID NO: 411836 - DNA, 16 bp, M. musculus
gccatctcactgaccc

SEQ ID NO: 411837 - DNA, 16 bp, M. musculus
gccatctcactgcccc

SEQ ID NO: 411838 - DNA, 16 bp, M. musculus
gccatctcactggccc

SEQ ID NO: 411839 - DNA, 16 bp, M. musculus
gccatctccacagcct

SEQ ID NO: 411840 - DNA, 16 bp, M. musculus
gccatctcccaggccc

SEQ ID NO: 411841 - DNA, 16 bp, M. musculus
gccatctccccagacc

SEQ ID NO: 411842 - DNA, 16 bp, M. musculus
gccatctccgcagccc

SEQ ID NO: 411843 - DNA, 16 bp, M. musculus
gccatctcctcagccc

SEQ ID NO: 411844 - DNA, 16 bp, M. musculus
gccatctctacagctc

SEQ ID NO: 411845 - DNA, 16 bp, M. musculus
gccatctctcaggccc

SEQ ID NO: 411846 - DNA, 16 bp, M. musculus
gccatctctccaaact

SEQ ID NO: 411847 - DNA, 16 bp, M. musculus
gccatctctccaggcc

SEQ ID NO: 411848 - DNA, 16 bp, M. musculus
gccatctctctaatcc

SEQ ID NO: 411849 - DNA, 16 bp, M. musculus
gccatctctctagcct

SEQ ID NO: 411850 - DNA, 16 bp, M. musculus
gccatctctctaggcc

SEQ ID NO: 411851 - DNA, 16 bp, M. musculus
gccatctctctggcca

SEQ ID NO: 411852 - DNA, 16 bp, M. musculus
gccatctctctgtccc

SEQ ID NO: 411853 - DNA, 16 bp, M. musculus
gccatctctggagccc

SEQ ID NO: 411854 - DNA, 16 bp, M. musculus
gccatctctttaaccc

SEQ ID NO: 411855 - DNA, 16 bp, M. musculus
gccatctgctgctaca

SEQ ID NO: 411856 - DNA, 16 bp, M. musculus
gccatctgggttctgg

SEQ ID NO: 411857 - DNA, 16 bp, M. musculus
gccatctggtctacct

SEQ ID NO: 411858 - DNA, 16 bp, M. musculus
gccatctgtccagcct

SEQ ID NO: 411859 - DNA, 16 bp, M. musculus
gccatctgtggaaaga

SEQ ID NO: 411860 - DNA, 16 bp, M. musculus
gccatcttcagctaca

SEQ ID NO: 411861 - DNA, 16 bp, M. musculus
gccatcttcccagcca

SEQ ID NO: 411862 - DNA, 16 bp, M. musculus
gccatcttctcagctc

SEQ ID NO: 411863 - DNA, 16 bp, M. musculus
gccatcttgcaggccc

SEQ ID NO: 411864 - DNA, 16 bp, M. musculus
gccatcttgccagctc

SEQ ID NO: 411865 - DNA, 16 bp, M. musculus
gccatcttgccagtct

SEQ ID NO: 411866 - DNA, 16 bp, M. musculus
gccatcttgctgaccc

SEQ ID NO: 411867 - DNA, 16 bp, M. musculus
gccatcttgctggctt

SEQ ID NO: 411868 - DNA, 16 bp, M. musculus
gccatcttggaactca

SEQ ID NO: 411869 - DNA, 16 bp, M. musculus
gccatcttgggtcctg

SEQ ID NO: 411870 - DNA, 16 bp, M. musculus
gccatcttggttccag

SEQ ID NO: 411871 - DNA, 16 bp, M. musculus
gccatcttgtaatggc

SEQ ID NO: 411872 - DNA, 16 bp, M. musculus
gccatctttccagctc

SEQ ID NO: 411873 - DNA, 16 bp, M. musculus
gccatctttctagccc

SEQ ID NO: 411874 - DNA, 16 bp, M. musculus
gccatctttggctaca

SEQ ID NO: 411875 - DNA, 16 bp, M. musculus
gccatcttttgatact

SEQ ID NO: 411876 - DNA, 16 bp, M. musculus
gccatcttttgctaca

SEQ ID NO: 411877 - DNA, 16 bp, M. musculus
gccatgaacacatgga

SEQ ID NO: 411878 - DNA, 16 bp, M. musculus
gccatgaccacatgga

SEQ ID NO: 411879 - DNA, 16 bp, M. musculus
gccatgcactggcagg

SEQ ID NO: 411880 - DNA, 16 bp, M. musculus
gccatgccatgccatg

SEQ ID NO: 411881 - DNA, 16 bp, M. musculus
gccatgctaaaggcct

SEQ ID NO: 411882 - DNA, 16 bp, M. musculus
gccatgctcccagaca

SEQ ID NO: 411883 - DNA, 16 bp, M. musculus
gccatgctgtgcttgc

SEQ ID NO: 411884 - DNA, 16 bp, M. musculus
gccatggaaggatgct

SEQ ID NO: 411885 - DNA, 16 bp, M. musculus
gccatggactctaacc

SEQ ID NO: 411886 - DNA, 16 bp, M. musculus
gccatggagaactggg

SEQ ID NO: 411887 - DNA, 16 bp, M. musculus
gccatggagggatgtg

SEQ ID NO: 411888 - DNA, 16 bp, M. musculus
gccatggagggatgtt

SEQ ID NO: 411889 - DNA, 16 bp, M. musculus
gccatggatgaactgg

SEQ ID NO: 411890 - DNA, 16 bp, M. musculus
gccatggccaagaagt

SEQ ID NO: 411891 - DNA, 16 bp, M. musculus
gccatggccaagagga

SEQ ID NO: 411892 - DNA, 16 bp, M. musculus
gccatggccagcctct

SEQ ID NO: 411893 - DNA, 16 bp, M. musculus
gccatggccaggaagc

SEQ ID NO: 411894 - DNA, 16 bp, M. musculus
gccatggccatggtgt

SEQ ID NO: 411895 - DNA, 16 bp, M. musculus
gccatggccttgtgga

SEQ ID NO: 411896 - DNA, 16 bp, M. musculus
gccatggctcagtggt

SEQ ID NO: 411897 - DNA, 16 bp, M. musculus
gccatgggacaggcag

SEQ ID NO: 411898 - DNA, 16 bp, M. musculus
gccatgggatacatgc

SEQ ID NO: 411899 - DNA, 81 bp, M. musculus
gccatggggactgacacaaaggcctcctcacttctcatagagacctcaaccccgtacactccagacttcttccattatact

SEQ ID NO: 411900 - DNA, 16 bp, M. musculus
gccatggggctggaga

SEQ ID NO: 411901 - DNA, 16 bp, M. musculus
gccatgggtcactcca

SEQ ID NO: 411902 - DNA, 16 bp, M. musculus
gccatgggtccctgca

SEQ ID NO: 411903 - DNA, 16 bp, M. musculus
gccatgggtgctggga

SEQ ID NO: 411904 - DNA, 16 bp, M. musculus
gccatggtggtgcaca

SEQ ID NO: 411905 - DNA, 16 bp, M. musculus
gccatggtgtgcatgt

SEQ ID NO: 411906 - DNA, 16 bp, M. musculus
gccatggtgtttatca

SEQ ID NO: 411907 - DNA, 16 bp, M. musculus
gccatgtctgtctcct

SEQ ID NO: 411908 - DNA, 16 bp, M. musculus
gccatgtgaatgctgg

SEQ ID NO: 411909 - DNA, 16 bp, M. musculus
gccatgtgggagctgg

SEQ ID NO: 411910 - DNA, 16 bp, M. musculus
gccatgtgggtcctgg

SEQ ID NO: 411911 - DNA, 16 bp, M. musculus
gccatgtggttgctgg

SEQ ID NO: 411912 - DNA, 16 bp, M. musculus
gccatgttactggatt

SEQ ID NO: 411913 - DNA, 16 bp, M. musculus
gccatgttggaggaag

SEQ ID NO: 411914 - DNA, 16 bp, M. musculus
gccatgtttttgtttg

SEQ ID NO: 411915 - DNA, 16 bp, M. musculus
gccattagagatttct

SEQ ID NO: 411916 - DNA, 16 bp, M. musculus
gccattataagatggc

SEQ ID NO: 411917 - DNA, 16 bp, M. musculus
gccattcagaattcct

SEQ ID NO: 411918 - DNA, 16 bp, M. musculus
gccattccctggacca

SEQ ID NO: 411919 - DNA, 23 bp, M. musculus
gccattcggtattcctcaggtga

SEQ ID NO: 411920 - DNA, 16 bp, M. musculus
gccattctcctgcctc

SEQ ID NO: 411921 - DNA, 16 bp, M. musculus
gccattctggtctaca

SEQ ID NO: 411922 - DNA, 16 bp, M. musculus
gccattcttccagagg

SEQ ID NO: 411923 - DNA, 16 bp, M. musculus
gccattcttggttgtg

SEQ ID NO: 411924 - DNA, 16 bp, M. musculus
gccattgaaactggga

SEQ ID NO: 411925 - DNA, 17 bp, M. musculus
gccattgaacaaggggc

SEQ ID NO: 411926 - DNA, 16 bp, M. musculus
gccattgacttgtatg

SEQ ID NO: 411927 - DNA, 16 bp, M. musculus
gccattgagtttgttt

SEQ ID NO: 411928 - DNA, 20 bp, M. musculus
gccattgatgttctattcag

SEQ ID NO: 411929 - DNA, 16 bp, M. musculus
gccattgatttctttg

SEQ ID NO: 411930 - DNA, 16 bp, M. musculus
gccattgctcttggtt

SEQ ID NO: 411931 - DNA, 16 bp, M. musculus
gccattggccattggc

SEQ ID NO: 411932 - DNA, 16 bp, M. musculus
gccatttaaccatggc

SEQ ID NO: 411933 - DNA, 16 bp, M. musculus
gccatttcaccagccc

SEQ ID NO: 411934 - DNA, 16 bp, M. musculus
gccatttctccatcct

SEQ ID NO: 411935 - DNA, 16 bp, M. musculus
gccatttgtatttctt

SEQ ID NO: 411936 - DNA, 16 bp, M. musculus
gccattttgattatat

SEQ ID NO: 411937 - DNA, 16 bp, M. musculus
gccattttgtcctatg

SEQ ID NO: 411938 - DNA, 16 bp, M. musculus
gcccaaaggaaagaag

SEQ ID NO: 411939 - DNA, 41 bp, M. musculus
gcccaaatttgccagaaacaggtcaagtatctggggtatct

SEQ ID NO: 411940 - DNA, 16 bp, M. musculus
gcccaagaaaaagcaa

SEQ ID NO: 411941 - DNA, 16 bp, M. musculus
gcccaagaattgtcct

SEQ ID NO: 411942 - DNA, 16 bp, M. musculus
gcccaagaggcttctg

SEQ ID NO: 411943 - DNA, 16 bp, M. musculus
gcccaagctggcctgg

SEQ ID NO: 411944 - DNA, 16 bp, M. musculus
gcccaagggcctctcc

SEQ ID NO: 411945 - DNA, 16 bp, M. musculus
gcccaagttatatcca

SEQ ID NO: 411946 - DNA, 16 bp, M. musculus
gcccacaaccatctat

SEQ ID NO: 411947 - DNA, 16 bp, M. musculus
gcccacaagcaaagga

SEQ ID NO: 411948 - DNA, 16 bp, M. musculus
gcccacacccacaggg

SEQ ID NO: 411949 - DNA, 16 bp, M. musculus
gcccacagctctggca

SEQ ID NO: 411950 - DNA, 16 bp, M. musculus
gcccacaggaacaaag

SEQ ID NO: 411951 - DNA, 16 bp, M. musculus
gcccacaggctggatc

SEQ ID NO: 411952 - DNA, 16 bp, M. musculus
gcccacagtgggcagg

SEQ ID NO: 411953 - DNA, 16 bp, M. musculus
gcccacatgggactcc

SEQ ID NO: 411954 - DNA, 16 bp, M. musculus
gcccaccagctctccc

SEQ ID NO: 411955 - DNA, 16 bp, M. musculus
gcccaccccagcatgg

SEQ ID NO: 411956 - DNA, 16 bp, M. musculus
gcccacccccaaagtg

SEQ ID NO: 411957 - DNA, 16 bp, M. musculus
gcccacctgcaaccag

SEQ ID NO: 411958 - DNA, 16 bp, M. musculus
gcccactcctgcttcc

SEQ ID NO: 411959 - DNA, 16 bp, M. musculus
gcccactgcccactgc

SEQ ID NO: 411960 - DNA, 16 bp, M. musculus
gcccactgtgcttgaa

SEQ ID NO: 411961 - DNA, 16 bp, M. musculus
gcccactgtgcttgga

SEQ ID NO: 411962 - DNA, 16 bp, M. musculus
gcccagaaacccagaa

SEQ ID NO: 411963 - DNA, 16 bp, M. musculus
gcccagaaatttagga

SEQ ID NO: 411964 - DNA, 16 bp, M. musculus
gcccagaactcacaga

SEQ ID NO: 411965 - DNA, 17 bp, M. musculus
gcccagaagatgctcca

SEQ ID NO: 411966 - DNA, 16 bp, M. musculus
gcccagaagattgtga

SEQ ID NO: 411967 - DNA, 16 bp, M. musculus
gcccagaccagaagga

SEQ ID NO: 411968 - DNA, 16 bp, M. musculus
gcccagagcaccagaa

SEQ ID NO: 411969 - DNA, 16 bp, M. musculus
gcccagagctctgcca

SEQ ID NO: 411970 - DNA, 16 bp, M. musculus
gcccagaggaccagga

SEQ ID NO: 411971 - DNA, 16 bp, M. musculus
gcccagagtcccccag

SEQ ID NO: 411972 - DNA, 16 bp, M. musculus
gcccagatccagggct

SEQ ID NO: 411973 - DNA, 16 bp, M. musculus
gcccagatctcagctg

SEQ ID NO: 411974 - DNA, 19 bp, M. musculus
gcccagattaaaggtgtgt

SEQ ID NO: 411975 - DNA, 16 bp, M. musculus
gcccagcacttgggag

SEQ ID NO: 411976 - DNA, 16 bp, M. musculus
gcccagcaggtaagag

SEQ ID NO: 411977 - DNA, 16 bp, M. musculus
gcccagccactgagct

SEQ ID NO: 411978 - DNA, 16 bp, M. musculus
gcccagccactggctg

SEQ ID NO: 411979 - DNA, 16 bp, M. musculus
gcccagccatctctcc

SEQ ID NO: 411980 - DNA, 16 bp, M. musculus
gcccagccattgagct

SEQ ID NO: 411981 - DNA, 16 bp, M. musculus
gcccagcccacagtgg

SEQ ID NO: 411982 - DNA, 16 bp, M. musculus
gcccagcccagcccct

SEQ ID NO: 411983 - DNA, 16 bp, M. musculus
gcccagcccagccctg

SEQ ID NO: 411984 - DNA, 16 bp, M. musculus
gcccagccccagtgac

SEQ ID NO: 411985 - DNA, 16 bp, M. musculus
gcccagccttgatatg

SEQ ID NO: 411986 - DNA, 16 bp, M. musculus
gcccagctctcaggag

SEQ ID NO: 411987 - DNA, 16 bp, M. musculus
gcccagctgtcctgga

SEQ ID NO: 411988 - DNA, 16 bp, M. musculus
gcccagctgtgagact

SEQ ID NO: 411989 - DNA, 16 bp, M. musculus
gcccaggaagcaggag

SEQ ID NO: 411990 - DNA, 16 bp, M. musculus
gcccaggaccacctgc

SEQ ID NO: 411991 - DNA, 16 bp, M. musculus
gcccaggagaagaatt

SEQ ID NO: 411992 - DNA, 16 bp, M. musculus
gcccaggctacccttg

SEQ ID NO: 411993 - DNA, 16 bp, M. musculus
gcccaggctagcctta

SEQ ID NO: 411994 - DNA, 16 bp, M. musculus
gcccaggctgacctgg

SEQ ID NO: 411995 - DNA, 16 bp, M. musculus
gcccaggctgactttg

SEQ ID NO: 411996 - DNA, 16 bp, M. musculus
gcccaggctggccaca

SEQ ID NO: 411997 - DNA, 16 bp, M. musculus
gcccaggctggccagg

SEQ ID NO: 411998 - DNA, 16 bp, M. musculus
gcccaggctggcctct

SEQ ID NO: 411999 - DNA, 16 bp, M. musculus
gcccaggctggcctga

SEQ ID NO: 412000 - DNA, 16 bp, M. musculus
gcccaggctgggctca

SEQ ID NO: 412001 - DNA, 16 bp, M. musculus
gcccaggctggtctgg

SEQ ID NO: 412002 - DNA, 16 bp, M. musculus
gcccaggctgtcctca

SEQ ID NO: 412003 - DNA, 16 bp, M. musculus
gcccagggagccctgc

SEQ ID NO: 412004 - DNA, 16 bp, M. musculus
gcccagggatggtgcc

SEQ ID NO: 412005 - DNA, 16 bp, M. musculus
gcccagggctggagag

SEQ ID NO: 412006 - DNA, 16 bp, M. musculus
gcccaggggctaggct

SEQ ID NO: 412007 - DNA, 16 bp, M. musculus
gcccagggtcagatgg

SEQ ID NO: 412008 - DNA, 16 bp, M. musculus
gcccagggtgaccttg

SEQ ID NO: 412009 - DNA, 16 bp, M. musculus
gcccagggtggcactg

SEQ ID NO: 412010 - DNA, 16 bp, M. musculus
gcccagggtggctttg

SEQ ID NO: 412011 - DNA, 16 bp, M. musculus
gcccaggttggcctga

SEQ ID NO: 412012 - DNA, 16 bp, M. musculus
gcccaggttgtcctgg

SEQ ID NO: 412013 - DNA, 16 bp, M. musculus
gcccagtcactgccca

SEQ ID NO: 412014 - DNA, 16 bp, M. musculus
gcccagtccctgggct

SEQ ID NO: 412015 - DNA, 16 bp, M. musculus
gcccagtcctgggcac

SEQ ID NO: 412016 - DNA, 16 bp, M. musculus
gcccagtctggtctac

SEQ ID NO: 412017 - DNA, 16 bp, M. musculus
gcccagtgcccagtgc

SEQ ID NO: 412018 - DNA, 16 bp, M. musculus
gcccagtggcagagca

SEQ ID NO: 412019 - DNA, 16 bp, M. musculus
gcccagtggccaccta

SEQ ID NO: 412020 - DNA, 16 bp, M. musculus
gcccagtgtctctctt

SEQ ID NO: 412021 - DNA, 16 bp, M. musculus
gcccagtgtggtggca

SEQ ID NO: 412022 - DNA, 16 bp, M. musculus
gcccagtgttcttggt

SEQ ID NO: 412023 - DNA, 16 bp, M. musculus
gcccagttgcagcaga

SEQ ID NO: 412024 - DNA, 16 bp, M. musculus
gcccatccccagtcac

SEQ ID NO: 412025 - DNA, 16 bp, M. musculus
gcccatctcctttctc

SEQ ID NO: 412026 - DNA, 16 bp, M. musculus
gcccatctgctgccca

SEQ ID NO: 412027 - DNA, 16 bp, M. musculus
gcccatgatcccagca

SEQ ID NO: 412028 - DNA, 16 bp, M. musculus
gcccatgcccagtgac

SEQ ID NO: 412029 - DNA, 16 bp, M. musculus
gcccatgcccatgccc

SEQ ID NO: 412030 - DNA, 16 bp, M. musculus
gcccatgctggcttca

SEQ ID NO: 412031 - DNA, 16 bp, M. musculus
gcccatggagggcaga

SEQ ID NO: 412032 - DNA, 20 bp, M. musculus
gcccattggacatgcaaact

SEQ ID NO: 412033 - DNA, 16 bp, M. musculus
gcccattgttcttgca

SEQ ID NO: 412034 - DNA, 16 bp, M. musculus
gccccaaactcagaaa

SEQ ID NO: 412035 - DNA, 16 bp, M. musculus
gccccaaagctcagaa

SEQ ID NO: 412036 - DNA, 16 bp, M. musculus
gccccaagggttcagg

SEQ ID NO: 412037 - DNA, 16 bp, M. musculus
gccccaaggtccccag

SEQ ID NO: 412038 - DNA, 16 bp, M. musculus
gccccaccacctggcc

SEQ ID NO: 412039 - DNA, 16 bp, M. musculus
gccccacctcttaaag

SEQ ID NO: 412040 - DNA, 16 bp, M. musculus
gccccacctgaggaag

SEQ ID NO: 412041 - DNA, 16 bp, M. musculus
gccccacctgggcatc

SEQ ID NO: 412042 - DNA, 16 bp, M. musculus
gccccacctggggacc

SEQ ID NO: 412043 - DNA, 16 bp, M. musculus
gccccagagaaggagg

SEQ ID NO: 412044 - DNA, 16 bp, M. musculus
gccccagagaagggag

SEQ ID NO: 412045 - DNA, 16 bp, M. musculus
gccccagcaccaggtc

SEQ ID NO: 412046 - DNA, 16 bp, M. musculus
gccccagccccagcct

SEQ ID NO: 412047 - DNA, 16 bp, M. musculus
gccccagccccagctg

SEQ ID NO: 412048 - DNA, 16 bp, M. musculus
gccccagcccctcact

SEQ ID NO: 412049 - DNA, 16 bp, M. musculus
gccccagctcctgggt

SEQ ID NO: 412050 - DNA, 16 bp, M. musculus
gccccaggaatttgtc

SEQ ID NO: 412051 - DNA, 16 bp, M. musculus
gccccaggcagcctct

SEQ ID NO: 412052 - DNA, 24 bp, M. musculus
gccccaggccccgagttactcaaa

SEQ ID NO: 412053 - DNA, 16 bp, M. musculus
gccccagggagtgagg

SEQ ID NO: 412054 - DNA, 16 bp, M. musculus
gccccagggctatcca

SEQ ID NO: 412055 - DNA, 16 bp, M. musculus
gccccagtgtggagga

SEQ ID NO: 412056 - DNA, 21 bp, M. musculus
gccccatcgggagggtattca

SEQ ID NO: 412057 - DNA, 16 bp, M. musculus
gccccatgcccagcag

SEQ ID NO: 412058 - DNA, 16 bp, M. musculus
gccccatgcccaggag

SEQ ID NO: 412059 - DNA, 16 bp, M. musculus
gccccatggatgtgtg

SEQ ID NO: 412060 - DNA, 16 bp, M. musculus
gccccatgggaagacc

SEQ ID NO: 412061 - DNA, 16 bp, M. musculus
gccccatgtatcctat

SEQ ID NO: 412062 - DNA, 16 bp, M. musculus
gccccatgtcccacac

SEQ ID NO: 412063 - DNA, 16 bp, M. musculus
gcccccacaggagagg

SEQ ID NO: 412064 - DNA, 16 bp, M. musculus
gcccccacctcactct

SEQ ID NO: 412065 - DNA, 16 bp, M. musculus
gcccccactcccactg

SEQ ID NO: 412066 - DNA, 16 bp, M. musculus
gcccccactgcccagc

SEQ ID NO: 412067 - DNA, 16 bp, M. musculus
gcccccagaggccaga

SEQ ID NO: 412068 - DNA, 16 bp, M. musculus
gcccccagcagccatg

SEQ ID NO: 412069 - DNA, 16 bp, M. musculus
gcccccagcccacagg

SEQ ID NO: 412070 - DNA, 16 bp, M. musculus
gcccccaggttcctgc

SEQ ID NO: 412071 - DNA, 16 bp, M. musculus
gccccccagtcgtacc

SEQ ID NO: 412072 - DNA, 16 bp, M. musculus
gccccccatggaggag

SEQ ID NO: 412073 - DNA, 16 bp, M. musculus
gccccccgcagccatg

SEQ ID NO: 412074 - DNA, 16 bp, M. musculus
gccccctggctgtcct

SEQ ID NO: 412075 - DNA, 16 bp, M. musculus
gcccccttctggcctc

SEQ ID NO: 412076 - DNA, 16 bp, M. musculus
gcccccttctggtgtg

SEQ ID NO: 412077 - DNA, 16 bp, M. musculus
gccccgggatgggcag

SEQ ID NO: 412078 - DNA, 16 bp, M. musculus
gcccctcacctgggca

SEQ ID NO: 412079 - DNA, 16 bp, M. musculus
gcccctcactcaggcc

SEQ ID NO: 412080 - DNA, 16 bp, M. musculus
gcccctcactggggga

SEQ ID NO: 412081 - DNA, 16 bp, M. musculus
gcccctcagaggacag

SEQ ID NO: 412082 - DNA, 16 bp, M. musculus
gcccctccagcctttg

SEQ ID NO: 412083 - DNA, 16 bp, M. musculus
gcccctcccacatcaa

SEQ ID NO: 412084 - DNA, 16 bp, M. musculus
gcccctccctgcccag

SEQ ID NO: 412085 - DNA, 16 bp, M. musculus
gcccctgagatctctc

SEQ ID NO: 412086 - DNA, 16 bp, M. musculus
gcccctgataccaggg

SEQ ID NO: 412087 - DNA, 16 bp, M. musculus
gcccctgcacacacac

SEQ ID NO: 412088 - DNA, 16 bp, M. musculus
gcccctgcatagtctc

SEQ ID NO: 412089 - DNA, 16 bp, M. musculus
gcccctgcctcagcct

SEQ ID NO: 412090 - DNA, 16 bp, M. musculus
gcccctgcctccccag

SEQ ID NO: 412091 - DNA, 16 bp, M. musculus
gcccctggacattccc

SEQ ID NO: 412092 - DNA, 16 bp, M. musculus
gcccctggaggccaga

SEQ ID NO: 412093 - DNA, 16 bp, M. musculus
gcccctgtcagcaagc

SEQ ID NO: 412094 - DNA, 16 bp, M. musculus
gccccttcttaggatt

SEQ ID NO: 412095 - DNA, 16 bp, M. musculus
gcccgagcatgcgcag

SEQ ID NO: 412096 - DNA, 16 bp, M. musculus
gcccggactgtatggg

SEQ ID NO: 412097 - DNA, 16 bp, M. musculus
gcccggcctgacaccc

SEQ ID NO: 412098 - DNA, 36 bp, M. musculus
gcccgggtagcctgcttccctatgtaccgcagtctc

SEQ ID NO: 412099 - DNA, 16 bp, M. musculus
gcccgtcccagaagct

SEQ ID NO: 412100 - DNA, 17 bp, M. musculus
gccctaaaagaagaatg

SEQ ID NO: 412101 - DNA, 17 bp, M. musculus
gccctacacaaaaccat

SEQ ID NO: 412102 - DNA, 16 bp, M. musculus
gccctagagaagagca

SEQ ID NO: 412103 - DNA, 16 bp, M. musculus
gccctaggtttgattc

SEQ ID NO: 412104 - DNA, 16 bp, M. musculus
gccctcaaaggccaga

SEQ ID NO: 412105 - DNA, 16 bp, M. musculus
gccctcaactccataa

SEQ ID NO: 412106 - DNA, 16 bp, M. musculus
gccctcaatccttccc

SEQ ID NO: 412107 - DNA, 16 bp, M. musculus
gccctcagaaagaccc

SEQ ID NO: 412108 - DNA, 16 bp, M. musculus
gccctcagaggccagg

SEQ ID NO: 412109 - DNA, 16 bp, M. musculus
gccctcagccctcagc

SEQ ID NO: 412110 - DNA, 16 bp, M. musculus
gccctcagggcttcac

SEQ ID NO: 412111 - DNA, 16 bp, M. musculus
gccctcagttgctgag

SEQ ID NO: 412112 - DNA, 16 bp, M. musculus
gccctccaaaagactc

SEQ ID NO: 412113 - DNA, 16 bp, M. musculus
gccctccaggccttta

SEQ ID NO: 412114 - DNA, 16 bp, M. musculus
gccctcccaggcagac

SEQ ID NO: 412115 - DNA, 16 bp, M. musculus
gccctcccccacagtg

SEQ ID NO: 412116 - DNA, 16 bp, M. musculus
gccctcctcttcagct

SEQ ID NO: 412117 - DNA, 16 bp, M. musculus
gccctccttgttattt

SEQ ID NO: 412118 - DNA, 16 bp, M. musculus
gccctctaaatcaaca

SEQ ID NO: 412119 - DNA, 16 bp, M. musculus
gccctctacccttgca

SEQ ID NO: 412120 - DNA, 51 bp, M. musculus
gccctctaccgagcccgcaacactccgggcccccatggactcactccgtat

SEQ ID NO: 412121 - DNA, 16 bp, M. musculus
gccctctactggtgtg

SEQ ID NO: 412122 - DNA, 16 bp, M. musculus
gccctctattggatat

SEQ ID NO: 412123 - DNA, 16 bp, M. musculus
gccctctcacccttga

SEQ ID NO: 412124 - DNA, 16 bp, M. musculus
gccctctctccaaccc

SEQ ID NO: 412125 - DNA, 16 bp, M. musculus
gccctctctccagcct

SEQ ID NO: 412126 - DNA, 16 bp, M. musculus
gccctctgccctccac

SEQ ID NO: 412127 - DNA, 16 bp, M. musculus
gccctctgctggcctc

SEQ ID NO: 412128 - DNA, 16 bp, M. musculus
gccctctgcttcctga

SEQ ID NO: 412129 - DNA, 16 bp, M. musculus
gccctctggaagaaca

SEQ ID NO: 412130 - DNA, 16 bp, M. musculus
gccctctggaagagca

SEQ ID NO: 412131 - DNA, 16 bp, M. musculus
gccctctggcctccac

SEQ ID NO: 412132 - DNA, 16 bp, M. musculus
gccctcttcaggcctc

SEQ ID NO: 412133 - DNA, 16 bp, M. musculus
gccctcttcaggtgtg

SEQ ID NO: 412134 - DNA, 16 bp, M. musculus
gccctcttcctgaaac

SEQ ID NO: 412135 - DNA, 17 bp, M. musculus
gccctcttctgacctcc

SEQ ID NO: 412136 - DNA, 16 bp, M. musculus
gccctcttctgacttt

SEQ ID NO: 412137 - DNA, 16 bp, M. musculus
gccctcttctgctgtg

SEQ ID NO: 412138 - DNA, 16 bp, M. musculus
gccctcttctggcctc

SEQ ID NO: 412139 - DNA, 16 bp, M. musculus
gccctcttctggcctt

SEQ ID NO: 412140 - DNA, 16 bp, M. musculus
gccctcttgtggtgtg

SEQ ID NO: 412141 - DNA, 16 bp, M. musculus
gccctgaaagaggaga

SEQ ID NO: 412142 - DNA, 16 bp, M. musculus
gccctgacaatggtga

SEQ ID NO: 412143 - DNA, 16 bp, M. musculus
gccctgaccacagaca

SEQ ID NO: 412144 - DNA, 16 bp, M. musculus
gccctgactggtctgg

SEQ ID NO: 412145 - DNA, 16 bp, M. musculus
gccctgacttcccttc

SEQ ID NO: 412146 - DNA, 16 bp, M. musculus
gccctgagaacatggg

SEQ ID NO: 412147 - DNA, 16 bp, M. musculus
gccctgagagcagctg

SEQ ID NO: 412148 - DNA, 16 bp, M. musculus
gccctgagggcctgca

SEQ ID NO: 412149 - DNA, 16 bp, M. musculus
gccctgagggctgccc

SEQ ID NO: 412150 - DNA, 16 bp, M. musculus
gccctgagtgccagca

SEQ ID NO: 412151 - DNA, 16 bp, M. musculus
gccctgagttccatcc

SEQ ID NO: 412152 - DNA, 16 bp, M. musculus
gccctgcccacagtgg

SEQ ID NO: 412153 - DNA, 16 bp, M. musculus
gccctgcccagcccag

SEQ ID NO: 412154 - DNA, 16 bp, M. musculus
gccctgccctgcccag

SEQ ID NO: 412155 - DNA, 16 bp, M. musculus
gccctgccctgcccca

SEQ ID NO: 412156 - DNA, 16 bp, M. musculus
gccctgcctcagcctc

SEQ ID NO: 412157 - DNA, 16 bp, M. musculus
gccctgcctctgccct

SEQ ID NO: 412158 - DNA, 16 bp, M. musculus
gccctgcctgttctgg

SEQ ID NO: 412159 - DNA, 16 bp, M. musculus
gccctgctagaggctg

SEQ ID NO: 412160 - DNA, 16 bp, M. musculus
gccctgctccagttgt

SEQ ID NO: 412161 - DNA, 16 bp, M. musculus
gccctgctccccaacc

SEQ ID NO: 412162 - DNA, 16 bp, M. musculus
gccctgctcttctctg

SEQ ID NO: 412163 - DNA, 16 bp, M. musculus
gccctgctggctctgt

SEQ ID NO: 412164 - DNA, 16 bp, M. musculus
gccctgctgtcctgga

SEQ ID NO: 412165 - DNA, 16 bp, M. musculus
gccctgcttgtccttg

SEQ ID NO: 412166 - DNA, 16 bp, M. musculus
gccctggaactggagt

SEQ ID NO: 412167 - DNA, 16 bp, M. musculus
gccctggaactggggt

SEQ ID NO: 412168 - DNA, 16 bp, M. musculus
gccctggaattcccct

SEQ ID NO: 412169 - DNA, 16 bp, M. musculus
gccctggaccagatgg

SEQ ID NO: 412170 - DNA, 16 bp, M. musculus
gccctggagggcatca

SEQ ID NO: 412171 - DNA, 16 bp, M. musculus
gccctggagttcccct

SEQ ID NO: 412172 - DNA, 16 bp, M. musculus
gccctggatctggacc

SEQ ID NO: 412173 - DNA, 16 bp, M. musculus
gccctggatgttctgg

SEQ ID NO: 412174 - DNA, 16 bp, M. musculus
gccctggcagtcctga

SEQ ID NO: 412175 - DNA, 16 bp, M. musculus
gccctggcatttgcct

SEQ ID NO: 412176 - DNA, 16 bp, M. musculus
gccctggctatcctga

SEQ ID NO: 412177 - DNA, 16 bp, M. musculus
gccctggctccttctg

SEQ ID NO: 412178 - DNA, 16 bp, M. musculus
gccctggctctcctgg

SEQ ID NO: 412179 - DNA, 16 bp, M. musculus
gccctggctctcttgg

SEQ ID NO: 412180 - DNA, 16 bp, M. musculus
gccctggctgatctgg

SEQ ID NO: 412181 - DNA, 16 bp, M. musculus
gccctggctgcagcag

SEQ ID NO: 412182 - DNA, 16 bp, M. musculus
gccctggctgcccagg

SEQ ID NO: 412183 - DNA, 16 bp, M. musculus
gccctggctgccctga

SEQ ID NO: 412184 - DNA, 16 bp, M. musculus
gccctggctgctctgg

SEQ ID NO: 412185 - DNA, 16 bp, M. musculus
gccctggctgctcttg

SEQ ID NO: 412186 - DNA, 16 bp, M. musculus
gccctggctggcatgg

SEQ ID NO: 412187 - DNA, 16 bp, M. musculus
gccctggctggcctcc

SEQ ID NO: 412188 - DNA, 16 bp, M. musculus
gccctggctggcctgg

SEQ ID NO: 412189 - DNA, 16 bp, M. musculus
gccctggctgtctggg

SEQ ID NO: 412190 - DNA, 16 bp, M. musculus
gccctggcttccatcc

SEQ ID NO: 412191 - DNA, 16 bp, M. musculus
gccctggctttcctgg

SEQ ID NO: 412192 - DNA, 16 bp, M. musculus
gccctggctttctcct

SEQ ID NO: 412193 - DNA, 16 bp, M. musculus
gccctggcttttgttg

SEQ ID NO: 412194 - DNA, 16 bp, M. musculus
gccctgggctccatcc

SEQ ID NO: 412195 - DNA, 16 bp, M. musculus
gccctgggctggagag

SEQ ID NO: 412196 - DNA, 16 bp, M. musculus
gccctggggaagggga

SEQ ID NO: 412197 - DNA, 16 bp, M. musculus
gccctggggcccccag

SEQ ID NO: 412198 - DNA, 16 bp, M. musculus
gccctgggggccagca

SEQ ID NO: 412199 - DNA, 16 bp, M. musculus
gccctgggtatcctgg

SEQ ID NO: 412200 - DNA, 16 bp, M. musculus
gccctgggttccattc

SEQ ID NO: 412201 - DNA, 16 bp, M. musculus
gccctgggtttgatcc

SEQ ID NO: 412202 - DNA, 16 bp, M. musculus
gccctggtattcctct

SEQ ID NO: 412203 - DNA, 16 bp, M. musculus
gccctggtgctgtttg

SEQ ID NO: 412204 - DNA, 16 bp, M. musculus
gccctggtggcatggg

SEQ ID NO: 412205 - DNA, 18 bp, M. musculus
gccctggtgttcccatgt

SEQ ID NO: 412206 - DNA, 16 bp, M. musculus
gccctggttcttcctt

SEQ ID NO: 412207 - DNA, 16 bp, M. musculus
gccctggttggcctag

SEQ ID NO: 412208 - DNA, 16 bp, M. musculus
gccctgtatcatggag

SEQ ID NO: 412209 - DNA, 16 bp, M. musculus
gccctgtctggcctca

SEQ ID NO: 412210 - DNA, 16 bp, M. musculus
gccctgtctggcctgg

SEQ ID NO: 412211 - DNA, 16 bp, M. musculus
gccctgtgacccatcc

SEQ ID NO: 412212 - DNA, 17 bp, M. musculus
gccctgtgatccatcca

SEQ ID NO: 412213 - DNA, 16 bp, M. musculus
gccctgtgcctgctgc

SEQ ID NO: 412214 - DNA, 16 bp, M. musculus
gccctgtgctccatcc

SEQ ID NO: 412215 - DNA, 16 bp, M. musculus
gccctgtgggtgctgg

SEQ ID NO: 412216 - DNA, 16 bp, M. musculus
gccctgtgtacagagg

SEQ ID NO: 412217 - DNA, 16 bp, M. musculus
gccctgtgtcatggag

SEQ ID NO: 412218 - DNA, 16 bp, M. musculus
gccctgtgttcaatcc

SEQ ID NO: 412219 - DNA, 16 bp, M. musculus
gccctgtgtttcatcc

SEQ ID NO: 412220 - DNA, 16 bp, M. musculus
gccctgttgttgaatt

SEQ ID NO: 412221 - DNA, 16 bp, M. musculus
gccctgtttccttctg

SEQ ID NO: 412222 - DNA, 16 bp, M. musculus
gcccttaatcctagca

SEQ ID NO: 412223 - DNA, 16 bp, M. musculus
gcccttactttaactg

SEQ ID NO: 412224 - DNA, 16 bp, M. musculus
gcccttcaaaatagaa

SEQ ID NO: 412225 - DNA, 16 bp, M. musculus
gcccttcacacacaca

SEQ ID NO: 412226 - DNA, 16 bp, M. musculus
gcccttcacagcctcc

SEQ ID NO: 412227 - DNA, 16 bp, M. musculus
gcccttccatttggag

SEQ ID NO: 412228 - DNA, 16 bp, M. musculus
gcccttgcagaggacc

SEQ ID NO: 412229 - DNA, 16 bp, M. musculus
gcccttgcctcttgcc

SEQ ID NO: 412230 - DNA, 24 bp, M. musculus
gcccttgctagagatttgcaataa

SEQ ID NO: 412231 - DNA, 16 bp, M. musculus
gcccttgctgctcttg

SEQ ID NO: 412232 - DNA, 16 bp, M. musculus
gcccttggccctgtgg

SEQ ID NO: 412233 - DNA, 16 bp, M. musculus
gcccttgggcctgagg

SEQ ID NO: 412234 - DNA, 16 bp, M. musculus
gcccttggggcttcag

SEQ ID NO: 412235 - DNA, 16 bp, M. musculus
gccctttaatcccagc

SEQ ID NO: 412236 - DNA, 16 bp, M. musculus
gccctttagtacagtt

SEQ ID NO: 412237 - DNA, 16 bp, M. musculus
gccctttctaactctg

SEQ ID NO: 412238 - DNA, 16 bp, M. musculus
gccctttgcctcagga

SEQ ID NO: 412239 - DNA, 16 bp, M. musculus
gcccttttctagcctc

SEQ ID NO: 412240 - DNA, 16 bp, M. musculus
gcccttttctggcctt

SEQ ID NO: 412241 - DNA, 16 bp, M. musculus
gcccttttttcctaaa

SEQ ID NO: 412242 - DNA, 16 bp, M. musculus
gccgaatcgggaattg

SEQ ID NO: 412243 - DNA, 20 bp, M. musculus
gccgaccacacctggtatac

SEQ ID NO: 412244 - DNA, 16 bp, M. musculus
gccgaggcaggaagat

SEQ ID NO: 412245 - DNA, 16 bp, M. musculus
gccgaggcaggaggac

SEQ ID NO: 412246 - DNA, 16 bp, M. musculus
gccgaggctgaggcct

SEQ ID NO: 412247 - DNA, 20 bp, M. musculus
gccgagtcggtccgtaaata

SEQ ID NO: 412248 - DNA, 16 bp, M. musculus
gccgccaccaccacct

SEQ ID NO: 412249 - DNA, 16 bp, M. musculus
gccgccaccacctggc

SEQ ID NO: 412250 - DNA, 16 bp, M. musculus
gccgccactgcccagc

SEQ ID NO: 412251 - DNA, 16 bp, M. musculus
gccgccatgcttccca

SEQ ID NO: 412252 - DNA, 16 bp, M. musculus
gccgctttgctgttct

SEQ ID NO: 412253 - DNA, 16 bp, M. musculus
gccggagagatggctc

SEQ ID NO: 412254 - DNA, 16 bp, M. musculus
gccggccatgcactgg

SEQ ID NO: 412255 - DNA, 16 bp, M. musculus
gccggcctctacttct

SEQ ID NO: 412256 - DNA, 16 bp, M. musculus
gccggcctctgcctcc

SEQ ID NO: 412257 - DNA, 16 bp, M. musculus
gccgggaggtggtggc

SEQ ID NO: 412258 - DNA, 16 bp, M. musculus
gccgggcagcggtggc

SEQ ID NO: 412259 - DNA, 16 bp, M. musculus
gccgggcgatggtggc

SEQ ID NO: 412260 - DNA, 17 bp, M. musculus
gccgggcttggtggcgc

SEQ ID NO: 412261 - DNA, 16 bp, M. musculus
gccggggcctgaggca

SEQ ID NO: 412262 - DNA, 16 bp, M. musculus
gccgggtgttggtggc

SEQ ID NO: 412263 - DNA, 16 bp, M. musculus
gccgtgtgggtgctgg

SEQ ID NO: 412264 - DNA, 16 bp, M. musculus
gcctacagagcaagtt

SEQ ID NO: 412265 - DNA, 16 bp, M. musculus
gcctacagagctgcag

SEQ ID NO: 412266 - DNA, 16 bp, M. musculus
gcctacagagtgagtt

SEQ ID NO: 412267 - DNA, 16 bp, M. musculus
gcctacaggcaaatct

SEQ ID NO: 412268 - DNA, 16 bp, M. musculus
gcctacatacacatgg

SEQ ID NO: 412269 - DNA, 16 bp, M. musculus
gcctaccgagtgctgg

SEQ ID NO: 412270 - DNA, 16 bp, M. musculus
gcctacctctgcctcc

SEQ ID NO: 412271 - DNA, 16 bp, M. musculus
gcctacctctgcctct

SEQ ID NO: 412272 - DNA, 16 bp, M. musculus
gcctactcacccagtg

SEQ ID NO: 412273 - DNA, 16 bp, M. musculus
gcctagaactttctat

SEQ ID NO: 412274 - DNA, 16 bp, M. musculus
gcctagaatcctccag

SEQ ID NO: 412275 - DNA, 16 bp, M. musculus
gcctagaggaaaagct

SEQ ID NO: 412276 - DNA, 16 bp, M. musculus
gcctagaggatgaagc

SEQ ID NO: 412277 - DNA, 16 bp, M. musculus
gcctagcaaacacaga

SEQ ID NO: 412278 - DNA, 16 bp, M. musculus
gcctagcatgcataaa

SEQ ID NO: 412279 - DNA, 16 bp, M. musculus
gcctagcatgtacaag

SEQ ID NO: 412280 - DNA, 18 bp, M. musculus
gcctaggacaggcgttct

SEQ ID NO: 412281 - DNA, 16 bp, M. musculus
gcctaggatggccttg

SEQ ID NO: 412282 - DNA, 16 bp, M. musculus
gcctaggctacagagt

SEQ ID NO: 412283 - DNA, 16 bp, M. musculus
gcctagggaatggtgc

SEQ ID NO: 412284 - DNA, 16 bp, M. musculus
gcctagttggccttca

SEQ ID NO: 412285 - DNA, 16 bp, M. musculus
gcctataatcccaaca

SEQ ID NO: 412286 - DNA, 16 bp, M. musculus
gcctatcagaatgaca

SEQ ID NO: 412287 - DNA, 16 bp, M. musculus
gcctatccccacagtg

SEQ ID NO: 412288 - DNA, 16 bp, M. musculus
gcctatgagggacatt

SEQ ID NO: 412289 - DNA, 16 bp, M. musculus
gcctatggaggccatt

SEQ ID NO: 412290 - DNA, 16 bp, M. musculus
gcctatgtcagcactc

SEQ ID NO: 412291 - DNA, 16 bp, M. musculus
gcctattagaattaca

SEQ ID NO: 412292 - DNA, 16 bp, M. musculus
gcctatttaaaaaaaa

SEQ ID NO: 412293 - DNA, 16 bp, M. musculus
gcctatttgtcaaaga

SEQ ID NO: 412294 - DNA, 16 bp, M. musculus
gcctcaaactaactct

SEQ ID NO: 412295 - DNA, 16 bp, M. musculus
gcctcaaactcataga

SEQ ID NO: 412296 - DNA, 16 bp, M. musculus
gcctcaaatttgctat

SEQ ID NO: 412297 - DNA, 16 bp, M. musculus
gcctcaagagtctcat

SEQ ID NO: 412298 - DNA, 16 bp, M. musculus
gcctcaagtctctcaa

SEQ ID NO: 412299 - DNA, 16 bp, M. musculus
gcctcaatgagagaag

SEQ ID NO: 412300 - DNA, 16 bp, M. musculus
gcctcaattttctcat

SEQ ID NO: 412301 - DNA, 16 bp, M. musculus
gcctcacactcctgcc

SEQ ID NO: 412302 - DNA, 16 bp, M. musculus
gcctcacaggagacag

SEQ ID NO: 412303 - DNA, 55 bp, M. musculus
gcctcacatgtgattcaacattgtcttgaggcatggagtgcttgggggaaaccca

SEQ ID NO: 412304 - DNA, 16 bp, M. musculus
gcctcagaagctgccc

SEQ ID NO: 412305 - DNA, 16 bp, M. musculus
gcctcagagtcacaga

SEQ ID NO: 412306 - DNA, 16 bp, M. musculus
gcctcagatgctgtct

SEQ ID NO: 412307 - DNA, 16 bp, M. musculus
gcctcagcccagcctt

SEQ ID NO: 412308 - DNA, 16 bp, M. musculus
gcctcagcctcaggag

SEQ ID NO: 412309 - DNA, 16 bp, M. musculus
gcctcagcctccagtg

SEQ ID NO: 412310 - DNA, 16 bp, M. musculus
gcctcagcctccctgg

SEQ ID NO: 412311 - DNA, 16 bp, M. musculus
gcctcagcctcctcag

SEQ ID NO: 412312 - DNA, 16 bp, M. musculus
gcctcagcctcctgaa

SEQ ID NO: 412313 - DNA, 16 bp, M. musculus
gcctcagcctcctgga

SEQ ID NO: 412314 - DNA, 16 bp, M. musculus
gcctcagccttggctt

SEQ ID NO: 412315 - DNA, 16 bp, M. musculus
gcctcagctcctgcct

SEQ ID NO: 412316 - DNA, 16 bp, M. musculus
gcctcagcttcctaaa

SEQ ID NO: 412317 - DNA, 16 bp, M. musculus
gcctcagcttcctcag

SEQ ID NO: 412318 - DNA, 16 bp, M. musculus
gcctcaggagcagcag

SEQ ID NO: 412319 - DNA, 16 bp, M. musculus
gcctcagggaaggggg

SEQ ID NO: 412320 - DNA, 16 bp, M. musculus
gcctcagggatccttg

SEQ ID NO: 412321 - DNA, 16 bp, M. musculus
gcctcaggttcctgcc

SEQ ID NO: 412322 - DNA, 16 bp, M. musculus
gcctcagtacagagga

SEQ ID NO: 412323 - DNA, 16 bp, M. musculus
gcctcagtctcctcag

SEQ ID NO: 412324 - DNA, 17 bp, M. musculus
gcctcagtggctctgtg

SEQ ID NO: 412325 - DNA, 16 bp, M. musculus
gcctcagtgggagaaa

SEQ ID NO: 412326 - DNA, 16 bp, M. musculus
gcctcagtttccccac

SEQ ID NO: 412327 - DNA, 16 bp, M. musculus
gcctcagtttccccat

SEQ ID NO: 412328 - DNA, 16 bp, M. musculus
gcctcagtttcccctt

SEQ ID NO: 412329 - DNA, 16 bp, M. musculus
gcctcagtttccctgt

SEQ ID NO: 412330 - DNA, 16 bp, M. musculus
gcctcagtttcctccc

SEQ ID NO: 412331 - DNA, 16 bp, M. musculus
gcctcagtttcctcct

SEQ ID NO: 412332 - DNA, 16 bp, M. musculus
gcctcagtttctccat

SEQ ID NO: 412333 - DNA, 16 bp, M. musculus
gcctcagtttctcctt

SEQ ID NO: 412334 - DNA, 16 bp, M. musculus
gcctcagtttctctat

SEQ ID NO: 412335 - DNA, 16 bp, M. musculus
gcctcagtttctctct

SEQ ID NO: 412336 - DNA, 16 bp, M. musculus
gcctcagtttcttcct

SEQ ID NO: 412337 - DNA, 16 bp, M. musculus
gcctcataagagacag

SEQ ID NO: 412338 - DNA, 16 bp, M. musculus
gcctcatctacagagc

SEQ ID NO: 412339 - DNA, 16 bp, M. musculus
gcctcatctggcatca

SEQ ID NO: 412340 - DNA, 16 bp, M. musculus
gcctcatggaggccag

SEQ ID NO: 412341 - DNA, 16 bp, M. musculus
gcctcatttttaatgg

SEQ ID NO: 412342 - DNA, 16 bp, M. musculus
gcctccaaagagaaac

SEQ ID NO: 412343 - DNA, 16 bp, M. musculus
gcctccaaatgaaaga

SEQ ID NO: 412344 - DNA, 16 bp, M. musculus
gcctccaacaccagca

SEQ ID NO: 412345 - DNA, 16 bp, M. musculus
gcctccaccctctcag

SEQ ID NO: 412346 - DNA, 16 bp, M. musculus
gcctccacctcccagg

SEQ ID NO: 412347 - DNA, 16 bp, M. musculus
gcctccacctcctcag

SEQ ID NO: 412348 - DNA, 16 bp, M. musculus
gcctccacttcctgag

SEQ ID NO: 412349 - DNA, 16 bp, M. musculus
gcctccagactgctgg

SEQ ID NO: 412350 - DNA, 16 bp, M. musculus
gcctccagagcactgg

SEQ ID NO: 412351 - DNA, 16 bp, M. musculus
gcctccagagccagct

SEQ ID NO: 412352 - DNA, 16 bp, M. musculus
gcctccagagcgctgg

SEQ ID NO: 412353 - DNA, 16 bp, M. musculus
gcctccagcctccagc

SEQ ID NO: 412354 - DNA, 16 bp, M. musculus
gcctccaggctcctgt

SEQ ID NO: 412355 - DNA, 16 bp, M. musculus
gcctccagggaaggct

SEQ ID NO: 412356 - DNA, 16 bp, M. musculus
gcctccaggttcctga

SEQ ID NO: 412357 - DNA, 16 bp, M. musculus
gcctccaggtttctac

SEQ ID NO: 412358 - DNA, 16 bp, M. musculus
gcctccatcttccaag

SEQ ID NO: 412359 - DNA, 16 bp, M. musculus
gcctccatgagatcta

SEQ ID NO: 412360 - DNA, 16 bp, M. musculus
gcctccattgtctgca

SEQ ID NO: 412361 - DNA, 16 bp, M. musculus
gcctccatttgtgatt

SEQ ID NO: 412362 - DNA, 16 bp, M. musculus
gcctccattttttttt

SEQ ID NO: 412363 - DNA, 16 bp, M. musculus
gcctcccaaatagctg

SEQ ID NO: 412364 - DNA, 16 bp, M. musculus
gcctcccaagtacttg

SEQ ID NO: 412365 - DNA, 16 bp, M. musculus
gcctcccaagtgatgg

SEQ ID NO: 412366 - DNA, 16 bp, M. musculus
gcctcccaagtgctgt

SEQ ID NO: 412367 - DNA, 16 bp, M. musculus
gcctcccacatgctgg

SEQ ID NO: 412368 - DNA, 16 bp, M. musculus
gcctcccacgtgctag

SEQ ID NO: 412369 - DNA, 16 bp, M. musculus
gcctcccacgtgctga

SEQ ID NO: 412370 - DNA, 16 bp, M. musculus
gcctcccagagactga

SEQ ID NO: 412371 - DNA, 16 bp, M. musculus
gcctcccagatgctgg

SEQ ID NO: 412372 - DNA, 16 bp, M. musculus
gcctcccaggagacag

SEQ ID NO: 412373 - DNA, 16 bp, M. musculus
gcctcccagggctggg

SEQ ID NO: 412374 - DNA, 16 bp, M. musculus
gcctcccatctcccca

SEQ ID NO: 412375 - DNA, 16 bp, M. musculus
gcctccccaagtgctg

SEQ ID NO: 412376 - DNA, 16 bp, M. musculus
gcctccccagagctgg

SEQ ID NO: 412377 - DNA, 16 bp, M. musculus
gcctccccagcactga

SEQ ID NO: 412378 - DNA, 16 bp, M. musculus
gcctccccagcactgg

SEQ ID NO: 412379 - DNA, 16 bp, M. musculus
gcctccccagtcctgg

SEQ ID NO: 412380 - DNA, 16 bp, M. musculus
gcctcccccttctcag

SEQ ID NO: 412381 - DNA, 16 bp, M. musculus
gcctccccggtgctgg

SEQ ID NO: 412382 - DNA, 16 bp, M. musculus
gcctccccttctctga

SEQ ID NO: 412383 - DNA, 16 bp, M. musculus
gcctcccgggctgtgc

SEQ ID NO: 412384 - DNA, 16 bp, M. musculus
gcctccctgcctccca

SEQ ID NO: 412385 - DNA, 16 bp, M. musculus
gcctccctgctccctg

SEQ ID NO: 412386 - DNA, 16 bp, M. musculus
gcctcccttcccagtg

SEQ ID NO: 412387 - DNA, 16 bp, M. musculus
gcctcccttcccattg

SEQ ID NO: 412388 - DNA, 16 bp, M. musculus
gcctcccttttccctg

SEQ ID NO: 412389 - DNA, 16 bp, M. musculus
gcctcctacatgctgg

SEQ ID NO: 412390 - DNA, 16 bp, M. musculus
gcctcctcagcagccg

SEQ ID NO: 412391 - DNA, 16 bp, M. musculus
gcctcctcccaagtgc

SEQ ID NO: 412392 - DNA, 16 bp, M. musculus
gcctcctcctggctgc

SEQ ID NO: 412393 - DNA, 16 bp, M. musculus
gcctcctgatgtgggt

SEQ ID NO: 412394 - DNA, 16 bp, M. musculus
gcctcctgcatgctag

SEQ ID NO: 412395 - DNA, 16 bp, M. musculus
gcctcctgcatgctgg

SEQ ID NO: 412396 - DNA, 16 bp, M. musculus
gcctcctggaaccagt

SEQ ID NO: 412397 - DNA, 16 bp, M. musculus
gcctcctggaagaagt

SEQ ID NO: 412398 - DNA, 16 bp, M. musculus
gcctcctggatgctgg

SEQ ID NO: 412399 - DNA, 16 bp, M. musculus
gcctcctggcagaggt

SEQ ID NO: 412400 - DNA, 16 bp, M. musculus
gcctcctggctgagaa

SEQ ID NO: 412401 - DNA, 16 bp, M. musculus
gcctcctggctgagga

SEQ ID NO: 412402 - DNA, 16 bp, M. musculus
gcctcctggctgctgc

SEQ ID NO: 412403 - DNA, 16 bp, M. musculus
gcctcctgtctctcct

SEQ ID NO: 412404 - DNA, 16 bp, M. musculus
gcctcctgtgcctcct

SEQ ID NO: 412405 - DNA, 16 bp, M. musculus
gcctccttccggacaa

SEQ ID NO: 412406 - DNA, 16 bp, M. musculus
gcctccttgttcagct

SEQ ID NO: 412407 - DNA, 16 bp, M. musculus
gcctcgaagatttggg

SEQ ID NO: 412408 - DNA, 16 bp, M. musculus
gcctcgagagtgctgg

SEQ ID NO: 412409 - DNA, 16 bp, M. musculus
gcctcgagctcagaaa

SEQ ID NO: 412410 - DNA, 17 bp, M. musculus
gcctcgggacagccgcg

SEQ ID NO: 412411 - DNA, 16 bp, M. musculus
gcctcggtttccccat

SEQ ID NO: 412412 - DNA, 16 bp, M. musculus
gcctcgtactcagaaa

SEQ ID NO: 412413 - DNA, 16 bp, M. musculus
gcctctactcccttct

SEQ ID NO: 412414 - DNA, 16 bp, M. musculus
gcctctacttcccaag

SEQ ID NO: 412415 - DNA, 16 bp, M. musculus
gcctctatcagactgg

SEQ ID NO: 412416 - DNA, 16 bp, M. musculus
gcctctatgaaggtgc

SEQ ID NO: 412417 - DNA, 16 bp, M. musculus
gcctctcaaaagacag

SEQ ID NO: 412418 - DNA, 16 bp, M. musculus
gcctctcaaaggacag

SEQ ID NO: 412419 - DNA, 16 bp, M. musculus
gcctctcaagagacag

SEQ ID NO: 412420 - DNA, 16 bp, M. musculus
gcctctcaagtgccag

SEQ ID NO: 412421 - DNA, 16 bp, M. musculus
gcctctcagagctcac

SEQ ID NO: 412422 - DNA, 16 bp, M. musculus
gcctctcagagggcag

SEQ ID NO: 412423 - DNA, 16 bp, M. musculus
gcctctcagtggacag

SEQ ID NO: 412424 - DNA, 16 bp, M. musculus
gcctctcatgtgctgg

SEQ ID NO: 412425 - DNA, 16 bp, M. musculus
gcctctccagagacag

SEQ ID NO: 412426 - DNA, 16 bp, M. musculus
gcctctcccctttctg

SEQ ID NO: 412427 - DNA, 16 bp, M. musculus
gcctctccctccccag

SEQ ID NO: 412428 - DNA, 16 bp, M. musculus
gcctctcctcccgttg

SEQ ID NO: 412429 - DNA, 16 bp, M. musculus
gcctctctcagggaaa

SEQ ID NO: 412430 - DNA, 16 bp, M. musculus
gcctctctgatgatgg

SEQ ID NO: 412431 - DNA, 16 bp, M. musculus
gcctctctgcacaggg

SEQ ID NO: 412432 - DNA, 16 bp, M. musculus
gcctctctgcctctct

SEQ ID NO: 412433 - DNA, 16 bp, M. musculus
gcctctctgcctcttt

SEQ ID NO: 412434 - DNA, 16 bp, M. musculus
gcctctcttcccactg

SEQ ID NO: 412435 - DNA, 16 bp, M. musculus
gcctctcttcccagta

SEQ ID NO: 412436 - DNA, 16 bp, M. musculus
gcctctctttccactt

SEQ ID NO: 412437 - DNA, 67 bp, M. musculus
gcctctctttccagtgatggccgactaggccatcttttgatatatatgcagctagagtcaagagctc

SEQ ID NO: 412438 - DNA, 16 bp, M. musculus
gcctctgaagtgctag

SEQ ID NO: 412439 - DNA, 16 bp, M. musculus
gcctctgaagtgctgg

SEQ ID NO: 412440 - DNA, 16 bp, M. musculus
gcctctgactctttca

SEQ ID NO: 412441 - DNA, 16 bp, M. musculus
gcctctgagggcacct

SEQ ID NO: 412442 - DNA, 16 bp, M. musculus
gcctctgcaggtacct

SEQ ID NO: 412443 - DNA, 16 bp, M. musculus
gcctctgcagtgctgg

SEQ ID NO: 412444 - DNA, 16 bp, M. musculus
gcctctgcatcagtcc

SEQ ID NO: 412445 - DNA, 16 bp, M. musculus
gcctctgcatcccaaa

SEQ ID NO: 412446 - DNA, 16 bp, M. musculus
gcctctgccatccaag

SEQ ID NO: 412447 - DNA, 16 bp, M. musculus
gcctctgcctcagcct

SEQ ID NO: 412448 - DNA, 16 bp, M. musculus
gcctctgcctcccacc

SEQ ID NO: 412449 - DNA, 16 bp, M. musculus
gcctctgcctcccata

SEQ ID NO: 412450 - DNA, 16 bp, M. musculus
gcctctgcctccccac

SEQ ID NO: 412451 - DNA, 16 bp, M. musculus
gcctctgcctcccttg

SEQ ID NO: 412452 - DNA, 16 bp, M. musculus
gcctctgcctcctgaa

SEQ ID NO: 412453 - DNA, 16 bp, M. musculus
gcctctgcctcctgca

SEQ ID NO: 412454 - DNA, 16 bp, M. musculus
gcctctgcctccttca

SEQ ID NO: 412455 - DNA, 16 bp, M. musculus
gcctctgcctctctct

SEQ ID NO: 412456 - DNA, 16 bp, M. musculus
gcctctgcctctgccc

SEQ ID NO: 412457 - DNA, 16 bp, M. musculus
gcctctgcctctgctg

SEQ ID NO: 412458 - DNA, 16 bp, M. musculus
gcctctgcctctgggg

SEQ ID NO: 412459 - DNA, 16 bp, M. musculus
gcctctgcctcttgtg

SEQ ID NO: 412460 - DNA, 16 bp, M. musculus
gcctctgccttctgga

SEQ ID NO: 412461 - DNA, 16 bp, M. musculus
gcctctgcctttggag

SEQ ID NO: 412462 - DNA, 16 bp, M. musculus
gcctctgcgcctctgc

SEQ ID NO: 412463 - DNA, 16 bp, M. musculus
gcctctgctatgcaga

SEQ ID NO: 412464 - DNA, 16 bp, M. musculus
gcctctgctgcccagg

SEQ ID NO: 412465 - DNA, 16 bp, M. musculus
gcctctgctgcctctg

SEQ ID NO: 412466 - DNA, 16 bp, M. musculus
gcctctgcttcagctc

SEQ ID NO: 412467 - DNA, 16 bp, M. musculus
gcctctgcttccagaa

SEQ ID NO: 412468 - DNA, 16 bp, M. musculus
gcctctgctttctgag

SEQ ID NO: 412469 - DNA, 16 bp, M. musculus
gcctctggaacaggca

SEQ ID NO: 412470 - DNA, 16 bp, M. musculus
gcctctggaactggag

SEQ ID NO: 412471 - DNA, 16 bp, M. musculus
gcctctggatagagaa

SEQ ID NO: 412472 - DNA, 16 bp, M. musculus
gcctctggctcccaag

SEQ ID NO: 412473 - DNA, 16 bp, M. musculus
gcctctggcttctgct

SEQ ID NO: 412474 - DNA, 16 bp, M. musculus
gcctctgtccctctgt

SEQ ID NO: 412475 - DNA, 16 bp, M. musculus
gcctctgtctcccaca

SEQ ID NO: 412476 - DNA, 16 bp, M. musculus
gcctctgtctgtctcc

SEQ ID NO: 412477 - DNA, 16 bp, M. musculus
gcctctgtctttgtca

SEQ ID NO: 412478 - DNA, 16 bp, M. musculus
gcctctgtgagcacca

SEQ ID NO: 412479 - DNA, 16 bp, M. musculus
gcctctgtgccctctg

SEQ ID NO: 412480 - DNA, 16 bp, M. musculus
gcctcttccagaagct

SEQ ID NO: 412481 - DNA, 18 bp, M. musculus
gcctcttctggagtgtct

SEQ ID NO: 412482 - DNA, 16 bp, M. musculus
gcctcttctggcctct

SEQ ID NO: 412483 - DNA, 16 bp, M. musculus
gcctcttctggccttc

SEQ ID NO: 412484 - DNA, 16 bp, M. musculus
gcctcttgacctatgg

SEQ ID NO: 412485 - DNA, 16 bp, M. musculus
gcctcttgagttctgg

SEQ ID NO: 412486 - DNA, 16 bp, M. musculus
gcctctttgagctgct

SEQ ID NO: 412487 - DNA, 16 bp, M. musculus
gcctcttttcccaatg

SEQ ID NO: 412488 - DNA, 16 bp, M. musculus
gcctgaaatcccagca

SEQ ID NO: 412489 - DNA, 16 bp, M. musculus
gcctgaaatcccagct

SEQ ID NO: 412490 - DNA, 16 bp, M. musculus
gcctgaagaaaagaag

SEQ ID NO: 412491 - DNA, 16 bp, M. musculus
gcctgaagagatggct

SEQ ID NO: 412492 - DNA, 16 bp, M. musculus
gcctgaagatctgagt

SEQ ID NO: 412493 - DNA, 16 bp, M. musculus
gcctgaagcaggctaa

SEQ ID NO: 412494 - DNA, 16 bp, M. musculus
gcctgaaggaacatcg

SEQ ID NO: 412495 - DNA, 16 bp, M. musculus
gcctgacaaatacaga

SEQ ID NO: 412496 - DNA, 16 bp, M. musculus
gcctgacaaatacata

SEQ ID NO: 412497 - DNA, 16 bp, M. musculus
gcctgacaaatactga

SEQ ID NO: 412498 - DNA, 16 bp, M. musculus
gcctgacaacctgagt

SEQ ID NO: 412499 - DNA, 16 bp, M. musculus
gcctgacagaagcttt

SEQ ID NO: 412500 - DNA, 16 bp, M. musculus
gcctgaccagcagctc

SEQ ID NO: 412501 - DNA, 16 bp, M. musculus
gcctgaccatctgagt

SEQ ID NO: 412502 - DNA, 16 bp, M. musculus
gcctgaccatgctttt

SEQ ID NO: 412503 - DNA, 16 bp, M. musculus
gcctgaccctgaccct

SEQ ID NO: 412504 - DNA, 16 bp, M. musculus
gcctgacctggggcac

SEQ ID NO: 412505 - DNA, 21 bp, M. musculus
gcctgacgtctgtaagttagt

SEQ ID NO: 412506 - DNA, 16 bp, M. musculus
gcctgagaagagaaaa

SEQ ID NO: 412507 - DNA, 16 bp, M. musculus
gcctgagattctcttt

SEQ ID NO: 412508 - DNA, 16 bp, M. musculus
gcctgagccactggag

SEQ ID NO: 412509 - DNA, 16 bp, M. musculus
gcctgagcccagcctg

SEQ ID NO: 412510 - DNA, 16 bp, M. musculus
gcctgagctacagagc

SEQ ID NO: 412511 - DNA, 16 bp, M. musculus
gcctgaggacctgaat

SEQ ID NO: 412512 - DNA, 16 bp, M. musculus
gcctgaggcaaggctg

SEQ ID NO: 412513 - DNA, 19 bp, M. musculus
gcctgaggcagaaacctct

SEQ ID NO: 412514 - DNA, 16 bp, M. musculus
gcctgaggcaggagga

SEQ ID NO: 412515 - DNA, 16 bp, M. musculus
gcctgagtccacagaa

SEQ ID NO: 412516 - DNA, 16 bp, M. musculus
gcctgagtgagcaggg

SEQ ID NO: 412517 - DNA, 16 bp, M. musculus
gcctgagtgtgtgtgt

SEQ ID NO: 412518 - DNA, 16 bp, M. musculus
gcctgagttcagttcc

SEQ ID NO: 412519 - DNA, 16 bp, M. musculus
gcctgatatgtctgtc

SEQ ID NO: 412520 - DNA, 16 bp, M. musculus
gcctgatctacagagg

SEQ ID NO: 412521 - DNA, 16 bp, M. musculus
gcctgatgccctcaga

SEQ ID NO: 412522 - DNA, 16 bp, M. musculus
gcctgcaaattcatga

SEQ ID NO: 412523 - DNA, 16 bp, M. musculus
gcctgcaaccccagca

SEQ ID NO: 412524 - DNA, 16 bp, M. musculus
gcctgcaatcccagca

SEQ ID NO: 412525 - DNA, 16 bp, M. musculus
gcctgcaatctcagca

SEQ ID NO: 412526 - DNA, 16 bp, M. musculus
gcctgcacactctgca

SEQ ID NO: 412527 - DNA, 16 bp, M. musculus
gcctgcacagtgccat

SEQ ID NO: 412528 - DNA, 16 bp, M. musculus
gcctgcaccatgcctt

SEQ ID NO: 412529 - DNA, 16 bp, M. musculus
gcctgcactgcctgca

SEQ ID NO: 412530 - DNA, 16 bp, M. musculus
gcctgcagaaagtact

SEQ ID NO: 412531 - DNA, 16 bp, M. musculus
gcctgcagaagccaga

SEQ ID NO: 412532 - DNA, 16 bp, M. musculus
gcctgcagagagaact

SEQ ID NO: 412533 - DNA, 16 bp, M. musculus
gcctgcagagctcaga

SEQ ID NO: 412534 - DNA, 16 bp, M. musculus
gcctgcagaggccaga

SEQ ID NO: 412535 - DNA, 16 bp, M. musculus
gcctgcagccctggct

SEQ ID NO: 412536 - DNA, 16 bp, M. musculus
gcctgcagctccagct

SEQ ID NO: 412537 - DNA, 16 bp, M. musculus
gcctgcaggagcacag

SEQ ID NO: 412538 - DNA, 16 bp, M. musculus
gcctgcagtcccacca

SEQ ID NO: 412539 - DNA, 16 bp, M. musculus
gcctgcatcttcttca

SEQ ID NO: 412540 - DNA, 16 bp, M. musculus
gcctgcatgcacaatg

SEQ ID NO: 412541 - DNA, 16 bp, M. musculus
gcctgcatgcctgcct

SEQ ID NO: 412542 - DNA, 16 bp, M. musculus
gcctgcatgtatgtgc

SEQ ID NO: 412543 - DNA, 16 bp, M. musculus
gcctgcatgtgtgtct

SEQ ID NO: 412544 - DNA, 16 bp, M. musculus
gcctgccaactctctg

SEQ ID NO: 412545 - DNA, 16 bp, M. musculus
gcctgccaccaagcct

SEQ ID NO: 412546 - DNA, 16 bp, M. musculus
gcctgccagctctcct

SEQ ID NO: 412547 - DNA, 16 bp, M. musculus
gcctgccatcccagca

SEQ ID NO: 412548 - DNA, 16 bp, M. musculus
gcctgcccacctgcct

SEQ ID NO: 412549 - DNA, 16 bp, M. musculus
gcctgcccccacagtg

SEQ ID NO: 412550 - DNA, 16 bp, M. musculus
gcctgcccctgccttc

SEQ ID NO: 412551 - DNA, 16 bp, M. musculus
gcctgcctacctgcct

SEQ ID NO: 412552 - DNA, 16 bp, M. musculus
gcctgcctagtctaca

SEQ ID NO: 412553 - DNA, 16 bp, M. musculus
gcctgcctatctgtct

SEQ ID NO: 412554 - DNA, 16 bp, M. musculus
gcctgcctcatccctt

SEQ ID NO: 412555 - DNA, 16 bp, M. musculus
gcctgcctcccaagtg

SEQ ID NO: 412556 - DNA, 16 bp, M. musculus
gcctgcctccccagtg

SEQ ID NO: 412557 - DNA, 17 bp, M. musculus
gcctgcctctacctcct

SEQ ID NO: 412558 - DNA, 16 bp, M. musculus
gcctgcctctgactcc

SEQ ID NO: 412559 - DNA, 16 bp, M. musculus
gcctgcctctgccctc

SEQ ID NO: 412560 - DNA, 16 bp, M. musculus
gcctgcctctgcctca

SEQ ID NO: 412561 - DNA, 16 bp, M. musculus
gcctgcctctgcctct

SEQ ID NO: 412562 - DNA, 16 bp, M. musculus
gcctgcctctgcctgc

SEQ ID NO: 412563 - DNA, 16 bp, M. musculus
gcctgcctctgccttc

SEQ ID NO: 412564 - DNA, 16 bp, M. musculus
gcctgcctctgctggg

SEQ ID NO: 412565 - DNA, 16 bp, M. musculus
gcctgcctctggctcc

SEQ ID NO: 412566 - DNA, 16 bp, M. musculus
gcctgcctctgtctct

SEQ ID NO: 412567 - DNA, 16 bp, M. musculus
gcctgcctcttcctct

SEQ ID NO: 412568 - DNA, 16 bp, M. musculus
gcctgcctgcctctct

SEQ ID NO: 412569 - DNA, 16 bp, M. musculus
gcctgcctgcctgcca

SEQ ID NO: 412570 - DNA, 16 bp, M. musculus
gcctgcctgcctgctt

SEQ ID NO: 412571 - DNA, 16 bp, M. musculus
gcctgcctgcctgtcc

SEQ ID NO: 412572 - DNA, 16 bp, M. musculus
gcctgcctgcctgtct

SEQ ID NO: 412573 - DNA, 16 bp, M. musculus
gcctgcctgcctgtgg

SEQ ID NO: 412574 - DNA, 16 bp, M. musculus
gcctgcctgcctgttt

SEQ ID NO: 412575 - DNA, 16 bp, M. musculus
gcctgcctgccttcct

SEQ ID NO: 412576 - DNA, 16 bp, M. musculus
gcctgcctgcctttct

SEQ ID NO: 412577 - DNA, 16 bp, M. musculus
gcctgcctgctttctt

SEQ ID NO: 412578 - DNA, 16 bp, M. musculus
gcctgcctggacactg

SEQ ID NO: 412579 - DNA, 16 bp, M. musculus
gcctgcctggatgcta

SEQ ID NO: 412580 - DNA, 16 bp, M. musculus
gcctgcctgggctgca

SEQ ID NO: 412581 - DNA, 16 bp, M. musculus
gcctgcctggtgaggt

SEQ ID NO: 412582 - DNA, 16 bp, M. musculus
gcctgcctgtgcttcc

SEQ ID NO: 412583 - DNA, 16 bp, M. musculus
gcctgccttcctgtgc

SEQ ID NO: 412584 - DNA, 16 bp, M. musculus
gcctgccttccttcct

SEQ ID NO: 412585 - DNA, 16 bp, M. musculus
gcctgcctttctctct

SEQ ID NO: 412586 - DNA, 16 bp, M. musculus
gcctgcctttgccttt

SEQ ID NO: 412587 - DNA, 16 bp, M. musculus
gcctgctacctgcctg

SEQ ID NO: 412588 - DNA, 16 bp, M. musculus
gcctgctctacagaga

SEQ ID NO: 412589 - DNA, 16 bp, M. musculus
gcctgctctgcctcct

SEQ ID NO: 412590 - DNA, 16 bp, M. musculus
gcctgctgagcttgct

SEQ ID NO: 412591 - DNA, 16 bp, M. musculus
gcctgctgccaagtct

SEQ ID NO: 412592 - DNA, 16 bp, M. musculus
gcctgctgccatgctc

SEQ ID NO: 412593 - DNA, 16 bp, M. musculus
gcctgctgcccacaga

SEQ ID NO: 412594 - DNA, 16 bp, M. musculus
gcctgctgcctgctgt

SEQ ID NO: 412595 - DNA, 16 bp, M. musculus
gcctgctgtctgactg

SEQ ID NO: 412596 - DNA, 16 bp, M. musculus
gcctgctgtgtgtgga

SEQ ID NO: 412597 - DNA, 16 bp, M. musculus
gcctgcttatcctttg

SEQ ID NO: 412598 - DNA, 16 bp, M. musculus
gcctgcttctgcctct

SEQ ID NO: 412599 - DNA, 16 bp, M. musculus
gcctgcttgccctgtg

SEQ ID NO: 412600 - DNA, 16 bp, M. musculus
gcctgcttgccttcct

SEQ ID NO: 412601 - DNA, 16 bp, M. musculus
gcctgctttctcacag

SEQ ID NO: 412602 - DNA, 16 bp, M. musculus
gcctgcttttccagag

SEQ ID NO: 412603 - DNA, 16 bp, M. musculus
gcctggaactcactgt

SEQ ID NO: 412604 - DNA, 16 bp, M. musculus
gcctggaactcatggt

SEQ ID NO: 412605 - DNA, 16 bp, M. musculus
gcctggaacttgctat

SEQ ID NO: 412606 - DNA, 16 bp, M. musculus
gcctggaacttgctct

SEQ ID NO: 412607 - DNA, 16 bp, M. musculus
gcctggaagcactcat

SEQ ID NO: 412608 - DNA, 16 bp, M. musculus
gcctggaagccagtct

SEQ ID NO: 412609 - DNA, 16 bp, M. musculus
gcctggacagtgacca

SEQ ID NO: 412610 - DNA, 16 bp, M. musculus
gcctggaccacatagt

SEQ ID NO: 412611 - DNA, 16 bp, M. musculus
gcctggacctcacaga

SEQ ID NO: 412612 - DNA, 16 bp, M. musculus
gcctggactacagaat

SEQ ID NO: 412613 - DNA, 16 bp, M. musculus
gcctggactacagagt

SEQ ID NO: 412614 - DNA, 16 bp, M. musculus
gcctggacttaagctt

SEQ ID NO: 412615 - DNA, 16 bp, M. musculus
gcctggagaaatggct

SEQ ID NO: 412616 - DNA, 16 bp, M. musculus
gcctggagagatagct

SEQ ID NO: 412617 - DNA, 16 bp, M. musculus
gcctggagagatgcct

SEQ ID NO: 412618 - DNA, 16 bp, M. musculus
gcctggagctcacaga

SEQ ID NO: 412619 - DNA, 16 bp, M. musculus
gcctggagctcaccaa

SEQ ID NO: 412620 - DNA, 16 bp, M. musculus
gcctggagctcatcaa

SEQ ID NO: 412621 - DNA, 16 bp, M. musculus
gcctggagctgcaggc

SEQ ID NO: 412622 - DNA, 16 bp, M. musculus
gcctggatgctgcctt

SEQ ID NO: 412623 - DNA, 16 bp, M. musculus
gcctggatgctgctgt

SEQ ID NO: 412624 - DNA, 16 bp, M. musculus
gcctggatggtagctg

SEQ ID NO: 412625 - DNA, 16 bp, M. musculus
gcctggcaaacagaga

SEQ ID NO: 412626 - DNA, 16 bp, M. musculus
gcctggcaagatggct

SEQ ID NO: 412627 - DNA, 16 bp, M. musculus
gcctggcaagtacaga

SEQ ID NO: 412628 - DNA, 16 bp, M. musculus
gcctggcacacagtag

SEQ ID NO: 412629 - DNA, 16 bp, M. musculus
gcctggcaggcagccc

SEQ ID NO: 412630 - DNA, 16 bp, M. musculus
gcctggcatggtggtg

SEQ ID NO: 412631 - DNA, 16 bp, M. musculus
gcctggcctacagagt

SEQ ID NO: 412632 - DNA, 16 bp, M. musculus
gcctggcctggaactc

SEQ ID NO: 412633 - DNA, 16 bp, M. musculus
gcctggcctggaattc

SEQ ID NO: 412634 - DNA, 16 bp, M. musculus
gcctggcctggcctgc

SEQ ID NO: 412635 - DNA, 16 bp, M. musculus
gcctggcctgggcatg

SEQ ID NO: 412636 - DNA, 16 bp, M. musculus
gcctggccttgaactt

SEQ ID NO: 412637 - DNA, 16 bp, M. musculus
gcctggctgctgccat

SEQ ID NO: 412638 - DNA, 16 bp, M. musculus
gcctggctggggaggc

SEQ ID NO: 412639 - DNA, 16 bp, M. musculus
gcctggctggtggctc

SEQ ID NO: 412640 - DNA, 16 bp, M. musculus
gcctgggaacacagat

SEQ ID NO: 412641 - DNA, 16 bp, M. musculus
gcctgggacagagcag

SEQ ID NO: 412642 - DNA, 16 bp, M. musculus
gcctgggacagaggga

SEQ ID NO: 412643 - DNA, 16 bp, M. musculus
gcctgggactgcagcc

SEQ ID NO: 412644 - DNA, 16 bp, M. musculus
gcctgggagatggctc

SEQ ID NO: 412645 - DNA, 16 bp, M. musculus
gcctgggagccagtat

SEQ ID NO: 412646 - DNA, 16 bp, M. musculus
gcctgggaggaggtgg

SEQ ID NO: 412647 - DNA, 16 bp, M. musculus
gcctgggaggcagagg

SEQ ID NO: 412648 - DNA, 16 bp, M. musculus
gcctgggaggcctttg

SEQ ID NO: 412649 - DNA, 16 bp, M. musculus
gcctgggagtggagct

SEQ ID NO: 412650 - DNA, 16 bp, M. musculus
gcctgggatcccagca

SEQ ID NO: 412651 - DNA, 56 bp, M. musculus
gcctgggcaataaccaccttgtctctcctagtttgggccttaagcttacagaccaa

SEQ ID NO: 412652 - DNA, 16 bp, M. musculus
gcctgggcagagggag

SEQ ID NO: 412653 - DNA, 16 bp, M. musculus
gcctgggcagcttggg

SEQ ID NO: 412654 - DNA, 16 bp, M. musculus
gcctgggccaggaagt

SEQ ID NO: 412655 - DNA, 16 bp, M. musculus
gcctgggctacacatt

SEQ ID NO: 412656 - DNA, 16 bp, M. musculus
gcctgggctacagaag

SEQ ID NO: 412657 - DNA, 16 bp, M. musculus
gcctgggctacatgtg

SEQ ID NO: 412658 - DNA, 16 bp, M. musculus
gcctgggctgcatagt

SEQ ID NO: 412659 - DNA, 16 bp, M. musculus
gcctgggctggagctg

SEQ ID NO: 412660 - DNA, 16 bp, M. musculus
gcctgggctggcattg

SEQ ID NO: 412661 - DNA, 16 bp, M. musculus
gcctgggctgggctgg

SEQ ID NO: 412662 - DNA, 16 bp, M. musculus
gcctggggacctgagt

SEQ ID NO: 412663 - DNA, 16 bp, M. musculus
gcctggggctgaggaa

SEQ ID NO: 412664 - DNA, 16 bp, M. musculus
gcctggggctggagag

SEQ ID NO: 412665 - DNA, 16 bp, M. musculus
gcctggtaccctcaga

SEQ ID NO: 412666 - DNA, 16 bp, M. musculus
gcctggtctgcagaga

SEQ ID NO: 412667 - DNA, 16 bp, M. musculus
gcctggtgcagggctg

SEQ ID NO: 412668 - DNA, 16 bp, M. musculus
gcctggtgcccacaga

SEQ ID NO: 412669 - DNA, 16 bp, M. musculus
gcctggtgcccgtgga

SEQ ID NO: 412670 - DNA, 16 bp, M. musculus
gcctggtgcctgagga

SEQ ID NO: 412671 - DNA, 16 bp, M. musculus
gcctggtgcctgcaga

SEQ ID NO: 412672 - DNA, 16 bp, M. musculus
gcctggtgcctgtgga

SEQ ID NO: 412673 - DNA, 16 bp, M. musculus
gcctggtgctcacaga

SEQ ID NO: 412674 - DNA, 16 bp, M. musculus
gcctggtgtccacaga

SEQ ID NO: 412675 - DNA, 16 bp, M. musculus
gcctggtgtgtgatgc

SEQ ID NO: 412676 - DNA, 16 bp, M. musculus
gcctggtgtgtgtgtg

SEQ ID NO: 412677 - DNA, 16 bp, M. musculus
gcctggttctgcctcc

SEQ ID NO: 412678 - DNA, 16 bp, M. musculus
gcctggtttacaaagt

SEQ ID NO: 412679 - DNA, 16 bp, M. musculus
gcctggtttggcctca

SEQ ID NO: 412680 - DNA, 16 bp, M. musculus
gcctgtaatcccaaca

SEQ ID NO: 412681 - DNA, 16 bp, M. musculus
gcctgtaatcccatca

SEQ ID NO: 412682 - DNA, 16 bp, M. musculus
gcctgtaatctcagcc

SEQ ID NO: 412683 - DNA, 16 bp, M. musculus
gcctgtagctctttat

SEQ ID NO: 412684 - DNA, 16 bp, M. musculus
gcctgtaggcaagtct

SEQ ID NO: 412685 - DNA, 16 bp, M. musculus
gcctgtataacatctg

SEQ ID NO: 412686 - DNA, 16 bp, M. musculus
gcctgtattagtcagg

SEQ ID NO: 412687 - DNA, 16 bp, M. musculus
gcctgtcactgtacct

SEQ ID NO: 412688 - DNA, 16 bp, M. musculus
gcctgtctcccaggag

SEQ ID NO: 412689 - DNA, 16 bp, M. musculus
gcctgtctctctctct

SEQ ID NO: 412690 - DNA, 16 bp, M. musculus
gcctgtctctgactct

SEQ ID NO: 412691 - DNA, 16 bp, M. musculus
gcctgtctctgtacaa

SEQ ID NO: 412692 - DNA, 16 bp, M. musculus
gcctgtctctgtacta

SEQ ID NO: 412693 - DNA, 16 bp, M. musculus
gcctgtctctgtttct

SEQ ID NO: 412694 - DNA, 16 bp, M. musculus
gcctgtctgcctgctg

SEQ ID NO: 412695 - DNA, 16 bp, M. musculus
gcctgtctgcttgcct

SEQ ID NO: 412696 - DNA, 16 bp, M. musculus
gcctgtctgtctgtcc

SEQ ID NO: 412697 - DNA, 16 bp, M. musculus
gcctgtctgtctgtct

SEQ ID NO: 412698 - DNA, 16 bp, M. musculus
gcctgtctgtgcagag

SEQ ID NO: 412699 - DNA, 16 bp, M. musculus
gcctgtgaaagccaga

SEQ ID NO: 412700 - DNA, 16 bp, M. musculus
gcctgtgaagaaacct

SEQ ID NO: 412701 - DNA, 16 bp, M. musculus
gcctgtgaagtctgcc

SEQ ID NO: 412702 - DNA, 16 bp, M. musculus
gcctgtgacagtgaga

SEQ ID NO: 412703 - DNA, 16 bp, M. musculus
gcctgtgaggggctgg

SEQ ID NO: 412704 - DNA, 16 bp, M. musculus
gcctgtgatggtttgt

SEQ ID NO: 412705 - DNA, 16 bp, M. musculus
gcctgtgcaccatgtg

SEQ ID NO: 412706 - DNA, 16 bp, M. musculus
gcctgtgccctgagca

SEQ ID NO: 412707 - DNA, 16 bp, M. musculus
gcctgtgcgtgtgtgc

SEQ ID NO: 412708 - DNA, 16 bp, M. musculus
gcctgtgctctgcctg

SEQ ID NO: 412709 - DNA, 16 bp, M. musculus
gcctgtggaggtcaga

SEQ ID NO: 412710 - DNA, 16 bp, M. musculus
gcctgtggatcctgct

SEQ ID NO: 412711 - DNA, 16 bp, M. musculus
gcctgtggggacattt

SEQ ID NO: 412712 - DNA, 16 bp, M. musculus
gcctgtggtggtttga

SEQ ID NO: 412713 - DNA, 16 bp, M. musculus
gcctgtgtcaagatga

SEQ ID NO: 412714 - DNA, 16 bp, M. musculus
gcctgtgtcatggaga

SEQ ID NO: 412715 - DNA, 16 bp, M. musculus
gcctgtgtgagggtgt

SEQ ID NO: 412716 - DNA, 16 bp, M. musculus
gcctgtgtgctgctgt

SEQ ID NO: 412717 - DNA, 16 bp, M. musculus
gcctgtgtggccactc

SEQ ID NO: 412718 - DNA, 16 bp, M. musculus
gcctgttactccagct

SEQ ID NO: 412719 - DNA, 21 bp, M. musculus
gcctgttcataccaaagaaac

SEQ ID NO: 412720 - DNA, 16 bp, M. musculus
gcctgttccagaagct

SEQ ID NO: 412721 - DNA, 16 bp, M. musculus
gcctgttgacactgtt

SEQ ID NO: 412722 - DNA, 16 bp, M. musculus
gcctgttgcctgcaga

SEQ ID NO: 412723 - DNA, 16 bp, M. musculus
gcctgttgctggacct

SEQ ID NO: 412724 - DNA, 16 bp, M. musculus
gcctgttgctggactt

SEQ ID NO: 412725 - DNA, 16 bp, M. musculus
gcctgtttatccatgg

SEQ ID NO: 412726 - DNA, 16 bp, M. musculus
gcctgtttattctttg

SEQ ID NO: 412727 - DNA, 16 bp, M. musculus
gcctgtttctctctct

SEQ ID NO: 412728 - DNA, 16 bp, M. musculus
gcctgttttgtgacag

SEQ ID NO: 412729 - DNA, 16 bp, M. musculus
gccttaaacacacaca

SEQ ID NO: 412730 - DNA, 16 bp, M. musculus
gccttaaactcacaga

SEQ ID NO: 412731 - DNA, 16 bp, M. musculus
gccttaaatcccagca

SEQ ID NO: 412732 - DNA, 73 bp, M. musculus
gccttacagaatgcacaattacaacgtattgaggattcgcagcctttcagtttgtgtgtctttaagacagcac

SEQ ID NO: 412733 - DNA, 16 bp, M. musculus
gccttacagctggacc

SEQ ID NO: 412734 - DNA, 16 bp, M. musculus
gccttagcctctcaag

SEQ ID NO: 412735 - DNA, 16 bp, M. musculus
gccttagcttcctgag

SEQ ID NO: 412736 - DNA, 16 bp, M. musculus
gccttagtctgtggtt

SEQ ID NO: 412737 - DNA, 16 bp, M. musculus
gccttagtgggagaag

SEQ ID NO: 412738 - DNA, 16 bp, M. musculus
gccttattcctttgag

SEQ ID NO: 412739 - DNA, 16 bp, M. musculus
gccttcacaggacgaa

SEQ ID NO: 412740 - DNA, 16 bp, M. musculus
gccttcacaggcacca

SEQ ID NO: 412741 - DNA, 16 bp, M. musculus
gccttcacatgcacac

SEQ ID NO: 412742 - DNA, 16 bp, M. musculus
gccttcagaacaagat

SEQ ID NO: 412743 - DNA, 16 bp, M. musculus
gccttcagagagtgct

SEQ ID NO: 412744 - DNA, 16 bp, M. musculus
gccttcagatgtagat

SEQ ID NO: 412745 - DNA, 16 bp, M. musculus
gccttcagccttcagc

SEQ ID NO: 412746 - DNA, 16 bp, M. musculus
gccttcaggttctccc

SEQ ID NO: 412747 - DNA, 16 bp, M. musculus
gccttcagttcctgcc

SEQ ID NO: 412748 - DNA, 16 bp, M. musculus
gccttcatcagagaag

SEQ ID NO: 412749 - DNA, 16 bp, M. musculus
gccttcattggccagt

SEQ ID NO: 412750 - DNA, 16 bp, M. musculus
gccttcattgggaaga

SEQ ID NO: 412751 - DNA, 16 bp, M. musculus
gccttccaagtactgg

SEQ ID NO: 412752 - DNA, 16 bp, M. musculus
gccttccagaagcttt

SEQ ID NO: 412753 - DNA, 16 bp, M. musculus
gccttccagcaggagg

SEQ ID NO: 412754 - DNA, 16 bp, M. musculus
gccttccagtgctggg

SEQ ID NO: 412755 - DNA, 16 bp, M. musculus
gccttccatggcttct

SEQ ID NO: 412756 - DNA, 16 bp, M. musculus
gccttccattgggaga

SEQ ID NO: 412757 - DNA, 16 bp, M. musculus
gccttcccagcactgg

SEQ ID NO: 412758 - DNA, 16 bp, M. musculus
gccttccctttccctg

SEQ ID NO: 412759 - DNA, 16 bp, M. musculus
gccttcctctgcctct

SEQ ID NO: 412760 - DNA, 16 bp, M. musculus
gccttcctgctggagg

SEQ ID NO: 412761 - DNA, 16 bp, M. musculus
gccttcctggaggaag

SEQ ID NO: 412762 - DNA, 16 bp, M. musculus
gccttcctggtgctgg

SEQ ID NO: 412763 - DNA, 16 bp, M. musculus
gccttccttgaggaaa

SEQ ID NO: 412764 - DNA, 22 bp, M. musculus
gccttctcagtcgaaccgttca

SEQ ID NO: 412765 - DNA, 16 bp, M. musculus
gccttctccatggtgg

SEQ ID NO: 412766 - DNA, 16 bp, M. musculus
gccttctctctgtctc

SEQ ID NO: 412767 - DNA, 16 bp, M. musculus
gccttctctggcatca

SEQ ID NO: 412768 - DNA, 25 bp, M. musculus
gccttctgaccttgatggctctatt

SEQ ID NO: 412769 - DNA, 16 bp, M. musculus
gccttctgcctcagcc

SEQ ID NO: 412770 - DNA, 16 bp, M. musculus
gccttctgtttctctg

SEQ ID NO: 412771 - DNA, 16 bp, M. musculus
gccttgaacagaaaca

SEQ ID NO: 412772 - DNA, 16 bp, M. musculus
gccttgaacagagatc

SEQ ID NO: 412773 - DNA, 17 bp, M. musculus
gccttgaactcacaaag

SEQ ID NO: 412774 - DNA, 16 bp, M. musculus
gccttgaactcagtat

SEQ ID NO: 412775 - DNA, 16 bp, M. musculus
gccttgaactcctggg

SEQ ID NO: 412776 - DNA, 16 bp, M. musculus
gccttgaacttgatat

SEQ ID NO: 412777 - DNA, 16 bp, M. musculus
gccttgaagtcagaga

SEQ ID NO: 412778 - DNA, 16 bp, M. musculus
gccttgaattcacaga

SEQ ID NO: 412779 - DNA, 16 bp, M. musculus
gccttgagctcctgct

SEQ ID NO: 412780 - DNA, 16 bp, M. musculus
gccttgatctggttga

SEQ ID NO: 412781 - DNA, 16 bp, M. musculus
gccttgatgataatgg

SEQ ID NO: 412782 - DNA, 16 bp, M. musculus
gccttgatgtgatggt

SEQ ID NO: 412783 - DNA, 16 bp, M. musculus
gccttgattcagacag

SEQ ID NO: 412784 - DNA, 16 bp, M. musculus
gccttgcaagaagaga

SEQ ID NO: 412785 - DNA, 16 bp, M. musculus
gccttgccacttagag

SEQ ID NO: 412786 - DNA, 16 bp, M. musculus
gccttgccctgccctg

SEQ ID NO: 412787 - DNA, 16 bp, M. musculus
gccttgctggaggaag

SEQ ID NO: 412788 - DNA, 16 bp, M. musculus
gccttgctgtcagttt

SEQ ID NO: 412789 - DNA, 16 bp, M. musculus
gccttggctggcctca

SEQ ID NO: 412790 - DNA, 16 bp, M. musculus
gccttggctggccttg

SEQ ID NO: 412791 - DNA, 16 bp, M. musculus
gccttggctgtcctgg

SEQ ID NO: 412792 - DNA, 16 bp, M. musculus
gccttgggacctctcc

SEQ ID NO: 412793 - DNA, 16 bp, M. musculus
gccttgggcttgctag

SEQ ID NO: 412794 - DNA, 16 bp, M. musculus
gccttggggaactgtg

SEQ ID NO: 412795 - DNA, 16 bp, M. musculus
gccttgggttcaatcc

SEQ ID NO: 412796 - DNA, 16 bp, M. musculus
gccttgggtttaatcc

SEQ ID NO: 412797 - DNA, 16 bp, M. musculus
gccttggtggaggaag

SEQ ID NO: 412798 - DNA, 16 bp, M. musculus
gccttgtcagcctttg

SEQ ID NO: 412799 - DNA, 16 bp, M. musculus
gccttgtcatgtatca

SEQ ID NO: 412800 - DNA, 16 bp, M. musculus
gccttgtcttgcctca

SEQ ID NO: 412801 - DNA, 16 bp, M. musculus
gccttgtggactgaac

SEQ ID NO: 412802 - DNA, 16 bp, M. musculus
gccttgtggatatttt

SEQ ID NO: 412803 - DNA, 16 bp, M. musculus
gccttgtggtttcttc

SEQ ID NO: 412804 - DNA, 16 bp, M. musculus
gccttgttagagaagg

SEQ ID NO: 412805 - DNA, 16 bp, M. musculus
gccttgttctcctggt

SEQ ID NO: 412806 - DNA, 16 bp, M. musculus
gccttgttggacatca

SEQ ID NO: 412807 - DNA, 16 bp, M. musculus
gccttgttggagaaag

SEQ ID NO: 412808 - DNA, 16 bp, M. musculus
gccttgttgggcatca

SEQ ID NO: 412809 - DNA, 16 bp, M. musculus
gccttgttttgtccct

SEQ ID NO: 412810 - DNA, 16 bp, M. musculus
gcctttaaccacagca

SEQ ID NO: 412811 - DNA, 16 bp, M. musculus
gcctttaaccccaaca

SEQ ID NO: 412812 - DNA, 16 bp, M. musculus
gcctttaatacagttc

SEQ ID NO: 412813 - DNA, 16 bp, M. musculus
gcctttaatcccagga

SEQ ID NO: 412814 - DNA, 16 bp, M. musculus
gcctttaatcctaaca

SEQ ID NO: 412815 - DNA, 16 bp, M. musculus
gcctttaatcctagta

SEQ ID NO: 412816 - DNA, 16 bp, M. musculus
gcctttaatctcagta

SEQ ID NO: 412817 - DNA, 16 bp, M. musculus
gcctttactcccagca

SEQ ID NO: 412818 - DNA, 16 bp, M. musculus
gcctttagtcccagga

SEQ ID NO: 412819 - DNA, 16 bp, M. musculus
gcctttatatttataa

SEQ ID NO: 412820 - DNA, 16 bp, M. musculus
gcctttatcagcagac

SEQ ID NO: 412821 - DNA, 16 bp, M. musculus
gcctttatttccagca

SEQ ID NO: 412822 - DNA, 16 bp, M. musculus
gcctttatttcttctt

SEQ ID NO: 412823 - DNA, 16 bp, M. musculus
gcctttcatcccagta

SEQ ID NO: 412824 - DNA, 16 bp, M. musculus
gcctttccccactgag

SEQ ID NO: 412825 - DNA, 16 bp, M. musculus
gcctttcccccttggt

SEQ ID NO: 412826 - DNA, 16 bp, M. musculus
gcctttcctcccaatg

SEQ ID NO: 412827 - DNA, 16 bp, M. musculus
gcctttcctctcattg

SEQ ID NO: 412828 - DNA, 16 bp, M. musculus
gcctttcctctcctgc

SEQ ID NO: 412829 - DNA, 16 bp, M. musculus
gcctttctggaggaag

SEQ ID NO: 412830 - DNA, 16 bp, M. musculus
gcctttgagtgctggg

SEQ ID NO: 412831 - DNA, 16 bp, M. musculus
gcctttgatcccagaa

SEQ ID NO: 412832 - DNA, 16 bp, M. musculus
gcctttgcctccccag

SEQ ID NO: 412833 - DNA, 16 bp, M. musculus
gcctttgcctctgcct

SEQ ID NO: 412834 - DNA, 16 bp, M. musculus
gcctttgccttcccag

SEQ ID NO: 412835 - DNA, 16 bp, M. musculus
gcctttgctctatctc

SEQ ID NO: 412836 - DNA, 16 bp, M. musculus
gcctttgcttttctgt

SEQ ID NO: 412837 - DNA, 16 bp, M. musculus
gcctttgtctacagag

SEQ ID NO: 412838 - DNA, 16 bp, M. musculus
gcctttgtttctgttg

SEQ ID NO: 412839 - DNA, 17 bp, M. musculus
gcctttgttttttgcaa

SEQ ID NO: 412840 - DNA, 16 bp, M. musculus
gccttttagtctgagg

SEQ ID NO: 412841 - DNA, 16 bp, M. musculus
gccttttatcctagca

SEQ ID NO: 412842 - DNA, 16 bp, M. musculus
gccttttcaggcatca

SEQ ID NO: 412843 - DNA, 16 bp, M. musculus
gccttttcattgatta

SEQ ID NO: 412844 - DNA, 16 bp, M. musculus
gccttttctggcctca

SEQ ID NO: 412845 - DNA, 16 bp, M. musculus
gccttttggctaagat

SEQ ID NO: 412846 - DNA, 16 bp, M. musculus
gcctttttggaagaag

SEQ ID NO: 412847 - DNA, 16 bp, M. musculus
gcctttttgtggttta

SEQ ID NO: 412848 - DNA, 16 bp, M. musculus
gcgactgacaaggacc

SEQ ID NO: 412849 - DNA, 16 bp, M. musculus
gcgagagaccctgtct

SEQ ID NO: 412850 - DNA, 16 bp, M. musculus
gcgagagagacagaga

SEQ ID NO: 412851 - DNA, 16 bp, M. musculus
gcgagagcgagagaga

SEQ ID NO: 412852 - DNA, 17 bp, M. musculus
gcgagagcgagagcgag

SEQ ID NO: 412853 - DNA, 16 bp, M. musculus
gcgagcgagcgagaga

SEQ ID NO: 412854 - DNA, 17 bp, M. musculus
gcgagcgagcgagagag

SEQ ID NO: 412855 - DNA, 16 bp, M. musculus
gcgagcgcgcgcgcac

SEQ ID NO: 412856 - DNA, 16 bp, M. musculus
gcgcacacatgtgcac

SEQ ID NO: 412857 - DNA, 16 bp, M. musculus
gcgcacacgcacacac

SEQ ID NO: 412858 - DNA, 16 bp, M. musculus
gcgcacatacacacac

SEQ ID NO: 412859 - DNA, 16 bp, M. musculus
gcgcacgcgcgcgcac

SEQ ID NO: 412860 - DNA, 16 bp, M. musculus
gcgcacgtgcacacac

SEQ ID NO: 412861 - DNA, 16 bp, M. musculus
gcgcagagaggcagag

SEQ ID NO: 412862 - DNA, 17 bp, M. musculus
gcgcagcgcagcgcagc

SEQ ID NO: 412863 - DNA, 95 bp, M. musculus
gcgcaggcccgagcaaacgcagctgctttgactccagagcagagagattggacttttgacttgttaacgggtcagggagcttattctgctgatca

SEQ ID NO: 412864 - DNA, 16 bp, M. musculus
gcgcagtggctgccag

SEQ ID NO: 412865 - DNA, 16 bp, M. musculus
gcgcatgtgtgcacat

SEQ ID NO: 412866 - DNA, 16 bp, M. musculus
gcgcatgtgtgtgcgt

SEQ ID NO: 412867 - DNA, 16 bp, M. musculus
gcgccaacccctccca

SEQ ID NO: 412868 - DNA, 16 bp, M. musculus
gcgccaccacaccctg

SEQ ID NO: 412869 - DNA, 16 bp, M. musculus
gcgccaccaccgcctg

SEQ ID NO: 412870 - DNA, 17 bp, M. musculus
gcgccaccttcggctcc

SEQ ID NO: 412871 - DNA, 16 bp, M. musculus
gcgccagagactgcag

SEQ ID NO: 412872 - DNA, 16 bp, M. musculus
gcgccatctctccagc

SEQ ID NO: 412873 - DNA, 16 bp, M. musculus
gcgccatgcctgcctg

SEQ ID NO: 412874 - DNA, 17 bp, M. musculus
gcgccctagctaccctg

SEQ ID NO: 412875 - DNA, 16 bp, M. musculus
gcgcctctgtgcttct

SEQ ID NO: 412876 - DNA, 16 bp, M. musculus
gcgcctgcgcctgcgc

SEQ ID NO: 412877 - DNA, 16 bp, M. musculus
gcgccttccaggccct

SEQ ID NO: 412878 - DNA, 16 bp, M. musculus
gcgcgaccggccagga

SEQ ID NO: 412879 - DNA, 16 bp, M. musculus
gcgcgcacacacacaa

SEQ ID NO: 412880 - DNA, 16 bp, M. musculus
gcgcgcacacacatac

SEQ ID NO: 412881 - DNA, 16 bp, M. musculus
gcgcgcacacgcacac

SEQ ID NO: 412882 - DNA, 16 bp, M. musculus
gcgcgcacacgcacgc

SEQ ID NO: 412883 - DNA, 16 bp, M. musculus
gcgcgcacgtgcgcgc

SEQ ID NO: 412884 - DNA, 16 bp, M. musculus
gcgcgcgcacgcgcac

SEQ ID NO: 412885 - DNA, 16 bp, M. musculus
gcgcgcgcccccaact

SEQ ID NO: 412886 - DNA, 16 bp, M. musculus
gcgcgcgcgcacgcac

SEQ ID NO: 412887 - DNA, 16 bp, M. musculus
gcgcgcgcgcatgcac

SEQ ID NO: 412888 - DNA, 16 bp, M. musculus
gcgcgcgcgcatgtgt

SEQ ID NO: 412889 - DNA, 23 bp, M. musculus
gcgcgcgcgcgcacacacacaca

SEQ ID NO: 412890 - DNA, 16 bp, M. musculus
gcgcgcgcgtacacac

SEQ ID NO: 412891 - DNA, 16 bp, M. musculus
gcgcgcgcgtgcgtgc

SEQ ID NO: 412892 - DNA, 16 bp, M. musculus
gcgcgcgcgtgtatgt

SEQ ID NO: 412893 - DNA, 16 bp, M. musculus
gcgcgcgcgtgtgtgc

SEQ ID NO: 412894 - DNA, 16 bp, M. musculus
gcgcgcgtgtgtgtgt

SEQ ID NO: 412895 - DNA, 16 bp, M. musculus
gcgcgggcacacacac

SEQ ID NO: 412896 - DNA, 16 bp, M. musculus
gcgcgtgcacgcacac

SEQ ID NO: 412897 - DNA, 16 bp, M. musculus
gcgcgtgcgcgtgcgc

SEQ ID NO: 412898 - DNA, 16 bp, M. musculus
gcgcgtgcgtgcgcgc

SEQ ID NO: 412899 - DNA, 16 bp, M. musculus
gcgcgtgcgtgcgtgc

SEQ ID NO: 412900 - DNA, 16 bp, M. musculus
gcgctctgcgctctgg

SEQ ID NO: 412901 - DNA, 16 bp, M. musculus
gcgctcttccgagccc

SEQ ID NO: 412902 - DNA, 16 bp, M. musculus
gcgctgacatcctgtg

SEQ ID NO: 412903 - DNA, 16 bp, M. musculus
gcgctgactactgctg

SEQ ID NO: 412904 - DNA, 16 bp, M. musculus
gcgctttgcctgagca

SEQ ID NO: 412905 - DNA, 16 bp, M. musculus
gcggagaaagcatttg

SEQ ID NO: 412906 - DNA, 16 bp, M. musculus
gcggaggagctgagaa

SEQ ID NO: 412907 - DNA, 16 bp, M. musculus
gcggagggcaggctgc

SEQ ID NO: 412908 - DNA, 17 bp, M. musculus
gcggatttctgagtttg

SEQ ID NO: 412909 - DNA, 16 bp, M. musculus
gcggcagcagcagcag

SEQ ID NO: 412910 - DNA, 16 bp, M. musculus
gcggcagcggcagcag

SEQ ID NO: 412911 - DNA, 16 bp, M. musculus
gcggcagctcaatcca

SEQ ID NO: 412912 - DNA, 16 bp, M. musculus
gcggcctaagccacag

SEQ ID NO: 412913 - DNA, 16 bp, M. musculus
gcggctgaggcaggag

SEQ ID NO: 412914 - DNA, 16 bp, M. musculus
gcgggaatgggcctcc

SEQ ID NO: 412915 - DNA, 16 bp, M. musculus
gcgggaggaatgggcg

SEQ ID NO: 412916 - DNA, 17 bp, M. musculus
gcgggctggtgagatgg

SEQ ID NO: 412917 - DNA, 16 bp, M. musculus
gcggtccccctcgcac

SEQ ID NO: 412918 - DNA, 16 bp, M. musculus
gcggtgacagtagggg

SEQ ID NO: 412919 - DNA, 16 bp, M. musculus
gcgtctaataacaata

SEQ ID NO: 412920 - DNA, 16 bp, M. musculus
gcgtctgtctgtcatt

SEQ ID NO: 412921 - DNA, 16 bp, M. musculus
gcgtgcacacacacgc

SEQ ID NO: 412922 - DNA, 16 bp, M. musculus
gcgtgcaccaccaccg

SEQ ID NO: 412923 - DNA, 16 bp, M. musculus
gcgtgcgccaccacaa

SEQ ID NO: 412924 - DNA, 16 bp, M. musculus
gcgtgcgccaccaccg

SEQ ID NO: 412925 - DNA, 17 bp, M. musculus
gcgtgcgccaccacgct

SEQ ID NO: 412926 - DNA, 16 bp, M. musculus
gcgtgcgccaccacgt

SEQ ID NO: 412927 - DNA, 17 bp, M. musculus
gcgtgcgccatcactgc

SEQ ID NO: 412928 - DNA, 16 bp, M. musculus
gcgtgcgtgcgtgcac

SEQ ID NO: 412929 - DNA, 16 bp, M. musculus
gcgtgcgtgtgcatgc

SEQ ID NO: 412930 - DNA, 16 bp, M. musculus
gcgtgcgtgtgtgtgc

SEQ ID NO: 412931 - DNA, 16 bp, M. musculus
gcgtggacccaagtgg

SEQ ID NO: 412932 - DNA, 16 bp, M. musculus
gcgtggtagtgcatgc

SEQ ID NO: 412933 - DNA, 16 bp, M. musculus
gcgtggtggcgcaagc

SEQ ID NO: 412934 - DNA, 16 bp, M. musculus
gcgtgtctgtgtgtgt

SEQ ID NO: 412935 - DNA, 16 bp, M. musculus
gcgtgtgccaccacac

SEQ ID NO: 412936 - DNA, 16 bp, M. musculus
gcgtgtgccaccacca

SEQ ID NO: 412937 - DNA, 16 bp, M. musculus
gcgtgtgccaccaccc

SEQ ID NO: 412938 - DNA, 16 bp, M. musculus
gcgtgtgcgcgtgcgc

SEQ ID NO: 412939 - DNA, 16 bp, M. musculus
gcgtgtgcgtgtgcgc

SEQ ID NO: 412940 - DNA, 16 bp, M. musculus
gcgtgtgtgcgtgcgt

SEQ ID NO: 412941 - DNA, 16 bp, M. musculus
gctaaaagatcccaaa

SEQ ID NO: 412942 - DNA, 16 bp, M. musculus
gctaaaagtaaagaga

SEQ ID NO: 412943 - DNA, 16 bp, M. musculus
gctaaaatgtgtgtga

SEQ ID NO: 412944 - DNA, 16 bp, M. musculus
gctaaacaagaaggaa

SEQ ID NO: 412945 - DNA, 16 bp, M. musculus
gctaaacaccattctc

SEQ ID NO: 412946 - DNA, 16 bp, M. musculus
gctaaacaggtagaag

SEQ ID NO: 412947 - DNA, 17 bp, M. musculus
gctaaagaaaaaacctg

SEQ ID NO: 412948 - DNA, 16 bp, M. musculus
gctaaagagttaaaag

SEQ ID NO: 412949 - DNA, 16 bp, M. musculus
gctaaagcacaagaaa

SEQ ID NO: 412950 - DNA, 16 bp, M. musculus
gctaaagcaggaagat

SEQ ID NO: 412951 - DNA, 16 bp, M. musculus
gctaaaggccctcaaa

SEQ ID NO: 412952 - DNA, 16 bp, M. musculus
gctaacagccatccat

SEQ ID NO: 412953 - DNA, 16 bp, M. musculus
gctaacccaaaagtcc

SEQ ID NO: 412954 - DNA, 16 bp, M. musculus
gctaacctagaactca

SEQ ID NO: 412955 - DNA, 16 bp, M. musculus
gctaacctcaaactca

SEQ ID NO: 412956 - DNA, 16 bp, M. musculus
gctaacctggtctata

SEQ ID NO: 412957 - DNA, 16 bp, M. musculus
gctaagaaagcatttg

SEQ ID NO: 412958 - DNA, 16 bp, M. musculus
gctaagacaggaggat

SEQ ID NO: 412959 - DNA, 16 bp, M. musculus
gctaagagcactggct

SEQ ID NO: 412960 - DNA, 16 bp, M. musculus
gctaagatcaagaaaa

SEQ ID NO: 412961 - DNA, 16 bp, M. musculus
gctaagcaagagctct

SEQ ID NO: 412962 - DNA, 16 bp, M. musculus
gctaagcaagtactct

SEQ ID NO: 412963 - DNA, 16 bp, M. musculus
gctaagcaagtgttct

SEQ ID NO: 412964 - DNA, 16 bp, M. musculus
gctaagcctcagctgc

SEQ ID NO: 412965 - DNA, 16 bp, M. musculus
gctaaggatgaccttg

SEQ ID NO: 412966 - DNA, 16 bp, M. musculus
gctaaggcaagaggat

SEQ ID NO: 412967 - DNA, 16 bp, M. musculus
gctaaggcaggaggat

SEQ ID NO: 412968 - DNA, 16 bp, M. musculus
gctaaggtgtatgagt

SEQ ID NO: 412969 - DNA, 16 bp, M. musculus
gctaagtaacaagaag

SEQ ID NO: 412970 - DNA, 16 bp, M. musculus
gctaagtcactccctt

SEQ ID NO: 412971 - DNA, 16 bp, M. musculus
gctaatcaaagaattg

SEQ ID NO: 412972 - DNA, 16 bp, M. musculus
gctaatgctgctgctg

SEQ ID NO: 412973 - DNA, 16 bp, M. musculus
gctaatgtcatctcca

SEQ ID NO: 412974 - DNA, 16 bp, M. musculus
gctaatgtcattccca

SEQ ID NO: 412975 - DNA, 16 bp, M. musculus
gctacaagagcatgct

SEQ ID NO: 412976 - DNA, 16 bp, M. musculus
gctacaagttccacca

SEQ ID NO: 412977 - DNA, 16 bp, M. musculus
gctacaatgtattcat

SEQ ID NO: 412978 - DNA, 16 bp, M. musculus
gctacacaaagaaact

SEQ ID NO: 412979 - DNA, 16 bp, M. musculus
gctacacaaagaattc

SEQ ID NO: 412980 - DNA, 16 bp, M. musculus
gctacacagtgagaac

SEQ ID NO: 412981 - DNA, 17 bp, M. musculus
gctacacagtgagacct

SEQ ID NO: 412982 - DNA, 16 bp, M. musculus
gctacactgtgagacc

SEQ ID NO: 412983 - DNA, 16 bp, M. musculus
gctacacttcagccag

SEQ ID NO: 412984 - DNA, 16 bp, M. musculus
gctacagaataagacc

SEQ ID NO: 412985 - DNA, 16 bp, M. musculus
gctacagagcaagttc

SEQ ID NO: 412986 - DNA, 16 bp, M. musculus
gctacagaggacagag

SEQ ID NO: 412987 - DNA, 16 bp, M. musculus
gctacagagtgagacc

SEQ ID NO: 412988 - DNA, 16 bp, M. musculus
gctacagcaacagggt

SEQ ID NO: 412989 - DNA, 16 bp, M. musculus
gctacagccagagaca

SEQ ID NO: 412990 - DNA, 16 bp, M. musculus
gctacagctgctgctg

SEQ ID NO: 412991 - DNA, 16 bp, M. musculus
gctacaggaggtggtc

SEQ ID NO: 412992 - DNA, 16 bp, M. musculus
gctacagggtgtggcc

SEQ ID NO: 412993 - DNA, 16 bp, M. musculus
gctacagtgtacagtg

SEQ ID NO: 412994 - DNA, 16 bp, M. musculus
gctacagtgtacttgg

SEQ ID NO: 412995 - DNA, 16 bp, M. musculus
gctacagtgttcttac

SEQ ID NO: 412996 - DNA, 16 bp, M. musculus
gctacataatgagacc

SEQ ID NO: 412997 - DNA, 16 bp, M. musculus
gctacatactgagttt

SEQ ID NO: 412998 - DNA, 16 bp, M. musculus
gctacatagcaagacc

SEQ ID NO: 412999 - DNA, 16 bp, M. musculus
gctacatagcaagact

SEQ ID NO: 413000 - DNA, 16 bp, M. musculus
gctacatagcaagttc

SEQ ID NO: 413001 - DNA, 16 bp, M. musculus
gctacatagtgagaac

SEQ ID NO: 413002 - DNA, 16 bp, M. musculus
gctacatagtgagctc

SEQ ID NO: 413003 - DNA, 16 bp, M. musculus
gctacatgagaccctg

SEQ ID NO: 413004 - DNA, 16 bp, M. musculus
gctacatgagatcctg

SEQ ID NO: 413005 - DNA, 16 bp, M. musculus
gctacatgatgagacc

SEQ ID NO: 413006 - DNA, 16 bp, M. musculus
gctacattggggaatt

SEQ ID NO: 413007 - DNA, 16 bp, M. musculus
gctacattttttttct

SEQ ID NO: 413008 - DNA, 16 bp, M. musculus
gctaccaagttctgct

SEQ ID NO: 413009 - DNA, 16 bp, M. musculus
gctaccacacccagct

SEQ ID NO: 413010 - DNA, 16 bp, M. musculus
gctaccacacccggct

SEQ ID NO: 413011 - DNA, 16 bp, M. musculus
gctaccacacctagct

SEQ ID NO: 413012 - DNA, 16 bp, M. musculus
gctaccaccacctggc

SEQ ID NO: 413013 - DNA, 16 bp, M. musculus
gctaccacccaggcct

SEQ ID NO: 413014 - DNA, 16 bp, M. musculus
gctaccactgcctggc

SEQ ID NO: 413015 - DNA, 16 bp, M. musculus
gctaccagatgcaagg

SEQ ID NO: 413016 - DNA, 16 bp, M. musculus
gctaccatgtctggct

SEQ ID NO: 413017 - DNA, 16 bp, M. musculus
gctacccacaacaccc

SEQ ID NO: 413018 - DNA, 16 bp, M. musculus
gctaccctcccaggtc

SEQ ID NO: 413019 - DNA, 16 bp, M. musculus
gctaccctggtgctgg

SEQ ID NO: 413020 - DNA, 16 bp, M. musculus
gctacctggaagccag

SEQ ID NO: 413021 - DNA, 16 bp, M. musculus
gctactatgaacatag

SEQ ID NO: 413022 - DNA, 16 bp, M. musculus
gctactatgcctcaag

SEQ ID NO: 413023 - DNA, 16 bp, M. musculus
gctactccccagaact

SEQ ID NO: 413024 - DNA, 16 bp, M. musculus
gctactctcccaggtc

SEQ ID NO: 413025 - DNA, 16 bp, M. musculus
gctactctgtgggttc

SEQ ID NO: 413026 - DNA, 16 bp, M. musculus
gctactgatttgtttg

SEQ ID NO: 413027 - DNA, 16 bp, M. musculus
gctactgctgctgcta

SEQ ID NO: 413028 - DNA, 16 bp, M. musculus
gctactggaggagaaa

SEQ ID NO: 413029 - DNA, 16 bp, M. musculus
gctactggtttgctgc

SEQ ID NO: 413030 - DNA, 16 bp, M. musculus
gctactttgtaactgt

SEQ ID NO: 413031 - DNA, 16 bp, M. musculus
gctagaaagggcaatt

SEQ ID NO: 413032 - DNA, 16 bp, M. musculus
gctagaattacaggtg

SEQ ID NO: 413033 - DNA, 16 bp, M. musculus
gctagacaaggcagct

SEQ ID NO: 413034 - DNA, 16 bp, M. musculus
gctagacacagatgaa

SEQ ID NO: 413035 - DNA, 16 bp, M. musculus
gctagactggctgact

SEQ ID NO: 413036 - DNA, 16 bp, M. musculus
gctagagaaaggagct

SEQ ID NO: 413037 - DNA, 24 bp, M. musculus
gctagagaaattacccaaggagct

SEQ ID NO: 413038 - DNA, 16 bp, M. musculus
gctagagacacaggct

SEQ ID NO: 413039 - DNA, 16 bp, M. musculus
gctagagagctggctc

SEQ ID NO: 413040 - DNA, 16 bp, M. musculus
gctagagaggcagaga

SEQ ID NO: 413041 - DNA, 16 bp, M. musculus
gctagagatcaaaccc

SEQ ID NO: 413042 - DNA, 16 bp, M. musculus
gctagagttatcacag

SEQ ID NO: 413043 - DNA, 17 bp, M. musculus
gctagagttatcacaga

SEQ ID NO: 413044 - DNA, 16 bp, M. musculus
gctagagtttcccagt

SEQ ID NO: 413045 - DNA, 16 bp, M. musculus
gctagcaaccttcaga

SEQ ID NO: 413046 - DNA, 16 bp, M. musculus
gctagcaaggatgtgg

SEQ ID NO: 413047 - DNA, 16 bp, M. musculus
gctagccagactctct

SEQ ID NO: 413048 - DNA, 16 bp, M. musculus
gctagccagcaagctc

SEQ ID NO: 413049 - DNA, 16 bp, M. musculus
gctagcccagaactca

SEQ ID NO: 413050 - DNA, 16 bp, M. musculus
gctagcctaggctaca

SEQ ID NO: 413051 - DNA, 16 bp, M. musculus
gctagcctagtctaca

SEQ ID NO: 413052 - DNA, 16 bp, M. musculus
gctagcctcaaactct

SEQ ID NO: 413053 - DNA, 16 bp, M. musculus
gctagcctcaaatttg

SEQ ID NO: 413054 - DNA, 16 bp, M. musculus
gctagcctggaattca

SEQ ID NO: 413055 - DNA, 16 bp, M. musculus
gctagccttgaactct

SEQ ID NO: 413056 - DNA, 16 bp, M. musculus
gctagctcaggctgct

SEQ ID NO: 413057 - DNA, 16 bp, M. musculus
gctagctgctggctgc

SEQ ID NO: 413058 - DNA, 16 bp, M. musculus
gctagcttcaaacttg

SEQ ID NO: 413059 - DNA, 16 bp, M. musculus
gctagcttggaactca

SEQ ID NO: 413060 - DNA, 16 bp, M. musculus
gctaggaattgaactg

SEQ ID NO: 413061 - DNA, 16 bp, M. musculus
gctaggatttgaactc

SEQ ID NO: 413062 - DNA, 16 bp, M. musculus
gctaggcaagcactct

SEQ ID NO: 413063 - DNA, 16 bp, M. musculus
gctaggcaagtgctct

SEQ ID NO: 413064 - DNA, 16 bp, M. musculus
gctaggcaagtgttct

SEQ ID NO: 413065 - DNA, 16 bp, M. musculus
gctaggccccagtgta

SEQ ID NO: 413066 - DNA, 16 bp, M. musculus
gctaggctggctgtcc

SEQ ID NO: 413067 - DNA, 16 bp, M. musculus
gctagggccctgagag

SEQ ID NO: 413068 - DNA, 16 bp, M. musculus
gctagggttacaggtg

SEQ ID NO: 413069 - DNA, 16 bp, M. musculus
gctagggttataggca

SEQ ID NO: 413070 - DNA, 16 bp, M. musculus
gctaggttggtgttta

SEQ ID NO: 413071 - DNA, 16 bp, M. musculus
gctagtaacccaaaac

SEQ ID NO: 413072 - DNA, 16 bp, M. musculus
gctagtgcaggagcag

SEQ ID NO: 413073 - DNA, 16 bp, M. musculus
gctagtgctcttaaca

SEQ ID NO: 413074 - DNA, 16 bp, M. musculus
gctagtgtgtgctctt

SEQ ID NO: 413075 - DNA, 16 bp, M. musculus
gctagttacagccagc

SEQ ID NO: 413076 - DNA, 16 bp, M. musculus
gctagttttgttttgt

SEQ ID NO: 413077 - DNA, 16 bp, M. musculus
gctataagatacaatt

SEQ ID NO: 413078 - DNA, 17 bp, M. musculus
gctataaggagctggcc

SEQ ID NO: 413079 - DNA, 16 bp, M. musculus
gctatacacctctgtt

SEQ ID NO: 413080 - DNA, 16 bp, M. musculus
gctatacagtgagacc

SEQ ID NO: 413081 - DNA, 16 bp, M. musculus
gctatacccagtgtgg

SEQ ID NO: 413082 - DNA, 16 bp, M. musculus
gctatagaaagtaccc

SEQ ID NO: 413083 - DNA, 16 bp, M. musculus
gctatagtcaagagct

SEQ ID NO: 413084 - DNA, 16 bp, M. musculus
gctatatagtgagact

SEQ ID NO: 413085 - DNA, 16 bp, M. musculus
gctatatgagaccctg

SEQ ID NO: 413086 - DNA, 16 bp, M. musculus
gctatcaaaaagaatg

SEQ ID NO: 413087 - DNA, 16 bp, M. musculus
gctatcaggaactagt

SEQ ID NO: 413088 - DNA, 16 bp, M. musculus
gctatcatagtctctg

SEQ ID NO: 413089 - DNA, 16 bp, M. musculus
gctatcctaaaagctg

SEQ ID NO: 413090 - DNA, 16 bp, M. musculus
gctatcctctgagagg

SEQ ID NO: 413091 - DNA, 16 bp, M. musculus
gctatcctctgctgca

SEQ ID NO: 413092 - DNA, 16 bp, M. musculus
gctatcctggtactca

SEQ ID NO: 413093 - DNA, 16 bp, M. musculus
gctatcttcttttggg

SEQ ID NO: 413094 - DNA, 16 bp, M. musculus
gctatcttgtctgagt

SEQ ID NO: 413095 - DNA, 16 bp, M. musculus
gctatgacaaaacact

SEQ ID NO: 413096 - DNA, 16 bp, M. musculus
gctatgagtgccttca

SEQ ID NO: 413097 - DNA, 16 bp, M. musculus
gctatgagtttttctt

SEQ ID NO: 413098 - DNA, 16 bp, M. musculus
gctatgatgtgcttat

SEQ ID NO: 413099 - DNA, 16 bp, M. musculus
gctatgcaaaggtgct

SEQ ID NO: 413100 - DNA, 16 bp, M. musculus
gctatgccagcgcctg

SEQ ID NO: 413101 - DNA, 16 bp, M. musculus
gctatgccagtgcttg

SEQ ID NO: 413102 - DNA, 16 bp, M. musculus
gctatgcctgcctgga

SEQ ID NO: 413103 - DNA, 16 bp, M. musculus
gctatgcttgcagaca

SEQ ID NO: 413104 - DNA, 16 bp, M. musculus
gctatgtccccagccc

SEQ ID NO: 413105 - DNA, 16 bp, M. musculus
gctatgtgaaaatcta

SEQ ID NO: 413106 - DNA, 16 bp, M. musculus
gctatgtgaacaagat

SEQ ID NO: 413107 - DNA, 18 bp, M. musculus
gctatgtgtcctcctggg

SEQ ID NO: 413108 - DNA, 16 bp, M. musculus
gctattaaaaggactg

SEQ ID NO: 413109 - DNA, 16 bp, M. musculus
gctattattattatta

SEQ ID NO: 413110 - DNA, 19 bp, M. musculus
gctattggatggaacacag

SEQ ID NO: 413111 - DNA, 16 bp, M. musculus
gctcaaaagttaagag

SEQ ID NO: 413112 - DNA, 16 bp, M. musculus
gctcaaacaaaacaaa

SEQ ID NO: 413113 - DNA, 16 bp, M. musculus
gctcaaagagactgaa

SEQ ID NO: 413114 - DNA, 16 bp, M. musculus
gctcaaagccctgggt

SEQ ID NO: 413115 - DNA, 16 bp, M. musculus
gctcaaaggaatagca

SEQ ID NO: 413116 - DNA, 16 bp, M. musculus
gctcaagaagatggaa

SEQ ID NO: 413117 - DNA, 16 bp, M. musculus
gctcaagaggcagagg

SEQ ID NO: 413118 - DNA, 16 bp, M. musculus
gctcaagatctccaaa

SEQ ID NO: 413119 - DNA, 16 bp, M. musculus
gctcaagctccaccca

SEQ ID NO: 413120 - DNA, 16 bp, M. musculus
gctcaagctccatcca

SEQ ID NO: 413121 - DNA, 16 bp, M. musculus
gctcaaggacagcctg

SEQ ID NO: 413122 - DNA, 16 bp, M. musculus
gctcaaggactaccta

SEQ ID NO: 413123 - DNA, 16 bp, M. musculus
gctcaaggagatctct

SEQ ID NO: 413124 - DNA, 16 bp, M. musculus
gctcaaggatgttcta

SEQ ID NO: 413125 - DNA, 16 bp, M. musculus
gctcaaggctggggaa

SEQ ID NO: 413126 - DNA, 16 bp, M. musculus
gctcaaggctggggga

SEQ ID NO: 413127 - DNA, 16 bp, M. musculus
gctcaagggcctctcc

SEQ ID NO: 413128 - DNA, 16 bp, M. musculus
gctcaagttcaagtgg

SEQ ID NO: 413129 - DNA, 16 bp, M. musculus
gctcaattctcagcac

SEQ ID NO: 413130 - DNA, 16 bp, M. musculus
gctcacaaccatctgc

SEQ ID NO: 413131 - DNA, 16 bp, M. musculus
gctcacaacggtctgt

SEQ ID NO: 413132 - DNA, 16 bp, M. musculus
gctcacaactccctgt

SEQ ID NO: 413133 - DNA, 16 bp, M. musculus
gctcacaactgcatgt

SEQ ID NO: 413134 - DNA, 16 bp, M. musculus
gctcacaactgcctct

SEQ ID NO: 413135 - DNA, 16 bp, M. musculus
gctcacaactgtctga

SEQ ID NO: 413136 - DNA, 16 bp, M. musculus
gctcacaatcacccat

SEQ ID NO: 413137 - DNA, 16 bp, M. musculus
gctcacaatcatctat

SEQ ID NO: 413138 - DNA, 16 bp, M. musculus
gctcacacctatctgt

SEQ ID NO: 413139 - DNA, 16 bp, M. musculus
gctcacacttccacat

SEQ ID NO: 413140 - DNA, 16 bp, M. musculus
gctcacagagtctgaa

SEQ ID NO: 413141 - DNA, 16 bp, M. musculus
gctcacagcagctgtg

SEQ ID NO: 413142 - DNA, 16 bp, M. musculus
gctcacagctgcttgt

SEQ ID NO: 413143 - DNA, 16 bp, M. musculus
gctcacagtcagctgt

SEQ ID NO: 413144 - DNA, 16 bp, M. musculus
gctcacagttggaggg

SEQ ID NO: 413145 - DNA, 16 bp, M. musculus
gctcacatggacaggg

SEQ ID NO: 413146 - DNA, 16 bp, M. musculus
gctcaccaccatctat

SEQ ID NO: 413147 - DNA, 16 bp, M. musculus
gctcaccttcagacaa

SEQ ID NO: 413148 - DNA, 16 bp, M. musculus
gctcaccttgaactca

SEQ ID NO: 413149 - DNA, 16 bp, M. musculus
gctcactaacccacct

SEQ ID NO: 413150 - DNA, 16 bp, M. musculus
gctcactcgctcgctc

SEQ ID NO: 413151 - DNA, 16 bp, M. musculus
gctcactggccagcta

SEQ ID NO: 413152 - DNA, 16 bp, M. musculus
gctcactggccaggca

SEQ ID NO: 413153 - DNA, 16 bp, M. musculus
gctcagaaaacccaag

SEQ ID NO: 413154 - DNA, 17 bp, M. musculus
gctcagaaacaactctt

SEQ ID NO: 413155 - DNA, 16 bp, M. musculus
gctcagaaagaaatta

SEQ ID NO: 413156 - DNA, 16 bp, M. musculus
gctcagactggaagga

SEQ ID NO: 413157 - DNA, 16 bp, M. musculus
gctcagagcaaagcag

SEQ ID NO: 413158 - DNA, 16 bp, M. musculus
gctcagagccatctgt

SEQ ID NO: 413159 - DNA, 16 bp, M. musculus
gctcagagctaaacaa

SEQ ID NO: 413160 - DNA, 16 bp, M. musculus
gctcagaggagaaagg

SEQ ID NO: 413161 - DNA, 16 bp, M. musculus
gctcagaggcagaggc

SEQ ID NO: 413162 - DNA, 16 bp, M. musculus
gctcagaggttaagtg

SEQ ID NO: 413163 - DNA, 16 bp, M. musculus
gctcagagtctgagag

SEQ ID NO: 413164 - DNA, 16 bp, M. musculus
gctcagatgtctggag

SEQ ID NO: 413165 - DNA, 16 bp, M. musculus
gctcagcacttaagaa

SEQ ID NO: 413166 - DNA, 16 bp, M. musculus
gctcagcagcagagca

SEQ ID NO: 413167 - DNA, 16 bp, M. musculus
gctcagcagcagcagc

SEQ ID NO: 413168 - DNA, 16 bp, M. musculus
gctcagcagctcagag

SEQ ID NO: 413169 - DNA, 16 bp, M. musculus
gctcagcagtcaagag

SEQ ID NO: 413170 - DNA, 16 bp, M. musculus
gctcagcagttaagaa

SEQ ID NO: 413171 - DNA, 16 bp, M. musculus
gctcagcagttaggag

SEQ ID NO: 413172 - DNA, 16 bp, M. musculus
gctcagcagttgggag

SEQ ID NO: 413173 - DNA, 16 bp, M. musculus
gctcagccattaagag

SEQ ID NO: 413174 - DNA, 16 bp, M. musculus
gctcagcccagcccag

SEQ ID NO: 413175 - DNA, 16 bp, M. musculus
gctcagcccccacctc

SEQ ID NO: 413176 - DNA, 16 bp, M. musculus
gctcagcctgctgtct

SEQ ID NO: 413177 - DNA, 16 bp, M. musculus
gctcagcctgctttct

SEQ ID NO: 413178 - DNA, 16 bp, M. musculus
gctcagcgggtaagaa

SEQ ID NO: 413179 - DNA, 16 bp, M. musculus
gctcagctcactctct

SEQ ID NO: 413180 - DNA, 16 bp, M. musculus
gctcagctcagcttct

SEQ ID NO: 413181 - DNA, 16 bp, M. musculus
gctcagctgctttctt

SEQ ID NO: 413182 - DNA, 16 bp, M. musculus
gctcagctggtgaagg

SEQ ID NO: 413183 - DNA, 16 bp, M. musculus
gctcagctgtgaagag

SEQ ID NO: 413184 - DNA, 16 bp, M. musculus
gctcagcttttgtcct

SEQ ID NO: 413185 - DNA, 16 bp, M. musculus
gctcaggaagaaggaa

SEQ ID NO: 413186 - DNA, 16 bp, M. musculus
gctcaggagctcagga

SEQ ID NO: 413187 - DNA, 16 bp, M. musculus
gctcaggatggcctca

SEQ ID NO: 413188 - DNA, 16 bp, M. musculus
gctcaggcacagctca

SEQ ID NO: 413189 - DNA, 16 bp, M. musculus
gctcaggctcaggctc

SEQ ID NO: 413190 - DNA, 16 bp, M. musculus
gctcaggctctgtctc

SEQ ID NO: 413191 - DNA, 16 bp, M. musculus
gctcaggctggctttg

SEQ ID NO: 413192 - DNA, 16 bp, M. musculus
gctcaggctgtcctca

SEQ ID NO: 413193 - DNA, 16 bp, M. musculus
gctcagggaatcctgt

SEQ ID NO: 413194 - DNA, 16 bp, M. musculus
gctcagggagtggcac

SEQ ID NO: 413195 - DNA, 16 bp, M. musculus
gctcagggattggtag

SEQ ID NO: 413196 - DNA, 16 bp, M. musculus
gctcagggcagcttgg

SEQ ID NO: 413197 - DNA, 16 bp, M. musculus
gctcagggggaggccc

SEQ ID NO: 413198 - DNA, 18 bp, M. musculus
gctcagggggtaagagca

SEQ ID NO: 413199 - DNA, 16 bp, M. musculus
gctcaggtaatggaac

SEQ ID NO: 413200 - DNA, 16 bp, M. musculus
gctcaggttccttctg

SEQ ID NO: 413201 - DNA, 16 bp, M. musculus
gctcaggttctttctg

SEQ ID NO: 413202 - DNA, 16 bp, M. musculus
gctcagtccctgctcc

SEQ ID NO: 413203 - DNA, 16 bp, M. musculus
gctcagtcggtaaagt

SEQ ID NO: 413204 - DNA, 16 bp, M. musculus
gctcagtgatgaagag

SEQ ID NO: 413205 - DNA, 16 bp, M. musculus
gctcagtgcttaagag

SEQ ID NO: 413206 - DNA, 16 bp, M. musculus
gctcagtggataaagg

SEQ ID NO: 413207 - DNA, 16 bp, M. musculus
gctcagtggctgagtg

SEQ ID NO: 413208 - DNA, 16 bp, M. musculus
gctcagtgggtaaggg

SEQ ID NO: 413209 - DNA, 16 bp, M. musculus
gctcagtgggtagagc

SEQ ID NO: 413210 - DNA, 16 bp, M. musculus
gctcagtgggtgaggg

SEQ ID NO: 413211 - DNA, 16 bp, M. musculus
gctcagtggtaaagca

SEQ ID NO: 413212 - DNA, 16 bp, M. musculus
gctcagtggtacagtg

SEQ ID NO: 413213 - DNA, 16 bp, M. musculus
gctcagtggtagcatg

SEQ ID NO: 413214 - DNA, 16 bp, M. musculus
gctcagtggtcaagca

SEQ ID NO: 413215 - DNA, 16 bp, M. musculus
gctcagtggtggagca

SEQ ID NO: 413216 - DNA, 16 bp, M. musculus
gctcagtggttaagaa

SEQ ID NO: 413217 - DNA, 17 bp, M. musculus
gctcagtggttaagggc

SEQ ID NO: 413218 - DNA, 16 bp, M. musculus
gctcagttagctttct

SEQ ID NO: 413219 - DNA, 16 bp, M. musculus
gctcagttgatagagt

SEQ ID NO: 413220 - DNA, 16 bp, M. musculus
gctcagttggtagggt

SEQ ID NO: 413221 - DNA, 16 bp, M. musculus
gctcagttggtgaagt

SEQ ID NO: 413222 - DNA, 16 bp, M. musculus
gctcagttggtggagt

SEQ ID NO: 413223 - DNA, 16 bp, M. musculus
gctcataactacctgt

SEQ ID NO: 413224 - DNA, 19 bp, M. musculus
gctcatcccgggacttgag

SEQ ID NO: 413225 - DNA, 16 bp, M. musculus
gctcatgactttaatc

SEQ ID NO: 413226 - DNA, 16 bp, M. musculus
gctcatgcctataatc

SEQ ID NO: 413227 - DNA, 16 bp, M. musculus
gctcatggagactgaa

SEQ ID NO: 413228 - DNA, 16 bp, M. musculus
gctcatggattggtgg

SEQ ID NO: 413229 - DNA, 16 bp, M. musculus
gctcatggcttggcag

SEQ ID NO: 413230 - DNA, 16 bp, M. musculus
gctcatggtttcagag

SEQ ID NO: 413231 - DNA, 16 bp, M. musculus
gctcattctgtcttta

SEQ ID NO: 413232 - DNA, 16 bp, M. musculus
gctcattgtgggtggt

SEQ ID NO: 413233 - DNA, 16 bp, M. musculus
gctccaagcatccaca

SEQ ID NO: 413234 - DNA, 17 bp, M. musculus
gctccaatcacagcact

SEQ ID NO: 413235 - DNA, 16 bp, M. musculus
gctccacaggaggaaa

SEQ ID NO: 413236 - DNA, 16 bp, M. musculus
gctccaccactgagct

SEQ ID NO: 413237 - DNA, 16 bp, M. musculus
gctccaccttcctttt

SEQ ID NO: 413238 - DNA, 17 bp, M. musculus
gctccacgtggttcact

SEQ ID NO: 413239 - DNA, 16 bp, M. musculus
gctccacttaatgttt

SEQ ID NO: 413240 - DNA, 16 bp, M. musculus
gctccagaacaaaaag

SEQ ID NO: 413241 - DNA, 16 bp, M. musculus
gctccagaagagggcg

SEQ ID NO: 413242 - DNA, 16 bp, M. musculus
gctccagaatccaaaa

SEQ ID NO: 413243 - DNA, 16 bp, M. musculus
gctccagacatccagc

SEQ ID NO: 413244 - DNA, 16 bp, M. musculus
gctccagagaacctga

SEQ ID NO: 413245 - DNA, 16 bp, M. musculus
gctccagctccagagg

SEQ ID NO: 413246 - DNA, 16 bp, M. musculus
gctccagctccagcct

SEQ ID NO: 413247 - DNA, 16 bp, M. musculus
gctccagctccatatg

SEQ ID NO: 413248 - DNA, 16 bp, M. musculus
gctccagctgtcctgg

SEQ ID NO: 413249 - DNA, 16 bp, M. musculus
gctccagcttcctgac

SEQ ID NO: 413250 - DNA, 16 bp, M. musculus
gctccaggaaggaaaa

SEQ ID NO: 413251 - DNA, 16 bp, M. musculus
gctccaggaatcctcc

SEQ ID NO: 413252 - DNA, 16 bp, M. musculus
gctccaggacagtcag

SEQ ID NO: 413253 - DNA, 16 bp, M. musculus
gctccaggatagccag

SEQ ID NO: 413254 - DNA, 16 bp, M. musculus
gctccaggccagcctg

SEQ ID NO: 413255 - DNA, 16 bp, M. musculus
gctccaggccagtgag

SEQ ID NO: 413256 - DNA, 16 bp, M. musculus
gctccaggcctgctcc

SEQ ID NO: 413257 - DNA, 16 bp, M. musculus
gctccagggagtcctg

SEQ ID NO: 413258 - DNA, 16 bp, M. musculus
gctccaggttcccagc

SEQ ID NO: 413259 - DNA, 16 bp, M. musculus
gctccaggtttagtga

SEQ ID NO: 413260 - DNA, 16 bp, M. musculus
gctccagtcagccctg

SEQ ID NO: 413261 - DNA, 16 bp, M. musculus
gctccatacccaaata

SEQ ID NO: 413262 - DNA, 16 bp, M. musculus
gctccatagccttagt

SEQ ID NO: 413263 - DNA, 16 bp, M. musculus
gctccatgtggtctgt

SEQ ID NO: 413264 - DNA, 16 bp, M. musculus
gctccatttcactttc

SEQ ID NO: 413265 - DNA, 16 bp, M. musculus
gctcccagaaactaag

SEQ ID NO: 413266 - DNA, 16 bp, M. musculus
gctccccaacccacca

SEQ ID NO: 413267 - DNA, 16 bp, M. musculus
gctccccagctcccca

SEQ ID NO: 413268 - DNA, 17 bp, M. musculus
gctcccccaaaggtccc

SEQ ID NO: 413269 - DNA, 16 bp, M. musculus
gctccccctgctgctg

SEQ ID NO: 413270 - DNA, 16 bp, M. musculus
gctccccttctctgag

SEQ ID NO: 413271 - DNA, 16 bp, M. musculus
gctccctcctctccag

SEQ ID NO: 413272 - DNA, 16 bp, M. musculus
gctccctctcacctgt

SEQ ID NO: 413273 - DNA, 16 bp, M. musculus
gctccctcttcccaga

SEQ ID NO: 413274 - DNA, 16 bp, M. musculus
gctcctactggaggaa

SEQ ID NO: 413275 - DNA, 16 bp, M. musculus
gctcctcactggggga

SEQ ID NO: 413276 - DNA, 16 bp, M. musculus
gctcctcagtccttcc

SEQ ID NO: 413277 - DNA, 16 bp, M. musculus
gctcctccagctccat

SEQ ID NO: 413278 - DNA, 16 bp, M. musculus
gctcctcctcagcttc

SEQ ID NO: 413279 - DNA, 16 bp, M. musculus
gctcctcctccagcac

SEQ ID NO: 413280 - DNA, 16 bp, M. musculus
gctcctcctcctgctg

SEQ ID NO: 413281 - DNA, 16 bp, M. musculus
gctcctcctgccccat

SEQ ID NO: 413282 - DNA, 16 bp, M. musculus
gctcctcctgcctctg

SEQ ID NO: 413283 - DNA, 16 bp, M. musculus
gctcctcctgctccat

SEQ ID NO: 413284 - DNA, 16 bp, M. musculus
gctcctccttgctctc

SEQ ID NO: 413285 - DNA, 16 bp, M. musculus
gctcctctcttgctct

SEQ ID NO: 413286 - DNA, 16 bp, M. musculus
gctcctcttccagaga

SEQ ID NO: 413287 - DNA, 25 bp, M. musculus
gctcctgaagatgtaagcaataaag

SEQ ID NO: 413288 - DNA, 16 bp, M. musculus
gctcctgaggaatgac

SEQ ID NO: 413289 - DNA, 16 bp, M. musculus
gctcctgagtgctgag

SEQ ID NO: 413290 - DNA, 16 bp, M. musculus
gctcctgcaggcctgc

SEQ ID NO: 413291 - DNA, 16 bp, M. musculus
gctcctgccagcaagc

SEQ ID NO: 413292 - DNA, 16 bp, M. musculus
gctcctgccctgcttg

SEQ ID NO: 413293 - DNA, 16 bp, M. musculus
gctcctgccctgtgtg

SEQ ID NO: 413294 - DNA, 16 bp, M. musculus
gctcctgccctgtttg

SEQ ID NO: 413295 - DNA, 16 bp, M. musculus
gctcctgcctcccaag

SEQ ID NO: 413296 - DNA, 16 bp, M. musculus
gctcctgctcctcctg

SEQ ID NO: 413297 - DNA, 16 bp, M. musculus
gctcctgctcctgccc

SEQ ID NO: 413298 - DNA, 16 bp, M. musculus
gctcctgctgctgctc

SEQ ID NO: 413299 - DNA, 16 bp, M. musculus
gctcctggaactggag

SEQ ID NO: 413300 - DNA, 16 bp, M. musculus
gctcctggacaccagg

SEQ ID NO: 413301 - DNA, 16 bp, M. musculus
gctcctggaggccaga

SEQ ID NO: 413302 - DNA, 16 bp, M. musculus
gctcctggagtctgtg

SEQ ID NO: 413303 - DNA, 16 bp, M. musculus
gctcctggattggcag

SEQ ID NO: 413304 - DNA, 16 bp, M. musculus
gctcctggctcctggc

SEQ ID NO: 413305 - DNA, 16 bp, M. musculus
gctcctgtatgctgcc

SEQ ID NO: 413306 - DNA, 16 bp, M. musculus
gctcctgtccacaagc

SEQ ID NO: 413307 - DNA, 16 bp, M. musculus
gctcctgtctgcaagc

SEQ ID NO: 413308 - DNA, 16 bp, M. musculus
gctcctgtgagtattt

SEQ ID NO: 413309 - DNA, 16 bp, M. musculus
gctcctgtgggggctg

SEQ ID NO: 413310 - DNA, 16 bp, M. musculus
gctccttcagtccttc

SEQ ID NO: 413311 - DNA, 16 bp, M. musculus
gctccttcagtgcttt

SEQ ID NO: 413312 - DNA, 16 bp, M. musculus
gctccttctccagctc

SEQ ID NO: 413313 - DNA, 16 bp, M. musculus
gctccttctgcagcac

SEQ ID NO: 413314 - DNA, 16 bp, M. musculus
gctccttggatgcttt

SEQ ID NO: 413315 - DNA, 16 bp, M. musculus
gctccttggttatttt

SEQ ID NO: 413316 - DNA, 16 bp, M. musculus
gctcctttctgtgtga

SEQ ID NO: 413317 - DNA, 16 bp, M. musculus
gctcctttgtcaaaga

SEQ ID NO: 413318 - DNA, 18 bp, M. musculus
gctcgcaaccatccgtaa

SEQ ID NO: 413319 - DNA, 16 bp, M. musculus
gctcgctcagcctgct

SEQ ID NO: 413320 - DNA, 16 bp, M. musculus
gctcgctcgctcgctc

SEQ ID NO: 413321 - DNA, 21 bp, M. musculus
gctcggtagccctgggagtgg

SEQ ID NO: 413322 - DNA, 16 bp, M. musculus
gctctaagatcagcaa

SEQ ID NO: 413323 - DNA, 16 bp, M. musculus
gctctaccagtgagct

SEQ ID NO: 413324 - DNA, 16 bp, M. musculus
gctctaccattgagct

SEQ ID NO: 413325 - DNA, 16 bp, M. musculus
gctctacctctgagct

SEQ ID NO: 413326 - DNA, 16 bp, M. musculus
gctctactgctgagct

SEQ ID NO: 413327 - DNA, 16 bp, M. musculus
gctctagcagaggacc

SEQ ID NO: 413328 - DNA, 21 bp, M. musculus
gctctatctatctatctatct

SEQ ID NO: 413329 - DNA, 16 bp, M. musculus
gctctattccccagtg

SEQ ID NO: 413330 - DNA, 16 bp, M. musculus
gctctcacagtctctg

SEQ ID NO: 413331 - DNA, 16 bp, M. musculus
gctctcagcaggtagc

SEQ ID NO: 413332 - DNA, 16 bp, M. musculus
gctctcatgatggttg

SEQ ID NO: 413333 - DNA, 16 bp, M. musculus
gctctccacaaactga

SEQ ID NO: 413334 - DNA, 16 bp, M. musculus
gctctccaggaatcct

SEQ ID NO: 413335 - DNA, 16 bp, M. musculus
gctctccatgctgcag

SEQ ID NO: 413336 - DNA, 16 bp, M. musculus
gctctcccaataaact

SEQ ID NO: 413337 - DNA, 17 bp, M. musculus
gctctcccaataaatgt

SEQ ID NO: 413338 - DNA, 16 bp, M. musculus
gctctcccacccacct

SEQ ID NO: 413339 - DNA, 16 bp, M. musculus
gctctcccagggacag

SEQ ID NO: 413340 - DNA, 16 bp, M. musculus
gctctccccagtgctg

SEQ ID NO: 413341 - DNA, 16 bp, M. musculus
gctctccctggcttgc

SEQ ID NO: 413342 - DNA, 16 bp, M. musculus
gctctcctcctggagt

SEQ ID NO: 413343 - DNA, 16 bp, M. musculus
gctctcctgcctgctg

SEQ ID NO: 413344 - DNA, 16 bp, M. musculus
gctctcctgctctcag

SEQ ID NO: 413345 - DNA, 16 bp, M. musculus
gctctcctggaacttg

SEQ ID NO: 413346 - DNA, 16 bp, M. musculus
gctctctaccaactga

SEQ ID NO: 413347 - DNA, 16 bp, M. musculus
gctctctccagacaca

SEQ ID NO: 413348 - DNA, 16 bp, M. musculus
gctctctccattttct

SEQ ID NO: 413349 - DNA, 16 bp, M. musculus
gctctctcctggcctc

SEQ ID NO: 413350 - DNA, 16 bp, M. musculus
gctctctctcctcagg

SEQ ID NO: 413351 - DNA, 16 bp, M. musculus
gctctctctctgcctc

SEQ ID NO: 413352 - DNA, 16 bp, M. musculus
gctctctctgcctcct

SEQ ID NO: 413353 - DNA, 16 bp, M. musculus
gctctctcttgctctg

SEQ ID NO: 413354 - DNA, 16 bp, M. musculus
gctctctgacctccat

SEQ ID NO: 413355 - DNA, 16 bp, M. musculus
gctctctgctactgct

SEQ ID NO: 413356 - DNA, 16 bp, M. musculus
gctctctgctctctgc

SEQ ID NO: 413357 - DNA, 16 bp, M. musculus
gctctctgctttctga

SEQ ID NO: 413358 - DNA, 16 bp, M. musculus
gctctctggccagcca

SEQ ID NO: 413359 - DNA, 16 bp, M. musculus
gctctctggctctctg

SEQ ID NO: 413360 - DNA, 16 bp, M. musculus
gctctcttaagctctc

SEQ ID NO: 413361 - DNA, 16 bp, M. musculus
gctctcttcagagaca

SEQ ID NO: 413362 - DNA, 16 bp, M. musculus
gctctcttgctctctc

SEQ ID NO: 413363 - DNA, 16 bp, M. musculus
gctctcttgctcttgc

SEQ ID NO: 413364 - DNA, 16 bp, M. musculus
gctctcttggaactca

SEQ ID NO: 413365 - DNA, 16 bp, M. musculus
gctctgaacagcaaag

SEQ ID NO: 413366 - DNA, 16 bp, M. musculus
gctctgaagagactcc

SEQ ID NO: 413367 - DNA, 16 bp, M. musculus
gctctgacctgcacct

SEQ ID NO: 413368 - DNA, 16 bp, M. musculus
gctctgagcaggcaga

SEQ ID NO: 413369 - DNA, 16 bp, M. musculus
gctctgagccatctct

SEQ ID NO: 413370 - DNA, 16 bp, M. musculus
gctctgaggaggcaga

SEQ ID NO: 413371 - DNA, 16 bp, M. musculus
gctctgaggtactggt

SEQ ID NO: 413372 - DNA, 16 bp, M. musculus
gctctgcacccagtcc

SEQ ID NO: 413373 - DNA, 17 bp, M. musculus
gctctgcagaccaggct

SEQ ID NO: 413374 - DNA, 16 bp, M. musculus
gctctgccacagcctg

SEQ ID NO: 413375 - DNA, 16 bp, M. musculus
gctctgccagagcctg

SEQ ID NO: 413376 - DNA, 16 bp, M. musculus
gctctgccagaggctg

SEQ ID NO: 413377 - DNA, 16 bp, M. musculus
gctctgccagtccctg

SEQ ID NO: 413378 - DNA, 16 bp, M. musculus
gctctgccagtgtctg

SEQ ID NO: 413379 - DNA, 16 bp, M. musculus
gctctgcccagtgcag

SEQ ID NO: 413380 - DNA, 16 bp, M. musculus
gctctgcctacaccat

SEQ ID NO: 413381 - DNA, 16 bp, M. musculus
gctctgcctagtgttt

SEQ ID NO: 413382 - DNA, 16 bp, M. musculus
gctctgcctcagtggc

SEQ ID NO: 413383 - DNA, 16 bp, M. musculus
gctctgcctcctgagt

SEQ ID NO: 413384 - DNA, 16 bp, M. musculus
gctctgcctcctgcct

SEQ ID NO: 413385 - DNA, 16 bp, M. musculus
gctctgcctcctggct

SEQ ID NO: 413386 - DNA, 16 bp, M. musculus
gctctgcctcctgggt

SEQ ID NO: 413387 - DNA, 16 bp, M. musculus
gctctgcctctctcag

SEQ ID NO: 413388 - DNA, 16 bp, M. musculus
gctctgcctgcttctg

SEQ ID NO: 413389 - DNA, 16 bp, M. musculus
gctctgcctgtcctgg

SEQ ID NO: 413390 - DNA, 16 bp, M. musculus
gctctgccttcccctt

SEQ ID NO: 413391 - DNA, 16 bp, M. musculus
gctctgctctctctct

SEQ ID NO: 413392 - DNA, 16 bp, M. musculus
gctctgctctgctctc

SEQ ID NO: 413393 - DNA, 16 bp, M. musculus
gctctgctgtcctgga

SEQ ID NO: 413394 - DNA, 16 bp, M. musculus
gctctggaattcccct

SEQ ID NO: 413395 - DNA, 16 bp, M. musculus
gctctggagagatggc

SEQ ID NO: 413396 - DNA, 16 bp, M. musculus
gctctggagaggcaga

SEQ ID NO: 413397 - DNA, 16 bp, M. musculus
gctctggaggctgagg

SEQ ID NO: 413398 - DNA, 16 bp, M. musculus
gctctggattctcaaa

SEQ ID NO: 413399 - DNA, 16 bp, M. musculus
gctctggcaaaggatc

SEQ ID NO: 413400 - DNA, 16 bp, M. musculus
gctctggcgctctggc

SEQ ID NO: 413401 - DNA, 16 bp, M. musculus
gctctggctaggtctt

SEQ ID NO: 413402 - DNA, 16 bp, M. musculus
gctctggctgacctgg

SEQ ID NO: 413403 - DNA, 16 bp, M. musculus
gctctggctgagcctc

SEQ ID NO: 413404 - DNA, 16 bp, M. musculus
gctctggctgccctgg

SEQ ID NO: 413405 - DNA, 16 bp, M. musculus
gctctggctgctcctc

SEQ ID NO: 413406 - DNA, 16 bp, M. musculus
gctctggctgctctgg

SEQ ID NO: 413407 - DNA, 16 bp, M. musculus
gctctggctgtcttgg

SEQ ID NO: 413408 - DNA, 16 bp, M. musculus
gctctggctttcctgg

SEQ ID NO: 413409 - DNA, 16 bp, M. musculus
gctctgggaggtactg

SEQ ID NO: 413410 - DNA, 16 bp, M. musculus
gctctgggcagcctct

SEQ ID NO: 413411 - DNA, 16 bp, M. musculus
gctctgggctccatcc

SEQ ID NO: 413412 - DNA, 16 bp, M. musculus
gctctggggatgactc

SEQ ID NO: 413413 - DNA, 16 bp, M. musculus
gctctggggcccacag

SEQ ID NO: 413414 - DNA, 16 bp, M. musculus
gctctggggctactgg

SEQ ID NO: 413415 - DNA, 16 bp, M. musculus
gctctggggggtctgg

SEQ ID NO: 413416 - DNA, 16 bp, M. musculus
gctctgggggtactgg

SEQ ID NO: 413417 - DNA, 16 bp, M. musculus
gctctgggggtgggga

SEQ ID NO: 413418 - DNA, 16 bp, M. musculus
gctctggggtatctgg

SEQ ID NO: 413419 - DNA, 16 bp, M. musculus
gctctgggtgggcaga

SEQ ID NO: 413420 - DNA, 16 bp, M. musculus
gctctgggtggtccag

SEQ ID NO: 413421 - DNA, 16 bp, M. musculus
gctctgggtgtcctgg

SEQ ID NO: 413422 - DNA, 16 bp, M. musculus
gctctgggtttgatcc

SEQ ID NO: 413423 - DNA, 16 bp, M. musculus
gctctgtaaggaagcc

SEQ ID NO: 413424 - DNA, 16 bp, M. musculus
gctctgtaccaggctg

SEQ ID NO: 413425 - DNA, 17 bp, M. musculus
gctctgtagagcaggct

SEQ ID NO: 413426 - DNA, 16 bp, M. musculus
gctctgtcactgagct

SEQ ID NO: 413427 - DNA, 16 bp, M. musculus
gctctgtcagtgcctg

SEQ ID NO: 413428 - DNA, 16 bp, M. musculus
gctctgtccagtggat

SEQ ID NO: 413429 - DNA, 16 bp, M. musculus
gctctgtctgcctctg

SEQ ID NO: 413430 - DNA, 16 bp, M. musculus
gctctgtctgtcctgg

SEQ ID NO: 413431 - DNA, 16 bp, M. musculus
gctctgtgctgtgtgt

SEQ ID NO: 413432 - DNA, 16 bp, M. musculus
gctctgtggcagcagt

SEQ ID NO: 413433 - DNA, 16 bp, M. musculus
gctctgtggctctgcc

SEQ ID NO: 413434 - DNA, 16 bp, M. musculus
gctctgtggttggtgg

SEQ ID NO: 413435 - DNA, 16 bp, M. musculus
gctctgtgtcatggag

SEQ ID NO: 413436 - DNA, 16 bp, M. musculus
gctctgttctgcccct

SEQ ID NO: 413437 - DNA, 16 bp, M. musculus
gctctgttgcttctgc

SEQ ID NO: 413438 - DNA, 16 bp, M. musculus
gctctgttggagtagg

SEQ ID NO: 413439 - DNA, 16 bp, M. musculus
gctcttaaaaagaatg

SEQ ID NO: 413440 - DNA, 16 bp, M. musculus
gctcttaatggctgag

SEQ ID NO: 413441 - DNA, 16 bp, M. musculus
gctcttaattgctgag

SEQ ID NO: 413442 - DNA, 16 bp, M. musculus
gctcttacacacacac

SEQ ID NO: 413443 - DNA, 16 bp, M. musculus
gctcttacagtctttt

SEQ ID NO: 413444 - DNA, 16 bp, M. musculus
gctcttagccacagag

SEQ ID NO: 413445 - DNA, 16 bp, M. musculus
gctcttatctgctgag

SEQ ID NO: 413446 - DNA, 16 bp, M. musculus
gctcttcatcttccat

SEQ ID NO: 413447 - DNA, 16 bp, M. musculus
gctcttccaaaaggtc

SEQ ID NO: 413448 - DNA, 16 bp, M. musculus
gctcttccagaagttc

SEQ ID NO: 413449 - DNA, 16 bp, M. musculus
gctcttccagagaccc

SEQ ID NO: 413450 - DNA, 16 bp, M. musculus
gctcttccagcagacc

SEQ ID NO: 413451 - DNA, 16 bp, M. musculus
gctcttccagcggtcc

SEQ ID NO: 413452 - DNA, 16 bp, M. musculus
gctcttccaggtcctg

SEQ ID NO: 413453 - DNA, 16 bp, M. musculus
gctcttccagtggccc

SEQ ID NO: 413454 - DNA, 16 bp, M. musculus
gctcttccccagtttc

SEQ ID NO: 413455 - DNA, 16 bp, M. musculus
gctcttccctggagaa

SEQ ID NO: 413456 - DNA, 16 bp, M. musculus
gctcttccgaaggacc

SEQ ID NO: 413457 - DNA, 16 bp, M. musculus
gctcttcctccagcac

SEQ ID NO: 413458 - DNA, 16 bp, M. musculus
gctcttcctgagttca

SEQ ID NO: 413459 - DNA, 16 bp, M. musculus
gctcttcctgccagag

SEQ ID NO: 413460 - DNA, 16 bp, M. musculus
gctcttctaggggtcc

SEQ ID NO: 413461 - DNA, 16 bp, M. musculus
gctcttctattcagga

SEQ ID NO: 413462 - DNA, 16 bp, M. musculus
gctcttctcctcagct

SEQ ID NO: 413463 - DNA, 16 bp, M. musculus
gctcttctctgagatc

SEQ ID NO: 413464 - DNA, 16 bp, M. musculus
gctcttctgtatttct

SEQ ID NO: 413465 - DNA, 16 bp, M. musculus
gctcttgaacaaaagg

SEQ ID NO: 413466 - DNA, 16 bp, M. musculus
gctcttgactgctgag

SEQ ID NO: 413467 - DNA, 16 bp, M. musculus
gctcttgcagaagacc

SEQ ID NO: 413468 - DNA, 16 bp, M. musculus
gctcttgcagaagact

SEQ ID NO: 413469 - DNA, 16 bp, M. musculus
gctcttgcagaggact

SEQ ID NO: 413470 - DNA, 16 bp, M. musculus
gctcttgcttctctct

SEQ ID NO: 413471 - DNA, 16 bp, M. musculus
gctcttgcttctggct

SEQ ID NO: 413472 - DNA, 16 bp, M. musculus
gctcttggacacccag

SEQ ID NO: 413473 - DNA, 16 bp, M. musculus
gctcttgtagaggacc

SEQ ID NO: 413474 - DNA, 16 bp, M. musculus
gctcttgtcagcactg

SEQ ID NO: 413475 - DNA, 16 bp, M. musculus
gctcttgtggaggacc

SEQ ID NO: 413476 - DNA, 16 bp, M. musculus
gctctttaagctctca

SEQ ID NO: 413477 - DNA, 16 bp, M. musculus
gctctttattgaccaa

SEQ ID NO: 413478 - DNA, 16 bp, M. musculus
gctctttcaaggtcta

SEQ ID NO: 413479 - DNA, 16 bp, M. musculus
gctctttcagaggacc

SEQ ID NO: 413480 - DNA, 16 bp, M. musculus
gctctttcagaggact

SEQ ID NO: 413481 - DNA, 16 bp, M. musculus
gctctttccaagactt

SEQ ID NO: 413482 - DNA, 16 bp, M. musculus
gctctttcctctgagt

SEQ ID NO: 413483 - DNA, 16 bp, M. musculus
gctcttttcagagcca

SEQ ID NO: 413484 - DNA, 16 bp, M. musculus
gctcttttgtgactgg

SEQ ID NO: 413485 - DNA, 16 bp, M. musculus
gctgaaaaaaattttt

SEQ ID NO: 413486 - DNA, 16 bp, M. musculus
gctgaaaactgaactc

SEQ ID NO: 413487 - DNA, 16 bp, M. musculus
gctgaaaacttggaag

SEQ ID NO: 413488 - DNA, 16 bp, M. musculus
gctgaaaagagagggg

SEQ ID NO: 413489 - DNA, 16 bp, M. musculus
gctgaaaagcttctgt

SEQ ID NO: 413490 - DNA, 16 bp, M. musculus
gctgaaagaagatgag

SEQ ID NO: 413491 - DNA, 16 bp, M. musculus
gctgaaagagaagagg

SEQ ID NO: 413492 - DNA, 16 bp, M. musculus
gctgaaagagagggaa

SEQ ID NO: 413493 - DNA, 16 bp, M. musculus
gctgaaagagatcaga

SEQ ID NO: 413494 - DNA, 16 bp, M. musculus
gctgaaagaggctgag

SEQ ID NO: 413495 - DNA, 16 bp, M. musculus
gctgaaagtctatttt

SEQ ID NO: 413496 - DNA, 16 bp, M. musculus
gctgaaatcaaccaag

SEQ ID NO: 413497 - DNA, 16 bp, M. musculus
gctgaaatcaatgaaa

SEQ ID NO: 413498 - DNA, 16 bp, M. musculus
gctgaaatgaaccctt

SEQ ID NO: 413499 - DNA, 16 bp, M. musculus
gctgaaattaataaaa

SEQ ID NO: 413500 - DNA, 16 bp, M. musculus
gctgaacaatgctcta

SEQ ID NO: 413501 - DNA, 16 bp, M. musculus
gctgaacagcatgctg

SEQ ID NO: 413502 - DNA, 16 bp, M. musculus
gctgaacctggagctc

SEQ ID NO: 413503 - DNA, 16 bp, M. musculus
gctgaagaacactcta

SEQ ID NO: 413504 - DNA, 16 bp, M. musculus
gctgaagaagaaggcc

SEQ ID NO: 413505 - DNA, 16 bp, M. musculus
gctgaagaagctgaga

SEQ ID NO: 413506 - DNA, 16 bp, M. musculus
gctgaagaatcaactg

SEQ ID NO: 413507 - DNA, 16 bp, M. musculus
gctgaagagaaggctc

SEQ ID NO: 413508 - DNA, 16 bp, M. musculus
gctgaagagatgtctc

SEQ ID NO: 413509 - DNA, 16 bp, M. musculus
gctgaagataacacct

SEQ ID NO: 413510 - DNA, 16 bp, M. musculus
gctgaagatgacctta

SEQ ID NO: 413511 - DNA, 16 bp, M. musculus
gctgaagcacaagaaa

SEQ ID NO: 413512 - DNA, 16 bp, M. musculus
gctgaagcagaaagat

SEQ ID NO: 413513 - DNA, 16 bp, M. musculus
gctgaagcagaagaat

SEQ ID NO: 413514 - DNA, 16 bp, M. musculus
gctgaagcagaaggat

SEQ ID NO: 413515 - DNA, 16 bp, M. musculus
gctgaagcaggaagat

SEQ ID NO: 413516 - DNA, 16 bp, M. musculus
gctgaagcaggagaat

SEQ ID NO: 413517 - DNA, 16 bp, M. musculus
gctgaagcaggaggat

SEQ ID NO: 413518 - DNA, 16 bp, M. musculus
gctgaagcaggcagat

SEQ ID NO: 413519 - DNA, 16 bp, M. musculus
gctgaagcagggggat

SEQ ID NO: 413520 - DNA, 16 bp, M. musculus
gctgaagctgctcccc

SEQ ID NO: 413521 - DNA, 16 bp, M. musculus
gctgaaggaaggaagg

SEQ ID NO: 413522 - DNA, 16 bp, M. musculus
gctgaaggagaaggaa

SEQ ID NO: 413523 - DNA, 16 bp, M. musculus
gctgaaggcaaaagaa

SEQ ID NO: 413524 - DNA, 16 bp, M. musculus
gctgaagtaggaggat

SEQ ID NO: 413525 - DNA, 21 bp, M. musculus
gctgaagtcaccttttggtga

SEQ ID NO: 413526 - DNA, 16 bp, M. musculus
gctgaagtgtccaagt

SEQ ID NO: 413527 - DNA, 16 bp, M. musculus
gctgaatacagagaga

SEQ ID NO: 413528 - DNA, 16 bp, M. musculus
gctgaatcttatggag

SEQ ID NO: 413529 - DNA, 16 bp, M. musculus
gctgaatttatttatt

SEQ ID NO: 413530 - DNA, 16 bp, M. musculus
gctgacaccactgcat

SEQ ID NO: 413531 - DNA, 16 bp, M. musculus
gctgacagacagacag

SEQ ID NO: 413532 - DNA, 16 bp, M. musculus
gctgacaggaatctga

SEQ ID NO: 413533 - DNA, 16 bp, M. musculus
gctgacattgaactca

SEQ ID NO: 413534 - DNA, 16 bp, M. musculus
gctgaccagagcaagc

SEQ ID NO: 413535 - DNA, 16 bp, M. musculus
gctgaccagcatcaat

SEQ ID NO: 413536 - DNA, 16 bp, M. musculus
gctgaccagtgagctc

SEQ ID NO: 413537 - DNA, 16 bp, M. musculus
gctgacccctttcctc

SEQ ID NO: 413538 - DNA, 16 bp, M. musculus
gctgacctctgacctc

SEQ ID NO: 413539 - DNA, 16 bp, M. musculus
gctgacctgagttcaa

SEQ ID NO: 413540 - DNA, 16 bp, M. musculus
gctgacctgagtttga

SEQ ID NO: 413541 - DNA, 16 bp, M. musculus
gctgacctgccttctg

SEQ ID NO: 413542 - DNA, 16 bp, M. musculus
gctgacctggaacttg

SEQ ID NO: 413543 - DNA, 16 bp, M. musculus
gctgacctggcactca

SEQ ID NO: 413544 - DNA, 16 bp, M. musculus
gctgaccttgaacctg

SEQ ID NO: 413545 - DNA, 16 bp, M. musculus
gctgaccttgaactga

SEQ ID NO: 413546 - DNA, 16 bp, M. musculus
gctgaccttgatctca

SEQ ID NO: 413547 - DNA, 16 bp, M. musculus
gctgactgaatttgtt

SEQ ID NO: 413548 - DNA, 16 bp, M. musculus
gctgactgagacagac

SEQ ID NO: 413549 - DNA, 16 bp, M. musculus
gctgactgagagcatc

SEQ ID NO: 413550 - DNA, 16 bp, M. musculus
gctgactgctcttcca

SEQ ID NO: 413551 - DNA, 16 bp, M. musculus
gctgactggccaatga

SEQ ID NO: 413552 - DNA, 16 bp, M. musculus
gctgactggctggctg

SEQ ID NO: 413553 - DNA, 16 bp, M. musculus
gctgactggcttgctt

SEQ ID NO: 413554 - DNA, 16 bp, M. musculus
gctgacttagggctgg

SEQ ID NO: 413555 - DNA, 16 bp, M. musculus
gctgacttcaaacaca

SEQ ID NO: 413556 - DNA, 16 bp, M. musculus
gctgagaaagaaaata

SEQ ID NO: 413557 - DNA, 16 bp, M. musculus
gctgagaaagaggaaa

SEQ ID NO: 413558 - DNA, 16 bp, M. musculus
gctgagaacaaaatgg

SEQ ID NO: 413559 - DNA, 16 bp, M. musculus
gctgagaaccaaactc

SEQ ID NO: 413560 - DNA, 16 bp, M. musculus
gctgagaagaaagctg

SEQ ID NO: 413561 - DNA, 16 bp, M. musculus
gctgagaagaaggaat

SEQ ID NO: 413562 - DNA, 16 bp, M. musculus
gctgagaatgtagctc

SEQ ID NO: 413563 - DNA, 16 bp, M. musculus
gctgagacaaagggat

SEQ ID NO: 413564 - DNA, 16 bp, M. musculus
gctgagacaggaggat

SEQ ID NO: 413565 - DNA, 16 bp, M. musculus
gctgagacaggcagat

SEQ ID NO: 413566 - DNA, 16 bp, M. musculus
gctgagaccagaagag

SEQ ID NO: 413567 - DNA, 16 bp, M. musculus
gctgagactggaggat

SEQ ID NO: 413568 - DNA, 16 bp, M. musculus
gctgagagaagccaga

SEQ ID NO: 413569 - DNA, 16 bp, M. musculus
gctgagagacactggg

SEQ ID NO: 413570 - DNA, 16 bp, M. musculus
gctgagagacggtaac

SEQ ID NO: 413571 - DNA, 16 bp, M. musculus
gctgagagagagagag

SEQ ID NO: 413572 - DNA, 16 bp, M. musculus
gctgagagaggcagag

SEQ ID NO: 413573 - DNA, 16 bp, M. musculus
gctgagagcaggagaa

SEQ ID NO: 413574 - DNA, 16 bp, M. musculus
gctgagagctctgcat

SEQ ID NO: 413575 - DNA, 16 bp, M. musculus
gctgagagctgagagc

SEQ ID NO: 413576 - DNA, 16 bp, M. musculus
gctgagaggccaggag

SEQ ID NO: 413577 - DNA, 23 bp, M. musculus
gctgagaggccccagagctattc

SEQ ID NO: 413578 - DNA, 16 bp, M. musculus
gctgagagtgatttga

SEQ ID NO: 413579 - DNA, 16 bp, M. musculus
gctgagatgaaaagat

SEQ ID NO: 413580 - DNA, 16 bp, M. musculus
gctgagattacaagtg

SEQ ID NO: 413581 - DNA, 16 bp, M. musculus
gctgagattgaaggaa

SEQ ID NO: 413582 - DNA, 16 bp, M. musculus
gctgagattgcaggtg

SEQ ID NO: 413583 - DNA, 16 bp, M. musculus
gctgagatttttgtct

SEQ ID NO: 413584 - DNA, 16 bp, M. musculus
gctgagcaaaccagta

SEQ ID NO: 413585 - DNA, 16 bp, M. musculus
gctgagcaaaccatgg

SEQ ID NO: 413586 - DNA, 16 bp, M. musculus
gctgagcaaggagaag

SEQ ID NO: 413587 - DNA, 16 bp, M. musculus
gctgagcaaggcagag

SEQ ID NO: 413588 - DNA, 16 bp, M. musculus
gctgagcagaagagag

SEQ ID NO: 413589 - DNA, 16 bp, M. musculus
gctgagcaggccaggg

SEQ ID NO: 413590 - DNA, 16 bp, M. musculus
gctgagccacacccta

SEQ ID NO: 413591 - DNA, 16 bp, M. musculus
gctgagccacctctcc

SEQ ID NO: 413592 - DNA, 16 bp, M. musculus
gctgagccacctctgc

SEQ ID NO: 413593 - DNA, 16 bp, M. musculus
gctgagccaggaggat

SEQ ID NO: 413594 - DNA, 17 bp, M. musculus
gctgagccatctcacca

SEQ ID NO: 413595 - DNA, 17 bp, M. musculus
gctgagccatctctcct

SEQ ID NO: 413596 - DNA, 16 bp, M. musculus
gctgagccctctcccc

SEQ ID NO: 413597 - DNA, 16 bp, M. musculus
gctgagccctctttcc

SEQ ID NO: 413598 - DNA, 16 bp, M. musculus
gctgagcgagccaggg

SEQ ID NO: 413599 - DNA, 16 bp, M. musculus
gctgagctcaaactca

SEQ ID NO: 413600 - DNA, 16 bp, M. musculus
gctgagctctctctct

SEQ ID NO: 413601 - DNA, 16 bp, M. musculus
gctgagctgcaaagaa

SEQ ID NO: 413602 - DNA, 16 bp, M. musculus
gctgagctgcctgcag

SEQ ID NO: 413603 - DNA, 16 bp, M. musculus
gctgagctgctgaaga

SEQ ID NO: 413604 - DNA, 16 bp, M. musculus
gctgaggaagcagagg

SEQ ID NO: 413605 - DNA, 16 bp, M. musculus
gctgaggaagccaggg

SEQ ID NO: 413606 - DNA, 16 bp, M. musculus
gctgaggaaggaggat

SEQ ID NO: 413607 - DNA, 16 bp, M. musculus
gctgaggacaaactcc

SEQ ID NO: 413608 - DNA, 16 bp, M. musculus
gctgaggacaaccttg

SEQ ID NO: 413609 - DNA, 16 bp, M. musculus
gctgaggacacagaga

SEQ ID NO: 413610 - DNA, 16 bp, M. musculus
gctgaggagaagagca

SEQ ID NO: 413611 - DNA, 16 bp, M. musculus
gctgaggagaagagtg

SEQ ID NO: 413612 - DNA, 16 bp, M. musculus
gctgaggagaagggca

SEQ ID NO: 413613 - DNA, 16 bp, M. musculus
gctgaggaggaggatg

SEQ ID NO: 413614 - DNA, 16 bp, M. musculus
gctgaggaggagggca

SEQ ID NO: 413615 - DNA, 16 bp, M. musculus
gctgaggaggctgagg

SEQ ID NO: 413616 - DNA, 16 bp, M. musculus
gctgaggaggcttcct

SEQ ID NO: 413617 - DNA, 16 bp, M. musculus
gctgaggagggtgacc

SEQ ID NO: 413618 - DNA, 16 bp, M. musculus
gctgaggaggtttgca

SEQ ID NO: 413619 - DNA, 16 bp, M. musculus
gctgaggatatagctc

SEQ ID NO: 413620 - DNA, 16 bp, M. musculus
gctgaggatgaaggcc

SEQ ID NO: 413621 - DNA, 16 bp, M. musculus
gctgaggcaagaggag

SEQ ID NO: 413622 - DNA, 16 bp, M. musculus
gctgaggcaagaggat

SEQ ID NO: 413623 - DNA, 16 bp, M. musculus
gctgaggcaaggcatg

SEQ ID NO: 413624 - DNA, 16 bp, M. musculus
gctgaggcagaaggat

SEQ ID NO: 413625 - DNA, 16 bp, M. musculus
gctgaggcaggaaagg

SEQ ID NO: 413626 - DNA, 16 bp, M. musculus
gctgaggcaggagaac

SEQ ID NO: 413627 - DNA, 16 bp, M. musculus
gctgaggcaggagaat

SEQ ID NO: 413628 - DNA, 16 bp, M. musculus
gctgaggcaggaggac

SEQ ID NO: 413629 - DNA, 16 bp, M. musculus
gctgaggcaggaggat

SEQ ID NO: 413630 - DNA, 16 bp, M. musculus
gctgaggcaggaggcc

SEQ ID NO: 413631 - DNA, 16 bp, M. musculus
gctgaggcagggggac

SEQ ID NO: 413632 - DNA, 16 bp, M. musculus
gctgaggcagggggat

SEQ ID NO: 413633 - DNA, 16 bp, M. musculus
gctgaggcaggtggac

SEQ ID NO: 413634 - DNA, 16 bp, M. musculus
gctgaggcaggtggat

SEQ ID NO: 413635 - DNA, 16 bp, M. musculus
gctgaggccatttcag

SEQ ID NO: 413636 - DNA, 16 bp, M. musculus
gctgaggctgaagcag

SEQ ID NO: 413637 - DNA, 16 bp, M. musculus
gctgaggctgaggccg

SEQ ID NO: 413638 - DNA, 16 bp, M. musculus
gctgaggctgaggctg

SEQ ID NO: 413639 - DNA, 16 bp, M. musculus
gctgaggctggacctc

SEQ ID NO: 413640 - DNA, 16 bp, M. musculus
gctgaggctggagaat

SEQ ID NO: 413641 - DNA, 16 bp, M. musculus
gctgaggctggaggac

SEQ ID NO: 413642 - DNA, 16 bp, M. musculus
gctgaggctggaggat

SEQ ID NO: 413643 - DNA, 16 bp, M. musculus
gctgaggctggggctg

SEQ ID NO: 413644 - DNA, 16 bp, M. musculus
gctgaggctgggggat

SEQ ID NO: 413645 - DNA, 16 bp, M. musculus
gctgagggagctgagg

SEQ ID NO: 413646 - DNA, 16 bp, M. musculus
gctgagggctggagag

SEQ ID NO: 413647 - DNA, 16 bp, M. musculus
gctgagggctggggag

SEQ ID NO: 413648 - DNA, 16 bp, M. musculus
gctgagggtgaccttg

SEQ ID NO: 413649 - DNA, 16 bp, M. musculus
gctgagggtggccttg

SEQ ID NO: 413650 - DNA, 16 bp, M. musculus
gctgagggtgtggctc

SEQ ID NO: 413651 - DNA, 16 bp, M. musculus
gctgaggtcagaggtc

SEQ ID NO: 413652 - DNA, 16 bp, M. musculus
gctgaggtggctgagg

SEQ ID NO: 413653 - DNA, 16 bp, M. musculus
gctgagtactattcca

SEQ ID NO: 413654 - DNA, 16 bp, M. musculus
gctgagtcacctctct

SEQ ID NO: 413655 - DNA, 16 bp, M. musculus
gctgagtcactcccat

SEQ ID NO: 413656 - DNA, 16 bp, M. musculus
gctgagtggaaagcat

SEQ ID NO: 413657 - DNA, 16 bp, M. musculus
gctgagtgtagtggtg

SEQ ID NO: 413658 - DNA, 16 bp, M. musculus
gctgagtgtggtggtg

SEQ ID NO: 413659 - DNA, 16 bp, M. musculus
gctgagttcaatccct

SEQ ID NO: 413660 - DNA, 16 bp, M. musculus
gctgatctggaactca

SEQ ID NO: 413661 - DNA, 16 bp, M. musculus
gctgatgatgatgatg

SEQ ID NO: 413662 - DNA, 16 bp, M. musculus
gctgatgattggacag

SEQ ID NO: 413663 - DNA, 16 bp, M. musculus
gctgatgcaaaggtca

SEQ ID NO: 413664 - DNA, 16 bp, M. musculus
gctgatgcagaggcta

SEQ ID NO: 413665 - DNA, 16 bp, M. musculus
gctgatgccaagaaat

SEQ ID NO: 413666 - DNA, 16 bp, M. musculus
gctgatgccaagaagc

SEQ ID NO: 413667 - DNA, 16 bp, M. musculus
gctgatgctcacattt

SEQ ID NO: 413668 - DNA, 16 bp, M. musculus
gctgatgctgaggcca

SEQ ID NO: 413669 - DNA, 16 bp, M. musculus
gctgatgctgatgctg

SEQ ID NO: 413670 - DNA, 16 bp, M. musculus
gctgatggtgatggtg

SEQ ID NO: 413671 - DNA, 16 bp, M. musculus
gctgatggtggtggtg

SEQ ID NO: 413672 - DNA, 17 bp, M. musculus
gctgattatgggatgga

SEQ ID NO: 413673 - DNA, 16 bp, M. musculus
gctgattcaaagcata

SEQ ID NO: 413674 - DNA, 16 bp, M. musculus
gctgattcaactggtg

SEQ ID NO: 413675 - DNA, 16 bp, M. musculus
gctgattcaatctggc

SEQ ID NO: 413676 - DNA, 16 bp, M. musculus
gctgattcttcagccc

SEQ ID NO: 413677 - DNA, 16 bp, M. musculus
gctgattgtgaaaaca

SEQ ID NO: 413678 - DNA, 16 bp, M. musculus
gctgcaaacccttcag

SEQ ID NO: 413679 - DNA, 16 bp, M. musculus
gctgcaaagagaaacc

SEQ ID NO: 413680 - DNA, 16 bp, M. musculus
gctgcaaccctggaag

SEQ ID NO: 413681 - DNA, 16 bp, M. musculus
gctgcaagctccttca

SEQ ID NO: 413682 - DNA, 16 bp, M. musculus
gctgcaagggaaaagg

SEQ ID NO: 413683 - DNA, 16 bp, M. musculus
gctgcaagggaggctg

SEQ ID NO: 413684 - DNA, 16 bp, M. musculus
gctgcaagggagtctg

SEQ ID NO: 413685 - DNA, 16 bp, M. musculus
gctgcaatgtgtgctt

SEQ ID NO: 413686 - DNA, 16 bp, M. musculus
gctgcacaaacaggac

SEQ ID NO: 413687 - DNA, 16 bp, M. musculus
gctgcacacactctgc

SEQ ID NO: 413688 - DNA, 16 bp, M. musculus
gctgcacatctgccac

SEQ ID NO: 413689 - DNA, 16 bp, M. musculus
gctgcagaagcagcaa

SEQ ID NO: 413690 - DNA, 16 bp, M. musculus
gctgcagaagcagcag

SEQ ID NO: 413691 - DNA, 16 bp, M. musculus
gctgcagagaaaccct

SEQ ID NO: 413692 - DNA, 16 bp, M. musculus
gctgcagagagcagaa

SEQ ID NO: 413693 - DNA, 16 bp, M. musculus
gctgcagaggcagaga

SEQ ID NO: 413694 - DNA, 16 bp, M. musculus
gctgcagaggccatgg

SEQ ID NO: 413695 - DNA, 16 bp, M. musculus
gctgcagagtgtgctg

SEQ ID NO: 413696 - DNA, 24 bp, M. musculus
gctgcagatacagatcctgaacct

SEQ ID NO: 413697 - DNA, 16 bp, M. musculus
gctgcagatgtggcag

SEQ ID NO: 413698 - DNA, 16 bp, M. musculus
gctgcagcagcagcag

SEQ ID NO: 413699 - DNA, 16 bp, M. musculus
gctgcagccatgggtc

SEQ ID NO: 413700 - DNA, 16 bp, M. musculus
gctgcagcccatggtg

SEQ ID NO: 413701 - DNA, 16 bp, M. musculus
gctgcagctcactccc

SEQ ID NO: 413702 - DNA, 16 bp, M. musculus
gctgcagctgctgctg

SEQ ID NO: 413703 - DNA, 16 bp, M. musculus
gctgcaggagaaagct

SEQ ID NO: 413704 - DNA, 16 bp, M. musculus
gctgcaggagagaaag

SEQ ID NO: 413705 - DNA, 16 bp, M. musculus
gctgcaggaggaagcc

SEQ ID NO: 413706 - DNA, 16 bp, M. musculus
gctgcaggaggagctg

SEQ ID NO: 413707 - DNA, 16 bp, M. musculus
gctgcaggatctctat

SEQ ID NO: 413708 - DNA, 16 bp, M. musculus
gctgcaggctctgact

SEQ ID NO: 413709 - DNA, 16 bp, M. musculus
gctgcaggtggctgct

SEQ ID NO: 413710 - DNA, 16 bp, M. musculus
gctgcagtagccattc

SEQ ID NO: 413711 - DNA, 16 bp, M. musculus
gctgcatatttccatt

SEQ ID NO: 413712 - DNA, 16 bp, M. musculus
gctgcatcttcagccc

SEQ ID NO: 413713 - DNA, 16 bp, M. musculus
gctgccaaacatgtgc

SEQ ID NO: 413714 - DNA, 16 bp, M. musculus
gctgccaactttctcc

SEQ ID NO: 413715 - DNA, 16 bp, M. musculus
gctgccacaactggca

SEQ ID NO: 413716 - DNA, 16 bp, M. musculus
gctgccacacctggct

SEQ ID NO: 413717 - DNA, 16 bp, M. musculus
gctgccacagctgcca

SEQ ID NO: 413718 - DNA, 16 bp, M. musculus
gctgccaccacctggc

SEQ ID NO: 413719 - DNA, 16 bp, M. musculus
gctgccacccaggccc

SEQ ID NO: 413720 - DNA, 16 bp, M. musculus
gctgccacctggtggc

SEQ ID NO: 413721 - DNA, 16 bp, M. musculus
gctgccactgcctgct

SEQ ID NO: 413722 - DNA, 16 bp, M. musculus
gctgccactgtggacc

SEQ ID NO: 413723 - DNA, 16 bp, M. musculus
gctgccagagggattg

SEQ ID NO: 413724 - DNA, 16 bp, M. musculus
gctgccaggaagccag

SEQ ID NO: 413725 - DNA, 16 bp, M. musculus
gctgccatgcttcccc

SEQ ID NO: 413726 - DNA, 16 bp, M. musculus
gctgccatgttccctg

SEQ ID NO: 413727 - DNA, 16 bp, M. musculus
gctgccatgttcctgc

SEQ ID NO: 413728 - DNA, 16 bp, M. musculus
gctgccattttgtctt

SEQ ID NO: 413729 - DNA, 16 bp, M. musculus
gctgcccaccttctcc

SEQ ID NO: 413730 - DNA, 16 bp, M. musculus
gctgcccactctctct

SEQ ID NO: 413731 - DNA, 16 bp, M. musculus
gctgcccactgtctcc

SEQ ID NO: 413732 - DNA, 16 bp, M. musculus
gctgcccagcctgatg

SEQ ID NO: 413733 - DNA, 16 bp, M. musculus
gctgcccagtttctcc

SEQ ID NO: 413734 - DNA, 16 bp, M. musculus
gctgccctctgagagg

SEQ ID NO: 413735 - DNA, 16 bp, M. musculus
gctgccctctggcctc

SEQ ID NO: 413736 - DNA, 17 bp, M. musculus
gctgccctgagcagcct

SEQ ID NO: 413737 - DNA, 16 bp, M. musculus
gctgccctgctcccct

SEQ ID NO: 413738 - DNA, 16 bp, M. musculus
gctgccctgctgccct

SEQ ID NO: 413739 - DNA, 16 bp, M. musculus
gctgccctggacccag

SEQ ID NO: 413740 - DNA, 16 bp, M. musculus
gctgccctgtgtcatg

SEQ ID NO: 413741 - DNA, 16 bp, M. musculus
gctgccgaggatgtgg

SEQ ID NO: 413742 - DNA, 16 bp, M. musculus
gctgccgccaccacca

SEQ ID NO: 413743 - DNA, 16 bp, M. musculus
gctgccgcctcctcct

SEQ ID NO: 413744 - DNA, 16 bp, M. musculus
gctgccgctgctgctg

SEQ ID NO: 413745 - DNA, 16 bp, M. musculus
gctgcctaaacaagat

SEQ ID NO: 413746 - DNA, 16 bp, M. musculus
gctgcctatcacagtc

SEQ ID NO: 413747 - DNA, 16 bp, M. musculus
gctgcctcagcctccc

SEQ ID NO: 413748 - DNA, 16 bp, M. musculus
gctgcctcccaagtgc

SEQ ID NO: 413749 - DNA, 16 bp, M. musculus
gctgcctcctgagagg

SEQ ID NO: 413750 - DNA, 16 bp, M. musculus
gctgcctctccagcct

SEQ ID NO: 413751 - DNA, 16 bp, M. musculus
gctgcctctgcctccc

SEQ ID NO: 413752 - DNA, 16 bp, M. musculus
gctgcctctgcctgct

SEQ ID NO: 413753 - DNA, 16 bp, M. musculus
gctgcctctgctcagg

SEQ ID NO: 413754 - DNA, 16 bp, M. musculus
gctgcctctggaacac

SEQ ID NO: 413755 - DNA, 16 bp, M. musculus
gctgcctctgtgtgtg

SEQ ID NO: 413756 - DNA, 16 bp, M. musculus
gctgcctgatgtgggt

SEQ ID NO: 413757 - DNA, 16 bp, M. musculus
gctgcctgccaggctg

SEQ ID NO: 413758 - DNA, 16 bp, M. musculus
gctgcctgcctcagtt

SEQ ID NO: 413759 - DNA, 17 bp, M. musculus
gctgcctgcctctgcct

SEQ ID NO: 413760 - DNA, 16 bp, M. musculus
gctgcctgcctgctgc

SEQ ID NO: 413761 - DNA, 16 bp, M. musculus
gctgcctgcctgtgga

SEQ ID NO: 413762 - DNA, 16 bp, M. musculus
gctgcctgctaacctg

SEQ ID NO: 413763 - DNA, 16 bp, M. musculus
gctgcctgctgcctcc

SEQ ID NO: 413764 - DNA, 16 bp, M. musculus
gctgcctggaagccaa

SEQ ID NO: 413765 - DNA, 16 bp, M. musculus
gctgcctggagcctga

SEQ ID NO: 413766 - DNA, 16 bp, M. musculus
gctgcctggagctgct

SEQ ID NO: 413767 - DNA, 16 bp, M. musculus
gctgcctggaggagga

SEQ ID NO: 413768 - DNA, 16 bp, M. musculus
gctgcctggccctggc

SEQ ID NO: 413769 - DNA, 16 bp, M. musculus
gctgcctggctgcctg

SEQ ID NO: 413770 - DNA, 16 bp, M. musculus
gctgcctgggacagga

SEQ ID NO: 413771 - DNA, 16 bp, M. musculus
gctgcctggtctggcc

SEQ ID NO: 413772 - DNA, 16 bp, M. musculus
gctgcctggtgtctgc

SEQ ID NO: 413773 - DNA, 16 bp, M. musculus
gctgcctgtggaagac

SEQ ID NO: 413774 - DNA, 16 bp, M. musculus
gctgccttgagaggca

SEQ ID NO: 413775 - DNA, 16 bp, M. musculus
gctgccttgcttcctg

SEQ ID NO: 413776 - DNA, 16 bp, M. musculus
gctgccttgtctggac

SEQ ID NO: 413777 - DNA, 16 bp, M. musculus
gctgcctttcatggcc

SEQ ID NO: 413778 - DNA, 16 bp, M. musculus
gctgcctttgcctcct

SEQ ID NO: 413779 - DNA, 17 bp, M. musculus
gctgcgagagcacagcc

SEQ ID NO: 413780 - DNA, 16 bp, M. musculus
gctgcggctgcggctg

SEQ ID NO: 413781 - DNA, 16 bp, M. musculus
gctgctaatatatgct

SEQ ID NO: 413782 - DNA, 16 bp, M. musculus
gctgctacctgctgag

SEQ ID NO: 413783 - DNA, 16 bp, M. musculus
gctgctacctgctgcc

SEQ ID NO: 413784 - DNA, 16 bp, M. musculus
gctgctactggacaca

SEQ ID NO: 413785 - DNA, 16 bp, M. musculus
gctgctagaagaagac

SEQ ID NO: 413786 - DNA, 16 bp, M. musculus
gctgctagagacatga

SEQ ID NO: 413787 - DNA, 16 bp, M. musculus
gctgctagcagaaaac

SEQ ID NO: 413788 - DNA, 16 bp, M. musculus
gctgctatccagttgg

SEQ ID NO: 413789 - DNA, 16 bp, M. musculus
gctgctcctcctgctc

SEQ ID NO: 413790 - DNA, 16 bp, M. musculus
gctgctcctgaggcag

SEQ ID NO: 413791 - DNA, 16 bp, M. musculus
gctgctctccagagga

SEQ ID NO: 413792 - DNA, 16 bp, M. musculus
gctgctctctcagagg

SEQ ID NO: 413793 - DNA, 16 bp, M. musculus
gctgctctctgacctc

SEQ ID NO: 413794 - DNA, 16 bp, M. musculus
gctgctctctgagagg

SEQ ID NO: 413795 - DNA, 16 bp, M. musculus
gctgctctgctgcttc

SEQ ID NO: 413796 - DNA, 16 bp, M. musculus
gctgctctggggctgc

SEQ ID NO: 413797 - DNA, 16 bp, M. musculus
gctgctctgtcctcgc

SEQ ID NO: 413798 - DNA, 16 bp, M. musculus
gctgctctgttcacaa

SEQ ID NO: 413799 - DNA, 16 bp, M. musculus
gctgctcttacagagg

SEQ ID NO: 413800 - DNA, 16 bp, M. musculus
gctgctcttcatgatc

SEQ ID NO: 413801 - DNA, 16 bp, M. musculus
gctgctcttccagaag

SEQ ID NO: 413802 - DNA, 16 bp, M. musculus
gctgctcttccagaga

SEQ ID NO: 413803 - DNA, 16 bp, M. musculus
gctgctcttccagagg

SEQ ID NO: 413804 - DNA, 16 bp, M. musculus
gctgctcttccaggag

SEQ ID NO: 413805 - DNA, 16 bp, M. musculus
gctgctcttcctgagg

SEQ ID NO: 413806 - DNA, 16 bp, M. musculus
gctgctcttctaaagg

SEQ ID NO: 413807 - DNA, 16 bp, M. musculus
gctgctcttctgaagg

SEQ ID NO: 413808 - DNA, 16 bp, M. musculus
gctgctcttgaagagg

SEQ ID NO: 413809 - DNA, 16 bp, M. musculus
gctgctcttggagagg

SEQ ID NO: 413810 - DNA, 16 bp, M. musculus
gctgctctttcagatg

SEQ ID NO: 413811 - DNA, 16 bp, M. musculus
gctgctgagaagaatg

SEQ ID NO: 413812 - DNA, 16 bp, M. musculus
gctgctgagatggctc

SEQ ID NO: 413813 - DNA, 16 bp, M. musculus
gctgctgagggagaaa

SEQ ID NO: 413814 - DNA, 16 bp, M. musculus
gctgctgatgctcagg

SEQ ID NO: 413815 - DNA, 16 bp, M. musculus
gctgctgattgccaga

SEQ ID NO: 413816 - DNA, 16 bp, M. musculus
gctgctgcagaagcca

SEQ ID NO: 413817 - DNA, 16 bp, M. musculus
gctgctgcagcagcag

SEQ ID NO: 413818 - DNA, 16 bp, M. musculus
gctgctgcagctgctg

SEQ ID NO: 413819 - DNA, 16 bp, M. musculus
gctgctgcagggccat

SEQ ID NO: 413820 - DNA, 17 bp, M. musculus
gctgctgccaatccagc

SEQ ID NO: 413821 - DNA, 16 bp, M. musculus
gctgctgccaccacca

SEQ ID NO: 413822 - DNA, 16 bp, M. musculus
gctgctgcctctctgg

SEQ ID NO: 413823 - DNA, 16 bp, M. musculus
gctgctgcggctgctg

SEQ ID NO: 413824 - DNA, 17 bp, M. musculus
gctgctgctacagctgc

SEQ ID NO: 413825 - DNA, 16 bp, M. musculus
gctgctgctactgcta

SEQ ID NO: 413826 - DNA, 21 bp, M. musculus
gctgctgctcctgctgctgct

SEQ ID NO: 413827 - DNA, 16 bp, M. musculus
gctgctgctcctgttg

SEQ ID NO: 413828 - DNA, 16 bp, M. musculus
gctgctgctctgtcct

SEQ ID NO: 413829 - DNA, 16 bp, M. musculus
gctgctgctcttgctg

SEQ ID NO: 413830 - DNA, 16 bp, M. musculus
gctgctgctgacctgt

SEQ ID NO: 413831 - DNA, 16 bp, M. musculus
gctgctgctgaggctg

SEQ ID NO: 413832 - DNA, 16 bp, M. musculus
gctgctgctgatgctg

SEQ ID NO: 413833 - DNA, 16 bp, M. musculus
gctgctgctgattcct

SEQ ID NO: 413834 - DNA, 17 bp, M. musculus
gctgctgctgattgcca

SEQ ID NO: 413835 - DNA, 16 bp, M. musculus
gctgctgctgcagttg

SEQ ID NO: 413836 - DNA, 16 bp, M. musculus
gctgctgctgccacca

SEQ ID NO: 413837 - DNA, 16 bp, M. musculus
gctgctgctgccgcca

SEQ ID NO: 413838 - DNA, 16 bp, M. musculus
gctgctgctgctcccc

SEQ ID NO: 413839 - DNA, 16 bp, M. musculus
gctgctgctgctctct

SEQ ID NO: 413840 - DNA, 16 bp, M. musculus
gctgctgctgctcttc

SEQ ID NO: 413841 - DNA, 16 bp, M. musculus
gctgctgctgctgaat

SEQ ID NO: 413842 - DNA, 16 bp, M. musculus
gctgctgctgctgacc

SEQ ID NO: 413843 - DNA, 16 bp, M. musculus
gctgctgctgctgaga

SEQ ID NO: 413844 - DNA, 16 bp, M. musculus
gctgctgctgctgcaa

SEQ ID NO: 413845 - DNA, 16 bp, M. musculus
gctgctgctgctgcag

SEQ ID NO: 413846 - DNA, 16 bp, M. musculus
gctgctgctgctgcca

SEQ ID NO: 413847 - DNA, 16 bp, M. musculus
gctgctgctgctgcct

SEQ ID NO: 413848 - DNA, 16 bp, M. musculus
gctgctgctgctgcgc

SEQ ID NO: 413849 - DNA, 16 bp, M. musculus
gctgctgctgctggaa

SEQ ID NO: 413850 - DNA, 16 bp, M. musculus
gctgctgctgctggca

SEQ ID NO: 413851 - DNA, 16 bp, M. musculus
gctgctgctgctggct

SEQ ID NO: 413852 - DNA, 16 bp, M. musculus
gctgctgctgctggga

SEQ ID NO: 413853 - DNA, 16 bp, M. musculus
gctgctgctgctggtg

SEQ ID NO: 413854 - DNA, 16 bp, M. musculus
gctgctgctgctgtat

SEQ ID NO: 413855 - DNA, 16 bp, M. musculus
gctgctgctgcttcct

SEQ ID NO: 413856 - DNA, 16 bp, M. musculus
gctgctgctgcttctg

SEQ ID NO: 413857 - DNA, 16 bp, M. musculus
gctgctgctgcttctt

SEQ ID NO: 413858 - DNA, 16 bp, M. musculus
gctgctgctgcttttg

SEQ ID NO: 413859 - DNA, 16 bp, M. musculus
gctgctgctgtccttg

SEQ ID NO: 413860 - DNA, 16 bp, M. musculus
gctgctgctgtctctg

SEQ ID NO: 413861 - DNA, 16 bp, M. musculus
gctgctgctgtggcct

SEQ ID NO: 413862 - DNA, 16 bp, M. musculus
gctgctgctgtggctc

SEQ ID NO: 413863 - DNA, 16 bp, M. musculus
gctgctgctgtggctg

SEQ ID NO: 413864 - DNA, 17 bp, M. musculus
gctgctgctgtggctta

SEQ ID NO: 413865 - DNA, 16 bp, M. musculus
gctgctgctgtgtgct

SEQ ID NO: 413866 - DNA, 16 bp, M. musculus
gctgctgctgttcctc

SEQ ID NO: 413867 - DNA, 16 bp, M. musculus
gctgctgctgttgctc

SEQ ID NO: 413868 - DNA, 16 bp, M. musculus
gctgctgctgttgctg

SEQ ID NO: 413869 - DNA, 17 bp, M. musculus
gctgctgctgttgctgt

SEQ ID NO: 413870 - DNA, 16 bp, M. musculus
gctgctgctgttgctt

SEQ ID NO: 413871 - DNA, 16 bp, M. musculus
gctgctgctgttgttg

SEQ ID NO: 413872 - DNA, 16 bp, M. musculus
gctgctgctgtttgtt

SEQ ID NO: 413873 - DNA, 16 bp, M. musculus
gctgctgctgttttct

SEQ ID NO: 413874 - DNA, 16 bp, M. musculus
gctgctgcttcctcct

SEQ ID NO: 413875 - DNA, 16 bp, M. musculus
gctgctgcttctcctt

SEQ ID NO: 413876 - DNA, 17 bp, M. musculus
gctgctgcttctgctgc

SEQ ID NO: 413877 - DNA, 16 bp, M. musculus
gctgctgcttcttctt

SEQ ID NO: 413878 - DNA, 16 bp, M. musculus
gctgctggacagctac

SEQ ID NO: 413879 - DNA, 16 bp, M. musculus
gctgctggcccagatc

SEQ ID NO: 413880 - DNA, 16 bp, M. musculus
gctgctggctgctgtg

SEQ ID NO: 413881 - DNA, 16 bp, M. musculus
gctgctgggaaccaaa

SEQ ID NO: 413882 - DNA, 16 bp, M. musculus
gctgctgggagaggaa

SEQ ID NO: 413883 - DNA, 16 bp, M. musculus
gctgctgggagaggga

SEQ ID NO: 413884 - DNA, 16 bp, M. musculus
gctgctgggcatccag

SEQ ID NO: 413885 - DNA, 16 bp, M. musculus
gctgctgggcatggtg

SEQ ID NO: 413886 - DNA, 16 bp, M. musculus
gctgctgggctgctgg

SEQ ID NO: 413887 - DNA, 16 bp, M. musculus
gctgctggggaagaaa

SEQ ID NO: 413888 - DNA, 16 bp, M. musculus
gctgctggggctgctg

SEQ ID NO: 413889 - DNA, 16 bp, M. musculus
gctgctggtcaggcag

SEQ ID NO: 413890 - DNA, 16 bp, M. musculus
gctgctggtgctgctg

SEQ ID NO: 413891 - DNA, 17 bp, M. musculus
gctgctggtggaagact

SEQ ID NO: 413892 - DNA, 16 bp, M. musculus
gctgctggtggtgctg

SEQ ID NO: 413893 - DNA, 16 bp, M. musculus
gctgctggttcgtgcc

SEQ ID NO: 413894 - DNA, 16 bp, M. musculus
gctgctgtaccagatg

SEQ ID NO: 413895 - DNA, 16 bp, M. musculus
gctgctgtgcaggctg

SEQ ID NO: 413896 - DNA, 18 bp, M. musculus
gctgctgtgcaggctgct

SEQ ID NO: 413897 - DNA, 16 bp, M. musculus
gctgctgtgcctggct

SEQ ID NO: 413898 - DNA, 17 bp, M. musculus
gctgctgtgcgcgtccc

SEQ ID NO: 413899 - DNA, 16 bp, M. musculus
gctgctgtgggtgctg

SEQ ID NO: 413900 - DNA, 16 bp, M. musculus
gctgctgttgctgcta

SEQ ID NO: 413901 - DNA, 16 bp, M. musculus
gctgctgttgctgctt

SEQ ID NO: 413902 - DNA, 16 bp, M. musculus
gctgctgttgctgttt

SEQ ID NO: 413903 - DNA, 16 bp, M. musculus
gctgcttactggctca

SEQ ID NO: 413904 - DNA, 16 bp, M. musculus
gctgcttcagactgtc

SEQ ID NO: 413905 - DNA, 16 bp, M. musculus
gctgcttcctctgcct

SEQ ID NO: 413906 - DNA, 16 bp, M. musculus
gctgcttcctgtcatt

SEQ ID NO: 413907 - DNA, 16 bp, M. musculus
gctgcttctccttcct

SEQ ID NO: 413908 - DNA, 16 bp, M. musculus
gctgcttctgcagcct

SEQ ID NO: 413909 - DNA, 16 bp, M. musculus
gctgcttctgggtctc

SEQ ID NO: 413910 - DNA, 16 bp, M. musculus
gctgcttctgtctatt

SEQ ID NO: 413911 - DNA, 16 bp, M. musculus
gctgcttcttcctccc

SEQ ID NO: 413912 - DNA, 16 bp, M. musculus
gctgcttcttgggtct

SEQ ID NO: 413913 - DNA, 16 bp, M. musculus
gctgcttgcctcctcc

SEQ ID NO: 413914 - DNA, 16 bp, M. musculus
gctgcttgcctggtga

SEQ ID NO: 413915 - DNA, 16 bp, M. musculus
gctgcttgctgggcct

SEQ ID NO: 413916 - DNA, 16 bp, M. musculus
gctgcttgctgggtct

SEQ ID NO: 413917 - DNA, 16 bp, M. musculus
gctgcttggccccacc

SEQ ID NO: 413918 - DNA, 16 bp, M. musculus
gctgcttgtccagagg

SEQ ID NO: 413919 - DNA, 16 bp, M. musculus
gctgctttctgctgag

SEQ ID NO: 413920 - DNA, 16 bp, M. musculus
gctgcttttaatattt

SEQ ID NO: 413921 - DNA, 16 bp, M. musculus
gctgcttttggctttt

SEQ ID NO: 413922 - DNA, 16 bp, M. musculus
gctgctttttgccttt

SEQ ID NO: 413923 - DNA, 16 bp, M. musculus
gctgctttttgggtct

SEQ ID NO: 413924 - DNA, 16 bp, M. musculus
gctgctttttgtcctt

SEQ ID NO: 413925 - DNA, 16 bp, M. musculus
gctggaaaacagcttt

SEQ ID NO: 413926 - DNA, 16 bp, M. musculus
gctggaaaaggagctg

SEQ ID NO: 413927 - DNA, 16 bp, M. musculus
gctggaaaataaacct

SEQ ID NO: 413928 - DNA, 16 bp, M. musculus
gctggaaacagcccag

SEQ ID NO: 413929 - DNA, 52 bp, M. musculus
gctggaaagaacctagatgcccctcaacagaggaatggatacagaaaatgtg

SEQ ID NO: 413930 - DNA, 16 bp, M. musculus
gctggaaagacggctc

SEQ ID NO: 413931 - DNA, 16 bp, M. musculus
gctggaaagatgggtc

SEQ ID NO: 413932 - DNA, 16 bp, M. musculus
gctggaaagctggctc

SEQ ID NO: 413933 - DNA, 16 bp, M. musculus
gctggaaattgaactt

SEQ ID NO: 413934 - DNA, 16 bp, M. musculus
gctggaagaaactgag

SEQ ID NO: 413935 - DNA, 16 bp, M. musculus
gctggaagaagcagag

SEQ ID NO: 413936 - DNA, 16 bp, M. musculus
gctggaagaagctgag

SEQ ID NO: 413937 - DNA, 16 bp, M. musculus
gctggaagaatctgag

SEQ ID NO: 413938 - DNA, 16 bp, M. musculus
gctggaagaggctgag

SEQ ID NO: 413939 - DNA, 16 bp, M. musculus
gctggaaggagagaac

SEQ ID NO: 413940 - DNA, 16 bp, M. musculus
gctggaaggagctgag

SEQ ID NO: 413941 - DNA, 16 bp, M. musculus
gctggaaggatggctc

SEQ ID NO: 413942 - DNA, 16 bp, M. musculus
gctggaatgacacacc

SEQ ID NO: 413943 - DNA, 16 bp, M. musculus
gctggaattacaagca

SEQ ID NO: 413944 - DNA, 16 bp, M. musculus
gctggacagtggtggt

SEQ ID NO: 413945 - DNA, 16 bp, M. musculus
gctggacatggtggtg

SEQ ID NO: 413946 - DNA, 16 bp, M. musculus
gctggaccccagaaaa

SEQ ID NO: 413947 - DNA, 18 bp, M. musculus
gctggacctaagacagtg

SEQ ID NO: 413948 - DNA, 16 bp, M. musculus
gctggacgaggtgagc

SEQ ID NO: 413949 - DNA, 16 bp, M. musculus
gctggacggtggtggc

SEQ ID NO: 413950 - DNA, 16 bp, M. musculus
gctggactatgaggag

SEQ ID NO: 413951 - DNA, 16 bp, M. musculus
gctggactctaaggag

SEQ ID NO: 413952 - DNA, 16 bp, M. musculus
gctggactgcagcctg

SEQ ID NO: 413953 - DNA, 16 bp, M. musculus
gctggactggcagcag

SEQ ID NO: 413954 - DNA, 16 bp, M. musculus
gctggacttgaacttg

SEQ ID NO: 413955 - DNA, 16 bp, M. musculus
gctggagaaagaaacc

SEQ ID NO: 413956 - DNA, 16 bp, M. musculus
gctggagaaatgactc

SEQ ID NO: 413957 - DNA, 16 bp, M. musculus
gctggagaaatggttc

SEQ ID NO: 413958 - DNA, 16 bp, M. musculus
gctggagaaatgtctc

SEQ ID NO: 413959 - DNA, 16 bp, M. musculus
gctggagaagagagcc

SEQ ID NO: 413960 - DNA, 16 bp, M. musculus
gctggagaaggagatg

SEQ ID NO: 413961 - DNA, 35 bp, M. musculus
gctggagaagtgacccaagcccttggaggagccca

SEQ ID NO: 413962 - DNA, 41 bp, M. musculus
gctggagaagtgacccaagcccttggaggagcccagaagat

SEQ ID NO: 413963 - DNA, 16 bp, M. musculus
gctggagaattggctc

SEQ ID NO: 413964 - DNA, 16 bp, M. musculus
gctggagacctggctc

SEQ ID NO: 413965 - DNA, 16 bp, M. musculus
gctggagagaaggctc

SEQ ID NO: 413966 - DNA, 16 bp, M. musculus
gctggagagacagccc

SEQ ID NO: 413967 - DNA, 16 bp, M. musculus
gctggagagagagatg

SEQ ID NO: 413968 - DNA, 16 bp, M. musculus
gctggagagagagctc

SEQ ID NO: 413969 - DNA, 16 bp, M. musculus
gctggagagagctcag

SEQ ID NO: 413970 - DNA, 16 bp, M. musculus
gctggagagatagatg

SEQ ID NO: 413971 - DNA, 17 bp, M. musculus
gctggagagatgactcc

SEQ ID NO: 413972 - DNA, 16 bp, M. musculus
gctggagagatgattc

SEQ ID NO: 413973 - DNA, 16 bp, M. musculus
gctggagagatggcta

SEQ ID NO: 413974 - DNA, 18 bp, M. musculus
gctggagagatggctcac

SEQ ID NO: 413975 - DNA, 16 bp, M. musculus
gctggagagatggctg

SEQ ID NO: 413976 - DNA, 16 bp, M. musculus
gctggagagatggctt

SEQ ID NO: 413977 - DNA, 16 bp, M. musculus
gctggagagatggtgg

SEQ ID NO: 413978 - DNA, 16 bp, M. musculus
gctggagagatggttc

SEQ ID NO: 413979 - DNA, 16 bp, M. musculus
gctggagagccagctc

SEQ ID NO: 413980 - DNA, 16 bp, M. musculus
gctggagaggcacata

SEQ ID NO: 413981 - DNA, 16 bp, M. musculus
gctggagaggcagaga

SEQ ID NO: 413982 - DNA, 16 bp, M. musculus
gctggagaggcagctc

SEQ ID NO: 413983 - DNA, 16 bp, M. musculus
gctggagagggagaga

SEQ ID NO: 413984 - DNA, 16 bp, M. musculus
gctggagagggggctc

SEQ ID NO: 413985 - DNA, 16 bp, M. musculus
gctggagagttggctc

SEQ ID NO: 413986 - DNA, 16 bp, M. musculus
gctggagatggagctg

SEQ ID NO: 413987 - DNA, 16 bp, M. musculus
gctggagatgtggctc

SEQ ID NO: 413988 - DNA, 16 bp, M. musculus
gctggagcacacaggt

SEQ ID NO: 413989 - DNA, 16 bp, M. musculus
gctggagcaggagctg

SEQ ID NO: 413990 - DNA, 16 bp, M. musculus
gctggagccacaggtc

SEQ ID NO: 413991 - DNA, 16 bp, M. musculus
gctggagccatgggta

SEQ ID NO: 413992 - DNA, 16 bp, M. musculus
gctggagctacagatg

SEQ ID NO: 413993 - DNA, 16 bp, M. musculus
gctggagctgatgcag

SEQ ID NO: 413994 - DNA, 16 bp, M. musculus
gctggagctgcaggtg

SEQ ID NO: 413995 - DNA, 16 bp, M. musculus
gctggagctggggctg

SEQ ID NO: 413996 - DNA, 16 bp, M. musculus
gctggagctgtgtgtg

SEQ ID NO: 413997 - DNA, 16 bp, M. musculus
gctggaggagctgagt

SEQ ID NO: 413998 - DNA, 17 bp, M. musculus
gctggaggagctggagg

SEQ ID NO: 413999 - DNA, 16 bp, M. musculus
gctggaggaggagctg

SEQ ID NO: 414000 - DNA, 16 bp, M. musculus
gctggaggaggcaacc

SEQ ID NO: 414001 - DNA, 16 bp, M. musculus
gctggagggctggagg

SEQ ID NO: 414002 - DNA, 16 bp, M. musculus
gctggaggggctgaga

SEQ ID NO: 414003 - DNA, 16 bp, M. musculus
gctggaggtgggctct

SEQ ID NO: 414004 - DNA, 16 bp, M. musculus
gctggagtgaccctga

SEQ ID NO: 414005 - DNA, 16 bp, M. musculus
gctggagtgatggctc

SEQ ID NO: 414006 - DNA, 16 bp, M. musculus
gctggagtgcaggaag

SEQ ID NO: 414007 - DNA, 16 bp, M. musculus
gctggagtggtggctc

SEQ ID NO: 414008 - DNA, 16 bp, M. musculus
gctggagttaaaggcg

SEQ ID NO: 414009 - DNA, 34 bp, M. musculus
gctggagttaccacagagaaaggagcttcagttg

SEQ ID NO: 414010 - DNA, 16 bp, M. musculus
gctggagttatcacag

SEQ ID NO: 414011 - DNA, 22 bp, M. musculus
gctggagttatcatagagaaag

SEQ ID NO: 414012 - DNA, 16 bp, M. musculus
gctggataaaaaatta

SEQ ID NO: 414013 - DNA, 16 bp, M. musculus
gctggatatataatta

SEQ ID NO: 414014 - DNA, 16 bp, M. musculus
gctggatccttctcag

SEQ ID NO: 414015 - DNA, 16 bp, M. musculus
gctggatctcatagag

SEQ ID NO: 414016 - DNA, 16 bp, M. musculus
gctggatctttgagaa

SEQ ID NO: 414017 - DNA, 16 bp, M. musculus
gctggatgaggcaacc

SEQ ID NO: 414018 - DNA, 16 bp, M. musculus
gctggatgcagtggtg

SEQ ID NO: 414019 - DNA, 16 bp, M. musculus
gctggatggatggatg

SEQ ID NO: 414020 - DNA, 16 bp, M. musculus
gctggatggtcaggga

SEQ ID NO: 414021 - DNA, 16 bp, M. musculus
gctggattacagtttc

SEQ ID NO: 414022 - DNA, 16 bp, M. musculus
gctggattctctggta

SEQ ID NO: 414023 - DNA, 16 bp, M. musculus
gctggattggtggaaa

SEQ ID NO: 414024 - DNA, 16 bp, M. musculus
gctggcaagacagctc

SEQ ID NO: 414025 - DNA, 16 bp, M. musculus
gctggcaaggaagccc

SEQ ID NO: 414026 - DNA, 16 bp, M. musculus
gctggcacagctggtg

SEQ ID NO: 414027 - DNA, 16 bp, M. musculus
gctggcactgaccgga

SEQ ID NO: 414028 - DNA, 16 bp, M. musculus
gctggcagacatggtg

SEQ ID NO: 414029 - DNA, 16 bp, M. musculus
gctggcagctctgcct

SEQ ID NO: 414030 - DNA, 16 bp, M. musculus
gctggcaggctgacca

SEQ ID NO: 414031 - DNA, 16 bp, M. musculus
gctggcattacaggtg

SEQ ID NO: 414032 - DNA, 16 bp, M. musculus
gctggccaattggagt

SEQ ID NO: 414033 - DNA, 16 bp, M. musculus
gctggccactcccaca

SEQ ID NO: 414034 - DNA, 16 bp, M. musculus
gctggccagacagcct

SEQ ID NO: 414035 - DNA, 16 bp, M. musculus
gctggccagcaagctc

SEQ ID NO: 414036 - DNA, 16 bp, M. musculus
gctggccagccagcct

SEQ ID NO: 414037 - DNA, 16 bp, M. musculus
gctggccaggcagcct

SEQ ID NO: 414038 - DNA, 16 bp, M. musculus
gctggccagggagccc

SEQ ID NO: 414039 - DNA, 16 bp, M. musculus
gctggccagtcagcct

SEQ ID NO: 414040 - DNA, 16 bp, M. musculus
gctggccagtgagcct

SEQ ID NO: 414041 - DNA, 16 bp, M. musculus
gctggccatctccccc

SEQ ID NO: 414042 - DNA, 16 bp, M. musculus
gctggccatgaacttg

SEQ ID NO: 414043 - DNA, 16 bp, M. musculus
gctggccatgaattca

SEQ ID NO: 414044 - DNA, 16 bp, M. musculus
gctggcccagaactca

SEQ ID NO: 414045 - DNA, 16 bp, M. musculus
gctggcccagatcact

SEQ ID NO: 414046 - DNA, 16 bp, M. musculus
gctggccccaaattca

SEQ ID NO: 414047 - DNA, 16 bp, M. musculus
gctggccctgaactcc

SEQ ID NO: 414048 - DNA, 16 bp, M. musculus
gctggccctgagctca

SEQ ID NO: 414049 - DNA, 16 bp, M. musculus
gctggccctggtggag

SEQ ID NO: 414050 - DNA, 16 bp, M. musculus
gctggccctggtggtg

SEQ ID NO: 414051 - DNA, 16 bp, M. musculus
gctggccgtgaactca

SEQ ID NO: 414052 - DNA, 16 bp, M. musculus
gctggcctacaactca

SEQ ID NO: 414053 - DNA, 16 bp, M. musculus
gctggcctagaattca

SEQ ID NO: 414054 - DNA, 16 bp, M. musculus
gctggcctagatctca

SEQ ID NO: 414055 - DNA, 16 bp, M. musculus
gctggcctcaaattta

SEQ ID NO: 414056 - DNA, 16 bp, M. musculus
gctggcctcacactca

SEQ ID NO: 414057 - DNA, 16 bp, M. musculus
gctggcctccaaatca

SEQ ID NO: 414058 - DNA, 16 bp, M. musculus
gctggcctccaattca

SEQ ID NO: 414059 - DNA, 16 bp, M. musculus
gctggcctcgatctca

SEQ ID NO: 414060 - DNA, 16 bp, M. musculus
gctggcctctacttcc

SEQ ID NO: 414061 - DNA, 16 bp, M. musculus
gctggcctctacttct

SEQ ID NO: 414062 - DNA, 16 bp, M. musculus
gctggcctctgccttc

SEQ ID NO: 414063 - DNA, 16 bp, M. musculus
gctggcctctgcttcc

SEQ ID NO: 414064 - DNA, 20 bp, M. musculus
gctggcctctgtattccaca

SEQ ID NO: 414065 - DNA, 16 bp, M. musculus
gctggcctctgtctct

SEQ ID NO: 414066 - DNA, 16 bp, M. musculus
gctggcctgaaactca

SEQ ID NO: 414067 - DNA, 16 bp, M. musculus
gctggcctgcagctct

SEQ ID NO: 414068 - DNA, 16 bp, M. musculus
gctggcctggaactgg

SEQ ID NO: 414069 - DNA, 16 bp, M. musculus
gctggcctggaagttg

SEQ ID NO: 414070 - DNA, 16 bp, M. musculus
gctggcctggaatcca

SEQ ID NO: 414071 - DNA, 16 bp, M. musculus
gctggcctggctggcc

SEQ ID NO: 414072 - DNA, 16 bp, M. musculus
gctggcctggtactca

SEQ ID NO: 414073 - DNA, 17 bp, M. musculus
gctggcctggtctacag

SEQ ID NO: 414074 - DNA, 16 bp, M. musculus
gctggccttgaacacc

SEQ ID NO: 414075 - DNA, 16 bp, M. musculus
gctggccttgaacctg

SEQ ID NO: 414076 - DNA, 16 bp, M. musculus
gctggccttgaacgca

SEQ ID NO: 414077 - DNA, 16 bp, M. musculus
gctggccttgaactaa

SEQ ID NO: 414078 - DNA, 16 bp, M. musculus
gctggccttgaactct

SEQ ID NO: 414079 - DNA, 16 bp, M. musculus
gctggccttgaacttc

SEQ ID NO: 414080 - DNA, 16 bp, M. musculus
gctggccttgaacttg

SEQ ID NO: 414081 - DNA, 16 bp, M. musculus
gctggccttgaacttt

SEQ ID NO: 414082 - DNA, 16 bp, M. musculus
gctggccttgaagtca

SEQ ID NO: 414083 - DNA, 16 bp, M. musculus
gctggccttgaagttg

SEQ ID NO: 414084 - DNA, 16 bp, M. musculus
gctggccttgaattca

SEQ ID NO: 414085 - DNA, 16 bp, M. musculus
gctggccttggacttg

SEQ ID NO: 414086 - DNA, 16 bp, M. musculus
gctggcgaggtggctc

SEQ ID NO: 414087 - DNA, 16 bp, M. musculus
gctggctagccagcct

SEQ ID NO: 414088 - DNA, 16 bp, M. musculus
gctggctcacccatgc

SEQ ID NO: 414089 - DNA, 16 bp, M. musculus
gctggctctggtggca

SEQ ID NO: 414090 - DNA, 16 bp, M. musculus
gctggctgatcacatt

SEQ ID NO: 414091 - DNA, 16 bp, M. musculus
gctggctgccttgtct

SEQ ID NO: 414092 - DNA, 16 bp, M. musculus
gctggctgctggctgc

SEQ ID NO: 414093 - DNA, 16 bp, M. musculus
gctggctggccagcag

SEQ ID NO: 414094 - DNA, 16 bp, M. musculus
gctggctggcctggaa

SEQ ID NO: 414095 - DNA, 16 bp, M. musculus
gctggctggctgactg

SEQ ID NO: 414096 - DNA, 16 bp, M. musculus
gctggctggctgcctg

SEQ ID NO: 414097 - DNA, 16 bp, M. musculus
gctggctggctggatg

SEQ ID NO: 414098 - DNA, 16 bp, M. musculus
gctggctggctggctt

SEQ ID NO: 414099 - DNA, 16 bp, M. musculus
gctggctgtctgcggc

SEQ ID NO: 414100 - DNA, 16 bp, M. musculus
gctggctgtgccccag

SEQ ID NO: 414101 - DNA, 16 bp, M. musculus
gctggctgtggtggca

SEQ ID NO: 414102 - DNA, 16 bp, M. musculus
gctggcttcaaattca

SEQ ID NO: 414103 - DNA, 16 bp, M. musculus
gctggcttccactggc

SEQ ID NO: 414104 - DNA, 16 bp, M. musculus
gctggcttcctgagct

SEQ ID NO: 414105 - DNA, 16 bp, M. musculus
gctggcttggaactct

SEQ ID NO: 414106 - DNA, 16 bp, M. musculus
gctggctttgaaatca

SEQ ID NO: 414107 - DNA, 16 bp, M. musculus
gctgggaacacagaga

SEQ ID NO: 414108 - DNA, 16 bp, M. musculus
gctgggaactgaacct

SEQ ID NO: 414109 - DNA, 16 bp, M. musculus
gctgggaagacagctc

SEQ ID NO: 414110 - DNA, 16 bp, M. musculus
gctgggaagatgactc

SEQ ID NO: 414111 - DNA, 16 bp, M. musculus
gctgggaagatgtctc

SEQ ID NO: 414112 - DNA, 16 bp, M. musculus
gctgggaagcagagag

SEQ ID NO: 414113 - DNA, 16 bp, M. musculus
gctgggaagcaggagt

SEQ ID NO: 414114 - DNA, 16 bp, M. musculus
gctgggaaggatgtgg

SEQ ID NO: 414115 - DNA, 16 bp, M. musculus
gctgggaatacaggca

SEQ ID NO: 414116 - DNA, 16 bp, M. musculus
gctgggaatgtggctc

SEQ ID NO: 414117 - DNA, 16 bp, M. musculus
gctgggacatcttctg

SEQ ID NO: 414118 - DNA, 16 bp, M. musculus
gctgggaccacaggtg

SEQ ID NO: 414119 - DNA, 16 bp, M. musculus
gctgggagaacctgga

SEQ ID NO: 414120 - DNA, 16 bp, M. musculus
gctgggagagagctgg

SEQ ID NO: 414121 - DNA, 16 bp, M. musculus
gctgggaggagctggg

SEQ ID NO: 414122 - DNA, 16 bp, M. musculus
gctgggaggagtggag

SEQ ID NO: 414123 - DNA, 16 bp, M. musculus
gctgggaggctggaga

SEQ ID NO: 414124 - DNA, 16 bp, M. musculus
gctgggagtcctgggt

SEQ ID NO: 414125 - DNA, 16 bp, M. musculus
gctgggatcccaggtg

SEQ ID NO: 414126 - DNA, 16 bp, M. musculus
gctgggatctcaggca

SEQ ID NO: 414127 - DNA, 16 bp, M. musculus
gctgggattaaacaca

SEQ ID NO: 414128 - DNA, 16 bp, M. musculus
gctgggattaaagcca

SEQ ID NO: 414129 - DNA, 16 bp, M. musculus
gctgggattaaatgcc

SEQ ID NO: 414130 - DNA, 16 bp, M. musculus
gctgggattacagcca

SEQ ID NO: 414131 - DNA, 16 bp, M. musculus
gctgggattacaggta

SEQ ID NO: 414132 - DNA, 16 bp, M. musculus
gctgggattagaggag

SEQ ID NO: 414133 - DNA, 16 bp, M. musculus
gctgggattccaggct

SEQ ID NO: 414134 - DNA, 16 bp, M. musculus
gctgggatttgaacac

SEQ ID NO: 414135 - DNA, 16 bp, M. musculus
gctgggatttgaaccc

SEQ ID NO: 414136 - DNA, 16 bp, M. musculus
gctgggcactggtggc

SEQ ID NO: 414137 - DNA, 16 bp, M. musculus
gctgggcagaagagaa

SEQ ID NO: 414138 - DNA, 16 bp, M. musculus
gctgggcagacacctc

SEQ ID NO: 414139 - DNA, 16 bp, M. musculus
gctgggcagggagatg

SEQ ID NO: 414140 - DNA, 16 bp, M. musculus
gctgggcagtgatggc

SEQ ID NO: 414141 - DNA, 16 bp, M. musculus
gctgggcagtggcagc

SEQ ID NO: 414142 - DNA, 16 bp, M. musculus
gctgggcagtggtagc

SEQ ID NO: 414143 - DNA, 16 bp, M. musculus
gctgggcagtggtggc

SEQ ID NO: 414144 - DNA, 16 bp, M. musculus
gctgggcattgtggtg

SEQ ID NO: 414145 - DNA, 16 bp, M. musculus
gctgggcccctgggag

SEQ ID NO: 414146 - DNA, 16 bp, M. musculus
gctgggcctcagggca

SEQ ID NO: 414147 - DNA, 16 bp, M. musculus
gctgggcctgggcctg

SEQ ID NO: 414148 - DNA, 16 bp, M. musculus
gctgggcctggtgaca

SEQ ID NO: 414149 - DNA, 16 bp, M. musculus
gctgggcctggtggtg

SEQ ID NO: 414150 - DNA, 16 bp, M. musculus
gctgggcgtggtgaca

SEQ ID NO: 414151 - DNA, 16 bp, M. musculus
gctgggctgctgggct

SEQ ID NO: 414152 - DNA, 16 bp, M. musculus
gctgggctggcagcag

SEQ ID NO: 414153 - DNA, 16 bp, M. musculus
gctgggctgggctgtg

SEQ ID NO: 414154 - DNA, 16 bp, M. musculus
gctgggcttggtggcg

SEQ ID NO: 414155 - DNA, 16 bp, M. musculus
gctggggaaactgagg

SEQ ID NO: 414156 - DNA, 16 bp, M. musculus
gctggggacatggctc

SEQ ID NO: 414157 - DNA, 16 bp, M. musculus
gctggggagatagctc

SEQ ID NO: 414158 - DNA, 16 bp, M. musculus
gctggggagatgcctc

SEQ ID NO: 414159 - DNA, 16 bp, M. musculus
gctggggagcaaaaag

SEQ ID NO: 414160 - DNA, 16 bp, M. musculus
gctggggaggcagctc

SEQ ID NO: 414161 - DNA, 16 bp, M. musculus
gctggggaggtggcct

SEQ ID NO: 414162 - DNA, 16 bp, M. musculus
gctggggatgaaaccc

SEQ ID NO: 414163 - DNA, 16 bp, M. musculus
gctggggatggaacct

SEQ ID NO: 414164 - DNA, 16 bp, M. musculus
gctggggatgtggctc

SEQ ID NO: 414165 - DNA, 16 bp, M. musculus
gctggggcagacccct

SEQ ID NO: 414166 - DNA, 16 bp, M. musculus
gctggggcagactgct

SEQ ID NO: 414167 - DNA, 16 bp, M. musculus
gctggggcagggggta

SEQ ID NO: 414168 - DNA, 16 bp, M. musculus
gctggggcccagcaaa

SEQ ID NO: 414169 - DNA, 16 bp, M. musculus
gctggggccgagactc

SEQ ID NO: 414170 - DNA, 16 bp, M. musculus
gctggggcctgtggcc

SEQ ID NO: 414171 - DNA, 16 bp, M. musculus
gctggggctaaaggca

SEQ ID NO: 414172 - DNA, 16 bp, M. musculus
gctggggctgaaaaga

SEQ ID NO: 414173 - DNA, 16 bp, M. musculus
gctggggctggggaga

SEQ ID NO: 414174 - DNA, 16 bp, M. musculus
gctggggctggtgaga

SEQ ID NO: 414175 - DNA, 16 bp, M. musculus
gctgggggaagggaag

SEQ ID NO: 414176 - DNA, 16 bp, M. musculus
gctgggggaatctgca

SEQ ID NO: 414177 - DNA, 16 bp, M. musculus
gctgggggctggtgag

SEQ ID NO: 414178 - DNA, 16 bp, M. musculus
gctggggtcaaaggca

SEQ ID NO: 414179 - DNA, 16 bp, M. musculus
gctggggtcacaggtg

SEQ ID NO: 414180 - DNA, 16 bp, M. musculus
gctggggttacaggca

SEQ ID NO: 414181 - DNA, 16 bp, M. musculus
gctggggttacaggtg

SEQ ID NO: 414182 - DNA, 16 bp, M. musculus
gctggggttataggca

SEQ ID NO: 414183 - DNA, 16 bp, M. musculus
gctggggttgcaggtg

SEQ ID NO: 414184 - DNA, 16 bp, M. musculus
gctgggtcttatggag

SEQ ID NO: 414185 - DNA, 16 bp, M. musculus
gctgggtcttcaggaa

SEQ ID NO: 414186 - DNA, 16 bp, M. musculus
gctgggtcttggggta

SEQ ID NO: 414187 - DNA, 16 bp, M. musculus
gctgggtggctcacaa

SEQ ID NO: 414188 - DNA, 16 bp, M. musculus
gctgggtggtgatggc

SEQ ID NO: 414189 - DNA, 16 bp, M. musculus
gctgggtgtggcagca

SEQ ID NO: 414190 - DNA, 16 bp, M. musculus
gctgggtttcctgctt

SEQ ID NO: 414191 - DNA, 17 bp, M. musculus
gctggtacaaaccttgt

SEQ ID NO: 414192 - DNA, 16 bp, M. musculus
gctggtacagaccttg

SEQ ID NO: 414193 - DNA, 16 bp, M. musculus
gctggtaccaatttgt

SEQ ID NO: 414194 - DNA, 16 bp, M. musculus
gctggtagagaatttt

SEQ ID NO: 414195 - DNA, 17 bp, M. musculus
gctggtagaggacatca

SEQ ID NO: 414196 - DNA, 21 bp, M. musculus
gctggtagtcttagttctata

SEQ ID NO: 414197 - DNA, 16 bp, M. musculus
gctggtcacactgtat

SEQ ID NO: 414198 - DNA, 16 bp, M. musculus
gctggtcagtggtggc

SEQ ID NO: 414199 - DNA, 16 bp, M. musculus
gctggtcattgttgta

SEQ ID NO: 414200 - DNA, 16 bp, M. musculus
gctggtccaaggcccc

SEQ ID NO: 414201 - DNA, 16 bp, M. musculus
gctggtcctgcagatc

SEQ ID NO: 414202 - DNA, 16 bp, M. musculus
gctggtctcaaactcc

SEQ ID NO: 414203 - DNA, 16 bp, M. musculus
gctggtctcaaactct

SEQ ID NO: 414204 - DNA, 16 bp, M. musculus
gctggtctcccaggac

SEQ ID NO: 414205 - DNA, 16 bp, M. musculus
gctggtctgcagagtg

SEQ ID NO: 414206 - DNA, 16 bp, M. musculus
gctggtctggaactcc

SEQ ID NO: 414207 - DNA, 16 bp, M. musculus
gctggtctggaactct

SEQ ID NO: 414208 - DNA, 17 bp, M. musculus
gctggtcttgaactcac

SEQ ID NO: 414209 - DNA, 16 bp, M. musculus
gctggtcttgaattca

SEQ ID NO: 414210 - DNA, 16 bp, M. musculus
gctggtctttgctggt

SEQ ID NO: 414211 - DNA, 16 bp, M. musculus
gctggtgaagatgtaa

SEQ ID NO: 414212 - DNA, 16 bp, M. musculus
gctggtgaatgctgcc

SEQ ID NO: 414213 - DNA, 16 bp, M. musculus
gctggtgacatggctc

SEQ ID NO: 414214 - DNA, 16 bp, M. musculus
gctggtgagagggctc

SEQ ID NO: 414215 - DNA, 16 bp, M. musculus
gctggtgagatggctt

SEQ ID NO: 414216 - DNA, 16 bp, M. musculus
gctggtgagatgggtc

SEQ ID NO: 414217 - DNA, 16 bp, M. musculus
gctggtgagcaggggg

SEQ ID NO: 414218 - DNA, 16 bp, M. musculus
gctggtgagctggctc

SEQ ID NO: 414219 - DNA, 16 bp, M. musculus
gctggtgcagaccaga

SEQ ID NO: 414220 - DNA, 16 bp, M. musculus
gctggtgctgatgctg

SEQ ID NO: 414221 - DNA, 16 bp, M. musculus
gctggtgctgctggtg

SEQ ID NO: 414222 - DNA, 16 bp, M. musculus
gctggtggccagcaag

SEQ ID NO: 414223 - DNA, 16 bp, M. musculus
gctggtgggatggctc

SEQ ID NO: 414224 - DNA, 16 bp, M. musculus
gctggtgggctgacca

SEQ ID NO: 414225 - DNA, 16 bp, M. musculus
gctggtggggatgtgg

SEQ ID NO: 414226 - DNA, 16 bp, M. musculus
gctggtgggggtgcaa

SEQ ID NO: 414227 - DNA, 16 bp, M. musculus
gctggtggtcctggct

SEQ ID NO: 414228 - DNA, 16 bp, M. musculus
gctggtggtgcacacc

SEQ ID NO: 414229 - DNA, 16 bp, M. musculus
gctggtgtgtgctgtc

SEQ ID NO: 414230 - DNA, 16 bp, M. musculus
gctggtgtgttcacag

SEQ ID NO: 414231 - DNA, 16 bp, M. musculus
gctggttatagtagtc

SEQ ID NO: 414232 - DNA, 16 bp, M. musculus
gctggttcctgctgct

SEQ ID NO: 414233 - DNA, 16 bp, M. musculus
gctggttctttgaaag

SEQ ID NO: 414234 - DNA, 16 bp, M. musculus
gctggttgatatccat

SEQ ID NO: 414235 - DNA, 16 bp, M. musculus
gctgtaaagaagtcat

SEQ ID NO: 414236 - DNA, 16 bp, M. musculus
gctgtaacttcttcct

SEQ ID NO: 414237 - DNA, 16 bp, M. musculus
gctgtagagatggttc

SEQ ID NO: 414238 - DNA, 16 bp, M. musculus
gctgtagaggaatttt

SEQ ID NO: 414239 - DNA, 16 bp, M. musculus
gctgtagatggctttt

SEQ ID NO: 414240 - DNA, 16 bp, M. musculus
gctgtagctcagttgg

SEQ ID NO: 414241 - DNA, 18 bp, M. musculus
gctgtagctgtcttcaga

SEQ ID NO: 414242 - DNA, 16 bp, M. musculus
gctgtaggtatctgca

SEQ ID NO: 414243 - DNA, 16 bp, M. musculus
gctgtataataataaa

SEQ ID NO: 414244 - DNA, 16 bp, M. musculus
gctgtatagatttcat

SEQ ID NO: 414245 - DNA, 16 bp, M. musculus
gctgtatagtattcca

SEQ ID NO: 414246 - DNA, 16 bp, M. musculus
gctgtatccccagccc

SEQ ID NO: 414247 - DNA, 16 bp, M. musculus
gctgtatggaaggaaa

SEQ ID NO: 414248 - DNA, 16 bp, M. musculus
gctgtattaaaaaaaa

SEQ ID NO: 414249 - DNA, 16 bp, M. musculus
gctgtattaaaggatc

SEQ ID NO: 414250 - DNA, 16 bp, M. musculus
gctgtattgcagagca

SEQ ID NO: 414251 - DNA, 16 bp, M. musculus
gctgtatttctttacc

SEQ ID NO: 414252 - DNA, 21 bp, M. musculus
gctgtatttttagagatcagg

SEQ ID NO: 414253 - DNA, 16 bp, M. musculus
gctgtcacctgaactt

SEQ ID NO: 414254 - DNA, 16 bp, M. musculus
gctgtcacctgagtgt

SEQ ID NO: 414255 - DNA, 16 bp, M. musculus
gctgtcaggagcagac

SEQ ID NO: 414256 - DNA, 16 bp, M. musculus
gctgtcataaaacacc

SEQ ID NO: 414257 - DNA, 16 bp, M. musculus
gctgtcatcagagagg

SEQ ID NO: 414258 - DNA, 16 bp, M. musculus
gctgtcatgctcctgc

SEQ ID NO: 414259 - DNA, 16 bp, M. musculus
gctgtcatttgaattt

SEQ ID NO: 414260 - DNA, 16 bp, M. musculus
gctgtcatttgagttt

SEQ ID NO: 414261 - DNA, 16 bp, M. musculus
gctgtccagtgactgg

SEQ ID NO: 414262 - DNA, 16 bp, M. musculus
gctgtccctcccagaa

SEQ ID NO: 414263 - DNA, 16 bp, M. musculus
gctgtccctgactctg

SEQ ID NO: 414264 - DNA, 16 bp, M. musculus
gctgtccctgagcctg

SEQ ID NO: 414265 - DNA, 16 bp, M. musculus
gctgtcctagaactta

SEQ ID NO: 414266 - DNA, 16 bp, M. musculus
gctgtcctcaaactca

SEQ ID NO: 414267 - DNA, 16 bp, M. musculus
gctgtcctccagcctc

SEQ ID NO: 414268 - DNA, 16 bp, M. musculus
gctgtcctctgagggg

SEQ ID NO: 414269 - DNA, 16 bp, M. musculus
gctgtcctggaaccag

SEQ ID NO: 414270 - DNA, 16 bp, M. musculus
gctgtcctggaactga

SEQ ID NO: 414271 - DNA, 16 bp, M. musculus
gctgtcctggagatca

SEQ ID NO: 414272 - DNA, 17 bp, M. musculus
gctgtcctggagctcac

SEQ ID NO: 414273 - DNA, 16 bp, M. musculus
gctgtccttgaactcc

SEQ ID NO: 414274 - DNA, 16 bp, M. musculus
gctgtcctttgacttc

SEQ ID NO: 414275 - DNA, 16 bp, M. musculus
gctgtctagacagatt

SEQ ID NO: 414276 - DNA, 16 bp, M. musculus
gctgtctcagactctg

SEQ ID NO: 414277 - DNA, 16 bp, M. musculus
gctgtctcctcagagg

SEQ ID NO: 414278 - DNA, 16 bp, M. musculus
gctgtctcctgaggct

SEQ ID NO: 414279 - DNA, 16 bp, M. musculus
gctgtctcctgcagag

SEQ ID NO: 414280 - DNA, 16 bp, M. musculus
gctgtctctccagctc

SEQ ID NO: 414281 - DNA, 16 bp, M. musculus
gctgtctctccagtcc

SEQ ID NO: 414282 - DNA, 16 bp, M. musculus
gctgtctctgactgga

SEQ ID NO: 414283 - DNA, 16 bp, M. musculus
gctgtctgcagacaca

SEQ ID NO: 414284 - DNA, 16 bp, M. musculus
gctgtctgcagcccgc

SEQ ID NO: 414285 - DNA, 18 bp, M. musculus
gctgtctgtctgtctgtc

SEQ ID NO: 414286 - DNA, 16 bp, M. musculus
gctgtctgtgcacagc

SEQ ID NO: 414287 - DNA, 16 bp, M. musculus
gctgtctgtgttttcc

SEQ ID NO: 414288 - DNA, 16 bp, M. musculus
gctgtcttctggcctc

SEQ ID NO: 414289 - DNA, 16 bp, M. musculus
gctgtcttggaacttt

SEQ ID NO: 414290 - DNA, 16 bp, M. musculus
gctgtctttagataca

SEQ ID NO: 414291 - DNA, 16 bp, M. musculus
gctgtctttcttcaac

SEQ ID NO: 414292 - DNA, 16 bp, M. musculus
gctgtctttgactgtg

SEQ ID NO: 414293 - DNA, 16 bp, M. musculus
gctgtcttttccactg

SEQ ID NO: 414294 - DNA, 16 bp, M. musculus
gctgtgaacacacacc

SEQ ID NO: 414295 - DNA, 16 bp, M. musculus
gctgtgaaccctgtga

SEQ ID NO: 414296 - DNA, 16 bp, M. musculus
gctgtgaagagactcc

SEQ ID NO: 414297 - DNA, 16 bp, M. musculus
gctgtgagcatcaact

SEQ ID NO: 414298 - DNA, 16 bp, M. musculus
gctgtgagctaccatg

SEQ ID NO: 414299 - DNA, 16 bp, M. musculus
gctgtgagctgccttg

SEQ ID NO: 414300 - DNA, 16 bp, M. musculus
gctgtgagctgctgtg

SEQ ID NO: 414301 - DNA, 16 bp, M. musculus
gctgtgagggatgcag

SEQ ID NO: 414302 - DNA, 16 bp, M. musculus
gctgtgataagatacc

SEQ ID NO: 414303 - DNA, 16 bp, M. musculus
gctgtgcaagccaggg

SEQ ID NO: 414304 - DNA, 16 bp, M. musculus
gctgtgcacagacacc

SEQ ID NO: 414305 - DNA, 16 bp, M. musculus
gctgtgcagtgctgtg

SEQ ID NO: 414306 - DNA, 16 bp, M. musculus
gctgtgccagtgcctg

SEQ ID NO: 414307 - DNA, 16 bp, M. musculus
gctgtgcctctctcag

SEQ ID NO: 414308 - DNA, 16 bp, M. musculus
gctgtgccttccaggt

SEQ ID NO: 414309 - DNA, 16 bp, M. musculus
gctgtgctagaactca

SEQ ID NO: 414310 - DNA, 16 bp, M. musculus
gctgtgctgagctgtg

SEQ ID NO: 414311 - DNA, 16 bp, M. musculus
gctgtgctgtgctgcg

SEQ ID NO: 414312 - DNA, 16 bp, M. musculus
gctgtgctgtgctgct

SEQ ID NO: 414313 - DNA, 16 bp, M. musculus
gctgtgctgtgctgtg

SEQ ID NO: 414314 - DNA, 16 bp, M. musculus
gctgtgctgtgtgtgc

SEQ ID NO: 414315 - DNA, 16 bp, M. musculus
gctgtgcttccagagg

SEQ ID NO: 414316 - DNA, 16 bp, M. musculus
gctgtgcttctctcag

SEQ ID NO: 414317 - DNA, 16 bp, M. musculus
gctgtggaggagtgct

SEQ ID NO: 414318 - DNA, 16 bp, M. musculus
gctgtggcaaagccct

SEQ ID NO: 414319 - DNA, 16 bp, M. musculus
gctgtggcagagcctc

SEQ ID NO: 414320 - DNA, 16 bp, M. musculus
gctgtggcagctgtgg

SEQ ID NO: 414321 - DNA, 16 bp, M. musculus
gctgtggctaaaggaa

SEQ ID NO: 414322 - DNA, 16 bp, M. musculus
gctgtggctgaggctg

SEQ ID NO: 414323 - DNA, 16 bp, M. musculus
gctgtggctgctgctg

SEQ ID NO: 414324 - DNA, 16 bp, M. musculus
gctgtggctggagaga

SEQ ID NO: 414325 - DNA, 16 bp, M. musculus
gctgtggctgtggctg

SEQ ID NO: 414326 - DNA, 16 bp, M. musculus
gctgtgggcacagtag

SEQ ID NO: 414327 - DNA, 16 bp, M. musculus
gctgtgggcctctgta

SEQ ID NO: 414328 - DNA, 16 bp, M. musculus
gctgtgggggcggtaa

SEQ ID NO: 414329 - DNA, 16 bp, M. musculus
gctgtgggtatctgca

SEQ ID NO: 414330 - DNA, 16 bp, M. musculus
gctgtgggtgtctgca

SEQ ID NO: 414331 - DNA, 16 bp, M. musculus
gctgtggtaaaatact

SEQ ID NO: 414332 - DNA, 16 bp, M. musculus
gctgtggtgaccccca

SEQ ID NO: 414333 - DNA, 16 bp, M. musculus
gctgtggtgatggtgg

SEQ ID NO: 414334 - DNA, 16 bp, M. musculus
gctgtggtgtcttcag

SEQ ID NO: 414335 - DNA, 16 bp, M. musculus
gctgtggtgtgctgtg

SEQ ID NO: 414336 - DNA, 18 bp, M. musculus
gctgtgtagccctggctg

SEQ ID NO: 414337 - DNA, 16 bp, M. musculus
gctgtgtctggaaaac

SEQ ID NO: 414338 - DNA, 16 bp, M. musculus
gctgtgtctgtgtgtc

SEQ ID NO: 414339 - DNA, 16 bp, M. musculus
gctgtgtgaccttgag

SEQ ID NO: 414340 - DNA, 16 bp, M. musculus
gctgtgtgaccttggg

SEQ ID NO: 414341 - DNA, 16 bp, M. musculus
gctgtgtgactctggg

SEQ ID NO: 414342 - DNA, 16 bp, M. musculus
gctgtgtgactttggg

SEQ ID NO: 414343 - DNA, 16 bp, M. musculus
gctgtgtggccttagg

SEQ ID NO: 414344 - DNA, 16 bp, M. musculus
gctgtgtgtctctgtg

SEQ ID NO: 414345 - DNA, 16 bp, M. musculus
gctgtgtgtgtgagtg

SEQ ID NO: 414346 - DNA, 16 bp, M. musculus
gctgtgttccagagat

SEQ ID NO: 414347 - DNA, 16 bp, M. musculus
gctgtgttcttcctgg

SEQ ID NO: 414348 - DNA, 16 bp, M. musculus
gctgtgttgcttctgc

SEQ ID NO: 414349 - DNA, 16 bp, M. musculus
gctgtgttttcattgc

SEQ ID NO: 414350 - DNA, 16 bp, M. musculus
gctgttaagagcactt

SEQ ID NO: 414351 - DNA, 18 bp, M. musculus
gctgttaccctttctcca

SEQ ID NO: 414352 - DNA, 16 bp, M. musculus
gctgttaggagtccca

SEQ ID NO: 414353 - DNA, 16 bp, M. musculus
gctgttcaagcatgag

SEQ ID NO: 414354 - DNA, 16 bp, M. musculus
gctgttccagagccat

SEQ ID NO: 414355 - DNA, 16 bp, M. musculus
gctgttccctaactag

SEQ ID NO: 414356 - DNA, 16 bp, M. musculus
gctgttcctcctcctc

SEQ ID NO: 414357 - DNA, 16 bp, M. musculus
gctgttcttacaaagg

SEQ ID NO: 414358 - DNA, 16 bp, M. musculus
gctgttcttccagaag

SEQ ID NO: 414359 - DNA, 16 bp, M. musculus
gctgttgccctgaggc

SEQ ID NO: 414360 - DNA, 16 bp, M. musculus
gctgttgcctggctcc

SEQ ID NO: 414361 - DNA, 16 bp, M. musculus
gctgttgctgctgctt

SEQ ID NO: 414362 - DNA, 16 bp, M. musculus
gctgttgtcctgtgtg

SEQ ID NO: 414363 - DNA, 16 bp, M. musculus
gctgtttacttgtgtt

SEQ ID NO: 414364 - DNA, 16 bp, M. musculus
gctgtttatctggttt

SEQ ID NO: 414365 - DNA, 16 bp, M. musculus
gctgtttctgactctg

SEQ ID NO: 414366 - DNA, 16 bp, M. musculus
gctgttttaataaagt

SEQ ID NO: 414367 - DNA, 16 bp, M. musculus
gctgttttccagagat

SEQ ID NO: 414368 - DNA, 16 bp, M. musculus
gctgttttctgagagg

SEQ ID NO: 414369 - DNA, 16 bp, M. musculus
gctgttttggaaggtt

SEQ ID NO: 414370 - DNA, 16 bp, M. musculus
gctgtttttataagac

SEQ ID NO: 414371 - DNA, 16 bp, M. musculus
gctgtttttgtaaaaa

SEQ ID NO: 414372 - DNA, 16 bp, M. musculus
gcttaaaaaacaaaac

SEQ ID NO: 414373 - DNA, 16 bp, M. musculus
gcttaaaaagaaaaag

SEQ ID NO: 414374 - DNA, 36 bp, M. musculus
gcttaaacaggaaacccttcttgttcaggactgtca

SEQ ID NO: 414375 - DNA, 16 bp, M. musculus
gcttaatatacagaaa

SEQ ID NO: 414376 - DNA, 16 bp, M. musculus
gcttaatgggtcatcc

SEQ ID NO: 414377 - DNA, 16 bp, M. musculus
gcttaatttctgtaaa

SEQ ID NO: 414378 - DNA, 16 bp, M. musculus
gcttacaaagcaagca

SEQ ID NO: 414379 - DNA, 16 bp, M. musculus
gcttacacagcaagtg

SEQ ID NO: 414380 - DNA, 16 bp, M. musculus
gcttacacttccacat

SEQ ID NO: 414381 - DNA, 16 bp, M. musculus
gcttacacttccatac

SEQ ID NO: 414382 - DNA, 20 bp, M. musculus
gcttacacttccatactgct

SEQ ID NO: 414383 - DNA, 16 bp, M. musculus
gcttacacttttcaca

SEQ ID NO: 414384 - DNA, 16 bp, M. musculus
gcttacagctcagagg

SEQ ID NO: 414385 - DNA, 16 bp, M. musculus
gcttacaggttgagag

SEQ ID NO: 414386 - DNA, 16 bp, M. musculus
gcttacagtttcagag

SEQ ID NO: 414387 - DNA, 16 bp, M. musculus
gcttacagtttcaggt

SEQ ID NO: 414388 - DNA, 16 bp, M. musculus
gcttacatttctacat

SEQ ID NO: 414389 - DNA, 16 bp, M. musculus
gcttacctagcatgca

SEQ ID NO: 414390 - DNA, 21 bp, M. musculus
gcttactggaagccctcctct

SEQ ID NO: 414391 - DNA, 17 bp, M. musculus
gcttactggcttgcttt

SEQ ID NO: 414392 - DNA, 16 bp, M. musculus
gcttactggcttgttc

SEQ ID NO: 414393 - DNA, 16 bp, M. musculus
gcttactggttaagag

SEQ ID NO: 414394 - DNA, 16 bp, M. musculus
gcttagactggccttg

SEQ ID NO: 414395 - DNA, 16 bp, M. musculus
gcttagcacttaagag

SEQ ID NO: 414396 - DNA, 16 bp, M. musculus
gcttagcagttgagag

SEQ ID NO: 414397 - DNA, 16 bp, M. musculus
gcttaggaggcagagg

SEQ ID NO: 414398 - DNA, 16 bp, M. musculus
gcttaggaggtgtggc

SEQ ID NO: 414399 - DNA, 16 bp, M. musculus
gcttagtggtagagca

SEQ ID NO: 414400 - DNA, 16 bp, M. musculus
gcttagttggtaaagt

SEQ ID NO: 414401 - DNA, 16 bp, M. musculus
gcttagttgtgtttct

SEQ ID NO: 414402 - DNA, 16 bp, M. musculus
gcttataaaggcaaaa

SEQ ID NO: 414403 - DNA, 16 bp, M. musculus
gcttatacaaagataa

SEQ ID NO: 414404 - DNA, 16 bp, M. musculus
gcttatacttctacat

SEQ ID NO: 414405 - DNA, 16 bp, M. musculus
gcttatataggatttc

SEQ ID NO: 414406 - DNA, 16 bp, M. musculus
gcttatgcagcaagca

SEQ ID NO: 414407 - DNA, 17 bp, M. musculus
gcttatgcccagatttc

SEQ ID NO: 414408 - DNA, 16 bp, M. musculus
gcttatgtatttggag

SEQ ID NO: 414409 - DNA, 16 bp, M. musculus
gcttcaagatctggat

SEQ ID NO: 414410 - DNA, 16 bp, M. musculus
gcttcaagcttctctc

SEQ ID NO: 414411 - DNA, 16 bp, M. musculus
gcttcaaggaagctct

SEQ ID NO: 414412 - DNA, 16 bp, M. musculus
gcttcaccccagggat

SEQ ID NO: 414413 - DNA, 16 bp, M. musculus
gcttcacctgcctctg

SEQ ID NO: 414414 - DNA, 16 bp, M. musculus
gcttcacttcctgcct

SEQ ID NO: 414415 - DNA, 16 bp, M. musculus
gcttcactttcattaa

SEQ ID NO: 414416 - DNA, 16 bp, M. musculus
gcttcagaaacaaagg

SEQ ID NO: 414417 - DNA, 16 bp, M. musculus
gcttcagaagacatca

SEQ ID NO: 414418 - DNA, 16 bp, M. musculus
gcttcagaagatatca

SEQ ID NO: 414419 - DNA, 16 bp, M. musculus
gcttcagacaggaatc

SEQ ID NO: 414420 - DNA, 16 bp, M. musculus
gcttcagactcagaga

SEQ ID NO: 414421 - DNA, 16 bp, M. musculus
gcttcagagaagatga

SEQ ID NO: 414422 - DNA, 16 bp, M. musculus
gcttcagcagcctgag

SEQ ID NO: 414423 - DNA, 28 bp, M. musculus
gcttcagctaatcagggcagcaggggca

SEQ ID NO: 414424 - DNA, 16 bp, M. musculus
gcttcagcttctgcct

SEQ ID NO: 414425 - DNA, 16 bp, M. musculus
gcttcagggtcagtga

SEQ ID NO: 414426 - DNA, 16 bp, M. musculus
gcttcaggtcctgcct

SEQ ID NO: 414427 - DNA, 16 bp, M. musculus
gcttcagtctctggga

SEQ ID NO: 414428 - DNA, 16 bp, M. musculus
gcttcagtgtctctgg

SEQ ID NO: 414429 - DNA, 16 bp, M. musculus
gcttcagttttgtttt

SEQ ID NO: 414430 - DNA, 16 bp, M. musculus
gcttcatagaacgagt

SEQ ID NO: 414431 - DNA, 16 bp, M. musculus
gcttcatgcatgctag

SEQ ID NO: 414432 - DNA, 16 bp, M. musculus
gcttcattcttctctt

SEQ ID NO: 414433 - DNA, 16 bp, M. musculus
gcttcattttttttaa

SEQ ID NO: 414434 - DNA, 17 bp, M. musculus
gcttccaaacactgaca

SEQ ID NO: 414435 - DNA, 16 bp, M. musculus
gcttccagattcctgc

SEQ ID NO: 414436 - DNA, 16 bp, M. musculus
gcttccatactgctgt

SEQ ID NO: 414437 - DNA, 16 bp, M. musculus
gcttccatcttctctc

SEQ ID NO: 414438 - DNA, 16 bp, M. musculus
gcttcccaactgctgg

SEQ ID NO: 414439 - DNA, 16 bp, M. musculus
gcttcccagccattca

SEQ ID NO: 414440 - DNA, 16 bp, M. musculus
gcttcccagtttcatg

SEQ ID NO: 414441 - DNA, 16 bp, M. musculus
gcttccccacccactc

SEQ ID NO: 414442 - DNA, 16 bp, M. musculus
gcttcccctcccactg

SEQ ID NO: 414443 - DNA, 16 bp, M. musculus
gcttccctgtaggaag

SEQ ID NO: 414444 - DNA, 16 bp, M. musculus
gcttcccttcccccac

SEQ ID NO: 414445 - DNA, 16 bp, M. musculus
gcttcctatattttca

SEQ ID NO: 414446 - DNA, 16 bp, M. musculus
gcttcctcaatgcctt

SEQ ID NO: 414447 - DNA, 16 bp, M. musculus
gcttcctcaggcacca

SEQ ID NO: 414448 - DNA, 16 bp, M. musculus
gcttcctccaggaagg

SEQ ID NO: 414449 - DNA, 16 bp, M. musculus
gcttcctcctgcagca

SEQ ID NO: 414450 - DNA, 16 bp, M. musculus
gcttcctcttccacag

SEQ ID NO: 414451 - DNA, 16 bp, M. musculus
gcttcctcttccactg

SEQ ID NO: 414452 - DNA, 16 bp, M. musculus
gcttcctgactgtgga

SEQ ID NO: 414453 - DNA, 16 bp, M. musculus
gcttcctgccctgctt

SEQ ID NO: 414454 - DNA, 16 bp, M. musculus
gcttcctgccctgttt

SEQ ID NO: 414455 - DNA, 16 bp, M. musculus
gcttcctgctcttcca

SEQ ID NO: 414456 - DNA, 16 bp, M. musculus
gcttcctgctcttgca

SEQ ID NO: 414457 - DNA, 16 bp, M. musculus
gcttcctgcttctgcc

SEQ ID NO: 414458 - DNA, 16 bp, M. musculus
gcttcctggaggagga

SEQ ID NO: 414459 - DNA, 16 bp, M. musculus
gcttcctggcagaaga

SEQ ID NO: 414460 - DNA, 16 bp, M. musculus
gcttcctggcccaggc

SEQ ID NO: 414461 - DNA, 16 bp, M. musculus
gcttcctggccccggc

SEQ ID NO: 414462 - DNA, 16 bp, M. musculus
gcttcctggcctcttt

SEQ ID NO: 414463 - DNA, 16 bp, M. musculus
gcttcctggccttcat

SEQ ID NO: 414464 - DNA, 16 bp, M. musculus
gcttcctggctgtgga

SEQ ID NO: 414465 - DNA, 16 bp, M. musculus
gcttcctgtctgtgga

SEQ ID NO: 414466 - DNA, 16 bp, M. musculus
gcttcctgttaatttt

SEQ ID NO: 414467 - DNA, 16 bp, M. musculus
gcttcctgttatttta

SEQ ID NO: 414468 - DNA, 16 bp, M. musculus
gcttccttacagagca

SEQ ID NO: 414469 - DNA, 16 bp, M. musculus
gcttccttacccacag

SEQ ID NO: 414470 - DNA, 16 bp, M. musculus
gcttccttccatgatg

SEQ ID NO: 414471 - DNA, 16 bp, M. musculus
gcttccttgcttcctt

SEQ ID NO: 414472 - DNA, 16 bp, M. musculus
gcttcctttggatgtt

SEQ ID NO: 414473 - DNA, 16 bp, M. musculus
gcttccttttcatttc

SEQ ID NO: 414474 - DNA, 16 bp, M. musculus
gcttcctttttaaggt

SEQ ID NO: 414475 - DNA, 16 bp, M. musculus
gcttcctttttttcta

SEQ ID NO: 414476 - DNA, 16 bp, M. musculus
gcttcggtccttctta

SEQ ID NO: 414477 - DNA, 16 bp, M. musculus
gcttctaactctggag

SEQ ID NO: 414478 - DNA, 16 bp, M. musculus
gcttctattttctctt

SEQ ID NO: 414479 - DNA, 16 bp, M. musculus
gcttctcaaaggaagt

SEQ ID NO: 414480 - DNA, 16 bp, M. musculus
gcttctcaagtgctgg

SEQ ID NO: 414481 - DNA, 16 bp, M. musculus
gcttctcaccatgaca

SEQ ID NO: 414482 - DNA, 16 bp, M. musculus
gcttctcactgaattg

SEQ ID NO: 414483 - DNA, 16 bp, M. musculus
gcttctcagagaacag

SEQ ID NO: 414484 - DNA, 16 bp, M. musculus
gcttctcagccacttg

SEQ ID NO: 414485 - DNA, 16 bp, M. musculus
gcttctcagccattcc

SEQ ID NO: 414486 - DNA, 16 bp, M. musculus
gcttctcagccatttg

SEQ ID NO: 414487 - DNA, 16 bp, M. musculus
gcttctcagccttcct

SEQ ID NO: 414488 - DNA, 16 bp, M. musculus
gcttctccagaggacc

SEQ ID NO: 414489 - DNA, 16 bp, M. musculus
gcttctccagtatgca

SEQ ID NO: 414490 - DNA, 16 bp, M. musculus
gcttctcctgcctcag

SEQ ID NO: 414491 - DNA, 16 bp, M. musculus
gcttctctcaacttct

SEQ ID NO: 414492 - DNA, 16 bp, M. musculus
gcttctctcagtttct

SEQ ID NO: 414493 - DNA, 16 bp, M. musculus
gcttctctggccaagg

SEQ ID NO: 414494 - DNA, 16 bp, M. musculus
gcttctctttgcagca

SEQ ID NO: 414495 - DNA, 16 bp, M. musculus
gcttctgacccagagt

SEQ ID NO: 414496 - DNA, 16 bp, M. musculus
gcttctgcaaggcaaa

SEQ ID NO: 414497 - DNA, 16 bp, M. musculus
gcttctgcagtccaca

SEQ ID NO: 414498 - DNA, 16 bp, M. musculus
gcttctgcctccagag

SEQ ID NO: 414499 - DNA, 16 bp, M. musculus
gcttctgcctcccaat

SEQ ID NO: 414500 - DNA, 16 bp, M. musculus
gcttctgcctcccaga

SEQ ID NO: 414501 - DNA, 16 bp, M. musculus
gcttctgcctcccagg

SEQ ID NO: 414502 - DNA, 16 bp, M. musculus
gcttctgcctccggag

SEQ ID NO: 414503 - DNA, 16 bp, M. musculus
gcttctgcctctgaag

SEQ ID NO: 414504 - DNA, 16 bp, M. musculus
gcttctgccttcccag

SEQ ID NO: 414505 - DNA, 16 bp, M. musculus
gcttctgctctgcttt

SEQ ID NO: 414506 - DNA, 16 bp, M. musculus
gcttctgctgctgcag

SEQ ID NO: 414507 - DNA, 16 bp, M. musculus
gcttctgcttctattt

SEQ ID NO: 414508 - DNA, 16 bp, M. musculus
gcttctgctttctgac

SEQ ID NO: 414509 - DNA, 16 bp, M. musculus
gcttctggaacaggca

SEQ ID NO: 414510 - DNA, 16 bp, M. musculus
gcttctggaagctgtg

SEQ ID NO: 414511 - DNA, 16 bp, M. musculus
gcttctggaatgttct

SEQ ID NO: 414512 - DNA, 16 bp, M. musculus
gcttctggcctctgtg

SEQ ID NO: 414513 - DNA, 16 bp, M. musculus
gcttctggctgctatg

SEQ ID NO: 414514 - DNA, 16 bp, M. musculus
gcttctgggacctgcc

SEQ ID NO: 414515 - DNA, 16 bp, M. musculus
gcttctgggatcctgg

SEQ ID NO: 414516 - DNA, 17 bp, M. musculus
gcttctggtggtcctta

SEQ ID NO: 414517 - DNA, 16 bp, M. musculus
gcttctgtctctgacc

SEQ ID NO: 414518 - DNA, 16 bp, M. musculus
gcttctgtcttatttt

SEQ ID NO: 414519 - DNA, 16 bp, M. musculus
gcttctgtgtctgttg

SEQ ID NO: 414520 - DNA, 16 bp, M. musculus
gcttctgttaaactgc

SEQ ID NO: 414521 - DNA, 16 bp, M. musculus
gcttcttcatcagctc

SEQ ID NO: 414522 - DNA, 16 bp, M. musculus
gcttcttcctcctgtg

SEQ ID NO: 414523 - DNA, 16 bp, M. musculus
gcttcttctagccttt

SEQ ID NO: 414524 - DNA, 16 bp, M. musculus
gcttcttgcaggaagc

SEQ ID NO: 414525 - DNA, 16 bp, M. musculus
gcttcttgctgcttcc

SEQ ID NO: 414526 - DNA, 16 bp, M. musculus
gcttcttggccctggc

SEQ ID NO: 414527 - DNA, 16 bp, M. musculus
gcttcttggccctggt

SEQ ID NO: 414528 - DNA, 16 bp, M. musculus
gcttcttgtatcttta

SEQ ID NO: 414529 - DNA, 16 bp, M. musculus
gcttctttaaaaaaaa

SEQ ID NO: 414530 - DNA, 16 bp, M. musculus
gcttctttgatgatgg

SEQ ID NO: 414531 - DNA, 16 bp, M. musculus
gcttcttttgaagtgt

SEQ ID NO: 414532 - DNA, 16 bp, M. musculus
gcttctttttctgtga

SEQ ID NO: 414533 - DNA, 16 bp, M. musculus
gcttctttttgcagta

SEQ ID NO: 414534 - DNA, 16 bp, M. musculus
gcttgaaaagttatta

SEQ ID NO: 414535 - DNA, 16 bp, M. musculus
gcttgaaagacaaaat

SEQ ID NO: 414536 - DNA, 16 bp, M. musculus
gcttgacagcaagcac

SEQ ID NO: 414537 - DNA, 16 bp, M. musculus
gcttgacaggctgaga

SEQ ID NO: 414538 - DNA, 16 bp, M. musculus
gcttgaccaccgatat

SEQ ID NO: 414539 - DNA, 16 bp, M. musculus
gcttgactgtcctgga

SEQ ID NO: 414540 - DNA, 16 bp, M. musculus
gcttgaggccagcctg

SEQ ID NO: 414541 - DNA, 16 bp, M. musculus
gcttgagggcctgagt

SEQ ID NO: 414542 - DNA, 16 bp, M. musculus
gcttgagttcctgtcc

SEQ ID NO: 414543 - DNA, 25 bp, M. musculus
gcttgatagtgctaagcactatgaa

SEQ ID NO: 414544 - DNA, 16 bp, M. musculus
gcttgatgccccagaa

SEQ ID NO: 414545 - DNA, 16 bp, M. musculus
gcttgcaaggcaagta

SEQ ID NO: 414546 - DNA, 16 bp, M. musculus
gcttgcacaactggtg

SEQ ID NO: 414547 - DNA, 16 bp, M. musculus
gcttgcagagagtact

SEQ ID NO: 414548 - DNA, 16 bp, M. musculus
gcttgcagaggccaga

SEQ ID NO: 414549 - DNA, 16 bp, M. musculus
gcttgcagaggggaaa

SEQ ID NO: 414550 - DNA, 16 bp, M. musculus
gcttgcagcagctgga

SEQ ID NO: 414551 - DNA, 16 bp, M. musculus
gcttgcatgctgccat

SEQ ID NO: 414552 - DNA, 16 bp, M. musculus
gcttgccaccaagcct

SEQ ID NO: 414553 - DNA, 16 bp, M. musculus
gcttgccatgaaagca

SEQ ID NO: 414554 - DNA, 16 bp, M. musculus
gcttgcccacagccca

SEQ ID NO: 414555 - DNA, 16 bp, M. musculus
gcttgcccagcatgca

SEQ ID NO: 414556 - DNA, 16 bp, M. musculus
gcttgccctcactctc

SEQ ID NO: 414557 - DNA, 16 bp, M. musculus
gcttgcctagaactca

SEQ ID NO: 414558 - DNA, 16 bp, M. musculus
gcttgcctagcaagca

SEQ ID NO: 414559 - DNA, 16 bp, M. musculus
gcttgcctcccctgac

SEQ ID NO: 414560 - DNA, 16 bp, M. musculus
gcttgcctgcacagag

SEQ ID NO: 414561 - DNA, 16 bp, M. musculus
gcttgcctgcagggag

SEQ ID NO: 414562 - DNA, 16 bp, M. musculus
gcttgcctggacttgc

SEQ ID NO: 414563 - DNA, 16 bp, M. musculus
gcttgcctggcatgca

SEQ ID NO: 414564 - DNA, 16 bp, M. musculus
gcttgcctgggctaca

SEQ ID NO: 414565 - DNA, 16 bp, M. musculus
gcttgcctttgcctcc

SEQ ID NO: 414566 - DNA, 16 bp, M. musculus
gcttgctatgcttgtt

SEQ ID NO: 414567 - DNA, 16 bp, M. musculus
gcttgctcagccagct

SEQ ID NO: 414568 - DNA, 16 bp, M. musculus
gcttgctcagtctgct

SEQ ID NO: 414569 - DNA, 16 bp, M. musculus
gcttgctccccatggt

SEQ ID NO: 414570 - DNA, 16 bp, M. musculus
gcttgctctgtcccag

SEQ ID NO: 414571 - DNA, 16 bp, M. musculus
gcttgctgataacttc

SEQ ID NO: 414572 - DNA, 16 bp, M. musculus
gcttgctgtcaggagc

SEQ ID NO: 414573 - DNA, 16 bp, M. musculus
gcttgcttcctgccat

SEQ ID NO: 414574 - DNA, 16 bp, M. musculus
gcttgcttgcagcaat

SEQ ID NO: 414575 - DNA, 16 bp, M. musculus
gcttgcttgcttcctt

SEQ ID NO: 414576 - DNA, 16 bp, M. musculus
gcttgcttgcttgcat

SEQ ID NO: 414577 - DNA, 16 bp, M. musculus
gcttgcttgcttgttt

SEQ ID NO: 414578 - DNA, 16 bp, M. musculus
gcttgcttgctttttg

SEQ ID NO: 414579 - DNA, 16 bp, M. musculus
gcttgcttttctgttg

SEQ ID NO: 414580 - DNA, 16 bp, M. musculus
gcttggaaaaaaaaaa

SEQ ID NO: 414581 - DNA, 16 bp, M. musculus
gcttggaaaaattgtt

SEQ ID NO: 414582 - DNA, 16 bp, M. musculus
gcttggaaagcattgc

SEQ ID NO: 414583 - DNA, 16 bp, M. musculus
gcttggacaaccactc

SEQ ID NO: 414584 - DNA, 16 bp, M. musculus
gcttggacttttgaaa

SEQ ID NO: 414585 - DNA, 16 bp, M. musculus
gcttggatgtggagaa

SEQ ID NO: 414586 - DNA, 16 bp, M. musculus
gcttggcaaatacaga

SEQ ID NO: 414587 - DNA, 16 bp, M. musculus
gcttggcatcatgaag

SEQ ID NO: 414588 - DNA, 16 bp, M. musculus
gcttggcattgtgaga

SEQ ID NO: 414589 - DNA, 16 bp, M. musculus
gcttggccccacctct

SEQ ID NO: 414590 - DNA, 16 bp, M. musculus
gcttggcctcacacta

SEQ ID NO: 414591 - DNA, 16 bp, M. musculus
gcttggctcagggagt

SEQ ID NO: 414592 - DNA, 16 bp, M. musculus
gcttggctcataggga

SEQ ID NO: 414593 - DNA, 16 bp, M. musculus
gcttggcttgctggta

SEQ ID NO: 414594 - DNA, 16 bp, M. musculus
gcttgggaagctgagg

SEQ ID NO: 414595 - DNA, 16 bp, M. musculus
gcttgggaggtcttca

SEQ ID NO: 414596 - DNA, 17 bp, M. musculus
gcttggggaaggttgcc

SEQ ID NO: 414597 - DNA, 16 bp, M. musculus
gcttggtccaggaagt

SEQ ID NO: 414598 - DNA, 16 bp, M. musculus
gcttggtccccagctg

SEQ ID NO: 414599 - DNA, 16 bp, M. musculus
gcttggtctacacagt

SEQ ID NO: 414600 - DNA, 16 bp, M. musculus
gcttggtgcccatgga

SEQ ID NO: 414601 - DNA, 16 bp, M. musculus
gcttggtggcaaggac

SEQ ID NO: 414602 - DNA, 16 bp, M. musculus
gcttggttcccagcac

SEQ ID NO: 414603 - DNA, 16 bp, M. musculus
gcttgtcatcccagca

SEQ ID NO: 414604 - DNA, 16 bp, M. musculus
gcttgtgagccacctg

SEQ ID NO: 414605 - DNA, 16 bp, M. musculus
gcttgtgatcccagca

SEQ ID NO: 414606 - DNA, 16 bp, M. musculus
gcttgtgcagaccttg

SEQ ID NO: 414607 - DNA, 17 bp, M. musculus
gcttgtggcaggtgcat

SEQ ID NO: 414608 - DNA, 16 bp, M. musculus
gcttgtgtctttagtt

SEQ ID NO: 414609 - DNA, 16 bp, M. musculus
gcttgtgtctttttat

SEQ ID NO: 414610 - DNA, 16 bp, M. musculus
gcttgtgtgcacatgt

SEQ ID NO: 414611 - DNA, 16 bp, M. musculus
gcttgtgtgctgtgtg

SEQ ID NO: 414612 - DNA, 16 bp, M. musculus
gcttgtgtgcttgtgt

SEQ ID NO: 414613 - DNA, 16 bp, M. musculus
gcttgtgtgtgcttgt

SEQ ID NO: 414614 - DNA, 16 bp, M. musculus
gcttgtgtttatatca

SEQ ID NO: 414615 - DNA, 16 bp, M. musculus
gcttgttatttctctc

SEQ ID NO: 414616 - DNA, 17 bp, M. musculus
gcttgttcctcaggtga

SEQ ID NO: 414617 - DNA, 16 bp, M. musculus
gcttgttcctcccatg

SEQ ID NO: 414618 - DNA, 16 bp, M. musculus
gcttgttcttcttgtg

SEQ ID NO: 414619 - DNA, 16 bp, M. musculus
gcttgttctttcttca

SEQ ID NO: 414620 - DNA, 16 bp, M. musculus
gcttgttgctcttcca

SEQ ID NO: 414621 - DNA, 16 bp, M. musculus
gctttaaaaagaaaga

SEQ ID NO: 414622 - DNA, 16 bp, M. musculus
gctttaaagactgatg

SEQ ID NO: 414623 - DNA, 16 bp, M. musculus
gctttaaatatttttt

SEQ ID NO: 414624 - DNA, 16 bp, M. musculus
gctttaacctcccttt

SEQ ID NO: 414625 - DNA, 16 bp, M. musculus
gctttaataaaaatct

SEQ ID NO: 414626 - DNA, 16 bp, M. musculus
gctttaatttttttaa

SEQ ID NO: 414627 - DNA, 16 bp, M. musculus
gctttacccactgagc

SEQ ID NO: 414628 - DNA, 16 bp, M. musculus
gctttagcagaatatc

SEQ ID NO: 414629 - DNA, 16 bp, M. musculus
gctttagtaaataaaa

SEQ ID NO: 414630 - DNA, 16 bp, M. musculus
gctttagtgggtctgt

SEQ ID NO: 414631 - DNA, 16 bp, M. musculus
gctttagttcctgcct

SEQ ID NO: 414632 - DNA, 16 bp, M. musculus
gctttatatatatata

SEQ ID NO: 414633 - DNA, 16 bp, M. musculus
gctttatgcatgctag

SEQ ID NO: 414634 - DNA, 16 bp, M. musculus
gctttatgcccttgcc

SEQ ID NO: 414635 - DNA, 16 bp, M. musculus
gctttattaaaaaaaa

SEQ ID NO: 414636 - DNA, 16 bp, M. musculus
gctttattattttaga

SEQ ID NO: 414637 - DNA, 16 bp, M. musculus
gctttattgcttatat

SEQ ID NO: 414638 - DNA, 16 bp, M. musculus
gctttatttggttggg

SEQ ID NO: 414639 - DNA, 16 bp, M. musculus
gctttcaagctgctag

SEQ ID NO: 414640 - DNA, 16 bp, M. musculus
gctttcagaggggaaa

SEQ ID NO: 414641 - DNA, 16 bp, M. musculus
gctttcagagtgctgg

SEQ ID NO: 414642 - DNA, 16 bp, M. musculus
gctttcagctgcaaca

SEQ ID NO: 414643 - DNA, 16 bp, M. musculus
gctttcatagtctgtg

SEQ ID NO: 414644 - DNA, 16 bp, M. musculus
gctttcatgtggttgt

SEQ ID NO: 414645 - DNA, 16 bp, M. musculus
gctttcccacccagga

SEQ ID NO: 414646 - DNA, 16 bp, M. musculus
gctttcctagaactca

SEQ ID NO: 414647 - DNA, 16 bp, M. musculus
gctttcctggaacttg

SEQ ID NO: 414648 - DNA, 16 bp, M. musculus
gctttccttggcaggt

SEQ ID NO: 414649 - DNA, 16 bp, M. musculus
gctttcctttggaaat

SEQ ID NO: 414650 - DNA, 16 bp, M. musculus
gctttctattactgtg

SEQ ID NO: 414651 - DNA, 16 bp, M. musculus
gctttctcagtaccta

SEQ ID NO: 414652 - DNA, 16 bp, M. musculus
gctttctcatacaacc

SEQ ID NO: 414653 - DNA, 16 bp, M. musculus
gctttctccttccacc

SEQ ID NO: 414654 - DNA, 16 bp, M. musculus
gctttctccttctacc

SEQ ID NO: 414655 - DNA, 16 bp, M. musculus
gctttctctgtgtaac

SEQ ID NO: 414656 - DNA, 16 bp, M. musculus
gctttctcttccatta

SEQ ID NO: 414657 - DNA, 16 bp, M. musculus
gctttctgctgtttct

SEQ ID NO: 414658 - DNA, 16 bp, M. musculus
gctttcttatacaccc

SEQ ID NO: 414659 - DNA, 16 bp, M. musculus
gctttcttatacagcc

SEQ ID NO: 414660 - DNA, 16 bp, M. musculus
gctttcttgactccta

SEQ ID NO: 414661 - DNA, 16 bp, M. musculus
gctttcttgtattata

SEQ ID NO: 414662 - DNA, 16 bp, M. musculus
gctttgaactcataat

SEQ ID NO: 414663 - DNA, 16 bp, M. musculus
gctttgaactcttgat

SEQ ID NO: 414664 - DNA, 16 bp, M. musculus
gctttgaacttataat

SEQ ID NO: 414665 - DNA, 16 bp, M. musculus
gctttgaatcccagca

SEQ ID NO: 414666 - DNA, 16 bp, M. musculus
gctttgagaatttaaa

SEQ ID NO: 414667 - DNA, 16 bp, M. musculus
gctttgaggtctccta

SEQ ID NO: 414668 - DNA, 16 bp, M. musculus
gctttgagttgaccca

SEQ ID NO: 414669 - DNA, 16 bp, M. musculus
gctttgagtttctctt

SEQ ID NO: 414670 - DNA, 16 bp, M. musculus
gctttgatcagaacct

SEQ ID NO: 414671 - DNA, 16 bp, M. musculus
gctttgatgataatgg

SEQ ID NO: 414672 - DNA, 16 bp, M. musculus
gctttgatttttaaaa

SEQ ID NO: 414673 - DNA, 16 bp, M. musculus
gctttgcagaaaataa

SEQ ID NO: 414674 - DNA, 16 bp, M. musculus
gctttgccatccctct

SEQ ID NO: 414675 - DNA, 16 bp, M. musculus
gctttgcctcctgagt

SEQ ID NO: 414676 - DNA, 16 bp, M. musculus
gctttgctgcagaagg

SEQ ID NO: 414677 - DNA, 16 bp, M. musculus
gctttgctttgccttg

SEQ ID NO: 414678 - DNA, 16 bp, M. musculus
gctttgctttgcttgt

SEQ ID NO: 414679 - DNA, 16 bp, M. musculus
gctttggaggcagagg

SEQ ID NO: 414680 - DNA, 16 bp, M. musculus
gctttggcttctttgt

SEQ ID NO: 414681 - DNA, 16 bp, M. musculus
gctttgggacaagata

SEQ ID NO: 414682 - DNA, 16 bp, M. musculus
gctttgggccttcatc

SEQ ID NO: 414683 - DNA, 16 bp, M. musculus
gctttggtccagtgtt

SEQ ID NO: 414684 - DNA, 16 bp, M. musculus
gctttggttcctctga

SEQ ID NO: 414685 - DNA, 16 bp, M. musculus
gctttggtttttcaag

SEQ ID NO: 414686 - DNA, 16 bp, M. musculus
gctttgtagaccagac

SEQ ID NO: 414687 - DNA, 16 bp, M. musculus
gctttgtctgggccag

SEQ ID NO: 414688 - DNA, 16 bp, M. musculus
gctttgtgcatgctaa

SEQ ID NO: 414689 - DNA, 16 bp, M. musculus
gctttgtgggtgctgg

SEQ ID NO: 414690 - DNA, 16 bp, M. musculus
gctttgttacagatct

SEQ ID NO: 414691 - DNA, 16 bp, M. musculus
gctttgtttcattttg

SEQ ID NO: 414692 - DNA, 16 bp, M. musculus
gctttgttttctgaga

SEQ ID NO: 414693 - DNA, 16 bp, M. musculus
gcttttaaaaatgttt

SEQ ID NO: 414694 - DNA, 16 bp, M. musculus
gcttttaaccccagca

SEQ ID NO: 414695 - DNA, 16 bp, M. musculus
gcttttaagcataaaa

SEQ ID NO: 414696 - DNA, 16 bp, M. musculus
gcttttaatatatttt

SEQ ID NO: 414697 - DNA, 16 bp, M. musculus
gcttttaatattattt

SEQ ID NO: 414698 - DNA, 16 bp, M. musculus
gcttttaatctcagca

SEQ ID NO: 414699 - DNA, 135 bp, M. musculus
gcttttacccagagcaaccctgacctgctcccgtgtcgttttgcctgggggaagggaactaggacactgaaccttcatgaaagatgacatgtctccctagaataggctcatatatgccgcagagcctttccattg

SEQ ID NO: 414700 - DNA, 16 bp, M. musculus
gcttttatggtataag

SEQ ID NO: 414701 - DNA, 16 bp, M. musculus
gcttttatgtatgcat

SEQ ID NO: 414702 - DNA, 16 bp, M. musculus
gcttttattatgttta

SEQ ID NO: 414703 - DNA, 16 bp, M. musculus
gcttttattttgtgga

SEQ ID NO: 414704 - DNA, 16 bp, M. musculus
gcttttccaaaggacc

SEQ ID NO: 414705 - DNA, 16 bp, M. musculus
gcttttccagagggcc

SEQ ID NO: 414706 - DNA, 16 bp, M. musculus
gcttttccagtgtgat

SEQ ID NO: 414707 - DNA, 16 bp, M. musculus
gcttttccctggggaa

SEQ ID NO: 414708 - DNA, 16 bp, M. musculus
gcttttcctcactttc

SEQ ID NO: 414709 - DNA, 16 bp, M. musculus
gcttttctagcccaaa

SEQ ID NO: 414710 - DNA, 16 bp, M. musculus
gcttttctattgctgt

SEQ ID NO: 414711 - DNA, 16 bp, M. musculus
gcttttctttaattct

SEQ ID NO: 414712 - DNA, 16 bp, M. musculus
gcttttctttataaga

SEQ ID NO: 414713 - DNA, 16 bp, M. musculus
gcttttgaagcctcaa

SEQ ID NO: 414714 - DNA, 16 bp, M. musculus
gcttttgacccctttt

SEQ ID NO: 414715 - DNA, 16 bp, M. musculus
gcttttgggagctgaa

SEQ ID NO: 414716 - DNA, 16 bp, M. musculus
gcttttgggatagctc

SEQ ID NO: 414717 - DNA, 16 bp, M. musculus
gcttttgtaaagcaaa

SEQ ID NO: 414718 - DNA, 16 bp, M. musculus
gcttttgtaaataaag

SEQ ID NO: 414719 - DNA, 16 bp, M. musculus
gcttttgtccattggt

SEQ ID NO: 414720 - DNA, 16 bp, M. musculus
gcttttgtggcaagca

SEQ ID NO: 414721 - DNA, 16 bp, M. musculus
gctttttaaaaaaata

SEQ ID NO: 414722 - DNA, 16 bp, M. musculus
gctttttaaaaacaaa

SEQ ID NO: 414723 - DNA, 16 bp, M. musculus
gctttttaaaatatat

SEQ ID NO: 414724 - DNA, 16 bp, M. musculus
gctttttactttaaga

SEQ ID NO: 414725 - DNA, 16 bp, M. musculus
gctttttattgctgtg

SEQ ID NO: 414726 - DNA, 16 bp, M. musculus
gctttttattttgaga

SEQ ID NO: 414727 - DNA, 16 bp, M. musculus
gctttttccagtccca

SEQ ID NO: 414728 - DNA, 16 bp, M. musculus
gctttttctaactcta

SEQ ID NO: 414729 - DNA, 16 bp, M. musculus
gctttttgagacagag

SEQ ID NO: 414730 - DNA, 16 bp, M. musculus
gctttttgagctgatg

SEQ ID NO: 414731 - DNA, 16 bp, M. musculus
gcttttttttccccca

SEQ ID NO: 414732 - DNA, 16 bp, M. musculus
ggaaaaaaaaatcctg

SEQ ID NO: 414733 - DNA, 16 bp, M. musculus
ggaaaaaaaagtattt

SEQ ID NO: 414734 - DNA, 16 bp, M. musculus
ggaaaaaaaatcacat

SEQ ID NO: 414735 - DNA, 16 bp, M. musculus
ggaaaaaaaatttttt

SEQ ID NO: 414736 - DNA, 16 bp, M. musculus
ggaaaaaaagttttcc

SEQ ID NO: 414737 - DNA, 16 bp, M. musculus
ggaaaaaaataaacct

SEQ ID NO: 414738 - DNA, 16 bp, M. musculus
ggaaaaaagacaacat

SEQ ID NO: 414739 - DNA, 16 bp, M. musculus
ggaaaaaagatcaagt

SEQ ID NO: 414740 - DNA, 16 bp, M. musculus
ggaaaaaatccaccaa

SEQ ID NO: 414741 - DNA, 16 bp, M. musculus
ggaaaaaatcctaatt

SEQ ID NO: 414742 - DNA, 16 bp, M. musculus
ggaaaaactgaaggag

SEQ ID NO: 414743 - DNA, 16 bp, M. musculus
ggaaaaattcttcact

SEQ ID NO: 414744 - DNA, 16 bp, M. musculus
ggaaaacaagtttcca

SEQ ID NO: 414745 - DNA, 16 bp, M. musculus
ggaaaacaatttggca

SEQ ID NO: 414746 - DNA, 16 bp, M. musculus
ggaaaacacaaattaa

SEQ ID NO: 414747 - DNA, 16 bp, M. musculus
ggaaaacacaatcaag

SEQ ID NO: 414748 - DNA, 16 bp, M. musculus
ggaaaacactcataca

SEQ ID NO: 414749 - DNA, 16 bp, M. musculus
ggaaaacattcctgaa

SEQ ID NO: 414750 - DNA, 16 bp, M. musculus
ggaaaacatttaattt

SEQ ID NO: 414751 - DNA, 16 bp, M. musculus
ggaaaactgaaaaagg

SEQ ID NO: 414752 - DNA, 16 bp, M. musculus
ggaaaactggaaaggg

SEQ ID NO: 414753 - DNA, 16 bp, M. musculus
ggaaaactggaagaag

SEQ ID NO: 414754 - DNA, 16 bp, M. musculus
ggaaaactgtgtctta

SEQ ID NO: 414755 - DNA, 16 bp, M. musculus
ggaaaagaaactgaga

SEQ ID NO: 414756 - DNA, 16 bp, M. musculus
ggaaaagaactctaaa

SEQ ID NO: 414757 - DNA, 16 bp, M. musculus
ggaaaagaagaagtca

SEQ ID NO: 414758 - DNA, 16 bp, M. musculus
ggaaaagaagtcaaaa

SEQ ID NO: 414759 - DNA, 16 bp, M. musculus
ggaaaagaattttcca

SEQ ID NO: 414760 - DNA, 16 bp, M. musculus
ggaaaagactcaaaga

SEQ ID NO: 414761 - DNA, 16 bp, M. musculus
ggaaaagagactgaag

SEQ ID NO: 414762 - DNA, 16 bp, M. musculus
ggaaaagagccttgaa

SEQ ID NO: 414763 - DNA, 16 bp, M. musculus
ggaaaagagtccaaga

SEQ ID NO: 414764 - DNA, 16 bp, M. musculus
ggaaaagatctttagc

SEQ ID NO: 414765 - DNA, 16 bp, M. musculus
ggaaaagcaaatcaaa

SEQ ID NO: 414766 - DNA, 16 bp, M. musculus
ggaaaagcagccagtg

SEQ ID NO: 414767 - DNA, 16 bp, M. musculus
ggaaaagctggaaaaa

SEQ ID NO: 414768 - DNA, 16 bp, M. musculus
ggaaaagctggaagaa

SEQ ID NO: 414769 - DNA, 16 bp, M. musculus
ggaaaaggaagtccag

SEQ ID NO: 414770 - DNA, 16 bp, M. musculus
ggaaaaggaatgaagc

SEQ ID NO: 414771 - DNA, 16 bp, M. musculus
ggaaaaggatttttac

SEQ ID NO: 414772 - DNA, 16 bp, M. musculus
ggaaaaggcagttcat

SEQ ID NO: 414773 - DNA, 16 bp, M. musculus
ggaaaaggctgaagcc

SEQ ID NO: 414774 - DNA, 16 bp, M. musculus
ggaaaaggtttccagg

SEQ ID NO: 414775 - DNA, 16 bp, M. musculus
ggaaaagtcacacaac

SEQ ID NO: 414776 - DNA, 16 bp, M. musculus
ggaaaagtcttgaaga

SEQ ID NO: 414777 - DNA, 16 bp, M. musculus
ggaaaataatttttca

SEQ ID NO: 414778 - DNA, 16 bp, M. musculus
ggaaaatacaaaattg

SEQ ID NO: 414779 - DNA, 16 bp, M. musculus
ggaaaatatttcaaaa

SEQ ID NO: 414780 - DNA, 16 bp, M. musculus
ggaaaatcaggaaaaa

SEQ ID NO: 414781 - DNA, 16 bp, M. musculus
ggaaaatctattttca

SEQ ID NO: 414782 - DNA, 16 bp, M. musculus
ggaaaatctggaagaa

SEQ ID NO: 414783 - DNA, 16 bp, M. musculus
ggaaaatgacaccctt

SEQ ID NO: 414784 - DNA, 16 bp, M. musculus
ggaaaatgactggatg

SEQ ID NO: 414785 - DNA, 16 bp, M. musculus
ggaaaatgcaaataaa

SEQ ID NO: 414786 - DNA, 16 bp, M. musculus
ggaaaatgctgaggag

SEQ ID NO: 414787 - DNA, 16 bp, M. musculus
ggaaaatgctgtcttt

SEQ ID NO: 414788 - DNA, 16 bp, M. musculus
ggaaaatggatggacc

SEQ ID NO: 414789 - DNA, 16 bp, M. musculus
ggaaaatggatttcag

SEQ ID NO: 414790 - DNA, 16 bp, M. musculus
ggaaaatggccagctg

SEQ ID NO: 414791 - DNA, 16 bp, M. musculus
ggaaaatggctcagtg

SEQ ID NO: 414792 - DNA, 16 bp, M. musculus
ggaaaatgtttggcct

SEQ ID NO: 414793 - DNA, 18 bp, M. musculus
ggaaaattaaagactctt

SEQ ID NO: 414794 - DNA, 20 bp, M. musculus
ggaaaattaaagactctttt

SEQ ID NO: 414795 - DNA, 16 bp, M. musculus
ggaaaattaattttat

SEQ ID NO: 414796 - DNA, 16 bp, M. musculus
ggaaaattccagaaac

SEQ ID NO: 414797 - DNA, 16 bp, M. musculus
ggaaaattcttttcca

SEQ ID NO: 414798 - DNA, 16 bp, M. musculus
ggaaaattgtttttca

SEQ ID NO: 414799 - DNA, 16 bp, M. musculus
ggaaacaaaacctaaa

SEQ ID NO: 414800 - DNA, 16 bp, M. musculus
ggaaacaaccaagatg

SEQ ID NO: 414801 - DNA, 16 bp, M. musculus
ggaaacaaccagatgt

SEQ ID NO: 414802 - DNA, 16 bp, M. musculus
ggaaacaagaagaact

SEQ ID NO: 414803 - DNA, 16 bp, M. musculus
ggaaacacacatacac

SEQ ID NO: 414804 - DNA, 16 bp, M. musculus
ggaaacacacctcagg

SEQ ID NO: 414805 - DNA, 16 bp, M. musculus
ggaaacacagaagtct

SEQ ID NO: 414806 - DNA, 16 bp, M. musculus
ggaaacagaaactaca

SEQ ID NO: 414807 - DNA, 16 bp, M. musculus
ggaaacagaaattaag

SEQ ID NO: 414808 - DNA, 16 bp, M. musculus
ggaaacagacaacctc

SEQ ID NO: 414809 - DNA, 16 bp, M. musculus
ggaaacagagacaggc

SEQ ID NO: 414810 - DNA, 16 bp, M. musculus
ggaaacaggaagaact

SEQ ID NO: 414811 - DNA, 16 bp, M. musculus
ggaaacatcacagaag

SEQ ID NO: 414812 - DNA, 16 bp, M. musculus
ggaaacatcttcaaca

SEQ ID NO: 414813 - DNA, 20 bp, M. musculus
ggaaaccaacgctttacttt

SEQ ID NO: 414814 - DNA, 16 bp, M. musculus
ggaaaccaagaaaggg

SEQ ID NO: 414815 - DNA, 16 bp, M. musculus
ggaaaccaaggctcag

SEQ ID NO: 414816 - DNA, 16 bp, M. musculus
ggaaaccagaagaggg

SEQ ID NO: 414817 - DNA, 16 bp, M. musculus
ggaaaccaggaaaggg

SEQ ID NO: 414818 - DNA, 16 bp, M. musculus
ggaaaccaggaaagtg

SEQ ID NO: 414819 - DNA, 16 bp, M. musculus
ggaaaccaggaagagg

SEQ ID NO: 414820 - DNA, 16 bp, M. musculus
ggaaaccaggaagggg

SEQ ID NO: 414821 - DNA, 16 bp, M. musculus
ggaaaccaggaatggg

SEQ ID NO: 414822 - DNA, 16 bp, M. musculus
ggaaaccccagggcca

SEQ ID NO: 414823 - DNA, 16 bp, M. musculus
ggaaacccctatccca

SEQ ID NO: 414824 - DNA, 16 bp, M. musculus
ggaaaccctcactcaa

SEQ ID NO: 414825 - DNA, 16 bp, M. musculus
ggaaaccgaggcagga

SEQ ID NO: 414826 - DNA, 16 bp, M. musculus
ggaaacctggaggcag

SEQ ID NO: 414827 - DNA, 16 bp, M. musculus
ggaaactaatgctaga

SEQ ID NO: 414828 - DNA, 16 bp, M. musculus
ggaaactatgcctcct

SEQ ID NO: 414829 - DNA, 16 bp, M. musculus
ggaaactgaagaactc

SEQ ID NO: 414830 - DNA, 16 bp, M. musculus
ggaaactgaagcagag

SEQ ID NO: 414831 - DNA, 16 bp, M. musculus
ggaaactgaattcagg

SEQ ID NO: 414832 - DNA, 16 bp, M. musculus
ggaaactgagcccagg

SEQ ID NO: 414833 - DNA, 16 bp, M. musculus
ggaaactgaggaaatt

SEQ ID NO: 414834 - DNA, 16 bp, M. musculus
ggaaactgaggcagag

SEQ ID NO: 414835 - DNA, 16 bp, M. musculus
ggaaactgaggcatga

SEQ ID NO: 414836 - DNA, 16 bp, M. musculus
ggaaactgaggcccaa

SEQ ID NO: 414837 - DNA, 16 bp, M. musculus
ggaaactgaggcccag

SEQ ID NO: 414838 - DNA, 16 bp, M. musculus
ggaaactgaggctcag

SEQ ID NO: 414839 - DNA, 16 bp, M. musculus
ggaaactgaggctgag

SEQ ID NO: 414840 - DNA, 16 bp, M. musculus
ggaaactgaggtacag

SEQ ID NO: 414841 - DNA, 16 bp, M. musculus
ggaaactgaggtccag

SEQ ID NO: 414842 - DNA, 16 bp, M. musculus
ggaaactgagtcccag

SEQ ID NO: 414843 - DNA, 16 bp, M. musculus
ggaaactgagtctcag

SEQ ID NO: 414844 - DNA, 16 bp, M. musculus
ggaaactgctgctgac

SEQ ID NO: 414845 - DNA, 16 bp, M. musculus
ggaaactggaaagggg

SEQ ID NO: 414846 - DNA, 16 bp, M. musculus
ggaaacttagcctcct

SEQ ID NO: 414847 - DNA, 16 bp, M. musculus
ggaaacttctctttgt

SEQ ID NO: 414848 - DNA, 16 bp, M. musculus
ggaaactttctcatgt

SEQ ID NO: 414849 - DNA, 16 bp, M. musculus
ggaaagaaactcaaag

SEQ ID NO: 414850 - DNA, 16 bp, M. musculus
ggaaagaaacttaaag

SEQ ID NO: 414851 - DNA, 16 bp, M. musculus
ggaaagaacacagatg

SEQ ID NO: 414852 - DNA, 16 bp, M. musculus
ggaaagaaccaacttc

SEQ ID NO: 414853 - DNA, 16 bp, M. musculus
ggaaagaacccaaatg

SEQ ID NO: 414854 - DNA, 16 bp, M. musculus
ggaaagaactcaaatg

SEQ ID NO: 414855 - DNA, 16 bp, M. musculus
ggaaagaagaaatcaa

SEQ ID NO: 414856 - DNA, 16 bp, M. musculus
ggaaagaagctgagga

SEQ ID NO: 414857 - DNA, 16 bp, M. musculus
ggaaagaaggcaggca

SEQ ID NO: 414858 - DNA, 16 bp, M. musculus
ggaaagacagaatacc

SEQ ID NO: 414859 - DNA, 16 bp, M. musculus
ggaaagacatctggaa

SEQ ID NO: 414860 - DNA, 16 bp, M. musculus
ggaaagacattgtgta

SEQ ID NO: 414861 - DNA, 16 bp, M. musculus
ggaaagaccatacaga

SEQ ID NO: 414862 - DNA, 16 bp, M. musculus
ggaaagagaagcccct

SEQ ID NO: 414863 - DNA, 16 bp, M. musculus
ggaaagagccaactcc

SEQ ID NO: 414864 - DNA, 16 bp, M. musculus
ggaaagagttacaaag

SEQ ID NO: 414865 - DNA, 16 bp, M. musculus
ggaaagagtttattta

SEQ ID NO: 414866 - DNA, 16 bp, M. musculus
ggaaagatctcccctg

SEQ ID NO: 414867 - DNA, 16 bp, M. musculus
ggaaagatctcctgtg

SEQ ID NO: 414868 - DNA, 16 bp, M. musculus
ggaaagatgactcagt

SEQ ID NO: 414869 - DNA, 16 bp, M. musculus
ggaaagattgaagaag

SEQ ID NO: 414870 - DNA, 16 bp, M. musculus
ggaaagcagaggcagg

SEQ ID NO: 414871 - DNA, 16 bp, M. musculus
ggaaagcatttgaaat

SEQ ID NO: 414872 - DNA, 16 bp, M. musculus
ggaaagccaaggccaa

SEQ ID NO: 414873 - DNA, 16 bp, M. musculus
ggaaagccagggccag

SEQ ID NO: 414874 - DNA, 16 bp, M. musculus
ggaaagctgaggcaga

SEQ ID NO: 414875 - DNA, 16 bp, M. musculus
ggaaagctggaagaag

SEQ ID NO: 414876 - DNA, 16 bp, M. musculus
ggaaagctgggtgtgg

SEQ ID NO: 414877 - DNA, 16 bp, M. musculus
ggaaagcttgcctgca

SEQ ID NO: 414878 - DNA, 16 bp, M. musculus
ggaaaggaaaaagtca

SEQ ID NO: 414879 - DNA, 16 bp, M. musculus
ggaaaggaactccaca

SEQ ID NO: 414880 - DNA, 16 bp, M. musculus
ggaaaggacagcattt

SEQ ID NO: 414881 - DNA, 16 bp, M. musculus
ggaaaggacccagatg

SEQ ID NO: 414882 - DNA, 16 bp, M. musculus
ggaaaggactgaagga

SEQ ID NO: 414883 - DNA, 16 bp, M. musculus
ggaaaggagaaagtca

SEQ ID NO: 414884 - DNA, 16 bp, M. musculus
ggaaaggatgcctcag

SEQ ID NO: 414885 - DNA, 16 bp, M. musculus
ggaaaggccacccaga

SEQ ID NO: 414886 - DNA, 16 bp, M. musculus
ggaaaggcctccatga

SEQ ID NO: 414887 - DNA, 16 bp, M. musculus
ggaaaggctgaaagaa

SEQ ID NO: 414888 - DNA, 16 bp, M. musculus
ggaaaggctggaagaa

SEQ ID NO: 414889 - DNA, 16 bp, M. musculus
ggaaagggatgcctca

SEQ ID NO: 414890 - DNA, 16 bp, M. musculus
ggaaaggggaaaacat

SEQ ID NO: 414891 - DNA, 23 bp, M. musculus
ggaaaggggataacatttgaaat

SEQ ID NO: 414892 - DNA, 16 bp, M. musculus
ggaaaggtaattgttg

SEQ ID NO: 414893 - DNA, 16 bp, M. musculus
ggaaaggttttattca

SEQ ID NO: 414894 - DNA, 16 bp, M. musculus
ggaaaggttttatttc

SEQ ID NO: 414895 - DNA, 16 bp, M. musculus
ggaaagtatttaattg

SEQ ID NO: 414896 - DNA, 16 bp, M. musculus
ggaaagtctttttttt

SEQ ID NO: 414897 - DNA, 16 bp, M. musculus
ggaaagtgaaagcagg

SEQ ID NO: 414898 - DNA, 16 bp, M. musculus
ggaaagtggtctgaag

SEQ ID NO: 414899 - DNA, 16 bp, M. musculus
ggaaagttttgtgggt

SEQ ID NO: 414900 - DNA, 16 bp, M. musculus
ggaaataaatatctgt

SEQ ID NO: 414901 - DNA, 16 bp, M. musculus
ggaaataattaaactt

SEQ ID NO: 414902 - DNA, 16 bp, M. musculus
ggaaatacaaattgga

SEQ ID NO: 414903 - DNA, 18 bp, M. musculus
ggaaatacaggagaacac

SEQ ID NO: 414904 - DNA, 16 bp, M. musculus
ggaaatagaaaatatc

SEQ ID NO: 414905 - DNA, 16 bp, M. musculus
ggaaatcaaagggata

SEQ ID NO: 414906 - DNA, 16 bp, M. musculus
ggaaatcattatgtta

SEQ ID NO: 414907 - DNA, 16 bp, M. musculus
ggaaatcattttggtg

SEQ ID NO: 414908 - DNA, 16 bp, M. musculus
ggaaatccaggacaaa

SEQ ID NO: 414909 - DNA, 16 bp, M. musculus
ggaaatccaggtggag

SEQ ID NO: 414910 - DNA, 16 bp, M. musculus
ggaaatccatcaaggt

SEQ ID NO: 414911 - DNA, 16 bp, M. musculus
ggaaatcctcctgcct

SEQ ID NO: 414912 - DNA, 16 bp, M. musculus
ggaaatctagatgaaa

SEQ ID NO: 414913 - DNA, 16 bp, M. musculus
ggaaatctccaaacaa

SEQ ID NO: 414914 - DNA, 16 bp, M. musculus
ggaaatgaaaatttta

SEQ ID NO: 414915 - DNA, 16 bp, M. musculus
ggaaatgaaagatctg

SEQ ID NO: 414916 - DNA, 16 bp, M. musculus
ggaaatgaaggcacaa

SEQ ID NO: 414917 - DNA, 16 bp, M. musculus
ggaaatgaaggtccag

SEQ ID NO: 414918 - DNA, 16 bp, M. musculus
ggaaatgactttctga

SEQ ID NO: 414919 - DNA, 16 bp, M. musculus
ggaaatgcaaactaaa

SEQ ID NO: 414920 - DNA, 16 bp, M. musculus
ggaaatgcaaatgaaa

SEQ ID NO: 414921 - DNA, 16 bp, M. musculus
ggaaatgcagagacaa

SEQ ID NO: 414922 - DNA, 19 bp, M. musculus
ggaaatgcctccatgagat

SEQ ID NO: 414923 - DNA, 16 bp, M. musculus
ggaaatgctgaggaga

SEQ ID NO: 414924 - DNA, 16 bp, M. musculus
ggaaatggaaatcaaa

SEQ ID NO: 414925 - DNA, 16 bp, M. musculus
ggaaatggaggcaaga

SEQ ID NO: 414926 - DNA, 16 bp, M. musculus
ggaaatggcagacacc

SEQ ID NO: 414927 - DNA, 16 bp, M. musculus
ggaaatggctcagagg

SEQ ID NO: 414928 - DNA, 16 bp, M. musculus
ggaaatggctcagtag

SEQ ID NO: 414929 - DNA, 16 bp, M. musculus
ggaaatgggcagagga

SEQ ID NO: 414930 - DNA, 16 bp, M. musculus
ggaaatgtaaaggaag

SEQ ID NO: 414931 - DNA, 16 bp, M. musculus
ggaaattaaagactct

SEQ ID NO: 414932 - DNA, 16 bp, M. musculus
ggaaattaataaatcc

SEQ ID NO: 414933 - DNA, 16 bp, M. musculus
ggaaattatgtaaata

SEQ ID NO: 414934 - DNA, 16 bp, M. musculus
ggaaattgaacacagg

SEQ ID NO: 414935 - DNA, 16 bp, M. musculus
ggaaattgaacagaaa

SEQ ID NO: 414936 - DNA, 16 bp, M. musculus
ggaaattgaacagaga

SEQ ID NO: 414937 - DNA, 16 bp, M. musculus
ggaaattgtaaataag

SEQ ID NO: 414938 - DNA, 16 bp, M. musculus
ggaaattgttctgtga

SEQ ID NO: 414939 - DNA, 16 bp, M. musculus
ggaaatttcaagacag

SEQ ID NO: 414940 - DNA, 16 bp, M. musculus
ggaacaaaaacagaat

SEQ ID NO: 414941 - DNA, 16 bp, M. musculus
ggaacaaaacaaccat

SEQ ID NO: 414942 - DNA, 16 bp, M. musculus
ggaacaaatgcagaga

SEQ ID NO: 414943 - DNA, 16 bp, M. musculus
ggaacaacaatcaaag

SEQ ID NO: 414944 - DNA, 16 bp, M. musculus
ggaacaacagcaacaa

SEQ ID NO: 414945 - DNA, 16 bp, M. musculus
ggaacaagatgttgaa

SEQ ID NO: 414946 - DNA, 16 bp, M. musculus
ggaacaagccaggaag

SEQ ID NO: 414947 - DNA, 16 bp, M. musculus
ggaacaataaaacaac

SEQ ID NO: 414948 - DNA, 16 bp, M. musculus
ggaacacaacttcttc

SEQ ID NO: 414949 - DNA, 16 bp, M. musculus
ggaacacagagccccc

SEQ ID NO: 414950 - DNA, 16 bp, M. musculus
ggaacacagagcctcc

SEQ ID NO: 414951 - DNA, 16 bp, M. musculus
ggaacacatgtccctg

SEQ ID NO: 414952 - DNA, 16 bp, M. musculus
ggaacaccagggcaaa

SEQ ID NO: 414953 - DNA, 16 bp, M. musculus
ggaacaccagggccag

SEQ ID NO: 414954 - DNA, 23 bp, M. musculus
ggaacaccccatgaggctatagg

SEQ ID NO: 414955 - DNA, 16 bp, M. musculus
ggaacaccctcataaa

SEQ ID NO: 414956 - DNA, 16 bp, M. musculus
ggaacaccttctggat

SEQ ID NO: 414957 - DNA, 16 bp, M. musculus
ggaacactgaggaaga

SEQ ID NO: 414958 - DNA, 16 bp, M. musculus
ggaacactgcttgctg

SEQ ID NO: 414959 - DNA, 17 bp, M. musculus
ggaacactggcagaagg

SEQ ID NO: 414960 - DNA, 16 bp, M. musculus
ggaacagaaggaaaat

SEQ ID NO: 414961 - DNA, 16 bp, M. musculus
ggaacagaagttcaag

SEQ ID NO: 414962 - DNA, 16 bp, M. musculus
ggaacagagaatgaag

SEQ ID NO: 414963 - DNA, 16 bp, M. musculus
ggaacagagacagaga

SEQ ID NO: 414964 - DNA, 16 bp, M. musculus
ggaacagagtcagaga

SEQ ID NO: 414965 - DNA, 16 bp, M. musculus
ggaacagatacagaaa

SEQ ID NO: 414966 - DNA, 16 bp, M. musculus
ggaacagcagaaaggc

SEQ ID NO: 414967 - DNA, 16 bp, M. musculus
ggaacagcctgggaca

SEQ ID NO: 414968 - DNA, 16 bp, M. musculus
ggaacaggaccttcag

SEQ ID NO: 414969 - DNA, 16 bp, M. musculus
ggaacaggagggatga

SEQ ID NO: 414970 - DNA, 16 bp, M. musculus
ggaacaggcagtacag

SEQ ID NO: 414971 - DNA, 16 bp, M. musculus
ggaacagtcaaagggt

SEQ ID NO: 414972 - DNA, 16 bp, M. musculus
ggaacagtttgaggaa

SEQ ID NO: 414973 - DNA, 16 bp, M. musculus
ggaacatcagggccaa

SEQ ID NO: 414974 - DNA, 16 bp, M. musculus
ggaacatctgggttat

SEQ ID NO: 414975 - DNA, 16 bp, M. musculus
ggaacattctggaaga

SEQ ID NO: 414976 - DNA, 16 bp, M. musculus
ggaacattgtagaaga

SEQ ID NO: 414977 - DNA, 16 bp, M. musculus
ggaacattttggaaga

SEQ ID NO: 414978 - DNA, 16 bp, M. musculus
ggaaccaaacccaggt

SEQ ID NO: 414979 - DNA, 16 bp, M. musculus
ggaaccaaactcaggt

SEQ ID NO: 414980 - DNA, 16 bp, M. musculus
ggaaccaaacttgggt

SEQ ID NO: 414981 - DNA, 16 bp, M. musculus
ggaaccaagacaaggc

SEQ ID NO: 414982 - DNA, 16 bp, M. musculus
ggaaccaagatgtctc

SEQ ID NO: 414983 - DNA, 16 bp, M. musculus
ggaaccaagctcaggt

SEQ ID NO: 414984 - DNA, 41 bp, M. musculus
ggaaccaatgctaattttaccttggtgcagttagacaggct

SEQ ID NO: 414985 - DNA, 16 bp, M. musculus
ggaaccacatggtggc

SEQ ID NO: 414986 - DNA, 16 bp, M. musculus
ggaaccaccagactgt

SEQ ID NO: 414987 - DNA, 16 bp, M. musculus
ggaaccagaactgcgg

SEQ ID NO: 414988 - DNA, 16 bp, M. musculus
ggaaccagaggctgga

SEQ ID NO: 414989 - DNA, 16 bp, M. musculus
ggaaccaggtcctctg

SEQ ID NO: 414990 - DNA, 16 bp, M. musculus
ggaaccatagatgcaa

SEQ ID NO: 414991 - DNA, 16 bp, M. musculus
ggaaccatcccataat

SEQ ID NO: 414992 - DNA, 16 bp, M. musculus
ggaaccatggctccag

SEQ ID NO: 414993 - DNA, 116 bp, M. musculus
ggaaccatgggccttattctcggccggggttcactcaccttgcagggcttagtagtccaccctggagttatggattgtcaacattcccctgaaatacaggtcctgtgctcaagccc

SEQ ID NO: 414994 - DNA, 16 bp, M. musculus
ggaacccaaagaactt

SEQ ID NO: 414995 - DNA, 16 bp, M. musculus
ggaacccagaggcagg

SEQ ID NO: 414996 - DNA, 16 bp, M. musculus
ggaacccaggtcctct

SEQ ID NO: 414997 - DNA, 16 bp, M. musculus
ggaaccccatgctcag

SEQ ID NO: 414998 - DNA, 16 bp, M. musculus
ggaaccctgaagaaga

SEQ ID NO: 414999 - DNA, 16 bp, M. musculus
ggaaccctgcagaaga

SEQ ID NO: 415000 - DNA, 16 bp, M. musculus
ggaaccctgcccaacc

SEQ ID NO: 415001 - DNA, 16 bp, M. musculus
ggaacctccattgaga

SEQ ID NO: 415002 - DNA, 16 bp, M. musculus
ggaacctgagactgtg

SEQ ID NO: 415003 - DNA, 16 bp, M. musculus
ggaacctgaggagcca

SEQ ID NO: 415004 - DNA, 16 bp, M. musculus
ggaacctggaggcaga

SEQ ID NO: 415005 - DNA, 18 bp, M. musculus
ggaaccttataaccttga

SEQ ID NO: 415006 - DNA, 16 bp, M. musculus
ggaacgaagtatccac

SEQ ID NO: 415007 - DNA, 16 bp, M. musculus
ggaactaaactcaggt

SEQ ID NO: 415008 - DNA, 16 bp, M. musculus
ggaactagctctgtaa

SEQ ID NO: 415009 - DNA, 17 bp, M. musculus
ggaactcaagcaggcca

SEQ ID NO: 415010 - DNA, 16 bp, M. musculus
ggaactcactatgcag

SEQ ID NO: 415011 - DNA, 16 bp, M. musculus
ggaactcagaaatcca

SEQ ID NO: 415012 - DNA, 16 bp, M. musculus
ggaactcagaaatctg

SEQ ID NO: 415013 - DNA, 16 bp, M. musculus
ggaactcagagacctg

SEQ ID NO: 415014 - DNA, 16 bp, M. musculus
ggaactcagagatccc

SEQ ID NO: 415015 - DNA, 16 bp, M. musculus
ggaactcccacctcct

SEQ ID NO: 415016 - DNA, 16 bp, M. musculus
ggaactcctacagctg

SEQ ID NO: 415017 - DNA, 16 bp, M. musculus
ggaactctgagtttga

SEQ ID NO: 415018 - DNA, 16 bp, M. musculus
ggaactctgtagacca

SEQ ID NO: 415019 - DNA, 16 bp, M. musculus
ggaactgaacttgagt

SEQ ID NO: 415020 - DNA, 16 bp, M. musculus
ggaactgaacttggga

SEQ ID NO: 415021 - DNA, 16 bp, M. musculus
ggaactgaagcagaaa

SEQ ID NO: 415022 - DNA, 16 bp, M. musculus
ggaactgaagcaggaa

SEQ ID NO: 415023 - DNA, 16 bp, M. musculus
ggaactgaaggagctg

SEQ ID NO: 415024 - DNA, 16 bp, M. musculus
ggaactgaagttacaa

SEQ ID NO: 415025 - DNA, 16 bp, M. musculus
ggaactgaatttgagt

SEQ ID NO: 415026 - DNA, 16 bp, M. musculus
ggaactgagcaactgc

SEQ ID NO: 415027 - DNA, 16 bp, M. musculus
ggaactgaggacacca

SEQ ID NO: 415028 - DNA, 16 bp, M. musculus
ggaactgaggcaggag

SEQ ID NO: 415029 - DNA, 16 bp, M. musculus
ggaactgagtgggaga

SEQ ID NO: 415030 - DNA, 16 bp, M. musculus
ggaactgccagacaga

SEQ ID NO: 415031 - DNA, 16 bp, M. musculus
ggaactgctgggctct

SEQ ID NO: 415032 - DNA, 16 bp, M. musculus
ggaactggaagagaag

SEQ ID NO: 415033 - DNA, 16 bp, M. musculus
ggaactggaagagagg

SEQ ID NO: 415034 - DNA, 16 bp, M. musculus
ggaactggaattacag

SEQ ID NO: 415035 - DNA, 16 bp, M. musculus
ggaactggaattatgg

SEQ ID NO: 415036 - DNA, 16 bp, M. musculus
ggaactggagaaatgg

SEQ ID NO: 415037 - DNA, 16 bp, M. musculus
ggaactggaggtacag

SEQ ID NO: 415038 - DNA, 16 bp, M. musculus
ggaactggagtcacaa

SEQ ID NO: 415039 - DNA, 16 bp, M. musculus
ggaactggagttccag

SEQ ID NO: 415040 - DNA, 16 bp, M. musculus
ggaactgggaaaggga

SEQ ID NO: 415041 - DNA, 16 bp, M. musculus
ggaactgggaactggg

SEQ ID NO: 415042 - DNA, 16 bp, M. musculus
ggaactgggaggaggg

SEQ ID NO: 415043 - DNA, 16 bp, M. musculus
ggaactggtaagatgt

SEQ ID NO: 415044 - DNA, 16 bp, M. musculus
ggaactgtatgaaagg

SEQ ID NO: 415045 - DNA, 16 bp, M. musculus
ggaactgtatttaagg

SEQ ID NO: 415046 - DNA, 17 bp, M. musculus
ggaactgtgggaagccg

SEQ ID NO: 415047 - DNA, 16 bp, M. musculus
ggaactgtgggagagg

SEQ ID NO: 415048 - DNA, 16 bp, M. musculus
ggaactgtgtgagggg

SEQ ID NO: 415049 - DNA, 16 bp, M. musculus
ggaacttgcagagatc

SEQ ID NO: 415050 - DNA, 16 bp, M. musculus
ggaacttgctccatag

SEQ ID NO: 415051 - DNA, 16 bp, M. musculus
ggaacttgttctgtag

SEQ ID NO: 415052 - DNA, 16 bp, M. musculus
ggaagaaaaacatttt

SEQ ID NO: 415053 - DNA, 16 bp, M. musculus
ggaagaaaaatatcaa

SEQ ID NO: 415054 - DNA, 16 bp, M. musculus
ggaagaaaagatggta

SEQ ID NO: 415055 - DNA, 16 bp, M. musculus
ggaagaaagaacccac

SEQ ID NO: 415056 - DNA, 16 bp, M. musculus
ggaagaaagacagaat

SEQ ID NO: 415057 - DNA, 16 bp, M. musculus
ggaagaaagagttcat

SEQ ID NO: 415058 - DNA, 16 bp, M. musculus
ggaagaaagcagacag

SEQ ID NO: 415059 - DNA, 16 bp, M. musculus
ggaagaaaggaaggct

SEQ ID NO: 415060 - DNA, 16 bp, M. musculus
ggaagaaatcaggaaa

SEQ ID NO: 415061 - DNA, 16 bp, M. musculus
ggaagaaatcgggaaa

SEQ ID NO: 415062 - DNA, 16 bp, M. musculus
ggaagaaattacagag

SEQ ID NO: 415063 - DNA, 16 bp, M. musculus
ggaagaacaaaaatat

SEQ ID NO: 415064 - DNA, 16 bp, M. musculus
ggaagaacaggaagtg

SEQ ID NO: 415065 - DNA, 16 bp, M. musculus
ggaagaacctcaaaca

SEQ ID NO: 415066 - DNA, 16 bp, M. musculus
ggaagaacctgaggag

SEQ ID NO: 415067 - DNA, 16 bp, M. musculus
ggaagaactgaagaag

SEQ ID NO: 415068 - DNA, 16 bp, M. musculus
ggaagaactgggagga

SEQ ID NO: 415069 - DNA, 16 bp, M. musculus
ggaagaagaaaactga

SEQ ID NO: 415070 - DNA, 16 bp, M. musculus
ggaagaagaaacaata

SEQ ID NO: 415071 - DNA, 16 bp, M. musculus
ggaagaagaacctgaa

SEQ ID NO: 415072 - DNA, 16 bp, M. musculus
ggaagaagaagctgct

SEQ ID NO: 415073 - DNA, 16 bp, M. musculus
ggaagaagagccagtg

SEQ ID NO: 415074 - DNA, 16 bp, M. musculus
ggaagaagatgtagaa

SEQ ID NO: 415075 - DNA, 16 bp, M. musculus
ggaagaagatgtgcct

SEQ ID NO: 415076 - DNA, 16 bp, M. musculus
ggaagaagcagaagca

SEQ ID NO: 415077 - DNA, 16 bp, M. musculus
ggaagaagcagctcat

SEQ ID NO: 415078 - DNA, 16 bp, M. musculus
ggaagaagccagccat

SEQ ID NO: 415079 - DNA, 16 bp, M. musculus
ggaagaagctgaggaa

SEQ ID NO: 415080 - DNA, 16 bp, M. musculus
ggaagaaggaagcttg

SEQ ID NO: 415081 - DNA, 16 bp, M. musculus
ggaagaaggaagtttg

SEQ ID NO: 415082 - DNA, 16 bp, M. musculus
ggaagaaggcatcaga

SEQ ID NO: 415083 - DNA, 16 bp, M. musculus
ggaagaagtatgtcac

SEQ ID NO: 415084 - DNA, 16 bp, M. musculus
ggaagaagtcaaagca

SEQ ID NO: 415085 - DNA, 16 bp, M. musculus
ggaagaataaattata

SEQ ID NO: 415086 - DNA, 16 bp, M. musculus
ggaagaatgacagcat

SEQ ID NO: 415087 - DNA, 16 bp, M. musculus
ggaagacaatgaagag

SEQ ID NO: 415088 - DNA, 16 bp, M. musculus
ggaagacaccaaagaa

SEQ ID NO: 415089 - DNA, 16 bp, M. musculus
ggaagacacctgatat

SEQ ID NO: 415090 - DNA, 16 bp, M. musculus
ggaagacaggaagcag

SEQ ID NO: 415091 - DNA, 16 bp, M. musculus
ggaagaccaaagtgcg

SEQ ID NO: 415092 - DNA, 16 bp, M. musculus
ggaagaccaaagtgtg

SEQ ID NO: 415093 - DNA, 16 bp, M. musculus
ggaagaccacagtgtg

SEQ ID NO: 415094 - DNA, 16 bp, M. musculus
ggaagaccagcagact

SEQ ID NO: 415095 - DNA, 16 bp, M. musculus
ggaagaccaggaaggg

SEQ ID NO: 415096 - DNA, 16 bp, M. musculus
ggaagacccaccctga

SEQ ID NO: 415097 - DNA, 16 bp, M. musculus
ggaagacccagaaatg

SEQ ID NO: 415098 - DNA, 16 bp, M. musculus
ggaagaccttgtctca

SEQ ID NO: 415099 - DNA, 16 bp, M. musculus
ggaagactatttcttc

SEQ ID NO: 415100 - DNA, 16 bp, M. musculus
ggaagactctgtctca

SEQ ID NO: 415101 - DNA, 16 bp, M. musculus
ggaagactggaagaaa

SEQ ID NO: 415102 - DNA, 16 bp, M. musculus
ggaagactgggaggag

SEQ ID NO: 415103 - DNA, 16 bp, M. musculus
ggaagactttaagaag

SEQ ID NO: 415104 - DNA, 16 bp, M. musculus
ggaagagagaatgaca

SEQ ID NO: 415105 - DNA, 16 bp, M. musculus
ggaagagagacagaca

SEQ ID NO: 415106 - DNA, 16 bp, M. musculus
ggaagagagctgtaag

SEQ ID NO: 415107 - DNA, 16 bp, M. musculus
ggaagagagtcccctt

SEQ ID NO: 415108 - DNA, 16 bp, M. musculus
ggaagagcaagcagtg

SEQ ID NO: 415109 - DNA, 16 bp, M. musculus
ggaagagcagaaagca

SEQ ID NO: 415110 - DNA, 16 bp, M. musculus
ggaagagcagcaagct

SEQ ID NO: 415111 - DNA, 16 bp, M. musculus
ggaagagcagcaagta

SEQ ID NO: 415112 - DNA, 16 bp, M. musculus
ggaagagcagcagtct

SEQ ID NO: 415113 - DNA, 16 bp, M. musculus
ggaagagcagcagtgc

SEQ ID NO: 415114 - DNA, 16 bp, M. musculus
ggaagagcagccactg

SEQ ID NO: 415115 - DNA, 16 bp, M. musculus
ggaagagcagctggta

SEQ ID NO: 415116 - DNA, 16 bp, M. musculus
ggaagagcagtcagag

SEQ ID NO: 415117 - DNA, 16 bp, M. musculus
ggaagagcagtcaggt

SEQ ID NO: 415118 - DNA, 22 bp, M. musculus
ggaagagcagtcagtgctcttg

SEQ ID NO: 415119 - DNA, 16 bp, M. musculus
ggaagagcctcaaaca

SEQ ID NO: 415120 - DNA, 16 bp, M. musculus
ggaagagcctctggga

SEQ ID NO: 415121 - DNA, 16 bp, M. musculus
ggaagagcctggaaca

SEQ ID NO: 415122 - DNA, 16 bp, M. musculus
ggaagagcctggaaga

SEQ ID NO: 415123 - DNA, 16 bp, M. musculus
ggaagagctggaagaa

SEQ ID NO: 415124 - DNA, 16 bp, M. musculus
ggaagagctggagaaa

SEQ ID NO: 415125 - DNA, 16 bp, M. musculus
ggaagagctggctctg

SEQ ID NO: 415126 - DNA, 16 bp, M. musculus
ggaagaggaagatgat

SEQ ID NO: 415127 - DNA, 16 bp, M. musculus
ggaagaggaatgggat

SEQ ID NO: 415128 - DNA, 16 bp, M. musculus
ggaagaggagatcaga

SEQ ID NO: 415129 - DNA, 16 bp, M. musculus
ggaagaggagccagtg

SEQ ID NO: 415130 - DNA, 16 bp, M. musculus
ggaagaggaggcacag

SEQ ID NO: 415131 - DNA, 16 bp, M. musculus
ggaagaggatgtgcct

SEQ ID NO: 415132 - DNA, 19 bp, M. musculus
ggaagaggggactataatt

SEQ ID NO: 415133 - DNA, 16 bp, M. musculus
ggaagaggggctggag

SEQ ID NO: 415134 - DNA, 16 bp, M. musculus
ggaagagtccagagca

SEQ ID NO: 415135 - DNA, 16 bp, M. musculus
ggaagagtccaggctg

SEQ ID NO: 415136 - DNA, 16 bp, M. musculus
ggaagagtggccagtg

SEQ ID NO: 415137 - DNA, 16 bp, M. musculus
ggaagagttgagagaa

SEQ ID NO: 415138 - DNA, 16 bp, M. musculus
ggaagagttggaagaa

SEQ ID NO: 415139 - DNA, 16 bp, M. musculus
ggaagagttggagaaa

SEQ ID NO: 415140 - DNA, 16 bp, M. musculus
ggaagagttggaggaa

SEQ ID NO: 415141 - DNA, 16 bp, M. musculus
ggaagagttgggagaa

SEQ ID NO: 415142 - DNA, 16 bp, M. musculus
ggaagataatgttgag

SEQ ID NO: 415143 - DNA, 16 bp, M. musculus
ggaagatacaaagaaa

SEQ ID NO: 415144 - DNA, 16 bp, M. musculus
ggaagatcagaatgag

SEQ ID NO: 415145 - DNA, 16 bp, M. musculus
ggaagatctcagaaga

SEQ ID NO: 415146 - DNA, 16 bp, M. musculus
ggaagatctctgagtt

SEQ ID NO: 415147 - DNA, 16 bp, M. musculus
ggaagatctttccatt

SEQ ID NO: 415148 - DNA, 16 bp, M. musculus
ggaagatgaagcagaa

SEQ ID NO: 415149 - DNA, 16 bp, M. musculus
ggaagatgaccttgaa

SEQ ID NO: 415150 - DNA, 16 bp, M. musculus
ggaagatgagcaggga

SEQ ID NO: 415151 - DNA, 16 bp, M. musculus
ggaagatgcacagagg

SEQ ID NO: 415152 - DNA, 16 bp, M. musculus
ggaagatgggatttct

SEQ ID NO: 415153 - DNA, 16 bp, M. musculus
ggaagcaaacaactca

SEQ ID NO: 415154 - DNA, 16 bp, M. musculus
ggaagcaaagacagga

SEQ ID NO: 415155 - DNA, 16 bp, M. musculus
ggaagcaaagccacaa

SEQ ID NO: 415156 - DNA, 16 bp, M. musculus
ggaagcaaaggcagaa

SEQ ID NO: 415157 - DNA, 16 bp, M. musculus
ggaagcaacagtgtca

SEQ ID NO: 415158 - DNA, 16 bp, M. musculus
ggaagcaagaggctcc

SEQ ID NO: 415159 - DNA, 16 bp, M. musculus
ggaagcaagccaataa

SEQ ID NO: 415160 - DNA, 16 bp, M. musculus
ggaagcaagccagtaa

SEQ ID NO: 415161 - DNA, 16 bp, M. musculus
ggaagcacaaaagtcc

SEQ ID NO: 415162 - DNA, 16 bp, M. musculus
ggaagcacaaaattcc

SEQ ID NO: 415163 - DNA, 16 bp, M. musculus
ggaagcacaggcaggc

SEQ ID NO: 415164 - DNA, 16 bp, M. musculus
ggaagcacttccccaa

SEQ ID NO: 415165 - DNA, 16 bp, M. musculus
ggaagcacttgttggc

SEQ ID NO: 415166 - DNA, 16 bp, M. musculus
ggaagcagaaaaactg

SEQ ID NO: 415167 - DNA, 16 bp, M. musculus
ggaagcagaaactgaa

SEQ ID NO: 415168 - DNA, 16 bp, M. musculus
ggaagcagaagcaggc

SEQ ID NO: 415169 - DNA, 16 bp, M. musculus
ggaagcagaagccagg

SEQ ID NO: 415170 - DNA, 16 bp, M. musculus
ggaagcagagagcaaa

SEQ ID NO: 415171 - DNA, 16 bp, M. musculus
ggaagcagagagcaat

SEQ ID NO: 415172 - DNA, 16 bp, M. musculus
ggaagcagagagcaga

SEQ ID NO: 415173 - DNA, 16 bp, M. musculus
ggaagcagagatggat

SEQ ID NO: 415174 - DNA, 16 bp, M. musculus
ggaagcagaggcaaga

SEQ ID NO: 415175 - DNA, 16 bp, M. musculus
ggaagcagaggcagaa

SEQ ID NO: 415176 - DNA, 16 bp, M. musculus
ggaagcagagggagat

SEQ ID NO: 415177 - DNA, 17 bp, M. musculus
ggaagcagagtcttgga

SEQ ID NO: 415178 - DNA, 16 bp, M. musculus
ggaagcaggaacttgg

SEQ ID NO: 415179 - DNA, 16 bp, M. musculus
ggaagcaggggcaggc

SEQ ID NO: 415180 - DNA, 16 bp, M. musculus
ggaagcaggtgctgat

SEQ ID NO: 415181 - DNA, 16 bp, M. musculus
ggaagcagtttctgct

SEQ ID NO: 415182 - DNA, 16 bp, M. musculus
ggaagcatggcactgt

SEQ ID NO: 415183 - DNA, 16 bp, M. musculus
ggaagccaaaacagga

SEQ ID NO: 415184 - DNA, 16 bp, M. musculus
ggaagccaactccaag

SEQ ID NO: 415185 - DNA, 16 bp, M. musculus
ggaagccaagaaaact

SEQ ID NO: 415186 - DNA, 16 bp, M. musculus
ggaagccaaggcagaa

SEQ ID NO: 415187 - DNA, 16 bp, M. musculus
ggaagccaccctcaca

SEQ ID NO: 415188 - DNA, 16 bp, M. musculus
ggaagccagaagaggg

SEQ ID NO: 415189 - DNA, 16 bp, M. musculus
ggaagccagagaacaa

SEQ ID NO: 415190 - DNA, 16 bp, M. musculus
ggaagccaggaaggac

SEQ ID NO: 415191 - DNA, 16 bp, M. musculus
ggaagccagggcagga

SEQ ID NO: 415192 - DNA, 18 bp, M. musculus
ggaagccagtgccatctt

SEQ ID NO: 415193 - DNA, 16 bp, M. musculus
ggaagccatggaaccc

SEQ ID NO: 415194 - DNA, 16 bp, M. musculus
ggaagccattgcagag

SEQ ID NO: 415195 - DNA, 16 bp, M. musculus
ggaagcccagaaggcc

SEQ ID NO: 415196 - DNA, 16 bp, M. musculus
ggaagccctcctctga

SEQ ID NO: 415197 - DNA, 16 bp, M. musculus
ggaagccctgctggaa

SEQ ID NO: 415198 - DNA, 16 bp, M. musculus
ggaagccctgggctgg

SEQ ID NO: 415199 - DNA, 16 bp, M. musculus
ggaagctcccagagac

SEQ ID NO: 415200 - DNA, 16 bp, M. musculus
ggaagctgaagcagga

SEQ ID NO: 415201 - DNA, 16 bp, M. musculus
ggaagctgagagttct

SEQ ID NO: 415202 - DNA, 16 bp, M. musculus
ggaagctgagcaagcc

SEQ ID NO: 415203 - DNA, 16 bp, M. musculus
ggaagctgaggaagga

SEQ ID NO: 415204 - DNA, 16 bp, M. musculus
ggaagctgaggtaaga

SEQ ID NO: 415205 - DNA, 16 bp, M. musculus
ggaagctgatcatggg

SEQ ID NO: 415206 - DNA, 16 bp, M. musculus
ggaagctgcctggaaa

SEQ ID NO: 415207 - DNA, 16 bp, M. musculus
ggaagctggaagctgg

SEQ ID NO: 415208 - DNA, 16 bp, M. musculus
ggaagctggagagatg

SEQ ID NO: 415209 - DNA, 16 bp, M. musculus
ggaagctggagcagga

SEQ ID NO: 415210 - DNA, 16 bp, M. musculus
ggaagctggagctgat

SEQ ID NO: 415211 - DNA, 16 bp, M. musculus
ggaagctggagtaggt

SEQ ID NO: 415212 - DNA, 16 bp, M. musculus
ggaagctgggcatggt

SEQ ID NO: 415213 - DNA, 16 bp, M. musculus
ggaagctgtcttatga

SEQ ID NO: 415214 - DNA, 16 bp, M. musculus
ggaagctgtgaaaggc

SEQ ID NO: 415215 - DNA, 16 bp, M. musculus
ggaagcttctacagta

SEQ ID NO: 415216 - DNA, 16 bp, M. musculus
ggaagcttctggcctc

SEQ ID NO: 415217 - DNA, 16 bp, M. musculus
ggaaggaaagaatcaa

SEQ ID NO: 415218 - DNA, 16 bp, M. musculus
ggaaggaaagggttca

SEQ ID NO: 415219 - DNA, 16 bp, M. musculus
ggaaggaaagtggaca

SEQ ID NO: 415220 - DNA, 16 bp, M. musculus
ggaaggaacctggagg

SEQ ID NO: 415221 - DNA, 16 bp, M. musculus
ggaaggaagaaagcca

SEQ ID NO: 415222 - DNA, 16 bp, M. musculus
ggaaggaagaaatcaa

SEQ ID NO: 415223 - DNA, 16 bp, M. musculus
ggaaggaagacagcat

SEQ ID NO: 415224 - DNA, 16 bp, M. musculus
ggaaggaagaccaaag

SEQ ID NO: 415225 - DNA, 16 bp, M. musculus
ggaaggaagcaagcag

SEQ ID NO: 415226 - DNA, 16 bp, M. musculus
ggaaggaagcaggcac

SEQ ID NO: 415227 - DNA, 16 bp, M. musculus
ggaaggaaggaactaa

SEQ ID NO: 415228 - DNA, 16 bp, M. musculus
ggaaggacacttgata

SEQ ID NO: 415229 - DNA, 16 bp, M. musculus
ggaaggacagactcca

SEQ ID NO: 415230 - DNA, 16 bp, M. musculus
ggaaggacagagacaa

SEQ ID NO: 415231 - DNA, 16 bp, M. musculus
ggaaggacattggtga

SEQ ID NO: 415232 - DNA, 16 bp, M. musculus
ggaaggacccagccca

SEQ ID NO: 415233 - DNA, 16 bp, M. musculus
ggaaggacctggaggg

SEQ ID NO: 415234 - DNA, 16 bp, M. musculus
ggaaggacggacggac

SEQ ID NO: 415235 - DNA, 16 bp, M. musculus
ggaaggactctgccct

SEQ ID NO: 415236 - DNA, 16 bp, M. musculus
ggaaggactgaagcag

SEQ ID NO: 415237 - DNA, 16 bp, M. musculus
ggaaggagaacagaca

SEQ ID NO: 415238 - DNA, 16 bp, M. musculus
ggaaggagagaaccaa

SEQ ID NO: 415239 - DNA, 16 bp, M. musculus
ggaaggagagaaccca

SEQ ID NO: 415240 - DNA, 16 bp, M. musculus
ggaaggagagaactgt

SEQ ID NO: 415241 - DNA, 16 bp, M. musculus
ggaaggagagagccca

SEQ ID NO: 415242 - DNA, 16 bp, M. musculus
ggaaggagaggcaggt

SEQ ID NO: 415243 - DNA, 16 bp, M. musculus
ggaaggagaggccctt

SEQ ID NO: 415244 - DNA, 16 bp, M. musculus
ggaaggagcaacagtg

SEQ ID NO: 415245 - DNA, 16 bp, M. musculus
ggaaggagcctccctt

SEQ ID NO: 415246 - DNA, 16 bp, M. musculus
ggaaggagctggagag

SEQ ID NO: 415247 - DNA, 16 bp, M. musculus
ggaaggagctggagga

SEQ ID NO: 415248 - DNA, 16 bp, M. musculus
ggaaggaggaaatgat

SEQ ID NO: 415249 - DNA, 16 bp, M. musculus
ggaaggaggagctgat

SEQ ID NO: 415250 - DNA, 16 bp, M. musculus
ggaaggagttgcaaag

SEQ ID NO: 415251 - DNA, 16 bp, M. musculus
ggaaggagttttcagg

SEQ ID NO: 415252 - DNA, 16 bp, M. musculus
ggaaggatcagaggaa

SEQ ID NO: 415253 - DNA, 16 bp, M. musculus
ggaaggatgtggagaa

SEQ ID NO: 415254 - DNA, 16 bp, M. musculus
ggaaggattgtggccc

SEQ ID NO: 415255 - DNA, 16 bp, M. musculus
ggaaggcaaaggcaag

SEQ ID NO: 415256 - DNA, 16 bp, M. musculus
ggaaggcaaggcagga

SEQ ID NO: 415257 - DNA, 16 bp, M. musculus
ggaaggcagacagaca

SEQ ID NO: 415258 - DNA, 16 bp, M. musculus
ggaaggcagagatggg

SEQ ID NO: 415259 - DNA, 16 bp, M. musculus
ggaaggcagaggacaa

SEQ ID NO: 415260 - DNA, 16 bp, M. musculus
ggaaggcagaggcaag

SEQ ID NO: 415261 - DNA, 16 bp, M. musculus
ggaaggcagaggtagg

SEQ ID NO: 415262 - DNA, 16 bp, M. musculus
ggaaggcagagtacat

SEQ ID NO: 415263 - DNA, 16 bp, M. musculus
ggaaggcaggactgga

SEQ ID NO: 415264 - DNA, 16 bp, M. musculus
ggaaggcaggagtggg

SEQ ID NO: 415265 - DNA, 16 bp, M. musculus
ggaaggcatcttggaa

SEQ ID NO: 415266 - DNA, 16 bp, M. musculus
ggaaggcattttctta

SEQ ID NO: 415267 - DNA, 16 bp, M. musculus
ggaaggccagcagtct

SEQ ID NO: 415268 - DNA, 17 bp, M. musculus
ggaaggccagtcaggtg

SEQ ID NO: 415269 - DNA, 17 bp, M. musculus
ggaaggccattggtgaa

SEQ ID NO: 415270 - DNA, 16 bp, M. musculus
ggaaggccccagaacc

SEQ ID NO: 415271 - DNA, 16 bp, M. musculus
ggaaggcctgctcttt

SEQ ID NO: 415272 - DNA, 16 bp, M. musculus
ggaaggccttcctgca

SEQ ID NO: 415273 - DNA, 16 bp, M. musculus
ggaaggctactggttt

SEQ ID NO: 415274 - DNA, 16 bp, M. musculus
ggaaggctgaggcagg

SEQ ID NO: 415275 - DNA, 16 bp, M. musculus
ggaaggctggaagaag

SEQ ID NO: 415276 - DNA, 16 bp, M. musculus
ggaagggaatgcaggg

SEQ ID NO: 415277 - DNA, 16 bp, M. musculus
ggaagggacacacaca

SEQ ID NO: 415278 - DNA, 16 bp, M. musculus
ggaagggactgggagg

SEQ ID NO: 415279 - DNA, 16 bp, M. musculus
ggaagggagggacctg

SEQ ID NO: 415280 - DNA, 16 bp, M. musculus
ggaagggcaaggcctg

SEQ ID NO: 415281 - DNA, 16 bp, M. musculus
ggaagggcccattgtg

SEQ ID NO: 415282 - DNA, 16 bp, M. musculus
ggaaggggtgcctcag

SEQ ID NO: 415283 - DNA, 16 bp, M. musculus
ggaagggtttatttca

SEQ ID NO: 415284 - DNA, 16 bp, M. musculus
ggaaggtggagaacca

SEQ ID NO: 415285 - DNA, 18 bp, M. musculus
ggaaggtggccggctgtc

SEQ ID NO: 415286 - DNA, 16 bp, M. musculus
ggaaggtggctggctg

SEQ ID NO: 415287 - DNA, 16 bp, M. musculus
ggaaggttgaaaacca

SEQ ID NO: 415288 - DNA, 16 bp, M. musculus
ggaaggttgagaaccc

SEQ ID NO: 415289 - DNA, 16 bp, M. musculus
ggaaggttttgttttg

SEQ ID NO: 415290 - DNA, 16 bp, M. musculus
ggaaggtttttaatga

SEQ ID NO: 415291 - DNA, 16 bp, M. musculus
ggaagtaactgggacc

SEQ ID NO: 415292 - DNA, 16 bp, M. musculus
ggaagtaactttatgg

SEQ ID NO: 415293 - DNA, 16 bp, M. musculus
ggaagtacaagtactt

SEQ ID NO: 415294 - DNA, 16 bp, M. musculus
ggaagtacacttcata

SEQ ID NO: 415295 - DNA, 16 bp, M. musculus
ggaagtataagatgaa

SEQ ID NO: 415296 - DNA, 16 bp, M. musculus
ggaagtatggctgctg

SEQ ID NO: 415297 - DNA, 16 bp, M. musculus
ggaagtatgtgtgtgt

SEQ ID NO: 415298 - DNA, 16 bp, M. musculus
ggaagtcaaggcagga

SEQ ID NO: 415299 - DNA, 16 bp, M. musculus
ggaagtcaatatgaaa

SEQ ID NO: 415300 - DNA, 16 bp, M. musculus
ggaagtcagaactgga

SEQ ID NO: 415301 - DNA, 16 bp, M. musculus
ggaagtcagaagagga

SEQ ID NO: 415302 - DNA, 16 bp, M. musculus
ggaagtcagagacagg

SEQ ID NO: 415303 - DNA, 16 bp, M. musculus
ggaagtcagaggagga

SEQ ID NO: 415304 - DNA, 16 bp, M. musculus
ggaagtcccacctctt

SEQ ID NO: 415305 - DNA, 16 bp, M. musculus
ggaagtcccgcctctt

SEQ ID NO: 415306 - DNA, 17 bp, M. musculus
ggaagtcctttcgttat

SEQ ID NO: 415307 - DNA, 16 bp, M. musculus
ggaagtctcaaaaaag

SEQ ID NO: 415308 - DNA, 16 bp, M. musculus
ggaagtctctctctct

SEQ ID NO: 415309 - DNA, 16 bp, M. musculus
ggaagtctgctgtgaa

SEQ ID NO: 415310 - DNA, 16 bp, M. musculus
ggaagtgaaagacctg

SEQ ID NO: 415311 - DNA, 16 bp, M. musculus
ggaagtgaggactgga

SEQ ID NO: 415312 - DNA, 16 bp, M. musculus
ggaagtgccattcagg

SEQ ID NO: 415313 - DNA, 16 bp, M. musculus
ggaagtgcttccatga

SEQ ID NO: 415314 - DNA, 16 bp, M. musculus
ggaagtggaaacaata

SEQ ID NO: 415315 - DNA, 16 bp, M. musculus
ggaagtggaagcagga

SEQ ID NO: 415316 - DNA, 16 bp, M. musculus
ggaagtggagacagga

SEQ ID NO: 415317 - DNA, 16 bp, M. musculus
ggaagtggaggcagaa

SEQ ID NO: 415318 - DNA, 16 bp, M. musculus
ggaagtggaggcagga

SEQ ID NO: 415319 - DNA, 16 bp, M. musculus
ggaagtggaggctgag

SEQ ID NO: 415320 - DNA, 16 bp, M. musculus
ggaagtggaggctgtg

SEQ ID NO: 415321 - DNA, 16 bp, M. musculus
ggaagtggagttacag

SEQ ID NO: 415322 - DNA, 16 bp, M. musculus
ggaagtggccagtggc

SEQ ID NO: 415323 - DNA, 16 bp, M. musculus
ggaagtggggccaggc

SEQ ID NO: 415324 - DNA, 16 bp, M. musculus
ggaagtggtgtgttga

SEQ ID NO: 415325 - DNA, 16 bp, M. musculus
ggaagtgtgtcactgg

SEQ ID NO: 415326 - DNA, 16 bp, M. musculus
ggaagttaaggcagga

SEQ ID NO: 415327 - DNA, 16 bp, M. musculus
ggaagttatcttctat

SEQ ID NO: 415328 - DNA, 16 bp, M. musculus
ggaagttcaaggatct

SEQ ID NO: 415329 - DNA, 16 bp, M. musculus
ggaagttcaaggtcac

SEQ ID NO: 415330 - DNA, 16 bp, M. musculus
ggaagttgtctatttc

SEQ ID NO: 415331 - DNA, 16 bp, M. musculus
ggaagttgtcttctga

SEQ ID NO: 415332 - DNA, 16 bp, M. musculus
ggaagtttccactgta

SEQ ID NO: 415333 - DNA, 16 bp, M. musculus
ggaagtttctggatgg

SEQ ID NO: 415334 - DNA, 16 bp, M. musculus
ggaataaaaattggaa

SEQ ID NO: 415335 - DNA, 16 bp, M. musculus
ggaataaaagacaaag

SEQ ID NO: 415336 - DNA, 16 bp, M. musculus
ggaataaattcagcat

SEQ ID NO: 415337 - DNA, 16 bp, M. musculus
ggaataaccaaccact

SEQ ID NO: 415338 - DNA, 16 bp, M. musculus
ggaataccaccagaag

SEQ ID NO: 415339 - DNA, 16 bp, M. musculus
ggaatacctggtaatt

SEQ ID NO: 415340 - DNA, 16 bp, M. musculus
ggaatagatgtgtcac

SEQ ID NO: 415341 - DNA, 16 bp, M. musculus
ggaatagccattacaa

SEQ ID NO: 415342 - DNA, 17 bp, M. musculus
ggaatagttccacttac

SEQ ID NO: 415343 - DNA, 16 bp, M. musculus
ggaatatcagggtcat

SEQ ID NO: 415344 - DNA, 16 bp, M. musculus
ggaatattaaacatga

SEQ ID NO: 415345 - DNA, 16 bp, M. musculus
ggaatcaaacccaggg

SEQ ID NO: 415346 - DNA, 16 bp, M. musculus
ggaatcaaactcagaa

SEQ ID NO: 415347 - DNA, 16 bp, M. musculus
ggaatcaaaggcatgc

SEQ ID NO: 415348 - DNA, 16 bp, M. musculus
ggaatcaccatgccca

SEQ ID NO: 415349 - DNA, 16 bp, M. musculus
ggaatcagcatcccag

SEQ ID NO: 415350 - DNA, 16 bp, M. musculus
ggaatcagtctggtgg

SEQ ID NO: 415351 - DNA, 16 bp, M. musculus
ggaatcctaaaagtcc

SEQ ID NO: 415352 - DNA, 16 bp, M. musculus
ggaatcctatgccctc

SEQ ID NO: 415353 - DNA, 16 bp, M. musculus
ggaatcctgaagaagt

SEQ ID NO: 415354 - DNA, 16 bp, M. musculus
ggaatctcaggtttat

SEQ ID NO: 415355 - DNA, 16 bp, M. musculus
ggaatctgacatcctc

SEQ ID NO: 415356 - DNA, 16 bp, M. musculus
ggaatctttgctctct

SEQ ID NO: 415357 - DNA, 16 bp, M. musculus
ggaatgaactactatc

SEQ ID NO: 415358 - DNA, 16 bp, M. musculus
ggaatgaacttgccag

SEQ ID NO: 415359 - DNA, 16 bp, M. musculus
ggaatgaagtattcat

SEQ ID NO: 415360 - DNA, 16 bp, M. musculus
ggaatgacaatccaga

SEQ ID NO: 415361 - DNA, 16 bp, M. musculus
ggaatgaccatccaga

SEQ ID NO: 415362 - DNA, 16 bp, M. musculus
ggaatgatcaccaaga

SEQ ID NO: 415363 - DNA, 16 bp, M. musculus
ggaatgccaggacagg

SEQ ID NO: 415364 - DNA, 16 bp, M. musculus
ggaatgctgagagcag

SEQ ID NO: 415365 - DNA, 16 bp, M. musculus
ggaatggaagcagaga

SEQ ID NO: 415366 - DNA, 16 bp, M. musculus
ggaatggaatgtggtg

SEQ ID NO: 415367 - DNA, 16 bp, M. musculus
ggaatggactttcccc

SEQ ID NO: 415368 - DNA, 16 bp, M. musculus
ggaatggagaggagcc

SEQ ID NO: 415369 - DNA, 16 bp, M. musculus
ggaatggagcagagac

SEQ ID NO: 415370 - DNA, 16 bp, M. musculus
ggaatggaggagtgtt

SEQ ID NO: 415371 - DNA, 16 bp, M. musculus
ggaatggatttttttt

SEQ ID NO: 415372 - DNA, 16 bp, M. musculus
ggaatggcaccatttg

SEQ ID NO: 415373 - DNA, 16 bp, M. musculus
ggaatggcactgccca

SEQ ID NO: 415374 - DNA, 16 bp, M. musculus
ggaatggcagaccagt

SEQ ID NO: 415375 - DNA, 16 bp, M. musculus
ggaatggcagctggga

SEQ ID NO: 415376 - DNA, 16 bp, M. musculus
ggaatggccaaccagt

SEQ ID NO: 415377 - DNA, 16 bp, M. musculus
ggaatggccaagaagc

SEQ ID NO: 415378 - DNA, 16 bp, M. musculus
ggaatgggaggttctg

SEQ ID NO: 415379 - DNA, 16 bp, M. musculus
ggaatgggatgagaaa

SEQ ID NO: 415380 - DNA, 16 bp, M. musculus
ggaatgggatgaggaa

SEQ ID NO: 415381 - DNA, 16 bp, M. musculus
ggaatggggatagcat

SEQ ID NO: 415382 - DNA, 16 bp, M. musculus
ggaatggtatcaccca

SEQ ID NO: 415383 - DNA, 16 bp, M. musculus
ggaatggtgataattc

SEQ ID NO: 415384 - DNA, 16 bp, M. musculus
ggaatggtgccgccca

SEQ ID NO: 415385 - DNA, 16 bp, M. musculus
ggaatggtgttgccca

SEQ ID NO: 415386 - DNA, 16 bp, M. musculus
ggaatggttctaatgt

SEQ ID NO: 415387 - DNA, 16 bp, M. musculus
ggaatgtcagaagcta

SEQ ID NO: 415388 - DNA, 16 bp, M. musculus
ggaatgtcagggccaa

SEQ ID NO: 415389 - DNA, 16 bp, M. musculus
ggaatgtccctagaga

SEQ ID NO: 415390 - DNA, 16 bp, M. musculus
ggaatgtcttcatcaa

SEQ ID NO: 415391 - DNA, 16 bp, M. musculus
ggaatgtggaagagtt

SEQ ID NO: 415392 - DNA, 16 bp, M. musculus
ggaatgtggtagtttg

SEQ ID NO: 415393 - DNA, 16 bp, M. musculus
ggaatgtttcttactg

SEQ ID NO: 415394 - DNA, 16 bp, M. musculus
ggaatgttttttggat

SEQ ID NO: 415395 - DNA, 16 bp, M. musculus
ggaattaaaaccttta

SEQ ID NO: 415396 - DNA, 16 bp, M. musculus
ggaattaaagactttt

SEQ ID NO: 415397 - DNA, 16 bp, M. musculus
ggaattaaaggtgtgc

SEQ ID NO: 415398 - DNA, 16 bp, M. musculus
ggaattaaatgaaaat

SEQ ID NO: 415399 - DNA, 16 bp, M. musculus
ggaattacagagataa

SEQ ID NO: 415400 - DNA, 16 bp, M. musculus
ggaattacaggagaat

SEQ ID NO: 415401 - DNA, 16 bp, M. musculus
ggaattaggggaagga

SEQ ID NO: 415402 - DNA, 16 bp, M. musculus
ggaattatgtctgtgt

SEQ ID NO: 415403 - DNA, 16 bp, M. musculus
ggaattcagttcccag

SEQ ID NO: 415404 - DNA, 16 bp, M. musculus
ggaattcccctacact

SEQ ID NO: 415405 - DNA, 16 bp, M. musculus
ggaattctgggaaatt

SEQ ID NO: 415406 - DNA, 16 bp, M. musculus
ggaattctgggaagga

SEQ ID NO: 415407 - DNA, 16 bp, M. musculus
ggaattgaacctgagt

SEQ ID NO: 415408 - DNA, 16 bp, M. musculus
ggaattgaactcagat

SEQ ID NO: 415409 - DNA, 16 bp, M. musculus
ggaattgaactcaggt

SEQ ID NO: 415410 - DNA, 16 bp, M. musculus
ggaattgaactcggaa

SEQ ID NO: 415411 - DNA, 16 bp, M. musculus
ggaattgacaaacctg

SEQ ID NO: 415412 - DNA, 16 bp, M. musculus
ggaattgacctcagga

SEQ ID NO: 415413 - DNA, 16 bp, M. musculus
ggaattgctggatctt

SEQ ID NO: 415414 - DNA, 16 bp, M. musculus
ggaattggtctgaagt

SEQ ID NO: 415415 - DNA, 16 bp, M. musculus
ggaatttattgataac

SEQ ID NO: 415416 - DNA, 16 bp, M. musculus
ggaatttgacctcaga

SEQ ID NO: 415417 - DNA, 16 bp, M. musculus
ggaatttgctttgtag

SEQ ID NO: 415418 - DNA, 16 bp, M. musculus
ggaatttggctgagtc

SEQ ID NO: 415419 - DNA, 16 bp, M. musculus
ggaattttataaattc

SEQ ID NO: 415420 - DNA, 16 bp, M. musculus
ggaattttccagaagg

SEQ ID NO: 415421 - DNA, 16 bp, M. musculus
ggaattttcttcattt

SEQ ID NO: 415422 - DNA, 16 bp, M. musculus
ggaatttttgtttctt

SEQ ID NO: 415423 - DNA, 16 bp, M. musculus
ggaatttttttctggt

SEQ ID NO: 415424 - DNA, 16 bp, M. musculus
ggaattttttttaaaa

SEQ ID NO: 415425 - DNA, 16 bp, M. musculus
ggacaaaagctcagga

SEQ ID NO: 415426 - DNA, 16 bp, M. musculus
ggacaaaaggagttat

SEQ ID NO: 415427 - DNA, 16 bp, M. musculus
ggacaaaagggtgtac

SEQ ID NO: 415428 - DNA, 16 bp, M. musculus
ggacaaacagaaagac

SEQ ID NO: 415429 - DNA, 16 bp, M. musculus
ggacaaactgaaagga

SEQ ID NO: 415430 - DNA, 16 bp, M. musculus
ggacaaagacagaaac

SEQ ID NO: 415431 - DNA, 16 bp, M. musculus
ggacaaagacaggaga

SEQ ID NO: 415432 - DNA, 16 bp, M. musculus
ggacaaagagtgaagc

SEQ ID NO: 415433 - DNA, 16 bp, M. musculus
ggacaaatttcttttc

SEQ ID NO: 415434 - DNA, 16 bp, M. musculus
ggacaacatgaccaag

SEQ ID NO: 415435 - DNA, 16 bp, M. musculus
ggacaacatgcttctg

SEQ ID NO: 415436 - DNA, 16 bp, M. musculus
ggacaacatttgaaat

SEQ ID NO: 415437 - DNA, 16 bp, M. musculus
ggacaacttgaaggaa

SEQ ID NO: 415438 - DNA, 16 bp, M. musculus
ggacaacttgctggag

SEQ ID NO: 415439 - DNA, 16 bp, M. musculus
ggacaacttggaggag

SEQ ID NO: 415440 - DNA, 16 bp, M. musculus
ggacaactttgggtgt

SEQ ID NO: 415441 - DNA, 16 bp, M. musculus
ggacaagaaacatctt

SEQ ID NO: 415442 - DNA, 16 bp, M. musculus
ggacaagctgccttgc

SEQ ID NO: 415443 - DNA, 16 bp, M. musculus
ggacaatctcctcaga

SEQ ID NO: 415444 - DNA, 16 bp, M. musculus
ggacaattgatgctga

SEQ ID NO: 415445 - DNA, 16 bp, M. musculus
ggacaattttatagac

SEQ ID NO: 415446 - DNA, 16 bp, M. musculus
ggacacaatgaaaagg

SEQ ID NO: 415447 - DNA, 17 bp, M. musculus
ggacacacaagtgaaca

SEQ ID NO: 415448 - DNA, 16 bp, M. musculus
ggacacacacacacaa

SEQ ID NO: 415449 - DNA, 16 bp, M. musculus
ggacacagaaaccaag

SEQ ID NO: 415450 - DNA, 16 bp, M. musculus
ggacacagacacagac

SEQ ID NO: 415451 - DNA, 16 bp, M. musculus
ggacacagaggacaca

SEQ ID NO: 415452 - DNA, 16 bp, M. musculus
ggacacagcagggcag

SEQ ID NO: 415453 - DNA, 16 bp, M. musculus
ggacacaggacacaag

SEQ ID NO: 415454 - DNA, 16 bp, M. musculus
ggacaccaagaaggac

SEQ ID NO: 415455 - DNA, 16 bp, M. musculus
ggacaccacacacaca

SEQ ID NO: 415456 - DNA, 16 bp, M. musculus
ggacaccacagagccc

SEQ ID NO: 415457 - DNA, 16 bp, M. musculus
ggacaccacaggaaga

SEQ ID NO: 415458 - DNA, 16 bp, M. musculus
ggacaccatgaaaaga

SEQ ID NO: 415459 - DNA, 16 bp, M. musculus
ggacacctgccctgaa

SEQ ID NO: 415460 - DNA, 17 bp, M. musculus
ggacactcaaactttat

SEQ ID NO: 415461 - DNA, 16 bp, M. musculus
ggacactccagaagag

SEQ ID NO: 415462 - DNA, 16 bp, M. musculus
ggacactgcaaacagg

SEQ ID NO: 415463 - DNA, 16 bp, M. musculus
ggacactgcagaagag

SEQ ID NO: 415464 - DNA, 16 bp, M. musculus
ggacacttcagcttgt

SEQ ID NO: 415465 - DNA, 16 bp, M. musculus
ggacactttgctcatt

SEQ ID NO: 415466 - DNA, 16 bp, M. musculus
ggacagaagccctgag

SEQ ID NO: 415467 - DNA, 16 bp, M. musculus
ggacagaagctgctgg

SEQ ID NO: 415468 - DNA, 16 bp, M. musculus
ggacagaaggacagag

SEQ ID NO: 415469 - DNA, 16 bp, M. musculus
ggacagaaggagctga

SEQ ID NO: 415470 - DNA, 16 bp, M. musculus
ggacagaatcaggtat

SEQ ID NO: 415471 - DNA, 16 bp, M. musculus
ggacagacaaggcagt

SEQ ID NO: 415472 - DNA, 16 bp, M. musculus
ggacagacagaaggac

SEQ ID NO: 415473 - DNA, 16 bp, M. musculus
ggacagacagacaaag

SEQ ID NO: 415474 - DNA, 16 bp, M. musculus
ggacagacagacacac

SEQ ID NO: 415475 - DNA, 16 bp, M. musculus
ggacagacagacagac

SEQ ID NO: 415476 - DNA, 16 bp, M. musculus
ggacagagacaggtgg

SEQ ID NO: 415477 - DNA, 16 bp, M. musculus
ggacagagcaggagca

SEQ ID NO: 415478 - DNA, 16 bp, M. musculus
ggacagagcagtcagc

SEQ ID NO: 415479 - DNA, 16 bp, M. musculus
ggacagagcttgggga

SEQ ID NO: 415480 - DNA, 16 bp, M. musculus
ggacagaggcaggcag

SEQ ID NO: 415481 - DNA, 16 bp, M. musculus
ggacagatggacacag

SEQ ID NO: 415482 - DNA, 16 bp, M. musculus
ggacagcaagatggct

SEQ ID NO: 415483 - DNA, 16 bp, M. musculus
ggacagcaggacagca

SEQ ID NO: 415484 - DNA, 16 bp, M. musculus
ggacagcagttctcaa

SEQ ID NO: 415485 - DNA, 16 bp, M. musculus
ggacagccaagtttag

SEQ ID NO: 415486 - DNA, 16 bp, M. musculus
ggacagccagagctat

SEQ ID NO: 415487 - DNA, 16 bp, M. musculus
ggacagccaggactac

SEQ ID NO: 415488 - DNA, 16 bp, M. musculus
ggacagccaggactgc

SEQ ID NO: 415489 - DNA, 16 bp, M. musculus
ggacagccagggcaca

SEQ ID NO: 415490 - DNA, 16 bp, M. musculus
ggacagccagggctgc

SEQ ID NO: 415491 - DNA, 16 bp, M. musculus
ggacagcccctgctcc

SEQ ID NO: 415492 - DNA, 16 bp, M. musculus
ggacagcccctgttcc

SEQ ID NO: 415493 - DNA, 16 bp, M. musculus
ggacagcctgggacag

SEQ ID NO: 415494 - DNA, 16 bp, M. musculus
ggacagcctgttctac

SEQ ID NO: 415495 - DNA, 16 bp, M. musculus
ggacagccttgtctgg

SEQ ID NO: 415496 - DNA, 16 bp, M. musculus
ggacagctacacagag

SEQ ID NO: 415497 - DNA, 16 bp, M. musculus
ggacagctctgtggag

SEQ ID NO: 415498 - DNA, 16 bp, M. musculus
ggacagcttgtgggag

SEQ ID NO: 415499 - DNA, 16 bp, M. musculus
ggacaggaactgaagc

SEQ ID NO: 415500 - DNA, 16 bp, M. musculus
ggacaggaacttggag

SEQ ID NO: 415501 - DNA, 16 bp, M. musculus
ggacaggaagacagga

SEQ ID NO: 415502 - DNA, 16 bp, M. musculus
ggacaggaagcaccca

SEQ ID NO: 415503 - DNA, 16 bp, M. musculus
ggacaggacaggaaag

SEQ ID NO: 415504 - DNA, 16 bp, M. musculus
ggacaggatccttctg

SEQ ID NO: 415505 - DNA, 16 bp, M. musculus
ggacaggcagacagac

SEQ ID NO: 415506 - DNA, 16 bp, M. musculus
ggacaggcagagctat

SEQ ID NO: 415507 - DNA, 16 bp, M. musculus
ggacaggcctgtgagt

SEQ ID NO: 415508 - DNA, 17 bp, M. musculus
ggacagggtttctctgt

SEQ ID NO: 415509 - DNA, 16 bp, M. musculus
ggacagtagccagtct

SEQ ID NO: 415510 - DNA, 16 bp, M. musculus
ggacagtatcctaatt

SEQ ID NO: 415511 - DNA, 16 bp, M. musculus
ggacagtcgaacaggg

SEQ ID NO: 415512 - DNA, 16 bp, M. musculus
ggacagtctctctctc

SEQ ID NO: 415513 - DNA, 16 bp, M. musculus
ggacagtctgggctat

SEQ ID NO: 415514 - DNA, 16 bp, M. musculus
ggacagtgacagtgta

SEQ ID NO: 415515 - DNA, 16 bp, M. musculus
ggacagtgagcaggat

SEQ ID NO: 415516 - DNA, 16 bp, M. musculus
ggacagtgatgtggaa

SEQ ID NO: 415517 - DNA, 16 bp, M. musculus
ggacagtggtggtgca

SEQ ID NO: 415518 - DNA, 16 bp, M. musculus
ggacataatgaaagca

SEQ ID NO: 415519 - DNA, 16 bp, M. musculus
ggacatcaacatggct

SEQ ID NO: 415520 - DNA, 16 bp, M. musculus
ggacatcaatgagaga

SEQ ID NO: 415521 - DNA, 16 bp, M. musculus
ggacatcagggttctt

SEQ ID NO: 415522 - DNA, 16 bp, M. musculus
ggacatccagagactg

SEQ ID NO: 415523 - DNA, 16 bp, M. musculus
ggacatctcttgtcac

SEQ ID NO: 415524 - DNA, 16 bp, M. musculus
ggacatctttccattt

SEQ ID NO: 415525 - DNA, 16 bp, M. musculus
ggacatggaggaggag

SEQ ID NO: 415526 - DNA, 16 bp, M. musculus
ggacatgggaagggga

SEQ ID NO: 415527 - DNA, 16 bp, M. musculus
ggacattcatggtatg

SEQ ID NO: 415528 - DNA, 16 bp, M. musculus
ggacattcttttcctc

SEQ ID NO: 415529 - DNA, 16 bp, M. musculus
ggacattggaagaaga

SEQ ID NO: 415530 - DNA, 16 bp, M. musculus
ggacattgtgtatgtg

SEQ ID NO: 415531 - DNA, 16 bp, M. musculus
ggacattttcctccca

SEQ ID NO: 415532 - DNA, 16 bp, M. musculus
ggacattttttaaaaa

SEQ ID NO: 415533 - DNA, 16 bp, M. musculus
ggaccaaaagcaagtt

SEQ ID NO: 415534 - DNA, 16 bp, M. musculus
ggaccaaacccagggc

SEQ ID NO: 415535 - DNA, 16 bp, M. musculus
ggaccaaactcaagtc

SEQ ID NO: 415536 - DNA, 16 bp, M. musculus
ggaccaaaggtctctc

SEQ ID NO: 415537 - DNA, 16 bp, M. musculus
ggaccaaatgttcaaa

SEQ ID NO: 415538 - DNA, 16 bp, M. musculus
ggaccaaccctctgaa

SEQ ID NO: 415539 - DNA, 16 bp, M. musculus
ggaccaagaagcaagt

SEQ ID NO: 415540 - DNA, 16 bp, M. musculus
ggaccaagagcctccc

SEQ ID NO: 415541 - DNA, 16 bp, M. musculus
ggaccaagagttcaaa

SEQ ID NO: 415542 - DNA, 31 bp, M. musculus
ggaccaagatggcgaccgctgctgctgtggc

SEQ ID NO: 415543 - DNA, 16 bp, M. musculus
ggaccaaggacctcca

SEQ ID NO: 415544 - DNA, 16 bp, M. musculus
ggaccaaggatctctc

SEQ ID NO: 415545 - DNA, 16 bp, M. musculus
ggaccaaggcaactct

SEQ ID NO: 415546 - DNA, 16 bp, M. musculus
ggaccaagtattcaaa

SEQ ID NO: 415547 - DNA, 16 bp, M. musculus
ggaccaagtgttcaaa

SEQ ID NO: 415548 - DNA, 16 bp, M. musculus
ggaccaagttttcaaa

SEQ ID NO: 415549 - DNA, 16 bp, M. musculus
ggaccaccaaccaagg

SEQ ID NO: 415550 - DNA, 16 bp, M. musculus
ggaccaccaacccagg

SEQ ID NO: 415551 - DNA, 16 bp, M. musculus
ggaccaccagccaaag

SEQ ID NO: 415552 - DNA, 16 bp, M. musculus
ggaccacctgcctggg

SEQ ID NO: 415553 - DNA, 16 bp, M. musculus
ggaccacggtgctgca

SEQ ID NO: 415554 - DNA, 17 bp, M. musculus
ggaccacttccttcatg

SEQ ID NO: 415555 - DNA, 16 bp, M. musculus
ggaccagagtttgatt

SEQ ID NO: 415556 - DNA, 16 bp, M. musculus
ggaccagcaggatcca

SEQ ID NO: 415557 - DNA, 16 bp, M. musculus
ggaccagcagggctat

SEQ ID NO: 415558 - DNA, 16 bp, M. musculus
ggaccagcattctcaa

SEQ ID NO: 415559 - DNA, 16 bp, M. musculus
ggaccagccctttcat

SEQ ID NO: 415560 - DNA, 16 bp, M. musculus
ggaccaggaaagaaat

SEQ ID NO: 415561 - DNA, 16 bp, M. musculus
ggaccaggagggggat

SEQ ID NO: 415562 - DNA, 16 bp, M. musculus
ggaccaggcagaaggg

SEQ ID NO: 415563 - DNA, 16 bp, M. musculus
ggaccaggctggcctg

SEQ ID NO: 415564 - DNA, 16 bp, M. musculus
ggaccaggctgtggcc

SEQ ID NO: 415565 - DNA, 16 bp, M. musculus
ggaccagtgagatggc

SEQ ID NO: 415566 - DNA, 16 bp, M. musculus
ggaccatctctgctca

SEQ ID NO: 415567 - DNA, 16 bp, M. musculus
ggaccatgggggtgtc

SEQ ID NO: 415568 - DNA, 16 bp, M. musculus
ggaccatggtgctgca

SEQ ID NO: 415569 - DNA, 16 bp, M. musculus
ggacccaaattaacat

SEQ ID NO: 415570 - DNA, 16 bp, M. musculus
ggacccaactatacca

SEQ ID NO: 415571 - DNA, 16 bp, M. musculus
ggacccaagggaggat

SEQ ID NO: 415572 - DNA, 16 bp, M. musculus
ggacccacagctccag

SEQ ID NO: 415573 - DNA, 16 bp, M. musculus
ggacccacatgggaga

SEQ ID NO: 415574 - DNA, 16 bp, M. musculus
ggacccacatggtgga

SEQ ID NO: 415575 - DNA, 18 bp, M. musculus
ggacccacatggtggaag

SEQ ID NO: 415576 - DNA, 16 bp, M. musculus
ggacccacgtggtaga

SEQ ID NO: 415577 - DNA, 16 bp, M. musculus
ggacccagagggtctg

SEQ ID NO: 415578 - DNA, 16 bp, M. musculus
ggacccagatacagct

SEQ ID NO: 415579 - DNA, 16 bp, M. musculus
ggacccagcaggggca

SEQ ID NO: 415580 - DNA, 16 bp, M. musculus
ggacccagggacccag

SEQ ID NO: 415581 - DNA, 16 bp, M. musculus
ggaccccacactcagt

SEQ ID NO: 415582 - DNA, 16 bp, M. musculus
ggaccccagcctgtgg

SEQ ID NO: 415583 - DNA, 16 bp, M. musculus
ggaccccatgctcagt

SEQ ID NO: 415584 - DNA, 16 bp, M. musculus
ggacccctatggagga

SEQ ID NO: 415585 - DNA, 16 bp, M. musculus
ggaccctgagaagcag

SEQ ID NO: 415586 - DNA, 16 bp, M. musculus
ggaccctgagacctct

SEQ ID NO: 415587 - DNA, 16 bp, M. musculus
ggaccctgagatcctg

SEQ ID NO: 415588 - DNA, 16 bp, M. musculus
ggaccctgagctcagt

SEQ ID NO: 415589 - DNA, 16 bp, M. musculus
ggaccctgctgagtgt

SEQ ID NO: 415590 - DNA, 16 bp, M. musculus
ggaccctggaggcagg

SEQ ID NO: 415591 - DNA, 16 bp, M. musculus
ggaccctggcatagct

SEQ ID NO: 415592 - DNA, 16 bp, M. musculus
ggaccctgtcaccttg

SEQ ID NO: 415593 - DNA, 16 bp, M. musculus
ggaccctgtcccagaa

SEQ ID NO: 415594 - DNA, 16 bp, M. musculus
ggaccctttgcccctt

SEQ ID NO: 415595 - DNA, 86 bp, M. musculus
ggacctactggacctactgtgagtcggacatcagtcaaaactccattaatcacctgccctccataagcccctactttaactggagg

SEQ ID NO: 415596 - DNA, 16 bp, M. musculus
ggacctactgtgtgct

SEQ ID NO: 415597 - DNA, 16 bp, M. musculus
ggacctccctcctggc

SEQ ID NO: 415598 - DNA, 16 bp, M. musculus
ggacctccgtgcctcc

SEQ ID NO: 415599 - DNA, 16 bp, M. musculus
ggacctcctcataaaa

SEQ ID NO: 415600 - DNA, 16 bp, M. musculus
ggacctcttaaaattg

SEQ ID NO: 415601 - DNA, 16 bp, M. musculus
ggacctgagttcaatc

SEQ ID NO: 415602 - DNA, 16 bp, M. musculus
ggacctgatgcagagg

SEQ ID NO: 415603 - DNA, 16 bp, M. musculus
ggacctgatgtcctct

SEQ ID NO: 415604 - DNA, 16 bp, M. musculus
ggacctggagaagggg

SEQ ID NO: 415605 - DNA, 16 bp, M. musculus
ggacctggagagcatc

SEQ ID NO: 415606 - DNA, 16 bp, M. musculus
ggacctggattcagtt

SEQ ID NO: 415607 - DNA, 16 bp, M. musculus
ggacctgggacctggg

SEQ ID NO: 415608 - DNA, 16 bp, M. musculus
ggacctgtctccatgg

SEQ ID NO: 415609 - DNA, 16 bp, M. musculus
ggaccttcagaagaac

SEQ ID NO: 415610 - DNA, 16 bp, M. musculus
ggaccttcagaagagg

SEQ ID NO: 415611 - DNA, 16 bp, M. musculus
ggaccttcagaggagc

SEQ ID NO: 415612 - DNA, 16 bp, M. musculus
ggaccttccagctaca

SEQ ID NO: 415613 - DNA, 16 bp, M. musculus
ggaccttctccaaaac

SEQ ID NO: 415614 - DNA, 16 bp, M. musculus
ggaccttgggggtgtc

SEQ ID NO: 415615 - DNA, 16 bp, M. musculus
ggaccttgtagagact

SEQ ID NO: 415616 - DNA, 16 bp, M. musculus
ggacctttacaacctg

SEQ ID NO: 415617 - DNA, 16 bp, M. musculus
ggacctttcccagaag

SEQ ID NO: 415618 - DNA, 23 bp, M. musculus
ggacctttggaagagcagtcagt

SEQ ID NO: 415619 - DNA, 16 bp, M. musculus
ggacctttggggctct

SEQ ID NO: 415620 - DNA, 16 bp, M. musculus
ggacgagaaaagaaat

SEQ ID NO: 415621 - DNA, 19 bp, M. musculus
ggacgagaagacctgggac

SEQ ID NO: 415622 - DNA, 16 bp, M. musculus
ggacgaggacgaggac

SEQ ID NO: 415623 - DNA, 18 bp, M. musculus
ggacgatttcaatatttt

SEQ ID NO: 415624 - DNA, 16 bp, M. musculus
ggacggacagacagac

SEQ ID NO: 415625 - DNA, 16 bp, M. musculus
ggacggacagacggac

SEQ ID NO: 415626 - DNA, 16 bp, M. musculus
ggacggacggacagac

SEQ ID NO: 415627 - DNA, 16 bp, M. musculus
ggacggacggacggac

SEQ ID NO: 415628 - DNA, 16 bp, M. musculus
ggacggatggacggat

SEQ ID NO: 415629 - DNA, 16 bp, M. musculus
ggacgtgcacagcagc

SEQ ID NO: 415630 - DNA, 16 bp, M. musculus
ggacgtggtggcgcac

SEQ ID NO: 415631 - DNA, 16 bp, M. musculus
ggactaaacctctgaa

SEQ ID NO: 415632 - DNA, 16 bp, M. musculus
ggactaaaggtgtgca

SEQ ID NO: 415633 - DNA, 16 bp, M. musculus
ggactacacagcaaga

SEQ ID NO: 415634 - DNA, 16 bp, M. musculus
ggactacatttcccag

SEQ ID NO: 415635 - DNA, 16 bp, M. musculus
ggactaggtggttcct

SEQ ID NO: 415636 - DNA, 16 bp, M. musculus
ggactcaagagagagt

SEQ ID NO: 415637 - DNA, 16 bp, M. musculus
ggactcagaaggcaga

SEQ ID NO: 415638 - DNA, 16 bp, M. musculus
ggactcagagctgaac

SEQ ID NO: 415639 - DNA, 16 bp, M. musculus
ggactcagttttcttt

SEQ ID NO: 415640 - DNA, 16 bp, M. musculus
ggactccacaggaaga

SEQ ID NO: 415641 - DNA, 16 bp, M. musculus
ggactcctaacagagg

SEQ ID NO: 415642 - DNA, 16 bp, M. musculus
ggactcctcagaaagt

SEQ ID NO: 415643 - DNA, 16 bp, M. musculus
ggactcctcagagtcc

SEQ ID NO: 415644 - DNA, 16 bp, M. musculus
ggactcctgaaaatca

SEQ ID NO: 415645 - DNA, 16 bp, M. musculus
ggactcctggctctag

SEQ ID NO: 415646 - DNA, 16 bp, M. musculus
ggactcctttcctcct

SEQ ID NO: 415647 - DNA, 16 bp, M. musculus
ggactcgaactcagaa

SEQ ID NO: 415648 - DNA, 16 bp, M. musculus
ggactcggagccgccg

SEQ ID NO: 415649 - DNA, 16 bp, M. musculus
ggactctacccaactc

SEQ ID NO: 415650 - DNA, 16 bp, M. musculus
ggactctcagctcctc

SEQ ID NO: 415651 - DNA, 16 bp, M. musculus
ggactctccatgccac

SEQ ID NO: 415652 - DNA, 16 bp, M. musculus
ggactctcttcccagt

SEQ ID NO: 415653 - DNA, 16 bp, M. musculus
ggactctggagagggt

SEQ ID NO: 415654 - DNA, 16 bp, M. musculus
ggactctggagatggc

SEQ ID NO: 415655 - DNA, 16 bp, M. musculus
ggactctggaggcaga

SEQ ID NO: 415656 - DNA, 16 bp, M. musculus
ggactctgtctcaaaa

SEQ ID NO: 415657 - DNA, 16 bp, M. musculus
ggactctttttctcct

SEQ ID NO: 415658 - DNA, 16 bp, M. musculus
ggactgaaatcaacca

SEQ ID NO: 415659 - DNA, 16 bp, M. musculus
ggactgaacaactact

SEQ ID NO: 415660 - DNA, 16 bp, M. musculus
ggactgaacacaggga

SEQ ID NO: 415661 - DNA, 16 bp, M. musculus
ggactgaacccagggc

SEQ ID NO: 415662 - DNA, 16 bp, M. musculus
ggactgaagctctgag

SEQ ID NO: 415663 - DNA, 16 bp, M. musculus
ggactgaaggagctga

SEQ ID NO: 415664 - DNA, 16 bp, M. musculus
ggactgaaggatctga

SEQ ID NO: 415665 - DNA, 16 bp, M. musculus
ggactgaatctctgaa

SEQ ID NO: 415666 - DNA, 16 bp, M. musculus
ggactgacctaggccc

SEQ ID NO: 415667 - DNA, 16 bp, M. musculus
ggactgagacaatcca

SEQ ID NO: 415668 - DNA, 16 bp, M. musculus
ggactgagagatgctg

SEQ ID NO: 415669 - DNA, 16 bp, M. musculus
ggactgagcaactact

SEQ ID NO: 415670 - DNA, 16 bp, M. musculus
ggactgagcaactatt

SEQ ID NO: 415671 - DNA, 16 bp, M. musculus
ggactgcagacagaag

SEQ ID NO: 415672 - DNA, 16 bp, M. musculus
ggactgcagagcccct

SEQ ID NO: 415673 - DNA, 21 bp, M. musculus
ggactgcagctaagtcttatg

SEQ ID NO: 415674 - DNA, 16 bp, M. musculus
ggactgcagggtctgg

SEQ ID NO: 415675 - DNA, 16 bp, M. musculus
ggactgccaccacacc

SEQ ID NO: 415676 - DNA, 16 bp, M. musculus
ggactgcctgcccagg

SEQ ID NO: 415677 - DNA, 16 bp, M. musculus
ggactggactggactg

SEQ ID NO: 415678 - DNA, 16 bp, M. musculus
ggactggagttacaga

SEQ ID NO: 415679 - DNA, 16 bp, M. musculus
ggactggctgatgtgg

SEQ ID NO: 415680 - DNA, 16 bp, M. musculus
ggactgggaaagagga

SEQ ID NO: 415681 - DNA, 16 bp, M. musculus
ggactgggaggacagg

SEQ ID NO: 415682 - DNA, 16 bp, M. musculus
ggactgggaggagaag

SEQ ID NO: 415683 - DNA, 16 bp, M. musculus
ggactgggaggagtgg

SEQ ID NO: 415684 - DNA, 16 bp, M. musculus
ggactgggcaaggtgg

SEQ ID NO: 415685 - DNA, 16 bp, M. musculus
ggactgggctccacaa

SEQ ID NO: 415686 - DNA, 16 bp, M. musculus
ggactgggctgccctt

SEQ ID NO: 415687 - DNA, 16 bp, M. musculus
ggactggggagacagc

SEQ ID NO: 415688 - DNA, 16 bp, M. musculus
ggactggtggtcctgg

SEQ ID NO: 415689 - DNA, 16 bp, M. musculus
ggactgtaaaaaagga

SEQ ID NO: 415690 - DNA, 16 bp, M. musculus
ggactgtaacttggaa

SEQ ID NO: 415691 - DNA, 16 bp, M. musculus
ggactgtccacagcag

SEQ ID NO: 415692 - DNA, 16 bp, M. musculus
ggactgtccagagact

SEQ ID NO: 415693 - DNA, 16 bp, M. musculus
ggactgtcttgtctgg

SEQ ID NO: 415694 - DNA, 16 bp, M. musculus
ggacttaaggcctgct

SEQ ID NO: 415695 - DNA, 16 bp, M. musculus
ggacttcatcctcagc

SEQ ID NO: 415696 - DNA, 16 bp, M. musculus
ggacttctggaagagc

SEQ ID NO: 415697 - DNA, 16 bp, M. musculus
ggacttgaactctgga

SEQ ID NO: 415698 - DNA, 16 bp, M. musculus
ggacttgaattcagtt

SEQ ID NO: 415699 - DNA, 16 bp, M. musculus
ggacttgacaaggctg

SEQ ID NO: 415700 - DNA, 16 bp, M. musculus
ggacttgctctgtaga

SEQ ID NO: 415701 - DNA, 16 bp, M. musculus
ggacttgctgtggtgg

SEQ ID NO: 415702 - DNA, 16 bp, M. musculus
ggactttaaaaaaaaa

SEQ ID NO: 415703 - DNA, 16 bp, M. musculus
ggactttgaacatttt

SEQ ID NO: 415704 - DNA, 16 bp, M. musculus
ggactttggaatttat

SEQ ID NO: 415705 - DNA, 16 bp, M. musculus
ggactttgggaatagc

SEQ ID NO: 415706 - DNA, 16 bp, M. musculus
ggagaaaaaagcataa

SEQ ID NO: 415707 - DNA, 16 bp, M. musculus
ggagaaaaaggaatac

SEQ ID NO: 415708 - DNA, 16 bp, M. musculus
ggagaaaacagaaaat

SEQ ID NO: 415709 - DNA, 16 bp, M. musculus
ggagaaaaccaacttc

SEQ ID NO: 415710 - DNA, 16 bp, M. musculus
ggagaaaactgactct

SEQ ID NO: 415711 - DNA, 16 bp, M. musculus
ggagaaaactgatttt

SEQ ID NO: 415712 - DNA, 16 bp, M. musculus
ggagaaaatacagaga

SEQ ID NO: 415713 - DNA, 16 bp, M. musculus
ggagaaaatcatttta

SEQ ID NO: 415714 - DNA, 16 bp, M. musculus
ggagaaacaggaacac

SEQ ID NO: 415715 - DNA, 16 bp, M. musculus
ggagaaaccaaaggat

SEQ ID NO: 415716 - DNA, 16 bp, M. musculus
ggagaaaccaaggtat

SEQ ID NO: 415717 - DNA, 16 bp, M. musculus
ggagaaaccctgtctc

SEQ ID NO: 415718 - DNA, 16 bp, M. musculus
ggagaaaccttgtctc

SEQ ID NO: 415719 - DNA, 16 bp, M. musculus
ggagaaactagagaaa

SEQ ID NO: 415720 - DNA, 16 bp, M. musculus
ggagaaactgaggccc

SEQ ID NO: 415721 - DNA, 16 bp, M. musculus
ggagaaactgaggctg

SEQ ID NO: 415722 - DNA, 16 bp, M. musculus
ggagaaagaaacccct

SEQ ID NO: 415723 - DNA, 16 bp, M. musculus
ggagaaagaactgaga

SEQ ID NO: 415724 - DNA, 16 bp, M. musculus
ggagaaagaagtttgt

SEQ ID NO: 415725 - DNA, 16 bp, M. musculus
ggagaaagagggcagc

SEQ ID NO: 415726 - DNA, 16 bp, M. musculus
ggagaaagagtttatt

SEQ ID NO: 415727 - DNA, 16 bp, M. musculus
ggagaaagcaaactga

SEQ ID NO: 415728 - DNA, 16 bp, M. musculus
ggagaaagtgcggaaa

SEQ ID NO: 415729 - DNA, 16 bp, M. musculus
ggagaaagtggcagcc

SEQ ID NO: 415730 - DNA, 16 bp, M. musculus
ggagaaagtgtggaag

SEQ ID NO: 415731 - DNA, 16 bp, M. musculus
ggagaaatcaccatcc

SEQ ID NO: 415732 - DNA, 16 bp, M. musculus
ggagaaatcctgtctc

SEQ ID NO: 415733 - DNA, 16 bp, M. musculus
ggagaaatgactcagc

SEQ ID NO: 415734 - DNA, 16 bp, M. musculus
ggagaaattggagaaa

SEQ ID NO: 415735 - DNA, 16 bp, M. musculus
ggagaaatttaagcaa

SEQ ID NO: 415736 - DNA, 16 bp, M. musculus
ggagaacacaaatgcc

SEQ ID NO: 415737 - DNA, 16 bp, M. musculus
ggagaacaccaagaaa

SEQ ID NO: 415738 - DNA, 16 bp, M. musculus
ggagaacagagcagag

SEQ ID NO: 415739 - DNA, 16 bp, M. musculus
ggagaacagcaagtgc

SEQ ID NO: 415740 - DNA, 16 bp, M. musculus
ggagaacagtcagtgc

SEQ ID NO: 415741 - DNA, 16 bp, M. musculus
ggagaaccagtgccag

SEQ ID NO: 415742 - DNA, 16 bp, M. musculus
ggagaaccctgtgctg

SEQ ID NO: 415743 - DNA, 16 bp, M. musculus
ggagaacctgaatgaa

SEQ ID NO: 415744 - DNA, 16 bp, M. musculus
ggagaacctgtcaaga

SEQ ID NO: 415745 - DNA, 16 bp, M. musculus
ggagaactccaggttt

SEQ ID NO: 415746 - DNA, 16 bp, M. musculus
ggagaactctgagaag

SEQ ID NO: 415747 - DNA, 16 bp, M. musculus
ggagaactgactccca

SEQ ID NO: 415748 - DNA, 16 bp, M. musculus
ggagaactggagagag

SEQ ID NO: 415749 - DNA, 16 bp, M. musculus
ggagaactgggctctg

SEQ ID NO: 415750 - DNA, 16 bp, M. musculus
ggagaactgtgttctg

SEQ ID NO: 415751 - DNA, 16 bp, M. musculus
ggagaacttggatgaa

SEQ ID NO: 415752 - DNA, 16 bp, M. musculus
ggagaagaaactgaga

SEQ ID NO: 415753 - DNA, 16 bp, M. musculus
ggagaagaagcagcag

SEQ ID NO: 415754 - DNA, 16 bp, M. musculus
ggagaagaatttcagt

SEQ ID NO: 415755 - DNA, 16 bp, M. musculus
ggagaagactgacttc

SEQ ID NO: 415756 - DNA, 16 bp, M. musculus
ggagaagagactgaag

SEQ ID NO: 415757 - DNA, 16 bp, M. musculus
ggagaagagcagaggc

SEQ ID NO: 415758 - DNA, 16 bp, M. musculus
ggagaagagcagcagc

SEQ ID NO: 415759 - DNA, 16 bp, M. musculus
ggagaagagtctgagg

SEQ ID NO: 415760 - DNA, 16 bp, M. musculus
ggagaagatacagaga

SEQ ID NO: 415761 - DNA, 16 bp, M. musculus
ggagaagcagcagctg

SEQ ID NO: 415762 - DNA, 16 bp, M. musculus
ggagaagcagcaggag

SEQ ID NO: 415763 - DNA, 16 bp, M. musculus
ggagaagcagccagtg

SEQ ID NO: 415764 - DNA, 16 bp, M. musculus
ggagaagcaggagcag

SEQ ID NO: 415765 - DNA, 16 bp, M. musculus
ggagaagccctgctgg

SEQ ID NO: 415766 - DNA, 16 bp, M. musculus
ggagaagctaaagaaa

SEQ ID NO: 415767 - DNA, 16 bp, M. musculus
ggagaagctggaagaa

SEQ ID NO: 415768 - DNA, 16 bp, M. musculus
ggagaagctggagaaa

SEQ ID NO: 415769 - DNA, 16 bp, M. musculus
ggagaaggactgaggg

SEQ ID NO: 415770 - DNA, 16 bp, M. musculus
ggagaaggatctgaga

SEQ ID NO: 415771 - DNA, 16 bp, M. musculus
ggagaaggcatcagat

SEQ ID NO: 415772 - DNA, 16 bp, M. musculus
ggagaagggactaaag

SEQ ID NO: 415773 - DNA, 16 bp, M. musculus
ggagaagggactgaag

SEQ ID NO: 415774 - DNA, 16 bp, M. musculus
ggagaagggtctcaaa

SEQ ID NO: 415775 - DNA, 16 bp, M. musculus
ggagaaggttctggaa

SEQ ID NO: 415776 - DNA, 16 bp, M. musculus
ggagaagtaattgttg

SEQ ID NO: 415777 - DNA, 16 bp, M. musculus
ggagaagtcaaggcag

SEQ ID NO: 415778 - DNA, 16 bp, M. musculus
ggagaagttctctgct

SEQ ID NO: 415779 - DNA, 16 bp, M. musculus
ggagaatatatgtgca

SEQ ID NO: 415780 - DNA, 17 bp, M. musculus
ggagaatgaagactgaa

SEQ ID NO: 415781 - DNA, 16 bp, M. musculus
ggagaatgagtggaaa

SEQ ID NO: 415782 - DNA, 16 bp, M. musculus
ggagaatgccagggcc

SEQ ID NO: 415783 - DNA, 16 bp, M. musculus
ggagaatggcagcatc

SEQ ID NO: 415784 - DNA, 16 bp, M. musculus
ggagaatttggttctg

SEQ ID NO: 415785 - DNA, 16 bp, M. musculus
ggagacaacctggtcc

SEQ ID NO: 415786 - DNA, 16 bp, M. musculus
ggagacacatccctcc

SEQ ID NO: 415787 - DNA, 16 bp, M. musculus
ggagacaccatttcca

SEQ ID NO: 415788 - DNA, 16 bp, M. musculus
ggagacagaaacagga

SEQ ID NO: 415789 - DNA, 16 bp, M. musculus
ggagacagaacctgaa

SEQ ID NO: 415790 - DNA, 16 bp, M. musculus
ggagacagaagcaaca

SEQ ID NO: 415791 - DNA, 16 bp, M. musculus
ggagacagaagcagaa

SEQ ID NO: 415792 - DNA, 16 bp, M. musculus
ggagacagaagcaggg

SEQ ID NO: 415793 - DNA, 16 bp, M. musculus
ggagacagaagcaggt

SEQ ID NO: 415794 - DNA, 16 bp, M. musculus
ggagacagacagacag

SEQ ID NO: 415795 - DNA, 16 bp, M. musculus
ggagacagacagagac

SEQ ID NO: 415796 - DNA, 16 bp, M. musculus
ggagacagacctggag

SEQ ID NO: 415797 - DNA, 16 bp, M. musculus
ggagacagagacagga

SEQ ID NO: 415798 - DNA, 16 bp, M. musculus
ggagacagagcaggag

SEQ ID NO: 415799 - DNA, 16 bp, M. musculus
ggagacagagccatgc

SEQ ID NO: 415800 - DNA, 16 bp, M. musculus
ggagacagaggcagag

SEQ ID NO: 415801 - DNA, 16 bp, M. musculus
ggagacagaggcagga

SEQ ID NO: 415802 - DNA, 16 bp, M. musculus
ggagacagaggccagc

SEQ ID NO: 415803 - DNA, 16 bp, M. musculus
ggagacagaggctggc

SEQ ID NO: 415804 - DNA, 16 bp, M. musculus
ggagacagaggtggga

SEQ ID NO: 415805 - DNA, 16 bp, M. musculus
ggagacagaggtttgc

SEQ ID NO: 415806 - DNA, 16 bp, M. musculus
ggagacagatcaactt

SEQ ID NO: 415807 - DNA, 16 bp, M. musculus
ggagacaggaggatgc

SEQ ID NO: 415808 - DNA, 16 bp, M. musculus
ggagacaggcaggcag

SEQ ID NO: 415809 - DNA, 16 bp, M. musculus
ggagacaggcaggtgg

SEQ ID NO: 415810 - DNA, 16 bp, M. musculus
ggagacagggtttttc

SEQ ID NO: 415811 - DNA, 16 bp, M. musculus
ggagacataaaaacag

SEQ ID NO: 415812 - DNA, 17 bp, M. musculus
ggagacataacaacaga

SEQ ID NO: 415813 - DNA, 16 bp, M. musculus
ggagacatctcagaag

SEQ ID NO: 415814 - DNA, 16 bp, M. musculus
ggagacatgaaggagg

SEQ ID NO: 415815 - DNA, 16 bp, M. musculus
ggagacattttctcag

SEQ ID NO: 415816 - DNA, 16 bp, M. musculus
ggagaccaacagagtc

SEQ ID NO: 415817 - DNA, 16 bp, M. musculus
ggagaccagcctgtct

SEQ ID NO: 415818 - DNA, 16 bp, M. musculus
ggagacccagaagcag

SEQ ID NO: 415819 - DNA, 16 bp, M. musculus
ggagacccagcaggtg

SEQ ID NO: 415820 - DNA, 16 bp, M. musculus
ggagaccctcactcag

SEQ ID NO: 415821 - DNA, 16 bp, M. musculus
ggagaccctcctccta

SEQ ID NO: 415822 - DNA, 16 bp, M. musculus
ggagacctgcctgcct

SEQ ID NO: 415823 - DNA, 16 bp, M. musculus
ggagacctggaaaagg

SEQ ID NO: 415824 - DNA, 16 bp, M. musculus
ggagacggctcagcag

SEQ ID NO: 415825 - DNA, 16 bp, M. musculus
ggagactaggcctaag

SEQ ID NO: 415826 - DNA, 16 bp, M. musculus
ggagactcacaaccat

SEQ ID NO: 415827 - DNA, 16 bp, M. musculus
ggagactccaagatgt

SEQ ID NO: 415828 - DNA, 16 bp, M. musculus
ggagactgaagcagga

SEQ ID NO: 415829 - DNA, 16 bp, M. musculus
ggagactgagaacctg

SEQ ID NO: 415830 - DNA, 16 bp, M. musculus
ggagactggagagatg

SEQ ID NO: 415831 - DNA, 16 bp, M. musculus
ggagactgggaggaga

SEQ ID NO: 415832 - DNA, 16 bp, M. musculus
ggagactgggaggagg

SEQ ID NO: 415833 - DNA, 16 bp, M. musculus
ggagactgtgtgtgtg

SEQ ID NO: 415834 - DNA, 16 bp, M. musculus
ggagacttttcagagg

SEQ ID NO: 415835 - DNA, 16 bp, M. musculus
ggagagaaaactggaa

SEQ ID NO: 415836 - DNA, 16 bp, M. musculus
ggagagaaacctgaag

SEQ ID NO: 415837 - DNA, 16 bp, M. musculus
ggagagaaactctatg

SEQ ID NO: 415838 - DNA, 16 bp, M. musculus
ggagagaaagaaggtt

SEQ ID NO: 415839 - DNA, 16 bp, M. musculus
ggagagaaagacacat

SEQ ID NO: 415840 - DNA, 16 bp, M. musculus
ggagagaaagcataca

SEQ ID NO: 415841 - DNA, 16 bp, M. musculus
ggagagaaccaactcc

SEQ ID NO: 415842 - DNA, 16 bp, M. musculus
ggagagaaccaattcc

SEQ ID NO: 415843 - DNA, 16 bp, M. musculus
ggagagaactgactcc

SEQ ID NO: 415844 - DNA, 16 bp, M. musculus
ggagagaactgactct

SEQ ID NO: 415845 - DNA, 16 bp, M. musculus
ggagagaactgagtcc

SEQ ID NO: 415846 - DNA, 16 bp, M. musculus
ggagagaagacagaca

SEQ ID NO: 415847 - DNA, 16 bp, M. musculus
ggagagaagtgactcc

SEQ ID NO: 415848 - DNA, 16 bp, M. musculus
ggagagaagtttgagc

SEQ ID NO: 415849 - DNA, 16 bp, M. musculus
ggagagaatgggcagc

SEQ ID NO: 415850 - DNA, 16 bp, M. musculus
ggagagacagacagac

SEQ ID NO: 415851 - DNA, 16 bp, M. musculus
ggagagacagctaaaa

SEQ ID NO: 415852 - DNA, 16 bp, M. musculus
ggagagacaggaggca

SEQ ID NO: 415853 - DNA, 16 bp, M. musculus
ggagagacctgggaag

SEQ ID NO: 415854 - DNA, 16 bp, M. musculus
ggagagacctgggagg

SEQ ID NO: 415855 - DNA, 16 bp, M. musculus
ggagagacgactcagc

SEQ ID NO: 415856 - DNA, 16 bp, M. musculus
ggagagactgggaagg

SEQ ID NO: 415857 - DNA, 16 bp, M. musculus
ggagagagaaggcctt

SEQ ID NO: 415858 - DNA, 23 bp, M. musculus
ggagagagaccctatgaatgtaa

SEQ ID NO: 415859 - DNA, 16 bp, M. musculus
ggagagagactgtgtg

SEQ ID NO: 415860 - DNA, 16 bp, M. musculus
ggagagagagacacag

SEQ ID NO: 415861 - DNA, 16 bp, M. musculus
ggagagagagctcaga

SEQ ID NO: 415862 - DNA, 16 bp, M. musculus
ggagagagagctcagc

SEQ ID NO: 415863 - DNA, 16 bp, M. musculus
ggagagagatcaggag

SEQ ID NO: 415864 - DNA, 16 bp, M. musculus
ggagagagcacctgtc

SEQ ID NO: 415865 - DNA, 16 bp, M. musculus
ggagagagccaactcc

SEQ ID NO: 415866 - DNA, 17 bp, M. musculus
ggagagagctactctcc

SEQ ID NO: 415867 - DNA, 16 bp, M. musculus
ggagagagctcagtgg

SEQ ID NO: 415868 - DNA, 16 bp, M. musculus
ggagagagctgtaaga

SEQ ID NO: 415869 - DNA, 16 bp, M. musculus
ggagagagctgttctc

SEQ ID NO: 415870 - DNA, 16 bp, M. musculus
ggagagaggatgctct

SEQ ID NO: 415871 - DNA, 16 bp, M. musculus
ggagagaggattctgg

SEQ ID NO: 415872 - DNA, 16 bp, M. musculus
ggagagaggctgttct

SEQ ID NO: 415873 - DNA, 16 bp, M. musculus
ggagagagggctgagg

SEQ ID NO: 415874 - DNA, 16 bp, M. musculus
ggagagagttaggggc

SEQ ID NO: 415875 - DNA, 16 bp, M. musculus
ggagagatattttaca

SEQ ID NO: 415876 - DNA, 16 bp, M. musculus
ggagagatcatacact

SEQ ID NO: 415877 - DNA, 16 bp, M. musculus
ggagagatgaatggag

SEQ ID NO: 415878 - DNA, 16 bp, M. musculus
ggagagatgctcagag

SEQ ID NO: 415879 - DNA, 16 bp, M. musculus
ggagagatggccctgt

SEQ ID NO: 415880 - DNA, 16 bp, M. musculus
ggagagatggctgagc

SEQ ID NO: 415881 - DNA, 16 bp, M. musculus
ggagagatggctggag

SEQ ID NO: 415882 - DNA, 16 bp, M. musculus
ggagagattgtaagag

SEQ ID NO: 415883 - DNA, 16 bp, M. musculus
ggagagcactgactcc

SEQ ID NO: 415884 - DNA, 16 bp, M. musculus
ggagagcagccagtgc

SEQ ID NO: 415885 - DNA, 16 bp, M. musculus
ggagagcagggctggg

SEQ ID NO: 415886 - DNA, 16 bp, M. musculus
ggagagcatgggagag

SEQ ID NO: 415887 - DNA, 16 bp, M. musculus
ggagagcctcagggag

SEQ ID NO: 415888 - DNA, 16 bp, M. musculus
ggagagctgaggcctc

SEQ ID NO: 415889 - DNA, 16 bp, M. musculus
ggagagctggcccagc

SEQ ID NO: 415890 - DNA, 16 bp, M. musculus
ggagagctggccttgc

SEQ ID NO: 415891 - DNA, 16 bp, M. musculus
ggagagctggctctgc

SEQ ID NO: 415892 - DNA, 16 bp, M. musculus
ggagagctgggcaggg

SEQ ID NO: 415893 - DNA, 16 bp, M. musculus
ggagagctgggttctg

SEQ ID NO: 415894 - DNA, 16 bp, M. musculus
ggagagctgtgacaca

SEQ ID NO: 415895 - DNA, 16 bp, M. musculus
ggagagcttccctgca

SEQ ID NO: 415896 - DNA, 16 bp, M. musculus
ggagaggaaaccagga

SEQ ID NO: 415897 - DNA, 16 bp, M. musculus
ggagaggaaactgcag

SEQ ID NO: 415898 - DNA, 16 bp, M. musculus
ggagaggaacaagctc

SEQ ID NO: 415899 - DNA, 16 bp, M. musculus
ggagaggaacctgaag

SEQ ID NO: 415900 - DNA, 16 bp, M. musculus
ggagaggaactgagag

SEQ ID NO: 415901 - DNA, 16 bp, M. musculus
ggagaggaagaagtca

SEQ ID NO: 415902 - DNA, 16 bp, M. musculus
ggagaggacaggacag

SEQ ID NO: 415903 - DNA, 16 bp, M. musculus
ggagaggacgcagaag

SEQ ID NO: 415904 - DNA, 16 bp, M. musculus
ggagaggactgactcc

SEQ ID NO: 415905 - DNA, 16 bp, M. musculus
ggagaggaggctgaga

SEQ ID NO: 415906 - DNA, 16 bp, M. musculus
ggagaggaggctgagg

SEQ ID NO: 415907 - DNA, 16 bp, M. musculus
ggagaggagtctgagg

SEQ ID NO: 415908 - DNA, 16 bp, M. musculus
ggagaggagtttgaga

SEQ ID NO: 415909 - DNA, 16 bp, M. musculus
ggagaggatgcagaag

SEQ ID NO: 415910 - DNA, 16 bp, M. musculus
ggagaggatgcagaga

SEQ ID NO: 415911 - DNA, 16 bp, M. musculus
ggagaggcagagccag

SEQ ID NO: 415912 - DNA, 16 bp, M. musculus
ggagaggcaggagaat

SEQ ID NO: 415913 - DNA, 16 bp, M. musculus
ggagaggcatgtctca

SEQ ID NO: 415914 - DNA, 16 bp, M. musculus
ggagaggccatccaga

SEQ ID NO: 415915 - DNA, 16 bp, M. musculus
ggagaggcccctggtc

SEQ ID NO: 415916 - DNA, 16 bp, M. musculus
ggagaggcctttggtc

SEQ ID NO: 415917 - DNA, 16 bp, M. musculus
ggagaggcctttgttc

SEQ ID NO: 415918 - DNA, 16 bp, M. musculus
ggagagggaatttgta

SEQ ID NO: 415919 - DNA, 16 bp, M. musculus
ggagagggagagaacc

SEQ ID NO: 415920 - DNA, 16 bp, M. musculus
ggagagggctggagag

SEQ ID NO: 415921 - DNA, 16 bp, M. musculus
ggagaggggcagtgag

SEQ ID NO: 415922 - DNA, 16 bp, M. musculus
ggagaggggcctgagg

SEQ ID NO: 415923 - DNA, 16 bp, M. musculus
ggagaggtattgctgt

SEQ ID NO: 415924 - DNA, 16 bp, M. musculus
ggagaggtctgcagtg

SEQ ID NO: 415925 - DNA, 16 bp, M. musculus
ggagaggtgactcagg

SEQ ID NO: 415926 - DNA, 16 bp, M. musculus
ggagaggttgtggaga

SEQ ID NO: 415927 - DNA, 16 bp, M. musculus
ggagagtcagttctct

SEQ ID NO: 415928 - DNA, 16 bp, M. musculus
ggagagtgatagagaa

SEQ ID NO: 415929 - DNA, 16 bp, M. musculus
ggagagtttgtttctg

SEQ ID NO: 415930 - DNA, 16 bp, M. musculus
ggagatacagagacag

SEQ ID NO: 415931 - DNA, 16 bp, M. musculus
ggagatagaggatgag

SEQ ID NO: 415932 - DNA, 16 bp, M. musculus
ggagatagaggcagaa

SEQ ID NO: 415933 - DNA, 16 bp, M. musculus
ggagatagctcagtgg

SEQ ID NO: 415934 - DNA, 16 bp, M. musculus
ggagatagctcagttg

SEQ ID NO: 415935 - DNA, 16 bp, M. musculus
ggagatcagagaacag

SEQ ID NO: 415936 - DNA, 16 bp, M. musculus
ggagatccaatgtcct

SEQ ID NO: 415937 - DNA, 16 bp, M. musculus
ggagatccagtgccct

SEQ ID NO: 415938 - DNA, 16 bp, M. musculus
ggagatctccagacag

SEQ ID NO: 415939 - DNA, 16 bp, M. musculus
ggagatctctggagag

SEQ ID NO: 415940 - DNA, 17 bp, M. musculus
ggagatctgatgccctc

SEQ ID NO: 415941 - DNA, 16 bp, M. musculus
ggagatctttgagttc

SEQ ID NO: 415942 - DNA, 16 bp, M. musculus
ggagatgaccttgaac

SEQ ID NO: 415943 - DNA, 16 bp, M. musculus
ggagatgagcaggact

SEQ ID NO: 415944 - DNA, 16 bp, M. musculus
ggagatgaggcaggga

SEQ ID NO: 415945 - DNA, 16 bp, M. musculus
ggagatgagtgggact

SEQ ID NO: 415946 - DNA, 16 bp, M. musculus
ggagatgatggctcag

SEQ ID NO: 415947 - DNA, 16 bp, M. musculus
ggagatgatttttttt

SEQ ID NO: 415948 - DNA, 16 bp, M. musculus
ggagatgcagagacaa

SEQ ID NO: 415949 - DNA, 16 bp, M. musculus
ggagatgctactcata

SEQ ID NO: 415950 - DNA, 16 bp, M. musculus
ggagatgctgctgctc

SEQ ID NO: 415951 - DNA, 16 bp, M. musculus
ggagatggagacagga

SEQ ID NO: 415952 - DNA, 16 bp, M. musculus
ggagatggagatagga

SEQ ID NO: 415953 - DNA, 16 bp, M. musculus
ggagatggagcagaga

SEQ ID NO: 415954 - DNA, 16 bp, M. musculus
ggagatggagttatag

SEQ ID NO: 415955 - DNA, 16 bp, M. musculus
ggagatggctcagaag

SEQ ID NO: 415956 - DNA, 16 bp, M. musculus
ggagatggctcagcgg

SEQ ID NO: 415957 - DNA, 17 bp, M. musculus
ggagatggctcagtggg

SEQ ID NO: 415958 - DNA, 16 bp, M. musculus
ggagatggctcagttg

SEQ ID NO: 415959 - DNA, 16 bp, M. musculus
ggagatggctctgtgg

SEQ ID NO: 415960 - DNA, 16 bp, M. musculus
ggagatggcttggtgg

SEQ ID NO: 415961 - DNA, 16 bp, M. musculus
ggagatgtgtcactgg

SEQ ID NO: 415962 - DNA, 16 bp, M. musculus
ggagattctccacaga

SEQ ID NO: 415963 - DNA, 17 bp, M. musculus
ggagattgtgaagggct

SEQ ID NO: 415964 - DNA, 16 bp, M. musculus
ggagcaaaaactgaag

SEQ ID NO: 415965 - DNA, 16 bp, M. musculus
ggagcaaatatggaga

SEQ ID NO: 415966 - DNA, 16 bp, M. musculus
ggagcaagagcaggag

SEQ ID NO: 415967 - DNA, 16 bp, M. musculus
ggagcaagagctgatg

SEQ ID NO: 415968 - DNA, 16 bp, M. musculus
ggagcaagccagtaag

SEQ ID NO: 415969 - DNA, 16 bp, M. musculus
ggagcaagccattaag

SEQ ID NO: 415970 - DNA, 16 bp, M. musculus
ggagcaaggacacagg

SEQ ID NO: 415971 - DNA, 16 bp, M. musculus
ggagcaaggggaacac

SEQ ID NO: 415972 - DNA, 16 bp, M. musculus
ggagcaagtggggcca

SEQ ID NO: 415973 - DNA, 16 bp, M. musculus
ggagcacagcagcatc

SEQ ID NO: 415974 - DNA, 20 bp, M. musculus
ggagcacccgactgctcttc

SEQ ID NO: 415975 - DNA, 16 bp, M. musculus
ggagcaccctcataga

SEQ ID NO: 415976 - DNA, 16 bp, M. musculus
ggagcaccttctgggt

SEQ ID NO: 415977 - DNA, 16 bp, M. musculus
ggagcactgactgctc

SEQ ID NO: 415978 - DNA, 16 bp, M. musculus
ggagcactttcataga

SEQ ID NO: 415979 - DNA, 16 bp, M. musculus
ggagcagaaaatgaag

SEQ ID NO: 415980 - DNA, 16 bp, M. musculus
ggagcagaagcagaag

SEQ ID NO: 415981 - DNA, 16 bp, M. musculus
ggagcagaagcaggag

SEQ ID NO: 415982 - DNA, 16 bp, M. musculus
ggagcagaagccagag

SEQ ID NO: 415983 - DNA, 16 bp, M. musculus
ggagcagaaggagcaa

SEQ ID NO: 415984 - DNA, 16 bp, M. musculus
ggagcagaaggagcag

SEQ ID NO: 415985 - DNA, 16 bp, M. musculus
ggagcagaaggcagga

SEQ ID NO: 415986 - DNA, 16 bp, M. musculus
ggagcagacactgaag

SEQ ID NO: 415987 - DNA, 16 bp, M. musculus
ggagcagagaatgaag

SEQ ID NO: 415988 - DNA, 16 bp, M. musculus
ggagcagagacagaga

SEQ ID NO: 415989 - DNA, 16 bp, M. musculus
ggagcagagacaggag

SEQ ID NO: 415990 - DNA, 16 bp, M. musculus
ggagcagagactggag

SEQ ID NO: 415991 - DNA, 16 bp, M. musculus
ggagcagagagtgagg

SEQ ID NO: 415992 - DNA, 16 bp, M. musculus
ggagcagagcagagca

SEQ ID NO: 415993 - DNA, 16 bp, M. musculus
ggagcagagccagcag

SEQ ID NO: 415994 - DNA, 16 bp, M. musculus
ggagcagagcctgaag

SEQ ID NO: 415995 - DNA, 16 bp, M. musculus
ggagcagaggcaggca

SEQ ID NO: 415996 - DNA, 16 bp, M. musculus
ggagcagaggcaggcg

SEQ ID NO: 415997 - DNA, 16 bp, M. musculus
ggagcagaggctgtct

SEQ ID NO: 415998 - DNA, 16 bp, M. musculus
ggagcagaggctgtgt

SEQ ID NO: 415999 - DNA, 16 bp, M. musculus
ggagcagagtctgaag

SEQ ID NO: 416000 - DNA, 16 bp, M. musculus
ggagcagatggcagga

SEQ ID NO: 416001 - DNA, 16 bp, M. musculus
ggagcagcagcagagg

SEQ ID NO: 416002 - DNA, 16 bp, M. musculus
ggagcagcagcaggag

SEQ ID NO: 416003 - DNA, 16 bp, M. musculus
ggagcagcaggagcag

SEQ ID NO: 416004 - DNA, 16 bp, M. musculus
ggagcagcatttggga

SEQ ID NO: 416005 - DNA, 16 bp, M. musculus
ggagcagctgggacag

SEQ ID NO: 416006 - DNA, 16 bp, M. musculus
ggagcaggagagatgg

SEQ ID NO: 416007 - DNA, 16 bp, M. musculus
ggagcaggagcaggaa

SEQ ID NO: 416008 - DNA, 16 bp, M. musculus
ggagcaggagctggag

SEQ ID NO: 416009 - DNA, 16 bp, M. musculus
ggagcaggaggagctg

SEQ ID NO: 416010 - DNA, 16 bp, M. musculus
ggagcaggaggagtgg

SEQ ID NO: 416011 - DNA, 16 bp, M. musculus
ggagcaggaggatcag

SEQ ID NO: 416012 - DNA, 16 bp, M. musculus
ggagcaggcctggagc

SEQ ID NO: 416013 - DNA, 16 bp, M. musculus
ggagcagggacacagg

SEQ ID NO: 416014 - DNA, 16 bp, M. musculus
ggagcagggcagcatc

SEQ ID NO: 416015 - DNA, 16 bp, M. musculus
ggagcaggggctgcct

SEQ ID NO: 416016 - DNA, 16 bp, M. musculus
ggagcagggtggagag

SEQ ID NO: 416017 - DNA, 16 bp, M. musculus
ggagcagtctttggat

SEQ ID NO: 416018 - DNA, 16 bp, M. musculus
ggagcagtgagtggga

SEQ ID NO: 416019 - DNA, 16 bp, M. musculus
ggagcagttggaaagg

SEQ ID NO: 416020 - DNA, 16 bp, M. musculus
ggagcatcacctcctg

SEQ ID NO: 416021 - DNA, 16 bp, M. musculus
ggagcatccacctctg

SEQ ID NO: 416022 - DNA, 16 bp, M. musculus
ggagcatgcctgtaat

SEQ ID NO: 416023 - DNA, 16 bp, M. musculus
ggagcatggcagcatg

SEQ ID NO: 416024 - DNA, 16 bp, M. musculus
ggagcatgtatcctta

SEQ ID NO: 416025 - DNA, 16 bp, M. musculus
ggagccaacaccctct

SEQ ID NO: 416026 - DNA, 16 bp, M. musculus
ggagccaagcagcccc

SEQ ID NO: 416027 - DNA, 16 bp, M. musculus
ggagccacacatgtgc

SEQ ID NO: 416028 - DNA, 16 bp, M. musculus
ggagccacagccccca

SEQ ID NO: 416029 - DNA, 16 bp, M. musculus
ggagccacagcctccc

SEQ ID NO: 416030 - DNA, 16 bp, M. musculus
ggagccaccagctaaa

SEQ ID NO: 416031 - DNA, 16 bp, M. musculus
ggagccagagagatca

SEQ ID NO: 416032 - DNA, 16 bp, M. musculus
ggagccagagagcaag

SEQ ID NO: 416033 - DNA, 16 bp, M. musculus
ggagccagagaggaag

SEQ ID NO: 416034 - DNA, 16 bp, M. musculus
ggagccagagccagag

SEQ ID NO: 416035 - DNA, 16 bp, M. musculus
ggagccagcctgggct

SEQ ID NO: 416036 - DNA, 16 bp, M. musculus
ggagccaggagccagg

SEQ ID NO: 416037 - DNA, 16 bp, M. musculus
ggagccagggtccagg

SEQ ID NO: 416038 - DNA, 16 bp, M. musculus
ggagccatctctccag

SEQ ID NO: 416039 - DNA, 16 bp, M. musculus
ggagccatggctccct

SEQ ID NO: 416040 - DNA, 16 bp, M. musculus
ggagccatgggtcccc

SEQ ID NO: 416041 - DNA, 16 bp, M. musculus
ggagccatttcctcaa

SEQ ID NO: 416042 - DNA, 16 bp, M. musculus
ggagcccaagctggcc

SEQ ID NO: 416043 - DNA, 16 bp, M. musculus
ggagcccagctgcagg

SEQ ID NO: 416044 - DNA, 16 bp, M. musculus
ggagcccagcttcttg

SEQ ID NO: 416045 - DNA, 16 bp, M. musculus
ggagcccaggctggcc

SEQ ID NO: 416046 - DNA, 16 bp, M. musculus
ggagccctgtggtcca

SEQ ID NO: 416047 - DNA, 17 bp, M. musculus
ggagccgaaggtggcgc

SEQ ID NO: 416048 - DNA, 17 bp, M. musculus
ggagccgccctcacatt

SEQ ID NO: 416049 - DNA, 16 bp, M. musculus
ggagccgcgggttacc

SEQ ID NO: 416050 - DNA, 18 bp, M. musculus
ggagccggagccggagcc

SEQ ID NO: 416051 - DNA, 16 bp, M. musculus
ggagccgggcatggtg

SEQ ID NO: 416052 - DNA, 16 bp, M. musculus
ggagcctagaggaaaa

SEQ ID NO: 416053 - DNA, 16 bp, M. musculus
ggagcctatgggagcc

SEQ ID NO: 416054 - DNA, 16 bp, M. musculus
ggagcctcccttgaga

SEQ ID NO: 416055 - DNA, 16 bp, M. musculus
ggagcctcctccatcc

SEQ ID NO: 416056 - DNA, 16 bp, M. musculus
ggagcctctcacttcc

SEQ ID NO: 416057 - DNA, 19 bp, M. musculus
ggagcctctcagttccctg

SEQ ID NO: 416058 - DNA, 16 bp, M. musculus
ggagcctgatattgct

SEQ ID NO: 416059 - DNA, 16 bp, M. musculus
ggagcctgcctccctg

SEQ ID NO: 416060 - DNA, 16 bp, M. musculus
ggagcctgggtcctct

SEQ ID NO: 416061 - DNA, 16 bp, M. musculus
ggagcctgtggagaca

SEQ ID NO: 416062 - DNA, 16 bp, M. musculus
ggagcctgtggaggcc

SEQ ID NO: 416063 - DNA, 16 bp, M. musculus
ggagcctgtgtgtgtg

SEQ ID NO: 416064 - DNA, 16 bp, M. musculus
ggagcctgttttgctt

SEQ ID NO: 416065 - DNA, 16 bp, M. musculus
ggagccttcttggctc

SEQ ID NO: 416066 - DNA, 16 bp, M. musculus
ggagcgccagggccaa

SEQ ID NO: 416067 - DNA, 16 bp, M. musculus
ggagcgtctgaagaca

SEQ ID NO: 416068 - DNA, 16 bp, M. musculus
ggagctaaaggggtca

SEQ ID NO: 416069 - DNA, 16 bp, M. musculus
ggagctaagaagaaag

SEQ ID NO: 416070 - DNA, 16 bp, M. musculus
ggagctaaggaattag

SEQ ID NO: 416071 - DNA, 16 bp, M. musculus
ggagctacagagacag

SEQ ID NO: 416072 - DNA, 16 bp, M. musculus
ggagctatctttggat

SEQ ID NO: 416073 - DNA, 16 bp, M. musculus
ggagctcaagaagaag

SEQ ID NO: 416074 - DNA, 16 bp, M. musculus
ggagctcaagaagctg

SEQ ID NO: 416075 - DNA, 16 bp, M. musculus
ggagctcacagagact

SEQ ID NO: 416076 - DNA, 16 bp, M. musculus
ggagctctgagctctg

SEQ ID NO: 416077 - DNA, 16 bp, M. musculus
ggagctctgggagatc

SEQ ID NO: 416078 - DNA, 16 bp, M. musculus
ggagctctgggagttc

SEQ ID NO: 416079 - DNA, 16 bp, M. musculus
ggagctctgggtgggg

SEQ ID NO: 416080 - DNA, 16 bp, M. musculus
ggagctcttgacccta

SEQ ID NO: 416081 - DNA, 16 bp, M. musculus
ggagctgaaagaaaag

SEQ ID NO: 416082 - DNA, 16 bp, M. musculus
ggagctgaaagggact

SEQ ID NO: 416083 - DNA, 16 bp, M. musculus
ggagctgaagagatct

SEQ ID NO: 416084 - DNA, 16 bp, M. musculus
ggagctgaagcaggag

SEQ ID NO: 416085 - DNA, 16 bp, M. musculus
ggagctgaagcctggg

SEQ ID NO: 416086 - DNA, 16 bp, M. musculus
ggagctgaagggattg

SEQ ID NO: 416087 - DNA, 16 bp, M. musculus
ggagctgaagggattt

SEQ ID NO: 416088 - DNA, 16 bp, M. musculus
ggagctgaagttagag

SEQ ID NO: 416089 - DNA, 16 bp, M. musculus
ggagctgaagttgcag

SEQ ID NO: 416090 - DNA, 16 bp, M. musculus
ggagctgaatcctgtg

SEQ ID NO: 416091 - DNA, 16 bp, M. musculus
ggagctgaatggggtt

SEQ ID NO: 416092 - DNA, 16 bp, M. musculus
ggagctgacacagagg

SEQ ID NO: 416093 - DNA, 16 bp, M. musculus
ggagctgaccctgtgc

SEQ ID NO: 416094 - DNA, 16 bp, M. musculus
ggagctgagaattctg

SEQ ID NO: 416095 - DNA, 16 bp, M. musculus
ggagctgagacaaagg

SEQ ID NO: 416096 - DNA, 16 bp, M. musculus
ggagctgagacaggtg

SEQ ID NO: 416097 - DNA, 16 bp, M. musculus
ggagctgagacccaga

SEQ ID NO: 416098 - DNA, 16 bp, M. musculus
ggagctgagagaaaag

SEQ ID NO: 416099 - DNA, 16 bp, M. musculus
ggagctgagagttctg

SEQ ID NO: 416100 - DNA, 16 bp, M. musculus
ggagctgagagttctt

SEQ ID NO: 416101 - DNA, 16 bp, M. musculus
ggagctgagatagaag

SEQ ID NO: 416102 - DNA, 16 bp, M. musculus
ggagctgaggaaggag

SEQ ID NO: 416103 - DNA, 16 bp, M. musculus
ggagctgaggcagaag

SEQ ID NO: 416104 - DNA, 16 bp, M. musculus
ggagctgaggcaggag

SEQ ID NO: 416105 - DNA, 16 bp, M. musculus
ggagctgaggctgttc

SEQ ID NO: 416106 - DNA, 16 bp, M. musculus
ggagctgagggagctg

SEQ ID NO: 416107 - DNA, 16 bp, M. musculus
ggagctgagggaggag

SEQ ID NO: 416108 - DNA, 16 bp, M. musculus
ggagctgagggagggc

SEQ ID NO: 416109 - DNA, 16 bp, M. musculus
ggagctgagggtgttt

SEQ ID NO: 416110 - DNA, 16 bp, M. musculus
ggagctgatgaagaag

SEQ ID NO: 416111 - DNA, 16 bp, M. musculus
ggagctgatgattttt

SEQ ID NO: 416112 - DNA, 16 bp, M. musculus
ggagctgatgcacaag

SEQ ID NO: 416113 - DNA, 16 bp, M. musculus
ggagctgatgcagaag

SEQ ID NO: 416114 - DNA, 16 bp, M. musculus
ggagctgatgcagtgg

SEQ ID NO: 416115 - DNA, 16 bp, M. musculus
ggagctgatgccctct

SEQ ID NO: 416116 - DNA, 16 bp, M. musculus
ggagctgatgcggagg

SEQ ID NO: 416117 - DNA, 16 bp, M. musculus
ggagctgatggagagg

SEQ ID NO: 416118 - DNA, 16 bp, M. musculus
ggagctgcagagatgg

SEQ ID NO: 416119 - DNA, 16 bp, M. musculus
ggagctgcggtggtgg

SEQ ID NO: 416120 - DNA, 16 bp, M. musculus
ggagctggaaagaaca

SEQ ID NO: 416121 - DNA, 16 bp, M. musculus
ggagctggagaaggag

SEQ ID NO: 416122 - DNA, 16 bp, M. musculus
ggagctggagacagag

SEQ ID NO: 416123 - DNA, 16 bp, M. musculus
ggagctggagagctgg

SEQ ID NO: 416124 - DNA, 16 bp, M. musculus
ggagctggagcaggag

SEQ ID NO: 416125 - DNA, 16 bp, M. musculus
ggagctggagctacag

SEQ ID NO: 416126 - DNA, 16 bp, M. musculus
ggagctggagctagag

SEQ ID NO: 416127 - DNA, 16 bp, M. musculus
ggagctggagctgaga

SEQ ID NO: 416128 - DNA, 16 bp, M. musculus
ggagctggagctggag

SEQ ID NO: 416129 - DNA, 16 bp, M. musculus
ggagctggaggaagga

SEQ ID NO: 416130 - DNA, 16 bp, M. musculus
ggagctggaggagctg

SEQ ID NO: 416131 - DNA, 16 bp, M. musculus
ggagctggagttacag

SEQ ID NO: 416132 - DNA, 16 bp, M. musculus
ggagctggagttccag

SEQ ID NO: 416133 - DNA, 16 bp, M. musculus
ggagctggagttgcag

SEQ ID NO: 416134 - DNA, 16 bp, M. musculus
ggagctggcacaactg

SEQ ID NO: 416135 - DNA, 16 bp, M. musculus
ggagctggctcagcag

SEQ ID NO: 416136 - DNA, 16 bp, M. musculus
ggagctggctctggag

SEQ ID NO: 416137 - DNA, 16 bp, M. musculus
ggagctgggagcagag

SEQ ID NO: 416138 - DNA, 16 bp, M. musculus
ggagctgggaggagag

SEQ ID NO: 416139 - DNA, 16 bp, M. musculus
ggagctgggcatggtg

SEQ ID NO: 416140 - DNA, 16 bp, M. musculus
ggagctggggagctgg

SEQ ID NO: 416141 - DNA, 16 bp, M. musculus
ggagctggggtgtggc

SEQ ID NO: 416142 - DNA, 16 bp, M. musculus
ggagctggtagaaaag

SEQ ID NO: 416143 - DNA, 16 bp, M. musculus
ggagctggttctctcc

SEQ ID NO: 416144 - DNA, 16 bp, M. musculus
ggagctgtttgggaag

SEQ ID NO: 416145 - DNA, 16 bp, M. musculus
ggagcttgagcatagg

SEQ ID NO: 416146 - DNA, 16 bp, M. musculus
ggagcttttaaagggg

SEQ ID NO: 416147 - DNA, 16 bp, M. musculus
ggagcttttcagtttc

SEQ ID NO: 416148 - DNA, 16 bp, M. musculus
ggaggaaaagcccttg

SEQ ID NO: 416149 - DNA, 16 bp, M. musculus
ggaggaaaaggtttat

SEQ ID NO: 416150 - DNA, 16 bp, M. musculus
ggaggaaaatgtccca

SEQ ID NO: 416151 - DNA, 16 bp, M. musculus
ggaggaaatacagaaa

SEQ ID NO: 416152 - DNA, 16 bp, M. musculus
ggaggaaatacagaga

SEQ ID NO: 416153 - DNA, 16 bp, M. musculus
ggaggaaatggacaaa

SEQ ID NO: 416154 - DNA, 16 bp, M. musculus
ggaggaaatggtttat

SEQ ID NO: 416155 - DNA, 16 bp, M. musculus
ggaggaaatttaaaaa

SEQ ID NO: 416156 - DNA, 16 bp, M. musculus
ggaggaacagcagcag

SEQ ID NO: 416157 - DNA, 16 bp, M. musculus
ggaggaacatcaatat

SEQ ID NO: 416158 - DNA, 16 bp, M. musculus
ggaggaactaaagaaa

SEQ ID NO: 416159 - DNA, 16 bp, M. musculus
ggaggaactagaaaaa

SEQ ID NO: 416160 - DNA, 16 bp, M. musculus
ggaggaactgaagcag

SEQ ID NO: 416161 - DNA, 16 bp, M. musculus
ggaggaactggagaga

SEQ ID NO: 416162 - DNA, 16 bp, M. musculus
ggaggaacttggagga

SEQ ID NO: 416163 - DNA, 16 bp, M. musculus
ggaggaagaagcagct

SEQ ID NO: 416164 - DNA, 16 bp, M. musculus
ggaggaagaagcaggc

SEQ ID NO: 416165 - DNA, 16 bp, M. musculus
ggaggaagaattgtag

SEQ ID NO: 416166 - DNA, 16 bp, M. musculus
ggaggaagagacaggc

SEQ ID NO: 416167 - DNA, 16 bp, M. musculus
ggaggaagagcagcag

SEQ ID NO: 416168 - DNA, 16 bp, M. musculus
ggaggaagagtctggg

SEQ ID NO: 416169 - DNA, 16 bp, M. musculus
ggaggaagatggacag

SEQ ID NO: 416170 - DNA, 16 bp, M. musculus
ggaggaagcagctcat

SEQ ID NO: 416171 - DNA, 16 bp, M. musculus
ggaggaagcttccagc

SEQ ID NO: 416172 - DNA, 16 bp, M. musculus
ggaggaagcttctctg

SEQ ID NO: 416173 - DNA, 16 bp, M. musculus
ggaggaaggagctgat

SEQ ID NO: 416174 - DNA, 16 bp, M. musculus
ggaggaaggattgcaa

SEQ ID NO: 416175 - DNA, 16 bp, M. musculus
ggaggaagggatctgg

SEQ ID NO: 416176 - DNA, 16 bp, M. musculus
ggaggaaggggaaact

SEQ ID NO: 416177 - DNA, 16 bp, M. musculus
ggaggaagggtttatt

SEQ ID NO: 416178 - DNA, 16 bp, M. musculus
ggaggaagtgcatcat

SEQ ID NO: 416179 - DNA, 16 bp, M. musculus
ggaggaagtggccaaa

SEQ ID NO: 416180 - DNA, 16 bp, M. musculus
ggaggaagtgtgtctt

SEQ ID NO: 416181 - DNA, 16 bp, M. musculus
ggaggaagtgtgtgtg

SEQ ID NO: 416182 - DNA, 16 bp, M. musculus
ggaggaatgctgcttc

SEQ ID NO: 416183 - DNA, 16 bp, M. musculus
ggaggaattacttttc

SEQ ID NO: 416184 - DNA, 16 bp, M. musculus
ggaggaatttttttct

SEQ ID NO: 416185 - DNA, 16 bp, M. musculus
ggaggacacttgatgt

SEQ ID NO: 416186 - DNA, 16 bp, M. musculus
ggaggacagatggaca

SEQ ID NO: 416187 - DNA, 16 bp, M. musculus
ggaggacagcctgggc

SEQ ID NO: 416188 - DNA, 17 bp, M. musculus
ggaggacatcaagaagg

SEQ ID NO: 416189 - DNA, 16 bp, M. musculus
ggaggaccagcagtct

SEQ ID NO: 416190 - DNA, 16 bp, M. musculus
ggaggacccaggttca

SEQ ID NO: 416191 - DNA, 16 bp, M. musculus
ggaggacctaattgaa

SEQ ID NO: 416192 - DNA, 16 bp, M. musculus
ggaggacctgagtttg

SEQ ID NO: 416193 - DNA, 16 bp, M. musculus
ggaggacctgggagga

SEQ ID NO: 416194 - DNA, 16 bp, M. musculus
ggaggacctgggttca

SEQ ID NO: 416195 - DNA, 16 bp, M. musculus
ggaggactccctttct

SEQ ID NO: 416196 - DNA, 16 bp, M. musculus
ggaggactggaggagg

SEQ ID NO: 416197 - DNA, 16 bp, M. musculus
ggaggagaaaccagga

SEQ ID NO: 416198 - DNA, 16 bp, M. musculus
ggaggagaacaacaac

SEQ ID NO: 416199 - DNA, 16 bp, M. musculus
ggaggagacagggatg

SEQ ID NO: 416200 - DNA, 16 bp, M. musculus
ggaggagacagtcagg

SEQ ID NO: 416201 - DNA, 16 bp, M. musculus
ggaggagacctccaaa

SEQ ID NO: 416202 - DNA, 16 bp, M. musculus
ggaggagactggggag

SEQ ID NO: 416203 - DNA, 16 bp, M. musculus
ggaggagagactgaag

SEQ ID NO: 416204 - DNA, 16 bp, M. musculus
ggaggagagagctctg

SEQ ID NO: 416205 - DNA, 16 bp, M. musculus
ggaggagagatccttg

SEQ ID NO: 416206 - DNA, 16 bp, M. musculus
ggaggagatgagagtt

SEQ ID NO: 416207 - DNA, 16 bp, M. musculus
ggaggagatgcagaga

SEQ ID NO: 416208 - DNA, 16 bp, M. musculus
ggaggagatttacctc

SEQ ID NO: 416209 - DNA, 16 bp, M. musculus
ggaggagatttactgc

SEQ ID NO: 416210 - DNA, 16 bp, M. musculus
ggaggagcactctcat

SEQ ID NO: 416211 - DNA, 16 bp, M. musculus
ggaggagcagaagttc

SEQ ID NO: 416212 - DNA, 16 bp, M. musculus
ggaggagcagcagcag

SEQ ID NO: 416213 - DNA, 16 bp, M. musculus
ggaggagcagcagctg

SEQ ID NO: 416214 - DNA, 16 bp, M. musculus
ggaggagcaggagcaa

SEQ ID NO: 416215 - DNA, 16 bp, M. musculus
ggaggagcgctgctta

SEQ ID NO: 416216 - DNA, 16 bp, M. musculus
ggaggagctagagaag

SEQ ID NO: 416217 - DNA, 16 bp, M. musculus
ggaggagctgagggag

SEQ ID NO: 416218 - DNA, 16 bp, M. musculus
ggaggagctgagggtt

SEQ ID NO: 416219 - DNA, 16 bp, M. musculus
ggaggagctgctgttg

SEQ ID NO: 416220 - DNA, 16 bp, M. musculus
ggaggagctggagaga

SEQ ID NO: 416221 - DNA, 17 bp, M. musculus
ggaggagctggaggagc

SEQ ID NO: 416222 - DNA, 16 bp, M. musculus
ggaggagcttagagtt

SEQ ID NO: 416223 - DNA, 16 bp, M. musculus
ggaggaggaagtggcc

SEQ ID NO: 416224 - DNA, 16 bp, M. musculus
ggaggaggaagtggct

SEQ ID NO: 416225 - DNA, 16 bp, M. musculus
ggaggaggagaggctg

SEQ ID NO: 416226 - DNA, 16 bp, M. musculus
ggaggaggaggaactg

SEQ ID NO: 416227 - DNA, 16 bp, M. musculus
ggaggaggaggagcct

SEQ ID NO: 416228 - DNA, 16 bp, M. musculus
ggaggaggaggagctt

SEQ ID NO: 416229 - DNA, 16 bp, M. musculus
ggaggaggaggagtca

SEQ ID NO: 416230 - DNA, 16 bp, M. musculus
ggaggaggaggctgag

SEQ ID NO: 416231 - DNA, 16 bp, M. musculus
ggaggaggatcaggag

SEQ ID NO: 416232 - DNA, 16 bp, M. musculus
ggaggaggctttcagg

SEQ ID NO: 416233 - DNA, 16 bp, M. musculus
ggaggagggagaagct

SEQ ID NO: 416234 - DNA, 16 bp, M. musculus
ggaggagggctttgag

SEQ ID NO: 416235 - DNA, 16 bp, M. musculus
ggaggaggtgaagctg

SEQ ID NO: 416236 - DNA, 16 bp, M. musculus
ggaggagtgctgcttt

SEQ ID NO: 416237 - DNA, 16 bp, M. musculus
ggaggagtggtccttg

SEQ ID NO: 416238 - DNA, 16 bp, M. musculus
ggaggagtgtacctct

SEQ ID NO: 416239 - DNA, 16 bp, M. musculus
ggaggagtgtagcctg

SEQ ID NO: 416240 - DNA, 16 bp, M. musculus
ggaggagtgttcatct

SEQ ID NO: 416241 - DNA, 16 bp, M. musculus
ggaggagtgttccccc

SEQ ID NO: 416242 - DNA, 16 bp, M. musculus
ggaggatatcaataac

SEQ ID NO: 416243 - DNA, 16 bp, M. musculus
ggaggatatcatcctg

SEQ ID NO: 416244 - DNA, 16 bp, M. musculus
ggaggatcaaaagttt

SEQ ID NO: 416245 - DNA, 16 bp, M. musculus
ggaggatcaggaggag

SEQ ID NO: 416246 - DNA, 16 bp, M. musculus
ggaggatcaggagttg

SEQ ID NO: 416247 - DNA, 16 bp, M. musculus
ggaggatccctggagc

SEQ ID NO: 416248 - DNA, 16 bp, M. musculus
ggaggatccctgggac

SEQ ID NO: 416249 - DNA, 16 bp, M. musculus
ggaggatctgggagga

SEQ ID NO: 416250 - DNA, 16 bp, M. musculus
ggaggatctgtgtgag

SEQ ID NO: 416251 - DNA, 16 bp, M. musculus
ggaggatggggaactg

SEQ ID NO: 416252 - DNA, 16 bp, M. musculus
ggaggattcctgggac

SEQ ID NO: 416253 - DNA, 16 bp, M. musculus
ggaggcaaagacaggg

SEQ ID NO: 416254 - DNA, 16 bp, M. musculus
ggaggcaaaggcaggt

SEQ ID NO: 416255 - DNA, 16 bp, M. musculus
ggaggcaagaggacca

SEQ ID NO: 416256 - DNA, 16 bp, M. musculus
ggaggcaagcataaga

SEQ ID NO: 416257 - DNA, 16 bp, M. musculus
ggaggcacacaccttt

SEQ ID NO: 416258 - DNA, 16 bp, M. musculus
ggaggcacacagagct

SEQ ID NO: 416259 - DNA, 16 bp, M. musculus
ggaggcacaggaggca

SEQ ID NO: 416260 - DNA, 16 bp, M. musculus
ggaggcactcagagct

SEQ ID NO: 416261 - DNA, 16 bp, M. musculus
ggaggcagaaagaatt

SEQ ID NO: 416262 - DNA, 16 bp, M. musculus
ggaggcagaaagactg

SEQ ID NO: 416263 - DNA, 16 bp, M. musculus
ggaggcagaaagatca

SEQ ID NO: 416264 - DNA, 16 bp, M. musculus
ggaggcagaacacagt

SEQ ID NO: 416265 - DNA, 16 bp, M. musculus
ggaggcagaagcagaa

SEQ ID NO: 416266 - DNA, 16 bp, M. musculus
ggaggcagaagctggc

SEQ ID NO: 416267 - DNA, 16 bp, M. musculus
ggaggcagaagtagat

SEQ ID NO: 416268 - DNA, 16 bp, M. musculus
ggaggcagacaggcag

SEQ ID NO: 416269 - DNA, 16 bp, M. musculus
ggaggcagagacagtc

SEQ ID NO: 416270 - DNA, 16 bp, M. musculus
ggaggcagagatgggg

SEQ ID NO: 416271 - DNA, 16 bp, M. musculus
ggaggcagagccagag

SEQ ID NO: 416272 - DNA, 16 bp, M. musculus
ggaggcagagctagga

SEQ ID NO: 416273 - DNA, 16 bp, M. musculus
ggaggcagaggcaagc

SEQ ID NO: 416274 - DNA, 16 bp, M. musculus
ggaggcagaggcacag

SEQ ID NO: 416275 - DNA, 16 bp, M. musculus
ggaggcagaggcagcc

SEQ ID NO: 416276 - DNA, 16 bp, M. musculus
ggaggcagaggcagcg

SEQ ID NO: 416277 - DNA, 16 bp, M. musculus
ggaggcagaggcagtc

SEQ ID NO: 416278 - DNA, 16 bp, M. musculus
ggaggcagaggcagtt

SEQ ID NO: 416279 - DNA, 16 bp, M. musculus
ggaggcagaggcggca

SEQ ID NO: 416280 - DNA, 16 bp, M. musculus
ggaggcagaggctgag

SEQ ID NO: 416281 - DNA, 16 bp, M. musculus
ggaggcagaggctgga

SEQ ID NO: 416282 - DNA, 16 bp, M. musculus
ggaggcagagggaggt

SEQ ID NO: 416283 - DNA, 16 bp, M. musculus
ggaggcagaggtaggc

SEQ ID NO: 416284 - DNA, 16 bp, M. musculus
ggaggcagaggtgagg

SEQ ID NO: 416285 - DNA, 16 bp, M. musculus
ggaggcagaggtgggc

SEQ ID NO: 416286 - DNA, 16 bp, M. musculus
ggaggcagatctgagc

SEQ ID NO: 416287 - DNA, 16 bp, M. musculus
ggaggcagatggagag

SEQ ID NO: 416288 - DNA, 16 bp, M. musculus
ggaggcagcaggcagc

SEQ ID NO: 416289 - DNA, 16 bp, M. musculus
ggaggcaggaactgag

SEQ ID NO: 416290 - DNA, 16 bp, M. musculus
ggaggcaggagctgac

SEQ ID NO: 416291 - DNA, 16 bp, M. musculus
ggaggcaggaggatct

SEQ ID NO: 416292 - DNA, 16 bp, M. musculus
ggaggcaggagtggtt

SEQ ID NO: 416293 - DNA, 16 bp, M. musculus
ggaggcaggagttggt

SEQ ID NO: 416294 - DNA, 16 bp, M. musculus
ggaggcaggcagatct

SEQ ID NO: 416295 - DNA, 16 bp, M. musculus
ggaggcaggcaggcag

SEQ ID NO: 416296 - DNA, 16 bp, M. musculus
ggaggcaggcagtgct

SEQ ID NO: 416297 - DNA, 16 bp, M. musculus
ggaggcaggggcagct

SEQ ID NO: 416298 - DNA, 16 bp, M. musculus
ggaggcagggggattg

SEQ ID NO: 416299 - DNA, 16 bp, M. musculus
ggaggcagtgaagaca

SEQ ID NO: 416300 - DNA, 16 bp, M. musculus
ggaggcataggcaggt

SEQ ID NO: 416301 - DNA, 16 bp, M. musculus
ggaggcatgttcctct

SEQ ID NO: 416302 - DNA, 16 bp, M. musculus
ggaggccaaaggtcaa

SEQ ID NO: 416303 - DNA, 16 bp, M. musculus
ggaggccaagagacca

SEQ ID NO: 416304 - DNA, 16 bp, M. musculus
ggaggccaaggcagga

SEQ ID NO: 416305 - DNA, 16 bp, M. musculus
ggaggccaccctggtc

SEQ ID NO: 416306 - DNA, 16 bp, M. musculus
ggaggccagaaaaggg

SEQ ID NO: 416307 - DNA, 16 bp, M. musculus
ggaggccagaagaagg

SEQ ID NO: 416308 - DNA, 16 bp, M. musculus
ggaggccagaagagtg

SEQ ID NO: 416309 - DNA, 16 bp, M. musculus
ggaggccagaggagaa

SEQ ID NO: 416310 - DNA, 16 bp, M. musculus
ggaggccagcctgagc

SEQ ID NO: 416311 - DNA, 16 bp, M. musculus
ggaggccagcctgctc

SEQ ID NO: 416312 - DNA, 16 bp, M. musculus
ggaggccagcctgggt

SEQ ID NO: 416313 - DNA, 16 bp, M. musculus
ggaggcccagggagtt

SEQ ID NO: 416314 - DNA, 16 bp, M. musculus
ggaggccccttggtct

SEQ ID NO: 416315 - DNA, 16 bp, M. musculus
ggaggccctggggaag

SEQ ID NO: 416316 - DNA, 16 bp, M. musculus
ggaggcctcctggaac

SEQ ID NO: 416317 - DNA, 16 bp, M. musculus
ggaggcctgctcttct

SEQ ID NO: 416318 - DNA, 16 bp, M. musculus
ggaggcctggcagttt

SEQ ID NO: 416319 - DNA, 16 bp, M. musculus
ggaggcctgggtccag

SEQ ID NO: 416320 - DNA, 19 bp, M. musculus
ggaggcgtggatccaggag

SEQ ID NO: 416321 - DNA, 16 bp, M. musculus
ggaggctaaagcagga

SEQ ID NO: 416322 - DNA, 16 bp, M. musculus
ggaggctaaggcagga

SEQ ID NO: 416323 - DNA, 16 bp, M. musculus
ggaggctagagagatg

SEQ ID NO: 416324 - DNA, 16 bp, M. musculus
ggaggctcaaatccca

SEQ ID NO: 416325 - DNA, 16 bp, M. musculus
ggaggctcaggcagga

SEQ ID NO: 416326 - DNA, 16 bp, M. musculus
ggaggctccttcctct

SEQ ID NO: 416327 - DNA, 16 bp, M. musculus
ggaggctctcagagga

SEQ ID NO: 416328 - DNA, 16 bp, M. musculus
ggaggctcttttctct

SEQ ID NO: 416329 - DNA, 16 bp, M. musculus
ggaggctgaagagatg

SEQ ID NO: 416330 - DNA, 16 bp, M. musculus
ggaggctgagaaagga

SEQ ID NO: 416331 - DNA, 16 bp, M. musculus
ggaggctgagccagga

SEQ ID NO: 416332 - DNA, 16 bp, M. musculus
ggaggctgagcttggc

SEQ ID NO: 416333 - DNA, 16 bp, M. musculus
ggaggctgaggaaaag

SEQ ID NO: 416334 - DNA, 16 bp, M. musculus
ggaggctgaggcaaga

SEQ ID NO: 416335 - DNA, 16 bp, M. musculus
ggaggctgaggcagaa

SEQ ID NO: 416336 - DNA, 16 bp, M. musculus
ggaggctgaggcagga

SEQ ID NO: 416337 - DNA, 16 bp, M. musculus
ggaggctgaggctgga

SEQ ID NO: 416338 - DNA, 16 bp, M. musculus
ggaggctgagggagga

SEQ ID NO: 416339 - DNA, 16 bp, M. musculus
ggaggctgaggtagaa

SEQ ID NO: 416340 - DNA, 16 bp, M. musculus
ggaggctgaggtagga

SEQ ID NO: 416341 - DNA, 16 bp, M. musculus
ggaggctgcagagatg

SEQ ID NO: 416342 - DNA, 16 bp, M. musculus
ggaggctggagaggtg

SEQ ID NO: 416343 - DNA, 16 bp, M. musculus
ggaggctggagcagga

SEQ ID NO: 416344 - DNA, 16 bp, M. musculus
ggaggctgggacagga

SEQ ID NO: 416345 - DNA, 16 bp, M. musculus
ggaggctggggcagaa

SEQ ID NO: 416346 - DNA, 16 bp, M. musculus
ggaggctggggcagga

SEQ ID NO: 416347 - DNA, 16 bp, M. musculus
ggagggaaagtggacg

SEQ ID NO: 416348 - DNA, 16 bp, M. musculus
ggagggaagcatggtg

SEQ ID NO: 416349 - DNA, 16 bp, M. musculus
ggagggaccagaagga

SEQ ID NO: 416350 - DNA, 16 bp, M. musculus
ggagggaccagggcca

SEQ ID NO: 416351 - DNA, 16 bp, M. musculus
ggagggacctgtgtgg

SEQ ID NO: 416352 - DNA, 16 bp, M. musculus
ggagggactgaaggag

SEQ ID NO: 416353 - DNA, 16 bp, M. musculus
ggagggactgagagga

SEQ ID NO: 416354 - DNA, 16 bp, M. musculus
ggagggacttccaggt

SEQ ID NO: 416355 - DNA, 16 bp, M. musculus
ggagggacttgggtgg

SEQ ID NO: 416356 - DNA, 16 bp, M. musculus
ggagggagaagaaacc

SEQ ID NO: 416357 - DNA, 16 bp, M. musculus
ggagggaggcaaccaa

SEQ ID NO: 416358 - DNA, 16 bp, M. musculus
ggagggagggagactg

SEQ ID NO: 416359 - DNA, 16 bp, M. musculus
ggagggatgcctcagc

SEQ ID NO: 416360 - DNA, 17 bp, M. musculus
ggagggatggccttttg

SEQ ID NO: 416361 - DNA, 16 bp, M. musculus
ggagggatggggcagt

SEQ ID NO: 416362 - DNA, 16 bp, M. musculus
ggagggcaccaaggcc

SEQ ID NO: 416363 - DNA, 16 bp, M. musculus
ggagggcaggctgcac

SEQ ID NO: 416364 - DNA, 16 bp, M. musculus
ggagggcaggctgcat

SEQ ID NO: 416365 - DNA, 16 bp, M. musculus
ggagggcatgggggac

SEQ ID NO: 416366 - DNA, 16 bp, M. musculus
ggagggcccagcccag

SEQ ID NO: 416367 - DNA, 16 bp, M. musculus
ggagggcccagctcat

SEQ ID NO: 416368 - DNA, 16 bp, M. musculus
ggagggctgccagacg

SEQ ID NO: 416369 - DNA, 16 bp, M. musculus
ggagggctgccagact

SEQ ID NO: 416370 - DNA, 16 bp, M. musculus
ggagggctgcccagaa

SEQ ID NO: 416371 - DNA, 16 bp, M. musculus
ggagggctggagagag

SEQ ID NO: 416372 - DNA, 16 bp, M. musculus
ggagggctggagggct

SEQ ID NO: 416373 - DNA, 16 bp, M. musculus
ggagggctggggtctg

SEQ ID NO: 416374 - DNA, 16 bp, M. musculus
ggaggggaaactggaa

SEQ ID NO: 416375 - DNA, 16 bp, M. musculus
ggaggggaagctgtgg

SEQ ID NO: 416376 - DNA, 16 bp, M. musculus
ggaggggacttttggg

SEQ ID NO: 416377 - DNA, 16 bp, M. musculus
ggaggggagcagtgag

SEQ ID NO: 416378 - DNA, 16 bp, M. musculus
ggaggggagctgctta

SEQ ID NO: 416379 - DNA, 16 bp, M. musculus
ggaggggaggctgcag

SEQ ID NO: 416380 - DNA, 53 bp, M. musculus
ggaggggccaggtgcaataacttatctttcaccttagaaggaatatctctgca

SEQ ID NO: 416381 - DNA, 16 bp, M. musculus
ggaggggctgagagtt

SEQ ID NO: 416382 - DNA, 16 bp, M. musculus
ggaggggctggaagag

SEQ ID NO: 416383 - DNA, 16 bp, M. musculus
ggagggggaactggga

SEQ ID NO: 416384 - DNA, 16 bp, M. musculus
ggagggggctgtgatt

SEQ ID NO: 416385 - DNA, 17 bp, M. musculus
ggaggggtggggcaata

SEQ ID NO: 416386 - DNA, 16 bp, M. musculus
ggagggtccctgctgg

SEQ ID NO: 416387 - DNA, 16 bp, M. musculus
ggagggtctggggaac

SEQ ID NO: 416388 - DNA, 16 bp, M. musculus
ggagggtctgggggac

SEQ ID NO: 416389 - DNA, 16 bp, M. musculus
ggagggtggaccagga

SEQ ID NO: 416390 - DNA, 16 bp, M. musculus
ggaggtagaagcaggc

SEQ ID NO: 416391 - DNA, 16 bp, M. musculus
ggaggtagaagtgggt

SEQ ID NO: 416392 - DNA, 16 bp, M. musculus
ggaggtagaggcaaga

SEQ ID NO: 416393 - DNA, 16 bp, M. musculus
ggaggtattgctggat

SEQ ID NO: 416394 - DNA, 16 bp, M. musculus
ggaggtcaaagagata

SEQ ID NO: 416395 - DNA, 16 bp, M. musculus
ggaggtcaaagggcaa

SEQ ID NO: 416396 - DNA, 16 bp, M. musculus
ggaggtcagaggacca

SEQ ID NO: 416397 - DNA, 16 bp, M. musculus
ggaggtcagaggtcag

SEQ ID NO: 416398 - DNA, 16 bp, M. musculus
ggaggtcagaggttaa

SEQ ID NO: 416399 - DNA, 16 bp, M. musculus
ggaggtcagaggttga

SEQ ID NO: 416400 - DNA, 16 bp, M. musculus
ggaggtccaaggacaa

SEQ ID NO: 416401 - DNA, 16 bp, M. musculus
ggaggtcccagggagt

SEQ ID NO: 416402 - DNA, 16 bp, M. musculus
ggaggtcgaggcagga

SEQ ID NO: 416403 - DNA, 16 bp, M. musculus
ggaggtctggcttgtg

SEQ ID NO: 416404 - DNA, 16 bp, M. musculus
ggaggtgaaggcagga

SEQ ID NO: 416405 - DNA, 16 bp, M. musculus
ggaggtgacctcttca

SEQ ID NO: 416406 - DNA, 16 bp, M. musculus
ggaggtgagctttgag

SEQ ID NO: 416407 - DNA, 16 bp, M. musculus
ggaggtgaggcaggag

SEQ ID NO: 416408 - DNA, 16 bp, M. musculus
ggaggtggaagcaggg

SEQ ID NO: 416409 - DNA, 16 bp, M. musculus
ggaggtggagacagga

SEQ ID NO: 416410 - DNA, 16 bp, M. musculus
ggaggtggagctaaga

SEQ ID NO: 416411 - DNA, 18 bp, M. musculus
ggaggtggaggcaggaga

SEQ ID NO: 416412 - DNA, 16 bp, M. musculus
ggaggtggatctgagc

SEQ ID NO: 416413 - DNA, 16 bp, M. musculus
ggaggtggccatttca

SEQ ID NO: 416414 - DNA, 16 bp, M. musculus
ggaggtggctcagagg

SEQ ID NO: 416415 - DNA, 16 bp, M. musculus
ggaggtggctcagctg

SEQ ID NO: 416416 - DNA, 16 bp, M. musculus
ggaggtgggaattgga

SEQ ID NO: 416417 - DNA, 16 bp, M. musculus
ggaggtgggagctgat

SEQ ID NO: 416418 - DNA, 16 bp, M. musculus
ggaggtgtcttagtca

SEQ ID NO: 416419 - DNA, 16 bp, M. musculus
ggaggtgtgtccctgg

SEQ ID NO: 416420 - DNA, 16 bp, M. musculus
ggagtactgggattaa

SEQ ID NO: 416421 - DNA, 17 bp, M. musculus
ggagtatatcatcctta

SEQ ID NO: 416422 - DNA, 16 bp, M. musculus
ggagtcaaagcagcag

SEQ ID NO: 416423 - DNA, 16 bp, M. musculus
ggagtcaaggacacca

SEQ ID NO: 416424 - DNA, 16 bp, M. musculus
ggagtcagaaagagaa

SEQ ID NO: 416425 - DNA, 17 bp, M. musculus
ggagtcagatctcgtta

SEQ ID NO: 416426 - DNA, 16 bp, M. musculus
ggagtcagatcttttt

SEQ ID NO: 416427 - DNA, 16 bp, M. musculus
ggagtcagggtgtgtg

SEQ ID NO: 416428 - DNA, 16 bp, M. musculus
ggagtcattaacctta

SEQ ID NO: 416429 - DNA, 16 bp, M. musculus
ggagtccagctctctc

SEQ ID NO: 416430 - DNA, 16 bp, M. musculus
ggagtcccagaatcaa

SEQ ID NO: 416431 - DNA, 18 bp, M. musculus
ggagtccctatcccaact

SEQ ID NO: 416432 - DNA, 16 bp, M. musculus
ggagtccctgaaccaa

SEQ ID NO: 416433 - DNA, 16 bp, M. musculus
ggagtcctctggcagg

SEQ ID NO: 416434 - DNA, 16 bp, M. musculus
ggagtctcaattgaga

SEQ ID NO: 416435 - DNA, 16 bp, M. musculus
ggagtctcagctaggg

SEQ ID NO: 416436 - DNA, 16 bp, M. musculus
ggagtcttgatgcccc

SEQ ID NO: 416437 - DNA, 16 bp, M. musculus
ggagtgcaccaccatg

SEQ ID NO: 416438 - DNA, 16 bp, M. musculus
ggagtgctgggattaa

SEQ ID NO: 416439 - DNA, 16 bp, M. musculus
ggagtgcttgcctgca

SEQ ID NO: 416440 - DNA, 16 bp, M. musculus
ggagtggaaactagga

SEQ ID NO: 416441 - DNA, 16 bp, M. musculus
ggagtggaaccagcct

SEQ ID NO: 416442 - DNA, 16 bp, M. musculus
ggagtggaactgtttg

SEQ ID NO: 416443 - DNA, 16 bp, M. musculus
ggagtggatgcagagg

SEQ ID NO: 416444 - DNA, 16 bp, M. musculus
ggagtggcactacttg

SEQ ID NO: 416445 - DNA, 16 bp, M. musculus
ggagtggccagagcat

SEQ ID NO: 416446 - DNA, 16 bp, M. musculus
ggagtggcgctattag

SEQ ID NO: 416447 - DNA, 16 bp, M. musculus
ggagtggggaggcctg

SEQ ID NO: 416448 - DNA, 16 bp, M. musculus
ggagtgggtagattgg

SEQ ID NO: 416449 - DNA, 16 bp, M. musculus
ggagtgggtggattag

SEQ ID NO: 416450 - DNA, 16 bp, M. musculus
ggagtgtctaagacag

SEQ ID NO: 416451 - DNA, 16 bp, M. musculus
ggagtgtctgatgaca

SEQ ID NO: 416452 - DNA, 16 bp, M. musculus
ggagtgtgctgcaggg

SEQ ID NO: 416453 - DNA, 16 bp, M. musculus
ggagtgtttgcctagc

SEQ ID NO: 416454 - DNA, 16 bp, M. musculus
ggagttacaggtggtc

SEQ ID NO: 416455 - DNA, 16 bp, M. musculus
ggagttacaggtggtg

SEQ ID NO: 416456 - DNA, 16 bp, M. musculus
ggagttagagaaatta

SEQ ID NO: 416457 - DNA, 16 bp, M. musculus
ggagttagaggaagga

SEQ ID NO: 416458 - DNA, 16 bp, M. musculus
ggagttcaaattcatg

SEQ ID NO: 416459 - DNA, 16 bp, M. musculus
ggagttcaaggccagc

SEQ ID NO: 416460 - DNA, 16 bp, M. musculus
ggagttcaaggccatc

SEQ ID NO: 416461 - DNA, 17 bp, M. musculus
ggagttcaaggtcagcc

SEQ ID NO: 416462 - DNA, 16 bp, M. musculus
ggagttcaaggtcatt

SEQ ID NO: 416463 - DNA, 16 bp, M. musculus
ggagttcagaggacag

SEQ ID NO: 416464 - DNA, 16 bp, M. musculus
ggagttcatcctcagc

SEQ ID NO: 416465 - DNA, 16 bp, M. musculus
ggagttccagaccagc

SEQ ID NO: 416466 - DNA, 16 bp, M. musculus
ggagttccaggacagc

SEQ ID NO: 416467 - DNA, 16 bp, M. musculus
ggagttcccaggggtc

SEQ ID NO: 416468 - DNA, 16 bp, M. musculus
ggagttcgagaccagc

SEQ ID NO: 416469 - DNA, 16 bp, M. musculus
ggagttctaggccagc

SEQ ID NO: 416470 - DNA, 16 bp, M. musculus
ggagttctgaatccag

SEQ ID NO: 416471 - DNA, 17 bp, M. musculus
ggagttctgccaaagga

SEQ ID NO: 416472 - DNA, 16 bp, M. musculus
ggagttgatacagagg

SEQ ID NO: 416473 - DNA, 16 bp, M. musculus
ggagttgatgcagaag

SEQ ID NO: 416474 - DNA, 16 bp, M. musculus
ggagttggttctgtcc

SEQ ID NO: 416475 - DNA, 16 bp, M. musculus
ggagttggttctttct

SEQ ID NO: 416476 - DNA, 16 bp, M. musculus
ggagtttctctgtgta

SEQ ID NO: 416477 - DNA, 16 bp, M. musculus
ggagtttcttcaaaaa

SEQ ID NO: 416478 - DNA, 16 bp, M. musculus
ggagtttgaggccagc

SEQ ID NO: 416479 - DNA, 16 bp, M. musculus
ggagtttgctgtgaga

SEQ ID NO: 416480 - DNA, 16 bp, M. musculus
ggagtttggggccagc

SEQ ID NO: 416481 - DNA, 16 bp, M. musculus
ggagtttgtgcccaag

SEQ ID NO: 416482 - DNA, 16 bp, M. musculus
ggagttttcctctttc

SEQ ID NO: 416483 - DNA, 16 bp, M. musculus
ggagttttctggtaga

SEQ ID NO: 416484 - DNA, 16 bp, M. musculus
ggagttttctgtgaga

SEQ ID NO: 416485 - DNA, 16 bp, M. musculus
ggagttttggcgttct

SEQ ID NO: 416486 - DNA, 16 bp, M. musculus
ggataaaactagaaaa

SEQ ID NO: 416487 - DNA, 16 bp, M. musculus
ggataaaagcacttgc

SEQ ID NO: 416488 - DNA, 16 bp, M. musculus
ggataaaatattctat

SEQ ID NO: 416489 - DNA, 16 bp, M. musculus
ggataaaatccacaga

SEQ ID NO: 416490 - DNA, 16 bp, M. musculus
ggataaacgggctgag

SEQ ID NO: 416491 - DNA, 16 bp, M. musculus
ggataaatatttagaa

SEQ ID NO: 416492 - DNA, 16 bp, M. musculus
ggataacttgcaggag

SEQ ID NO: 416493 - DNA, 16 bp, M. musculus
ggataaggagttcaag

SEQ ID NO: 416494 - DNA, 16 bp, M. musculus
ggataatgactgaact

SEQ ID NO: 416495 - DNA, 16 bp, M. musculus
ggatacagaaaatgtt

SEQ ID NO: 416496 - DNA, 16 bp, M. musculus
ggatacagtccatcac

SEQ ID NO: 416497 - DNA, 16 bp, M. musculus
ggatacccagggggcc

SEQ ID NO: 416498 - DNA, 16 bp, M. musculus
ggatactgcttactgg

SEQ ID NO: 416499 - DNA, 16 bp, M. musculus
ggatactgtttctgtg

SEQ ID NO: 416500 - DNA, 16 bp, M. musculus
ggatacttgcagccaa

SEQ ID NO: 416501 - DNA, 16 bp, M. musculus
ggatagaacccagggc

SEQ ID NO: 416502 - DNA, 16 bp, M. musculus
ggataggaaaaagatg

SEQ ID NO: 416503 - DNA, 16 bp, M. musculus
ggatagggggtttcct

SEQ ID NO: 416504 - DNA, 16 bp, M. musculus
ggatataagcccagaa

SEQ ID NO: 416505 - DNA, 16 bp, M. musculus
ggatatacagagacaa

SEQ ID NO: 416506 - DNA, 16 bp, M. musculus
ggatatatagatatat

SEQ ID NO: 416507 - DNA, 16 bp, M. musculus
ggatatccaggactca

SEQ ID NO: 416508 - DNA, 16 bp, M. musculus
ggatatctgatatttg

SEQ ID NO: 416509 - DNA, 16 bp, M. musculus
ggatatctggagcctg

SEQ ID NO: 416510 - DNA, 16 bp, M. musculus
ggatatcttataaata

SEQ ID NO: 416511 - DNA, 16 bp, M. musculus
ggatatggaacctgaa

SEQ ID NO: 416512 - DNA, 16 bp, M. musculus
ggatatgggactgctt

SEQ ID NO: 416513 - DNA, 16 bp, M. musculus
ggatatggtgtcttca

SEQ ID NO: 416514 - DNA, 16 bp, M. musculus
ggatattaaccccaaa

SEQ ID NO: 416515 - DNA, 16 bp, M. musculus
ggatattagtccttta

SEQ ID NO: 416516 - DNA, 16 bp, M. musculus
ggatattttctagttt

SEQ ID NO: 416517 - DNA, 16 bp, M. musculus
ggatcaaaaacagctc

SEQ ID NO: 416518 - DNA, 16 bp, M. musculus
ggatcaaactcaggtt

SEQ ID NO: 416519 - DNA, 16 bp, M. musculus
ggatcaaagactgaag

SEQ ID NO: 416520 - DNA, 24 bp, M. musculus
ggatcaaaggcatgcgccaccacc

SEQ ID NO: 416521 - DNA, 16 bp, M. musculus
ggatcaagagtttgag

SEQ ID NO: 416522 - DNA, 16 bp, M. musculus
ggatcaagctcaggtc

SEQ ID NO: 416523 - DNA, 16 bp, M. musculus
ggatcaaggaactgca

SEQ ID NO: 416524 - DNA, 16 bp, M. musculus
ggatcaatttcctttc

SEQ ID NO: 416525 - DNA, 16 bp, M. musculus
ggatcacagagacagc

SEQ ID NO: 416526 - DNA, 16 bp, M. musculus
ggatcaccaatgcctt

SEQ ID NO: 416527 - DNA, 16 bp, M. musculus
ggatcaccacaacatg

SEQ ID NO: 416528 - DNA, 16 bp, M. musculus
ggatcaccttcataga

SEQ ID NO: 416529 - DNA, 16 bp, M. musculus
ggatcactgtgagttt

SEQ ID NO: 416530 - DNA, 16 bp, M. musculus
ggatcagaaattttga

SEQ ID NO: 416531 - DNA, 16 bp, M. musculus
ggatcagaagttcaaa

SEQ ID NO: 416532 - DNA, 16 bp, M. musculus
ggatcagctccacctc

SEQ ID NO: 416533 - DNA, 16 bp, M. musculus
ggatcaggaattcagg

SEQ ID NO: 416534 - DNA, 16 bp, M. musculus
ggatcaggagttcaaa

SEQ ID NO: 416535 - DNA, 16 bp, M. musculus
ggatcatatttatact

SEQ ID NO: 416536 - DNA, 16 bp, M. musculus
ggatcatccagagact

SEQ ID NO: 416537 - DNA, 16 bp, M. musculus
ggatcattgctctttg

SEQ ID NO: 416538 - DNA, 16 bp, M. musculus
ggatccaacacctctg

SEQ ID NO: 416539 - DNA, 16 bp, M. musculus
ggatccaacccagggc

SEQ ID NO: 416540 - DNA, 16 bp, M. musculus
ggatccaatatcctct

SEQ ID NO: 416541 - DNA, 16 bp, M. musculus
ggatccaatgccatct

SEQ ID NO: 416542 - DNA, 16 bp, M. musculus
ggatccacatggtgga

SEQ ID NO: 416543 - DNA, 27 bp, M. musculus
ggatccaccccataatcagcatccaaa

SEQ ID NO: 416544 - DNA, 16 bp, M. musculus
ggatccacctgtctct

SEQ ID NO: 416545 - DNA, 16 bp, M. musculus
ggatccagcaatacct

SEQ ID NO: 416546 - DNA, 16 bp, M. musculus
ggatccagcaatgcct

SEQ ID NO: 416547 - DNA, 16 bp, M. musculus
ggatccagctgtaagg

SEQ ID NO: 416548 - DNA, 16 bp, M. musculus
ggatccagtgtcctct

SEQ ID NO: 416549 - DNA, 16 bp, M. musculus
ggatccattgcactgg

SEQ ID NO: 416550 - DNA, 16 bp, M. musculus
ggatcccaaaatcaca

SEQ ID NO: 416551 - DNA, 16 bp, M. musculus
ggatcccagccaggga

SEQ ID NO: 416552 - DNA, 16 bp, M. musculus
ggatcccagcccatgg

SEQ ID NO: 416553 - DNA, 16 bp, M. musculus
ggatcccaggagcttg

SEQ ID NO: 416554 - DNA, 17 bp, M. musculus
ggatcccattacagatg

SEQ ID NO: 416555 - DNA, 16 bp, M. musculus
ggatccccaggtgtgg

SEQ ID NO: 416556 - DNA, 16 bp, M. musculus
ggatccccagtctctg

SEQ ID NO: 416557 - DNA, 16 bp, M. musculus
ggatcccctggaactg

SEQ ID NO: 416558 - DNA, 16 bp, M. musculus
ggatccctggaactgg

SEQ ID NO: 416559 - DNA, 16 bp, M. musculus
ggatccctggatccca

SEQ ID NO: 416560 - DNA, 16 bp, M. musculus
ggatccctgggtatgg

SEQ ID NO: 416561 - DNA, 16 bp, M. musculus
ggatcctccagcagta

SEQ ID NO: 416562 - DNA, 16 bp, M. musculus
ggatcctctggaaatg

SEQ ID NO: 416563 - DNA, 16 bp, M. musculus
ggatcctctggaacta

SEQ ID NO: 416564 - DNA, 16 bp, M. musculus
ggatccttctcaacag

SEQ ID NO: 416565 - DNA, 16 bp, M. musculus
ggatcctttggagctg

SEQ ID NO: 416566 - DNA, 16 bp, M. musculus
ggatccttttcctcct

SEQ ID NO: 416567 - DNA, 23 bp, M. musculus
ggatcgaccagatcaggtgttga

SEQ ID NO: 416568 - DNA, 16 bp, M. musculus
ggatctaacactctct

SEQ ID NO: 416569 - DNA, 16 bp, M. musculus
ggatctatgagttcaa

SEQ ID NO: 416570 - DNA, 16 bp, M. musculus
ggatctatgtggaaga

SEQ ID NO: 416571 - DNA, 16 bp, M. musculus
ggatctcaccatgtag

SEQ ID NO: 416572 - DNA, 16 bp, M. musculus
ggatctcactgtgtag

SEQ ID NO: 416573 - DNA, 16 bp, M. musculus
ggatctctatgagttt

SEQ ID NO: 416574 - DNA, 16 bp, M. musculus
ggatctctctgtggtt

SEQ ID NO: 416575 - DNA, 16 bp, M. musculus
ggatctctgagctcaa

SEQ ID NO: 416576 - DNA, 16 bp, M. musculus
ggatctctgagcttga

SEQ ID NO: 416577 - DNA, 16 bp, M. musculus
ggatctctgagttcaa

SEQ ID NO: 416578 - DNA, 16 bp, M. musculus
ggatctctgagttgga

SEQ ID NO: 416579 - DNA, 16 bp, M. musculus
ggatctctgagtttaa

SEQ ID NO: 416580 - DNA, 16 bp, M. musculus
ggatctctgggagttc

SEQ ID NO: 416581 - DNA, 16 bp, M. musculus
ggatctctgtgacaca

SEQ ID NO: 416582 - DNA, 16 bp, M. musculus
ggatctgacaccctca

SEQ ID NO: 416583 - DNA, 16 bp, M. musculus
ggatctgatgcagagg

SEQ ID NO: 416584 - DNA, 16 bp, M. musculus
ggatctgcaggactgg

SEQ ID NO: 416585 - DNA, 16 bp, M. musculus
ggatctgcctgtctct

SEQ ID NO: 416586 - DNA, 16 bp, M. musculus
ggatctgggaggagtt

SEQ ID NO: 416587 - DNA, 16 bp, M. musculus
ggatctggtggtgttt

SEQ ID NO: 416588 - DNA, 16 bp, M. musculus
ggatctgtcaccctct

SEQ ID NO: 416589 - DNA, 16 bp, M. musculus
ggatcttgctgtgtag

SEQ ID NO: 416590 - DNA, 16 bp, M. musculus
ggatctttacctttcc

SEQ ID NO: 416591 - DNA, 16 bp, M. musculus
ggatctttctgtgctt

SEQ ID NO: 416592 - DNA, 16 bp, M. musculus
ggatctttgtaagttc

SEQ ID NO: 416593 - DNA, 16 bp, M. musculus
ggatcttttagctttc

SEQ ID NO: 416594 - DNA, 16 bp, M. musculus
ggatgaaaaaccaaga

SEQ ID NO: 416595 - DNA, 16 bp, M. musculus
ggatgaaaatgtagaa

SEQ ID NO: 416596 - DNA, 16 bp, M. musculus
ggatgaaacctctgaa

SEQ ID NO: 416597 - DNA, 16 bp, M. musculus
ggatgaaagagttggt

SEQ ID NO: 416598 - DNA, 16 bp, M. musculus
ggatgaaaggcatgtg

SEQ ID NO: 416599 - DNA, 16 bp, M. musculus
ggatgaaatgaacaag

SEQ ID NO: 416600 - DNA, 16 bp, M. musculus
ggatgaaatggaaaac

SEQ ID NO: 416601 - DNA, 16 bp, M. musculus
ggatgaaatggacagt

SEQ ID NO: 416602 - DNA, 16 bp, M. musculus
ggatgaaatggacatg

SEQ ID NO: 416603 - DNA, 16 bp, M. musculus
ggatgaagaaactgag

SEQ ID NO: 416604 - DNA, 16 bp, M. musculus
ggatgaagaaatggat

SEQ ID NO: 416605 - DNA, 16 bp, M. musculus
ggatgaagatgaaggc

SEQ ID NO: 416606 - DNA, 16 bp, M. musculus
ggatgaagcctacctg

SEQ ID NO: 416607 - DNA, 16 bp, M. musculus
ggatgaagcttccagg

SEQ ID NO: 416608 - DNA, 16 bp, M. musculus
ggatgaagtgtccttt

SEQ ID NO: 416609 - DNA, 16 bp, M. musculus
ggatgaatctagaaaa

SEQ ID NO: 416610 - DNA, 16 bp, M. musculus
ggatgaccatccagag

SEQ ID NO: 416611 - DNA, 16 bp, M. musculus
ggatgactacaaggaa

SEQ ID NO: 416612 - DNA, 16 bp, M. musculus
ggatgactgtgatcat

SEQ ID NO: 416613 - DNA, 16 bp, M. musculus
ggatgagaaccagagg

SEQ ID NO: 416614 - DNA, 16 bp, M. musculus
ggatgagaataaagat

SEQ ID NO: 416615 - DNA, 16 bp, M. musculus
ggatgagacaggagga

SEQ ID NO: 416616 - DNA, 16 bp, M. musculus
ggatgaggaactgggg

SEQ ID NO: 416617 - DNA, 16 bp, M. musculus
ggatgataccacccac

SEQ ID NO: 416618 - DNA, 16 bp, M. musculus
ggatgatatccaccag

SEQ ID NO: 416619 - DNA, 16 bp, M. musculus
ggatgatcatgttgat

SEQ ID NO: 416620 - DNA, 16 bp, M. musculus
ggatgatcattttgat

SEQ ID NO: 416621 - DNA, 16 bp, M. musculus
ggatgatgccctcctg

SEQ ID NO: 416622 - DNA, 18 bp, M. musculus
ggatgatgcccttcaggt

SEQ ID NO: 416623 - DNA, 16 bp, M. musculus
ggatgatgctggaaga

SEQ ID NO: 416624 - DNA, 16 bp, M. musculus
ggatgatgtcctccag

SEQ ID NO: 416625 - DNA, 16 bp, M. musculus
ggatgattttattcaa

SEQ ID NO: 416626 - DNA, 16 bp, M. musculus
ggatgcagagacagga

SEQ ID NO: 416627 - DNA, 16 bp, M. musculus
ggatgcagagacccac

SEQ ID NO: 416628 - DNA, 16 bp, M. musculus
ggatgcagagatggct

SEQ ID NO: 416629 - DNA, 16 bp, M. musculus
ggatgcagaggaggaa

SEQ ID NO: 416630 - DNA, 16 bp, M. musculus
ggatgcagaggcaggt

SEQ ID NO: 416631 - DNA, 16 bp, M. musculus
ggatgcagctcagtgg

SEQ ID NO: 416632 - DNA, 16 bp, M. musculus
ggatgcaggagtcaga

SEQ ID NO: 416633 - DNA, 16 bp, M. musculus
ggatgccaaggctcca

SEQ ID NO: 416634 - DNA, 16 bp, M. musculus
ggatgccagcaagtgc

SEQ ID NO: 416635 - DNA, 16 bp, M. musculus
ggatgccaggcaagca

SEQ ID NO: 416636 - DNA, 16 bp, M. musculus
ggatgccctcttctgg

SEQ ID NO: 416637 - DNA, 16 bp, M. musculus
ggatgccctggactgg

SEQ ID NO: 416638 - DNA, 16 bp, M. musculus
ggatgccctggagctg

SEQ ID NO: 416639 - DNA, 16 bp, M. musculus
ggatgctcacagtctg

SEQ ID NO: 416640 - DNA, 16 bp, M. musculus
ggatgctcctccaccc

SEQ ID NO: 416641 - DNA, 16 bp, M. musculus
ggatgctgaacagttt

SEQ ID NO: 416642 - DNA, 16 bp, M. musculus
ggatgctgagaaccaa

SEQ ID NO: 416643 - DNA, 16 bp, M. musculus
ggatgctgagatgctg

SEQ ID NO: 416644 - DNA, 16 bp, M. musculus
ggatgctgccatattc

SEQ ID NO: 416645 - DNA, 16 bp, M. musculus
ggatgctgctgtgctt

SEQ ID NO: 416646 - DNA, 16 bp, M. musculus
ggatgctgcttattgg

SEQ ID NO: 416647 - DNA, 16 bp, M. musculus
ggatgctggacatttt

SEQ ID NO: 416648 - DNA, 16 bp, M. musculus
ggatgctgggaagcaa

SEQ ID NO: 416649 - DNA, 16 bp, M. musculus
ggatgctgggaatcca

SEQ ID NO: 416650 - DNA, 16 bp, M. musculus
ggatgctgggacctga

SEQ ID NO: 416651 - DNA, 16 bp, M. musculus
ggatgctgggagagcc

SEQ ID NO: 416652 - DNA, 16 bp, M. musculus
ggatgctgggagccaa

SEQ ID NO: 416653 - DNA, 16 bp, M. musculus
ggatgctggggattga

SEQ ID NO: 416654 - DNA, 16 bp, M. musculus
ggatgctgtttactgg

SEQ ID NO: 416655 - DNA, 16 bp, M. musculus
ggatggaaacaacctt

SEQ ID NO: 416656 - DNA, 16 bp, M. musculus
ggatggaacccagagc

SEQ ID NO: 416657 - DNA, 16 bp, M. musculus
ggatggaacccaggat

SEQ ID NO: 416658 - DNA, 16 bp, M. musculus
ggatggaacccagggc

SEQ ID NO: 416659 - DNA, 16 bp, M. musculus
ggatggaactagaaat

SEQ ID NO: 416660 - DNA, 16 bp, M. musculus
ggatggaagccagggc

SEQ ID NO: 416661 - DNA, 16 bp, M. musculus
ggatggaatacagggc

SEQ ID NO: 416662 - DNA, 16 bp, M. musculus
ggatggacagacagat

SEQ ID NO: 416663 - DNA, 16 bp, M. musculus
ggatggacctggagaa

SEQ ID NO: 416664 - DNA, 16 bp, M. musculus
ggatggacggacggac

SEQ ID NO: 416665 - DNA, 16 bp, M. musculus
ggatggagaagaaagc

SEQ ID NO: 416666 - DNA, 16 bp, M. musculus
ggatggagatggagat

SEQ ID NO: 416667 - DNA, 16 bp, M. musculus
ggatggagcagagccc

SEQ ID NO: 416668 - DNA, 16 bp, M. musculus
ggatggagccatgggt

SEQ ID NO: 416669 - DNA, 16 bp, M. musculus
ggatggagcccagagc

SEQ ID NO: 416670 - DNA, 16 bp, M. musculus
ggatggagcttaggga

SEQ ID NO: 416671 - DNA, 16 bp, M. musculus
ggatggagggaggcag

SEQ ID NO: 416672 - DNA, 16 bp, M. musculus
ggatggatcactaggt

SEQ ID NO: 416673 - DNA, 16 bp, M. musculus
ggatggatccccaggt

SEQ ID NO: 416674 - DNA, 16 bp, M. musculus
ggatggatccccagtg

SEQ ID NO: 416675 - DNA, 16 bp, M. musculus
ggatggatccctagat

SEQ ID NO: 416676 - DNA, 16 bp, M. musculus
ggatggatgatggatg

SEQ ID NO: 416677 - DNA, 16 bp, M. musculus
ggatggatgcatgcat

SEQ ID NO: 416678 - DNA, 16 bp, M. musculus
ggatggatggaatgga

SEQ ID NO: 416679 - DNA, 16 bp, M. musculus
ggatggatgggatgga

SEQ ID NO: 416680 - DNA, 16 bp, M. musculus
ggatggatgggtgagt

SEQ ID NO: 416681 - DNA, 16 bp, M. musculus
ggatggatggtggatg

SEQ ID NO: 416682 - DNA, 16 bp, M. musculus
ggatggatttggagga

SEQ ID NO: 416683 - DNA, 16 bp, M. musculus
ggatggcaccagtcag

SEQ ID NO: 416684 - DNA, 16 bp, M. musculus
ggatggccatttttac

SEQ ID NO: 416685 - DNA, 16 bp, M. musculus
ggatggcctcagactc

SEQ ID NO: 416686 - DNA, 23 bp, M. musculus
ggatggcctcaggatggtacttt

SEQ ID NO: 416687 - DNA, 16 bp, M. musculus
ggatggcctcatctgg

SEQ ID NO: 416688 - DNA, 16 bp, M. musculus
ggatggcctgaaactc

SEQ ID NO: 416689 - DNA, 16 bp, M. musculus
ggatggcctggaactc

SEQ ID NO: 416690 - DNA, 16 bp, M. musculus
ggatggccttgaattc

SEQ ID NO: 416691 - DNA, 16 bp, M. musculus
ggatggctcagtggtt

SEQ ID NO: 416692 - DNA, 16 bp, M. musculus
ggatggctcctgagga

SEQ ID NO: 416693 - DNA, 16 bp, M. musculus
ggatggctctgtgctg

SEQ ID NO: 416694 - DNA, 16 bp, M. musculus
ggatggctggatggct

SEQ ID NO: 416695 - DNA, 16 bp, M. musculus
ggatggctgtgagcac

SEQ ID NO: 416696 - DNA, 16 bp, M. musculus
ggatggcttagtggtt

SEQ ID NO: 416697 - DNA, 16 bp, M. musculus
ggatggctttgaactt

SEQ ID NO: 416698 - DNA, 16 bp, M. musculus
ggatgggaagctgtct

SEQ ID NO: 416699 - DNA, 16 bp, M. musculus
ggatgggacacagggc

SEQ ID NO: 416700 - DNA, 16 bp, M. musculus
ggatgggagggacagg

SEQ ID NO: 416701 - DNA, 16 bp, M. musculus
ggatgggataggcttt

SEQ ID NO: 416702 - DNA, 16 bp, M. musculus
ggatgggggatttttg

SEQ ID NO: 416703 - DNA, 16 bp, M. musculus
ggatggtacacagggc

SEQ ID NO: 416704 - DNA, 16 bp, M. musculus
ggatggtcctggaggg

SEQ ID NO: 416705 - DNA, 16 bp, M. musculus
ggatggtccttccttt

SEQ ID NO: 416706 - DNA, 16 bp, M. musculus
ggatggtgaacatttt

SEQ ID NO: 416707 - DNA, 16 bp, M. musculus
ggatggtgctgcccac

SEQ ID NO: 416708 - DNA, 16 bp, M. musculus
ggatggttcagcagtt

SEQ ID NO: 416709 - DNA, 23 bp, M. musculus
ggatggttgtaagccaccatgtg

SEQ ID NO: 416710 - DNA, 16 bp, M. musculus
ggatggttgtgaacca

SEQ ID NO: 416711 - DNA, 21 bp, M. musculus
ggatggttgtgagccaccatg

SEQ ID NO: 416712 - DNA, 16 bp, M. musculus
ggatggttgtgagtca

SEQ ID NO: 416713 - DNA, 16 bp, M. musculus
ggatggttttagctcc

SEQ ID NO: 416714 - DNA, 16 bp, M. musculus
ggatgtaactcagttg

SEQ ID NO: 416715 - DNA, 16 bp, M. musculus
ggatgtagagttggta

SEQ ID NO: 416716 - DNA, 16 bp, M. musculus
ggatgtagcccagtgg

SEQ ID NO: 416717 - DNA, 16 bp, M. musculus
ggatgtagctcagtag

SEQ ID NO: 416718 - DNA, 16 bp, M. musculus
ggatgtagttcagttg

SEQ ID NO: 416719 - DNA, 16 bp, M. musculus
ggatgtccccacccct

SEQ ID NO: 416720 - DNA, 17 bp, M. musculus
ggatgtcctgttttcac

SEQ ID NO: 416721 - DNA, 16 bp, M. musculus
ggatgtcctttccttc

SEQ ID NO: 416722 - DNA, 16 bp, M. musculus
ggatgtctccatcaaa

SEQ ID NO: 416723 - DNA, 16 bp, M. musculus
ggatgtctggagcctg

SEQ ID NO: 416724 - DNA, 16 bp, M. musculus
ggatgtgaataaaagt

SEQ ID NO: 416725 - DNA, 17 bp, M. musculus
ggatgtgcttacaggat

SEQ ID NO: 416726 - DNA, 16 bp, M. musculus
ggatgtggaaaaagaa

SEQ ID NO: 416727 - DNA, 16 bp, M. musculus
ggatgtggagaaaaag

SEQ ID NO: 416728 - DNA, 16 bp, M. musculus
ggatgtggagaaaagg

SEQ ID NO: 416729 - DNA, 16 bp, M. musculus
ggatgtggagaaagag

SEQ ID NO: 416730 - DNA, 16 bp, M. musculus
ggatgtggagaaagga

SEQ ID NO: 416731 - DNA, 16 bp, M. musculus
ggatgtggagaaagtg

SEQ ID NO: 416732 - DNA, 16 bp, M. musculus
ggatgtggagaatgag

SEQ ID NO: 416733 - DNA, 16 bp, M. musculus
ggatgtggagacagag

SEQ ID NO: 416734 - DNA, 16 bp, M. musculus
ggatgtggccacccac

SEQ ID NO: 416735 - DNA, 16 bp, M. musculus
ggatgtggtgaaagag

SEQ ID NO: 416736 - DNA, 16 bp, M. musculus
ggatgtgtgtcactgg

SEQ ID NO: 416737 - DNA, 16 bp, M. musculus
ggatgtgtttgcttct

SEQ ID NO: 416738 - DNA, 21 bp, M. musculus
ggatgttcattactggcttgc

SEQ ID NO: 416739 - DNA, 16 bp, M. musculus
ggatgttctgctgaag

SEQ ID NO: 416740 - DNA, 16 bp, M. musculus
ggatgttggattttgt

SEQ ID NO: 416741 - DNA, 16 bp, M. musculus
ggatgttttgagtttg

SEQ ID NO: 416742 - DNA, 16 bp, M. musculus
ggatgttttgtctgca

SEQ ID NO: 416743 - DNA, 16 bp, M. musculus
ggattaaaatcatgtg

SEQ ID NO: 416744 - DNA, 16 bp, M. musculus
ggattaaagctgtgtg

SEQ ID NO: 416745 - DNA, 16 bp, M. musculus
ggattaaaggcacata

SEQ ID NO: 416746 - DNA, 16 bp, M. musculus
ggattaaaggcacgtg

SEQ ID NO: 416747 - DNA, 16 bp, M. musculus
ggattaaaggcaggca

SEQ ID NO: 416748 - DNA, 16 bp, M. musculus
ggattaaaggcatatg

SEQ ID NO: 416749 - DNA, 16 bp, M. musculus
ggattaaaggcatgtt

SEQ ID NO: 416750 - DNA, 16 bp, M. musculus
ggattaaaggccacca

SEQ ID NO: 416751 - DNA, 22 bp, M. musculus
ggattaaaggcgtgcaccacca

SEQ ID NO: 416752 - DNA, 21 bp, M. musculus
ggattaaaggcgtgcgccact

SEQ ID NO: 416753 - DNA, 16 bp, M. musculus
ggattaaaggcgttcg

SEQ ID NO: 416754 - DNA, 16 bp, M. musculus
ggattaaaggcttgca

SEQ ID NO: 416755 - DNA, 16 bp, M. musculus
ggattaaaggtgtgca

SEQ ID NO: 416756 - DNA, 16 bp, M. musculus
ggattaacatagtgaa

SEQ ID NO: 416757 - DNA, 16 bp, M. musculus
ggattacagatgtgtg

SEQ ID NO: 416758 - DNA, 16 bp, M. musculus
ggattacaggcacaca

SEQ ID NO: 416759 - DNA, 16 bp, M. musculus
ggattacaggcatcaa

SEQ ID NO: 416760 - DNA, 16 bp, M. musculus
ggattacaggcatttg

SEQ ID NO: 416761 - DNA, 16 bp, M. musculus
ggattacaggcctgtg

SEQ ID NO: 416762 - DNA, 16 bp, M. musculus
ggattacattgatgaa

SEQ ID NO: 416763 - DNA, 16 bp, M. musculus
ggattaccagccactg

SEQ ID NO: 416764 - DNA, 16 bp, M. musculus
ggattaccttaaaagg

SEQ ID NO: 416765 - DNA, 16 bp, M. musculus
ggattagaggtgtgtg

SEQ ID NO: 416766 - DNA, 16 bp, M. musculus
ggattagagtccatga

SEQ ID NO: 416767 - DNA, 16 bp, M. musculus
ggattataggcatgcg

SEQ ID NO: 416768 - DNA, 16 bp, M. musculus
ggattatttaaatatt

SEQ ID NO: 416769 - DNA, 16 bp, M. musculus
ggattatttcagtttt

SEQ ID NO: 416770 - DNA, 16 bp, M. musculus
ggattcaaactcaggt

SEQ ID NO: 416771 - DNA, 16 bp, M. musculus
ggattcacatggtgga

SEQ ID NO: 416772 - DNA, 16 bp, M. musculus
ggattcagctccattc

SEQ ID NO: 416773 - DNA, 16 bp, M. musculus
ggattccaggcagcta

SEQ ID NO: 416774 - DNA, 16 bp, M. musculus
ggattccagtagtatt

SEQ ID NO: 416775 - DNA, 16 bp, M. musculus
ggattcccaaggattc

SEQ ID NO: 416776 - DNA, 16 bp, M. musculus
ggattccctggaactg

SEQ ID NO: 416777 - DNA, 16 bp, M. musculus
ggattccctggagctg

SEQ ID NO: 416778 - DNA, 17 bp, M. musculus
ggattccctttgacttg

SEQ ID NO: 416779 - DNA, 16 bp, M. musculus
ggattcctggggctca

SEQ ID NO: 416780 - DNA, 16 bp, M. musculus
ggattcctgtgagttt

SEQ ID NO: 416781 - DNA, 16 bp, M. musculus
ggattccttccacttt

SEQ ID NO: 416782 - DNA, 16 bp, M. musculus
ggattctctggaagag

SEQ ID NO: 416783 - DNA, 16 bp, M. musculus
ggattctctgtgtagc

SEQ ID NO: 416784 - DNA, 16 bp, M. musculus
ggattctgggagaacc

SEQ ID NO: 416785 - DNA, 16 bp, M. musculus
ggattctgtccccagc

SEQ ID NO: 416786 - DNA, 16 bp, M. musculus
ggattctttatcaaaa

SEQ ID NO: 416787 - DNA, 16 bp, M. musculus
ggattctttccagctc

SEQ ID NO: 416788 - DNA, 16 bp, M. musculus
ggattctttggaacag

SEQ ID NO: 416789 - DNA, 16 bp, M. musculus
ggattctttggaactg

SEQ ID NO: 416790 - DNA, 16 bp, M. musculus
ggattgaattcaagtc

SEQ ID NO: 416791 - DNA, 16 bp, M. musculus
ggattgaggacagcag

SEQ ID NO: 416792 - DNA, 16 bp, M. musculus
ggattgcttcaagtgt

SEQ ID NO: 416793 - DNA, 16 bp, M. musculus
ggattgggatgcatga

SEQ ID NO: 416794 - DNA, 16 bp, M. musculus
ggattggtagaattaa

SEQ ID NO: 416795 - DNA, 16 bp, M. musculus
ggattggttctactgg

SEQ ID NO: 416796 - DNA, 16 bp, M. musculus
ggattgtgaagattct

SEQ ID NO: 416797 - DNA, 16 bp, M. musculus
ggattgtgttgatgga

SEQ ID NO: 416798 - DNA, 16 bp, M. musculus
ggattgtttccagttt

SEQ ID NO: 416799 - DNA, 16 bp, M. musculus
ggatttaaaaatggaa

SEQ ID NO: 416800 - DNA, 33 bp, M. musculus
ggatttaaaagcatatctcatgatgatggtaga

SEQ ID NO: 416801 - DNA, 16 bp, M. musculus
ggatttagaatcacca

SEQ ID NO: 416802 - DNA, 16 bp, M. musculus
ggatttccatattttg

SEQ ID NO: 416803 - DNA, 16 bp, M. musculus
ggatttctatgagttc

SEQ ID NO: 416804 - DNA, 16 bp, M. musculus
ggatttctgagattga

SEQ ID NO: 416805 - DNA, 16 bp, M. musculus
ggatttctgattttga

SEQ ID NO: 416806 - DNA, 16 bp, M. musculus
ggatttctgtgcttcc

SEQ ID NO: 416807 - DNA, 16 bp, M. musculus
ggatttcttagttcaa

SEQ ID NO: 416808 - DNA, 16 bp, M. musculus
ggatttcttcagattc

SEQ ID NO: 416809 - DNA, 16 bp, M. musculus
ggatttcttgaatgtt

SEQ ID NO: 416810 - DNA, 16 bp, M. musculus
ggatttgaaaaaatta

SEQ ID NO: 416811 - DNA, 16 bp, M. musculus
ggatttgaactcagat

SEQ ID NO: 416812 - DNA, 16 bp, M. musculus
ggatttgatggagaca

SEQ ID NO: 416813 - DNA, 16 bp, M. musculus
ggatttgcttcctttt

SEQ ID NO: 416814 - DNA, 16 bp, M. musculus
ggatttgcttttgtgt

SEQ ID NO: 416815 - DNA, 16 bp, M. musculus
ggatttggaaagcaat

SEQ ID NO: 416816 - DNA, 16 bp, M. musculus
ggattttaactttgat

SEQ ID NO: 416817 - DNA, 16 bp, M. musculus
ggattttaagaaggaa

SEQ ID NO: 416818 - DNA, 16 bp, M. musculus
ggattttactgagtat

SEQ ID NO: 416819 - DNA, 16 bp, M. musculus
ggattttctaggatgt

SEQ ID NO: 416820 - DNA, 16 bp, M. musculus
ggatttttaggcttat

SEQ ID NO: 416821 - DNA, 16 bp, M. musculus
ggatttttcttttaaa

SEQ ID NO: 416822 - DNA, 16 bp, M. musculus
ggattttttttaaaaa

SEQ ID NO: 416823 - DNA, 16 bp, M. musculus
ggatttttttttaaag

SEQ ID NO: 416824 - DNA, 16 bp, M. musculus
ggatttttttttcaat

SEQ ID NO: 416825 - DNA, 16 bp, M. musculus
ggatttttttttccct

SEQ ID NO: 416826 - DNA, 16 bp, M. musculus
ggattttttttttcaa

SEQ ID NO: 416827 - DNA, 16 bp, M. musculus
ggcaaaacaactaaaa

SEQ ID NO: 416828 - DNA, 16 bp, M. musculus
ggcaaaaccctcatac

SEQ ID NO: 416829 - DNA, 16 bp, M. musculus
ggcaaaagaaactgtc

SEQ ID NO: 416830 - DNA, 16 bp, M. musculus
ggcaaaagagtcagag

SEQ ID NO: 416831 - DNA, 16 bp, M. musculus
ggcaaacactctacca

SEQ ID NO: 416832 - DNA, 16 bp, M. musculus
ggcaaacaggagaaga

SEQ ID NO: 416833 - DNA, 16 bp, M. musculus
ggcaaacataaaaatg

SEQ ID NO: 416834 - DNA, 16 bp, M. musculus
ggcaaacgcaagaatc

SEQ ID NO: 416835 - DNA, 16 bp, M. musculus
ggcaaagacaggaaga

SEQ ID NO: 416836 - DNA, 16 bp, M. musculus
ggcaaagactgaagga

SEQ ID NO: 416837 - DNA, 16 bp, M. musculus
ggcaaagagccatcct

SEQ ID NO: 416838 - DNA, 16 bp, M. musculus
ggcaaagcacacatac

SEQ ID NO: 416839 - DNA, 16 bp, M. musculus
ggcaaagctggagaag

SEQ ID NO: 416840 - DNA, 21 bp, M. musculus
ggcaaaggagatcctaagaag

SEQ ID NO: 416841 - DNA, 16 bp, M. musculus
ggcaaaggatgtgaag

SEQ ID NO: 416842 - DNA, 16 bp, M. musculus
ggcaaagggaggcaga

SEQ ID NO: 416843 - DNA, 16 bp, M. musculus
ggcaaaggggaggtgg

SEQ ID NO: 416844 - DNA, 16 bp, M. musculus
ggcaaagtcctcctgg

SEQ ID NO: 416845 - DNA, 16 bp, M. musculus
ggcaaagtgcttgcca

SEQ ID NO: 416846 - DNA, 16 bp, M. musculus
ggcaaagtggccacac

SEQ ID NO: 416847 - DNA, 16 bp, M. musculus
ggcaaataaacccttt

SEQ ID NO: 416848 - DNA, 16 bp, M. musculus
ggcaaatacagaagcg

SEQ ID NO: 416849 - DNA, 16 bp, M. musculus
ggcaaatacagaagtg

SEQ ID NO: 416850 - DNA, 16 bp, M. musculus
ggcaaatatttggaat

SEQ ID NO: 416851 - DNA, 16 bp, M. musculus
ggcaaatcttataaaa

SEQ ID NO: 416852 - DNA, 16 bp, M. musculus
ggcaaatgaatggaat

SEQ ID NO: 416853 - DNA, 16 bp, M. musculus
ggcaaatgccagggcc

SEQ ID NO: 416854 - DNA, 16 bp, M. musculus
ggcaaatgctttacca

SEQ ID NO: 416855 - DNA, 16 bp, M. musculus
ggcaaatggatggata

SEQ ID NO: 416856 - DNA, 16 bp, M. musculus
ggcaaatggatggtcc

SEQ ID NO: 416857 - DNA, 16 bp, M. musculus
ggcaaatgggtggaac

SEQ ID NO: 416858 - DNA, 16 bp, M. musculus
ggcaacaacaggataa

SEQ ID NO: 416859 - DNA, 16 bp, M. musculus
ggcaacaaggaaccca

SEQ ID NO: 416860 - DNA, 16 bp, M. musculus
ggcaacaccccaaatc

SEQ ID NO: 416861 - DNA, 16 bp, M. musculus
ggcaacagagtcagaa

SEQ ID NO: 416862 - DNA, 16 bp, M. musculus
ggcaacagcaggataa

SEQ ID NO: 416863 - DNA, 16 bp, M. musculus
ggcaacatcagaaccc

SEQ ID NO: 416864 - DNA, 16 bp, M. musculus
ggcaacatttgaaatg

SEQ ID NO: 416865 - DNA, 22 bp, M. musculus
ggcaaccacatggtggctcaca

SEQ ID NO: 416866 - DNA, 16 bp, M. musculus
ggcaaccagaccttgg

SEQ ID NO: 416867 - DNA, 16 bp, M. musculus
ggcaaccagatcttgg

SEQ ID NO: 416868 - DNA, 16 bp, M. musculus
ggcaaccaggtcctga

SEQ ID NO: 416869 - DNA, 16 bp, M. musculus
ggcaacccagcaggag

SEQ ID NO: 416870 - DNA, 16 bp, M. musculus
ggcaacctgggctaca

SEQ ID NO: 416871 - DNA, 16 bp, M. musculus
ggcaacctggtctaca

SEQ ID NO: 416872 - DNA, 16 bp, M. musculus
ggcaactttttttttt

SEQ ID NO: 416873 - DNA, 16 bp, M. musculus
ggcaagaacccagatg

SEQ ID NO: 416874 - DNA, 16 bp, M. musculus
ggcaagaacctggagg

SEQ ID NO: 416875 - DNA, 16 bp, M. musculus
ggcaagaactctacca

SEQ ID NO: 416876 - DNA, 16 bp, M. musculus
ggcaagagcgcaagag

SEQ ID NO: 416877 - DNA, 16 bp, M. musculus
ggcaagagctgatgta

SEQ ID NO: 416878 - DNA, 16 bp, M. musculus
ggcaagaggattatga

SEQ ID NO: 416879 - DNA, 16 bp, M. musculus
ggcaagatggctcagc

SEQ ID NO: 416880 - DNA, 16 bp, M. musculus
ggcaagattccaccca

SEQ ID NO: 416881 - DNA, 16 bp, M. musculus
ggcaagcaagatggct

SEQ ID NO: 416882 - DNA, 16 bp, M. musculus
ggcaagcaagccagta

SEQ ID NO: 416883 - DNA, 16 bp, M. musculus
ggcaagcacctgaagg

SEQ ID NO: 416884 - DNA, 16 bp, M. musculus
ggcaagcactcaacca

SEQ ID NO: 416885 - DNA, 16 bp, M. musculus
ggcaagcactctacca

SEQ ID NO: 416886 - DNA, 16 bp, M. musculus
ggcaagcactttatca

SEQ ID NO: 416887 - DNA, 16 bp, M. musculus
ggcaagcagatctctt

SEQ ID NO: 416888 - DNA, 16 bp, M. musculus
ggcaagcagtctacca

SEQ ID NO: 416889 - DNA, 16 bp, M. musculus
ggcaagcattttacca

SEQ ID NO: 416890 - DNA, 16 bp, M. musculus
ggcaagctgatctctg

SEQ ID NO: 416891 - DNA, 16 bp, M. musculus
ggcaaggaagcaggag

SEQ ID NO: 416892 - DNA, 16 bp, M. musculus
ggcaaggactgaagga

SEQ ID NO: 416893 - DNA, 16 bp, M. musculus
ggcaaggatggggaga

SEQ ID NO: 416894 - DNA, 16 bp, M. musculus
ggcaaggatgtggagt

SEQ ID NO: 416895 - DNA, 16 bp, M. musculus
ggcaaggcagtaaaca

SEQ ID NO: 416896 - DNA, 16 bp, M. musculus
ggcaagggtaagaaca

SEQ ID NO: 416897 - DNA, 16 bp, M. musculus
ggcaaggtagccaggg

SEQ ID NO: 416898 - DNA, 16 bp, M. musculus
ggcaaggtggctcagc

SEQ ID NO: 416899 - DNA, 16 bp, M. musculus
ggcaagtctgtagagc

SEQ ID NO: 416900 - DNA, 16 bp, M. musculus
ggcaagtgctctaccc

SEQ ID NO: 416901 - DNA, 16 bp, M. musculus
ggcaagtgctttactg

SEQ ID NO: 416902 - DNA, 16 bp, M. musculus
ggcaagtgcttttacc

SEQ ID NO: 416903 - DNA, 16 bp, M. musculus
ggcaagttctttaatt

SEQ ID NO: 416904 - DNA, 16 bp, M. musculus
ggcaatcctcctgttt

SEQ ID NO: 416905 - DNA, 16 bp, M. musculus
ggcaatgagcaggatg

SEQ ID NO: 416906 - DNA, 16 bp, M. musculus
ggcaatggcagagcct

SEQ ID NO: 416907 - DNA, 16 bp, M. musculus
ggcaatggtccatcct

SEQ ID NO: 416908 - DNA, 16 bp, M. musculus
ggcaattcctcaactg

SEQ ID NO: 416909 - DNA, 16 bp, M. musculus
ggcaattttttttttc

SEQ ID NO: 416910 - DNA, 16 bp, M. musculus
ggcacacacacacaca

SEQ ID NO: 416911 - DNA, 16 bp, M. musculus
ggcacacacacataca

SEQ ID NO: 416912 - DNA, 16 bp, M. musculus
ggcacacacactcata

SEQ ID NO: 416913 - DNA, 16 bp, M. musculus
ggcacacacagacaca

SEQ ID NO: 416914 - DNA, 16 bp, M. musculus
ggcacacaccaccatg

SEQ ID NO: 416915 - DNA, 16 bp, M. musculus
ggcacacacctttatt

SEQ ID NO: 416916 - DNA, 16 bp, M. musculus
ggcacacagacacaga

SEQ ID NO: 416917 - DNA, 16 bp, M. musculus
ggcacacaggcaggca

SEQ ID NO: 416918 - DNA, 16 bp, M. musculus
ggcacacagtaggcac

SEQ ID NO: 416919 - DNA, 16 bp, M. musculus
ggcacacatgcacaca

SEQ ID NO: 416920 - DNA, 16 bp, M. musculus
ggcacacatgtagtgc

SEQ ID NO: 416921 - DNA, 16 bp, M. musculus
ggcacacctggctgtt

SEQ ID NO: 416922 - DNA, 16 bp, M. musculus
ggcacagaaattgtgg

SEQ ID NO: 416923 - DNA, 16 bp, M. musculus
ggcacagacacacaca

SEQ ID NO: 416924 - DNA, 16 bp, M. musculus
ggcacagagaaagcat

SEQ ID NO: 416925 - DNA, 16 bp, M. musculus
ggcacagagccttcac

SEQ ID NO: 416926 - DNA, 16 bp, M. musculus
ggcacagaggttaaga

SEQ ID NO: 416927 - DNA, 16 bp, M. musculus
ggcacaggctcaggca

SEQ ID NO: 416928 - DNA, 16 bp, M. musculus
ggcacagggcacaggg

SEQ ID NO: 416929 - DNA, 16 bp, M. musculus
ggcacaggggatggag

SEQ ID NO: 416930 - DNA, 16 bp, M. musculus
ggcacaggtagagctg

SEQ ID NO: 416931 - DNA, 16 bp, M. musculus
ggcacaggtgagccag

SEQ ID NO: 416932 - DNA, 16 bp, M. musculus
ggcacagtgacagaca

SEQ ID NO: 416933 - DNA, 16 bp, M. musculus
ggcacataataaatat

SEQ ID NO: 416934 - DNA, 16 bp, M. musculus
ggcacatatctataat

SEQ ID NO: 416935 - DNA, 16 bp, M. musculus
ggcacatcatctctga

SEQ ID NO: 416936 - DNA, 26 bp, M. musculus
ggcacatgcgcagattatttgtttac

SEQ ID NO: 416937 - DNA, 40 bp, M. musculus
ggcacatgcgcagattatttgtttaccacttagaacacag

SEQ ID NO: 416938 - DNA, 16 bp, M. musculus
ggcacatgtgcatgca

SEQ ID NO: 416939 - DNA, 16 bp, M. musculus
ggcacatttttccaga

SEQ ID NO: 416940 - DNA, 16 bp, M. musculus
ggcaccaaaatgtatt

SEQ ID NO: 416941 - DNA, 17 bp, M. musculus
ggcaccacccagaagtg

SEQ ID NO: 416942 - DNA, 16 bp, M. musculus
ggcaccagacatgcac

SEQ ID NO: 416943 - DNA, 16 bp, M. musculus
ggcaccatgaccatgg

SEQ ID NO: 416944 - DNA, 19 bp, M. musculus
ggcaccatttgaaggtgtg

SEQ ID NO: 416945 - DNA, 16 bp, M. musculus
ggcacccaggaactcc

SEQ ID NO: 416946 - DNA, 16 bp, M. musculus
ggcaccccagaagagg

SEQ ID NO: 416947 - DNA, 16 bp, M. musculus
ggcacctgctgccaag

SEQ ID NO: 416948 - DNA, 16 bp, M. musculus
ggcacgaaccagcagc

SEQ ID NO: 416949 - DNA, 16 bp, M. musculus
ggcacgcatgcacaca

SEQ ID NO: 416950 - DNA, 16 bp, M. musculus
ggcacgggcacgggca

SEQ ID NO: 416951 - DNA, 16 bp, M. musculus
ggcacggggagggtat

SEQ ID NO: 416952 - DNA, 16 bp, M. musculus
ggcactactaggaggt

SEQ ID NO: 416953 - DNA, 18 bp, M. musculus
ggcactatgagaataaca

SEQ ID NO: 416954 - DNA, 16 bp, M. musculus
ggcactctgagaggcc

SEQ ID NO: 416955 - DNA, 16 bp, M. musculus
ggcactctggaggcag

SEQ ID NO: 416956 - DNA, 16 bp, M. musculus
ggcactgaaggagctg

SEQ ID NO: 416957 - DNA, 16 bp, M. musculus
ggcactgactgctctt

SEQ ID NO: 416958 - DNA, 16 bp, M. musculus
ggcactgcctcagaag

SEQ ID NO: 416959 - DNA, 16 bp, M. musculus
ggcactggaggagctg

SEQ ID NO: 416960 - DNA, 16 bp, M. musculus
ggcactggcatagccc

SEQ ID NO: 416961 - DNA, 16 bp, M. musculus
ggcactggggagatgg

SEQ ID NO: 416962 - DNA, 16 bp, M. musculus
ggcactgtggcacaca

SEQ ID NO: 416963 - DNA, 16 bp, M. musculus
ggcacttaaaaaaaaa

SEQ ID NO: 416964 - DNA, 16 bp, M. musculus
ggcacttcctctctca

SEQ ID NO: 416965 - DNA, 16 bp, M. musculus
ggcactttaagtctct

SEQ ID NO: 416966 - DNA, 16 bp, M. musculus
ggcactttcttaatta

SEQ ID NO: 416967 - DNA, 16 bp, M. musculus
ggcactttttttttct

SEQ ID NO: 416968 - DNA, 16 bp, M. musculus
ggcagaaacagcagca

SEQ ID NO: 416969 - DNA, 16 bp, M. musculus
ggcagaaacaggagaa

SEQ ID NO: 416970 - DNA, 16 bp, M. musculus
ggcagaactatagagc

SEQ ID NO: 416971 - DNA, 16 bp, M. musculus
ggcagaactggagaag

SEQ ID NO: 416972 - DNA, 16 bp, M. musculus
ggcagaacttcaggca

SEQ ID NO: 416973 - DNA, 16 bp, M. musculus
ggcagaacttctcagg

SEQ ID NO: 416974 - DNA, 16 bp, M. musculus
ggcagaagatgaaagc

SEQ ID NO: 416975 - DNA, 16 bp, M. musculus
ggcagaagatgaagcc

SEQ ID NO: 416976 - DNA, 16 bp, M. musculus
ggcagaagatgaaggc

SEQ ID NO: 416977 - DNA, 16 bp, M. musculus
ggcagaagcaagagga

SEQ ID NO: 416978 - DNA, 16 bp, M. musculus
ggcagaagcagaggca

SEQ ID NO: 416979 - DNA, 16 bp, M. musculus
ggcagaagcagatgga

SEQ ID NO: 416980 - DNA, 16 bp, M. musculus
ggcagaagcagctgac

SEQ ID NO: 416981 - DNA, 16 bp, M. musculus
ggcagaagcaggaagc

SEQ ID NO: 416982 - DNA, 16 bp, M. musculus
ggcagaagcaggcaag

SEQ ID NO: 416983 - DNA, 16 bp, M. musculus
ggcagaagccacagag

SEQ ID NO: 416984 - DNA, 16 bp, M. musculus
ggcagaagccagcaga

SEQ ID NO: 416985 - DNA, 16 bp, M. musculus
ggcagaagctggcaga

SEQ ID NO: 416986 - DNA, 16 bp, M. musculus
ggcagaaggatctgga

SEQ ID NO: 416987 - DNA, 16 bp, M. musculus
ggcagacaaaatgatg

SEQ ID NO: 416988 - DNA, 16 bp, M. musculus
ggcagacagacagaca

SEQ ID NO: 416989 - DNA, 16 bp, M. musculus
ggcagacagacagata

SEQ ID NO: 416990 - DNA, 16 bp, M. musculus
ggcagacagaggcagg

SEQ ID NO: 416991 - DNA, 16 bp, M. musculus
ggcagacagatttctg

SEQ ID NO: 416992 - DNA, 16 bp, M. musculus
ggcagacaggaagcag

SEQ ID NO: 416993 - DNA, 16 bp, M. musculus
ggcagacatggcactg

SEQ ID NO: 416994 - DNA, 23 bp, M. musculus
ggcagacccccgtgctctcacca

SEQ ID NO: 416995 - DNA, 16 bp, M. musculus
ggcagacctgtcagaa

SEQ ID NO: 416996 - DNA, 16 bp, M. musculus
ggcagacgcaggagga

SEQ ID NO: 416997 - DNA, 16 bp, M. musculus
ggcagagaagcaggga

SEQ ID NO: 416998 - DNA, 16 bp, M. musculus
ggcagagacaagagaa

SEQ ID NO: 416999 - DNA, 16 bp, M. musculus
ggcagagacagaggag

SEQ ID NO: 417000 - DNA, 16 bp, M. musculus
ggcagagacagggaga

SEQ ID NO: 417001 - DNA, 16 bp, M. musculus
ggcagagagcagagga

SEQ ID NO: 417002 - DNA, 16 bp, M. musculus
ggcagagagcttgcct

SEQ ID NO: 417003 - DNA, 16 bp, M. musculus
ggcagagataagcaga

SEQ ID NO: 417004 - DNA, 16 bp, M. musculus
ggcagagatgggaaga

SEQ ID NO: 417005 - DNA, 16 bp, M. musculus
ggcagagcacttgcct

SEQ ID NO: 417006 - DNA, 16 bp, M. musculus
ggcagagccagagcca

SEQ ID NO: 417007 - DNA, 16 bp, M. musculus
ggcagagccaggcaga

SEQ ID NO: 417008 - DNA, 16 bp, M. musculus
ggcagagccctcctgg

SEQ ID NO: 417009 - DNA, 16 bp, M. musculus
ggcagagcctctgagg

SEQ ID NO: 417010 - DNA, 16 bp, M. musculus
ggcagagcgtctcagg

SEQ ID NO: 417011 - DNA, 16 bp, M. musculus
ggcagagctgagaatt

SEQ ID NO: 417012 - DNA, 16 bp, M. musculus
ggcagagctggagaag

SEQ ID NO: 417013 - DNA, 16 bp, M. musculus
ggcagagctggagaga

SEQ ID NO: 417014 - DNA, 16 bp, M. musculus
ggcagagctggagagg

SEQ ID NO: 417015 - DNA, 16 bp, M. musculus
ggcagagcttgaagaa

SEQ ID NO: 417016 - DNA, 16 bp, M. musculus
ggcagagcttgaggaa

SEQ ID NO: 417017 - DNA, 16 bp, M. musculus
ggcagaggacctgggt

SEQ ID NO: 417018 - DNA, 16 bp, M. musculus
ggcagaggagacagag

SEQ ID NO: 417019 - DNA, 16 bp, M. musculus
ggcagaggaggagggt

SEQ ID NO: 417020 - DNA, 16 bp, M. musculus
ggcagaggaggcagat

SEQ ID NO: 417021 - DNA, 16 bp, M. musculus
ggcagaggcaaaggca

SEQ ID NO: 417022 - DNA, 16 bp, M. musculus
ggcagaggcaagcaca

SEQ ID NO: 417023 - DNA, 16 bp, M. musculus
ggcagaggcaaggcca

SEQ ID NO: 417024 - DNA, 16 bp, M. musculus
ggcagaggcacgcaga

SEQ ID NO: 417025 - DNA, 16 bp, M. musculus
ggcagaggcagaagaa

SEQ ID NO: 417026 - DNA, 16 bp, M. musculus
ggcagaggcagaagag

SEQ ID NO: 417027 - DNA, 16 bp, M. musculus
ggcagaggcagagaga

SEQ ID NO: 417028 - DNA, 16 bp, M. musculus
ggcagaggcagagatg

SEQ ID NO: 417029 - DNA, 16 bp, M. musculus
ggcagaggcagaggaa

SEQ ID NO: 417030 - DNA, 16 bp, M. musculus
ggcagaggcagaggcg

SEQ ID NO: 417031 - DNA, 16 bp, M. musculus
ggcagaggcagcagaa

SEQ ID NO: 417032 - DNA, 16 bp, M. musculus
ggcagaggcagccgga

SEQ ID NO: 417033 - DNA, 16 bp, M. musculus
ggcagaggcagctgga

SEQ ID NO: 417034 - DNA, 16 bp, M. musculus
ggcagaggcaggagaa

SEQ ID NO: 417035 - DNA, 19 bp, M. musculus
ggcagaggcaggcaaattt

SEQ ID NO: 417036 - DNA, 16 bp, M. musculus
ggcagaggcaggcagg

SEQ ID NO: 417037 - DNA, 16 bp, M. musculus
ggcagaggcaggcctg

SEQ ID NO: 417038 - DNA, 16 bp, M. musculus
ggcagaggcaggcgat

SEQ ID NO: 417039 - DNA, 16 bp, M. musculus
ggcagaggcaggggat

SEQ ID NO: 417040 - DNA, 16 bp, M. musculus
ggcagaggcaggtagg

SEQ ID NO: 417041 - DNA, 16 bp, M. musculus
ggcagaggcaggtgac

SEQ ID NO: 417042 - DNA, 16 bp, M. musculus
ggcagaggccagaaga

SEQ ID NO: 417043 - DNA, 16 bp, M. musculus
ggcagaggcctggctg

SEQ ID NO: 417044 - DNA, 16 bp, M. musculus
ggcagaggctggtgga

SEQ ID NO: 417045 - DNA, 16 bp, M. musculus
ggcagagggagacaga

SEQ ID NO: 417046 - DNA, 16 bp, M. musculus
ggcagagtgcttgcct

SEQ ID NO: 417047 - DNA, 16 bp, M. musculus
ggcagataaaagagaa

SEQ ID NO: 417048 - DNA, 16 bp, M. musculus
ggcagatatgaaggga

SEQ ID NO: 417049 - DNA, 27 bp, M. musculus
ggcagatcccaatcctcagaattctta

SEQ ID NO: 417050 - DNA, 16 bp, M. musculus
ggcagatccctgagtt

SEQ ID NO: 417051 - DNA, 16 bp, M. musculus
ggcagatctctatgaa

SEQ ID NO: 417052 - DNA, 16 bp, M. musculus
ggcagatctctgtcag

SEQ ID NO: 417053 - DNA, 16 bp, M. musculus
ggcagatgaggcagat

SEQ ID NO: 417054 - DNA, 16 bp, M. musculus
ggcagatgccagcaag

SEQ ID NO: 417055 - DNA, 16 bp, M. musculus
ggcagatgctcacagc

SEQ ID NO: 417056 - DNA, 16 bp, M. musculus
ggcagatggacagaca

SEQ ID NO: 417057 - DNA, 16 bp, M. musculus
ggcagatggagctctg

SEQ ID NO: 417058 - DNA, 16 bp, M. musculus
ggcagatgggcctggg

SEQ ID NO: 417059 - DNA, 16 bp, M. musculus
ggcagatgtggtgctg

SEQ ID NO: 417060 - DNA, 16 bp, M. musculus
ggcagcaccatcccat

SEQ ID NO: 417061 - DNA, 16 bp, M. musculus
ggcagcactattccct

SEQ ID NO: 417062 - DNA, 16 bp, M. musculus
ggcagcagaaggaaac

SEQ ID NO: 417063 - DNA, 16 bp, M. musculus
ggcagcagagagagag

SEQ ID NO: 417064 - DNA, 16 bp, M. musculus
ggcagcagaggaggaa

SEQ ID NO: 417065 - DNA, 16 bp, M. musculus
ggcagcagatttctga

SEQ ID NO: 417066 - DNA, 18 bp, M. musculus
ggcagcagcagcagcagg

SEQ ID NO: 417067 - DNA, 16 bp, M. musculus
ggcagcagcagcagcc

SEQ ID NO: 417068 - DNA, 16 bp, M. musculus
ggcagcagcaggtgga

SEQ ID NO: 417069 - DNA, 16 bp, M. musculus
ggcagcagcggcagca

SEQ ID NO: 417070 - DNA, 16 bp, M. musculus
ggcagcagctgctgct

SEQ ID NO: 417071 - DNA, 16 bp, M. musculus
ggcagcaggaaaagag

SEQ ID NO: 417072 - DNA, 16 bp, M. musculus
ggcagcaggaagagag

SEQ ID NO: 417073 - DNA, 16 bp, M. musculus
ggcagcaggaagagca

SEQ ID NO: 417074 - DNA, 16 bp, M. musculus
ggcagcaggaaggcag

SEQ ID NO: 417075 - DNA, 16 bp, M. musculus
ggcagcaggagcttga

SEQ ID NO: 417076 - DNA, 16 bp, M. musculus
ggcagcaggaggcctg

SEQ ID NO: 417077 - DNA, 16 bp, M. musculus
ggcagcaggcagacat

SEQ ID NO: 417078 - DNA, 16 bp, M. musculus
ggcagcaggcaggcaa

SEQ ID NO: 417079 - DNA, 16 bp, M. musculus
ggcagcaggcaggcag

SEQ ID NO: 417080 - DNA, 16 bp, M. musculus
ggcagcaggcagggaa

SEQ ID NO: 417081 - DNA, 16 bp, M. musculus
ggcagcaggcagggag

SEQ ID NO: 417082 - DNA, 16 bp, M. musculus
ggcagcaggcatggtg

SEQ ID NO: 417083 - DNA, 16 bp, M. musculus
ggcagcagggcagcag

SEQ ID NO: 417084 - DNA, 16 bp, M. musculus
ggcagcaggggcagga

SEQ ID NO: 417085 - DNA, 16 bp, M. musculus
ggcagcagtgtgtgtg

SEQ ID NO: 417086 - DNA, 16 bp, M. musculus
ggcagcatccaggcag

SEQ ID NO: 417087 - DNA, 16 bp, M. musculus
ggcagcatccatgcag

SEQ ID NO: 417088 - DNA, 16 bp, M. musculus
ggcagcatccatgctg

SEQ ID NO: 417089 - DNA, 16 bp, M. musculus
ggcagcatcctggcag

SEQ ID NO: 417090 - DNA, 16 bp, M. musculus
ggcagcatctgctgtc

SEQ ID NO: 417091 - DNA, 16 bp, M. musculus
ggcagcatctgggcag

SEQ ID NO: 417092 - DNA, 16 bp, M. musculus
ggcagccaagactaca

SEQ ID NO: 417093 - DNA, 16 bp, M. musculus
ggcagccaagaggagg

SEQ ID NO: 417094 - DNA, 16 bp, M. musculus
ggcagccagccctgca

SEQ ID NO: 417095 - DNA, 16 bp, M. musculus
ggcagccaggagaaga

SEQ ID NO: 417096 - DNA, 16 bp, M. musculus
ggcagccctcagggcc

SEQ ID NO: 417097 - DNA, 16 bp, M. musculus
ggcagcctccagggtc

SEQ ID NO: 417098 - DNA, 16 bp, M. musculus
ggcagcctgcaggcag

SEQ ID NO: 417099 - DNA, 16 bp, M. musculus
ggcagcctggccatgg

SEQ ID NO: 417100 - DNA, 16 bp, M. musculus
ggcagcctgggctaca

SEQ ID NO: 417101 - DNA, 16 bp, M. musculus
ggcagcctggtctaca

SEQ ID NO: 417102 - DNA, 16 bp, M. musculus
ggcagcctggttcctg

SEQ ID NO: 417103 - DNA, 16 bp, M. musculus
ggcagcctgtggtcct

SEQ ID NO: 417104 - DNA, 16 bp, M. musculus
ggcagcggtggtggtg

SEQ ID NO: 417105 - DNA, 16 bp, M. musculus
ggcagctagggtgaag

SEQ ID NO: 417106 - DNA, 16 bp, M. musculus
ggcagctcacaagtgt

SEQ ID NO: 417107 - DNA, 16 bp, M. musculus
ggcagctcacagccat

SEQ ID NO: 417108 - DNA, 16 bp, M. musculus
ggcagctcacagctct

SEQ ID NO: 417109 - DNA, 16 bp, M. musculus
ggcagctcactactgt

SEQ ID NO: 417110 - DNA, 16 bp, M. musculus
ggcagctgaagccaga

SEQ ID NO: 417111 - DNA, 16 bp, M. musculus
ggcagctgcagcagca

SEQ ID NO: 417112 - DNA, 16 bp, M. musculus
ggcagctgcccagctc

SEQ ID NO: 417113 - DNA, 16 bp, M. musculus
ggcagctggagagatg

SEQ ID NO: 417114 - DNA, 16 bp, M. musculus
ggcagctggagcagga

SEQ ID NO: 417115 - DNA, 16 bp, M. musculus
ggcagctggcagctgg

SEQ ID NO: 417116 - DNA, 18 bp, M. musculus
ggcagctgggtggccccc

SEQ ID NO: 417117 - DNA, 16 bp, M. musculus
ggcagctgtgagcctc

SEQ ID NO: 417118 - DNA, 16 bp, M. musculus
ggcagcttctctcttc

SEQ ID NO: 417119 - DNA, 16 bp, M. musculus
ggcagcttgattccca

SEQ ID NO: 417120 - DNA, 16 bp, M. musculus
ggcaggaaaagtacaa

SEQ ID NO: 417121 - DNA, 16 bp, M. musculus
ggcaggaaacatggca

SEQ ID NO: 417122 - DNA, 16 bp, M. musculus
ggcaggaaattatcaa

SEQ ID NO: 417123 - DNA, 16 bp, M. musculus
ggcaggaacagctgag

SEQ ID NO: 417124 - DNA, 16 bp, M. musculus
ggcaggaacaggagga

SEQ ID NO: 417125 - DNA, 16 bp, M. musculus
ggcaggaacccggagg

SEQ ID NO: 417126 - DNA, 16 bp, M. musculus
ggcaggaacctggaag

SEQ ID NO: 417127 - DNA, 16 bp, M. musculus
ggcaggaacctggagg

SEQ ID NO: 417128 - DNA, 16 bp, M. musculus
ggcaggaactgaagtg

SEQ ID NO: 417129 - DNA, 16 bp, M. musculus
ggcaggaactggaggc

SEQ ID NO: 417130 - DNA, 16 bp, M. musculus
ggcaggaacttggagg

SEQ ID NO: 417131 - DNA, 16 bp, M. musculus
ggcaggaagaatggca

SEQ ID NO: 417132 - DNA, 16 bp, M. musculus
ggcaggaagatccctg

SEQ ID NO: 417133 - DNA, 16 bp, M. musculus
ggcaggaagattatga

SEQ ID NO: 417134 - DNA, 16 bp, M. musculus
ggcaggaagattgaga

SEQ ID NO: 417135 - DNA, 16 bp, M. musculus
ggcaggaagcaaggca

SEQ ID NO: 417136 - DNA, 16 bp, M. musculus
ggcaggaagcagacat

SEQ ID NO: 417137 - DNA, 16 bp, M. musculus
ggcaggaagcaggagc

SEQ ID NO: 417138 - DNA, 16 bp, M. musculus
ggcaggaaggtcagaa

SEQ ID NO: 417139 - DNA, 16 bp, M. musculus
ggcaggaagtagaagg

SEQ ID NO: 417140 - DNA, 16 bp, M. musculus
ggcaggacagggcagg

SEQ ID NO: 417141 - DNA, 16 bp, M. musculus
ggcaggaccagctctc

SEQ ID NO: 417142 - DNA, 16 bp, M. musculus
ggcaggagaatcacca

SEQ ID NO: 417143 - DNA, 16 bp, M. musculus
ggcaggagaattgcaa

SEQ ID NO: 417144 - DNA, 16 bp, M. musculus
ggcaggagagaactga

SEQ ID NO: 417145 - DNA, 16 bp, M. musculus
ggcaggagcaggaagc

SEQ ID NO: 417146 - DNA, 16 bp, M. musculus
ggcaggagcaggaggc

SEQ ID NO: 417147 - DNA, 16 bp, M. musculus
ggcaggagcccagcac

SEQ ID NO: 417148 - DNA, 16 bp, M. musculus
ggcaggagcctggagg

SEQ ID NO: 417149 - DNA, 16 bp, M. musculus
ggcaggaggaactaag

SEQ ID NO: 417150 - DNA, 16 bp, M. musculus
ggcaggaggacatctg

SEQ ID NO: 417151 - DNA, 16 bp, M. musculus
ggcaggaggatcaaaa

SEQ ID NO: 417152 - DNA, 16 bp, M. musculus
ggcaggaggatcaagg

SEQ ID NO: 417153 - DNA, 16 bp, M. musculus
ggcaggaggatcacag

SEQ ID NO: 417154 - DNA, 16 bp, M. musculus
ggcaggaggatcagat

SEQ ID NO: 417155 - DNA, 16 bp, M. musculus
ggcaggaggatcatgt

SEQ ID NO: 417156 - DNA, 16 bp, M. musculus
ggcaggaggatcctga

SEQ ID NO: 417157 - DNA, 16 bp, M. musculus
ggcaggaggattttca

SEQ ID NO: 417158 - DNA, 16 bp, M. musculus
ggcaggaggattttga

SEQ ID NO: 417159 - DNA, 16 bp, M. musculus
ggcaggagtctggagg

SEQ ID NO: 417160 - DNA, 16 bp, M. musculus
ggcaggatttctctgt

SEQ ID NO: 417161 - DNA, 16 bp, M. musculus
ggcaggatttgggtat

SEQ ID NO: 417162 - DNA, 16 bp, M. musculus
ggcaggcaagcatggc

SEQ ID NO: 417163 - DNA, 16 bp, M. musculus
ggcaggcactgtgttc

SEQ ID NO: 417164 - DNA, 16 bp, M. musculus
ggcaggcagacctcta

SEQ ID NO: 417165 - DNA, 16 bp, M. musculus
ggcaggcagagctctg

SEQ ID NO: 417166 - DNA, 16 bp, M. musculus
ggcaggcagagctctt

SEQ ID NO: 417167 - DNA, 16 bp, M. musculus
ggcaggcagaggcaga

SEQ ID NO: 417168 - DNA, 16 bp, M. musculus
ggcaggcagaggcagg

SEQ ID NO: 417169 - DNA, 16 bp, M. musculus
ggcaggcagataggca

SEQ ID NO: 417170 - DNA, 16 bp, M. musculus
ggcaggcagcaggcag

SEQ ID NO: 417171 - DNA, 16 bp, M. musculus
ggcaggcaggcaaaag

SEQ ID NO: 417172 - DNA, 16 bp, M. musculus
ggcaggcaggcaaaca

SEQ ID NO: 417173 - DNA, 16 bp, M. musculus
ggcaggcaggcagagg

SEQ ID NO: 417174 - DNA, 16 bp, M. musculus
ggcaggcaggcagcag

SEQ ID NO: 417175 - DNA, 16 bp, M. musculus
ggcaggcaggcaggga

SEQ ID NO: 417176 - DNA, 16 bp, M. musculus
ggcaggcaggcatgac

SEQ ID NO: 417177 - DNA, 16 bp, M. musculus
ggcaggcaggcatggc

SEQ ID NO: 417178 - DNA, 16 bp, M. musculus
ggcaggcagggaaaca

SEQ ID NO: 417179 - DNA, 16 bp, M. musculus
ggcaggcagggaggca

SEQ ID NO: 417180 - DNA, 16 bp, M. musculus
ggcaggcagtgtcaca

SEQ ID NO: 417181 - DNA, 16 bp, M. musculus
ggcaggcatggagcag

SEQ ID NO: 417182 - DNA, 16 bp, M. musculus
ggcaggcatggcatag

SEQ ID NO: 417183 - DNA, 16 bp, M. musculus
ggcaggccaagaggcc

SEQ ID NO: 417184 - DNA, 16 bp, M. musculus
ggcaggcctataagaa

SEQ ID NO: 417185 - DNA, 16 bp, M. musculus
ggcaggcctggtgctg

SEQ ID NO: 417186 - DNA, 16 bp, M. musculus
ggcaggccttgaactc

SEQ ID NO: 417187 - DNA, 16 bp, M. musculus
ggcaggcggacttctg

SEQ ID NO: 417188 - DNA, 16 bp, M. musculus
ggcaggctgagcaagc

SEQ ID NO: 417189 - DNA, 16 bp, M. musculus
ggcagggaatctcagt

SEQ ID NO: 417190 - DNA, 16 bp, M. musculus
ggcagggacagggaca

SEQ ID NO: 417191 - DNA, 16 bp, M. musculus
ggcagggacaggtgga

SEQ ID NO: 417192 - DNA, 16 bp, M. musculus
ggcagggagcactaga

SEQ ID NO: 417193 - DNA, 16 bp, M. musculus
ggcagggagctgggag

SEQ ID NO: 417194 - DNA, 16 bp, M. musculus
ggcagggcagggcagc

SEQ ID NO: 417195 - DNA, 16 bp, M. musculus
ggcagggccaaaaagg

SEQ ID NO: 417196 - DNA, 16 bp, M. musculus
ggcaggggcaggggct

SEQ ID NO: 417197 - DNA, 16 bp, M. musculus
ggcaggggctctccca

SEQ ID NO: 417198 - DNA, 16 bp, M. musculus
ggcaggggcttgtgtg

SEQ ID NO: 417199 - DNA, 16 bp, M. musculus
ggcagggtttctctgt

SEQ ID NO: 417200 - DNA, 16 bp, M. musculus
ggcaggtaacagagtc

SEQ ID NO: 417201 - DNA, 16 bp, M. musculus
ggcaggtcctcagaaa

SEQ ID NO: 417202 - DNA, 16 bp, M. musculus
ggcaggtctctatgag

SEQ ID NO: 417203 - DNA, 16 bp, M. musculus
ggcaggtgaatctctg

SEQ ID NO: 417204 - DNA, 16 bp, M. musculus
ggcaggtgaggaagga

SEQ ID NO: 417205 - DNA, 16 bp, M. musculus
ggcaggtggaactctg

SEQ ID NO: 417206 - DNA, 16 bp, M. musculus
ggcaggtggagaggtg

SEQ ID NO: 417207 - DNA, 16 bp, M. musculus
ggcaggtggatctctc

SEQ ID NO: 417208 - DNA, 16 bp, M. musculus
ggcaggtggatttttt

SEQ ID NO: 417209 - DNA, 16 bp, M. musculus
ggcaggtggcaggcag

SEQ ID NO: 417210 - DNA, 16 bp, M. musculus
ggcaggtggcaggtgg

SEQ ID NO: 417211 - DNA, 16 bp, M. musculus
ggcaggtggctttctg

SEQ ID NO: 417212 - DNA, 16 bp, M. musculus
ggcaggtgggcctggg

SEQ ID NO: 417213 - DNA, 16 bp, M. musculus
ggcaggtgttgtgggt

SEQ ID NO: 417214 - DNA, 16 bp, M. musculus
ggcagtccaggatgag

SEQ ID NO: 417215 - DNA, 16 bp, M. musculus
ggcagtccctggatgg

SEQ ID NO: 417216 - DNA, 16 bp, M. musculus
ggcagtctctacatga

SEQ ID NO: 417217 - DNA, 16 bp, M. musculus
ggcagtctctggaggg

SEQ ID NO: 417218 - DNA, 16 bp, M. musculus
ggcagtctctggatgg

SEQ ID NO: 417219 - DNA, 16 bp, M. musculus
ggcagtgaaggatttg

SEQ ID NO: 417220 - DNA, 16 bp, M. musculus
ggcagtgaggagggag

SEQ ID NO: 417221 - DNA, 16 bp, M. musculus
ggcagtgaggcaggag

SEQ ID NO: 417222 - DNA, 16 bp, M. musculus
ggcagtgagtctgttc

SEQ ID NO: 417223 - DNA, 16 bp, M. musculus
ggcagtgatggtacac

SEQ ID NO: 417224 - DNA, 16 bp, M. musculus
ggcagtgctacccctg

SEQ ID NO: 417225 - DNA, 16 bp, M. musculus
ggcagtgctgggttct

SEQ ID NO: 417226 - DNA, 16 bp, M. musculus
ggcagtggcggtgcac

SEQ ID NO: 417227 - DNA, 16 bp, M. musculus
ggcagtgggaaagaaa

SEQ ID NO: 417228 - DNA, 16 bp, M. musculus
ggcagtggtgatgcac

SEQ ID NO: 417229 - DNA, 16 bp, M. musculus
ggcagtggtggcacac

SEQ ID NO: 417230 - DNA, 16 bp, M. musculus
ggcagtggtggcagtg

SEQ ID NO: 417231 - DNA, 16 bp, M. musculus
ggcagtggtggcccac

SEQ ID NO: 417232 - DNA, 16 bp, M. musculus
ggcagtggtggcgcac

SEQ ID NO: 417233 - DNA, 16 bp, M. musculus
ggcagtggtggggcac

SEQ ID NO: 417234 - DNA, 16 bp, M. musculus
ggcagtggtggtgcac

SEQ ID NO: 417235 - DNA, 16 bp, M. musculus
ggcagtggtggtgctt

SEQ ID NO: 417236 - DNA, 16 bp, M. musculus
ggcagtggtggtggtg

SEQ ID NO: 417237 - DNA, 16 bp, M. musculus
ggcagtgtttctctgt

SEQ ID NO: 417238 - DNA, 16 bp, M. musculus
ggcagttcagtctctg

SEQ ID NO: 417239 - DNA, 16 bp, M. musculus
ggcagttcccagaagc

SEQ ID NO: 417240 - DNA, 16 bp, M. musculus
ggcagttcttcagttg

SEQ ID NO: 417241 - DNA, 16 bp, M. musculus
ggcagttgtgaactgt

SEQ ID NO: 417242 - DNA, 16 bp, M. musculus
ggcagttgtgccagca

SEQ ID NO: 417243 - DNA, 16 bp, M. musculus
ggcagtttccaggcag

SEQ ID NO: 417244 - DNA, 16 bp, M. musculus
ggcatacatttttttg

SEQ ID NO: 417245 - DNA, 16 bp, M. musculus
ggcatacctgggtttg

SEQ ID NO: 417246 - DNA, 16 bp, M. musculus
ggcatagaagatatga

SEQ ID NO: 417247 - DNA, 16 bp, M. musculus
ggcatagagccttctc

SEQ ID NO: 417248 - DNA, 16 bp, M. musculus
ggcatagtagcacaca

SEQ ID NO: 417249 - DNA, 16 bp, M. musculus
ggcatagtagtgcaca

SEQ ID NO: 417250 - DNA, 19 bp, M. musculus
ggcatataaagtttgcaag

SEQ ID NO: 417251 - DNA, 17 bp, M. musculus
ggcatatatatatatat

SEQ ID NO: 417252 - DNA, 16 bp, M. musculus
ggcatatatccaaaag

SEQ ID NO: 417253 - DNA, 26 bp, M. musculus
ggcatatatccagaagatgtcccaac

SEQ ID NO: 417254 - DNA, 16 bp, M. musculus
ggcatatctctgagtt

SEQ ID NO: 417255 - DNA, 16 bp, M. musculus
ggcatatgtcaccaca

SEQ ID NO: 417256 - DNA, 16 bp, M. musculus
ggcatatgtgtgtgtg

SEQ ID NO: 417257 - DNA, 16 bp, M. musculus
ggcatcaacctgagtg

SEQ ID NO: 417258 - DNA, 16 bp, M. musculus
ggcatcaagcattcac

SEQ ID NO: 417259 - DNA, 16 bp, M. musculus
ggcatcaagcctccct

SEQ ID NO: 417260 - DNA, 16 bp, M. musculus
ggcatcaccaatagtg

SEQ ID NO: 417261 - DNA, 16 bp, M. musculus
ggcatcagattctatt

SEQ ID NO: 417262 - DNA, 29 bp, M. musculus
ggcatcaggttcccagagatcatttattt

SEQ ID NO: 417263 - DNA, 16 bp, M. musculus
ggcatcattgggaaga

SEQ ID NO: 417264 - DNA, 16 bp, M. musculus
ggcatccaacaccctc

SEQ ID NO: 417265 - DNA, 16 bp, M. musculus
ggcatccacgtggaga

SEQ ID NO: 417266 - DNA, 16 bp, M. musculus
ggcatccctgggctgg

SEQ ID NO: 417267 - DNA, 16 bp, M. musculus
ggcatctccaaaacac

SEQ ID NO: 417268 - DNA, 16 bp, M. musculus
ggcatctccaggaaga

SEQ ID NO: 417269 - DNA, 16 bp, M. musculus
ggcatctctctctctc

SEQ ID NO: 417270 - DNA, 16 bp, M. musculus
ggcatctctgggatga

SEQ ID NO: 417271 - DNA, 16 bp, M. musculus
ggcatctgagttctct

SEQ ID NO: 417272 - DNA, 16 bp, M. musculus
ggcatctgggtttggg

SEQ ID NO: 417273 - DNA, 16 bp, M. musculus
ggcatgactctaaata

SEQ ID NO: 417274 - DNA, 16 bp, M. musculus
ggcatgatgcaggcag

SEQ ID NO: 417275 - DNA, 16 bp, M. musculus
ggcatgcaccactgtg

SEQ ID NO: 417276 - DNA, 16 bp, M. musculus
ggcatgctcagcctgc

SEQ ID NO: 417277 - DNA, 16 bp, M. musculus
ggcatggaagaaggaa

SEQ ID NO: 417278 - DNA, 16 bp, M. musculus
ggcatggacagagtcc

SEQ ID NO: 417279 - DNA, 16 bp, M. musculus
ggcatggatctcaagc

SEQ ID NO: 417280 - DNA, 16 bp, M. musculus
ggcatggcagtgcaca

SEQ ID NO: 417281 - DNA, 16 bp, M. musculus
ggcatggccaaacacc

SEQ ID NO: 417282 - DNA, 16 bp, M. musculus
ggcatgggatcccctg

SEQ ID NO: 417283 - DNA, 16 bp, M. musculus
ggcatgggcatgggca

SEQ ID NO: 417284 - DNA, 16 bp, M. musculus
ggcatgggctttggaa

SEQ ID NO: 417285 - DNA, 16 bp, M. musculus
ggcatgggcttttgaa

SEQ ID NO: 417286 - DNA, 16 bp, M. musculus
ggcatggggaggaggt

SEQ ID NO: 417287 - DNA, 16 bp, M. musculus
ggcatggggcctgccc

SEQ ID NO: 417288 - DNA, 16 bp, M. musculus
ggcatggtagcacaca

SEQ ID NO: 417289 - DNA, 16 bp, M. musculus
ggcatggtgacacact

SEQ ID NO: 417290 - DNA, 16 bp, M. musculus
ggcatggtgatgcaca

SEQ ID NO: 417291 - DNA, 16 bp, M. musculus
ggcatggtgcaggcag

SEQ ID NO: 417292 - DNA, 16 bp, M. musculus
ggcatggtggcaggag

SEQ ID NO: 417293 - DNA, 16 bp, M. musculus
ggcatggtggcaggca

SEQ ID NO: 417294 - DNA, 16 bp, M. musculus
ggcatggtggcgcata

SEQ ID NO: 417295 - DNA, 16 bp, M. musculus
ggcatggtggctggag

SEQ ID NO: 417296 - DNA, 16 bp, M. musculus
ggcatggtgggccatc

SEQ ID NO: 417297 - DNA, 16 bp, M. musculus
ggcatggtggtataca

SEQ ID NO: 417298 - DNA, 16 bp, M. musculus
ggcatggtggtccaca

SEQ ID NO: 417299 - DNA, 16 bp, M. musculus
ggcatggtggtgcaca

SEQ ID NO: 417300 - DNA, 16 bp, M. musculus
ggcatggtggtggtgg

SEQ ID NO: 417301 - DNA, 16 bp, M. musculus
ggcatggtggtgtgtg

SEQ ID NO: 417302 - DNA, 16 bp, M. musculus
ggcatggtttcaggaa

SEQ ID NO: 417303 - DNA, 16 bp, M. musculus
ggcatgtagaagaatg

SEQ ID NO: 417304 - DNA, 16 bp, M. musculus
ggcatgtatgcatgtg

SEQ ID NO: 417305 - DNA, 16 bp, M. musculus
ggcatgtctgtgaggg

SEQ ID NO: 417306 - DNA, 16 bp, M. musculus
ggcatgtgacaccaca

SEQ ID NO: 417307 - DNA, 16 bp, M. musculus
ggcatgtgcaaggccc

SEQ ID NO: 417308 - DNA, 16 bp, M. musculus
ggcatgtgccaccatt

SEQ ID NO: 417309 - DNA, 16 bp, M. musculus
ggcatgtgccactatg

SEQ ID NO: 417310 - DNA, 16 bp, M. musculus
ggcatgtttgtttgtt

SEQ ID NO: 417311 - DNA, 16 bp, M. musculus
ggcattcctcaggtga

SEQ ID NO: 417312 - DNA, 16 bp, M. musculus
ggcattcctctgctgt

SEQ ID NO: 417313 - DNA, 16 bp, M. musculus
ggcattctaagtttct

SEQ ID NO: 417314 - DNA, 16 bp, M. musculus
ggcattctgggttctg

SEQ ID NO: 417315 - DNA, 16 bp, M. musculus
ggcattggagcccctg

SEQ ID NO: 417316 - DNA, 16 bp, M. musculus
ggcattggatcccctg

SEQ ID NO: 417317 - DNA, 16 bp, M. musculus
ggcattggatgccctg

SEQ ID NO: 417318 - DNA, 16 bp, M. musculus
ggcattggtggcacac

SEQ ID NO: 417319 - DNA, 16 bp, M. musculus
ggcattgtgcaatagt

SEQ ID NO: 417320 - DNA, 16 bp, M. musculus
ggcatttaaaaaataa

SEQ ID NO: 417321 - DNA, 16 bp, M. musculus
ggcatttatttattta

SEQ ID NO: 417322 - DNA, 16 bp, M. musculus
ggcatttatttcattt

SEQ ID NO: 417323 - DNA, 16 bp, M. musculus
ggcatttccctacttt

SEQ ID NO: 417324 - DNA, 16 bp, M. musculus
ggcatttggacctgcc

SEQ ID NO: 417325 - DNA, 16 bp, M. musculus
ggcatttgtgttctcc

SEQ ID NO: 417326 - DNA, 16 bp, M. musculus
ggcatttgttttgttt

SEQ ID NO: 417327 - DNA, 16 bp, M. musculus
ggcattttcttaataa

SEQ ID NO: 417328 - DNA, 16 bp, M. musculus
ggcattttcttaattg

SEQ ID NO: 417329 - DNA, 16 bp, M. musculus
ggcattttcttcatta

SEQ ID NO: 417330 - DNA, 16 bp, M. musculus
ggcatttttgttgttg

SEQ ID NO: 417331 - DNA, 16 bp, M. musculus
ggcatttttttttcaa

SEQ ID NO: 417332 - DNA, 16 bp, M. musculus
ggccaaaaagtgggag

SEQ ID NO: 417333 - DNA, 16 bp, M. musculus
ggccaaaaagtgggga

SEQ ID NO: 417334 - DNA, 16 bp, M. musculus
ggccaaagcagcacag

SEQ ID NO: 417335 - DNA, 16 bp, M. musculus
ggccaaatggaagcct

SEQ ID NO: 417336 - DNA, 16 bp, M. musculus
ggccaacaactccaaa

SEQ ID NO: 417337 - DNA, 16 bp, M. musculus
ggccaacagaaagaat

SEQ ID NO: 417338 - DNA, 16 bp, M. musculus
ggccaacagaatgaat

SEQ ID NO: 417339 - DNA, 16 bp, M. musculus
ggccaaccagagtgag

SEQ ID NO: 417340 - DNA, 16 bp, M. musculus
ggccaaccagggctgc

SEQ ID NO: 417341 - DNA, 16 bp, M. musculus
ggccaacctggcctac

SEQ ID NO: 417342 - DNA, 16 bp, M. musculus
ggccaacctgggctat

SEQ ID NO: 417343 - DNA, 16 bp, M. musculus
ggccaacctgggctgc

SEQ ID NO: 417344 - DNA, 16 bp, M. musculus
ggccaagaaagaaatt

SEQ ID NO: 417345 - DNA, 16 bp, M. musculus
ggccaagaacctgtgg

SEQ ID NO: 417346 - DNA, 16 bp, M. musculus
ggccaagaagcaggag

SEQ ID NO: 417347 - DNA, 16 bp, M. musculus
ggccaagaagctggag

SEQ ID NO: 417348 - DNA, 16 bp, M. musculus
ggccaagaagtagaag

SEQ ID NO: 417349 - DNA, 16 bp, M. musculus
ggccaagaggaaagaa

SEQ ID NO: 417350 - DNA, 16 bp, M. musculus
ggccaagcagcccttc

SEQ ID NO: 417351 - DNA, 16 bp, M. musculus
ggccaaggagtgggag

SEQ ID NO: 417352 - DNA, 16 bp, M. musculus
ggccaaggagttttag

SEQ ID NO: 417353 - DNA, 16 bp, M. musculus
ggccaaggcaagagga

SEQ ID NO: 417354 - DNA, 16 bp, M. musculus
ggccaaggcaggagaa

SEQ ID NO: 417355 - DNA, 16 bp, M. musculus
ggccaaggctgcccct

SEQ ID NO: 417356 - DNA, 16 bp, M. musculus
ggccaaggtcacacag

SEQ ID NO: 417357 - DNA, 16 bp, M. musculus
ggccaagtggagagag

SEQ ID NO: 417358 - DNA, 16 bp, M. musculus
ggccaatctctgtgag

SEQ ID NO: 417359 - DNA, 16 bp, M. musculus
ggccacacagagaaag

SEQ ID NO: 417360 - DNA, 16 bp, M. musculus
ggccacacagggaaac

SEQ ID NO: 417361 - DNA, 16 bp, M. musculus
ggccacacccgctcct

SEQ ID NO: 417362 - DNA, 16 bp, M. musculus
ggccacacctactcca

SEQ ID NO: 417363 - DNA, 16 bp, M. musculus
ggccacacctcctcca

SEQ ID NO: 417364 - DNA, 16 bp, M. musculus
ggccacacctccttca

SEQ ID NO: 417365 - DNA, 16 bp, M. musculus
ggccacagaagcagca

SEQ ID NO: 417366 - DNA, 16 bp, M. musculus
ggccacagcttctaat

SEQ ID NO: 417367 - DNA, 16 bp, M. musculus
ggccacaggccacagg

SEQ ID NO: 417368 - DNA, 16 bp, M. musculus
ggccacaggccccagc

SEQ ID NO: 417369 - DNA, 16 bp, M. musculus
ggccacaggcctacca

SEQ ID NO: 417370 - DNA, 17 bp, M. musculus
ggccaccaaagaggaga

SEQ ID NO: 417371 - DNA, 16 bp, M. musculus
ggccaccaacagatgg

SEQ ID NO: 417372 - DNA, 16 bp, M. musculus
ggccaccaattgtcac

SEQ ID NO: 417373 - DNA, 16 bp, M. musculus
ggccaccaccacccag

SEQ ID NO: 417374 - DNA, 16 bp, M. musculus
ggccaccaggcttggc

SEQ ID NO: 417375 - DNA, 16 bp, M. musculus
ggccaccagggggcag

SEQ ID NO: 417376 - DNA, 16 bp, M. musculus
ggccacccacacatct

SEQ ID NO: 417377 - DNA, 16 bp, M. musculus
ggccacccactcatct

SEQ ID NO: 417378 - DNA, 16 bp, M. musculus
ggccactcacaacagg

SEQ ID NO: 417379 - DNA, 16 bp, M. musculus
ggccactgggcagaaa

SEQ ID NO: 417380 - DNA, 16 bp, M. musculus
ggccacttcctcctcc

SEQ ID NO: 417381 - DNA, 16 bp, M. musculus
ggccagaaaacatctt

SEQ ID NO: 417382 - DNA, 16 bp, M. musculus
ggccagaaaagggtat

SEQ ID NO: 417383 - DNA, 16 bp, M. musculus
ggccagaaagatggct

SEQ ID NO: 417384 - DNA, 16 bp, M. musculus
ggccagaaagtgggag

SEQ ID NO: 417385 - DNA, 16 bp, M. musculus
ggccagaagaaggaat

SEQ ID NO: 417386 - DNA, 16 bp, M. musculus
ggccagaagaggctgt

SEQ ID NO: 417387 - DNA, 16 bp, M. musculus
ggccagaagctcagaa

SEQ ID NO: 417388 - DNA, 16 bp, M. musculus
ggccagacaaggtggt

SEQ ID NO: 417389 - DNA, 16 bp, M. musculus
ggccagagagaaggct

SEQ ID NO: 417390 - DNA, 16 bp, M. musculus
ggccagagagatagct

SEQ ID NO: 417391 - DNA, 16 bp, M. musculus
ggccagagaggtggct

SEQ ID NO: 417392 - DNA, 16 bp, M. musculus
ggccagaggaaggcat

SEQ ID NO: 417393 - DNA, 16 bp, M. musculus
ggccagaggagagacc

SEQ ID NO: 417394 - DNA, 16 bp, M. musculus
ggccagagggccagag

SEQ ID NO: 417395 - DNA, 16 bp, M. musculus
ggccagaggttgactt

SEQ ID NO: 417396 - DNA, 16 bp, M. musculus
ggccagagtgagcagg

SEQ ID NO: 417397 - DNA, 16 bp, M. musculus
ggccagcaagatagct

SEQ ID NO: 417398 - DNA, 16 bp, M. musculus
ggccagcaagatggat

SEQ ID NO: 417399 - DNA, 16 bp, M. musculus
ggccagcaagccccag

SEQ ID NO: 417400 - DNA, 16 bp, M. musculus
ggccagcaagctccca

SEQ ID NO: 417401 - DNA, 16 bp, M. musculus
ggccagcaagttccag

SEQ ID NO: 417402 - DNA, 16 bp, M. musculus
ggccagcaccaggacc

SEQ ID NO: 417403 - DNA, 16 bp, M. musculus
ggccagcagaaaggat

SEQ ID NO: 417404 - DNA, 16 bp, M. musculus
ggccagcagagggtgt

SEQ ID NO: 417405 - DNA, 16 bp, M. musculus
ggccagcagcagcagc

SEQ ID NO: 417406 - DNA, 16 bp, M. musculus
ggccagcaggccagca

SEQ ID NO: 417407 - DNA, 16 bp, M. musculus
ggccagcatgctgctc

SEQ ID NO: 417408 - DNA, 16 bp, M. musculus
ggccagcatggactac

SEQ ID NO: 417409 - DNA, 16 bp, M. musculus
ggccagccagccagcc

SEQ ID NO: 417410 - DNA, 16 bp, M. musculus
ggccagccagcctggc

SEQ ID NO: 417411 - DNA, 16 bp, M. musculus
ggccagccaggactgc

SEQ ID NO: 417412 - DNA, 16 bp, M. musculus
ggccagccaggccagc

SEQ ID NO: 417413 - DNA, 16 bp, M. musculus
ggccagccagggctat

SEQ ID NO: 417414 - DNA, 16 bp, M. musculus
ggccagccagggctcc

SEQ ID NO: 417415 - DNA, 16 bp, M. musculus
ggccagccagggcttc

SEQ ID NO: 417416 - DNA, 16 bp, M. musculus
ggccagcctaggctat

SEQ ID NO: 417417 - DNA, 16 bp, M. musculus
ggccagcctctgcttc

SEQ ID NO: 417418 - DNA, 16 bp, M. musculus
ggccagcctcttctac

SEQ ID NO: 417419 - DNA, 16 bp, M. musculus
ggccagcctcttctct

SEQ ID NO: 417420 - DNA, 16 bp, M. musculus
ggccagcctgagctcc

SEQ ID NO: 417421 - DNA, 16 bp, M. musculus
ggccagcctgcactac

SEQ ID NO: 417422 - DNA, 16 bp, M. musculus
ggccagcctgctttac

SEQ ID NO: 417423 - DNA, 16 bp, M. musculus
ggccagcctggactag

SEQ ID NO: 417424 - DNA, 16 bp, M. musculus
ggccagcctgggcaac

SEQ ID NO: 417425 - DNA, 16 bp, M. musculus
ggccagcctggtacag

SEQ ID NO: 417426 - DNA, 16 bp, M. musculus
ggccagcctggtgtgc

SEQ ID NO: 417427 - DNA, 16 bp, M. musculus
ggccagcctgtgctac

SEQ ID NO: 417428 - DNA, 16 bp, M. musculus
ggccagcctgttctat

SEQ ID NO: 417429 - DNA, 16 bp, M. musculus
ggccagctcatcctgg

SEQ ID NO: 417430 - DNA, 16 bp, M. musculus
ggccagctctcctgtc

SEQ ID NO: 417431 - DNA, 16 bp, M. musculus
ggccagctgcttcagg

SEQ ID NO: 417432 - DNA, 16 bp, M. musculus
ggccagcttgctgctc

SEQ ID NO: 417433 - DNA, 16 bp, M. musculus
ggccaggaaaagggag

SEQ ID NO: 417434 - DNA, 16 bp, M. musculus
ggccaggaaagtggcc

SEQ ID NO: 417435 - DNA, 16 bp, M. musculus
ggccaggaactcagag

SEQ ID NO: 417436 - DNA, 21 bp, M. musculus
ggccaggaagaacgacgctgc

SEQ ID NO: 417437 - DNA, 16 bp, M. musculus
ggccaggaagaaggac

SEQ ID NO: 417438 - DNA, 16 bp, M. musculus
ggccaggaagcaggac

SEQ ID NO: 417439 - DNA, 16 bp, M. musculus
ggccaggaagcaggag

SEQ ID NO: 417440 - DNA, 16 bp, M. musculus
ggccaggaagccccag

SEQ ID NO: 417441 - DNA, 16 bp, M. musculus
ggccaggaaggtggca

SEQ ID NO: 417442 - DNA, 16 bp, M. musculus
ggccaggaaggtggct

SEQ ID NO: 417443 - DNA, 16 bp, M. musculus
ggccaggaagtgggag

SEQ ID NO: 417444 - DNA, 16 bp, M. musculus
ggccaggaagtgggtg

SEQ ID NO: 417445 - DNA, 16 bp, M. musculus
ggccaggagagatggc

SEQ ID NO: 417446 - DNA, 16 bp, M. musculus
ggccaggagagggcgc

SEQ ID NO: 417447 - DNA, 16 bp, M. musculus
ggccaggatgtggaga

SEQ ID NO: 417448 - DNA, 16 bp, M. musculus
ggccaggatgtgggag

SEQ ID NO: 417449 - DNA, 16 bp, M. musculus
ggccaggcagacccct

SEQ ID NO: 417450 - DNA, 16 bp, M. musculus
ggccaggcaggaaccc

SEQ ID NO: 417451 - DNA, 16 bp, M. musculus
ggccaggcagtatctt

SEQ ID NO: 417452 - DNA, 17 bp, M. musculus
ggccaggcagtggtggc

SEQ ID NO: 417453 - DNA, 16 bp, M. musculus
ggccaggcatggtggt

SEQ ID NO: 417454 - DNA, 16 bp, M. musculus
ggccaggccaggccag

SEQ ID NO: 417455 - DNA, 16 bp, M. musculus
ggccaggcctggtgtg

SEQ ID NO: 417456 - DNA, 16 bp, M. musculus
ggccaggctgcaggcc

SEQ ID NO: 417457 - DNA, 16 bp, M. musculus
ggccagggatggcagg

SEQ ID NO: 417458 - DNA, 16 bp, M. musculus
ggccagggcaccatct

SEQ ID NO: 417459 - DNA, 16 bp, M. musculus
ggccaggtggcagggc

SEQ ID NO: 417460 - DNA, 16 bp, M. musculus
ggccaggtgtggtggc

SEQ ID NO: 417461 - DNA, 16 bp, M. musculus
ggccaggtgtggtggt

SEQ ID NO: 417462 - DNA, 16 bp, M. musculus
ggccaggtgtgtgtgt

SEQ ID NO: 417463 - DNA, 16 bp, M. musculus
ggccagtaaatacctt

SEQ ID NO: 417464 - DNA, 16 bp, M. musculus
ggccagtgagatggct

SEQ ID NO: 417465 - DNA, 16 bp, M. musculus
ggccagtgagctcctg

SEQ ID NO: 417466 - DNA, 16 bp, M. musculus
ggccagtgagctctgg

SEQ ID NO: 417467 - DNA, 16 bp, M. musculus
ggccagtgaggtggct

SEQ ID NO: 417468 - DNA, 16 bp, M. musculus
ggccagtggcttccag

SEQ ID NO: 417469 - DNA, 16 bp, M. musculus
ggccagttctactgtg

SEQ ID NO: 417470 - DNA, 19 bp, M. musculus
ggccatcactggaaagaga

SEQ ID NO: 417471 - DNA, 16 bp, M. musculus
ggccatccagacactg

SEQ ID NO: 417472 - DNA, 16 bp, M. musculus
ggccatccagagctac

SEQ ID NO: 417473 - DNA, 16 bp, M. musculus
ggccatccagagtctg

SEQ ID NO: 417474 - DNA, 16 bp, M. musculus
ggccatccagtgacca

SEQ ID NO: 417475 - DNA, 16 bp, M. musculus
ggccatcctagaactc

SEQ ID NO: 417476 - DNA, 16 bp, M. musculus
ggccatcctcagctac

SEQ ID NO: 417477 - DNA, 16 bp, M. musculus
ggccatcctcctgcct

SEQ ID NO: 417478 - DNA, 16 bp, M. musculus
ggccatcctgggctat

SEQ ID NO: 417479 - DNA, 16 bp, M. musculus
ggccatcctgtgctac

SEQ ID NO: 417480 - DNA, 16 bp, M. musculus
ggccatctctccagcc

SEQ ID NO: 417481 - DNA, 16 bp, M. musculus
ggccatcttctgctgc

SEQ ID NO: 417482 - DNA, 16 bp, M. musculus
ggccatcttttgatgc

SEQ ID NO: 417483 - DNA, 16 bp, M. musculus
ggccatgacccctttg

SEQ ID NO: 417484 - DNA, 16 bp, M. musculus
ggccatgccttctgct

SEQ ID NO: 417485 - DNA, 16 bp, M. musculus
ggccatggaggagggc

SEQ ID NO: 417486 - DNA, 16 bp, M. musculus
ggccatggctgggagc

SEQ ID NO: 417487 - DNA, 16 bp, M. musculus
ggccatgtagagactg

SEQ ID NO: 417488 - DNA, 16 bp, M. musculus
ggccatgttttcatga

SEQ ID NO: 417489 - DNA, 16 bp, M. musculus
ggccattctcattcaa

SEQ ID NO: 417490 - DNA, 16 bp, M. musculus
ggccattctggaactc

SEQ ID NO: 417491 - DNA, 65 bp, M. musculus
ggccattggggcagcacgacccataccatggaaaacaggggacccagtgtgggttcctcaatggc

SEQ ID NO: 417492 - DNA, 16 bp, M. musculus
ggccattgtccatgcc

SEQ ID NO: 417493 - DNA, 16 bp, M. musculus
ggccatttagagactg

SEQ ID NO: 417494 - DNA, 16 bp, M. musculus
ggccattttctacaat

SEQ ID NO: 417495 - DNA, 17 bp, M. musculus
ggcccaaaacagaacct

SEQ ID NO: 417496 - DNA, 16 bp, M. musculus
ggcccaaacccagggc

SEQ ID NO: 417497 - DNA, 16 bp, M. musculus
ggcccaacccactgtg

SEQ ID NO: 417498 - DNA, 16 bp, M. musculus
ggcccaagttcagttc

SEQ ID NO: 417499 - DNA, 16 bp, M. musculus
ggcccaccccagcatc

SEQ ID NO: 417500 - DNA, 16 bp, M. musculus
ggcccactgtgggcag

SEQ ID NO: 417501 - DNA, 16 bp, M. musculus
ggcccagagaatggca

SEQ ID NO: 417502 - DNA, 16 bp, M. musculus
ggcccagagaccccag

SEQ ID NO: 417503 - DNA, 16 bp, M. musculus
ggcccagagggctcag

SEQ ID NO: 417504 - DNA, 16 bp, M. musculus
ggcccagcccactgag

SEQ ID NO: 417505 - DNA, 16 bp, M. musculus
ggcccagcccattgtg

SEQ ID NO: 417506 - DNA, 16 bp, M. musculus
ggcccaggacagccag

SEQ ID NO: 417507 - DNA, 16 bp, M. musculus
ggcccaggagtggtat

SEQ ID NO: 417508 - DNA, 16 bp, M. musculus
ggcccaggcttgggaa

SEQ ID NO: 417509 - DNA, 16 bp, M. musculus
ggcccagggactggca

SEQ ID NO: 417510 - DNA, 17 bp, M. musculus
ggcccagttcccttctg

SEQ ID NO: 417511 - DNA, 18 bp, M. musculus
ggcccagttgtcatcacg

SEQ ID NO: 417512 - DNA, 16 bp, M. musculus
ggcccatgggaagtgg

SEQ ID NO: 417513 - DNA, 16 bp, M. musculus
ggccccaaaaacctgg

SEQ ID NO: 417514 - DNA, 16 bp, M. musculus
ggccccacacaaagct

SEQ ID NO: 417515 - DNA, 16 bp, M. musculus
ggccccagcatagcct

SEQ ID NO: 417516 - DNA, 16 bp, M. musculus
ggccccagcccattgt

SEQ ID NO: 417517 - DNA, 16 bp, M. musculus
ggccccagggagtggg

SEQ ID NO: 417518 - DNA, 16 bp, M. musculus
ggccccagtacatttg

SEQ ID NO: 417519 - DNA, 16 bp, M. musculus
ggcccccaaggcctgg

SEQ ID NO: 417520 - DNA, 16 bp, M. musculus
ggcccccagggcttca

SEQ ID NO: 417521 - DNA, 16 bp, M. musculus
ggccccccatggagga

SEQ ID NO: 417522 - DNA, 16 bp, M. musculus
ggccccgcccacagtg

SEQ ID NO: 417523 - DNA, 16 bp, M. musculus
ggcccctccttgctct

SEQ ID NO: 417524 - DNA, 16 bp, M. musculus
ggcccctgcatagcct

SEQ ID NO: 417525 - DNA, 16 bp, M. musculus
ggcccctggtgggtgg

SEQ ID NO: 417526 - DNA, 16 bp, M. musculus
ggccccttgtgggtgg

SEQ ID NO: 417527 - DNA, 16 bp, M. musculus
ggcccctttgtcttgc

SEQ ID NO: 417528 - DNA, 16 bp, M. musculus
ggccctcaatccttcc

SEQ ID NO: 417529 - DNA, 16 bp, M. musculus
ggccctcatgcttgtg

SEQ ID NO: 417530 - DNA, 16 bp, M. musculus
ggccctcctccatcaa

SEQ ID NO: 417531 - DNA, 16 bp, M. musculus
ggccctcctgccatgt

SEQ ID NO: 417532 - DNA, 16 bp, M. musculus
ggccctctggacttct

SEQ ID NO: 417533 - DNA, 16 bp, M. musculus
ggccctctgggcctct

SEQ ID NO: 417534 - DNA, 16 bp, M. musculus
ggccctgaaggagata

SEQ ID NO: 417535 - DNA, 16 bp, M. musculus
ggccctgcagcagcag

SEQ ID NO: 417536 - DNA, 16 bp, M. musculus
ggccctgcatcacttc

SEQ ID NO: 417537 - DNA, 16 bp, M. musculus
ggccctgcccactgtg

SEQ ID NO: 417538 - DNA, 16 bp, M. musculus
ggccctgccccttgct

SEQ ID NO: 417539 - DNA, 16 bp, M. musculus
ggccctgcctctgccc

SEQ ID NO: 417540 - DNA, 16 bp, M. musculus
ggccctgctcactcag

SEQ ID NO: 417541 - DNA, 16 bp, M. musculus
ggccctggagtttccc

SEQ ID NO: 417542 - DNA, 16 bp, M. musculus
ggccctggcagagcct

SEQ ID NO: 417543 - DNA, 16 bp, M. musculus
ggccctggcattccca

SEQ ID NO: 417544 - DNA, 16 bp, M. musculus
ggccctggcattgccc

SEQ ID NO: 417545 - DNA, 16 bp, M. musculus
ggccctggctatcctg

SEQ ID NO: 417546 - DNA, 16 bp, M. musculus
ggccctggctgccctg

SEQ ID NO: 417547 - DNA, 16 bp, M. musculus
ggccctggcttccatc

SEQ ID NO: 417548 - DNA, 16 bp, M. musculus
ggccctgggacttggg

SEQ ID NO: 417549 - DNA, 16 bp, M. musculus
ggccctggggaagagg

SEQ ID NO: 417550 - DNA, 16 bp, M. musculus
ggccctgggttcaaac

SEQ ID NO: 417551 - DNA, 16 bp, M. musculus
ggccctgggttccatc

SEQ ID NO: 417552 - DNA, 16 bp, M. musculus
ggccctgggtttcatc

SEQ ID NO: 417553 - DNA, 16 bp, M. musculus
ggccctgggtttgatc

SEQ ID NO: 417554 - DNA, 16 bp, M. musculus
ggccctggtggggaca

SEQ ID NO: 417555 - DNA, 16 bp, M. musculus
ggccctggtgttcctc

SEQ ID NO: 417556 - DNA, 16 bp, M. musculus
ggccctgtgcacactg

SEQ ID NO: 417557 - DNA, 16 bp, M. musculus
ggccctgtgcatgctg

SEQ ID NO: 417558 - DNA, 16 bp, M. musculus
ggccctgtgtgccatc

SEQ ID NO: 417559 - DNA, 16 bp, M. musculus
ggccctgttggaatag

SEQ ID NO: 417560 - DNA, 16 bp, M. musculus
ggccctgttttccatc

SEQ ID NO: 417561 - DNA, 16 bp, M. musculus
ggcccttctcaaagat

SEQ ID NO: 417562 - DNA, 16 bp, M. musculus
ggcccttcttagaagg

SEQ ID NO: 417563 - DNA, 16 bp, M. musculus
ggcccttggacctgtg

SEQ ID NO: 417564 - DNA, 16 bp, M. musculus
ggcccttggtcttgca

SEQ ID NO: 417565 - DNA, 17 bp, M. musculus
ggccctttcagcaaaat

SEQ ID NO: 417566 - DNA, 16 bp, M. musculus
ggccgaagcaacacag

SEQ ID NO: 417567 - DNA, 16 bp, M. musculus
ggccgagcaagccagg

SEQ ID NO: 417568 - DNA, 16 bp, M. musculus
ggccgagttgtcgtca

SEQ ID NO: 417569 - DNA, 16 bp, M. musculus
ggccgcagacagccag

SEQ ID NO: 417570 - DNA, 16 bp, M. musculus
ggccgggaaacagcgc

SEQ ID NO: 417571 - DNA, 16 bp, M. musculus
ggccgggcggacccct

SEQ ID NO: 417572 - DNA, 16 bp, M. musculus
ggcctaagggaaaggt

SEQ ID NO: 417573 - DNA, 16 bp, M. musculus
ggcctacatgaaccag

SEQ ID NO: 417574 - DNA, 16 bp, M. musculus
ggcctaggggaaaggt

SEQ ID NO: 417575 - DNA, 16 bp, M. musculus
ggcctaggtccagcct

SEQ ID NO: 417576 - DNA, 16 bp, M. musculus
ggcctaggttcagccc

SEQ ID NO: 417577 - DNA, 17 bp, M. musculus
ggcctataaaaactggg

SEQ ID NO: 417578 - DNA, 16 bp, M. musculus
ggcctcaaactcactc

SEQ ID NO: 417579 - DNA, 16 bp, M. musculus
ggcctcacactgcaga

SEQ ID NO: 417580 - DNA, 16 bp, M. musculus
ggcctcacctactcca

SEQ ID NO: 417581 - DNA, 16 bp, M. musculus
ggcctcactctgtagc

SEQ ID NO: 417582 - DNA, 16 bp, M. musculus
ggcctcagatcagctg

SEQ ID NO: 417583 - DNA, 16 bp, M. musculus
ggcctcagcaggagag

SEQ ID NO: 417584 - DNA, 16 bp, M. musculus
ggcctcagcctcagca

SEQ ID NO: 417585 - DNA, 16 bp, M. musculus
ggcctcagcctcagga

SEQ ID NO: 417586 - DNA, 16 bp, M. musculus
ggcctcagtgggagaa

SEQ ID NO: 417587 - DNA, 16 bp, M. musculus
ggcctcagtttcccca

SEQ ID NO: 417588 - DNA, 16 bp, M. musculus
ggcctcagtttccccc

SEQ ID NO: 417589 - DNA, 16 bp, M. musculus
ggcctcagtttcctca

SEQ ID NO: 417590 - DNA, 16 bp, M. musculus
ggcctcagtttcctta

SEQ ID NO: 417591 - DNA, 16 bp, M. musculus
ggcctcatgcatgctg

SEQ ID NO: 417592 - DNA, 16 bp, M. musculus
ggcctccacatgcatg

SEQ ID NO: 417593 - DNA, 16 bp, M. musculus
ggcctccacgtgcaca

SEQ ID NO: 417594 - DNA, 16 bp, M. musculus
ggcctccagctcagaa

SEQ ID NO: 417595 - DNA, 16 bp, M. musculus
ggcctccaggggcacc

SEQ ID NO: 417596 - DNA, 16 bp, M. musculus
ggcctccatgggcaac

SEQ ID NO: 417597 - DNA, 16 bp, M. musculus
ggcctcccctcctgtt

SEQ ID NO: 417598 - DNA, 16 bp, M. musculus
ggcctccccttttctt

SEQ ID NO: 417599 - DNA, 16 bp, M. musculus
ggcctccctgggcact

SEQ ID NO: 417600 - DNA, 16 bp, M. musculus
ggcctcccttcccatt

SEQ ID NO: 417601 - DNA, 16 bp, M. musculus
ggcctcctcactccct

SEQ ID NO: 417602 - DNA, 16 bp, M. musculus
ggcctcctgctgcact

SEQ ID NO: 417603 - DNA, 16 bp, M. musculus
ggcctcctggctgctg

SEQ ID NO: 417604 - DNA, 16 bp, M. musculus
ggcctccttttgttgt

SEQ ID NO: 417605 - DNA, 16 bp, M. musculus
ggcctctatcagatgt

SEQ ID NO: 417606 - DNA, 26 bp, M. musculus
ggcctctcactcttatatactctcag

SEQ ID NO: 417607 - DNA, 16 bp, M. musculus
ggcctctcctccaact

SEQ ID NO: 417608 - DNA, 16 bp, M. musculus
ggcctctctcagcctc

SEQ ID NO: 417609 - DNA, 16 bp, M. musculus
ggcctctctcctctga

SEQ ID NO: 417610 - DNA, 16 bp, M. musculus
ggcctctcttcccatt

SEQ ID NO: 417611 - DNA, 16 bp, M. musculus
ggcctctcttcctagt

SEQ ID NO: 417612 - DNA, 16 bp, M. musculus
ggcctctctttcctgt

SEQ ID NO: 417613 - DNA, 17 bp, M. musculus
ggcctctcttttcagtg

SEQ ID NO: 417614 - DNA, 16 bp, M. musculus
ggcctctgcaccagct

SEQ ID NO: 417615 - DNA, 16 bp, M. musculus
ggcctctgcagacacc

SEQ ID NO: 417616 - DNA, 16 bp, M. musculus
ggcctctgcagcagct

SEQ ID NO: 417617 - DNA, 16 bp, M. musculus
ggcctctgcaggaact

SEQ ID NO: 417618 - DNA, 16 bp, M. musculus
ggcctctgcatcatct

SEQ ID NO: 417619 - DNA, 16 bp, M. musculus
ggcctctgcatccact

SEQ ID NO: 417620 - DNA, 16 bp, M. musculus
ggcctctgcatctgct

SEQ ID NO: 417621 - DNA, 16 bp, M. musculus
ggcctctgcttcagtc

SEQ ID NO: 417622 - DNA, 16 bp, M. musculus
ggcctctggcctctgc

SEQ ID NO: 417623 - DNA, 16 bp, M. musculus
ggcctctgtaggcacc

SEQ ID NO: 417624 - DNA, 16 bp, M. musculus
ggcctctgtgagttca

SEQ ID NO: 417625 - DNA, 16 bp, M. musculus
ggcctctgtgggaaag

SEQ ID NO: 417626 - DNA, 16 bp, M. musculus
ggcctctgtgggaact

SEQ ID NO: 417627 - DNA, 16 bp, M. musculus
ggcctctgtgggtact

SEQ ID NO: 417628 - DNA, 16 bp, M. musculus
ggcctgactgtctctg

SEQ ID NO: 417629 - DNA, 16 bp, M. musculus
ggcctgagagttcgag

SEQ ID NO: 417630 - DNA, 16 bp, M. musculus
ggcctgagtaccagag

SEQ ID NO: 417631 - DNA, 16 bp, M. musculus
ggcctgcaccaccacg

SEQ ID NO: 417632 - DNA, 16 bp, M. musculus
ggcctgctcagcctgc

SEQ ID NO: 417633 - DNA, 16 bp, M. musculus
ggcctgctcttctctg

SEQ ID NO: 417634 - DNA, 16 bp, M. musculus
ggcctgctgtgcatgg

SEQ ID NO: 417635 - DNA, 17 bp, M. musculus
ggcctgctgtgcgtgga

SEQ ID NO: 417636 - DNA, 16 bp, M. musculus
ggcctgctgtgtgtgg

SEQ ID NO: 417637 - DNA, 16 bp, M. musculus
ggcctggaacacatgc

SEQ ID NO: 417638 - DNA, 16 bp, M. musculus
ggcctggaactcaaaa

SEQ ID NO: 417639 - DNA, 16 bp, M. musculus
ggcctggaactcaaga

SEQ ID NO: 417640 - DNA, 16 bp, M. musculus
ggcctggaactcacaa

SEQ ID NO: 417641 - DNA, 16 bp, M. musculus
ggcctggaactcacca

SEQ ID NO: 417642 - DNA, 16 bp, M. musculus
ggcctggaactcatgg

SEQ ID NO: 417643 - DNA, 16 bp, M. musculus
ggcctggaactcattc

SEQ ID NO: 417644 - DNA, 16 bp, M. musculus
ggcctggaactctgta

SEQ ID NO: 417645 - DNA, 16 bp, M. musculus
ggcctggaacttactg

SEQ ID NO: 417646 - DNA, 17 bp, M. musculus
ggcctggaaggtgctct

SEQ ID NO: 417647 - DNA, 16 bp, M. musculus
ggcctggagaaaccgc

SEQ ID NO: 417648 - DNA, 16 bp, M. musculus
ggcctggagaagccac

SEQ ID NO: 417649 - DNA, 16 bp, M. musculus
ggcctggagggcatca

SEQ ID NO: 417650 - DNA, 16 bp, M. musculus
ggcctggagttcacca

SEQ ID NO: 417651 - DNA, 16 bp, M. musculus
ggcctggctacctccc

SEQ ID NO: 417652 - DNA, 17 bp, M. musculus
ggcctggctggagaagt

SEQ ID NO: 417653 - DNA, 16 bp, M. musculus
ggcctggctggcctgg

SEQ ID NO: 417654 - DNA, 16 bp, M. musculus
ggcctggctgtcctag

SEQ ID NO: 417655 - DNA, 16 bp, M. musculus
ggcctggctgttcctg

SEQ ID NO: 417656 - DNA, 16 bp, M. musculus
ggcctgggctacatag

SEQ ID NO: 417657 - DNA, 16 bp, M. musculus
ggcctgggggccaaga

SEQ ID NO: 417658 - DNA, 16 bp, M. musculus
ggcctgggtttgattc

SEQ ID NO: 417659 - DNA, 16 bp, M. musculus
ggcctggtctacaaag

SEQ ID NO: 417660 - DNA, 16 bp, M. musculus
ggcctggtgagatggc

SEQ ID NO: 417661 - DNA, 16 bp, M. musculus
ggcctggtggcacatg

SEQ ID NO: 417662 - DNA, 16 bp, M. musculus
ggcctggtggtcctgg

SEQ ID NO: 417663 - DNA, 16 bp, M. musculus
ggcctgtgagctcctg

SEQ ID NO: 417664 - DNA, 16 bp, M. musculus
ggcctgtgatctcatt

SEQ ID NO: 417665 - DNA, 16 bp, M. musculus
ggcctgtggccctggc

SEQ ID NO: 417666 - DNA, 16 bp, M. musculus
ggcctgtgggcatgtg

SEQ ID NO: 417667 - DNA, 16 bp, M. musculus
ggcctgtgtggttctg

SEQ ID NO: 417668 - DNA, 16 bp, M. musculus
ggcctgttttatgact

SEQ ID NO: 417669 - DNA, 16 bp, M. musculus
ggcctgttttgtcacc

SEQ ID NO: 417670 - DNA, 16 bp, M. musculus
ggccttactatgtagc

SEQ ID NO: 417671 - DNA, 16 bp, M. musculus
ggccttcaattcttcc

SEQ ID NO: 417672 - DNA, 16 bp, M. musculus
ggccttcatcatctgc

SEQ ID NO: 417673 - DNA, 16 bp, M. musculus
ggccttccagagactg

SEQ ID NO: 417674 - DNA, 16 bp, M. musculus
ggccttccgagccagg

SEQ ID NO: 417675 - DNA, 16 bp, M. musculus
ggccttccgtggcctc

SEQ ID NO: 417676 - DNA, 16 bp, M. musculus
ggccttcctgcctcag

SEQ ID NO: 417677 - DNA, 16 bp, M. musculus
ggccttcctgtggagt

SEQ ID NO: 417678 - DNA, 16 bp, M. musculus
ggccttctgacaggag

SEQ ID NO: 417679 - DNA, 16 bp, M. musculus
ggccttcttataggga

SEQ ID NO: 417680 - DNA, 16 bp, M. musculus
ggccttctttcttgtt

SEQ ID NO: 417681 - DNA, 16 bp, M. musculus
ggccttgaactaagag

SEQ ID NO: 417682 - DNA, 16 bp, M. musculus
ggccttgaactcatga

SEQ ID NO: 417683 - DNA, 16 bp, M. musculus
ggccttgaactcctga

SEQ ID NO: 417684 - DNA, 16 bp, M. musculus
ggccttgcatttggag

SEQ ID NO: 417685 - DNA, 16 bp, M. musculus
ggccttgctgaatctg

SEQ ID NO: 417686 - DNA, 16 bp, M. musculus
ggccttgctggaggag

SEQ ID NO: 417687 - DNA, 16 bp, M. musculus
ggccttgctgtgtgtg

SEQ ID NO: 417688 - DNA, 16 bp, M. musculus
ggccttggagcctccc

SEQ ID NO: 417689 - DNA, 16 bp, M. musculus
ggccttggcctcagga

SEQ ID NO: 417690 - DNA, 16 bp, M. musculus
ggccttgggaccttcc

SEQ ID NO: 417691 - DNA, 16 bp, M. musculus
ggccttggtgccctcc

SEQ ID NO: 417692 - DNA, 16 bp, M. musculus
ggccttggtttctgtt

SEQ ID NO: 417693 - DNA, 16 bp, M. musculus
ggccttgtgcatgcta

SEQ ID NO: 417694 - DNA, 16 bp, M. musculus
ggccttgtgttaagga

SEQ ID NO: 417695 - DNA, 16 bp, M. musculus
ggccttgttagagaaa

SEQ ID NO: 417696 - DNA, 16 bp, M. musculus
ggccttgttagagtgg

SEQ ID NO: 417697 - DNA, 16 bp, M. musculus
ggccttgttggaaaag

SEQ ID NO: 417698 - DNA, 16 bp, M. musculus
ggccttgttggaagaa

SEQ ID NO: 417699 - DNA, 16 bp, M. musculus
ggccttgttggaagga

SEQ ID NO: 417700 - DNA, 16 bp, M. musculus
ggcctttaacataatt

SEQ ID NO: 417701 - DNA, 16 bp, M. musculus
ggcctttaatcccagc

SEQ ID NO: 417702 - DNA, 16 bp, M. musculus
ggcctttcctccttga

SEQ ID NO: 417703 - DNA, 17 bp, M. musculus
ggcctttctctacataa

SEQ ID NO: 417704 - DNA, 16 bp, M. musculus
ggcctttgggatagca

SEQ ID NO: 417705 - DNA, 16 bp, M. musculus
ggcctttgtcagtgcc

SEQ ID NO: 417706 - DNA, 16 bp, M. musculus
ggccttttccaccttt

SEQ ID NO: 417707 - DNA, 16 bp, M. musculus
ggcgaactctgcaaaa

SEQ ID NO: 417708 - DNA, 16 bp, M. musculus
ggcgaggatgtagaga

SEQ ID NO: 417709 - DNA, 16 bp, M. musculus
ggcgattccaatcttc

SEQ ID NO: 417710 - DNA, 24 bp, M. musculus
ggcgcaaggaagatccctcattcc

SEQ ID NO: 417711 - DNA, 16 bp, M. musculus
ggcgcaggcctttaat

SEQ ID NO: 417712 - DNA, 17 bp, M. musculus
ggcgccgcctcagaggc

SEQ ID NO: 417713 - DNA, 16 bp, M. musculus
ggcgcctgggactgca

SEQ ID NO: 417714 - DNA, 16 bp, M. musculus
ggcgctggaggagctg

SEQ ID NO: 417715 - DNA, 16 bp, M. musculus
ggcggaggcacagagc

SEQ ID NO: 417716 - DNA, 16 bp, M. musculus
ggcggcggcagcagca

SEQ ID NO: 417717 - DNA, 32 bp, M. musculus
ggcgggatagggaactcgtatggatgttcggg

SEQ ID NO: 417718 - DNA, 16 bp, M. musculus
ggcggtgatggtgcac

SEQ ID NO: 417719 - DNA, 16 bp, M. musculus
ggcggtggcgcacgcc

SEQ ID NO: 417720 - DNA, 16 bp, M. musculus
ggcggtggtggcacac

SEQ ID NO: 417721 - DNA, 16 bp, M. musculus
ggcggtggtggcgcac

SEQ ID NO: 417722 - DNA, 16 bp, M. musculus
ggcggtggtggtacac

SEQ ID NO: 417723 - DNA, 16 bp, M. musculus
ggcgtacaccaccacc

SEQ ID NO: 417724 - DNA, 16 bp, M. musculus
ggcgtgcaccatcatg

SEQ ID NO: 417725 - DNA, 17 bp, M. musculus
ggcgtggtggcacatgc

SEQ ID NO: 417726 - DNA, 17 bp, M. musculus
ggcgtggtggcgcacac

SEQ ID NO: 417727 - DNA, 17 bp, M. musculus
ggcgtggtggcgcatgc

SEQ ID NO: 417728 - DNA, 16 bp, M. musculus
ggcgtggtggtgcaca

SEQ ID NO: 417729 - DNA, 16 bp, M. musculus
ggcgtggtggtgcacc

SEQ ID NO: 417730 - DNA, 17 bp, M. musculus
ggcgtggtggtgcatgc

SEQ ID NO: 417731 - DNA, 17 bp, M. musculus
ggcgttcccctatactg

SEQ ID NO: 417732 - DNA, 68 bp, M. musculus
ggcgttttttctattagtaaaggagataggatagctcagctgctgctcctccctgataataccaggga

SEQ ID NO: 417733 - DNA, 16 bp, M. musculus
ggctaaggatgttaaa

SEQ ID NO: 417734 - DNA, 16 bp, M. musculus
ggctaaggcaggagga

SEQ ID NO: 417735 - DNA, 16 bp, M. musculus
ggctaagttcaaaacc

SEQ ID NO: 417736 - DNA, 17 bp, M. musculus
ggctaatatccacttat

SEQ ID NO: 417737 - DNA, 16 bp, M. musculus
ggctacacacagaaat

SEQ ID NO: 417738 - DNA, 16 bp, M. musculus
ggctacacactgagac

SEQ ID NO: 417739 - DNA, 16 bp, M. musculus
ggctacacagaaatcc

SEQ ID NO: 417740 - DNA, 16 bp, M. musculus
ggctacacagacaaac

SEQ ID NO: 417741 - DNA, 18 bp, M. musculus
ggctacacagagaaacca

SEQ ID NO: 417742 - DNA, 17 bp, M. musculus
ggctacacagagaaact

SEQ ID NO: 417743 - DNA, 18 bp, M. musculus
ggctacacagagaaatct

SEQ ID NO: 417744 - DNA, 16 bp, M. musculus
ggctacacagcaagat

SEQ ID NO: 417745 - DNA, 16 bp, M. musculus
ggctacacaggaagac

SEQ ID NO: 417746 - DNA, 16 bp, M. musculus
ggctacacagtaaaat

SEQ ID NO: 417747 - DNA, 16 bp, M. musculus
ggctacagagaaatcc

SEQ ID NO: 417748 - DNA, 16 bp, M. musculus
ggctacagagagaccc

SEQ ID NO: 417749 - DNA, 16 bp, M. musculus
ggctacagagtgagat

SEQ ID NO: 417750 - DNA, 17 bp, M. musculus
ggctacagcaacagggt

SEQ ID NO: 417751 - DNA, 16 bp, M. musculus
ggctacagcatcagca

SEQ ID NO: 417752 - DNA, 16 bp, M. musculus
ggctacaggagaccct

SEQ ID NO: 417753 - DNA, 16 bp, M. musculus
ggctacataatgagat

SEQ ID NO: 417754 - DNA, 16 bp, M. musculus
ggctacatagagagac

SEQ ID NO: 417755 - DNA, 17 bp, M. musculus
ggctacatagtgaaacc

SEQ ID NO: 417756 - DNA, 16 bp, M. musculus
ggctacatagtgaatt

SEQ ID NO: 417757 - DNA, 16 bp, M. musculus
ggctacatgaaactct

SEQ ID NO: 417758 - DNA, 16 bp, M. musculus
ggctacatgagagcct

SEQ ID NO: 417759 - DNA, 16 bp, M. musculus
ggctaccctggaactt

SEQ ID NO: 417760 - DNA, 16 bp, M. musculus
ggctactcagagaaac

SEQ ID NO: 417761 - DNA, 16 bp, M. musculus
ggctactgctgctgct

SEQ ID NO: 417762 - DNA, 16 bp, M. musculus
ggctactggttggttc

SEQ ID NO: 417763 - DNA, 16 bp, M. musculus
ggctacttcctgctga

SEQ ID NO: 417764 - DNA, 25 bp, M. musculus
ggctactttttacccttgtctgaaa

SEQ ID NO: 417765 - DNA, 16 bp, M. musculus
ggctagaagatccatt

SEQ ID NO: 417766 - DNA, 16 bp, M. musculus
ggctagagagaaggct

SEQ ID NO: 417767 - DNA, 16 bp, M. musculus
ggctagagagacagct

SEQ ID NO: 417768 - DNA, 16 bp, M. musculus
ggctagagagattgct

SEQ ID NO: 417769 - DNA, 16 bp, M. musculus
ggctagagatgtggct

SEQ ID NO: 417770 - DNA, 16 bp, M. musculus
ggctagcctgaaactc

SEQ ID NO: 417771 - DNA, 16 bp, M. musculus
ggctagcctgagctgc

SEQ ID NO: 417772 - DNA, 16 bp, M. musculus
ggctagcctgggctgc

SEQ ID NO: 417773 - DNA, 16 bp, M. musculus
ggctagccttcaactt

SEQ ID NO: 417774 - DNA, 16 bp, M. musculus
ggctagccttgaagtc

SEQ ID NO: 417775 - DNA, 16 bp, M. musculus
ggctagccttggctat

SEQ ID NO: 417776 - DNA, 16 bp, M. musculus
ggctagctggagagag

SEQ ID NO: 417777 - DNA, 16 bp, M. musculus
ggctaggctgcctggc

SEQ ID NO: 417778 - DNA, 16 bp, M. musculus
ggctaggctggctagc

SEQ ID NO: 417779 - DNA, 16 bp, M. musculus
ggctaggctggctggc

SEQ ID NO: 417780 - DNA, 16 bp, M. musculus
ggctaggctggctgtc

SEQ ID NO: 417781 - DNA, 16 bp, M. musculus
ggctagggagatggct

SEQ ID NO: 417782 - DNA, 16 bp, M. musculus
ggctaggggtgtagct

SEQ ID NO: 417783 - DNA, 16 bp, M. musculus
ggctagtctgggctat

SEQ ID NO: 417784 - DNA, 16 bp, M. musculus
ggctagtgacaggggc

SEQ ID NO: 417785 - DNA, 16 bp, M. musculus
ggctagtgagatgact

SEQ ID NO: 417786 - DNA, 16 bp, M. musculus
ggctagtggaagactg

SEQ ID NO: 417787 - DNA, 16 bp, M. musculus
ggctataaagaaggaa

SEQ ID NO: 417788 - DNA, 16 bp, M. musculus
ggctataaagagaaac

SEQ ID NO: 417789 - DNA, 16 bp, M. musculus
ggctatacaaagaaac

SEQ ID NO: 417790 - DNA, 16 bp, M. musculus
ggctatacaatgagac

SEQ ID NO: 417791 - DNA, 16 bp, M. musculus
ggctatacagagaaat

SEQ ID NO: 417792 - DNA, 16 bp, M. musculus
ggctatagagtgagtt

SEQ ID NO: 417793 - DNA, 16 bp, M. musculus
ggctatatagtaagac

SEQ ID NO: 417794 - DNA, 16 bp, M. musculus
ggctatcattgggaag

SEQ ID NO: 417795 - DNA, 16 bp, M. musculus
ggctatccagggctac

SEQ ID NO: 417796 - DNA, 16 bp, M. musculus
ggctatcctaaaagct

SEQ ID NO: 417797 - DNA, 16 bp, M. musculus
ggctatcctgcagaaa

SEQ ID NO: 417798 - DNA, 16 bp, M. musculus
ggctatcctggaattc

SEQ ID NO: 417799 - DNA, 16 bp, M. musculus
ggctatctagtctcag

SEQ ID NO: 417800 - DNA, 17 bp, M. musculus
ggctatcttgtctgagt

SEQ ID NO: 417801 - DNA, 16 bp, M. musculus
ggctatgagtttttct

SEQ ID NO: 417802 - DNA, 16 bp, M. musculus
ggctatgctggaactc

SEQ ID NO: 417803 - DNA, 16 bp, M. musculus
ggctatgggtctctgc

SEQ ID NO: 417804 - DNA, 27 bp, M. musculus
ggctattagggcctggaaggcgctctc

SEQ ID NO: 417805 - DNA, 16 bp, M. musculus
ggctattataaacaaa

SEQ ID NO: 417806 - DNA, 16 bp, M. musculus
ggctattctggaactc

SEQ ID NO: 417807 - DNA, 16 bp, M. musculus
ggctattcttgggcct

SEQ ID NO: 417808 - DNA, 16 bp, M. musculus
ggctattgaagaacag

SEQ ID NO: 417809 - DNA, 16 bp, M. musculus
ggctattgccaaggct

SEQ ID NO: 417810 - DNA, 16 bp, M. musculus
ggctatttttttaaaa

SEQ ID NO: 417811 - DNA, 16 bp, M. musculus
ggctcaaactcagaaa

SEQ ID NO: 417812 - DNA, 16 bp, M. musculus
ggctcaagctctaaga

SEQ ID NO: 417813 - DNA, 16 bp, M. musculus
ggctcaaggtccgtgg

SEQ ID NO: 417814 - DNA, 16 bp, M. musculus
ggctcaatccccagta

SEQ ID NO: 417815 - DNA, 16 bp, M. musculus
ggctcacaactgccta

SEQ ID NO: 417816 - DNA, 16 bp, M. musculus
ggctcacaactgtctg

SEQ ID NO: 417817 - DNA, 16 bp, M. musculus
ggctcacagccacctg

SEQ ID NO: 417818 - DNA, 16 bp, M. musculus
ggctcacagttaagag

SEQ ID NO: 417819 - DNA, 16 bp, M. musculus
ggctcacagttccagg

SEQ ID NO: 417820 - DNA, 16 bp, M. musculus
ggctcacagtttgagg

SEQ ID NO: 417821 - DNA, 16 bp, M. musculus
ggctcacagttttaga

SEQ ID NO: 417822 - DNA, 16 bp, M. musculus
ggctcacatgtttgaa

SEQ ID NO: 417823 - DNA, 16 bp, M. musculus
ggctcaccaaccagcc

SEQ ID NO: 417824 - DNA, 16 bp, M. musculus
ggctcaccacagcatg

SEQ ID NO: 417825 - DNA, 16 bp, M. musculus
ggctcaccagtgatcc

SEQ ID NO: 417826 - DNA, 16 bp, M. musculus
ggctcactgtttcaga

SEQ ID NO: 417827 - DNA, 16 bp, M. musculus
ggctcagaactgaaaa

SEQ ID NO: 417828 - DNA, 16 bp, M. musculus
ggctcagaactgaata

SEQ ID NO: 417829 - DNA, 16 bp, M. musculus
ggctcagaaggaagat

SEQ ID NO: 417830 - DNA, 16 bp, M. musculus
ggctcagagaagttaa

SEQ ID NO: 417831 - DNA, 16 bp, M. musculus
ggctcagagatcattg

SEQ ID NO: 417832 - DNA, 16 bp, M. musculus
ggctcagcaggaaaag

SEQ ID NO: 417833 - DNA, 16 bp, M. musculus
ggctcagccagtgcct

SEQ ID NO: 417834 - DNA, 16 bp, M. musculus
ggctcagctgcttctg

SEQ ID NO: 417835 - DNA, 16 bp, M. musculus
ggctcagctgggaaag

SEQ ID NO: 417836 - DNA, 16 bp, M. musculus
ggctcagctggtgaag

SEQ ID NO: 417837 - DNA, 16 bp, M. musculus
ggctcaggaaacactg

SEQ ID NO: 417838 - DNA, 16 bp, M. musculus
ggctcaggaggtaaaa

SEQ ID NO: 417839 - DNA, 16 bp, M. musculus
ggctcagggagcagag

SEQ ID NO: 417840 - DNA, 16 bp, M. musculus
ggctcagtcagagaag

SEQ ID NO: 417841 - DNA, 16 bp, M. musculus
ggctcagtgagtaaaa

SEQ ID NO: 417842 - DNA, 16 bp, M. musculus
ggctcagtgatgaaga

SEQ ID NO: 417843 - DNA, 16 bp, M. musculus
ggctcagtgattaaga

SEQ ID NO: 417844 - DNA, 16 bp, M. musculus
ggctcagtgggaaaag

SEQ ID NO: 417845 - DNA, 16 bp, M. musculus
ggctcagtgggagagc

SEQ ID NO: 417846 - DNA, 16 bp, M. musculus
ggctcagtgggtagag

SEQ ID NO: 417847 - DNA, 16 bp, M. musculus
ggctcagtggtcagag

SEQ ID NO: 417848 - DNA, 19 bp, M. musculus
ggctcagtggttaagagcc

SEQ ID NO: 417849 - DNA, 16 bp, M. musculus
ggctcatatgtttgaa

SEQ ID NO: 417850 - DNA, 16 bp, M. musculus
ggctcatgcctataat

SEQ ID NO: 417851 - DNA, 16 bp, M. musculus
ggctcatgcttgtaat

SEQ ID NO: 417852 - DNA, 16 bp, M. musculus
ggctcatggttccaga

SEQ ID NO: 417853 - DNA, 16 bp, M. musculus
ggctccacacagcagc

SEQ ID NO: 417854 - DNA, 16 bp, M. musculus
ggctccaccagtgcct

SEQ ID NO: 417855 - DNA, 16 bp, M. musculus
ggctccacccagtgtg

SEQ ID NO: 417856 - DNA, 16 bp, M. musculus
ggctccactcccaggc

SEQ ID NO: 417857 - DNA, 16 bp, M. musculus
ggctccagaacagcaa

SEQ ID NO: 417858 - DNA, 16 bp, M. musculus
ggctccagagatggct

SEQ ID NO: 417859 - DNA, 16 bp, M. musculus
ggctccagatgcctgt

SEQ ID NO: 417860 - DNA, 16 bp, M. musculus
ggctccagccagagac

SEQ ID NO: 417861 - DNA, 16 bp, M. musculus
ggctccaggtccatgg

SEQ ID NO: 417862 - DNA, 16 bp, M. musculus
ggctccaggttcctgc

SEQ ID NO: 417863 - DNA, 16 bp, M. musculus
ggctccatccagcagc

SEQ ID NO: 417864 - DNA, 16 bp, M. musculus
ggctcccagaacccaa

SEQ ID NO: 417865 - DNA, 16 bp, M. musculus
ggctcccagcaccagc

SEQ ID NO: 417866 - DNA, 16 bp, M. musculus
ggctcccagcacctac

SEQ ID NO: 417867 - DNA, 16 bp, M. musculus
ggctcccagcagcagc

SEQ ID NO: 417868 - DNA, 16 bp, M. musculus
ggctcccaggcagcta

SEQ ID NO: 417869 - DNA, 16 bp, M. musculus
ggctcccatcctccct

SEQ ID NO: 417870 - DNA, 17 bp, M. musculus
ggctccccgagcccatc

SEQ ID NO: 417871 - DNA, 16 bp, M. musculus
ggctcccctgggtatc

SEQ ID NO: 417872 - DNA, 16 bp, M. musculus
ggctcccgagtgctgg

SEQ ID NO: 417873 - DNA, 16 bp, M. musculus
ggctccctgtgccaag

SEQ ID NO: 417874 - DNA, 16 bp, M. musculus
ggctcccttctctgtg

SEQ ID NO: 417875 - DNA, 16 bp, M. musculus
ggctcctccagcacca

SEQ ID NO: 417876 - DNA, 16 bp, M. musculus
ggctcctcctgtctct

SEQ ID NO: 417877 - DNA, 16 bp, M. musculus
ggctcctctccattcc

SEQ ID NO: 417878 - DNA, 16 bp, M. musculus
ggctcctgctgctgct

SEQ ID NO: 417879 - DNA, 16 bp, M. musculus
ggctcctgtcagcaag

SEQ ID NO: 417880 - DNA, 17 bp, M. musculus
ggctcctgtcgaagtta

SEQ ID NO: 417881 - DNA, 16 bp, M. musculus
ggctcctgtctataag

SEQ ID NO: 417882 - DNA, 16 bp, M. musculus
ggctcctgtgtccttg

SEQ ID NO: 417883 - DNA, 16 bp, M. musculus
ggctccttcagcacca

SEQ ID NO: 417884 - DNA, 16 bp, M. musculus
ggctcgagtggagcag

SEQ ID NO: 417885 - DNA, 16 bp, M. musculus
ggctcgccagcaagaa

SEQ ID NO: 417886 - DNA, 16 bp, M. musculus
ggctcgtgtgtgtgtg

SEQ ID NO: 417887 - DNA, 16 bp, M. musculus
ggctctatgccccagt

SEQ ID NO: 417888 - DNA, 16 bp, M. musculus
ggctctcagccttcct

SEQ ID NO: 417889 - DNA, 16 bp, M. musculus
ggctctcccagcatcc

SEQ ID NO: 417890 - DNA, 16 bp, M. musculus
ggctctccctaaagct

SEQ ID NO: 417891 - DNA, 16 bp, M. musculus
ggctctccctcccagc

SEQ ID NO: 417892 - DNA, 16 bp, M. musculus
ggctctcctgaaactc

SEQ ID NO: 417893 - DNA, 16 bp, M. musculus
ggctctctgtggaggt

SEQ ID NO: 417894 - DNA, 16 bp, M. musculus
ggctctcttcccagtg

SEQ ID NO: 417895 - DNA, 16 bp, M. musculus
ggctctcttgccaaaa

SEQ ID NO: 417896 - DNA, 16 bp, M. musculus
ggctctgaggtttcag

SEQ ID NO: 417897 - DNA, 16 bp, M. musculus
ggctctgagtttattg

SEQ ID NO: 417898 - DNA, 16 bp, M. musculus
ggctctgatcccagga

SEQ ID NO: 417899 - DNA, 16 bp, M. musculus
ggctctgcacagacag

SEQ ID NO: 417900 - DNA, 16 bp, M. musculus
ggctctgccagcacct

SEQ ID NO: 417901 - DNA, 16 bp, M. musculus
ggctctgccagggcct

SEQ ID NO: 417902 - DNA, 16 bp, M. musculus
ggctctgccagtgcct

SEQ ID NO: 417903 - DNA, 16 bp, M. musculus
ggctctgccagtgtct

SEQ ID NO: 417904 - DNA, 16 bp, M. musculus
ggctctgccctctgca

SEQ ID NO: 417905 - DNA, 16 bp, M. musculus
ggctctgcctcacctc

SEQ ID NO: 417906 - DNA, 16 bp, M. musculus
ggctctgctccatcca

SEQ ID NO: 417907 - DNA, 16 bp, M. musculus
ggctctgctgtcctct

SEQ ID NO: 417908 - DNA, 16 bp, M. musculus
ggctctggcacagcct

SEQ ID NO: 417909 - DNA, 16 bp, M. musculus
ggctctggcaggcctt

SEQ ID NO: 417910 - DNA, 16 bp, M. musculus
ggctctggcattttta

SEQ ID NO: 417911 - DNA, 16 bp, M. musculus
ggctctggctctgcct

SEQ ID NO: 417912 - DNA, 16 bp, M. musculus
ggctctgggctctggg

SEQ ID NO: 417913 - DNA, 16 bp, M. musculus
ggctctgtgcatgcta

SEQ ID NO: 417914 - DNA, 16 bp, M. musculus
ggctctgtgcttccac

SEQ ID NO: 417915 - DNA, 16 bp, M. musculus
ggctctgtgcttccgc

SEQ ID NO: 417916 - DNA, 16 bp, M. musculus
ggctctgtggctcctg

SEQ ID NO: 417917 - DNA, 16 bp, M. musculus
ggctctgtggttaaga

SEQ ID NO: 417918 - DNA, 16 bp, M. musculus
ggctctgtgtgtgtgt

SEQ ID NO: 417919 - DNA, 16 bp, M. musculus
ggctcttacaatcttt

SEQ ID NO: 417920 - DNA, 24 bp, M. musculus
ggctcttagaaactgtcttgagag

SEQ ID NO: 417921 - DNA, 16 bp, M. musculus
ggctcttccagcacca

SEQ ID NO: 417922 - DNA, 16 bp, M. musculus
ggctcttgcttcttgc

SEQ ID NO: 417923 - DNA, 16 bp, M. musculus
ggctctttcctgcttt

SEQ ID NO: 417924 - DNA, 16 bp, M. musculus
ggctcttttatttggg

SEQ ID NO: 417925 - DNA, 16 bp, M. musculus
ggctgaaaattctgga

SEQ ID NO: 417926 - DNA, 16 bp, M. musculus
ggctgaaagaaactga

SEQ ID NO: 417927 - DNA, 16 bp, M. musculus
ggctgaaagaagttga

SEQ ID NO: 417928 - DNA, 16 bp, M. musculus
ggctgaagagatagct

SEQ ID NO: 417929 - DNA, 16 bp, M. musculus
ggctgaagagatggcc

SEQ ID NO: 417930 - DNA, 16 bp, M. musculus
ggctgaagatgaagcc

SEQ ID NO: 417931 - DNA, 16 bp, M. musculus
ggctgaagatgtggct

SEQ ID NO: 417932 - DNA, 16 bp, M. musculus
ggctgaagcaggagaa

SEQ ID NO: 417933 - DNA, 16 bp, M. musculus
ggctgaaggagctgaa

SEQ ID NO: 417934 - DNA, 16 bp, M. musculus
ggctgaaggaggagga

SEQ ID NO: 417935 - DNA, 16 bp, M. musculus
ggctgaatatttcctg

SEQ ID NO: 417936 - DNA, 16 bp, M. musculus
ggctgacacaggagga

SEQ ID NO: 417937 - DNA, 16 bp, M. musculus
ggctgaccagagcgag

SEQ ID NO: 417938 - DNA, 16 bp, M. musculus
ggctgacctaaaactc

SEQ ID NO: 417939 - DNA, 16 bp, M. musculus
ggctgacctctgcctc

SEQ ID NO: 417940 - DNA, 16 bp, M. musculus
ggctgacctggaactc

SEQ ID NO: 417941 - DNA, 16 bp, M. musculus
ggctgaccttgagctc

SEQ ID NO: 417942 - DNA, 16 bp, M. musculus
ggctgaccttgatctc

SEQ ID NO: 417943 - DNA, 16 bp, M. musculus
ggctgactacctccag

SEQ ID NO: 417944 - DNA, 16 bp, M. musculus
ggctgagaaagaaaat

SEQ ID NO: 417945 - DNA, 16 bp, M. musculus
ggctgagaagcagctg

SEQ ID NO: 417946 - DNA, 16 bp, M. musculus
ggctgagaatgaaatt

SEQ ID NO: 417947 - DNA, 16 bp, M. musculus
ggctgagagaagctga

SEQ ID NO: 417948 - DNA, 16 bp, M. musculus
ggctgagcaaaccagt

SEQ ID NO: 417949 - DNA, 16 bp, M. musculus
ggctgagcaagccagg

SEQ ID NO: 417950 - DNA, 16 bp, M. musculus
ggctgagcaagccatg

SEQ ID NO: 417951 - DNA, 16 bp, M. musculus
ggctgagcatggtggc

SEQ ID NO: 417952 - DNA, 16 bp, M. musculus
ggctgagccatctcct

SEQ ID NO: 417953 - DNA, 16 bp, M. musculus
ggctgagctgggctgg

SEQ ID NO: 417954 - DNA, 16 bp, M. musculus
ggctgaggagacagct

SEQ ID NO: 417955 - DNA, 16 bp, M. musculus
ggctgaggagggagga

SEQ ID NO: 417956 - DNA, 16 bp, M. musculus
ggctgaggcagaaaga

SEQ ID NO: 417957 - DNA, 16 bp, M. musculus
ggctgaggcagaaggg

SEQ ID NO: 417958 - DNA, 16 bp, M. musculus
ggctgaggcaggaaga

SEQ ID NO: 417959 - DNA, 16 bp, M. musculus
ggctgaggcaggcaaa

SEQ ID NO: 417960 - DNA, 16 bp, M. musculus
ggctgaggccagagga

SEQ ID NO: 417961 - DNA, 16 bp, M. musculus
ggctgaggcgggagga

SEQ ID NO: 417962 - DNA, 16 bp, M. musculus
ggctgaggcttggctg

SEQ ID NO: 417963 - DNA, 16 bp, M. musculus
ggctgagggctgaggg

SEQ ID NO: 417964 - DNA, 16 bp, M. musculus
ggctgagtgagctctg

SEQ ID NO: 417965 - DNA, 16 bp, M. musculus
ggctgagtgctccaaa

SEQ ID NO: 417966 - DNA, 16 bp, M. musculus
ggctgagtggaaagca

SEQ ID NO: 417967 - DNA, 16 bp, M. musculus
ggctgatattgggatg

SEQ ID NO: 417968 - DNA, 16 bp, M. musculus
ggctgatcttcaatac

SEQ ID NO: 417969 - DNA, 16 bp, M. musculus
ggctgatcttccagag

SEQ ID NO: 417970 - DNA, 16 bp, M. musculus
ggctgatcttgaactc

SEQ ID NO: 417971 - DNA, 16 bp, M. musculus
ggctgatgcagaggcc

SEQ ID NO: 417972 - DNA, 16 bp, M. musculus
ggctgatgcaggagaa

SEQ ID NO: 417973 - DNA, 16 bp, M. musculus
ggctgcacacactctg

SEQ ID NO: 417974 - DNA, 16 bp, M. musculus
ggctgcacagagagac

SEQ ID NO: 417975 - DNA, 16 bp, M. musculus
ggctgcacctcctaat

SEQ ID NO: 417976 - DNA, 16 bp, M. musculus
ggctgcagaacagccc

SEQ ID NO: 417977 - DNA, 16 bp, M. musculus
ggctgcagagaaggct

SEQ ID NO: 417978 - DNA, 16 bp, M. musculus
ggctgcagagacagct

SEQ ID NO: 417979 - DNA, 16 bp, M. musculus
ggctgcagagatggct

SEQ ID NO: 417980 - DNA, 16 bp, M. musculus
ggctgcagagctggct

SEQ ID NO: 417981 - DNA, 16 bp, M. musculus
ggctgcagagtgagtt

SEQ ID NO: 417982 - DNA, 16 bp, M. musculus
ggctgcagcccatcag

SEQ ID NO: 417983 - DNA, 16 bp, M. musculus
ggctgcaggagagaag

SEQ ID NO: 417984 - DNA, 16 bp, M. musculus
ggctgcaggctgcagg

SEQ ID NO: 417985 - DNA, 16 bp, M. musculus
ggctgcaggtggctgc

SEQ ID NO: 417986 - DNA, 16 bp, M. musculus
ggctgcagtcccaggc

SEQ ID NO: 417987 - DNA, 16 bp, M. musculus
ggctgcagttcccttt

SEQ ID NO: 417988 - DNA, 16 bp, M. musculus
ggctgcatccaggcag

SEQ ID NO: 417989 - DNA, 16 bp, M. musculus
ggctgcatgggtgagg

SEQ ID NO: 417990 - DNA, 16 bp, M. musculus
ggctgccactgtccaa

SEQ ID NO: 417991 - DNA, 16 bp, M. musculus
ggctgccatgaacata

SEQ ID NO: 417992 - DNA, 16 bp, M. musculus
ggctgccattttgtcc

SEQ ID NO: 417993 - DNA, 16 bp, M. musculus
ggctgccccatcacag

SEQ ID NO: 417994 - DNA, 16 bp, M. musculus
ggctgccctgaaactc

SEQ ID NO: 417995 - DNA, 19 bp, M. musculus
ggctgccctgagaagtaaa

SEQ ID NO: 417996 - DNA, 16 bp, M. musculus
ggctgccctggaactt

SEQ ID NO: 417997 - DNA, 16 bp, M. musculus
ggctgccctgggactc

SEQ ID NO: 417998 - DNA, 16 bp, M. musculus
ggctgccctgtctggc

SEQ ID NO: 417999 - DNA, 16 bp, M. musculus
ggctgcctctgctcag

SEQ ID NO: 418000 - DNA, 16 bp, M. musculus
ggctgcctctggaaca

SEQ ID NO: 418001 - DNA, 16 bp, M. musculus
ggctgcctggccagtg

SEQ ID NO: 418002 - DNA, 16 bp, M. musculus
ggctgcctgtgcacag

SEQ ID NO: 418003 - DNA, 16 bp, M. musculus
ggctgctagtgaaaga

SEQ ID NO: 418004 - DNA, 16 bp, M. musculus
ggctgctatgaagata

SEQ ID NO: 418005 - DNA, 16 bp, M. musculus
ggctgctcactctctc

SEQ ID NO: 418006 - DNA, 16 bp, M. musculus
ggctgctctaccactt

SEQ ID NO: 418007 - DNA, 16 bp, M. musculus
ggctgctctcccagag

SEQ ID NO: 418008 - DNA, 16 bp, M. musculus
ggctgctctggaactc

SEQ ID NO: 418009 - DNA, 16 bp, M. musculus
ggctgctcttgcagag

SEQ ID NO: 418010 - DNA, 16 bp, M. musculus
ggctgctcttttctga

SEQ ID NO: 418011 - DNA, 16 bp, M. musculus
ggctgctgaggcagga

SEQ ID NO: 418012 - DNA, 16 bp, M. musculus
ggctgctgagggagaa

SEQ ID NO: 418013 - DNA, 16 bp, M. musculus
ggctgctgaggtggct

SEQ ID NO: 418014 - DNA, 16 bp, M. musculus
ggctgctgcaggagga

SEQ ID NO: 418015 - DNA, 16 bp, M. musculus
ggctgctgctcttcca

SEQ ID NO: 418016 - DNA, 16 bp, M. musculus
ggctgctgctgctcct

SEQ ID NO: 418017 - DNA, 16 bp, M. musculus
ggctgctgctgctgct

SEQ ID NO: 418018 - DNA, 17 bp, M. musculus
ggctgctgctgctgctc

SEQ ID NO: 418019 - DNA, 18 bp, M. musculus
ggctgctgctgctgctgt

SEQ ID NO: 418020 - DNA, 16 bp, M. musculus
ggctgctgctgcttct

SEQ ID NO: 418021 - DNA, 16 bp, M. musculus
ggctgctggggcaggg

SEQ ID NO: 418022 - DNA, 16 bp, M. musculus
ggctgctggtcttcct

SEQ ID NO: 418023 - DNA, 16 bp, M. musculus
ggctgcttccttctac

SEQ ID NO: 418024 - DNA, 16 bp, M. musculus
ggctgcttggcccctc

SEQ ID NO: 418025 - DNA, 16 bp, M. musculus
ggctgctttctgccct

SEQ ID NO: 418026 - DNA, 16 bp, M. musculus
ggctgctttggactgt

SEQ ID NO: 418027 - DNA, 16 bp, M. musculus
ggctgcttttacagag

SEQ ID NO: 418028 - DNA, 16 bp, M. musculus
ggctggaaaacaactt

SEQ ID NO: 418029 - DNA, 16 bp, M. musculus
ggctggaactagaaaa

SEQ ID NO: 418030 - DNA, 16 bp, M. musculus
ggctggaagaaactga

SEQ ID NO: 418031 - DNA, 16 bp, M. musculus
ggctggaagaagctga

SEQ ID NO: 418032 - DNA, 16 bp, M. musculus
ggctggaagatggctc

SEQ ID NO: 418033 - DNA, 16 bp, M. musculus
ggctggaagggacttg

SEQ ID NO: 418034 - DNA, 16 bp, M. musculus
ggctggaatgcagaca

SEQ ID NO: 418035 - DNA, 16 bp, M. musculus
ggctggacctaggtct

SEQ ID NO: 418036 - DNA, 16 bp, M. musculus
ggctggagaaatggca

SEQ ID NO: 418037 - DNA, 16 bp, M. musculus
ggctggagaagtggct

SEQ ID NO: 418038 - DNA, 16 bp, M. musculus
ggctggagacacagct

SEQ ID NO: 418039 - DNA, 16 bp, M. musculus
ggctggagacgtggct

SEQ ID NO: 418040 - DNA, 16 bp, M. musculus
ggctggagagagagat

SEQ ID NO: 418041 - DNA, 16 bp, M. musculus
ggctggagagaggctc

SEQ ID NO: 418042 - DNA, 16 bp, M. musculus
ggctggagagagggct

SEQ ID NO: 418043 - DNA, 16 bp, M. musculus
ggctggagagatgatg

SEQ ID NO: 418044 - DNA, 16 bp, M. musculus
ggctggagagatggcc

SEQ ID NO: 418045 - DNA, 16 bp, M. musculus
ggctggagagctggct

SEQ ID NO: 418046 - DNA, 16 bp, M. musculus
ggctggagaggcagct

SEQ ID NO: 418047 - DNA, 16 bp, M. musculus
ggctggagatgtggct

SEQ ID NO: 418048 - DNA, 16 bp, M. musculus
ggctggagcaagcaga

SEQ ID NO: 418049 - DNA, 16 bp, M. musculus
ggctggagcagcagct

SEQ ID NO: 418050 - DNA, 163 bp, M. musculus
ggctggagcagcggtgaccaccgagaccgaggtaatctgggccaaggcgttgccagccgggacatccgcccagcgagctgaactaatagcactcacccaggccctaaagatggcagaaggtaagaagctaaatgtttatactgatagccgctatgcctttgct

SEQ ID NO: 418051 - DNA, 16 bp, M. musculus
ggctggagctgtatgg

SEQ ID NO: 418052 - DNA, 16 bp, M. musculus
ggctggaggaagtggg

SEQ ID NO: 418053 - DNA, 16 bp, M. musculus
ggctggaggagctgag

SEQ ID NO: 418054 - DNA, 16 bp, M. musculus
ggctggaggatcagaa

SEQ ID NO: 418055 - DNA, 16 bp, M. musculus
ggctggaggcgtggct

SEQ ID NO: 418056 - DNA, 16 bp, M. musculus
ggctggaggtgtggct

SEQ ID NO: 418057 - DNA, 16 bp, M. musculus
ggctggcaagatggct

SEQ ID NO: 418058 - DNA, 16 bp, M. musculus
ggctggcagaaggaag

SEQ ID NO: 418059 - DNA, 16 bp, M. musculus
ggctggcagccagcaa

SEQ ID NO: 418060 - DNA, 16 bp, M. musculus
ggctggcagcctgcca

SEQ ID NO: 418061 - DNA, 16 bp, M. musculus
ggctggcatttctgtt

SEQ ID NO: 418062 - DNA, 16 bp, M. musculus
ggctggccaggaacac

SEQ ID NO: 418063 - DNA, 16 bp, M. musculus
ggctggcctagaattc

SEQ ID NO: 418064 - DNA, 16 bp, M. musculus
ggctggcctcaaacac

SEQ ID NO: 418065 - DNA, 16 bp, M. musculus
ggctggcctcaaacat

SEQ ID NO: 418066 - DNA, 16 bp, M. musculus
ggctggcctcaaactt

SEQ ID NO: 418067 - DNA, 16 bp, M. musculus
ggctggcctcaagctc

SEQ ID NO: 418068 - DNA, 16 bp, M. musculus
ggctggcctcagactt

SEQ ID NO: 418069 - DNA, 16 bp, M. musculus
ggctggcctccaactt

SEQ ID NO: 418070 - DNA, 16 bp, M. musculus
ggctggcctccacctc

SEQ ID NO: 418071 - DNA, 18 bp, M. musculus
ggctggcctcgaactcac

SEQ ID NO: 418072 - DNA, 17 bp, M. musculus
ggctggcctcgcactca

SEQ ID NO: 418073 - DNA, 16 bp, M. musculus
ggctggcctctacctc

SEQ ID NO: 418074 - DNA, 16 bp, M. musculus
ggctggcctctgcctt

SEQ ID NO: 418075 - DNA, 16 bp, M. musculus
ggctggcctcttttgt

SEQ ID NO: 418076 - DNA, 16 bp, M. musculus
ggctggcctgaaactc

SEQ ID NO: 418077 - DNA, 16 bp, M. musculus
ggctggcctggaaatc

SEQ ID NO: 418078 - DNA, 16 bp, M. musculus
ggctggcctggaactc

SEQ ID NO: 418079 - DNA, 16 bp, M. musculus
ggctggcctggaattc

SEQ ID NO: 418080 - DNA, 16 bp, M. musculus
ggctggcctggagctc

SEQ ID NO: 418081 - DNA, 16 bp, M. musculus
ggctggcctgggactc

SEQ ID NO: 418082 - DNA, 16 bp, M. musculus
ggctggcctgtgagcc

SEQ ID NO: 418083 - DNA, 16 bp, M. musculus
ggctggccttagactc

SEQ ID NO: 418084 - DNA, 16 bp, M. musculus
ggctggccttgaactt

SEQ ID NO: 418085 - DNA, 21 bp, M. musculus
ggctggccttgaacttacaga

SEQ ID NO: 418086 - DNA, 16 bp, M. musculus
ggctggccttgaattt

SEQ ID NO: 418087 - DNA, 16 bp, M. musculus
ggctggccttgagttc

SEQ ID NO: 418088 - DNA, 16 bp, M. musculus
ggctggccttgcactc

SEQ ID NO: 418089 - DNA, 16 bp, M. musculus
ggctggctcagacctg

SEQ ID NO: 418090 - DNA, 16 bp, M. musculus
ggctggctgactggct

SEQ ID NO: 418091 - DNA, 16 bp, M. musculus
ggctggctgcctgcct

SEQ ID NO: 418092 - DNA, 16 bp, M. musculus
ggctggctgctggctg

SEQ ID NO: 418093 - DNA, 16 bp, M. musculus
ggctggctggccagca

SEQ ID NO: 418094 - DNA, 16 bp, M. musculus
ggctggctggctagct

SEQ ID NO: 418095 - DNA, 16 bp, M. musculus
ggctggctggctggca

SEQ ID NO: 418096 - DNA, 16 bp, M. musculus
ggctggctggctgtgt

SEQ ID NO: 418097 - DNA, 16 bp, M. musculus
ggctggctgtcctgga

SEQ ID NO: 418098 - DNA, 16 bp, M. musculus
ggctggctgtgaactc

SEQ ID NO: 418099 - DNA, 16 bp, M. musculus
ggctggcttacaggct

SEQ ID NO: 418100 - DNA, 16 bp, M. musculus
ggctggcttcccctgg

SEQ ID NO: 418101 - DNA, 16 bp, M. musculus
ggctggcttgcaggtt

SEQ ID NO: 418102 - DNA, 16 bp, M. musculus
ggctggcttggaactc

SEQ ID NO: 418103 - DNA, 16 bp, M. musculus
ggctggctttgaactt

SEQ ID NO: 418104 - DNA, 16 bp, M. musculus
ggctggctttgaattt

SEQ ID NO: 418105 - DNA, 16 bp, M. musculus
ggctggcttttgtgtt

SEQ ID NO: 418106 - DNA, 16 bp, M. musculus
ggctgggaaggtggct

SEQ ID NO: 418107 - DNA, 16 bp, M. musculus
ggctgggaatatagct

SEQ ID NO: 418108 - DNA, 16 bp, M. musculus
ggctgggactcccaca

SEQ ID NO: 418109 - DNA, 16 bp, M. musculus
ggctgggactgtagct

SEQ ID NO: 418110 - DNA, 16 bp, M. musculus
ggctgggacttcacca

SEQ ID NO: 418111 - DNA, 16 bp, M. musculus
ggctgggagagagaag

SEQ ID NO: 418112 - DNA, 16 bp, M. musculus
ggctgggagtcctggg

SEQ ID NO: 418113 - DNA, 16 bp, M. musculus
ggctgggatccattca

SEQ ID NO: 418114 - DNA, 16 bp, M. musculus
ggctgggatttgtgtt

SEQ ID NO: 418115 - DNA, 16 bp, M. musculus
ggctgggcagacccct

SEQ ID NO: 418116 - DNA, 16 bp, M. musculus
ggctgggcaggaagac

SEQ ID NO: 418117 - DNA, 16 bp, M. musculus
ggctgggcatggtggc

SEQ ID NO: 418118 - DNA, 16 bp, M. musculus
ggctgggccaatgaga

SEQ ID NO: 418119 - DNA, 16 bp, M. musculus
ggctgggcctggggct

SEQ ID NO: 418120 - DNA, 16 bp, M. musculus
ggctgggctctcccca

SEQ ID NO: 418121 - DNA, 16 bp, M. musculus
ggctgggctgcccttc

SEQ ID NO: 418122 - DNA, 16 bp, M. musculus
ggctggggatggagct

SEQ ID NO: 418123 - DNA, 16 bp, M. musculus
ggctggggctgaggct

SEQ ID NO: 418124 - DNA, 16 bp, M. musculus
ggctggggctggagag

SEQ ID NO: 418125 - DNA, 16 bp, M. musculus
ggctggggctggagct

SEQ ID NO: 418126 - DNA, 16 bp, M. musculus
ggctggggtgatggct

SEQ ID NO: 418127 - DNA, 16 bp, M. musculus
ggctggtcatgaactc

SEQ ID NO: 418128 - DNA, 16 bp, M. musculus
ggctggtccttcaggg

SEQ ID NO: 418129 - DNA, 16 bp, M. musculus
ggctggtctcaaactt

SEQ ID NO: 418130 - DNA, 16 bp, M. musculus
ggctggtctccagttg

SEQ ID NO: 418131 - DNA, 16 bp, M. musculus
ggctggtcttgaactt

SEQ ID NO: 418132 - DNA, 16 bp, M. musculus
ggctggtcttgaattc

SEQ ID NO: 418133 - DNA, 16 bp, M. musculus
ggctggtgacatggct

SEQ ID NO: 418134 - DNA, 16 bp, M. musculus
ggctggtgagatagct

SEQ ID NO: 418135 - DNA, 16 bp, M. musculus
ggctggttttgaactt

SEQ ID NO: 418136 - DNA, 16 bp, M. musculus
ggctgtaaatatctgc

SEQ ID NO: 418137 - DNA, 16 bp, M. musculus
ggctgtaaggagagac

SEQ ID NO: 418138 - DNA, 16 bp, M. musculus
ggctgtagagatagct

SEQ ID NO: 418139 - DNA, 16 bp, M. musculus
ggctgtagaggtggct

SEQ ID NO: 418140 - DNA, 16 bp, M. musculus
ggctgtagctcagtgg

SEQ ID NO: 418141 - DNA, 16 bp, M. musculus
ggctgtccaggaactc

SEQ ID NO: 418142 - DNA, 16 bp, M. musculus
ggctgtcctcaaagtc

SEQ ID NO: 418143 - DNA, 16 bp, M. musculus
ggctgtcctcgaattc

SEQ ID NO: 418144 - DNA, 16 bp, M. musculus
ggctgtcctctgactt

SEQ ID NO: 418145 - DNA, 16 bp, M. musculus
ggctgtcctgcctctg

SEQ ID NO: 418146 - DNA, 16 bp, M. musculus
ggctgtcctggaacta

SEQ ID NO: 418147 - DNA, 16 bp, M. musculus
ggctgtcctggagctc

SEQ ID NO: 418148 - DNA, 16 bp, M. musculus
ggctgtcctgggactt

SEQ ID NO: 418149 - DNA, 16 bp, M. musculus
ggctgtcctggtactc

SEQ ID NO: 418150 - DNA, 16 bp, M. musculus
ggctgtccttgaattc

SEQ ID NO: 418151 - DNA, 16 bp, M. musculus
ggctgtcctttaactc

SEQ ID NO: 418152 - DNA, 16 bp, M. musculus
ggctgtctttgaactc

SEQ ID NO: 418153 - DNA, 16 bp, M. musculus
ggctgtgaaggccatt

SEQ ID NO: 418154 - DNA, 16 bp, M. musculus
ggctgtgagcatcagc

SEQ ID NO: 418155 - DNA, 16 bp, M. musculus
ggctgtgagcatgcac

SEQ ID NO: 418156 - DNA, 16 bp, M. musculus
ggctgtgagccaccac

SEQ ID NO: 418157 - DNA, 16 bp, M. musculus
ggctgtgccctggggc

SEQ ID NO: 418158 - DNA, 16 bp, M. musculus
ggctgtgcctctctca

SEQ ID NO: 418159 - DNA, 16 bp, M. musculus
ggctgtgctggaactc

SEQ ID NO: 418160 - DNA, 16 bp, M. musculus
ggctgtggagacagct

SEQ ID NO: 418161 - DNA, 16 bp, M. musculus
ggctgtggctctctgc

SEQ ID NO: 418162 - DNA, 16 bp, M. musculus
ggctgtggctgtctgc

SEQ ID NO: 418163 - DNA, 17 bp, M. musculus
ggctgtgggaggtggta

SEQ ID NO: 418164 - DNA, 16 bp, M. musculus
ggctgtgggcctctgc

SEQ ID NO: 418165 - DNA, 16 bp, M. musculus
ggctgtggtcagcaga

SEQ ID NO: 418166 - DNA, 16 bp, M. musculus
ggctgttgataacaca

SEQ ID NO: 418167 - DNA, 16 bp, M. musculus
ggctgttgctgctgct

SEQ ID NO: 418168 - DNA, 16 bp, M. musculus
ggcttaaaaagaaaaa

SEQ ID NO: 418169 - DNA, 16 bp, M. musculus
ggcttacagcttcaga

SEQ ID NO: 418170 - DNA, 16 bp, M. musculus
ggcttagcctgcttca

SEQ ID NO: 418171 - DNA, 16 bp, M. musculus
ggcttatatatatata

SEQ ID NO: 418172 - DNA, 16 bp, M. musculus
ggcttatgtttccaga

SEQ ID NO: 418173 - DNA, 16 bp, M. musculus
ggcttattataaatat

SEQ ID NO: 418174 - DNA, 16 bp, M. musculus
ggcttatttggcttat

SEQ ID NO: 418175 - DNA, 16 bp, M. musculus
ggcttcaaactcactg

SEQ ID NO: 418176 - DNA, 16 bp, M. musculus
ggcttcaaactcatgg

SEQ ID NO: 418177 - DNA, 16 bp, M. musculus
ggcttcacagtgagac

SEQ ID NO: 418178 - DNA, 16 bp, M. musculus
ggcttcagactcacag

SEQ ID NO: 418179 - DNA, 16 bp, M. musculus
ggcttcagccaatcag

SEQ ID NO: 418180 - DNA, 16 bp, M. musculus
ggcttcaggtggcagc

SEQ ID NO: 418181 - DNA, 16 bp, M. musculus
ggcttcagtggaagag

SEQ ID NO: 418182 - DNA, 16 bp, M. musculus
ggcttcatccagcaac

SEQ ID NO: 418183 - DNA, 16 bp, M. musculus
ggcttcatgcatgcta

SEQ ID NO: 418184 - DNA, 16 bp, M. musculus
ggcttcatggagaaac

SEQ ID NO: 418185 - DNA, 16 bp, M. musculus
ggcttcattcttctct

SEQ ID NO: 418186 - DNA, 16 bp, M. musculus
ggcttccacatgcaca

SEQ ID NO: 418187 - DNA, 16 bp, M. musculus
ggcttccactgtgcct

SEQ ID NO: 418188 - DNA, 16 bp, M. musculus
ggcttccagcacccac

SEQ ID NO: 418189 - DNA, 16 bp, M. musculus
ggcttccagcccctca

SEQ ID NO: 418190 - DNA, 16 bp, M. musculus
ggcttccaggactcaa

SEQ ID NO: 418191 - DNA, 16 bp, M. musculus
ggcttccatatgcaca

SEQ ID NO: 418192 - DNA, 16 bp, M. musculus
ggcttccctacagccc

SEQ ID NO: 418193 - DNA, 16 bp, M. musculus
ggcttcctccagcagc

SEQ ID NO: 418194 - DNA, 16 bp, M. musculus
ggcttcctggaactca

SEQ ID NO: 418195 - DNA, 16 bp, M. musculus
ggcttcctggaagagg

SEQ ID NO: 418196 - DNA, 16 bp, M. musculus
ggcttcctggaggaag

SEQ ID NO: 418197 - DNA, 16 bp, M. musculus
ggcttcctggaggagg

SEQ ID NO: 418198 - DNA, 16 bp, M. musculus
ggcttctacttcagtt

SEQ ID NO: 418199 - DNA, 16 bp, M. musculus
ggcttctcacagcctg

SEQ ID NO: 418200 - DNA, 16 bp, M. musculus
ggcttctccaagggct

SEQ ID NO: 418201 - DNA, 16 bp, M. musculus
ggcttctctgggcctc

SEQ ID NO: 418202 - DNA, 16 bp, M. musculus
ggcttctctgtgtagt

SEQ ID NO: 418203 - DNA, 16 bp, M. musculus
ggcttctgacaccctc

SEQ ID NO: 418204 - DNA, 16 bp, M. musculus
ggcttctgcaggctct

SEQ ID NO: 418205 - DNA, 16 bp, M. musculus
ggcttctggaagagca

SEQ ID NO: 418206 - DNA, 16 bp, M. musculus
ggcttctgtccattgg

SEQ ID NO: 418207 - DNA, 18 bp, M. musculus
ggcttcttgtatgttcat

SEQ ID NO: 418208 - DNA, 16 bp, M. musculus
ggcttcttttatgatc

SEQ ID NO: 418209 - DNA, 16 bp, M. musculus
ggcttgaaagccatct

SEQ ID NO: 418210 - DNA, 16 bp, M. musculus
ggcttgatccccagtc

SEQ ID NO: 418211 - DNA, 16 bp, M. musculus
ggcttgcaagatggct

SEQ ID NO: 418212 - DNA, 16 bp, M. musculus
ggcttgcagagttccc

SEQ ID NO: 418213 - DNA, 16 bp, M. musculus
ggcttgccatcccaca

SEQ ID NO: 418214 - DNA, 16 bp, M. musculus
ggcttgcctcccaggt

SEQ ID NO: 418215 - DNA, 16 bp, M. musculus
ggcttgcctggaactc

SEQ ID NO: 418216 - DNA, 17 bp, M. musculus
ggcttgctcaggttgct

SEQ ID NO: 418217 - DNA, 16 bp, M. musculus
ggcttgctcggcctgc

SEQ ID NO: 418218 - DNA, 16 bp, M. musculus
ggcttgctgcaggagg

SEQ ID NO: 418219 - DNA, 16 bp, M. musculus
ggcttgcttctcatgg

SEQ ID NO: 418220 - DNA, 16 bp, M. musculus
ggcttgctttcttctt

SEQ ID NO: 418221 - DNA, 16 bp, M. musculus
ggcttggcagcaggca

SEQ ID NO: 418222 - DNA, 16 bp, M. musculus
ggcttgggaatgtgac

SEQ ID NO: 418223 - DNA, 16 bp, M. musculus
ggcttgggcttttgaa

SEQ ID NO: 418224 - DNA, 16 bp, M. musculus
ggcttggtagcaggca

SEQ ID NO: 418225 - DNA, 16 bp, M. musculus
ggcttggtggcaagcc

SEQ ID NO: 418226 - DNA, 16 bp, M. musculus
ggcttggtggcaagtg

SEQ ID NO: 418227 - DNA, 16 bp, M. musculus
ggcttgtaagagaaca

SEQ ID NO: 418228 - DNA, 16 bp, M. musculus
ggcttgtatatttgaa

SEQ ID NO: 418229 - DNA, 16 bp, M. musculus
ggcttgttctgtcttt

SEQ ID NO: 418230 - DNA, 16 bp, M. musculus
ggcttgttttgtgact

SEQ ID NO: 418231 - DNA, 16 bp, M. musculus
ggctttacagcagaag

SEQ ID NO: 418232 - DNA, 16 bp, M. musculus
ggctttagtgcagagt

SEQ ID NO: 418233 - DNA, 16 bp, M. musculus
ggctttatgcccttgc

SEQ ID NO: 418234 - DNA, 16 bp, M. musculus
ggctttcatagtgtct

SEQ ID NO: 418235 - DNA, 16 bp, M. musculus
ggctttctcttattta

SEQ ID NO: 418236 - DNA, 16 bp, M. musculus
ggctttctggtgtttc

SEQ ID NO: 418237 - DNA, 16 bp, M. musculus
ggctttgaactcacaa

SEQ ID NO: 418238 - DNA, 16 bp, M. musculus
ggctttgaactcacag

SEQ ID NO: 418239 - DNA, 16 bp, M. musculus
ggctttgaactcctaa

SEQ ID NO: 418240 - DNA, 16 bp, M. musculus
ggctttgaacttgctg

SEQ ID NO: 418241 - DNA, 16 bp, M. musculus
ggctttgagattaaaa

SEQ ID NO: 418242 - DNA, 16 bp, M. musculus
ggctttgagatttcaa

SEQ ID NO: 418243 - DNA, 16 bp, M. musculus
ggctttgaggatagca

SEQ ID NO: 418244 - DNA, 16 bp, M. musculus
ggctttgctggaggaa

SEQ ID NO: 418245 - DNA, 16 bp, M. musculus
ggctttgggacaagat

SEQ ID NO: 418246 - DNA, 16 bp, M. musculus
ggctttgggacaagtt

SEQ ID NO: 418247 - DNA, 16 bp, M. musculus
ggctttgtcagtgcct

SEQ ID NO: 418248 - DNA, 16 bp, M. musculus
ggctttgtgcatgcta

SEQ ID NO: 418249 - DNA, 16 bp, M. musculus
ggctttgtgcatgtta

SEQ ID NO: 418250 - DNA, 16 bp, M. musculus
ggcttttaaaaacaaa

SEQ ID NO: 418251 - DNA, 16 bp, M. musculus
ggcttttaaaacctca

SEQ ID NO: 418252 - DNA, 16 bp, M. musculus
ggcttttaatcccagc

SEQ ID NO: 418253 - DNA, 16 bp, M. musculus
ggcttttatagaccag

SEQ ID NO: 418254 - DNA, 16 bp, M. musculus
ggcttttccagctgta

SEQ ID NO: 418255 - DNA, 16 bp, M. musculus
ggcttttccccccttt

SEQ ID NO: 418256 - DNA, 16 bp, M. musculus
ggcttttcccgacttt

SEQ ID NO: 418257 - DNA, 16 bp, M. musculus
ggcttttccctgcttt

SEQ ID NO: 418258 - DNA, 16 bp, M. musculus
ggcttttgaaacctca

SEQ ID NO: 418259 - DNA, 16 bp, M. musculus
ggcttttgtagaagga

SEQ ID NO: 418260 - DNA, 16 bp, M. musculus
ggctttttaaaaaatt

SEQ ID NO: 418261 - DNA, 16 bp, M. musculus
ggctttttctgtgtag

SEQ ID NO: 418262 - DNA, 16 bp, M. musculus
gggaaaaaaaatccaa

SEQ ID NO: 418263 - DNA, 16 bp, M. musculus
gggaaaaaaccccaca

SEQ ID NO: 418264 - DNA, 16 bp, M. musculus
gggaaaaaagtcaagt

SEQ ID NO: 418265 - DNA, 16 bp, M. musculus
gggaaaacacagacag

SEQ ID NO: 418266 - DNA, 16 bp, M. musculus
gggaaaacatttaaaa

SEQ ID NO: 418267 - DNA, 16 bp, M. musculus
gggaaaaccaggaaag

SEQ ID NO: 418268 - DNA, 16 bp, M. musculus
gggaaaagatcttcat

SEQ ID NO: 418269 - DNA, 16 bp, M. musculus
gggaaaagccagggcc

SEQ ID NO: 418270 - DNA, 16 bp, M. musculus
gggaaaagcctcgaag

SEQ ID NO: 418271 - DNA, 17 bp, M. musculus
gggaaaagccttgaaga

SEQ ID NO: 418272 - DNA, 16 bp, M. musculus
gggaaaaggggaacat

SEQ ID NO: 418273 - DNA, 16 bp, M. musculus
gggaaaatatctttat

SEQ ID NO: 418274 - DNA, 16 bp, M. musculus
gggaaaattcctgaag

SEQ ID NO: 418275 - DNA, 16 bp, M. musculus
gggaaaattgatgctg

SEQ ID NO: 418276 - DNA, 16 bp, M. musculus
gggaaacaaagtcaca

SEQ ID NO: 418277 - DNA, 16 bp, M. musculus
gggaaacaacacccct

SEQ ID NO: 418278 - DNA, 16 bp, M. musculus
gggaaacagaggcaga

SEQ ID NO: 418279 - DNA, 16 bp, M. musculus
gggaaacagtgaaact

SEQ ID NO: 418280 - DNA, 16 bp, M. musculus
gggaaacatggtggca

SEQ ID NO: 418281 - DNA, 16 bp, M. musculus
gggaaacattgtgtgg

SEQ ID NO: 418282 - DNA, 16 bp, M. musculus
gggaaaccaggaatgt

SEQ ID NO: 418283 - DNA, 16 bp, M. musculus
gggaaaccagtaaagg

SEQ ID NO: 418284 - DNA, 16 bp, M. musculus
gggaaactgaggcagc

SEQ ID NO: 418285 - DNA, 16 bp, M. musculus
gggaaactgaggcagg

SEQ ID NO: 418286 - DNA, 16 bp, M. musculus
gggaaactgaggcttg

SEQ ID NO: 418287 - DNA, 16 bp, M. musculus
gggaaactgaggtcag

SEQ ID NO: 418288 - DNA, 16 bp, M. musculus
gggaaactgggaagga

SEQ ID NO: 418289 - DNA, 16 bp, M. musculus
gggaaactgtggttgg

SEQ ID NO: 418290 - DNA, 16 bp, M. musculus
gggaaagactgaagga

SEQ ID NO: 418291 - DNA, 16 bp, M. musculus
gggaaagactggaaga

SEQ ID NO: 418292 - DNA, 16 bp, M. musculus
gggaaagactgggtgg

SEQ ID NO: 418293 - DNA, 16 bp, M. musculus
gggaaagagaaacact

SEQ ID NO: 418294 - DNA, 16 bp, M. musculus
gggaaagattgtggga

SEQ ID NO: 418295 - DNA, 16 bp, M. musculus
gggaaagcaagcaagc

SEQ ID NO: 418296 - DNA, 16 bp, M. musculus
gggaaagccagggtca

SEQ ID NO: 418297 - DNA, 16 bp, M. musculus
gggaaagcctcaaaga

SEQ ID NO: 418298 - DNA, 16 bp, M. musculus
gggaaaggaagaagtc

SEQ ID NO: 418299 - DNA, 16 bp, M. musculus
gggaaaggattgaaga

SEQ ID NO: 418300 - DNA, 16 bp, M. musculus
gggaaaggatttttac

SEQ ID NO: 418301 - DNA, 16 bp, M. musculus
gggaaaggctccttgt

SEQ ID NO: 418302 - DNA, 16 bp, M. musculus
gggaaagggatgcctc

SEQ ID NO: 418303 - DNA, 16 bp, M. musculus
gggaaagtcaaggcag

SEQ ID NO: 418304 - DNA, 16 bp, M. musculus
gggaaataaaatatgg

SEQ ID NO: 418305 - DNA, 16 bp, M. musculus
gggaaatacagaagtg

SEQ ID NO: 418306 - DNA, 16 bp, M. musculus
gggaaatagggaagca

SEQ ID NO: 418307 - DNA, 16 bp, M. musculus
gggaaatcaggaaaga

SEQ ID NO: 418308 - DNA, 16 bp, M. musculus
gggaaatgatgtaatt

SEQ ID NO: 418309 - DNA, 16 bp, M. musculus
gggaaatggaagcagg

SEQ ID NO: 418310 - DNA, 16 bp, M. musculus
gggaaatggagacaga

SEQ ID NO: 418311 - DNA, 16 bp, M. musculus
gggaaatggttcagtg

SEQ ID NO: 418312 - DNA, 16 bp, M. musculus
gggaaattcaaataaa

SEQ ID NO: 418313 - DNA, 16 bp, M. musculus
gggaaatttcacctgc

SEQ ID NO: 418314 - DNA, 16 bp, M. musculus
gggaaatttttctgaa

SEQ ID NO: 418315 - DNA, 16 bp, M. musculus
gggaacaaaagaccca

SEQ ID NO: 418316 - DNA, 16 bp, M. musculus
gggaacaaactcaggt

SEQ ID NO: 418317 - DNA, 16 bp, M. musculus
gggaacaaattaccca

SEQ ID NO: 418318 - DNA, 16 bp, M. musculus
gggaacaagcctagct

SEQ ID NO: 418319 - DNA, 16 bp, M. musculus
gggaacacaagggcca

SEQ ID NO: 418320 - DNA, 16 bp, M. musculus
gggaacactcatccat

SEQ ID NO: 418321 - DNA, 16 bp, M. musculus
gggaacagagtcagag

SEQ ID NO: 418322 - DNA, 16 bp, M. musculus
gggaacagatgcagaa

SEQ ID NO: 418323 - DNA, 16 bp, M. musculus
gggaaccaagcattca

SEQ ID NO: 418324 - DNA, 120 bp, M. musculus
gggaaccatgggccttattctcggccggggttcactcaccttacagggcttagtagtccaccctggagttatggattgtcaacattcccctgaaatacaggtcctgtgctcaagccctaa

SEQ ID NO: 418325 - DNA, 16 bp, M. musculus
gggaaccccaactgag

SEQ ID NO: 418326 - DNA, 16 bp, M. musculus
gggaaccccatccctc

SEQ ID NO: 418327 - DNA, 16 bp, M. musculus
gggaaccgaacctggg

SEQ ID NO: 418328 - DNA, 50 bp, M. musculus
gggaaccgactcccccaccgagttcagaactttcagcagtcagtggttgc

SEQ ID NO: 418329 - DNA, 16 bp, M. musculus
gggaacgccagtgcca

SEQ ID NO: 418330 - DNA, 16 bp, M. musculus
gggaactcccagagac

SEQ ID NO: 418331 - DNA, 16 bp, M. musculus
gggaactgaactgagg

SEQ ID NO: 418332 - DNA, 16 bp, M. musculus
gggaactgaacttggc

SEQ ID NO: 418333 - DNA, 16 bp, M. musculus
gggaactgaagcagaa

SEQ ID NO: 418334 - DNA, 16 bp, M. musculus
gggaactgaattcagg

SEQ ID NO: 418335 - DNA, 38 bp, M. musculus
gggaactggtcgcaggagctggagaggttgcagacgag

SEQ ID NO: 418336 - DNA, 16 bp, M. musculus
gggaactttcgagata

SEQ ID NO: 418337 - DNA, 16 bp, M. musculus
gggaagaaaataatct

SEQ ID NO: 418338 - DNA, 16 bp, M. musculus
gggaagaacccagatg

SEQ ID NO: 418339 - DNA, 16 bp, M. musculus
gggaagaagaagggtc

SEQ ID NO: 418340 - DNA, 16 bp, M. musculus
gggaagaagcaggcag

SEQ ID NO: 418341 - DNA, 16 bp, M. musculus
gggaagaaggtcaagt

SEQ ID NO: 418342 - DNA, 16 bp, M. musculus
gggaagaatttctttt

SEQ ID NO: 418343 - DNA, 16 bp, M. musculus
gggaagaccccgaacc

SEQ ID NO: 418344 - DNA, 16 bp, M. musculus
gggaagacctgcccac

SEQ ID NO: 418345 - DNA, 16 bp, M. musculus
gggaagagaggccatt

SEQ ID NO: 418346 - DNA, 16 bp, M. musculus
gggaagagcctcgaat

SEQ ID NO: 418347 - DNA, 16 bp, M. musculus
gggaagagctggagaa

SEQ ID NO: 418348 - DNA, 16 bp, M. musculus
gggaagagggaacctc

SEQ ID NO: 418349 - DNA, 16 bp, M. musculus
gggaagatcaggaatt

SEQ ID NO: 418350 - DNA, 16 bp, M. musculus
gggaagatcaggagtt

SEQ ID NO: 418351 - DNA, 16 bp, M. musculus
gggaagatggctctgt

SEQ ID NO: 418352 - DNA, 16 bp, M. musculus
gggaagcaaacacaga

SEQ ID NO: 418353 - DNA, 16 bp, M. musculus
gggaagcaaaggcagg

SEQ ID NO: 418354 - DNA, 16 bp, M. musculus
gggaagcaagcaagcc

SEQ ID NO: 418355 - DNA, 16 bp, M. musculus
gggaagcacacacaca

SEQ ID NO: 418356 - DNA, 16 bp, M. musculus
gggaagcaccctcata

SEQ ID NO: 418357 - DNA, 16 bp, M. musculus
gggaagcagaaacagg

SEQ ID NO: 418358 - DNA, 16 bp, M. musculus
gggaagcagaggcaag

SEQ ID NO: 418359 - DNA, 16 bp, M. musculus
gggaagcagaggcaga

SEQ ID NO: 418360 - DNA, 16 bp, M. musculus
gggaagcagaggctgg

SEQ ID NO: 418361 - DNA, 16 bp, M. musculus
gggaagccagaagagg

SEQ ID NO: 418362 - DNA, 16 bp, M. musculus
gggaagccgccctcac

SEQ ID NO: 418363 - DNA, 16 bp, M. musculus
gggaagctagtgaaaa

SEQ ID NO: 418364 - DNA, 16 bp, M. musculus
gggaagctgaggcagg

SEQ ID NO: 418365 - DNA, 16 bp, M. musculus
gggaagctggaggcag

SEQ ID NO: 418366 - DNA, 16 bp, M. musculus
gggaagctgttaggag

SEQ ID NO: 418367 - DNA, 16 bp, M. musculus
gggaaggaaaaggttt

SEQ ID NO: 418368 - DNA, 16 bp, M. musculus
gggaaggacccagccc

SEQ ID NO: 418369 - DNA, 16 bp, M. musculus
gggaaggacctgggtg

SEQ ID NO: 418370 - DNA, 16 bp, M. musculus
gggaaggagctgagag

SEQ ID NO: 418371 - DNA, 16 bp, M. musculus
gggaaggattaaagga

SEQ ID NO: 418372 - DNA, 16 bp, M. musculus
gggaaggcaaccccat

SEQ ID NO: 418373 - DNA, 29 bp, M. musculus
gggaaggcagagcacatggagtggagaac

SEQ ID NO: 418374 - DNA, 16 bp, M. musculus
gggaaggcttcctgga

SEQ ID NO: 418375 - DNA, 16 bp, M. musculus
gggaagggaagtttat

SEQ ID NO: 418376 - DNA, 16 bp, M. musculus
gggaaggtgcacactt

SEQ ID NO: 418377 - DNA, 16 bp, M. musculus
gggaaggtgcagagat

SEQ ID NO: 418378 - DNA, 16 bp, M. musculus
gggaaggtgcccggat

SEQ ID NO: 418379 - DNA, 16 bp, M. musculus
gggaaggtggagacag

SEQ ID NO: 418380 - DNA, 16 bp, M. musculus
gggaaggttgtggact

SEQ ID NO: 418381 - DNA, 16 bp, M. musculus
gggaagtagaagcagg

SEQ ID NO: 418382 - DNA, 16 bp, M. musculus
gggaagtagagacagg

SEQ ID NO: 418383 - DNA, 16 bp, M. musculus
gggaagtagaggcagg

SEQ ID NO: 418384 - DNA, 16 bp, M. musculus
gggaagttgaggcagg

SEQ ID NO: 418385 - DNA, 16 bp, M. musculus
gggaataattctattt

SEQ ID NO: 418386 - DNA, 16 bp, M. musculus
gggaatataatcttca

SEQ ID NO: 418387 - DNA, 16 bp, M. musculus
gggaatcaagcctggg

SEQ ID NO: 418388 - DNA, 16 bp, M. musculus
gggaatccagtgccct

SEQ ID NO: 418389 - DNA, 16 bp, M. musculus
gggaatccatcccata

SEQ ID NO: 418390 - DNA, 16 bp, M. musculus
gggaatccatcctata

SEQ ID NO: 418391 - DNA, 16 bp, M. musculus
gggaatcccagggcca

SEQ ID NO: 418392 - DNA, 16 bp, M. musculus
gggaatcctaggtttt

SEQ ID NO: 418393 - DNA, 16 bp, M. musculus
gggaatcgagggcagg

SEQ ID NO: 418394 - DNA, 16 bp, M. musculus
gggaatctcaattgag

SEQ ID NO: 418395 - DNA, 16 bp, M. musculus
gggaatctgatgccct

SEQ ID NO: 418396 - DNA, 16 bp, M. musculus
gggaatcttcactctt

SEQ ID NO: 418397 - DNA, 16 bp, M. musculus
gggaatctttgttctc

SEQ ID NO: 418398 - DNA, 16 bp, M. musculus
gggaatgaggtagtag

SEQ ID NO: 418399 - DNA, 16 bp, M. musculus
gggaatgccaagacag

SEQ ID NO: 418400 - DNA, 16 bp, M. musculus
gggaatgccagaacag

SEQ ID NO: 418401 - DNA, 16 bp, M. musculus
gggaatgccagagcag

SEQ ID NO: 418402 - DNA, 16 bp, M. musculus
gggaatgcctgggagg

SEQ ID NO: 418403 - DNA, 16 bp, M. musculus
gggaatggagacagga

SEQ ID NO: 418404 - DNA, 16 bp, M. musculus
gggaatggagcccagg

SEQ ID NO: 418405 - DNA, 16 bp, M. musculus
gggaatggaggacacc

SEQ ID NO: 418406 - DNA, 16 bp, M. musculus
gggaatggggaactgg

SEQ ID NO: 418407 - DNA, 16 bp, M. musculus
gggaatggtgttgccc

SEQ ID NO: 418408 - DNA, 16 bp, M. musculus
gggaatgtagaaatgg

SEQ ID NO: 418409 - DNA, 16 bp, M. musculus
gggaattaaactcaga

SEQ ID NO: 418410 - DNA, 16 bp, M. musculus
gggaattcatcccata

SEQ ID NO: 418411 - DNA, 16 bp, M. musculus
gggaattgaactcaag

SEQ ID NO: 418412 - DNA, 16 bp, M. musculus
gggaattgaactcagt

SEQ ID NO: 418413 - DNA, 16 bp, M. musculus
gggaattgggcccctc

SEQ ID NO: 418414 - DNA, 16 bp, M. musculus
gggaattttttttttc

SEQ ID NO: 418415 - DNA, 16 bp, M. musculus
gggacaaaaaatggag

SEQ ID NO: 418416 - DNA, 16 bp, M. musculus
gggacaaaactggaga

SEQ ID NO: 418417 - DNA, 16 bp, M. musculus
gggacaacaggtgact

SEQ ID NO: 418418 - DNA, 16 bp, M. musculus
gggacaacccctgctc

SEQ ID NO: 418419 - DNA, 16 bp, M. musculus
gggacaagaggacaga

SEQ ID NO: 418420 - DNA, 16 bp, M. musculus
gggacaagccaaagtc

SEQ ID NO: 418421 - DNA, 16 bp, M. musculus
gggacaaggggttttg

SEQ ID NO: 418422 - DNA, 21 bp, M. musculus
gggacaagttaaggttcctgg

SEQ ID NO: 418423 - DNA, 16 bp, M. musculus
gggacacacagagaga

SEQ ID NO: 418424 - DNA, 16 bp, M. musculus
gggacacagttaaact

SEQ ID NO: 418425 - DNA, 16 bp, M. musculus
gggacagaaacagaga

SEQ ID NO: 418426 - DNA, 16 bp, M. musculus
gggacagaacaggtct

SEQ ID NO: 418427 - DNA, 16 bp, M. musculus
gggacagaactcaggt

SEQ ID NO: 418428 - DNA, 16 bp, M. musculus
gggacagaaggaaaat

SEQ ID NO: 418429 - DNA, 16 bp, M. musculus
gggacagacagacaga

SEQ ID NO: 418430 - DNA, 16 bp, M. musculus
gggacagacagatttg

SEQ ID NO: 418431 - DNA, 16 bp, M. musculus
gggacagagaaggaca

SEQ ID NO: 418432 - DNA, 16 bp, M. musculus
gggacagagacacaga

SEQ ID NO: 418433 - DNA, 16 bp, M. musculus
gggacagagacaggga

SEQ ID NO: 418434 - DNA, 16 bp, M. musculus
gggacagaggcaggca

SEQ ID NO: 418435 - DNA, 16 bp, M. musculus
gggacagcagaggggt

SEQ ID NO: 418436 - DNA, 16 bp, M. musculus
gggacagcatttggga

SEQ ID NO: 418437 - DNA, 16 bp, M. musculus
gggacagccagggcta

SEQ ID NO: 418438 - DNA, 16 bp, M. musculus
gggacagccctcacag

SEQ ID NO: 418439 - DNA, 16 bp, M. musculus
gggacagcctgggcta

SEQ ID NO: 418440 - DNA, 16 bp, M. musculus
gggacagcctggtcta

SEQ ID NO: 418441 - DNA, 16 bp, M. musculus
gggacagctggagctg

SEQ ID NO: 418442 - DNA, 16 bp, M. musculus
gggacaggaagcagga

SEQ ID NO: 418443 - DNA, 16 bp, M. musculus
gggacaggactgaagc

SEQ ID NO: 418444 - DNA, 16 bp, M. musculus
gggacaggagagatgg

SEQ ID NO: 418445 - DNA, 16 bp, M. musculus
gggacaggcagaagcc

SEQ ID NO: 418446 - DNA, 16 bp, M. musculus
gggacagggagatgaa

SEQ ID NO: 418447 - DNA, 16 bp, M. musculus
gggacagggccagcag

SEQ ID NO: 418448 - DNA, 16 bp, M. musculus
gggacaggtgtgtgtg

SEQ ID NO: 418449 - DNA, 16 bp, M. musculus
gggacagtccctggat

SEQ ID NO: 418450 - DNA, 16 bp, M. musculus
gggacagtttctggat

SEQ ID NO: 418451 - DNA, 16 bp, M. musculus
gggacatcaaaccttc

SEQ ID NO: 418452 - DNA, 16 bp, M. musculus
gggacatcctcttgga

SEQ ID NO: 418453 - DNA, 16 bp, M. musculus
gggacatggaggcagg

SEQ ID NO: 418454 - DNA, 16 bp, M. musculus
gggacattcagtttga

SEQ ID NO: 418455 - DNA, 16 bp, M. musculus
gggacattctggaact

SEQ ID NO: 418456 - DNA, 16 bp, M. musculus
gggacattgtctgtgt

SEQ ID NO: 418457 - DNA, 16 bp, M. musculus
gggaccaaatgttcaa

SEQ ID NO: 418458 - DNA, 16 bp, M. musculus
gggaccaagtgctcaa

SEQ ID NO: 418459 - DNA, 16 bp, M. musculus
gggaccactgtgaccc

SEQ ID NO: 418460 - DNA, 16 bp, M. musculus
gggaccagagttacag

SEQ ID NO: 418461 - DNA, 16 bp, M. musculus
gggaccatctgctgag

SEQ ID NO: 418462 - DNA, 16 bp, M. musculus
gggaccatctttgggc

SEQ ID NO: 418463 - DNA, 16 bp, M. musculus
gggacccactgtgctc

SEQ ID NO: 418464 - DNA, 16 bp, M. musculus
gggaccccacgctcag

SEQ ID NO: 418465 - DNA, 16 bp, M. musculus
gggaccccatgctcag

SEQ ID NO: 418466 - DNA, 16 bp, M. musculus
gggacccctatggttg

SEQ ID NO: 418467 - DNA, 16 bp, M. musculus
gggaccctaatgaagg

SEQ ID NO: 418468 - DNA, 16 bp, M. musculus
gggaccctgcccccag

SEQ ID NO: 418469 - DNA, 99 bp, M. musculus
gggaccctgctgaccggagaagaaaagcagcgggtgctcctagaggctagaaaggcagtccggggcaatgatggacgccccactcagttgcctaatgaa

SEQ ID NO: 418470 - DNA, 16 bp, M. musculus
gggaccctggagctac

SEQ ID NO: 418471 - DNA, 16 bp, M. musculus
gggaccctgtctcaga

SEQ ID NO: 418472 - DNA, 16 bp, M. musculus
gggaccctgtgatcag

SEQ ID NO: 418473 - DNA, 16 bp, M. musculus
gggaccctgtgctcag

SEQ ID NO: 418474 - DNA, 16 bp, M. musculus
gggaccctgtgcttca

SEQ ID NO: 418475 - DNA, 16 bp, M. musculus
gggaccctgtggtcca

SEQ ID NO: 418476 - DNA, 16 bp, M. musculus
gggaccctttcctcct

SEQ ID NO: 418477 - DNA, 16 bp, M. musculus
gggacctcaccatggc

SEQ ID NO: 418478 - DNA, 16 bp, M. musculus
gggacctcagactgca

SEQ ID NO: 418479 - DNA, 16 bp, M. musculus
gggacctcagagccct

SEQ ID NO: 418480 - DNA, 16 bp, M. musculus
gggacctccagtctct

SEQ ID NO: 418481 - DNA, 16 bp, M. musculus
gggacctctggaagag

SEQ ID NO: 418482 - DNA, 20 bp, M. musculus
gggacctgaagaatggcaga

SEQ ID NO: 418483 - DNA, 16 bp, M. musculus
gggacctgatgcctct

SEQ ID NO: 418484 - DNA, 16 bp, M. musculus
gggacctggaagggaa

SEQ ID NO: 418485 - DNA, 16 bp, M. musculus
gggacctgggacctgg

SEQ ID NO: 418486 - DNA, 16 bp, M. musculus
gggaccttccagaatg

SEQ ID NO: 418487 - DNA, 16 bp, M. musculus
gggaccttgggaccct

SEQ ID NO: 418488 - DNA, 16 bp, M. musculus
gggactaaacctctga

SEQ ID NO: 418489 - DNA, 26 bp, M. musculus
gggactacagccctagtggccaccaa

SEQ ID NO: 418490 - DNA, 16 bp, M. musculus
gggactaggaagagag

SEQ ID NO: 418491 - DNA, 16 bp, M. musculus
gggactatgaaagcca

SEQ ID NO: 418492 - DNA, 16 bp, M. musculus
gggactcctgagtgtg

SEQ ID NO: 418493 - DNA, 16 bp, M. musculus
gggactcctggctcca

SEQ ID NO: 418494 - DNA, 16 bp, M. musculus
gggactctcttcccag

SEQ ID NO: 418495 - DNA, 16 bp, M. musculus
gggactctgcggaggg

SEQ ID NO: 418496 - DNA, 16 bp, M. musculus
gggactgaacaactgc

SEQ ID NO: 418497 - DNA, 16 bp, M. musculus
gggactgaactcaagt

SEQ ID NO: 418498 - DNA, 16 bp, M. musculus
gggactgaactcaggt

SEQ ID NO: 418499 - DNA, 16 bp, M. musculus
gggactgcagagatgg

SEQ ID NO: 418500 - DNA, 16 bp, M. musculus
gggactggaaagatgg

SEQ ID NO: 418501 - DNA, 16 bp, M. musculus
gggactggacagatgg

SEQ ID NO: 418502 - DNA, 16 bp, M. musculus
gggactggagagatgg

SEQ ID NO: 418503 - DNA, 16 bp, M. musculus
gggactgggacaccaa

SEQ ID NO: 418504 - DNA, 16 bp, M. musculus
gggactgggaggaaag

SEQ ID NO: 418505 - DNA, 16 bp, M. musculus
gggactgtctgctgag

SEQ ID NO: 418506 - DNA, 16 bp, M. musculus
gggactgtgggactgt

SEQ ID NO: 418507 - DNA, 16 bp, M. musculus
gggacttccaggttcc

SEQ ID NO: 418508 - DNA, 16 bp, M. musculus
gggacttctcatttct

SEQ ID NO: 418509 - DNA, 16 bp, M. musculus
gggacttgaactcagg

SEQ ID NO: 418510 - DNA, 16 bp, M. musculus
gggacttgaactcagt

SEQ ID NO: 418511 - DNA, 16 bp, M. musculus
gggacttgtgacccta

SEQ ID NO: 418512 - DNA, 16 bp, M. musculus
gggactttcgggatag

SEQ ID NO: 418513 - DNA, 16 bp, M. musculus
gggactttggatttgg

SEQ ID NO: 418514 - DNA, 16 bp, M. musculus
gggacttttgatgctg

SEQ ID NO: 418515 - DNA, 16 bp, M. musculus
gggactttttttttct

SEQ ID NO: 418516 - DNA, 16 bp, M. musculus
gggagaaaaggactga

SEQ ID NO: 418517 - DNA, 16 bp, M. musculus
gggagaaagggtttat

SEQ ID NO: 418518 - DNA, 16 bp, M. musculus
gggagaacctggaagc

SEQ ID NO: 418519 - DNA, 16 bp, M. musculus
gggagaacctggaggc

SEQ ID NO: 418520 - DNA, 16 bp, M. musculus
gggagaactggtttct

SEQ ID NO: 418521 - DNA, 16 bp, M. musculus
gggagaagagacatag

SEQ ID NO: 418522 - DNA, 16 bp, M. musculus
gggagaagaggccatt

SEQ ID NO: 418523 - DNA, 16 bp, M. musculus
gggagaagtctggtgt

SEQ ID NO: 418524 - DNA, 16 bp, M. musculus
gggagaatcagggtcc

SEQ ID NO: 418525 - DNA, 16 bp, M. musculus
gggagaatctaagttc

SEQ ID NO: 418526 - DNA, 16 bp, M. musculus
gggagaatgtggagaa

SEQ ID NO: 418527 - DNA, 16 bp, M. musculus
gggagacaaaagcagg

SEQ ID NO: 418528 - DNA, 16 bp, M. musculus
gggagacagaaacagg

SEQ ID NO: 418529 - DNA, 16 bp, M. musculus
gggagacagaagcagg

SEQ ID NO: 418530 - DNA, 16 bp, M. musculus
gggagacagagacaga

SEQ ID NO: 418531 - DNA, 16 bp, M. musculus
gggagacagagacagg

SEQ ID NO: 418532 - DNA, 16 bp, M. musculus
gggagacagagccagg

SEQ ID NO: 418533 - DNA, 16 bp, M. musculus
gggagacagaggcaag

SEQ ID NO: 418534 - DNA, 16 bp, M. musculus
gggagacagaggcagc

SEQ ID NO: 418535 - DNA, 16 bp, M. musculus
gggagacagaggcagt

SEQ ID NO: 418536 - DNA, 16 bp, M. musculus
gggagacagctcagtt

SEQ ID NO: 418537 - DNA, 16 bp, M. musculus
gggagacaggcaggtg

SEQ ID NO: 418538 - DNA, 16 bp, M. musculus
gggagacagggagaca

SEQ ID NO: 418539 - DNA, 16 bp, M. musculus
gggagaccctgcctca

SEQ ID NO: 418540 - DNA, 16 bp, M. musculus
gggagacctatcagaa

SEQ ID NO: 418541 - DNA, 16 bp, M. musculus
gggagacttcaacacc

SEQ ID NO: 418542 - DNA, 16 bp, M. musculus
gggagacttcaacatc

SEQ ID NO: 418543 - DNA, 16 bp, M. musculus
gggagagaatgcagag

SEQ ID NO: 418544 - DNA, 16 bp, M. musculus
gggagagagagagtta

SEQ ID NO: 418545 - DNA, 16 bp, M. musculus
gggagagagagcacac

SEQ ID NO: 418546 - DNA, 16 bp, M. musculus
gggagagaggtcagag

SEQ ID NO: 418547 - DNA, 16 bp, M. musculus
gggagagatggagaca

SEQ ID NO: 418548 - DNA, 18 bp, M. musculus
gggagagatggctcagca

SEQ ID NO: 418549 - DNA, 16 bp, M. musculus
gggagagcatcctaat

SEQ ID NO: 418550 - DNA, 16 bp, M. musculus
gggagagcatcctcat

SEQ ID NO: 418551 - DNA, 16 bp, M. musculus
gggagagcctgtctca

SEQ ID NO: 418552 - DNA, 16 bp, M. musculus
gggagagctggcccag

SEQ ID NO: 418553 - DNA, 16 bp, M. musculus
gggagagctgggagga

SEQ ID NO: 418554 - DNA, 21 bp, M. musculus
gggagagcttgattgcagagg

SEQ ID NO: 418555 - DNA, 16 bp, M. musculus
gggagaggaggccctt

SEQ ID NO: 418556 - DNA, 16 bp, M. musculus
gggagaggatatattt

SEQ ID NO: 418557 - DNA, 16 bp, M. musculus
gggagagggaactttt

SEQ ID NO: 418558 - DNA, 16 bp, M. musculus
gggagagggcccagcc

SEQ ID NO: 418559 - DNA, 16 bp, M. musculus
gggagagtgggccctg

SEQ ID NO: 418560 - DNA, 16 bp, M. musculus
gggagataactctgga

SEQ ID NO: 418561 - DNA, 16 bp, M. musculus
gggagatgatgtgcct

SEQ ID NO: 418562 - DNA, 16 bp, M. musculus
gggagatgcttcagtg

SEQ ID NO: 418563 - DNA, 16 bp, M. musculus
gggagatggctcagag

SEQ ID NO: 418564 - DNA, 16 bp, M. musculus
gggagcagagttgggg

SEQ ID NO: 418565 - DNA, 16 bp, M. musculus
gggagcagcagcagca

SEQ ID NO: 418566 - DNA, 16 bp, M. musculus
gggagcaggaagctga

SEQ ID NO: 418567 - DNA, 16 bp, M. musculus
gggagcagggcaggca

SEQ ID NO: 418568 - DNA, 16 bp, M. musculus
gggagcagggcagtgg

SEQ ID NO: 418569 - DNA, 16 bp, M. musculus
gggagcagggctgagg

SEQ ID NO: 418570 - DNA, 16 bp, M. musculus
gggagcagggtaggga

SEQ ID NO: 418571 - DNA, 16 bp, M. musculus
gggagcagggtgagga

SEQ ID NO: 418572 - DNA, 16 bp, M. musculus
gggagcagggtggaga

SEQ ID NO: 418573 - DNA, 17 bp, M. musculus
gggagcaggtcagggtt

SEQ ID NO: 418574 - DNA, 16 bp, M. musculus
gggagcaggtgcagag

SEQ ID NO: 418575 - DNA, 16 bp, M. musculus
gggagcatggcaaatg

SEQ ID NO: 418576 - DNA, 16 bp, M. musculus
gggagccaaggaatac

SEQ ID NO: 418577 - DNA, 16 bp, M. musculus
gggagccacagagcct

SEQ ID NO: 418578 - DNA, 16 bp, M. musculus
gggagccagaggcagg

SEQ ID NO: 418579 - DNA, 16 bp, M. musculus
gggagccagatgctgg

SEQ ID NO: 418580 - DNA, 16 bp, M. musculus
gggagccaggagggca

SEQ ID NO: 418581 - DNA, 16 bp, M. musculus
gggagccatggcctca

SEQ ID NO: 418582 - DNA, 16 bp, M. musculus
gggagccctttgcctc

SEQ ID NO: 418583 - DNA, 16 bp, M. musculus
gggagcctggcttctg

SEQ ID NO: 418584 - DNA, 16 bp, M. musculus
gggagctccaggccag

SEQ ID NO: 418585 - DNA, 16 bp, M. musculus
gggagctctggagggt

SEQ ID NO: 418586 - DNA, 16 bp, M. musculus
gggagctctggggtgg

SEQ ID NO: 418587 - DNA, 16 bp, M. musculus
gggagctcttggggta

SEQ ID NO: 418588 - DNA, 16 bp, M. musculus
gggagctgactgcctt

SEQ ID NO: 418589 - DNA, 16 bp, M. musculus
gggagctgagctcagg

SEQ ID NO: 418590 - DNA, 16 bp, M. musculus
gggagctggaacagca

SEQ ID NO: 418591 - DNA, 16 bp, M. musculus
gggagctggaggcaga

SEQ ID NO: 418592 - DNA, 16 bp, M. musculus
gggagctggagttaca

SEQ ID NO: 418593 - DNA, 16 bp, M. musculus
gggagctggctcagca

SEQ ID NO: 418594 - DNA, 16 bp, M. musculus
gggagctgggcagtgg

SEQ ID NO: 418595 - DNA, 16 bp, M. musculus
gggagcttccaggggt

SEQ ID NO: 418596 - DNA, 16 bp, M. musculus
gggaggaacaacaata

SEQ ID NO: 418597 - DNA, 16 bp, M. musculus
gggaggagagcccctt

SEQ ID NO: 418598 - DNA, 16 bp, M. musculus
gggaggagatgcagag

SEQ ID NO: 418599 - DNA, 16 bp, M. musculus
gggaggagatttacct

SEQ ID NO: 418600 - DNA, 16 bp, M. musculus
gggaggagcagcagct

SEQ ID NO: 418601 - DNA, 16 bp, M. musculus
gggaggagcctgagga

SEQ ID NO: 418602 - DNA, 16 bp, M. musculus
gggaggagcctggtgc

SEQ ID NO: 418603 - DNA, 16 bp, M. musculus
gggaggagctggaagg

SEQ ID NO: 418604 - DNA, 16 bp, M. musculus
gggaggagctggggaa

SEQ ID NO: 418605 - DNA, 16 bp, M. musculus
gggaggaggcgctcgg

SEQ ID NO: 418606 - DNA, 16 bp, M. musculus
gggaggaggtgaccag

SEQ ID NO: 418607 - DNA, 16 bp, M. musculus
gggaggaggtgactgg

SEQ ID NO: 418608 - DNA, 16 bp, M. musculus
gggaggcaaaggcaga

SEQ ID NO: 418609 - DNA, 16 bp, M. musculus
gggaggcaagcataag

SEQ ID NO: 418610 - DNA, 16 bp, M. musculus
gggaggcacaggcaga

SEQ ID NO: 418611 - DNA, 16 bp, M. musculus
gggaggcagaaacagg

SEQ ID NO: 418612 - DNA, 16 bp, M. musculus
gggaggcagaagcaag

SEQ ID NO: 418613 - DNA, 16 bp, M. musculus
gggaggcagaagcaga

SEQ ID NO: 418614 - DNA, 16 bp, M. musculus
gggaggcagacagaga

SEQ ID NO: 418615 - DNA, 16 bp, M. musculus
gggaggcagagacaaa

SEQ ID NO: 418616 - DNA, 16 bp, M. musculus
gggaggcagagacaag

SEQ ID NO: 418617 - DNA, 16 bp, M. musculus
gggaggcagagacaca

SEQ ID NO: 418618 - DNA, 16 bp, M. musculus
gggaggcagagacaga

SEQ ID NO: 418619 - DNA, 16 bp, M. musculus
gggaggcagagactgg

SEQ ID NO: 418620 - DNA, 16 bp, M. musculus
gggaggcagagatgga

SEQ ID NO: 418621 - DNA, 16 bp, M. musculus
gggaggcagagctggg

SEQ ID NO: 418622 - DNA, 16 bp, M. musculus
gggaggcagaggcaaa

SEQ ID NO: 418623 - DNA, 16 bp, M. musculus
gggaggcagaggcact

SEQ ID NO: 418624 - DNA, 16 bp, M. musculus
gggaggcagaggcagc

SEQ ID NO: 418625 - DNA, 16 bp, M. musculus
gggaggcagaggcagt

SEQ ID NO: 418626 - DNA, 16 bp, M. musculus
gggaggcagaggcatg

SEQ ID NO: 418627 - DNA, 16 bp, M. musculus
gggaggcagaggctgg

SEQ ID NO: 418628 - DNA, 16 bp, M. musculus
gggaggcagaggtagg

SEQ ID NO: 418629 - DNA, 16 bp, M. musculus
gggaggcagatgcagg

SEQ ID NO: 418630 - DNA, 16 bp, M. musculus
gggaggcaggaggatc

SEQ ID NO: 418631 - DNA, 16 bp, M. musculus
gggaggcagtggcagg

SEQ ID NO: 418632 - DNA, 16 bp, M. musculus
gggaggccctgggttc

SEQ ID NO: 418633 - DNA, 16 bp, M. musculus
gggaggcctggcagga

SEQ ID NO: 418634 - DNA, 16 bp, M. musculus
gggaggcctgtgatcc

SEQ ID NO: 418635 - DNA, 16 bp, M. musculus
gggaggcctttgcctc

SEQ ID NO: 418636 - DNA, 16 bp, M. musculus
gggaggcgacctcagc

SEQ ID NO: 418637 - DNA, 16 bp, M. musculus
gggaggctccttcctc

SEQ ID NO: 418638 - DNA, 16 bp, M. musculus
gggaggctgagacaag

SEQ ID NO: 418639 - DNA, 18 bp, M. musculus
gggaggctgagacaggaa

SEQ ID NO: 418640 - DNA, 16 bp, M. musculus
gggaggctgaggcaaa

SEQ ID NO: 418641 - DNA, 16 bp, M. musculus
gggaggctgaggcaga

SEQ ID NO: 418642 - DNA, 16 bp, M. musculus
gggaggctgaggcagg

SEQ ID NO: 418643 - DNA, 16 bp, M. musculus
gggaggctggagagga

SEQ ID NO: 418644 - DNA, 16 bp, M. musculus
gggaggctggagatgg

SEQ ID NO: 418645 - DNA, 16 bp, M. musculus
gggaggctgtgaaggg

SEQ ID NO: 418646 - DNA, 16 bp, M. musculus
gggagggaaaactgta

SEQ ID NO: 418647 - DNA, 16 bp, M. musculus
gggagggaaggacttg

SEQ ID NO: 418648 - DNA, 16 bp, M. musculus
gggagggacagagaca

SEQ ID NO: 418649 - DNA, 16 bp, M. musculus
gggagggacctggaag

SEQ ID NO: 418650 - DNA, 16 bp, M. musculus
gggagggactgtgtga

SEQ ID NO: 418651 - DNA, 16 bp, M. musculus
gggagggagagcctgt

SEQ ID NO: 418652 - DNA, 16 bp, M. musculus
gggagggagctggaga

SEQ ID NO: 418653 - DNA, 16 bp, M. musculus
gggagggcccattgtg

SEQ ID NO: 418654 - DNA, 16 bp, M. musculus
gggaggggaggctaca

SEQ ID NO: 418655 - DNA, 16 bp, M. musculus
gggaggggccagccca

SEQ ID NO: 418656 - DNA, 16 bp, M. musculus
gggagggggaagctgt

SEQ ID NO: 418657 - DNA, 16 bp, M. musculus
gggagggtccagccca

SEQ ID NO: 418658 - DNA, 16 bp, M. musculus
gggaggtaaagacagg

SEQ ID NO: 418659 - DNA, 16 bp, M. musculus
gggaggtagaaacaga

SEQ ID NO: 418660 - DNA, 16 bp, M. musculus
gggaggtagaaacagg

SEQ ID NO: 418661 - DNA, 16 bp, M. musculus
gggaggtagaagcagg

SEQ ID NO: 418662 - DNA, 16 bp, M. musculus
gggaggtagagacagg

SEQ ID NO: 418663 - DNA, 16 bp, M. musculus
gggaggtagagccagg

SEQ ID NO: 418664 - DNA, 16 bp, M. musculus
gggaggtagaggcaag

SEQ ID NO: 418665 - DNA, 16 bp, M. musculus
gggaggtagaggcaga

SEQ ID NO: 418666 - DNA, 16 bp, M. musculus
gggaggtagaggcagg

SEQ ID NO: 418667 - DNA, 16 bp, M. musculus
gggaggtagaggcagt

SEQ ID NO: 418668 - DNA, 16 bp, M. musculus
gggaggtatagggaac

SEQ ID NO: 418669 - DNA, 16 bp, M. musculus
gggaggtcccaaggcc

SEQ ID NO: 418670 - DNA, 16 bp, M. musculus
gggaggtcccagggcc

SEQ ID NO: 418671 - DNA, 16 bp, M. musculus
gggaggtctggtaggg

SEQ ID NO: 418672 - DNA, 16 bp, M. musculus
gggaggtctggtggag

SEQ ID NO: 418673 - DNA, 16 bp, M. musculus
gggaggtgagacactc

SEQ ID NO: 418674 - DNA, 16 bp, M. musculus
gggaggtgagagatgc

SEQ ID NO: 418675 - DNA, 16 bp, M. musculus
gggaggtggaagcagg

SEQ ID NO: 418676 - DNA, 16 bp, M. musculus
gggaggtggagctaag

SEQ ID NO: 418677 - DNA, 16 bp, M. musculus
gggaggtggaggcaga

SEQ ID NO: 418678 - DNA, 16 bp, M. musculus
gggaggtgtatgtgta

SEQ ID NO: 418679 - DNA, 16 bp, M. musculus
gggaggtttagaagtg

SEQ ID NO: 418680 - DNA, 16 bp, M. musculus
gggagtaatttctttt

SEQ ID NO: 418681 - DNA, 16 bp, M. musculus
gggagtagcactatta

SEQ ID NO: 418682 - DNA, 16 bp, M. musculus
gggagtatgctgcagg

SEQ ID NO: 418683 - DNA, 16 bp, M. musculus
gggagtcaaacccagg

SEQ ID NO: 418684 - DNA, 16 bp, M. musculus
gggagtcaaggcagga

SEQ ID NO: 418685 - DNA, 16 bp, M. musculus
gggagtcagtgcagtg

SEQ ID NO: 418686 - DNA, 16 bp, M. musculus
gggagtcagttctttc

SEQ ID NO: 418687 - DNA, 16 bp, M. musculus
gggagtggagcttcct

SEQ ID NO: 418688 - DNA, 16 bp, M. musculus
gggagtggatctggat

SEQ ID NO: 418689 - DNA, 16 bp, M. musculus
gggagttccagggcag

SEQ ID NO: 418690 - DNA, 16 bp, M. musculus
gggagttgaaaccttt

SEQ ID NO: 418691 - DNA, 16 bp, M. musculus
gggataaaaagcttgt

SEQ ID NO: 418692 - DNA, 16 bp, M. musculus
gggataaaactcaggt

SEQ ID NO: 418693 - DNA, 16 bp, M. musculus
gggataagcttaaatt

SEQ ID NO: 418694 - DNA, 16 bp, M. musculus
gggatacaaattggca

SEQ ID NO: 418695 - DNA, 16 bp, M. musculus
gggatacagaggcagg

SEQ ID NO: 418696 - DNA, 16 bp, M. musculus
gggatagaactcagat

SEQ ID NO: 418697 - DNA, 16 bp, M. musculus
gggatagcaaacagga

SEQ ID NO: 418698 - DNA, 17 bp, M. musculus
gggatagcattgcaaat

SEQ ID NO: 418699 - DNA, 16 bp, M. musculus
gggatatcattgaaaa

SEQ ID NO: 418700 - DNA, 16 bp, M. musculus
gggatatgaaacctga

SEQ ID NO: 418701 - DNA, 16 bp, M. musculus
gggatatggctcagtg

SEQ ID NO: 418702 - DNA, 16 bp, M. musculus
gggatcaaactcaggt

SEQ ID NO: 418703 - DNA, 16 bp, M. musculus
gggatcaaaggcgtgc

SEQ ID NO: 418704 - DNA, 16 bp, M. musculus
gggatcaaattcaagt

SEQ ID NO: 418705 - DNA, 16 bp, M. musculus
gggatcacatgtgtac

SEQ ID NO: 418706 - DNA, 16 bp, M. musculus
gggatcagcatctgtc

SEQ ID NO: 418707 - DNA, 16 bp, M. musculus
gggatcaggatgtaaa

SEQ ID NO: 418708 - DNA, 16 bp, M. musculus
gggatcattgcagaga

SEQ ID NO: 418709 - DNA, 16 bp, M. musculus
gggatccaaactcagg

SEQ ID NO: 418710 - DNA, 16 bp, M. musculus
gggatccaaaggcagg

SEQ ID NO: 418711 - DNA, 16 bp, M. musculus
gggatccaacactttc

SEQ ID NO: 418712 - DNA, 16 bp, M. musculus
gggatccaacagcctc

SEQ ID NO: 418713 - DNA, 16 bp, M. musculus
gggatccaatgccctt

SEQ ID NO: 418714 - DNA, 16 bp, M. musculus
gggatccatcccataa

SEQ ID NO: 418715 - DNA, 16 bp, M. musculus
gggatcccaggatccc

SEQ ID NO: 418716 - DNA, 16 bp, M. musculus
gggatccctgtggttg

SEQ ID NO: 418717 - DNA, 16 bp, M. musculus
gggatccgacaccctc

SEQ ID NO: 418718 - DNA, 16 bp, M. musculus
gggatcctggaaccaa

SEQ ID NO: 418719 - DNA, 16 bp, M. musculus
gggatcgaactcagat

SEQ ID NO: 418720 - DNA, 16 bp, M. musculus
gggatctagtgccctc

SEQ ID NO: 418721 - DNA, 16 bp, M. musculus
gggatctgaactcagg

SEQ ID NO: 418722 - DNA, 16 bp, M. musculus
gggatctgatgcctct

SEQ ID NO: 418723 - DNA, 16 bp, M. musculus
gggatctgggaaggaa

SEQ ID NO: 418724 - DNA, 16 bp, M. musculus
gggatcttcactctct

SEQ ID NO: 418725 - DNA, 16 bp, M. musculus
gggatgaagagatgaa

SEQ ID NO: 418726 - DNA, 16 bp, M. musculus
gggatgaagcctattt

SEQ ID NO: 418727 - DNA, 16 bp, M. musculus
gggatgagctggccaa

SEQ ID NO: 418728 - DNA, 16 bp, M. musculus
gggatgaggaactgtt

SEQ ID NO: 418729 - DNA, 16 bp, M. musculus
gggatgatttaatata

SEQ ID NO: 418730 - DNA, 16 bp, M. musculus
gggatgcagaggcagg

SEQ ID NO: 418731 - DNA, 16 bp, M. musculus
gggatgctagagtggt

SEQ ID NO: 418732 - DNA, 16 bp, M. musculus
gggatgctgaacattt

SEQ ID NO: 418733 - DNA, 16 bp, M. musculus
gggatgctgggaaaac

SEQ ID NO: 418734 - DNA, 16 bp, M. musculus
gggatggaacccagag

SEQ ID NO: 418735 - DNA, 16 bp, M. musculus
gggatggaaccctgga

SEQ ID NO: 418736 - DNA, 16 bp, M. musculus
gggatggacccccagg

SEQ ID NO: 418737 - DNA, 16 bp, M. musculus
gggatggacccctggg

SEQ ID NO: 418738 - DNA, 16 bp, M. musculus
gggatggactgaagga

SEQ ID NO: 418739 - DNA, 16 bp, M. musculus
gggatggagaacacca

SEQ ID NO: 418740 - DNA, 16 bp, M. musculus
gggatggagcagaaac

SEQ ID NO: 418741 - DNA, 16 bp, M. musculus
gggatggatacccagg

SEQ ID NO: 418742 - DNA, 16 bp, M. musculus
gggatggcaatcccat

SEQ ID NO: 418743 - DNA, 16 bp, M. musculus
gggatggcaccaccac

SEQ ID NO: 418744 - DNA, 16 bp, M. musculus
gggatggcaccaccta

SEQ ID NO: 418745 - DNA, 16 bp, M. musculus
gggatggctccaccca

SEQ ID NO: 418746 - DNA, 16 bp, M. musculus
gggatgggaaactggg

SEQ ID NO: 418747 - DNA, 16 bp, M. musculus
gggatgggaaccccac

SEQ ID NO: 418748 - DNA, 16 bp, M. musculus
gggatgggacccaggg

SEQ ID NO: 418749 - DNA, 16 bp, M. musculus
gggatgggagaggctc

SEQ ID NO: 418750 - DNA, 16 bp, M. musculus
gggatgggcctcccct

SEQ ID NO: 418751 - DNA, 16 bp, M. musculus
gggatggggaactgtg

SEQ ID NO: 418752 - DNA, 16 bp, M. musculus
gggatggggaaggctc

SEQ ID NO: 418753 - DNA, 16 bp, M. musculus
gggatggtgatttccc

SEQ ID NO: 418754 - DNA, 16 bp, M. musculus
gggatgtggagacagg

SEQ ID NO: 418755 - DNA, 16 bp, M. musculus
gggatgtgtctcaagt

SEQ ID NO: 418756 - DNA, 16 bp, M. musculus
gggattaaaaatgtgc

SEQ ID NO: 418757 - DNA, 16 bp, M. musculus
gggattaaaagtgtgt

SEQ ID NO: 418758 - DNA, 16 bp, M. musculus
gggattaaactcaggt

SEQ ID NO: 418759 - DNA, 16 bp, M. musculus
gggattaaagacattt

SEQ ID NO: 418760 - DNA, 16 bp, M. musculus
gggattaaaggcacac

SEQ ID NO: 418761 - DNA, 16 bp, M. musculus
gggattaaaggcctat

SEQ ID NO: 418762 - DNA, 24 bp, M. musculus
gggattaaaggcgtgcgccaccaa

SEQ ID NO: 418763 - DNA, 16 bp, M. musculus
gggattaaaggctgca

SEQ ID NO: 418764 - DNA, 16 bp, M. musculus
gggattaaagtcatgc

SEQ ID NO: 418765 - DNA, 16 bp, M. musculus
gggattaaagtcatgt

SEQ ID NO: 418766 - DNA, 16 bp, M. musculus
gggattacagatatga

SEQ ID NO: 418767 - DNA, 16 bp, M. musculus
gggattacaggtgggc

SEQ ID NO: 418768 - DNA, 16 bp, M. musculus
gggattacaggtgtaa

SEQ ID NO: 418769 - DNA, 16 bp, M. musculus
gggattatagcagaga

SEQ ID NO: 418770 - DNA, 16 bp, M. musculus
gggattcagctcaagg

SEQ ID NO: 418771 - DNA, 16 bp, M. musculus
gggattcccccccccc

SEQ ID NO: 418772 - DNA, 16 bp, M. musculus
gggattctgtctcaaa

SEQ ID NO: 418773 - DNA, 16 bp, M. musculus
gggattgaaaccaggg

SEQ ID NO: 418774 - DNA, 16 bp, M. musculus
gggattgaactcagct

SEQ ID NO: 418775 - DNA, 16 bp, M. musculus
gggattgaactcaggc

SEQ ID NO: 418776 - DNA, 16 bp, M. musculus
gggattgaactcatgt

SEQ ID NO: 418777 - DNA, 16 bp, M. musculus
gggattgaattcaggt

SEQ ID NO: 418778 - DNA, 16 bp, M. musculus
gggattgacttttaat

SEQ ID NO: 418779 - DNA, 16 bp, M. musculus
gggattgcagatgtga

SEQ ID NO: 418780 - DNA, 16 bp, M. musculus
gggattgcaggtgtga

SEQ ID NO: 418781 - DNA, 16 bp, M. musculus
gggattgcttccagat

SEQ ID NO: 418782 - DNA, 16 bp, M. musculus
gggatttccatgggac

SEQ ID NO: 418783 - DNA, 16 bp, M. musculus
gggatttcctgaagct

SEQ ID NO: 418784 - DNA, 16 bp, M. musculus
gggatttctgagttca

SEQ ID NO: 418785 - DNA, 16 bp, M. musculus
gggatttctgagttcg

SEQ ID NO: 418786 - DNA, 16 bp, M. musculus
gggatttctttttaaa

SEQ ID NO: 418787 - DNA, 16 bp, M. musculus
gggatttgaactcatg

SEQ ID NO: 418788 - DNA, 16 bp, M. musculus
gggatttgaacttagg

SEQ ID NO: 418789 - DNA, 16 bp, M. musculus
gggatttgcccttgga

SEQ ID NO: 418790 - DNA, 16 bp, M. musculus
gggattttcagagaga

SEQ ID NO: 418791 - DNA, 16 bp, M. musculus
gggattttcgggatag

SEQ ID NO: 418792 - DNA, 16 bp, M. musculus
gggcaaaagatactgt

SEQ ID NO: 418793 - DNA, 16 bp, M. musculus
gggcaaagcgtccaca

SEQ ID NO: 418794 - DNA, 16 bp, M. musculus
gggcaaagggcaaagg

SEQ ID NO: 418795 - DNA, 16 bp, M. musculus
gggcaaccaggccttg

SEQ ID NO: 418796 - DNA, 16 bp, M. musculus
gggcaaggaaccccgg

SEQ ID NO: 418797 - DNA, 16 bp, M. musculus
gggcaaggcagggcag

SEQ ID NO: 418798 - DNA, 16 bp, M. musculus
gggcaagggagagatg

SEQ ID NO: 418799 - DNA, 16 bp, M. musculus
gggcaagggcaagggc

SEQ ID NO: 418800 - DNA, 16 bp, M. musculus
gggcacaatgaaaaga

SEQ ID NO: 418801 - DNA, 16 bp, M. musculus
gggcacacacctttaa

SEQ ID NO: 418802 - DNA, 16 bp, M. musculus
gggcacagccagcaga

SEQ ID NO: 418803 - DNA, 16 bp, M. musculus
gggcacagggaaaaaa

SEQ ID NO: 418804 - DNA, 16 bp, M. musculus
gggcacagggggaaaa

SEQ ID NO: 418805 - DNA, 16 bp, M. musculus
gggcacaggtggaaaa

SEQ ID NO: 418806 - DNA, 16 bp, M. musculus
gggcacagtgacagca

SEQ ID NO: 418807 - DNA, 16 bp, M. musculus
gggcaccaggaacaca

SEQ ID NO: 418808 - DNA, 16 bp, M. musculus
gggcaccaggcacaca

SEQ ID NO: 418809 - DNA, 16 bp, M. musculus
gggcaccaggcatgca

SEQ ID NO: 418810 - DNA, 16 bp, M. musculus
gggcaccatcctgagt

SEQ ID NO: 418811 - DNA, 16 bp, M. musculus
gggcaccatcttgggg

SEQ ID NO: 418812 - DNA, 16 bp, M. musculus
gggcaccccaacacac

SEQ ID NO: 418813 - DNA, 16 bp, M. musculus
gggcacctacattcat

SEQ ID NO: 418814 - DNA, 16 bp, M. musculus
gggcacgccagggcca

SEQ ID NO: 418815 - DNA, 16 bp, M. musculus
gggcacgtgtgtgtgt

SEQ ID NO: 418816 - DNA, 16 bp, M. musculus
gggcactctgcatctt

SEQ ID NO: 418817 - DNA, 16 bp, M. musculus
gggcacttgggaggca

SEQ ID NO: 418818 - DNA, 16 bp, M. musculus
gggcagaaagcagcca

SEQ ID NO: 418819 - DNA, 16 bp, M. musculus
gggcagaaagttctgg

SEQ ID NO: 418820 - DNA, 17 bp, M. musculus
gggcagaacttcgggca

SEQ ID NO: 418821 - DNA, 16 bp, M. musculus
gggcagaacttgagca

SEQ ID NO: 418822 - DNA, 16 bp, M. musculus
gggcagaagctgctga

SEQ ID NO: 418823 - DNA, 16 bp, M. musculus
gggcagaatcagaacc

SEQ ID NO: 418824 - DNA, 16 bp, M. musculus
gggcagagaaagaaat

SEQ ID NO: 418825 - DNA, 16 bp, M. musculus
gggcagagaaggacag

SEQ ID NO: 418826 - DNA, 16 bp, M. musculus
gggcagagacaggcag

SEQ ID NO: 418827 - DNA, 16 bp, M. musculus
gggcagagaggtggag

SEQ ID NO: 418828 - DNA, 16 bp, M. musculus
gggcagagagtagctg

SEQ ID NO: 418829 - DNA, 16 bp, M. musculus
gggcagagccagagaa

SEQ ID NO: 418830 - DNA, 16 bp, M. musculus
gggcagagcttgagca

SEQ ID NO: 418831 - DNA, 16 bp, M. musculus
gggcagaggagatcga

SEQ ID NO: 418832 - DNA, 16 bp, M. musculus
gggcagaggcagatgg

SEQ ID NO: 418833 - DNA, 16 bp, M. musculus
gggcagagtacttctg

SEQ ID NO: 418834 - DNA, 16 bp, M. musculus
gggcagagttcttcag

SEQ ID NO: 418835 - DNA, 16 bp, M. musculus
gggcagatggctcagt

SEQ ID NO: 418836 - DNA, 16 bp, M. musculus
gggcagattttctgca

SEQ ID NO: 418837 - DNA, 16 bp, M. musculus
gggcagcaagatggct

SEQ ID NO: 418838 - DNA, 16 bp, M. musculus
gggcagcaagtgcttt

SEQ ID NO: 418839 - DNA, 16 bp, M. musculus
gggcagcagaggcagg

SEQ ID NO: 418840 - DNA, 16 bp, M. musculus
gggcagcagaggctgg

SEQ ID NO: 418841 - DNA, 16 bp, M. musculus
gggcagcagcagcagc

SEQ ID NO: 418842 - DNA, 16 bp, M. musculus
gggcagcaggcagcag

SEQ ID NO: 418843 - DNA, 16 bp, M. musculus
gggcagcatcctgagt

SEQ ID NO: 418844 - DNA, 16 bp, M. musculus
gggcagccagagctac

SEQ ID NO: 418845 - DNA, 16 bp, M. musculus
gggcagccaggaggag

SEQ ID NO: 418846 - DNA, 16 bp, M. musculus
gggcagccagggctgc

SEQ ID NO: 418847 - DNA, 16 bp, M. musculus
gggcagctcacagcca

SEQ ID NO: 418848 - DNA, 16 bp, M. musculus
gggcagctctcctgct

SEQ ID NO: 418849 - DNA, 16 bp, M. musculus
gggcagctgaggcagg

SEQ ID NO: 418850 - DNA, 16 bp, M. musculus
gggcagctgcaggtgg

SEQ ID NO: 418851 - DNA, 16 bp, M. musculus
gggcagctgcttctgt

SEQ ID NO: 418852 - DNA, 16 bp, M. musculus
gggcaggaaactggag

SEQ ID NO: 418853 - DNA, 16 bp, M. musculus
gggcaggaaatggaat

SEQ ID NO: 418854 - DNA, 16 bp, M. musculus
gggcaggaacctgaag

SEQ ID NO: 418855 - DNA, 16 bp, M. musculus
gggcaggaactgtgtc

SEQ ID NO: 418856 - DNA, 16 bp, M. musculus
gggcaggaagtgggag

SEQ ID NO: 418857 - DNA, 16 bp, M. musculus
gggcaggagctgaagc

SEQ ID NO: 418858 - DNA, 16 bp, M. musculus
gggcaggaggatcagg

SEQ ID NO: 418859 - DNA, 16 bp, M. musculus
gggcaggcagaggcag

SEQ ID NO: 418860 - DNA, 16 bp, M. musculus
gggcaggcaggcaggc

SEQ ID NO: 418861 - DNA, 16 bp, M. musculus
gggcaggcctgaggtt

SEQ ID NO: 418862 - DNA, 21 bp, M. musculus
gggcagggaaagtacaagttt

SEQ ID NO: 418863 - DNA, 16 bp, M. musculus
gggcagggaggctgga

SEQ ID NO: 418864 - DNA, 16 bp, M. musculus
gggcagggcagggcac

SEQ ID NO: 418865 - DNA, 16 bp, M. musculus
gggcaggggtctccaa

SEQ ID NO: 418866 - DNA, 16 bp, M. musculus
gggcagggtgagggta

SEQ ID NO: 418867 - DNA, 16 bp, M. musculus
gggcagtagtggcaca

SEQ ID NO: 418868 - DNA, 16 bp, M. musculus
gggcagtctctgctcc

SEQ ID NO: 418869 - DNA, 16 bp, M. musculus
gggcagtctctggttg

SEQ ID NO: 418870 - DNA, 16 bp, M. musculus
gggcagtctcttgatg

SEQ ID NO: 418871 - DNA, 16 bp, M. musculus
gggcagtctgcaggcc

SEQ ID NO: 418872 - DNA, 16 bp, M. musculus
gggcagtctgtggatg

SEQ ID NO: 418873 - DNA, 16 bp, M. musculus
gggcagtgagatggct

SEQ ID NO: 418874 - DNA, 16 bp, M. musculus
gggcagtgagtgggat

SEQ ID NO: 418875 - DNA, 16 bp, M. musculus
gggcagtgatggtgca

SEQ ID NO: 418876 - DNA, 16 bp, M. musculus
gggcagtggaaatgca

SEQ ID NO: 418877 - DNA, 16 bp, M. musculus
gggcagtggcagcaca

SEQ ID NO: 418878 - DNA, 16 bp, M. musculus
gggcagtgggcatggg

SEQ ID NO: 418879 - DNA, 16 bp, M. musculus
gggcagtggtagtgca

SEQ ID NO: 418880 - DNA, 16 bp, M. musculus
gggcagtggtgctgca

SEQ ID NO: 418881 - DNA, 16 bp, M. musculus
gggcagtggtggcaca

SEQ ID NO: 418882 - DNA, 18 bp, M. musculus
gggcagtggtggcgcatg

SEQ ID NO: 418883 - DNA, 16 bp, M. musculus
gggcagtggtggtgta

SEQ ID NO: 418884 - DNA, 16 bp, M. musculus
gggcatcaagacttca

SEQ ID NO: 418885 - DNA, 16 bp, M. musculus
gggcatcagattcctg

SEQ ID NO: 418886 - DNA, 16 bp, M. musculus
gggcatcaggcatgca

SEQ ID NO: 418887 - DNA, 16 bp, M. musculus
gggcatcatgctgagt

SEQ ID NO: 418888 - DNA, 16 bp, M. musculus
gggcatctccttcttt

SEQ ID NO: 418889 - DNA, 16 bp, M. musculus
gggcatctgcacacac

SEQ ID NO: 418890 - DNA, 16 bp, M. musculus
gggcatggctgtgggg

SEQ ID NO: 418891 - DNA, 16 bp, M. musculus
gggcatggggaaggga

SEQ ID NO: 418892 - DNA, 16 bp, M. musculus
gggcatggtggcccat

SEQ ID NO: 418893 - DNA, 16 bp, M. musculus
gggcatggtggctcag

SEQ ID NO: 418894 - DNA, 17 bp, M. musculus
gggcatggtggtgcata

SEQ ID NO: 418895 - DNA, 16 bp, M. musculus
gggcattgctgcaggg

SEQ ID NO: 418896 - DNA, 16 bp, M. musculus
gggcattggatcccat

SEQ ID NO: 418897 - DNA, 16 bp, M. musculus
gggcattggtggcaca

SEQ ID NO: 418898 - DNA, 16 bp, M. musculus
gggcatttgctgctct

SEQ ID NO: 418899 - DNA, 16 bp, M. musculus
gggccaaaaaaatgag

SEQ ID NO: 418900 - DNA, 16 bp, M. musculus
gggccaaagggagaag

SEQ ID NO: 418901 - DNA, 16 bp, M. musculus
gggccaaccattcaaa

SEQ ID NO: 418902 - DNA, 16 bp, M. musculus
gggccaagcagcccct

SEQ ID NO: 418903 - DNA, 16 bp, M. musculus
gggccacacagtgaga

SEQ ID NO: 418904 - DNA, 16 bp, M. musculus
gggccacagcctgtgg

SEQ ID NO: 418905 - DNA, 16 bp, M. musculus
gggccaccatgcccag

SEQ ID NO: 418906 - DNA, 16 bp, M. musculus
gggccacctccaggaa

SEQ ID NO: 418907 - DNA, 16 bp, M. musculus
gggccagaaagatggc

SEQ ID NO: 418908 - DNA, 16 bp, M. musculus
gggccagaaagtggga

SEQ ID NO: 418909 - DNA, 16 bp, M. musculus
gggccagaagaggaca

SEQ ID NO: 418910 - DNA, 16 bp, M. musculus
gggccagaagagggca

SEQ ID NO: 418911 - DNA, 16 bp, M. musculus
gggccagagcgagcag

SEQ ID NO: 418912 - DNA, 16 bp, M. musculus
gggccagagggccagg

SEQ ID NO: 418913 - DNA, 16 bp, M. musculus
gggccagcagaaagaa

SEQ ID NO: 418914 - DNA, 16 bp, M. musculus
gggccagcaggaacag

SEQ ID NO: 418915 - DNA, 17 bp, M. musculus
gggccagcctaggctac

SEQ ID NO: 418916 - DNA, 16 bp, M. musculus
gggccagcctgggcta

SEQ ID NO: 418917 - DNA, 16 bp, M. musculus
gggccaggaagatggc

SEQ ID NO: 418918 - DNA, 18 bp, M. musculus
gggccaggaaggccagaa

SEQ ID NO: 418919 - DNA, 16 bp, M. musculus
gggccaggaggtggga

SEQ ID NO: 418920 - DNA, 16 bp, M. musculus
gggccaggcgtggtgg

SEQ ID NO: 418921 - DNA, 16 bp, M. musculus
gggccagggaccatgg

SEQ ID NO: 418922 - DNA, 16 bp, M. musculus
gggccagggagtggca

SEQ ID NO: 418923 - DNA, 16 bp, M. musculus
gggccaggtggtggtg

SEQ ID NO: 418924 - DNA, 16 bp, M. musculus
gggccagtgagatgac

SEQ ID NO: 418925 - DNA, 16 bp, M. musculus
gggccagttctcctgc

SEQ ID NO: 418926 - DNA, 33 bp, M. musculus
gggccatagtaagatcatggccagtacctttac

SEQ ID NO: 418927 - DNA, 51 bp, M. musculus
gggccatagtaagatcatggccagtacctttaccggtacattccaattctt

SEQ ID NO: 418928 - DNA, 17 bp, M. musculus
gggccatcactggaaag

SEQ ID NO: 418929 - DNA, 16 bp, M. musculus
gggccatctactggag

SEQ ID NO: 418930 - DNA, 16 bp, M. musculus
gggccatgaagtggga

SEQ ID NO: 418931 - DNA, 16 bp, M. musculus
gggccatgccttctgc

SEQ ID NO: 418932 - DNA, 16 bp, M. musculus
gggccatggtccagat

SEQ ID NO: 418933 - DNA, 16 bp, M. musculus
gggccatggtggtgca

SEQ ID NO: 418934 - DNA, 16 bp, M. musculus
gggccatgtctgagtc

SEQ ID NO: 418935 - DNA, 16 bp, M. musculus
gggccattcccccttg

SEQ ID NO: 418936 - DNA, 16 bp, M. musculus
gggccattgctgtttt

SEQ ID NO: 418937 - DNA, 38 bp, M. musculus
gggcccaacaaggtccttatagaacagggccccccagt

SEQ ID NO: 418938 - DNA, 16 bp, M. musculus
gggcccacaatggaga

SEQ ID NO: 418939 - DNA, 16 bp, M. musculus
gggcccacagagactg

SEQ ID NO: 418940 - DNA, 16 bp, M. musculus
gggcccatggtgggtg

SEQ ID NO: 418941 - DNA, 16 bp, M. musculus
gggcccatgttctcag

SEQ ID NO: 418942 - DNA, 16 bp, M. musculus
gggccccagacagctg

SEQ ID NO: 418943 - DNA, 16 bp, M. musculus
gggccccagggccaca

SEQ ID NO: 418944 - DNA, 16 bp, M. musculus
gggccccatgttccat

SEQ ID NO: 418945 - DNA, 16 bp, M. musculus
gggcccccaatggggg

SEQ ID NO: 418946 - DNA, 16 bp, M. musculus
gggcccccactggagg

SEQ ID NO: 418947 - DNA, 29 bp, M. musculus
gggcccctattgggactcctattattgat

SEQ ID NO: 418948 - DNA, 16 bp, M. musculus
gggcccctccatgtgt

SEQ ID NO: 418949 - DNA, 16 bp, M. musculus
gggccctccccctttg

SEQ ID NO: 418950 - DNA, 16 bp, M. musculus
gggccctcctgctgtg

SEQ ID NO: 418951 - DNA, 16 bp, M. musculus
gggccctgtgttccat

SEQ ID NO: 418952 - DNA, 16 bp, M. musculus
gggccgagtggaaagc

SEQ ID NO: 418953 - DNA, 16 bp, M. musculus
gggccgatgtaacgat

SEQ ID NO: 418954 - DNA, 16 bp, M. musculus
gggccgggcagtggtg

SEQ ID NO: 418955 - DNA, 16 bp, M. musculus
gggccggggagatggc

SEQ ID NO: 418956 - DNA, 40 bp, M. musculus
gggcctagcaaacacagaagtggatgatcacagtcagcta

SEQ ID NO: 418957 - DNA, 16 bp, M. musculus
gggcctagcagacaca

SEQ ID NO: 418958 - DNA, 16 bp, M. musculus
gggcctcaaatcagct

SEQ ID NO: 418959 - DNA, 16 bp, M. musculus
gggcctcagtttccct

SEQ ID NO: 418960 - DNA, 16 bp, M. musculus
gggcctcagtttcctc

SEQ ID NO: 418961 - DNA, 16 bp, M. musculus
gggcctcatgcttgct

SEQ ID NO: 418962 - DNA, 16 bp, M. musculus
gggcctcatgtcagct

SEQ ID NO: 418963 - DNA, 16 bp, M. musculus
gggcctcccttcccac

SEQ ID NO: 418964 - DNA, 16 bp, M. musculus
gggcctccctttccac

SEQ ID NO: 418965 - DNA, 16 bp, M. musculus
gggcctcctacatcaa

SEQ ID NO: 418966 - DNA, 16 bp, M. musculus
gggcctcctcacagag

SEQ ID NO: 418967 - DNA, 16 bp, M. musculus
gggcctcctcccccag

SEQ ID NO: 418968 - DNA, 16 bp, M. musculus
gggcctctcctccaaa

SEQ ID NO: 418969 - DNA, 16 bp, M. musculus
gggcctctccttctat

SEQ ID NO: 418970 - DNA, 16 bp, M. musculus
gggcctcttttcccat

SEQ ID NO: 418971 - DNA, 16 bp, M. musculus
gggcctgaagagatgg

SEQ ID NO: 418972 - DNA, 16 bp, M. musculus
gggcctgcctgcctgc

SEQ ID NO: 418973 - DNA, 16 bp, M. musculus
gggcctgccttagaag

SEQ ID NO: 418974 - DNA, 16 bp, M. musculus
gggcctggagagacag

SEQ ID NO: 418975 - DNA, 16 bp, M. musculus
gggcctggagttacag

SEQ ID NO: 418976 - DNA, 16 bp, M. musculus
gggcctgtgccagcag

SEQ ID NO: 418977 - DNA, 16 bp, M. musculus
gggcctgttgctggaa

SEQ ID NO: 418978 - DNA, 16 bp, M. musculus
gggccttgaattccct

SEQ ID NO: 418979 - DNA, 16 bp, M. musculus
gggcctttacctgctg

SEQ ID NO: 418980 - DNA, 16 bp, M. musculus
gggcctttctcagaag

SEQ ID NO: 418981 - DNA, 16 bp, M. musculus
gggcgagtctgctggc

SEQ ID NO: 418982 - DNA, 16 bp, M. musculus
gggcggctgcaggtgg

SEQ ID NO: 418983 - DNA, 16 bp, M. musculus
gggcggggcagacacc

SEQ ID NO: 418984 - DNA, 16 bp, M. musculus
gggcggtggtggccca

SEQ ID NO: 418985 - DNA, 16 bp, M. musculus
gggcgtagtggtgcac

SEQ ID NO: 418986 - DNA, 16 bp, M. musculus
gggcgtggtagcgcac

SEQ ID NO: 418987 - DNA, 16 bp, M. musculus
gggcgtggtagtgcac

SEQ ID NO: 418988 - DNA, 16 bp, M. musculus
gggcgtggtggcacac

SEQ ID NO: 418989 - DNA, 16 bp, M. musculus
gggcgtggtggcgcac

SEQ ID NO: 418990 - DNA, 16 bp, M. musculus
gggcgtggtggtgcac

SEQ ID NO: 418991 - DNA, 16 bp, M. musculus
gggctacacagaaaga

SEQ ID NO: 418992 - DNA, 16 bp, M. musculus
gggctacacagagaag

SEQ ID NO: 418993 - DNA, 16 bp, M. musculus
gggctacacagagaat

SEQ ID NO: 418994 - DNA, 16 bp, M. musculus
gggctacacagagaga

SEQ ID NO: 418995 - DNA, 16 bp, M. musculus
gggctacacagaggaa

SEQ ID NO: 418996 - DNA, 16 bp, M. musculus
gggctacactgggatc

SEQ ID NO: 418997 - DNA, 16 bp, M. musculus
gggctacagagaaact

SEQ ID NO: 418998 - DNA, 16 bp, M. musculus
gggctacatagcaaga

SEQ ID NO: 418999 - DNA, 16 bp, M. musculus
gggctagaacccaggg

SEQ ID NO: 419000 - DNA, 16 bp, M. musculus
gggctagcaagatggc

SEQ ID NO: 419001 - DNA, 16 bp, M. musculus
gggctagtgagatggc

SEQ ID NO: 419002 - DNA, 16 bp, M. musculus
gggctatacaaaaaaa

SEQ ID NO: 419003 - DNA, 16 bp, M. musculus
gggctatgtagtgaga

SEQ ID NO: 419004 - DNA, 18 bp, M. musculus
gggctatttgacataaat

SEQ ID NO: 419005 - DNA, 16 bp, M. musculus
gggctcacaaagactg

SEQ ID NO: 419006 - DNA, 16 bp, M. musculus
gggctcagtggttaag

SEQ ID NO: 419007 - DNA, 16 bp, M. musculus
gggctccctggccagc

SEQ ID NO: 419008 - DNA, 16 bp, M. musculus
gggctcctccaaagag

SEQ ID NO: 419009 - DNA, 16 bp, M. musculus
gggctctcccactgag

SEQ ID NO: 419010 - DNA, 16 bp, M. musculus
gggctctctggccagc

SEQ ID NO: 419011 - DNA, 16 bp, M. musculus
gggctctgacaccctc

SEQ ID NO: 419012 - DNA, 16 bp, M. musculus
gggctctgaccctggg

SEQ ID NO: 419013 - DNA, 16 bp, M. musculus
gggctctgacctccag

SEQ ID NO: 419014 - DNA, 16 bp, M. musculus
gggctctgggcagccc

SEQ ID NO: 419015 - DNA, 16 bp, M. musculus
gggctcttacccactg

SEQ ID NO: 419016 - DNA, 22 bp, M. musculus
gggctgaagaatcagctgtgat

SEQ ID NO: 419017 - DNA, 16 bp, M. musculus
gggctgaagcaggagg

SEQ ID NO: 419018 - DNA, 16 bp, M. musculus
gggctgaaggagctga

SEQ ID NO: 419019 - DNA, 16 bp, M. musculus
gggctgaccagctcag

SEQ ID NO: 419020 - DNA, 16 bp, M. musculus
gggctgaccatttgct

SEQ ID NO: 419021 - DNA, 16 bp, M. musculus
gggctgactctgactc

SEQ ID NO: 419022 - DNA, 16 bp, M. musculus
gggctgagccacacca

SEQ ID NO: 419023 - DNA, 16 bp, M. musculus
gggctgaggagacagc

SEQ ID NO: 419024 - DNA, 16 bp, M. musculus
gggctgaggatgtggc

SEQ ID NO: 419025 - DNA, 16 bp, M. musculus
gggctgaggctggggc

SEQ ID NO: 419026 - DNA, 16 bp, M. musculus
gggctgagtggaaaga

SEQ ID NO: 419027 - DNA, 16 bp, M. musculus
gggctgagtggaaagc

SEQ ID NO: 419028 - DNA, 16 bp, M. musculus
gggctgattggcagag

SEQ ID NO: 419029 - DNA, 16 bp, M. musculus
gggctgcagagctggc

SEQ ID NO: 419030 - DNA, 16 bp, M. musculus
gggctgcagcaaggag

SEQ ID NO: 419031 - DNA, 16 bp, M. musculus
gggctgcatagagaaa

SEQ ID NO: 419032 - DNA, 16 bp, M. musculus
gggctgcatggaaagc

SEQ ID NO: 419033 - DNA, 16 bp, M. musculus
gggctgccccttgtcc

SEQ ID NO: 419034 - DNA, 16 bp, M. musculus
gggctgcctgggacag

SEQ ID NO: 419035 - DNA, 17 bp, M. musculus
gggctgctgctgctgct

SEQ ID NO: 419036 - DNA, 16 bp, M. musculus
gggctgcttggcccca

SEQ ID NO: 419037 - DNA, 16 bp, M. musculus
gggctggaaactgttg

SEQ ID NO: 419038 - DNA, 16 bp, M. musculus
gggctggaaagaaggc

SEQ ID NO: 419039 - DNA, 16 bp, M. musculus
gggctggaaagagggc

SEQ ID NO: 419040 - DNA, 16 bp, M. musculus
gggctggaaaggtggc

SEQ ID NO: 419041 - DNA, 16 bp, M. musculus
gggctggaaggaagaa

SEQ ID NO: 419042 - DNA, 18 bp, M. musculus
gggctggaatttgtgttc

SEQ ID NO: 419043 - DNA, 16 bp, M. musculus
gggctggacctaggtc

SEQ ID NO: 419044 - DNA, 16 bp, M. musculus
gggctggacctagtcc

SEQ ID NO: 419045 - DNA, 16 bp, M. musculus
gggctggagaaagggc

SEQ ID NO: 419046 - DNA, 16 bp, M. musculus
gggctggagaatggct

SEQ ID NO: 419047 - DNA, 16 bp, M. musculus
gggctggagagagggc

SEQ ID NO: 419048 - DNA, 16 bp, M. musculus
gggctggagagatgct

SEQ ID NO: 419049 - DNA, 16 bp, M. musculus
gggctggagagatggt

SEQ ID NO: 419050 - DNA, 16 bp, M. musculus
gggctggagaggcagc

SEQ ID NO: 419051 - DNA, 16 bp, M. musculus
gggctggagagggctc

SEQ ID NO: 419052 - DNA, 16 bp, M. musculus
gggctggagagttggc

SEQ ID NO: 419053 - DNA, 16 bp, M. musculus
gggctggaggaatggc

SEQ ID NO: 419054 - DNA, 16 bp, M. musculus
gggctggaggagctga

SEQ ID NO: 419055 - DNA, 16 bp, M. musculus
gggctggagggagcag

SEQ ID NO: 419056 - DNA, 16 bp, M. musculus
gggctggagtgatggc

SEQ ID NO: 419057 - DNA, 16 bp, M. musculus
gggctggatccctgga

SEQ ID NO: 419058 - DNA, 16 bp, M. musculus
gggctggcaggatggc

SEQ ID NO: 419059 - DNA, 16 bp, M. musculus
gggctggccatttggt

SEQ ID NO: 419060 - DNA, 16 bp, M. musculus
gggctggccccgacct

SEQ ID NO: 419061 - DNA, 16 bp, M. musculus
gggctggcctcaaact

SEQ ID NO: 419062 - DNA, 16 bp, M. musculus
gggctggcgagatagc

SEQ ID NO: 419063 - DNA, 16 bp, M. musculus
gggctggctggctggc

SEQ ID NO: 419064 - DNA, 16 bp, M. musculus
gggctgggaaatggct

SEQ ID NO: 419065 - DNA, 16 bp, M. musculus
gggctgggaagatggc

SEQ ID NO: 419066 - DNA, 16 bp, M. musculus
gggctgggaaggtggc

SEQ ID NO: 419067 - DNA, 16 bp, M. musculus
gggctgggagagagaa

SEQ ID NO: 419068 - DNA, 16 bp, M. musculus
gggctgggagtgtggc

SEQ ID NO: 419069 - DNA, 16 bp, M. musculus
gggctgggatcacagg

SEQ ID NO: 419070 - DNA, 16 bp, M. musculus
gggctgggatgtggct

SEQ ID NO: 419071 - DNA, 16 bp, M. musculus
gggctgggattaaagg

SEQ ID NO: 419072 - DNA, 16 bp, M. musculus
gggctgggcagatggc

SEQ ID NO: 419073 - DNA, 16 bp, M. musculus
gggctgggctgagctg

SEQ ID NO: 419074 - DNA, 16 bp, M. musculus
gggctgggctgtggct

SEQ ID NO: 419075 - DNA, 16 bp, M. musculus
gggctgggcttcccct

SEQ ID NO: 419076 - DNA, 16 bp, M. musculus
gggctggggagaagag

SEQ ID NO: 419077 - DNA, 16 bp, M. musculus
gggctggggcatggct

SEQ ID NO: 419078 - DNA, 16 bp, M. musculus
gggctggggctgaggc

SEQ ID NO: 419079 - DNA, 16 bp, M. musculus
gggctggggtggagct

SEQ ID NO: 419080 - DNA, 17 bp, M. musculus
gggctggtgacatggct

SEQ ID NO: 419081 - DNA, 20 bp, M. musculus
gggctggtgagatggctcag

SEQ ID NO: 419082 - DNA, 16 bp, M. musculus
gggctggtgagatgtc

SEQ ID NO: 419083 - DNA, 16 bp, M. musculus
gggctggtgaggtggc

SEQ ID NO: 419084 - DNA, 16 bp, M. musculus
gggctggtgggatggc

SEQ ID NO: 419085 - DNA, 16 bp, M. musculus
gggctggtggtcctag

SEQ ID NO: 419086 - DNA, 16 bp, M. musculus
gggctggtgttcctgg

SEQ ID NO: 419087 - DNA, 16 bp, M. musculus
gggctgtcctggaact

SEQ ID NO: 419088 - DNA, 16 bp, M. musculus
gggctgtgaggcagga

SEQ ID NO: 419089 - DNA, 16 bp, M. musculus
gggctgtgagtgagga

SEQ ID NO: 419090 - DNA, 16 bp, M. musculus
gggctgtgcacagaca

SEQ ID NO: 419091 - DNA, 16 bp, M. musculus
gggctgtggagatggc

SEQ ID NO: 419092 - DNA, 16 bp, M. musculus
gggctgtgggcaagcc

SEQ ID NO: 419093 - DNA, 16 bp, M. musculus
gggctgtgtaagaaag

SEQ ID NO: 419094 - DNA, 16 bp, M. musculus
gggctgtgtgcatgct

SEQ ID NO: 419095 - DNA, 16 bp, M. musculus
gggctgtgttcttgtg

SEQ ID NO: 419096 - DNA, 16 bp, M. musculus
gggctgttcttccaga

SEQ ID NO: 419097 - DNA, 16 bp, M. musculus
gggctgttgagaaagg

SEQ ID NO: 419098 - DNA, 16 bp, M. musculus
gggcttaatggaccat

SEQ ID NO: 419099 - DNA, 17 bp, M. musculus
gggcttatctttgttca

SEQ ID NO: 419100 - DNA, 16 bp, M. musculus
gggcttcagagatggc

SEQ ID NO: 419101 - DNA, 16 bp, M. musculus
gggcttccagagactg

SEQ ID NO: 419102 - DNA, 16 bp, M. musculus
gggcttccagtccctc

SEQ ID NO: 419103 - DNA, 16 bp, M. musculus
gggcttctagccttag

SEQ ID NO: 419104 - DNA, 16 bp, M. musculus
gggcttctcagcaggt

SEQ ID NO: 419105 - DNA, 16 bp, M. musculus
gggcttctctgtgtat

SEQ ID NO: 419106 - DNA, 16 bp, M. musculus
gggcttctttcctgtc

SEQ ID NO: 419107 - DNA, 16 bp, M. musculus
gggcttgctggccatc

SEQ ID NO: 419108 - DNA, 16 bp, M. musculus
gggcttggtcacacca

SEQ ID NO: 419109 - DNA, 16 bp, M. musculus
gggcttggtggcacac

SEQ ID NO: 419110 - DNA, 16 bp, M. musculus
gggcttgtggtcctgg

SEQ ID NO: 419111 - DNA, 16 bp, M. musculus
gggctttctctctctc

SEQ ID NO: 419112 - DNA, 16 bp, M. musculus
gggctttgtctgtgtg

SEQ ID NO: 419113 - DNA, 16 bp, M. musculus
ggggaaaaaaaaatca

SEQ ID NO: 419114 - DNA, 16 bp, M. musculus
ggggaaaaaaaagcat

SEQ ID NO: 419115 - DNA, 16 bp, M. musculus
ggggaaaaaaaatcaa

SEQ ID NO: 419116 - DNA, 16 bp, M. musculus
ggggaaaaaaaccaca

SEQ ID NO: 419117 - DNA, 16 bp, M. musculus
ggggaaaaaaaccctt

SEQ ID NO: 419118 - DNA, 16 bp, M. musculus
ggggaaaagctggaag

SEQ ID NO: 419119 - DNA, 16 bp, M. musculus
ggggaaaaggcctccc

SEQ ID NO: 419120 - DNA, 16 bp, M. musculus
ggggaaaattcctgaa

SEQ ID NO: 419121 - DNA, 16 bp, M. musculus
ggggaaaccaaggcag

SEQ ID NO: 419122 - DNA, 16 bp, M. musculus
ggggaaaccaggaaaa

SEQ ID NO: 419123 - DNA, 16 bp, M. musculus
ggggaaactgaatggt

SEQ ID NO: 419124 - DNA, 16 bp, M. musculus
ggggaaactgaggcct

SEQ ID NO: 419125 - DNA, 16 bp, M. musculus
ggggaaactgaggctc

SEQ ID NO: 419126 - DNA, 16 bp, M. musculus
ggggaaactgaggctg

SEQ ID NO: 419127 - DNA, 16 bp, M. musculus
ggggaaactggaaagg

SEQ ID NO: 419128 - DNA, 16 bp, M. musculus
ggggaaactgggaggg

SEQ ID NO: 419129 - DNA, 16 bp, M. musculus
ggggaaagattgtggg

SEQ ID NO: 419130 - DNA, 16 bp, M. musculus
ggggaaagcctcaacc

SEQ ID NO: 419131 - DNA, 16 bp, M. musculus
ggggaaaggccccttg

SEQ ID NO: 419132 - DNA, 16 bp, M. musculus
ggggaaatttcttaaa

SEQ ID NO: 419133 - DNA, 16 bp, M. musculus
ggggaacaccagggac

SEQ ID NO: 419134 - DNA, 16 bp, M. musculus
ggggaacaccatggcc

SEQ ID NO: 419135 - DNA, 16 bp, M. musculus
ggggaacactcctcta

SEQ ID NO: 419136 - DNA, 16 bp, M. musculus
ggggaacaggatcagg

SEQ ID NO: 419137 - DNA, 16 bp, M. musculus
ggggaaccataatcag

SEQ ID NO: 419138 - DNA, 16 bp, M. musculus
ggggaagcaagacagt

SEQ ID NO: 419139 - DNA, 16 bp, M. musculus
ggggaagccctgctgg

SEQ ID NO: 419140 - DNA, 16 bp, M. musculus
ggggaagctggagaga

SEQ ID NO: 419141 - DNA, 16 bp, M. musculus
ggggaaggactgtggg

SEQ ID NO: 419142 - DNA, 16 bp, M. musculus
ggggaaggagaacctg

SEQ ID NO: 419143 - DNA, 16 bp, M. musculus
ggggaaggagctgaag

SEQ ID NO: 419144 - DNA, 16 bp, M. musculus
ggggaaggcagggagt

SEQ ID NO: 419145 - DNA, 17 bp, M. musculus
ggggaaggccagggcca

SEQ ID NO: 419146 - DNA, 17 bp, M. musculus
ggggaaggtggactata

SEQ ID NO: 419147 - DNA, 16 bp, M. musculus
ggggaagtcagggcag

SEQ ID NO: 419148 - DNA, 16 bp, M. musculus
ggggaatctgatctgg

SEQ ID NO: 419149 - DNA, 16 bp, M. musculus
ggggacaactgctttt

SEQ ID NO: 419150 - DNA, 16 bp, M. musculus
ggggacagagtgggag

SEQ ID NO: 419151 - DNA, 16 bp, M. musculus
ggggacagccggccac

SEQ ID NO: 419152 - DNA, 16 bp, M. musculus
ggggacatcaagaagg

SEQ ID NO: 419153 - DNA, 16 bp, M. musculus
ggggaccatttttatt

SEQ ID NO: 419154 - DNA, 16 bp, M. musculus
ggggacccaggttcaa

SEQ ID NO: 419155 - DNA, 16 bp, M. musculus
ggggaccctctgctca

SEQ ID NO: 419156 - DNA, 16 bp, M. musculus
ggggaccttggggatg

SEQ ID NO: 419157 - DNA, 16 bp, M. musculus
ggggactacaatggtc

SEQ ID NO: 419158 - DNA, 16 bp, M. musculus
ggggactcatatccaa

SEQ ID NO: 419159 - DNA, 16 bp, M. musculus
ggggactctggagagg

SEQ ID NO: 419160 - DNA, 16 bp, M. musculus
ggggactcttgtggaa

SEQ ID NO: 419161 - DNA, 16 bp, M. musculus
ggggactgaattcaga

SEQ ID NO: 419162 - DNA, 16 bp, M. musculus
ggggacttccccttct

SEQ ID NO: 419163 - DNA, 16 bp, M. musculus
ggggactttcaggaaa

SEQ ID NO: 419164 - DNA, 16 bp, M. musculus
ggggagacaggaggat

SEQ ID NO: 419165 - DNA, 16 bp, M. musculus
ggggagacctgaaaag

SEQ ID NO: 419166 - DNA, 16 bp, M. musculus
ggggagacctggaagg

SEQ ID NO: 419167 - DNA, 16 bp, M. musculus
ggggagacggctcagt

SEQ ID NO: 419168 - DNA, 16 bp, M. musculus
ggggagagctatgtgt

SEQ ID NO: 419169 - DNA, 16 bp, M. musculus
ggggagatagctcaga

SEQ ID NO: 419170 - DNA, 16 bp, M. musculus
ggggagatccccttgt

SEQ ID NO: 419171 - DNA, 16 bp, M. musculus
ggggagatgtacagag

SEQ ID NO: 419172 - DNA, 16 bp, M. musculus
ggggagatgtaggcag

SEQ ID NO: 419173 - DNA, 16 bp, M. musculus
ggggagattgcaaggg

SEQ ID NO: 419174 - DNA, 16 bp, M. musculus
ggggagcagagctggg

SEQ ID NO: 419175 - DNA, 16 bp, M. musculus
ggggagcaggactggg

SEQ ID NO: 419176 - DNA, 16 bp, M. musculus
ggggagcagggaatgg

SEQ ID NO: 419177 - DNA, 16 bp, M. musculus
ggggagcagggagatg

SEQ ID NO: 419178 - DNA, 16 bp, M. musculus
ggggagcagggcatgg

SEQ ID NO: 419179 - DNA, 16 bp, M. musculus
ggggagcagggtgcag

SEQ ID NO: 419180 - DNA, 16 bp, M. musculus
ggggagccagaggcag

SEQ ID NO: 419181 - DNA, 16 bp, M. musculus
ggggagccagctcttg

SEQ ID NO: 419182 - DNA, 16 bp, M. musculus
ggggaggaacttggag

SEQ ID NO: 419183 - DNA, 16 bp, M. musculus
ggggaggactgtagaa

SEQ ID NO: 419184 - DNA, 16 bp, M. musculus
ggggaggaggcgctca

SEQ ID NO: 419185 - DNA, 16 bp, M. musculus
ggggaggcagaaacag

SEQ ID NO: 419186 - DNA, 16 bp, M. musculus
ggggaggctcccagga

SEQ ID NO: 419187 - DNA, 16 bp, M. musculus
ggggagggaagagttt

SEQ ID NO: 419188 - DNA, 16 bp, M. musculus
ggggaggggagatgct

SEQ ID NO: 419189 - DNA, 16 bp, M. musculus
ggggaggtcagaggtc

SEQ ID NO: 419190 - DNA, 16 bp, M. musculus
ggggaggtctggttgg

SEQ ID NO: 419191 - DNA, 16 bp, M. musculus
ggggaggttgcaaggg

SEQ ID NO: 419192 - DNA, 16 bp, M. musculus
ggggagtcagaggctg

SEQ ID NO: 419193 - DNA, 16 bp, M. musculus
ggggagtctctggaca

SEQ ID NO: 419194 - DNA, 16 bp, M. musculus
ggggagtggcactatt

SEQ ID NO: 419195 - DNA, 16 bp, M. musculus
ggggatacatattgga

SEQ ID NO: 419196 - DNA, 16 bp, M. musculus
ggggatcaaagccagg

SEQ ID NO: 419197 - DNA, 16 bp, M. musculus
ggggatcatcctgagt

SEQ ID NO: 419198 - DNA, 16 bp, M. musculus
ggggatccatcctata

SEQ ID NO: 419199 - DNA, 16 bp, M. musculus
ggggatcctgtggggg

SEQ ID NO: 419200 - DNA, 16 bp, M. musculus
ggggatctggtgccct

SEQ ID NO: 419201 - DNA, 16 bp, M. musculus
ggggatgacattagct

SEQ ID NO: 419202 - DNA, 16 bp, M. musculus
ggggatgcacatccac

SEQ ID NO: 419203 - DNA, 16 bp, M. musculus
ggggatgctagggcag

SEQ ID NO: 419204 - DNA, 16 bp, M. musculus
ggggatggcatttgaa

SEQ ID NO: 419205 - DNA, 16 bp, M. musculus
ggggatgggctttgag

SEQ ID NO: 419206 - DNA, 16 bp, M. musculus
ggggatgtagttcagt

SEQ ID NO: 419207 - DNA, 16 bp, M. musculus
ggggattacaattaag

SEQ ID NO: 419208 - DNA, 16 bp, M. musculus
ggggattccaggcagg

SEQ ID NO: 419209 - DNA, 16 bp, M. musculus
ggggattgaactcggg

SEQ ID NO: 419210 - DNA, 16 bp, M. musculus
ggggatttgaagtaag

SEQ ID NO: 419211 - DNA, 16 bp, M. musculus
ggggcaacctaagaca

SEQ ID NO: 419212 - DNA, 16 bp, M. musculus
ggggcaagcagtccct

SEQ ID NO: 419213 - DNA, 16 bp, M. musculus
ggggcaaggttacata

SEQ ID NO: 419214 - DNA, 16 bp, M. musculus
ggggcacagagctaaa

SEQ ID NO: 419215 - DNA, 16 bp, M. musculus
ggggcagagcagatgg

SEQ ID NO: 419216 - DNA, 16 bp, M. musculus
ggggcagagtcttaag

SEQ ID NO: 419217 - DNA, 17 bp, M. musculus
ggggcagcagcagcagc

SEQ ID NO: 419218 - DNA, 16 bp, M. musculus
ggggcagcagtggtgg

SEQ ID NO: 419219 - DNA, 16 bp, M. musculus
ggggcagcctgggcta

SEQ ID NO: 419220 - DNA, 16 bp, M. musculus
ggggcagccttggcct

SEQ ID NO: 419221 - DNA, 16 bp, M. musculus
ggggcagctggggcag

SEQ ID NO: 419222 - DNA, 16 bp, M. musculus
ggggcagctggtcaca

SEQ ID NO: 419223 - DNA, 16 bp, M. musculus
ggggcaggtgagatgg

SEQ ID NO: 419224 - DNA, 16 bp, M. musculus
ggggcagtgaacagga

SEQ ID NO: 419225 - DNA, 16 bp, M. musculus
ggggcagtgggctgtg

SEQ ID NO: 419226 - DNA, 16 bp, M. musculus
ggggcatctgggtttt

SEQ ID NO: 419227 - DNA, 16 bp, M. musculus
ggggcattgagccctc

SEQ ID NO: 419228 - DNA, 16 bp, M. musculus
ggggcattgatccttc

SEQ ID NO: 419229 - DNA, 16 bp, M. musculus
ggggccaaagggaaaa

SEQ ID NO: 419230 - DNA, 16 bp, M. musculus
ggggccaagcagcccc

SEQ ID NO: 419231 - DNA, 16 bp, M. musculus
ggggccacagcagatg

SEQ ID NO: 419232 - DNA, 16 bp, M. musculus
ggggccagccccacca

SEQ ID NO: 419233 - DNA, 16 bp, M. musculus
ggggccagcctgggct

SEQ ID NO: 419234 - DNA, 16 bp, M. musculus
ggggccatgcctattc

SEQ ID NO: 419235 - DNA, 16 bp, M. musculus
ggggccctggggaaga

SEQ ID NO: 419236 - DNA, 16 bp, M. musculus
ggggccctgtgatctg

SEQ ID NO: 419237 - DNA, 16 bp, M. musculus
ggggccgtgtgttcca

SEQ ID NO: 419238 - DNA, 16 bp, M. musculus
ggggcctcagaccagc

SEQ ID NO: 419239 - DNA, 16 bp, M. musculus
ggggcctccaccctct

SEQ ID NO: 419240 - DNA, 16 bp, M. musculus
ggggcctctcttccct

SEQ ID NO: 419241 - DNA, 16 bp, M. musculus
ggggcctgccctggag

SEQ ID NO: 419242 - DNA, 16 bp, M. musculus
ggggcctggagagatg

SEQ ID NO: 419243 - DNA, 16 bp, M. musculus
ggggcctgtccttcct

SEQ ID NO: 419244 - DNA, 23 bp, M. musculus
ggggccttcccagtatttcagga

SEQ ID NO: 419245 - DNA, 16 bp, M. musculus
ggggcgtcagatctca

SEQ ID NO: 419246 - DNA, 16 bp, M. musculus
ggggctagagagttgg

SEQ ID NO: 419247 - DNA, 17 bp, M. musculus
ggggctaggtggcaaga

SEQ ID NO: 419248 - DNA, 16 bp, M. musculus
ggggctcacagagact

SEQ ID NO: 419249 - DNA, 16 bp, M. musculus
ggggctcagtgctgaa

SEQ ID NO: 419250 - DNA, 16 bp, M. musculus
ggggctccccttctct

SEQ ID NO: 419251 - DNA, 16 bp, M. musculus
ggggctctctggccag

SEQ ID NO: 419252 - DNA, 16 bp, M. musculus
ggggctgaagagatgg

SEQ ID NO: 419253 - DNA, 16 bp, M. musculus
ggggctgaagaggtgg

SEQ ID NO: 419254 - DNA, 16 bp, M. musculus
ggggctgaggcaggag

SEQ ID NO: 419255 - DNA, 16 bp, M. musculus
ggggctgaggctgagg

SEQ ID NO: 419256 - DNA, 16 bp, M. musculus
ggggctgcaaacacct

SEQ ID NO: 419257 - DNA, 16 bp, M. musculus
ggggctgcagagatga

SEQ ID NO: 419258 - DNA, 16 bp, M. musculus
ggggctgcagagatgg

SEQ ID NO: 419259 - DNA, 16 bp, M. musculus
ggggctgcctcagaag

SEQ ID NO: 419260 - DNA, 16 bp, M. musculus
ggggctgcttcagact

SEQ ID NO: 419261 - DNA, 16 bp, M. musculus
ggggctgcttcagatt

SEQ ID NO: 419262 - DNA, 16 bp, M. musculus
ggggctggaaatgaaa

SEQ ID NO: 419263 - DNA, 16 bp, M. musculus
ggggctggagaagtgg

SEQ ID NO: 419264 - DNA, 16 bp, M. musculus
ggggctggagagagag

SEQ ID NO: 419265 - DNA, 16 bp, M. musculus
ggggctggagaggcag

SEQ ID NO: 419266 - DNA, 16 bp, M. musculus
ggggctggagagttgg

SEQ ID NO: 419267 - DNA, 16 bp, M. musculus
ggggctggagatgcag

SEQ ID NO: 419268 - DNA, 16 bp, M. musculus
ggggctggcaagatgg

SEQ ID NO: 419269 - DNA, 16 bp, M. musculus
ggggctggcatggcaa

SEQ ID NO: 419270 - DNA, 16 bp, M. musculus
ggggctggcattgctc

SEQ ID NO: 419271 - DNA, 16 bp, M. musculus
ggggctggcctacagt

SEQ ID NO: 419272 - DNA, 16 bp, M. musculus
ggggctggctgtggag

SEQ ID NO: 419273 - DNA, 16 bp, M. musculus
ggggctgggaagatag

SEQ ID NO: 419274 - DNA, 16 bp, M. musculus
ggggctgggaagatgg

SEQ ID NO: 419275 - DNA, 16 bp, M. musculus
ggggctgggattaaag

SEQ ID NO: 419276 - DNA, 16 bp, M. musculus
ggggctgggcatggtg

SEQ ID NO: 419277 - DNA, 16 bp, M. musculus
ggggctggggctggaa

SEQ ID NO: 419278 - DNA, 16 bp, M. musculus
ggggctgtccctgagc

SEQ ID NO: 419279 - DNA, 16 bp, M. musculus
ggggctgtctctgatt

SEQ ID NO: 419280 - DNA, 16 bp, M. musculus
ggggctgtgagaccac

SEQ ID NO: 419281 - DNA, 16 bp, M. musculus
ggggctgtgtggaaag

SEQ ID NO: 419282 - DNA, 16 bp, M. musculus
ggggcttacaggttaa

SEQ ID NO: 419283 - DNA, 16 bp, M. musculus
ggggcttgttggccag

SEQ ID NO: 419284 - DNA, 22 bp, M. musculus
ggggctttgatgcattccagaa

SEQ ID NO: 419285 - DNA, 16 bp, M. musculus
gggggaaaaaaaaact

SEQ ID NO: 419286 - DNA, 16 bp, M. musculus
gggggaaaaaaaaccc

SEQ ID NO: 419287 - DNA, 16 bp, M. musculus
gggggaagggagtgcc

SEQ ID NO: 419288 - DNA, 16 bp, M. musculus
gggggacaggatcagg

SEQ ID NO: 419289 - DNA, 16 bp, M. musculus
gggggacatcctcttg

SEQ ID NO: 419290 - DNA, 16 bp, M. musculus
gggggacattcttatt

SEQ ID NO: 419291 - DNA, 16 bp, M. musculus
gggggaggtactggtt

SEQ ID NO: 419292 - DNA, 16 bp, M. musculus
gggggatagggaactg

SEQ ID NO: 419293 - DNA, 16 bp, M. musculus
gggggatctgatgccc

SEQ ID NO: 419294 - DNA, 17 bp, M. musculus
gggggattctaggcaga

SEQ ID NO: 419295 - DNA, 16 bp, M. musculus
gggggcaacatttggg

SEQ ID NO: 419296 - DNA, 16 bp, M. musculus
gggggcagaggcaggt

SEQ ID NO: 419297 - DNA, 16 bp, M. musculus
gggggcagctggatct

SEQ ID NO: 419298 - DNA, 16 bp, M. musculus
gggggcagggaatgga

SEQ ID NO: 419299 - DNA, 16 bp, M. musculus
gggggcagtgagaagg

SEQ ID NO: 419300 - DNA, 16 bp, M. musculus
gggggcatcagatctc

SEQ ID NO: 419301 - DNA, 16 bp, M. musculus
gggggccacccagctg

SEQ ID NO: 419302 - DNA, 19 bp, M. musculus
gggggccacggagccttct

SEQ ID NO: 419303 - DNA, 16 bp, M. musculus
gggggccagcagaaag

SEQ ID NO: 419304 - DNA, 16 bp, M. musculus
gggggcccagtgatcc

SEQ ID NO: 419305 - DNA, 16 bp, M. musculus
gggggccctgtgatca

SEQ ID NO: 419306 - DNA, 16 bp, M. musculus
gggggcctcgtatcag

SEQ ID NO: 419307 - DNA, 16 bp, M. musculus
gggggctagagagatg

SEQ ID NO: 419308 - DNA, 16 bp, M. musculus
gggggctggaaagatg

SEQ ID NO: 419309 - DNA, 16 bp, M. musculus
gggggctggggaaatg

SEQ ID NO: 419310 - DNA, 16 bp, M. musculus
gggggctttgggaata

SEQ ID NO: 419311 - DNA, 16 bp, M. musculus
ggggggccctgtgatc

SEQ ID NO: 419312 - DNA, 16 bp, M. musculus
gggggggaccctccag

SEQ ID NO: 419313 - DNA, 16 bp, M. musculus
ggggggggcattctta

SEQ ID NO: 419314 - DNA, 16 bp, M. musculus
gggggggggcagtatt

SEQ ID NO: 419315 - DNA, 16 bp, M. musculus
ggggggggggaatctc

SEQ ID NO: 419316 - DNA, 16 bp, M. musculus
ggggggggggtcattt

SEQ ID NO: 419317 - DNA, 16 bp, M. musculus
ggggggggtcacatat

SEQ ID NO: 419318 - DNA, 16 bp, M. musculus
gggggtcactacaaca

SEQ ID NO: 419319 - DNA, 16 bp, M. musculus
gggggtgctgatgggc

SEQ ID NO: 419320 - DNA, 16 bp, M. musculus
gggggtgggggacaca

SEQ ID NO: 419321 - DNA, 16 bp, M. musculus
gggggtgtagctcagt

SEQ ID NO: 419322 - DNA, 16 bp, M. musculus
gggggtttacccctac

SEQ ID NO: 419323 - DNA, 16 bp, M. musculus
ggggtaacagaaagga

SEQ ID NO: 419324 - DNA, 16 bp, M. musculus
ggggtataactgcccc

SEQ ID NO: 419325 - DNA, 16 bp, M. musculus
ggggtatttaagcagc

SEQ ID NO: 419326 - DNA, 16 bp, M. musculus
ggggtcaccacaacac

SEQ ID NO: 419327 - DNA, 16 bp, M. musculus
ggggtcaccacagcac

SEQ ID NO: 419328 - DNA, 16 bp, M. musculus
ggggtcaccataacat

SEQ ID NO: 419329 - DNA, 16 bp, M. musculus
ggggtcactacagcat

SEQ ID NO: 419330 - DNA, 16 bp, M. musculus
ggggtcagccccaggc

SEQ ID NO: 419331 - DNA, 16 bp, M. musculus
ggggtcagtggcctaa

SEQ ID NO: 419332 - DNA, 16 bp, M. musculus
ggggtccccaggctca

SEQ ID NO: 419333 - DNA, 16 bp, M. musculus
ggggtcctgagttcaa

SEQ ID NO: 419334 - DNA, 16 bp, M. musculus
ggggtcctgagttcag

SEQ ID NO: 419335 - DNA, 16 bp, M. musculus
ggggtctccaaagcaa

SEQ ID NO: 419336 - DNA, 16 bp, M. musculus
ggggtgaagaactcag

SEQ ID NO: 419337 - DNA, 16 bp, M. musculus
ggggtgaccaggagga

SEQ ID NO: 419338 - DNA, 16 bp, M. musculus
ggggtgactcagcaag

SEQ ID NO: 419339 - DNA, 16 bp, M. musculus
ggggtggcacacacct

SEQ ID NO: 419340 - DNA, 16 bp, M. musculus
ggggtggccaaggggc

SEQ ID NO: 419341 - DNA, 16 bp, M. musculus
ggggtgggccaattca

SEQ ID NO: 419342 - DNA, 16 bp, M. musculus
ggggtgggctttcagg

SEQ ID NO: 419343 - DNA, 16 bp, M. musculus
ggggtgggctttgaga

SEQ ID NO: 419344 - DNA, 16 bp, M. musculus
ggggtggggacattct

SEQ ID NO: 419345 - DNA, 16 bp, M. musculus
ggggtgggggacagca

SEQ ID NO: 419346 - DNA, 16 bp, M. musculus
ggggtgtgtgtgtgca

SEQ ID NO: 419347 - DNA, 16 bp, M. musculus
ggggttacaggtgtga

SEQ ID NO: 419348 - DNA, 17 bp, M. musculus
ggggttctgccaaggga

SEQ ID NO: 419349 - DNA, 16 bp, M. musculus
ggggttgccataccac

SEQ ID NO: 419350 - DNA, 16 bp, M. musculus
ggggttggaaagatgg

SEQ ID NO: 419351 - DNA, 16 bp, M. musculus
ggggttggagaaatgg

SEQ ID NO: 419352 - DNA, 16 bp, M. musculus
ggggtttccaggaggg

SEQ ID NO: 419353 - DNA, 16 bp, M. musculus
ggggtttctctgtata

SEQ ID NO: 419354 - DNA, 16 bp, M. musculus
ggggtttctctgtgta

SEQ ID NO: 419355 - DNA, 16 bp, M. musculus
ggggtttctttattgt

SEQ ID NO: 419356 - DNA, 16 bp, M. musculus
ggggtttgaacccagg

SEQ ID NO: 419357 - DNA, 16 bp, M. musculus
gggtaaactgaggcag

SEQ ID NO: 419358 - DNA, 16 bp, M. musculus
gggtaaaggtgcttac

SEQ ID NO: 419359 - DNA, 16 bp, M. musculus
gggtaaaggtgtttgc

SEQ ID NO: 419360 - DNA, 16 bp, M. musculus
gggtaaatgcccagga

SEQ ID NO: 419361 - DNA, 16 bp, M. musculus
gggtaaccaagagcaa

SEQ ID NO: 419362 - DNA, 16 bp, M. musculus
gggtaagactccctgg

SEQ ID NO: 419363 - DNA, 17 bp, M. musculus
gggtaagagcactgact

SEQ ID NO: 419364 - DNA, 16 bp, M. musculus
gggtacagctcagtgg

SEQ ID NO: 419365 - DNA, 19 bp, M. musculus
gggtactgcttagttcata

SEQ ID NO: 419366 - DNA, 16 bp, M. musculus
gggtagaaaccccagg

SEQ ID NO: 419367 - DNA, 16 bp, M. musculus
gggtagagctggagaa

SEQ ID NO: 419368 - DNA, 16 bp, M. musculus
gggtagaggaccatgg

SEQ ID NO: 419369 - DNA, 16 bp, M. musculus
gggtagagtaccttct

SEQ ID NO: 419370 - DNA, 16 bp, M. musculus
gggtagcagagatgaa

SEQ ID NO: 419371 - DNA, 16 bp, M. musculus
gggtagcctagaactc

SEQ ID NO: 419372 - DNA, 16 bp, M. musculus
gggtataggggtcttt

SEQ ID NO: 419373 - DNA, 20 bp, M. musculus
gggtatagtagcctgggctg

SEQ ID NO: 419374 - DNA, 16 bp, M. musculus
gggtatatatatatat

SEQ ID NO: 419375 - DNA, 16 bp, M. musculus
gggtatgagacacgcc

SEQ ID NO: 419376 - DNA, 16 bp, M. musculus
gggtatggtggtgcac

SEQ ID NO: 419377 - DNA, 16 bp, M. musculus
gggtatgtgtgtatgt

SEQ ID NO: 419378 - DNA, 16 bp, M. musculus
gggtattgcaacccca

SEQ ID NO: 419379 - DNA, 16 bp, M. musculus
gggtattttgtttcct

SEQ ID NO: 419380 - DNA, 16 bp, M. musculus
gggtcacaaccatctg

SEQ ID NO: 419381 - DNA, 16 bp, M. musculus
gggtcacagagactga

SEQ ID NO: 419382 - DNA, 16 bp, M. musculus
gggtcacagccccttt

SEQ ID NO: 419383 - DNA, 16 bp, M. musculus
gggtcacaggatgctg

SEQ ID NO: 419384 - DNA, 16 bp, M. musculus
gggtcaccacaacatg

SEQ ID NO: 419385 - DNA, 16 bp, M. musculus
gggtcaccacctctcc

SEQ ID NO: 419386 - DNA, 16 bp, M. musculus
gggtcaccactacatg

SEQ ID NO: 419387 - DNA, 16 bp, M. musculus
gggtcacctaagacca

SEQ ID NO: 419388 - DNA, 16 bp, M. musculus
gggtcacgaagagcag

SEQ ID NO: 419389 - DNA, 35 bp, M. musculus
gggtcacttatatatactatcatatcatctgcaaa

SEQ ID NO: 419390 - DNA, 16 bp, M. musculus
gggtcagacacttcct

SEQ ID NO: 419391 - DNA, 16 bp, M. musculus
gggtcagcacaacatg

SEQ ID NO: 419392 - DNA, 16 bp, M. musculus
gggtcagctgcttctc

SEQ ID NO: 419393 - DNA, 16 bp, M. musculus
gggtcaggggtcaggg

SEQ ID NO: 419394 - DNA, 16 bp, M. musculus
gggtcatctcaggcat

SEQ ID NO: 419395 - DNA, 16 bp, M. musculus
gggtcatgcagagaag

SEQ ID NO: 419396 - DNA, 16 bp, M. musculus
gggtcccagactgaat

SEQ ID NO: 419397 - DNA, 16 bp, M. musculus
gggtcccagtgctcag

SEQ ID NO: 419398 - DNA, 16 bp, M. musculus
gggtcccctggaactg

SEQ ID NO: 419399 - DNA, 16 bp, M. musculus
gggtcccggatccctc

SEQ ID NO: 419400 - DNA, 16 bp, M. musculus
gggtccctggggcttg

SEQ ID NO: 419401 - DNA, 16 bp, M. musculus
gggtccctgggtccct

SEQ ID NO: 419402 - DNA, 16 bp, M. musculus
gggtccctgtccccag

SEQ ID NO: 419403 - DNA, 16 bp, M. musculus
gggtcctctcagcaaa

SEQ ID NO: 419404 - DNA, 16 bp, M. musculus
gggtcctctgcagaag

SEQ ID NO: 419405 - DNA, 16 bp, M. musculus
gggtcctctgggagag

SEQ ID NO: 419406 - DNA, 16 bp, M. musculus
gggtcctggaccaaga

SEQ ID NO: 419407 - DNA, 16 bp, M. musculus
gggtcctggagactga

SEQ ID NO: 419408 - DNA, 16 bp, M. musculus
gggtcctggggcttga

SEQ ID NO: 419409 - DNA, 16 bp, M. musculus
gggtcctggttggttg

SEQ ID NO: 419410 - DNA, 16 bp, M. musculus
gggtcctgtgaggacc

SEQ ID NO: 419411 - DNA, 16 bp, M. musculus
gggtcctgtttgtgtt

SEQ ID NO: 419412 - DNA, 16 bp, M. musculus
gggtccttcccccagg

SEQ ID NO: 419413 - DNA, 16 bp, M. musculus
gggtccttgtgcttgc

SEQ ID NO: 419414 - DNA, 24 bp, M. musculus
gggtcctttcagcaaaatcttgct

SEQ ID NO: 419415 - DNA, 16 bp, M. musculus
gggtctagcttttcag

SEQ ID NO: 419416 - DNA, 16 bp, M. musculus
gggtctcacagagact

SEQ ID NO: 419417 - DNA, 16 bp, M. musculus
gggtctcactatgtgg

SEQ ID NO: 419418 - DNA, 16 bp, M. musculus
gggtctcactctgtag

SEQ ID NO: 419419 - DNA, 16 bp, M. musculus
gggtctcactttgtaa

SEQ ID NO: 419420 - DNA, 16 bp, M. musculus
gggtctcagctccacc

SEQ ID NO: 419421 - DNA, 16 bp, M. musculus
gggtctcaggtagccc

SEQ ID NO: 419422 - DNA, 19 bp, M. musculus
gggtctcatgtagcccagg

SEQ ID NO: 419423 - DNA, 16 bp, M. musculus
gggtctcatgtagctc

SEQ ID NO: 419424 - DNA, 16 bp, M. musculus
gggtctcattttgtag

SEQ ID NO: 419425 - DNA, 16 bp, M. musculus
gggtctccagggcttc

SEQ ID NO: 419426 - DNA, 16 bp, M. musculus
gggtctctaactgtag

SEQ ID NO: 419427 - DNA, 16 bp, M. musculus
gggtctctcacttgaa

SEQ ID NO: 419428 - DNA, 16 bp, M. musculus
gggtctctgcatctct

SEQ ID NO: 419429 - DNA, 16 bp, M. musculus
gggtctgccaggcctg

SEQ ID NO: 419430 - DNA, 16 bp, M. musculus
gggtctgccagtgcct

SEQ ID NO: 419431 - DNA, 16 bp, M. musculus
gggtctggagagatag

SEQ ID NO: 419432 - DNA, 16 bp, M. musculus
gggtcttattgctgtg

SEQ ID NO: 419433 - DNA, 16 bp, M. musculus
gggtcttcatttctgt

SEQ ID NO: 419434 - DNA, 16 bp, M. musculus
gggtcttccctcctga

SEQ ID NO: 419435 - DNA, 16 bp, M. musculus
gggtcttgaacaactg

SEQ ID NO: 419436 - DNA, 16 bp, M. musculus
gggtcttgctatgtat

SEQ ID NO: 419437 - DNA, 16 bp, M. musculus
gggtcttgtttatgta

SEQ ID NO: 419438 - DNA, 16 bp, M. musculus
gggtctttgtgtggct

SEQ ID NO: 419439 - DNA, 16 bp, M. musculus
gggtgaaatattctat

SEQ ID NO: 419440 - DNA, 16 bp, M. musculus
gggtgaagggttactt

SEQ ID NO: 419441 - DNA, 16 bp, M. musculus
gggtgaatatgatcaa

SEQ ID NO: 419442 - DNA, 16 bp, M. musculus
gggtgacacactggca

SEQ ID NO: 419443 - DNA, 16 bp, M. musculus
gggtgacccctgtgaa

SEQ ID NO: 419444 - DNA, 16 bp, M. musculus
gggtgacctcaaactc

SEQ ID NO: 419445 - DNA, 16 bp, M. musculus
gggtgactgtggcctc

SEQ ID NO: 419446 - DNA, 16 bp, M. musculus
gggtgagggagagctg

SEQ ID NO: 419447 - DNA, 16 bp, M. musculus
gggtgagtggaacaca

SEQ ID NO: 419448 - DNA, 16 bp, M. musculus
gggtgatgagcctaag

SEQ ID NO: 419449 - DNA, 16 bp, M. musculus
gggtgcaagagcagag

SEQ ID NO: 419450 - DNA, 18 bp, M. musculus
gggtgcaaggctaagcac

SEQ ID NO: 419451 - DNA, 21 bp, M. musculus
gggtgcagaagattccataga

SEQ ID NO: 419452 - DNA, 16 bp, M. musculus
gggtgcagatggaggc

SEQ ID NO: 419453 - DNA, 16 bp, M. musculus
gggtgcagcgaacttt

SEQ ID NO: 419454 - DNA, 16 bp, M. musculus
gggtgcatgtatgtgt

SEQ ID NO: 419455 - DNA, 16 bp, M. musculus
gggtgccaggcacaca

SEQ ID NO: 419456 - DNA, 16 bp, M. musculus
gggtgcccaggaccag

SEQ ID NO: 419457 - DNA, 16 bp, M. musculus
gggtgcctgcagcatg

SEQ ID NO: 419458 - DNA, 16 bp, M. musculus
gggtgctgagaactaa

SEQ ID NO: 419459 - DNA, 16 bp, M. musculus
gggtgctgagattaaa

SEQ ID NO: 419460 - DNA, 16 bp, M. musculus
gggtgctgccatccct

SEQ ID NO: 419461 - DNA, 16 bp, M. musculus
gggtgctggagagatg

SEQ ID NO: 419462 - DNA, 16 bp, M. musculus
gggtgctgggagtcaa

SEQ ID NO: 419463 - DNA, 16 bp, M. musculus
gggtgctgggtaccaa

SEQ ID NO: 419464 - DNA, 16 bp, M. musculus
gggtgcttggaattga

SEQ ID NO: 419465 - DNA, 16 bp, M. musculus
gggtggacctggaagg

SEQ ID NO: 419466 - DNA, 16 bp, M. musculus
gggtggactttgaggt

SEQ ID NO: 419467 - DNA, 16 bp, M. musculus
gggtggagcctctcaa

SEQ ID NO: 419468 - DNA, 27 bp, M. musculus
gggtggagcttcctgctcattcgttct

SEQ ID NO: 419469 - DNA, 17 bp, M. musculus
gggtggatttctgagtt

SEQ ID NO: 419470 - DNA, 16 bp, M. musculus
gggtggcacatgcctt

SEQ ID NO: 419471 - DNA, 16 bp, M. musculus
gggtggcaccacccac

SEQ ID NO: 419472 - DNA, 16 bp, M. musculus
gggtggcaccatccca

SEQ ID NO: 419473 - DNA, 16 bp, M. musculus
gggtggcagaggcagg

SEQ ID NO: 419474 - DNA, 16 bp, M. musculus
gggtggccccacccac

SEQ ID NO: 419475 - DNA, 16 bp, M. musculus
gggtggccttgaactt

SEQ ID NO: 419476 - DNA, 16 bp, M. musculus
gggtggctggctggct

SEQ ID NO: 419477 - DNA, 16 bp, M. musculus
gggtgggaaagcacag

SEQ ID NO: 419478 - DNA, 16 bp, M. musculus
gggtgggactgggaag

SEQ ID NO: 419479 - DNA, 16 bp, M. musculus
gggtgggcagggcagt

SEQ ID NO: 419480 - DNA, 16 bp, M. musculus
gggtgggggagagaca

SEQ ID NO: 419481 - DNA, 16 bp, M. musculus
gggtggtaccatccct

SEQ ID NO: 419482 - DNA, 16 bp, M. musculus
gggtggtcagcaggac

SEQ ID NO: 419483 - DNA, 16 bp, M. musculus
gggtggtgccactcct

SEQ ID NO: 419484 - DNA, 16 bp, M. musculus
gggtggtggctcagtg

SEQ ID NO: 419485 - DNA, 16 bp, M. musculus
gggtggtggtggcaca

SEQ ID NO: 419486 - DNA, 16 bp, M. musculus
gggtggttcacaacca

SEQ ID NO: 419487 - DNA, 22 bp, M. musculus
gggtggttgtgagccaccatgt

SEQ ID NO: 419488 - DNA, 16 bp, M. musculus
gggtgtagctcagtga

SEQ ID NO: 419489 - DNA, 16 bp, M. musculus
gggtgtcagctgactc

SEQ ID NO: 419490 - DNA, 16 bp, M. musculus
gggtgtccttggtgaa

SEQ ID NO: 419491 - DNA, 16 bp, M. musculus
gggtgtctctgactgg

SEQ ID NO: 419492 - DNA, 16 bp, M. musculus
gggtgtctggagactc

SEQ ID NO: 419493 - DNA, 16 bp, M. musculus
gggtgtctgggagtgg

SEQ ID NO: 419494 - DNA, 16 bp, M. musculus
gggtgtggactttgag

SEQ ID NO: 419495 - DNA, 16 bp, M. musculus
gggtgtgggcatcttt

SEQ ID NO: 419496 - DNA, 16 bp, M. musculus
gggtgtggtggcacac

SEQ ID NO: 419497 - DNA, 16 bp, M. musculus
gggtgtggtggcactc

SEQ ID NO: 419498 - DNA, 16 bp, M. musculus
gggtgtggtggcgcac

SEQ ID NO: 419499 - DNA, 16 bp, M. musculus
gggtgtggtggctcag

SEQ ID NO: 419500 - DNA, 16 bp, M. musculus
gggtgtggtggtacaa

SEQ ID NO: 419501 - DNA, 16 bp, M. musculus
gggtgtggtggtgcac

SEQ ID NO: 419502 - DNA, 16 bp, M. musculus
gggtgtgtgcacacat

SEQ ID NO: 419503 - DNA, 16 bp, M. musculus
gggtgtgtgcagagta

SEQ ID NO: 419504 - DNA, 16 bp, M. musculus
gggtgtgtggaggtca

SEQ ID NO: 419505 - DNA, 16 bp, M. musculus
gggtgtgtgtctgtct

SEQ ID NO: 419506 - DNA, 16 bp, M. musculus
gggtgttactgctgtg

SEQ ID NO: 419507 - DNA, 16 bp, M. musculus
gggtgttccttactgg

SEQ ID NO: 419508 - DNA, 16 bp, M. musculus
gggtgttctgtttctg

SEQ ID NO: 419509 - DNA, 16 bp, M. musculus
gggtgttgtttaccta

SEQ ID NO: 419510 - DNA, 16 bp, M. musculus
gggtgttgtttcccca

SEQ ID NO: 419511 - DNA, 16 bp, M. musculus
gggtgttttgtctaca

SEQ ID NO: 419512 - DNA, 16 bp, M. musculus
gggtgttttgttccca

SEQ ID NO: 419513 - DNA, 16 bp, M. musculus
gggtgtttttcctgca

SEQ ID NO: 419514 - DNA, 16 bp, M. musculus
gggttaaaggtatgtg

SEQ ID NO: 419515 - DNA, 16 bp, M. musculus
gggttacaaagtgaga

SEQ ID NO: 419516 - DNA, 16 bp, M. musculus
gggttaccgtgcagac

SEQ ID NO: 419517 - DNA, 16 bp, M. musculus
gggttacctcacccag

SEQ ID NO: 419518 - DNA, 16 bp, M. musculus
gggttagagtccatga

SEQ ID NO: 419519 - DNA, 16 bp, M. musculus
gggttagagtctatga

SEQ ID NO: 419520 - DNA, 16 bp, M. musculus
gggttaggatattttt

SEQ ID NO: 419521 - DNA, 16 bp, M. musculus
gggttataggcatgtg

SEQ ID NO: 419522 - DNA, 16 bp, M. musculus
gggttataggtgtgtg

SEQ ID NO: 419523 - DNA, 16 bp, M. musculus
gggttcaaacctcagc

SEQ ID NO: 419524 - DNA, 16 bp, M. musculus
gggttcaatgagagac

SEQ ID NO: 419525 - DNA, 16 bp, M. musculus
gggttcaattcccagc

SEQ ID NO: 419526 - DNA, 16 bp, M. musculus
gggttcagacctcagt

SEQ ID NO: 419527 - DNA, 16 bp, M. musculus
gggttcagatccccag

SEQ ID NO: 419528 - DNA, 17 bp, M. musculus
gggttcagttcccagca

SEQ ID NO: 419529 - DNA, 16 bp, M. musculus
gggttccaggccagcc

SEQ ID NO: 419530 - DNA, 16 bp, M. musculus
gggttcccaggtaggg

SEQ ID NO: 419531 - DNA, 16 bp, M. musculus
gggttccctgagccct

SEQ ID NO: 419532 - DNA, 16 bp, M. musculus
gggttcctcttggagg

SEQ ID NO: 419533 - DNA, 16 bp, M. musculus
gggttccttctgtttc

SEQ ID NO: 419534 - DNA, 18 bp, M. musculus
gggttccttgcaggactg

SEQ ID NO: 419535 - DNA, 16 bp, M. musculus
gggttccttggggcaa

SEQ ID NO: 419536 - DNA, 16 bp, M. musculus
gggttctgagttcaaa

SEQ ID NO: 419537 - DNA, 16 bp, M. musculus
gggttctgatgaaggt

SEQ ID NO: 419538 - DNA, 16 bp, M. musculus
gggttctggacaggtg

SEQ ID NO: 419539 - DNA, 16 bp, M. musculus
gggttctggagatctg

SEQ ID NO: 419540 - DNA, 16 bp, M. musculus
gggttcttttatttat

SEQ ID NO: 419541 - DNA, 16 bp, M. musculus
gggttgaacccagagc

SEQ ID NO: 419542 - DNA, 16 bp, M. musculus
gggttgccttcctcct

SEQ ID NO: 419543 - DNA, 16 bp, M. musculus
gggttggagagaaggc

SEQ ID NO: 419544 - DNA, 16 bp, M. musculus
gggttgggacccacag

SEQ ID NO: 419545 - DNA, 16 bp, M. musculus
gggttgggagtgctgc

SEQ ID NO: 419546 - DNA, 16 bp, M. musculus
gggttggtgaagattc

SEQ ID NO: 419547 - DNA, 16 bp, M. musculus
gggttggtggtcctga

SEQ ID NO: 419548 - DNA, 16 bp, M. musculus
gggttgtaatcccctt

SEQ ID NO: 419549 - DNA, 16 bp, M. musculus
gggttgtttccagcta

SEQ ID NO: 419550 - DNA, 16 bp, M. musculus
gggtttagtaactgta

SEQ ID NO: 419551 - DNA, 16 bp, M. musculus
gggtttcattgctgtg

SEQ ID NO: 419552 - DNA, 16 bp, M. musculus
gggtttccatcccaca

SEQ ID NO: 419553 - DNA, 16 bp, M. musculus
gggtttctattgctgc

SEQ ID NO: 419554 - DNA, 16 bp, M. musculus
gggtttctctctgtaa

SEQ ID NO: 419555 - DNA, 16 bp, M. musculus
gggtttctctctgtat

SEQ ID NO: 419556 - DNA, 16 bp, M. musculus
gggtttctctctgtgg

SEQ ID NO: 419557 - DNA, 16 bp, M. musculus
gggtttctctgtggaa

SEQ ID NO: 419558 - DNA, 16 bp, M. musculus
gggtttctctgtgtaa

SEQ ID NO: 419559 - DNA, 16 bp, M. musculus
gggtttctttttatag

SEQ ID NO: 419560 - DNA, 16 bp, M. musculus
gggtttgaagccagcc

SEQ ID NO: 419561 - DNA, 16 bp, M. musculus
gggtttggagggagaa

SEQ ID NO: 419562 - DNA, 16 bp, M. musculus
gggtttggatgctgat

SEQ ID NO: 419563 - DNA, 16 bp, M. musculus
gggtttgtggaaagat

SEQ ID NO: 419564 - DNA, 16 bp, M. musculus
gggttttattactgtg

SEQ ID NO: 419565 - DNA, 16 bp, M. musculus
gggttttctgtgtagc

SEQ ID NO: 419566 - DNA, 16 bp, M. musculus
gggttttctgtttccc

SEQ ID NO: 419567 - DNA, 16 bp, M. musculus
gggttttcttcattgt

SEQ ID NO: 419568 - DNA, 21 bp, M. musculus
gggttttgagccgcccggtgc

SEQ ID NO: 419569 - DNA, 16 bp, M. musculus
gggtttttccagcttc

SEQ ID NO: 419570 - DNA, 16 bp, M. musculus
gggtttttctgtgtaa

SEQ ID NO: 419571 - DNA, 16 bp, M. musculus
gggttttttttccccc

SEQ ID NO: 419572 - DNA, 16 bp, M. musculus
ggtaaaaactgcatgg

SEQ ID NO: 419573 - DNA, 16 bp, M. musculus
ggtaaaagcacttgcc

SEQ ID NO: 419574 - DNA, 16 bp, M. musculus
ggtaaaattcaatgtt

SEQ ID NO: 419575 - DNA, 16 bp, M. musculus
ggtaaacagatctgtg

SEQ ID NO: 419576 - DNA, 17 bp, M. musculus
ggtaaaggccactgagg

SEQ ID NO: 419577 - DNA, 16 bp, M. musculus
ggtaaaggtgcttgca

SEQ ID NO: 419578 - DNA, 16 bp, M. musculus
ggtaaaggtgcttgct

SEQ ID NO: 419579 - DNA, 16 bp, M. musculus
ggtaaaggtgcttgtc

SEQ ID NO: 419580 - DNA, 16 bp, M. musculus
ggtaaagtgcttgctg

SEQ ID NO: 419581 - DNA, 16 bp, M. musculus
ggtaaagtgcttgctt

SEQ ID NO: 419582 - DNA, 16 bp, M. musculus
ggtaaagtgtttgctg

SEQ ID NO: 419583 - DNA, 16 bp, M. musculus
ggtaaccacagctgct

SEQ ID NO: 419584 - DNA, 16 bp, M. musculus
ggtaacttagacagga

SEQ ID NO: 419585 - DNA, 24 bp, M. musculus
ggtaagagcacccaactgctcttc

SEQ ID NO: 419586 - DNA, 24 bp, M. musculus
ggtaagagcacccgactgctcttc

SEQ ID NO: 419587 - DNA, 24 bp, M. musculus
ggtaagagcacccgattgctcttc

SEQ ID NO: 419588 - DNA, 24 bp, M. musculus
ggtaagagcacctgactgctcttc

SEQ ID NO: 419589 - DNA, 16 bp, M. musculus
ggtaaggactgaagga

SEQ ID NO: 419590 - DNA, 16 bp, M. musculus
ggtaaggagcacctgc

SEQ ID NO: 419591 - DNA, 16 bp, M. musculus
ggtaaggatgtggcac

SEQ ID NO: 419592 - DNA, 16 bp, M. musculus
ggtaaggtaaggtaag

SEQ ID NO: 419593 - DNA, 16 bp, M. musculus
ggtaagtaaggaggtg

SEQ ID NO: 419594 - DNA, 16 bp, M. musculus
ggtacacacacacata

SEQ ID NO: 419595 - DNA, 16 bp, M. musculus
ggtacacagacatcca

SEQ ID NO: 419596 - DNA, 16 bp, M. musculus
ggtacacaggcagaca

SEQ ID NO: 419597 - DNA, 16 bp, M. musculus
ggtacacctgggaggc

SEQ ID NO: 419598 - DNA, 16 bp, M. musculus
ggtacagagagagagt

SEQ ID NO: 419599 - DNA, 16 bp, M. musculus
ggtacagccttgctgg

SEQ ID NO: 419600 - DNA, 16 bp, M. musculus
ggtacaggcctttaat

SEQ ID NO: 419601 - DNA, 16 bp, M. musculus
ggtacagggaaagcat

SEQ ID NO: 419602 - DNA, 16 bp, M. musculus
ggtacatatatacaat

SEQ ID NO: 419603 - DNA, 16 bp, M. musculus
ggtacatgtgtgcaca

SEQ ID NO: 419604 - DNA, 17 bp, M. musculus
ggtacattgtggcttca

SEQ ID NO: 419605 - DNA, 16 bp, M. musculus
ggtacatttttacaat

SEQ ID NO: 419606 - DNA, 16 bp, M. musculus
ggtaccaacttctgtc

SEQ ID NO: 419607 - DNA, 16 bp, M. musculus
ggtaccaggcatgcat

SEQ ID NO: 419608 - DNA, 16 bp, M. musculus
ggtacccatggaagcc

SEQ ID NO: 419609 - DNA, 16 bp, M. musculus
ggtacccgtgttccca

SEQ ID NO: 419610 - DNA, 16 bp, M. musculus
ggtacctgcagaggtc

SEQ ID NO: 419611 - DNA, 16 bp, M. musculus
ggtaccttgtatctgt

SEQ ID NO: 419612 - DNA, 16 bp, M. musculus
ggtactaccagaggat

SEQ ID NO: 419613 - DNA, 16 bp, M. musculus
ggtactgaggattgaa

SEQ ID NO: 419614 - DNA, 16 bp, M. musculus
ggtactgcatgcatgt

SEQ ID NO: 419615 - DNA, 16 bp, M. musculus
ggtactggaaaccaaa

SEQ ID NO: 419616 - DNA, 16 bp, M. musculus
ggtactgggattaaag

SEQ ID NO: 419617 - DNA, 16 bp, M. musculus
ggtactggttttggag

SEQ ID NO: 419618 - DNA, 16 bp, M. musculus
ggtacttacccaagat

SEQ ID NO: 419619 - DNA, 16 bp, M. musculus
ggtactttgtggcttc

SEQ ID NO: 419620 - DNA, 16 bp, M. musculus
ggtactttgttcccca

SEQ ID NO: 419621 - DNA, 16 bp, M. musculus
ggtagaaacccccaaa

SEQ ID NO: 419622 - DNA, 16 bp, M. musculus
ggtagaagaagaaaac

SEQ ID NO: 419623 - DNA, 16 bp, M. musculus
ggtagaagaagagaac

SEQ ID NO: 419624 - DNA, 16 bp, M. musculus
ggtagaaggcaaggac

SEQ ID NO: 419625 - DNA, 16 bp, M. musculus
ggtagacaactctgga

SEQ ID NO: 419626 - DNA, 16 bp, M. musculus
ggtagaccaggctggc

SEQ ID NO: 419627 - DNA, 16 bp, M. musculus
ggtagagacagagaca

SEQ ID NO: 419628 - DNA, 16 bp, M. musculus
ggtagagagtgggcag

SEQ ID NO: 419629 - DNA, 16 bp, M. musculus
ggtagagatcctttcc

SEQ ID NO: 419630 - DNA, 16 bp, M. musculus
ggtagagcacatgctt

SEQ ID NO: 419631 - DNA, 16 bp, M. musculus
ggtagagcacttgcct

SEQ ID NO: 419632 - DNA, 16 bp, M. musculus
ggtagagcccttgcct

SEQ ID NO: 419633 - DNA, 16 bp, M. musculus
ggtagagctcttgctt

SEQ ID NO: 419634 - DNA, 16 bp, M. musculus
ggtagaggacttgcct

SEQ ID NO: 419635 - DNA, 17 bp, M. musculus
ggtagaggctgcaagaa

SEQ ID NO: 419636 - DNA, 16 bp, M. musculus
ggtagagggagagaac

SEQ ID NO: 419637 - DNA, 16 bp, M. musculus
ggtagagtgcttgtct

SEQ ID NO: 419638 - DNA, 16 bp, M. musculus
ggtagagtgtttgtct

SEQ ID NO: 419639 - DNA, 16 bp, M. musculus
ggtagatgagaatgaa

SEQ ID NO: 419640 - DNA, 16 bp, M. musculus
ggtagatttttttctt

SEQ ID NO: 419641 - DNA, 16 bp, M. musculus
ggtagattttttttct

SEQ ID NO: 419642 - DNA, 16 bp, M. musculus
ggtagcacacaggcag

SEQ ID NO: 419643 - DNA, 16 bp, M. musculus
ggtagcacatgcctgt

SEQ ID NO: 419644 - DNA, 16 bp, M. musculus
ggtagcagcagcagca

SEQ ID NO: 419645 - DNA, 16 bp, M. musculus
ggtagccatttttaca

SEQ ID NO: 419646 - DNA, 16 bp, M. musculus
ggtagcccatgccttt

SEQ ID NO: 419647 - DNA, 16 bp, M. musculus
ggtagctcacagccat

SEQ ID NO: 419648 - DNA, 16 bp, M. musculus
ggtagctcatgcctgt

SEQ ID NO: 419649 - DNA, 16 bp, M. musculus
ggtagctgagctggtc

SEQ ID NO: 419650 - DNA, 16 bp, M. musculus
ggtaggaacatggaag

SEQ ID NO: 419651 - DNA, 16 bp, M. musculus
ggtaggcctgacccac

SEQ ID NO: 419652 - DNA, 16 bp, M. musculus
ggtagggagcatggtg

SEQ ID NO: 419653 - DNA, 16 bp, M. musculus
ggtaggggtggggaca

SEQ ID NO: 419654 - DNA, 16 bp, M. musculus
ggtagtcagcctcagg

SEQ ID NO: 419655 - DNA, 17 bp, M. musculus
ggtagtctctgtatagt

SEQ ID NO: 419656 - DNA, 16 bp, M. musculus
ggtagtctctgtcttt

SEQ ID NO: 419657 - DNA, 16 bp, M. musculus
ggtagtgcatgtcttt

SEQ ID NO: 419658 - DNA, 16 bp, M. musculus
ggtagtggtggcgcac

SEQ ID NO: 419659 - DNA, 16 bp, M. musculus
ggtagtgtttgtcttt

SEQ ID NO: 419660 - DNA, 16 bp, M. musculus
ggtataacctgggcta

SEQ ID NO: 419661 - DNA, 16 bp, M. musculus
ggtatagagaaagaca

SEQ ID NO: 419662 - DNA, 16 bp, M. musculus
ggtatagatgagaagg

SEQ ID NO: 419663 - DNA, 16 bp, M. musculus
ggtatagctaggtcct

SEQ ID NO: 419664 - DNA, 16 bp, M. musculus
ggtatagctgggtctt

SEQ ID NO: 419665 - DNA, 16 bp, M. musculus
ggtatagctgtctcat

SEQ ID NO: 419666 - DNA, 16 bp, M. musculus
ggtatagtaacctggg

SEQ ID NO: 419667 - DNA, 16 bp, M. musculus
ggtatagtggtgcaca

SEQ ID NO: 419668 - DNA, 16 bp, M. musculus
ggtatatatacatata

SEQ ID NO: 419669 - DNA, 16 bp, M. musculus
ggtatatgtgtgtgtg

SEQ ID NO: 419670 - DNA, 16 bp, M. musculus
ggtatccacattcatt

SEQ ID NO: 419671 - DNA, 16 bp, M. musculus
ggtatctcaggaggag

SEQ ID NO: 419672 - DNA, 16 bp, M. musculus
ggtatctgtgtagaaa

SEQ ID NO: 419673 - DNA, 62 bp, M. musculus
ggtatgaacaggccttaatttcatctagcctctggcccaggaagagtgcacatttaaaggga

SEQ ID NO: 419674 - DNA, 16 bp, M. musculus
ggtatgaggtggaatc

SEQ ID NO: 419675 - DNA, 16 bp, M. musculus
ggtatgccagccagga

SEQ ID NO: 419676 - DNA, 16 bp, M. musculus
ggtatggcagactttt

SEQ ID NO: 419677 - DNA, 16 bp, M. musculus
ggtatggcagtctcta

SEQ ID NO: 419678 - DNA, 16 bp, M. musculus
ggtatggtggcacaca

SEQ ID NO: 419679 - DNA, 16 bp, M. musculus
ggtatggtggtgcaca

SEQ ID NO: 419680 - DNA, 16 bp, M. musculus
ggtatgtcagagctcc

SEQ ID NO: 419681 - DNA, 16 bp, M. musculus
ggtatgtgaattgtat

SEQ ID NO: 419682 - DNA, 16 bp, M. musculus
ggtatgtgtgtacaca

SEQ ID NO: 419683 - DNA, 16 bp, M. musculus
ggtatgtgtgtgtata

SEQ ID NO: 419684 - DNA, 16 bp, M. musculus
ggtattccagatgaat

SEQ ID NO: 419685 - DNA, 16 bp, M. musculus
ggtattccatggagat

SEQ ID NO: 419686 - DNA, 16 bp, M. musculus
ggtattctgaatttct

SEQ ID NO: 419687 - DNA, 16 bp, M. musculus
ggtattggttgggtta

SEQ ID NO: 419688 - DNA, 16 bp, M. musculus
ggtatttatttcattt

SEQ ID NO: 419689 - DNA, 16 bp, M. musculus
ggtatttgttcttctt

SEQ ID NO: 419690 - DNA, 16 bp, M. musculus
ggtattttccttattt

SEQ ID NO: 419691 - DNA, 16 bp, M. musculus
ggtattttggatttct

SEQ ID NO: 419692 - DNA, 16 bp, M. musculus
ggtattttgtcacaac

SEQ ID NO: 419693 - DNA, 16 bp, M. musculus
ggtcaaagaagaaggc

SEQ ID NO: 419694 - DNA, 16 bp, M. musculus
ggtcaaaggacaacct

SEQ ID NO: 419695 - DNA, 16 bp, M. musculus
ggtcaacaagctgaag

SEQ ID NO: 419696 - DNA, 16 bp, M. musculus
ggtcaagacccacagg

SEQ ID NO: 419697 - DNA, 16 bp, M. musculus
ggtcaagatgtttgtg

SEQ ID NO: 419698 - DNA, 16 bp, M. musculus
ggtcaaggacaccatg

SEQ ID NO: 419699 - DNA, 16 bp, M. musculus
ggtcaagtccaagtgg

SEQ ID NO: 419700 - DNA, 16 bp, M. musculus
ggtcaatttgcttcct

SEQ ID NO: 419701 - DNA, 16 bp, M. musculus
ggtcacaacatgagga

SEQ ID NO: 419702 - DNA, 16 bp, M. musculus
ggtcacagcactagga

SEQ ID NO: 419703 - DNA, 16 bp, M. musculus
ggtcacaggtcagcct

SEQ ID NO: 419704 - DNA, 16 bp, M. musculus
ggtcaccctctcccac

SEQ ID NO: 419705 - DNA, 16 bp, M. musculus
ggtcaccctgggctac

SEQ ID NO: 419706 - DNA, 16 bp, M. musculus
ggtcacctaaaaccat

SEQ ID NO: 419707 - DNA, 17 bp, M. musculus
ggtcacctgaaactgga

SEQ ID NO: 419708 - DNA, 16 bp, M. musculus
ggtcacttctccagcc

SEQ ID NO: 419709 - DNA, 16 bp, M. musculus
ggtcagaaaacaactt

SEQ ID NO: 419710 - DNA, 16 bp, M. musculus
ggtcagaaatgtgact

SEQ ID NO: 419711 - DNA, 16 bp, M. musculus
ggtcagaacccagaaa

SEQ ID NO: 419712 - DNA, 16 bp, M. musculus
ggtcagaagacaggag

SEQ ID NO: 419713 - DNA, 16 bp, M. musculus
ggtcagaagacagttt

SEQ ID NO: 419714 - DNA, 16 bp, M. musculus
ggtcagaagactccac

SEQ ID NO: 419715 - DNA, 16 bp, M. musculus
ggtcagaagagggcgt

SEQ ID NO: 419716 - DNA, 16 bp, M. musculus
ggtcagaagataactt

SEQ ID NO: 419717 - DNA, 16 bp, M. musculus
ggtcagaagttcaagg

SEQ ID NO: 419718 - DNA, 16 bp, M. musculus
ggtcagaagttcaggg

SEQ ID NO: 419719 - DNA, 16 bp, M. musculus
ggtcagagaactctct

SEQ ID NO: 419720 - DNA, 16 bp, M. musculus
ggtcagagccttccct

SEQ ID NO: 419721 - DNA, 16 bp, M. musculus
ggtcagaggcttggat

SEQ ID NO: 419722 - DNA, 16 bp, M. musculus
ggtcagattcttctca

SEQ ID NO: 419723 - DNA, 16 bp, M. musculus
ggtcagcagcttctgc

SEQ ID NO: 419724 - DNA, 16 bp, M. musculus
ggtcagcagttaagag

SEQ ID NO: 419725 - DNA, 16 bp, M. musculus
ggtcagccagggctgt

SEQ ID NO: 419726 - DNA, 16 bp, M. musculus
ggtcagcctgtgctat

SEQ ID NO: 419727 - DNA, 16 bp, M. musculus
ggtcagctgcctctgt

SEQ ID NO: 419728 - DNA, 16 bp, M. musculus
ggtcagctggagctga

SEQ ID NO: 419729 - DNA, 16 bp, M. musculus
ggtcaggaacctggag

SEQ ID NO: 419730 - DNA, 16 bp, M. musculus
ggtcaggcagggctcc

SEQ ID NO: 419731 - DNA, 16 bp, M. musculus
ggtcaggggtcaccac

SEQ ID NO: 419732 - DNA, 16 bp, M. musculus
ggtcaggtggagtggg

SEQ ID NO: 419733 - DNA, 16 bp, M. musculus
ggtcaggtggtggaaa

SEQ ID NO: 419734 - DNA, 16 bp, M. musculus
ggtcagtgaactcaac

SEQ ID NO: 419735 - DNA, 16 bp, M. musculus
ggtcagttctcagcac

SEQ ID NO: 419736 - DNA, 16 bp, M. musculus
ggtcatacacacacac

SEQ ID NO: 419737 - DNA, 16 bp, M. musculus
ggtcatagcattagga

SEQ ID NO: 419738 - DNA, 16 bp, M. musculus
ggtcatcccagaccca

SEQ ID NO: 419739 - DNA, 16 bp, M. musculus
ggtcatcctcagctat

SEQ ID NO: 419740 - DNA, 16 bp, M. musculus
ggtcatctgcttctgt

SEQ ID NO: 419741 - DNA, 16 bp, M. musculus
ggtcatgctgaccaca

SEQ ID NO: 419742 - DNA, 16 bp, M. musculus
ggtcatggagagcagc

SEQ ID NO: 419743 - DNA, 16 bp, M. musculus
ggtcatggagatcctg

SEQ ID NO: 419744 - DNA, 16 bp, M. musculus
ggtcatggctggcctc

SEQ ID NO: 419745 - DNA, 16 bp, M. musculus
ggtcatggtgtctggt

SEQ ID NO: 419746 - DNA, 17 bp, M. musculus
ggtcatttggggaacct

SEQ ID NO: 419747 - DNA, 16 bp, M. musculus
ggtccaaagaaacaag

SEQ ID NO: 419748 - DNA, 16 bp, M. musculus
ggtccacacaggagag

SEQ ID NO: 419749 - DNA, 16 bp, M. musculus
ggtccacttcccccac

SEQ ID NO: 419750 - DNA, 16 bp, M. musculus
ggtccacttgccccac

SEQ ID NO: 419751 - DNA, 16 bp, M. musculus
ggtccagatccagggc

SEQ ID NO: 419752 - DNA, 16 bp, M. musculus
ggtccaggctgccttt

SEQ ID NO: 419753 - DNA, 32 bp, M. musculus
ggtccagtagaaaggtgcacgtgtgtggctcc

SEQ ID NO: 419754 - DNA, 16 bp, M. musculus
ggtccagtgaaggttc

SEQ ID NO: 419755 - DNA, 16 bp, M. musculus
ggtccatgaagcccct

SEQ ID NO: 419756 - DNA, 16 bp, M. musculus
ggtcccaagaaacatg

SEQ ID NO: 419757 - DNA, 16 bp, M. musculus
ggtcccagcactgaga

SEQ ID NO: 419758 - DNA, 16 bp, M. musculus
ggtcccaggaactgaa

SEQ ID NO: 419759 - DNA, 16 bp, M. musculus
ggtccccaagctcagt

SEQ ID NO: 419760 - DNA, 16 bp, M. musculus
ggtccccaatgaagga

SEQ ID NO: 419761 - DNA, 16 bp, M. musculus
ggtccccaccagcacc

SEQ ID NO: 419762 - DNA, 16 bp, M. musculus
ggtccccagctagtgg

SEQ ID NO: 419763 - DNA, 16 bp, M. musculus
ggtccccgatggagga

SEQ ID NO: 419764 - DNA, 16 bp, M. musculus
ggtccctcaatctttc

SEQ ID NO: 419765 - DNA, 16 bp, M. musculus
ggtccctccaggtgta

SEQ ID NO: 419766 - DNA, 16 bp, M. musculus
ggtccctccatgtgta

SEQ ID NO: 419767 - DNA, 16 bp, M. musculus
ggtccctgtgtctgtg

SEQ ID NO: 419768 - DNA, 16 bp, M. musculus
ggtcccttgtgggtgg

SEQ ID NO: 419769 - DNA, 16 bp, M. musculus
ggtcctaggaatcaaa

SEQ ID NO: 419770 - DNA, 16 bp, M. musculus
ggtcctcctgcctcta

SEQ ID NO: 419771 - DNA, 16 bp, M. musculus
ggtcctctccaagaac

SEQ ID NO: 419772 - DNA, 16 bp, M. musculus
ggtcctctgcaaaggc

SEQ ID NO: 419773 - DNA, 16 bp, M. musculus
ggtcctctgcaagaag

SEQ ID NO: 419774 - DNA, 16 bp, M. musculus
ggtcctctgcaagagt

SEQ ID NO: 419775 - DNA, 16 bp, M. musculus
ggtcctctggaaaaat

SEQ ID NO: 419776 - DNA, 16 bp, M. musculus
ggtcctctggaagaga

SEQ ID NO: 419777 - DNA, 16 bp, M. musculus
ggtcctctggaagagc

SEQ ID NO: 419778 - DNA, 16 bp, M. musculus
ggtcctgagaaggctg

SEQ ID NO: 419779 - DNA, 16 bp, M. musculus
ggtcctgagccaccat

SEQ ID NO: 419780 - DNA, 16 bp, M. musculus
ggtcctgagtacaatt

SEQ ID NO: 419781 - DNA, 16 bp, M. musculus
ggtcctgcacctcacc

SEQ ID NO: 419782 - DNA, 16 bp, M. musculus
ggtcctgccagagcct

SEQ ID NO: 419783 - DNA, 16 bp, M. musculus
ggtcctggaaatcaaa

SEQ ID NO: 419784 - DNA, 16 bp, M. musculus
ggtcctgggaattgaa

SEQ ID NO: 419785 - DNA, 16 bp, M. musculus
ggtcctgggctctttt

SEQ ID NO: 419786 - DNA, 16 bp, M. musculus
ggtcctggggaggttt

SEQ ID NO: 419787 - DNA, 16 bp, M. musculus
ggtcctgggttctatc

SEQ ID NO: 419788 - DNA, 16 bp, M. musculus
ggtcctgggttttata

SEQ ID NO: 419789 - DNA, 16 bp, M. musculus
ggtcctgtgaagggtc

SEQ ID NO: 419790 - DNA, 16 bp, M. musculus
ggtcctgtgaaggttg

SEQ ID NO: 419791 - DNA, 16 bp, M. musculus
ggtcctgtggaagttt

SEQ ID NO: 419792 - DNA, 16 bp, M. musculus
ggtccttggggccagt

SEQ ID NO: 419793 - DNA, 16 bp, M. musculus
ggtccttgtgcttaca

SEQ ID NO: 419794 - DNA, 17 bp, M. musculus
ggtcctttcagcaaaat

SEQ ID NO: 419795 - DNA, 16 bp, M. musculus
ggtcctttctctggct

SEQ ID NO: 419796 - DNA, 16 bp, M. musculus
ggtcctttggaagatc

SEQ ID NO: 419797 - DNA, 16 bp, M. musculus
ggtctacagagtgatt

SEQ ID NO: 419798 - DNA, 16 bp, M. musculus
ggtctacagagtgtgt

SEQ ID NO: 419799 - DNA, 16 bp, M. musculus
ggtctacagatcaagt

SEQ ID NO: 419800 - DNA, 16 bp, M. musculus
ggtctacatagcaaat

SEQ ID NO: 419801 - DNA, 16 bp, M. musculus
ggtctaggacagccag

SEQ ID NO: 419802 - DNA, 16 bp, M. musculus
ggtctaggtccagctc

SEQ ID NO: 419803 - DNA, 16 bp, M. musculus
ggtctatacagagaaa

SEQ ID NO: 419804 - DNA, 16 bp, M. musculus
ggtctcaaaaaaaaaa

SEQ ID NO: 419805 - DNA, 16 bp, M. musculus
ggtctcactatgtaga

SEQ ID NO: 419806 - DNA, 16 bp, M. musculus
ggtctcactctgtggc

SEQ ID NO: 419807 - DNA, 16 bp, M. musculus
ggtctcactgtgtagc

SEQ ID NO: 419808 - DNA, 16 bp, M. musculus
ggtctcagctctgcct

SEQ ID NO: 419809 - DNA, 16 bp, M. musculus
ggtctcagtttcccca

SEQ ID NO: 419810 - DNA, 16 bp, M. musculus
ggtctcatttgttgat

SEQ ID NO: 419811 - DNA, 16 bp, M. musculus
ggtctccagaaaatca

SEQ ID NO: 419812 - DNA, 16 bp, M. musculus
ggtctccagcagaaga

SEQ ID NO: 419813 - DNA, 16 bp, M. musculus
ggtctccatggcaact

SEQ ID NO: 419814 - DNA, 16 bp, M. musculus
ggtctcccaggaatgc

SEQ ID NO: 419815 - DNA, 16 bp, M. musculus
ggtctcccctcccact

SEQ ID NO: 419816 - DNA, 16 bp, M. musculus
ggtctccctttcagaa

SEQ ID NO: 419817 - DNA, 16 bp, M. musculus
ggtctctgagtttgag

SEQ ID NO: 419818 - DNA, 16 bp, M. musculus
ggtctctggatgacct

SEQ ID NO: 419819 - DNA, 16 bp, M. musculus
ggtctctggatggcct

SEQ ID NO: 419820 - DNA, 16 bp, M. musculus
ggtctctggcatatcc

SEQ ID NO: 419821 - DNA, 16 bp, M. musculus
ggtctctggcttctgc

SEQ ID NO: 419822 - DNA, 16 bp, M. musculus
ggtctctgggtgcaga

SEQ ID NO: 419823 - DNA, 16 bp, M. musculus
ggtctctgtatagccc

SEQ ID NO: 419824 - DNA, 16 bp, M. musculus
ggtctctgttgagaag

SEQ ID NO: 419825 - DNA, 16 bp, M. musculus
ggtctctttatgtagc

SEQ ID NO: 419826 - DNA, 16 bp, M. musculus
ggtctgaacaccagat

SEQ ID NO: 419827 - DNA, 16 bp, M. musculus
ggtctgagaaatgtta

SEQ ID NO: 419828 - DNA, 16 bp, M. musculus
ggtctgagagaggaag

SEQ ID NO: 419829 - DNA, 16 bp, M. musculus
ggtctgaggcccctga

SEQ ID NO: 419830 - DNA, 16 bp, M. musculus
ggtctgaggtggaatc

SEQ ID NO: 419831 - DNA, 16 bp, M. musculus
ggtctgatgtctgtgt

SEQ ID NO: 419832 - DNA, 16 bp, M. musculus
ggtctgcagatagagg

SEQ ID NO: 419833 - DNA, 16 bp, M. musculus
ggtctggagagatggc

SEQ ID NO: 419834 - DNA, 16 bp, M. musculus
ggtctggcacctctgt

SEQ ID NO: 419835 - DNA, 16 bp, M. musculus
ggtctggctgtcctgg

SEQ ID NO: 419836 - DNA, 16 bp, M. musculus
ggtctggctgtctctg

SEQ ID NO: 419837 - DNA, 16 bp, M. musculus
ggtctggcttgagcat

SEQ ID NO: 419838 - DNA, 16 bp, M. musculus
ggtctgggttcagtca

SEQ ID NO: 419839 - DNA, 16 bp, M. musculus
ggtctgggtttcctca

SEQ ID NO: 419840 - DNA, 16 bp, M. musculus
ggtctggtctcagtga

SEQ ID NO: 419841 - DNA, 16 bp, M. musculus
ggtctgtgaattgcat

SEQ ID NO: 419842 - DNA, 16 bp, M. musculus
ggtctgtggagtacag

SEQ ID NO: 419843 - DNA, 16 bp, M. musculus
ggtctgtggattatag

SEQ ID NO: 419844 - DNA, 16 bp, M. musculus
ggtctgtttaaattgc

SEQ ID NO: 419845 - DNA, 16 bp, M. musculus
ggtcttactatatagc

SEQ ID NO: 419846 - DNA, 16 bp, M. musculus
ggtcttactctgtagc

SEQ ID NO: 419847 - DNA, 16 bp, M. musculus
ggtcttcagtcctttt

SEQ ID NO: 419848 - DNA, 16 bp, M. musculus
ggtcttcatgtttgtg

SEQ ID NO: 419849 - DNA, 16 bp, M. musculus
ggtcttcccacttcag

SEQ ID NO: 419850 - DNA, 27 bp, M. musculus
ggtcttcctcttcatgttgaaactggt

SEQ ID NO: 419851 - DNA, 16 bp, M. musculus
ggtcttcctggacctc

SEQ ID NO: 419852 - DNA, 16 bp, M. musculus
ggtcttccttcatctt

SEQ ID NO: 419853 - DNA, 16 bp, M. musculus
ggtcttctcgtcctgg

SEQ ID NO: 419854 - DNA, 16 bp, M. musculus
ggtcttctgcaagagc

SEQ ID NO: 419855 - DNA, 16 bp, M. musculus
ggtcttcttggaaggt

SEQ ID NO: 419856 - DNA, 16 bp, M. musculus
ggtcttgaaatcatgc

SEQ ID NO: 419857 - DNA, 16 bp, M. musculus
ggtcttgaaatttcat

SEQ ID NO: 419858 - DNA, 16 bp, M. musculus
ggtcttgaactcatga

SEQ ID NO: 419859 - DNA, 16 bp, M. musculus
ggtcttgaactctcaa

SEQ ID NO: 419860 - DNA, 16 bp, M. musculus
ggtcttgaacttctga

SEQ ID NO: 419861 - DNA, 17 bp, M. musculus
ggtcttgcaaactttat

SEQ ID NO: 419862 - DNA, 16 bp, M. musculus
ggtcttgccttagcaa

SEQ ID NO: 419863 - DNA, 16 bp, M. musculus
ggtcttgctctgtaga

SEQ ID NO: 419864 - DNA, 16 bp, M. musculus
ggtcttgctgtctcta

SEQ ID NO: 419865 - DNA, 16 bp, M. musculus
ggtcttgtatgtagaa

SEQ ID NO: 419866 - DNA, 16 bp, M. musculus
ggtcttgttcatttcc

SEQ ID NO: 419867 - DNA, 16 bp, M. musculus
ggtcttgttggaagaa

SEQ ID NO: 419868 - DNA, 16 bp, M. musculus
ggtctttccttcagtt

SEQ ID NO: 419869 - DNA, 16 bp, M. musculus
ggtctttctgagggca

SEQ ID NO: 419870 - DNA, 16 bp, M. musculus
ggtctttgacaaagaa

SEQ ID NO: 419871 - DNA, 16 bp, M. musculus
ggtctttgaggtttca

SEQ ID NO: 419872 - DNA, 16 bp, M. musculus
ggtctttggatgtgat

SEQ ID NO: 419873 - DNA, 16 bp, M. musculus
ggtctttgtgagttca

SEQ ID NO: 419874 - DNA, 16 bp, M. musculus
ggtctttgtgcttgca

SEQ ID NO: 419875 - DNA, 16 bp, M. musculus
ggtcttttacttgctt

SEQ ID NO: 419876 - DNA, 16 bp, M. musculus
ggtcttttgcaagaac

SEQ ID NO: 419877 - DNA, 16 bp, M. musculus
ggtcttttggaggaca

SEQ ID NO: 419878 - DNA, 16 bp, M. musculus
ggtcttttgtgactga

SEQ ID NO: 419879 - DNA, 16 bp, M. musculus
ggtgaaaagtctggtg

SEQ ID NO: 419880 - DNA, 16 bp, M. musculus
ggtgaaagaagctgag

SEQ ID NO: 419881 - DNA, 16 bp, M. musculus
ggtgaaagttcatgtt

SEQ ID NO: 419882 - DNA, 16 bp, M. musculus
ggtgaaatttacaagg

SEQ ID NO: 419883 - DNA, 16 bp, M. musculus
ggtgaactggtcaggc

SEQ ID NO: 419884 - DNA, 16 bp, M. musculus
ggtgaagaaggatgat

SEQ ID NO: 419885 - DNA, 16 bp, M. musculus
ggtgaagaatgtgact

SEQ ID NO: 419886 - DNA, 16 bp, M. musculus
ggtgaagaatgtggct

SEQ ID NO: 419887 - DNA, 16 bp, M. musculus
ggtgaagcaggagtgg

SEQ ID NO: 419888 - DNA, 16 bp, M. musculus
ggtgaaggaagaaata

SEQ ID NO: 419889 - DNA, 16 bp, M. musculus
ggtgaaggaggagctg

SEQ ID NO: 419890 - DNA, 16 bp, M. musculus
ggtgaaggcagaagga

SEQ ID NO: 419891 - DNA, 16 bp, M. musculus
ggtgaaggtgaaggtg

SEQ ID NO: 419892 - DNA, 16 bp, M. musculus
ggtgaaggtgtggaat

SEQ ID NO: 419893 - DNA, 16 bp, M. musculus
ggtgaatataatcaaa

SEQ ID NO: 419894 - DNA, 16 bp, M. musculus
ggtgaatatgataaaa

SEQ ID NO: 419895 - DNA, 16 bp, M. musculus
ggtgaatatgattaaa

SEQ ID NO: 419896 - DNA, 16 bp, M. musculus
ggtgaatttgcctcct

SEQ ID NO: 419897 - DNA, 16 bp, M. musculus
ggtgacaaatatgagt

SEQ ID NO: 419898 - DNA, 16 bp, M. musculus
ggtgacaacagatgct

SEQ ID NO: 419899 - DNA, 16 bp, M. musculus
ggtgacacaggcctgt

SEQ ID NO: 419900 - DNA, 38 bp, M. musculus
ggtgacactcgtagggcccaacaaggtccttatagaac

SEQ ID NO: 419901 - DNA, 16 bp, M. musculus
ggtgacagcagatgtg

SEQ ID NO: 419902 - DNA, 16 bp, M. musculus
ggtgacaggaaagctg

SEQ ID NO: 419903 - DNA, 16 bp, M. musculus
ggtgaccaagtgctgg

SEQ ID NO: 419904 - DNA, 16 bp, M. musculus
ggtgaccacagctgct

SEQ ID NO: 419905 - DNA, 16 bp, M. musculus
ggtgaccacagtcata

SEQ ID NO: 419906 - DNA, 16 bp, M. musculus
ggtgacccctatgaaa

SEQ ID NO: 419907 - DNA, 16 bp, M. musculus
ggtgacctggagctgg

SEQ ID NO: 419908 - DNA, 16 bp, M. musculus
ggtgactcacaactgt

SEQ ID NO: 419909 - DNA, 16 bp, M. musculus
ggtgactcccagccat

SEQ ID NO: 419910 - DNA, 16 bp, M. musculus
ggtgacttacaaccat

SEQ ID NO: 419911 - DNA, 16 bp, M. musculus
ggtgagaagcaggaag

SEQ ID NO: 419912 - DNA, 16 bp, M. musculus
ggtgagaagctggatg

SEQ ID NO: 419913 - DNA, 16 bp, M. musculus
ggtgagatcttgtctc

SEQ ID NO: 419914 - DNA, 16 bp, M. musculus
ggtgagatggctcaat

SEQ ID NO: 419915 - DNA, 16 bp, M. musculus
ggtgagcaccctcaca

SEQ ID NO: 419916 - DNA, 16 bp, M. musculus
ggtgagcctgggctac

SEQ ID NO: 419917 - DNA, 16 bp, M. musculus
ggtgagctggccctgc

SEQ ID NO: 419918 - DNA, 16 bp, M. musculus
ggtgagcttcaggttc

SEQ ID NO: 419919 - DNA, 16 bp, M. musculus
ggtgaggcagggggat

SEQ ID NO: 419920 - DNA, 16 bp, M. musculus
ggtgaggggcagggcc

SEQ ID NO: 419921 - DNA, 16 bp, M. musculus
ggtgaggggcagggct

SEQ ID NO: 419922 - DNA, 16 bp, M. musculus
ggtgaggtgctgagaa

SEQ ID NO: 419923 - DNA, 16 bp, M. musculus
ggtgagtgaaacttgc

SEQ ID NO: 419924 - DNA, 16 bp, M. musculus
ggtgagttcaaggcca

SEQ ID NO: 419925 - DNA, 21 bp, M. musculus
ggtgagttccaggacagccaa

SEQ ID NO: 419926 - DNA, 22 bp, M. musculus
ggtgagttccaggacagccagg

SEQ ID NO: 419927 - DNA, 16 bp, M. musculus
ggtgataaatatggat

SEQ ID NO: 419928 - DNA, 16 bp, M. musculus
ggtgatcagaagaagg

SEQ ID NO: 419929 - DNA, 16 bp, M. musculus
ggtgatgctgatgctg

SEQ ID NO: 419930 - DNA, 16 bp, M. musculus
ggtgatgctggtgatg

SEQ ID NO: 419931 - DNA, 16 bp, M. musculus
ggtgatgggcgagcaa

SEQ ID NO: 419932 - DNA, 16 bp, M. musculus
ggtgatggtgacagtg

SEQ ID NO: 419933 - DNA, 16 bp, M. musculus
ggtgatggtgatgata

SEQ ID NO: 419934 - DNA, 16 bp, M. musculus
ggtgatggtggtggct

SEQ ID NO: 419935 - DNA, 16 bp, M. musculus
ggtgatggtggtggtc

SEQ ID NO: 419936 - DNA, 26 bp, M. musculus
ggtgattccaccagaggttcttttat

SEQ ID NO: 419937 - DNA, 16 bp, M. musculus
ggtgattgtgagccat

SEQ ID NO: 419938 - DNA, 16 bp, M. musculus
ggtgatttctccagaa

SEQ ID NO: 419939 - DNA, 16 bp, M. musculus
ggtgatttgaactgtg

SEQ ID NO: 419940 - DNA, 16 bp, M. musculus
ggtgatttgataggat

SEQ ID NO: 419941 - DNA, 16 bp, M. musculus
ggtgcacacatttaat

SEQ ID NO: 419942 - DNA, 16 bp, M. musculus
ggtgcacacctgtgat

SEQ ID NO: 419943 - DNA, 16 bp, M. musculus
ggtgcacagatataca

SEQ ID NO: 419944 - DNA, 16 bp, M. musculus
ggtgcacatacacaca

SEQ ID NO: 419945 - DNA, 16 bp, M. musculus
ggtgcaccaaattgtc

SEQ ID NO: 419946 - DNA, 16 bp, M. musculus
ggtgcagaaggagctg

SEQ ID NO: 419947 - DNA, 16 bp, M. musculus
ggtgcagaatattcca

SEQ ID NO: 419948 - DNA, 16 bp, M. musculus
ggtgcagagacccaca

SEQ ID NO: 419949 - DNA, 16 bp, M. musculus
ggtgcagatgggcaag

SEQ ID NO: 419950 - DNA, 17 bp, M. musculus
ggtgcagcgtgtgcagg

SEQ ID NO: 419951 - DNA, 16 bp, M. musculus
ggtgcaggagaagctg

SEQ ID NO: 419952 - DNA, 16 bp, M. musculus
ggtgcaggagaaggag

SEQ ID NO: 419953 - DNA, 16 bp, M. musculus
ggtgcaggagagctgg

SEQ ID NO: 419954 - DNA, 16 bp, M. musculus
ggtgcaggaggacctg

SEQ ID NO: 419955 - DNA, 16 bp, M. musculus
ggtgcaggaggagatg

SEQ ID NO: 419956 - DNA, 16 bp, M. musculus
ggtgcaggaggagctg

SEQ ID NO: 419957 - DNA, 16 bp, M. musculus
ggtgcaggaggatctg

SEQ ID NO: 419958 - DNA, 16 bp, M. musculus
ggtgcaggcaggagga

SEQ ID NO: 419959 - DNA, 16 bp, M. musculus
ggtgcaggcctgtaat

SEQ ID NO: 419960 - DNA, 16 bp, M. musculus
ggtgcaggctgagctg

SEQ ID NO: 419961 - DNA, 16 bp, M. musculus
ggtgcaggtgcaggtg

SEQ ID NO: 419962 - DNA, 16 bp, M. musculus
ggtgcatcctctctga

SEQ ID NO: 419963 - DNA, 16 bp, M. musculus
ggtgcatcttctctga

SEQ ID NO: 419964 - DNA, 16 bp, M. musculus
ggtgcatgatgggaaa

SEQ ID NO: 419965 - DNA, 20 bp, M. musculus
ggtgcatgcctttaattcca

SEQ ID NO: 419966 - DNA, 16 bp, M. musculus
ggtgcatgtgtggagg

SEQ ID NO: 419967 - DNA, 16 bp, M. musculus
ggtgccacacaccttt

SEQ ID NO: 419968 - DNA, 16 bp, M. musculus
ggtgccaggaactgaa

SEQ ID NO: 419969 - DNA, 16 bp, M. musculus
ggtgccatccctgggt

SEQ ID NO: 419970 - DNA, 16 bp, M. musculus
ggtgccatcttggggc

SEQ ID NO: 419971 - DNA, 16 bp, M. musculus
ggtgccattcctgggt

SEQ ID NO: 419972 - DNA, 16 bp, M. musculus
ggtgcccaaggaggtc

SEQ ID NO: 419973 - DNA, 16 bp, M. musculus
ggtgcccaggactggc

SEQ ID NO: 419974 - DNA, 16 bp, M. musculus
ggtgcccaggactggg

SEQ ID NO: 419975 - DNA, 16 bp, M. musculus
ggtgcccagggaggcc

SEQ ID NO: 419976 - DNA, 16 bp, M. musculus
ggtgcccatggaggtc

SEQ ID NO: 419977 - DNA, 16 bp, M. musculus
ggtgcccctgtggcat

SEQ ID NO: 419978 - DNA, 16 bp, M. musculus
ggtgccctggaactgg

SEQ ID NO: 419979 - DNA, 16 bp, M. musculus
ggtgccctggtgctgg

SEQ ID NO: 419980 - DNA, 16 bp, M. musculus
ggtgcctcacagccat

SEQ ID NO: 419981 - DNA, 16 bp, M. musculus
ggtgcctccagtctct

SEQ ID NO: 419982 - DNA, 16 bp, M. musculus
ggtgcctgcagcatgg

SEQ ID NO: 419983 - DNA, 16 bp, M. musculus
ggtgcctgccaccaag

SEQ ID NO: 419984 - DNA, 16 bp, M. musculus
ggtgcctggggacagc

SEQ ID NO: 419985 - DNA, 16 bp, M. musculus
ggtgcctgtggagatc

SEQ ID NO: 419986 - DNA, 16 bp, M. musculus
ggtgcctttacccact

SEQ ID NO: 419987 - DNA, 16 bp, M. musculus
ggtgctagagattgaa

SEQ ID NO: 419988 - DNA, 16 bp, M. musculus
ggtgctaggattaaag

SEQ ID NO: 419989 - DNA, 16 bp, M. musculus
ggtgctcacagtcatc

SEQ ID NO: 419990 - DNA, 16 bp, M. musculus
ggtgctcactgctgta

SEQ ID NO: 419991 - DNA, 16 bp, M. musculus
ggtgctcttccagagg

SEQ ID NO: 419992 - DNA, 16 bp, M. musculus
ggtgctcttggaggcc

SEQ ID NO: 419993 - DNA, 16 bp, M. musculus
ggtgctgaaaatcaaa

SEQ ID NO: 419994 - DNA, 16 bp, M. musculus
ggtgctgaagagatgg

SEQ ID NO: 419995 - DNA, 16 bp, M. musculus
ggtgctgacagctgtg

SEQ ID NO: 419996 - DNA, 16 bp, M. musculus
ggtgctgagaaccaaa

SEQ ID NO: 419997 - DNA, 16 bp, M. musculus
ggtgctgagacttgaa

SEQ ID NO: 419998 - DNA, 16 bp, M. musculus
ggtgctgagattacag

SEQ ID NO: 419999 - DNA, 16 bp, M. musculus
ggtgctgaggaccaaa

SEQ ID NO: 420000 - DNA, 16 bp, M. musculus
ggtgctgaggatctga

SEQ ID NO: 420001 - DNA, 16 bp, M. musculus
ggtgctgaggattaaa

SEQ ID NO: 420002 - DNA, 16 bp, M. musculus
ggtgctgagtgtgtcc

SEQ ID NO: 420003 - DNA, 16 bp, M. musculus
ggtgctgatgctggtg

SEQ ID NO: 420004 - DNA, 16 bp, M. musculus
ggtgctgcagtgggcc

SEQ ID NO: 420005 - DNA, 16 bp, M. musculus
ggtgctgcccacagtg

SEQ ID NO: 420006 - DNA, 16 bp, M. musculus
ggtgctgctgctgctg

SEQ ID NO: 420007 - DNA, 16 bp, M. musculus
ggtgctggaaaccaaa

SEQ ID NO: 420008 - DNA, 16 bp, M. musculus
ggtgctggaaactgaa

SEQ ID NO: 420009 - DNA, 16 bp, M. musculus
ggtgctggaagagctg

SEQ ID NO: 420010 - DNA, 16 bp, M. musculus
ggtgctggagaaacag

SEQ ID NO: 420011 - DNA, 16 bp, M. musculus
ggtgctggagaaatgg

SEQ ID NO: 420012 - DNA, 16 bp, M. musculus
ggtgctggagaagaag

SEQ ID NO: 420013 - DNA, 16 bp, M. musculus
ggtgctggagaaggag

SEQ ID NO: 420014 - DNA, 16 bp, M. musculus
ggtgctggagaagttg

SEQ ID NO: 420015 - DNA, 16 bp, M. musculus
ggtgctggagaggaag

SEQ ID NO: 420016 - DNA, 16 bp, M. musculus
ggtgctggagatggag

SEQ ID NO: 420017 - DNA, 16 bp, M. musculus
ggtgctggagattgaa

SEQ ID NO: 420018 - DNA, 16 bp, M. musculus
ggtgctggaggagccc

SEQ ID NO: 420019 - DNA, 16 bp, M. musculus
ggtgctggaggagccg

SEQ ID NO: 420020 - DNA, 16 bp, M. musculus
ggtgctggaggaggag

SEQ ID NO: 420021 - DNA, 16 bp, M. musculus
ggtgctgggaaacaaa

SEQ ID NO: 420022 - DNA, 16 bp, M. musculus
ggtgctgggaactgag

SEQ ID NO: 420023 - DNA, 16 bp, M. musculus
ggtgctgggagccaaa

SEQ ID NO: 420024 - DNA, 16 bp, M. musculus
ggtgctgggatcaaag

SEQ ID NO: 420025 - DNA, 16 bp, M. musculus
ggtgctgggattaaag

SEQ ID NO: 420026 - DNA, 16 bp, M. musculus
ggtgctggggactgaa

SEQ ID NO: 420027 - DNA, 16 bp, M. musculus
ggtgctggggatcaaa

SEQ ID NO: 420028 - DNA, 16 bp, M. musculus
ggtgctggggtctgaa

SEQ ID NO: 420029 - DNA, 16 bp, M. musculus
ggtgctggtaaccaaa

SEQ ID NO: 420030 - DNA, 16 bp, M. musculus
ggtgctggtgctgacc

SEQ ID NO: 420031 - DNA, 16 bp, M. musculus
ggtgctggttcaaatg

SEQ ID NO: 420032 - DNA, 16 bp, M. musculus
ggtgctggttcagctg

SEQ ID NO: 420033 - DNA, 16 bp, M. musculus
ggtgctgtggtgctgt

SEQ ID NO: 420034 - DNA, 16 bp, M. musculus
ggtgcttgccactaag

SEQ ID NO: 420035 - DNA, 16 bp, M. musculus
ggtgcttgctaccaag

SEQ ID NO: 420036 - DNA, 16 bp, M. musculus
ggtgcttggaactgaa

SEQ ID NO: 420037 - DNA, 16 bp, M. musculus
ggtgcttggaatcaaa

SEQ ID NO: 420038 - DNA, 16 bp, M. musculus
ggtgcttgtcaccaag

SEQ ID NO: 420039 - DNA, 16 bp, M. musculus
ggtgctttctttagct

SEQ ID NO: 420040 - DNA, 16 bp, M. musculus
ggtggaacatcaatat

SEQ ID NO: 420041 - DNA, 16 bp, M. musculus
ggtggaacattatgaa

SEQ ID NO: 420042 - DNA, 16 bp, M. musculus
ggtggaaggaaaaaac

SEQ ID NO: 420043 - DNA, 16 bp, M. musculus
ggtggaaggagaaaac

SEQ ID NO: 420044 - DNA, 16 bp, M. musculus
ggtggaaggagagaac

SEQ ID NO: 420045 - DNA, 16 bp, M. musculus
ggtggaaggagagacc

SEQ ID NO: 420046 - DNA, 16 bp, M. musculus
ggtggaatccgggaac

SEQ ID NO: 420047 - DNA, 16 bp, M. musculus
ggtggaatttttgggt

SEQ ID NO: 420048 - DNA, 16 bp, M. musculus
ggtggacaaggagcag

SEQ ID NO: 420049 - DNA, 16 bp, M. musculus
ggtggacaaggagggg

SEQ ID NO: 420050 - DNA, 16 bp, M. musculus
ggtggacacctatcct

SEQ ID NO: 420051 - DNA, 16 bp, M. musculus
ggtggacagagagaac

SEQ ID NO: 420052 - DNA, 16 bp, M. musculus
ggtggacagccttgtc

SEQ ID NO: 420053 - DNA, 16 bp, M. musculus
ggtggaccagaagaag

SEQ ID NO: 420054 - DNA, 16 bp, M. musculus
ggtggactgggaggag

SEQ ID NO: 420055 - DNA, 16 bp, M. musculus
ggtggacttttttttt

SEQ ID NO: 420056 - DNA, 16 bp, M. musculus
ggtggagaaatggctc

SEQ ID NO: 420057 - DNA, 16 bp, M. musculus
ggtggagaagtctctg

SEQ ID NO: 420058 - DNA, 16 bp, M. musculus
ggtggagactggagga

SEQ ID NO: 420059 - DNA, 16 bp, M. musculus
ggtggagagggagcag

SEQ ID NO: 420060 - DNA, 16 bp, M. musculus
ggtggagctagagaaa

SEQ ID NO: 420061 - DNA, 16 bp, M. musculus
ggtggagctctgtgag

SEQ ID NO: 420062 - DNA, 16 bp, M. musculus
ggtggagcttaagcat

SEQ ID NO: 420063 - DNA, 16 bp, M. musculus
ggtggaggacaccaag

SEQ ID NO: 420064 - DNA, 16 bp, M. musculus
ggtggaggaggagctg

SEQ ID NO: 420065 - DNA, 16 bp, M. musculus
ggtggaggcagcagga

SEQ ID NO: 420066 - DNA, 16 bp, M. musculus
ggtggaggcaggagaa

SEQ ID NO: 420067 - DNA, 16 bp, M. musculus
ggtggaggccatggct

SEQ ID NO: 420068 - DNA, 16 bp, M. musculus
ggtggagtcttctgac

SEQ ID NO: 420069 - DNA, 16 bp, M. musculus
ggtggatctccgagtt

SEQ ID NO: 420070 - DNA, 16 bp, M. musculus
ggtggatctctctgag

SEQ ID NO: 420071 - DNA, 16 bp, M. musculus
ggtggatctctgagtc

SEQ ID NO: 420072 - DNA, 16 bp, M. musculus
ggtggatgactccaag

SEQ ID NO: 420073 - DNA, 16 bp, M. musculus
ggtggatgctctcagc

SEQ ID NO: 420074 - DNA, 16 bp, M. musculus
ggtggatggaggaatg

SEQ ID NO: 420075 - DNA, 16 bp, M. musculus
ggtggatggctcctga

SEQ ID NO: 420076 - DNA, 16 bp, M. musculus
ggtggattctcatatc

SEQ ID NO: 420077 - DNA, 16 bp, M. musculus
ggtggattttcccttt

SEQ ID NO: 420078 - DNA, 17 bp, M. musculus
ggtggcaaggtgctgag

SEQ ID NO: 420079 - DNA, 16 bp, M. musculus
ggtggcacacacttgc

SEQ ID NO: 420080 - DNA, 16 bp, M. musculus
ggtggcacatgccttc

SEQ ID NO: 420081 - DNA, 16 bp, M. musculus
ggtggcaccacccaca

SEQ ID NO: 420082 - DNA, 16 bp, M. musculus
ggtggcaccatctctg

SEQ ID NO: 420083 - DNA, 16 bp, M. musculus
ggtggcacctgccttt

SEQ ID NO: 420084 - DNA, 16 bp, M. musculus
ggtggcacgcaccttt

SEQ ID NO: 420085 - DNA, 16 bp, M. musculus
ggtggcacgtgcctgt

SEQ ID NO: 420086 - DNA, 16 bp, M. musculus
ggtggcagaagcagga

SEQ ID NO: 420087 - DNA, 16 bp, M. musculus
ggtggcagaggcaggt

SEQ ID NO: 420088 - DNA, 17 bp, M. musculus
ggtggcagccattccag

SEQ ID NO: 420089 - DNA, 16 bp, M. musculus
ggtggcaggtgctttt

SEQ ID NO: 420090 - DNA, 16 bp, M. musculus
ggtggcaggtgtgtgt

SEQ ID NO: 420091 - DNA, 16 bp, M. musculus
ggtggccaagaacctg

SEQ ID NO: 420092 - DNA, 16 bp, M. musculus
ggtggccctgtgttcc

SEQ ID NO: 420093 - DNA, 17 bp, M. musculus
ggtggccggctgtctgc

SEQ ID NO: 420094 - DNA, 16 bp, M. musculus
ggtggccggttgtctg

SEQ ID NO: 420095 - DNA, 16 bp, M. musculus
ggtggcctccaactca

SEQ ID NO: 420096 - DNA, 16 bp, M. musculus
ggtggcctgcttttga

SEQ ID NO: 420097 - DNA, 16 bp, M. musculus
ggtggccttgttggag

SEQ ID NO: 420098 - DNA, 16 bp, M. musculus
ggtggcctttttgtcc

SEQ ID NO: 420099 - DNA, 17 bp, M. musculus
ggtggcctttttgtctt

SEQ ID NO: 420100 - DNA, 16 bp, M. musculus
ggtggcgcccgctgct

SEQ ID NO: 420101 - DNA, 16 bp, M. musculus
ggtggcggcggcggca

SEQ ID NO: 420102 - DNA, 16 bp, M. musculus
ggtggctcacaactcc

SEQ ID NO: 420103 - DNA, 16 bp, M. musculus
ggtggctcacatctgc

SEQ ID NO: 420104 - DNA, 16 bp, M. musculus
ggtggctcagaaccac

SEQ ID NO: 420105 - DNA, 16 bp, M. musculus
ggtggctcaggaccat

SEQ ID NO: 420106 - DNA, 16 bp, M. musculus
ggtggctcataatcac

SEQ ID NO: 420107 - DNA, 16 bp, M. musculus
ggtggctctgtctctg

SEQ ID NO: 420108 - DNA, 16 bp, M. musculus
ggtggctgggatgtgg

SEQ ID NO: 420109 - DNA, 16 bp, M. musculus
ggtggctgtgaaccac

SEQ ID NO: 420110 - DNA, 16 bp, M. musculus
ggtggctgtgagccac

SEQ ID NO: 420111 - DNA, 16 bp, M. musculus
ggtggcttcctcctct

SEQ ID NO: 420112 - DNA, 16 bp, M. musculus
ggtggctttctgagtt

SEQ ID NO: 420113 - DNA, 16 bp, M. musculus
ggtgggaacatcctct

SEQ ID NO: 420114 - DNA, 16 bp, M. musculus
ggtgggacattctctg

SEQ ID NO: 420115 - DNA, 16 bp, M. musculus
ggtgggagagggagca

SEQ ID NO: 420116 - DNA, 16 bp, M. musculus
ggtgggaggataccca

SEQ ID NO: 420117 - DNA, 16 bp, M. musculus
ggtgggatcatggcag

SEQ ID NO: 420118 - DNA, 16 bp, M. musculus
ggtgggcatccaagcc

SEQ ID NO: 420119 - DNA, 16 bp, M. musculus
ggtgggctgggccctc

SEQ ID NO: 420120 - DNA, 16 bp, M. musculus
ggtgggctttgaggtc

SEQ ID NO: 420121 - DNA, 16 bp, M. musculus
ggtgggctttgggatt

SEQ ID NO: 420122 - DNA, 16 bp, M. musculus
ggtggggaagcaggag

SEQ ID NO: 420123 - DNA, 16 bp, M. musculus
ggtggggaagccaagg

SEQ ID NO: 420124 - DNA, 16 bp, M. musculus
ggtggggaagtaccct

SEQ ID NO: 420125 - DNA, 16 bp, M. musculus
ggtggggacatggcag

SEQ ID NO: 420126 - DNA, 16 bp, M. musculus
ggtggggcactctctg

SEQ ID NO: 420127 - DNA, 16 bp, M. musculus
ggtggggcagtctcta

SEQ ID NO: 420128 - DNA, 16 bp, M. musculus
ggtggggctggtgaga

SEQ ID NO: 420129 - DNA, 16 bp, M. musculus
ggtggggcttctgccc

SEQ ID NO: 420130 - DNA, 16 bp, M. musculus
ggtggggtcctggcct

SEQ ID NO: 420131 - DNA, 16 bp, M. musculus
ggtgggtaagggaaca

SEQ ID NO: 420132 - DNA, 16 bp, M. musculus
ggtgggtatctggctg

SEQ ID NO: 420133 - DNA, 16 bp, M. musculus
ggtgggtcacaaccat

SEQ ID NO: 420134 - DNA, 16 bp, M. musculus
ggtgggtctctgagtt

SEQ ID NO: 420135 - DNA, 16 bp, M. musculus
ggtgggtctctgtgaa

SEQ ID NO: 420136 - DNA, 16 bp, M. musculus
ggtgggtggatggata

SEQ ID NO: 420137 - DNA, 16 bp, M. musculus
ggtggtcaggaaggac

SEQ ID NO: 420138 - DNA, 16 bp, M. musculus
ggtggtcatgggttct

SEQ ID NO: 420139 - DNA, 16 bp, M. musculus
ggtggtcattcatggt

SEQ ID NO: 420140 - DNA, 16 bp, M. musculus
ggtggtcattgctgac

SEQ ID NO: 420141 - DNA, 16 bp, M. musculus
ggtggtccagtgtctg

SEQ ID NO: 420142 - DNA, 16 bp, M. musculus
ggtggtcctggattct

SEQ ID NO: 420143 - DNA, 16 bp, M. musculus
ggtggtcctgggttgt

SEQ ID NO: 420144 - DNA, 16 bp, M. musculus
ggtggtgacagtggtg

SEQ ID NO: 420145 - DNA, 16 bp, M. musculus
ggtggtgatgatgatt

SEQ ID NO: 420146 - DNA, 16 bp, M. musculus
ggtggtgatgctgctg

SEQ ID NO: 420147 - DNA, 16 bp, M. musculus
ggtggtgatgctggtg

SEQ ID NO: 420148 - DNA, 16 bp, M. musculus
ggtggtgcacaccctt

SEQ ID NO: 420149 - DNA, 16 bp, M. musculus
ggtggtgcacacctgt

SEQ ID NO: 420150 - DNA, 16 bp, M. musculus
ggtggtgcagtgtttg

SEQ ID NO: 420151 - DNA, 16 bp, M. musculus
ggtggtgccatcctgg

SEQ ID NO: 420152 - DNA, 16 bp, M. musculus
ggtggtgctgatgctg

SEQ ID NO: 420153 - DNA, 16 bp, M. musculus
ggtggtgctgatggtg

SEQ ID NO: 420154 - DNA, 16 bp, M. musculus
ggtggtggcagcagca

SEQ ID NO: 420155 - DNA, 16 bp, M. musculus
ggtggtggcagcagct

SEQ ID NO: 420156 - DNA, 16 bp, M. musculus
ggtggtggcagcagtg

SEQ ID NO: 420157 - DNA, 19 bp, M. musculus
ggtggtggcgcacaccttt

SEQ ID NO: 420158 - DNA, 16 bp, M. musculus
ggtggtggcggcacat

SEQ ID NO: 420159 - DNA, 16 bp, M. musculus
ggtggtgggggagcac

SEQ ID NO: 420160 - DNA, 16 bp, M. musculus
ggtggtgggggagccc

SEQ ID NO: 420161 - DNA, 16 bp, M. musculus
ggtggtggtcctggtt

SEQ ID NO: 420162 - DNA, 16 bp, M. musculus
ggtggtggtgatgctg

SEQ ID NO: 420163 - DNA, 16 bp, M. musculus
ggtggtggtgcaggcc

SEQ ID NO: 420164 - DNA, 19 bp, M. musculus
ggtggtggtgcatgccttt

SEQ ID NO: 420165 - DNA, 16 bp, M. musculus
ggtggtggtggcacac

SEQ ID NO: 420166 - DNA, 16 bp, M. musculus
ggtggtggtggcgcac

SEQ ID NO: 420167 - DNA, 16 bp, M. musculus
ggtggtggtggggcac

SEQ ID NO: 420168 - DNA, 16 bp, M. musculus
ggtggtggtggtagca

SEQ ID NO: 420169 - DNA, 16 bp, M. musculus
ggtggtggtggtgaca

SEQ ID NO: 420170 - DNA, 16 bp, M. musculus
ggtggtggtggtgcac

SEQ ID NO: 420171 - DNA, 16 bp, M. musculus
ggtggtggtggtggca

SEQ ID NO: 420172 - DNA, 16 bp, M. musculus
ggtggtgtgcaggcag

SEQ ID NO: 420173 - DNA, 16 bp, M. musculus
ggtggtgttgctgctg

SEQ ID NO: 420174 - DNA, 16 bp, M. musculus
ggtggttctctgagtt

SEQ ID NO: 420175 - DNA, 16 bp, M. musculus
ggtggttctgagttct

SEQ ID NO: 420176 - DNA, 29 bp, M. musculus
ggtggttgtgagccaccatgtggttgctg

SEQ ID NO: 420177 - DNA, 16 bp, M. musculus
ggtggtttcatccctg

SEQ ID NO: 420178 - DNA, 16 bp, M. musculus
ggtggtttggggagca

SEQ ID NO: 420179 - DNA, 16 bp, M. musculus
ggtgtaactcagtggt

SEQ ID NO: 420180 - DNA, 34 bp, M. musculus
ggtgtaatccactgatcataaaatttactgctaa

SEQ ID NO: 420181 - DNA, 16 bp, M. musculus
ggtgtaattcttatag

SEQ ID NO: 420182 - DNA, 16 bp, M. musculus
ggtgtacaccaccatg

SEQ ID NO: 420183 - DNA, 16 bp, M. musculus
ggtgtacacttttaat

SEQ ID NO: 420184 - DNA, 16 bp, M. musculus
ggtgtactcatataca

SEQ ID NO: 420185 - DNA, 16 bp, M. musculus
ggtgtacttgtctgtc

SEQ ID NO: 420186 - DNA, 16 bp, M. musculus
ggtgtagctcagatta

SEQ ID NO: 420187 - DNA, 16 bp, M. musculus
ggtgtaggggactttt

SEQ ID NO: 420188 - DNA, 16 bp, M. musculus
ggtgtatatgtgtgtg

SEQ ID NO: 420189 - DNA, 16 bp, M. musculus
ggtgtatggatctgtg

SEQ ID NO: 420190 - DNA, 16 bp, M. musculus
ggtgtcaaaaaaaaaa

SEQ ID NO: 420191 - DNA, 16 bp, M. musculus
ggtgtcagaatttgga

SEQ ID NO: 420192 - DNA, 16 bp, M. musculus
ggtgtcatttctcagg

SEQ ID NO: 420193 - DNA, 16 bp, M. musculus
ggtgtccacagcccat

SEQ ID NO: 420194 - DNA, 16 bp, M. musculus
ggtgtccacctgggag

SEQ ID NO: 420195 - DNA, 16 bp, M. musculus
ggtgtcctcgcccaga

SEQ ID NO: 420196 - DNA, 16 bp, M. musculus
ggtgtcctctggcctc

SEQ ID NO: 420197 - DNA, 16 bp, M. musculus
ggtgtctgaggaggcc

SEQ ID NO: 420198 - DNA, 16 bp, M. musculus
ggtgtctgatcacagc

SEQ ID NO: 420199 - DNA, 16 bp, M. musculus
ggtgtctgcccaggag

SEQ ID NO: 420200 - DNA, 16 bp, M. musculus
ggtgtctgccctgcct

SEQ ID NO: 420201 - DNA, 16 bp, M. musculus
ggtgtctgcctggccc

SEQ ID NO: 420202 - DNA, 16 bp, M. musculus
ggtgtctgtgtctgtc

SEQ ID NO: 420203 - DNA, 16 bp, M. musculus
ggtgtcttagtcaggg

SEQ ID NO: 420204 - DNA, 16 bp, M. musculus
ggtgtgaattgggttc

SEQ ID NO: 420205 - DNA, 16 bp, M. musculus
ggtgtgagccaccaca

SEQ ID NO: 420206 - DNA, 16 bp, M. musculus
ggtgtgagccaccacg

SEQ ID NO: 420207 - DNA, 16 bp, M. musculus
ggtgtgagccaccgtg

SEQ ID NO: 420208 - DNA, 16 bp, M. musculus
ggtgtgagctctcagc

SEQ ID NO: 420209 - DNA, 16 bp, M. musculus
ggtgtgagcttttgaa

SEQ ID NO: 420210 - DNA, 16 bp, M. musculus
ggtgtgagggtgtcag

SEQ ID NO: 420211 - DNA, 16 bp, M. musculus
ggtgtgaggtggaata

SEQ ID NO: 420212 - DNA, 16 bp, M. musculus
ggtgtgaggtggcatc

SEQ ID NO: 420213 - DNA, 16 bp, M. musculus
ggtgtgattctaatag

SEQ ID NO: 420214 - DNA, 16 bp, M. musculus
ggtgtgcagacataca

SEQ ID NO: 420215 - DNA, 16 bp, M. musculus
ggtgtgcaggtgtgca

SEQ ID NO: 420216 - DNA, 16 bp, M. musculus
ggtgtgcatgccttta

SEQ ID NO: 420217 - DNA, 16 bp, M. musculus
ggtgtgcatgtggagg

SEQ ID NO: 420218 - DNA, 16 bp, M. musculus
ggtgtgccactgtggg

SEQ ID NO: 420219 - DNA, 16 bp, M. musculus
ggtgtgccccaccatg

SEQ ID NO: 420220 - DNA, 18 bp, M. musculus
ggtgtgcgccaccacgcc

SEQ ID NO: 420221 - DNA, 16 bp, M. musculus
ggtgtgcgtgcatgtg

SEQ ID NO: 420222 - DNA, 16 bp, M. musculus
ggtgtggaatgtggaa

SEQ ID NO: 420223 - DNA, 26 bp, M. musculus
ggtgtggacacgccacactaaggtgt

SEQ ID NO: 420224 - DNA, 16 bp, M. musculus
ggtgtggcaggcctct

SEQ ID NO: 420225 - DNA, 16 bp, M. musculus
ggtgtggccctgttgt

SEQ ID NO: 420226 - DNA, 16 bp, M. musculus
ggtgtggcctttttgg

SEQ ID NO: 420227 - DNA, 16 bp, M. musculus
ggtgtgggacactcag

SEQ ID NO: 420228 - DNA, 16 bp, M. musculus
ggtgtgggctttaata

SEQ ID NO: 420229 - DNA, 16 bp, M. musculus
ggtgtgggtgcaggtg

SEQ ID NO: 420230 - DNA, 16 bp, M. musculus
ggtgtggtagcgcacg

SEQ ID NO: 420231 - DNA, 16 bp, M. musculus
ggtgtggtgacacaca

SEQ ID NO: 420232 - DNA, 16 bp, M. musculus
ggtgtggtgaccccaa

SEQ ID NO: 420233 - DNA, 16 bp, M. musculus
ggtgtggtgatgcaca

SEQ ID NO: 420234 - DNA, 16 bp, M. musculus
ggtgtggtggcatgca

SEQ ID NO: 420235 - DNA, 16 bp, M. musculus
ggtgtggtggctgaca

SEQ ID NO: 420236 - DNA, 16 bp, M. musculus
ggtgtggtggtacagg

SEQ ID NO: 420237 - DNA, 16 bp, M. musculus
ggtgtggtggtgaaca

SEQ ID NO: 420238 - DNA, 16 bp, M. musculus
ggtgtggtggtgcaca

SEQ ID NO: 420239 - DNA, 16 bp, M. musculus
ggtgtgtaccaccaca

SEQ ID NO: 420240 - DNA, 16 bp, M. musculus
ggtgtgtcactgtggc

SEQ ID NO: 420241 - DNA, 16 bp, M. musculus
ggtgtgtcactgtggg

SEQ ID NO: 420242 - DNA, 16 bp, M. musculus
ggtgtgtgccactacc

SEQ ID NO: 420243 - DNA, 16 bp, M. musculus
ggtgtgtggctcagtg

SEQ ID NO: 420244 - DNA, 16 bp, M. musculus
ggtgtgtgggagctgg

SEQ ID NO: 420245 - DNA, 16 bp, M. musculus
ggtgtgtgtcaccatc

SEQ ID NO: 420246 - DNA, 16 bp, M. musculus
ggtgtgtgtgcatatg

SEQ ID NO: 420247 - DNA, 16 bp, M. musculus
ggtgtgttcctctttc

SEQ ID NO: 420248 - DNA, 16 bp, M. musculus
ggtgtgttggagtatc

SEQ ID NO: 420249 - DNA, 16 bp, M. musculus
ggtgtgtttgaagaga

SEQ ID NO: 420250 - DNA, 16 bp, M. musculus
ggtgttagatcccttg

SEQ ID NO: 420251 - DNA, 16 bp, M. musculus
ggtgttattctgatag

SEQ ID NO: 420252 - DNA, 16 bp, M. musculus
ggtgttggaaactgaa

SEQ ID NO: 420253 - DNA, 16 bp, M. musculus
ggtgttgggattacag

SEQ ID NO: 420254 - DNA, 18 bp, M. musculus
ggtgttgtgggtagctgg

SEQ ID NO: 420255 - DNA, 16 bp, M. musculus
ggtgtttgctattgaa

SEQ ID NO: 420256 - DNA, 16 bp, M. musculus
ggtgttttaaaatgtt

SEQ ID NO: 420257 - DNA, 16 bp, M. musculus
ggtgttttctcagttg

SEQ ID NO: 420258 - DNA, 16 bp, M. musculus
ggtgttttgcctgcac

SEQ ID NO: 420259 - DNA, 16 bp, M. musculus
ggtgttttgcttgcat

SEQ ID NO: 420260 - DNA, 16 bp, M. musculus
ggtgtttttttcccaa

SEQ ID NO: 420261 - DNA, 16 bp, M. musculus
ggttaaattcccagca

SEQ ID NO: 420262 - DNA, 16 bp, M. musculus
ggttaagaacacttgt

SEQ ID NO: 420263 - DNA, 16 bp, M. musculus
ggttaagagcacttcc

SEQ ID NO: 420264 - DNA, 16 bp, M. musculus
ggttaagagcatcgac

SEQ ID NO: 420265 - DNA, 16 bp, M. musculus
ggttaagagcattagc

SEQ ID NO: 420266 - DNA, 16 bp, M. musculus
ggttaagagcatttgt

SEQ ID NO: 420267 - DNA, 16 bp, M. musculus
ggttaagagtgcttgc

SEQ ID NO: 420268 - DNA, 17 bp, M. musculus
ggttaagggcactgact

SEQ ID NO: 420269 - DNA, 16 bp, M. musculus
ggttaatggcaggagg

SEQ ID NO: 420270 - DNA, 17 bp, M. musculus
ggttaattcataatgtt

SEQ ID NO: 420271 - DNA, 16 bp, M. musculus
ggttacagacctcagg

SEQ ID NO: 420272 - DNA, 16 bp, M. musculus
ggttacatagtgagac

SEQ ID NO: 420273 - DNA, 16 bp, M. musculus
ggttactgggtattgt

SEQ ID NO: 420274 - DNA, 19 bp, M. musculus
ggttacttgctacaccaat

SEQ ID NO: 420275 - DNA, 16 bp, M. musculus
ggttagaaagatggct

SEQ ID NO: 420276 - DNA, 16 bp, M. musculus
ggttagagtattctct

SEQ ID NO: 420277 - DNA, 16 bp, M. musculus
ggttagctttaattgt

SEQ ID NO: 420278 - DNA, 16 bp, M. musculus
ggttagggaagttttc

SEQ ID NO: 420279 - DNA, 16 bp, M. musculus
ggttataaagagaaac

SEQ ID NO: 420280 - DNA, 16 bp, M. musculus
ggttataagccaccat

SEQ ID NO: 420281 - DNA, 16 bp, M. musculus
ggttatatttatattc

SEQ ID NO: 420282 - DNA, 16 bp, M. musculus
ggttatcatgaagaag

SEQ ID NO: 420283 - DNA, 16 bp, M. musculus
ggttatcctggaactc

SEQ ID NO: 420284 - DNA, 16 bp, M. musculus
ggttatctgataggat

SEQ ID NO: 420285 - DNA, 16 bp, M. musculus
ggttatgtagagagac

SEQ ID NO: 420286 - DNA, 16 bp, M. musculus
ggttattgacagggaa

SEQ ID NO: 420287 - DNA, 16 bp, M. musculus
ggttattggttggcca

SEQ ID NO: 420288 - DNA, 16 bp, M. musculus
ggttcaaagccagcct

SEQ ID NO: 420289 - DNA, 16 bp, M. musculus
ggttcaaatcctggct

SEQ ID NO: 420290 - DNA, 16 bp, M. musculus
ggttcaagcctgggag

SEQ ID NO: 420291 - DNA, 16 bp, M. musculus
ggttcaaggtcagcct

SEQ ID NO: 420292 - DNA, 16 bp, M. musculus
ggttcaagtcccagaa

SEQ ID NO: 420293 - DNA, 16 bp, M. musculus
ggttcaagtcccagca

SEQ ID NO: 420294 - DNA, 19 bp, M. musculus
ggttcaattcccagcacct

SEQ ID NO: 420295 - DNA, 16 bp, M. musculus
ggttcaattcccagta

SEQ ID NO: 420296 - DNA, 16 bp, M. musculus
ggttcaatttccagca

SEQ ID NO: 420297 - DNA, 17 bp, M. musculus
ggttcacgcagcaactt

SEQ ID NO: 420298 - DNA, 16 bp, M. musculus
ggttcacttcccagca

SEQ ID NO: 420299 - DNA, 16 bp, M. musculus
ggttcagacctcagct

SEQ ID NO: 420300 - DNA, 16 bp, M. musculus
ggttcagaggttcagc

SEQ ID NO: 420301 - DNA, 16 bp, M. musculus
ggttcagaggttgagt

SEQ ID NO: 420302 - DNA, 16 bp, M. musculus
ggttcaggcagaagat

SEQ ID NO: 420303 - DNA, 16 bp, M. musculus
ggttcagggtcttcct

SEQ ID NO: 420304 - DNA, 16 bp, M. musculus
ggttcagtgtctggga

SEQ ID NO: 420305 - DNA, 16 bp, M. musculus
ggttcagttcccagct

SEQ ID NO: 420306 - DNA, 16 bp, M. musculus
ggttcagtttccagaa

SEQ ID NO: 420307 - DNA, 16 bp, M. musculus
ggttcagtttctagta

SEQ ID NO: 420308 - DNA, 16 bp, M. musculus
ggttcatgtatttgaa

SEQ ID NO: 420309 - DNA, 16 bp, M. musculus
ggttcattttctggat

SEQ ID NO: 420310 - DNA, 16 bp, M. musculus
ggttccaacgccctac

SEQ ID NO: 420311 - DNA, 16 bp, M. musculus
ggttccaagaaacaag

SEQ ID NO: 420312 - DNA, 16 bp, M. musculus
ggttccactccctgtt

SEQ ID NO: 420313 - DNA, 16 bp, M. musculus
ggttccagagaagttc

SEQ ID NO: 420314 - DNA, 16 bp, M. musculus
ggttccagaggcagct

SEQ ID NO: 420315 - DNA, 16 bp, M. musculus
ggttccaggacagcca

SEQ ID NO: 420316 - DNA, 16 bp, M. musculus
ggttccaggactctgc

SEQ ID NO: 420317 - DNA, 16 bp, M. musculus
ggttccagggaccaaa

SEQ ID NO: 420318 - DNA, 16 bp, M. musculus
ggttccagtcagcagt

SEQ ID NO: 420319 - DNA, 16 bp, M. musculus
ggttccagtgtcagct

SEQ ID NO: 420320 - DNA, 16 bp, M. musculus
ggttccatctccagca

SEQ ID NO: 420321 - DNA, 16 bp, M. musculus
ggttccattcccagca

SEQ ID NO: 420322 - DNA, 16 bp, M. musculus
ggttccatttctctct

SEQ ID NO: 420323 - DNA, 16 bp, M. musculus
ggttcccagtgcccac

SEQ ID NO: 420324 - DNA, 16 bp, M. musculus
ggttcccagttggtgg

SEQ ID NO: 420325 - DNA, 16 bp, M. musculus
ggttccctcttccaaa

SEQ ID NO: 420326 - DNA, 16 bp, M. musculus
ggttccctggaagagc

SEQ ID NO: 420327 - DNA, 16 bp, M. musculus
ggttcctaccctgact

SEQ ID NO: 420328 - DNA, 16 bp, M. musculus
ggttcctagcacccac

SEQ ID NO: 420329 - DNA, 16 bp, M. musculus
ggttcctgccctgcct

SEQ ID NO: 420330 - DNA, 16 bp, M. musculus
ggttcctggactcagc

SEQ ID NO: 420331 - DNA, 16 bp, M. musculus
ggttcctgggaccaga

SEQ ID NO: 420332 - DNA, 16 bp, M. musculus
ggttcctgtggcttct

SEQ ID NO: 420333 - DNA, 16 bp, M. musculus
ggttccttccctgttt

SEQ ID NO: 420334 - DNA, 16 bp, M. musculus
ggttccttttgatcag

SEQ ID NO: 420335 - DNA, 16 bp, M. musculus
ggttcgagtattaaag

SEQ ID NO: 420336 - DNA, 16 bp, M. musculus
ggttctacaaccttcc

SEQ ID NO: 420337 - DNA, 16 bp, M. musculus
ggttctaccagcacct

SEQ ID NO: 420338 - DNA, 16 bp, M. musculus
ggttctaggacagcca

SEQ ID NO: 420339 - DNA, 16 bp, M. musculus
ggttctcaactttcct

SEQ ID NO: 420340 - DNA, 16 bp, M. musculus
ggttctcagcctccag

SEQ ID NO: 420341 - DNA, 16 bp, M. musculus
ggttctctcccacccc

SEQ ID NO: 420342 - DNA, 16 bp, M. musculus
ggttctctgtgtgtgt

SEQ ID NO: 420343 - DNA, 16 bp, M. musculus
ggttctgagcttgcaa

SEQ ID NO: 420344 - DNA, 16 bp, M. musculus
ggttctgaggatccaa

SEQ ID NO: 420345 - DNA, 16 bp, M. musculus
ggttctgatgatgcaa

SEQ ID NO: 420346 - DNA, 16 bp, M. musculus
ggttctgatgatgcca

SEQ ID NO: 420347 - DNA, 16 bp, M. musculus
ggttctgatgattcca

SEQ ID NO: 420348 - DNA, 16 bp, M. musculus
ggttctgccagcacct

SEQ ID NO: 420349 - DNA, 16 bp, M. musculus
ggttctggagaaggag

SEQ ID NO: 420350 - DNA, 16 bp, M. musculus
ggttctgggaacagaa

SEQ ID NO: 420351 - DNA, 16 bp, M. musculus
ggttctgggaattcaa

SEQ ID NO: 420352 - DNA, 16 bp, M. musculus
ggttctgggactctgc

SEQ ID NO: 420353 - DNA, 16 bp, M. musculus
ggttctggggacccaa

SEQ ID NO: 420354 - DNA, 16 bp, M. musculus
ggttctggttctggtt

SEQ ID NO: 420355 - DNA, 16 bp, M. musculus
ggttctgtcttttcaa

SEQ ID NO: 420356 - DNA, 16 bp, M. musculus
ggttctgttgatggtg

SEQ ID NO: 420357 - DNA, 16 bp, M. musculus
ggttcttaacctgtgg

SEQ ID NO: 420358 - DNA, 16 bp, M. musculus
ggttcttatacctcta

SEQ ID NO: 420359 - DNA, 16 bp, M. musculus
ggttcttcagttttgt

SEQ ID NO: 420360 - DNA, 16 bp, M. musculus
ggttcttggacttggc

SEQ ID NO: 420361 - DNA, 16 bp, M. musculus
ggttctttcagaaaat

SEQ ID NO: 420362 - DNA, 17 bp, M. musculus
ggttctttcagcaaaat

SEQ ID NO: 420363 - DNA, 25 bp, M. musculus
ggttctttccagcttctggctatta

SEQ ID NO: 420364 - DNA, 29 bp, M. musculus
ggttctttccagcttctggctattataaa

SEQ ID NO: 420365 - DNA, 16 bp, M. musculus
ggttctttcccatttt

SEQ ID NO: 420366 - DNA, 16 bp, M. musculus
ggttcttttattgttg

SEQ ID NO: 420367 - DNA, 16 bp, M. musculus
ggttcttttcaacttc

SEQ ID NO: 420368 - DNA, 16 bp, M. musculus
ggttctttttgcattt

SEQ ID NO: 420369 - DNA, 16 bp, M. musculus
ggttgaagcaggagaa

SEQ ID NO: 420370 - DNA, 16 bp, M. musculus
ggttgacactgttgct

SEQ ID NO: 420371 - DNA, 16 bp, M. musculus
ggttgaccagagcaag

SEQ ID NO: 420372 - DNA, 16 bp, M. musculus
ggttgaccagagtgag

SEQ ID NO: 420373 - DNA, 16 bp, M. musculus
ggttgacctggaactc

SEQ ID NO: 420374 - DNA, 16 bp, M. musculus
ggttgagaacctctgg

SEQ ID NO: 420375 - DNA, 16 bp, M. musculus
ggttgagaactactga

SEQ ID NO: 420376 - DNA, 16 bp, M. musculus
ggttgagaactactgc

SEQ ID NO: 420377 - DNA, 16 bp, M. musculus
ggttgagaactgctgc

SEQ ID NO: 420378 - DNA, 16 bp, M. musculus
ggttgagaactgttgt

SEQ ID NO: 420379 - DNA, 16 bp, M. musculus
ggttgagaagcacctg

SEQ ID NO: 420380 - DNA, 16 bp, M. musculus
ggttgagctctggcca

SEQ ID NO: 420381 - DNA, 16 bp, M. musculus
ggttgaggccagcctg

SEQ ID NO: 420382 - DNA, 16 bp, M. musculus
ggttgaggctgagctc

SEQ ID NO: 420383 - DNA, 16 bp, M. musculus
ggttgatattcttgtt

SEQ ID NO: 420384 - DNA, 16 bp, M. musculus
ggttgcaagggcagag

SEQ ID NO: 420385 - DNA, 16 bp, M. musculus
ggttgcagaacccttt

SEQ ID NO: 420386 - DNA, 16 bp, M. musculus
ggttgcagacaccttt

SEQ ID NO: 420387 - DNA, 16 bp, M. musculus
ggttgcagatcccccc

SEQ ID NO: 420388 - DNA, 16 bp, M. musculus
ggttgccacccccttc

SEQ ID NO: 420389 - DNA, 16 bp, M. musculus
ggttgcctcactcagg

SEQ ID NO: 420390 - DNA, 16 bp, M. musculus
ggttgctgctgctgct

SEQ ID NO: 420391 - DNA, 16 bp, M. musculus
ggttgctgggaaagag

SEQ ID NO: 420392 - DNA, 16 bp, M. musculus
ggttggaagtggattt

SEQ ID NO: 420393 - DNA, 16 bp, M. musculus
ggttggacctcagtgg

SEQ ID NO: 420394 - DNA, 16 bp, M. musculus
ggttggagaaatggct

SEQ ID NO: 420395 - DNA, 16 bp, M. musculus
ggttggagagaaggct

SEQ ID NO: 420396 - DNA, 16 bp, M. musculus
ggttggagggagaaaa

SEQ ID NO: 420397 - DNA, 16 bp, M. musculus
ggttggattcccagca

SEQ ID NO: 420398 - DNA, 16 bp, M. musculus
ggttggcctagaactc

SEQ ID NO: 420399 - DNA, 16 bp, M. musculus
ggttggcctcaaactt

SEQ ID NO: 420400 - DNA, 16 bp, M. musculus
ggttggcctggaattt

SEQ ID NO: 420401 - DNA, 16 bp, M. musculus
ggttggccttaaactt

SEQ ID NO: 420402 - DNA, 16 bp, M. musculus
ggttggccttgaactt

SEQ ID NO: 420403 - DNA, 16 bp, M. musculus
ggttggctggctggct

SEQ ID NO: 420404 - DNA, 16 bp, M. musculus
ggttggctttgaactc

SEQ ID NO: 420405 - DNA, 16 bp, M. musculus
ggttgggaagatggct

SEQ ID NO: 420406 - DNA, 16 bp, M. musculus
ggttggggagcagggc

SEQ ID NO: 420407 - DNA, 16 bp, M. musculus
ggttggggctggagag

SEQ ID NO: 420408 - DNA, 16 bp, M. musculus
ggttggtctggaactc

SEQ ID NO: 420409 - DNA, 16 bp, M. musculus
ggttggtgaagatctt

SEQ ID NO: 420410 - DNA, 16 bp, M. musculus
ggttggtgatttagtc

SEQ ID NO: 420411 - DNA, 16 bp, M. musculus
ggttggttttctcctt

SEQ ID NO: 420412 - DNA, 16 bp, M. musculus
ggttgtaacccctttg

SEQ ID NO: 420413 - DNA, 16 bp, M. musculus
ggttgtaagccaacat

SEQ ID NO: 420414 - DNA, 16 bp, M. musculus
ggttgtacctgcttgc

SEQ ID NO: 420415 - DNA, 17 bp, M. musculus
ggttgtataagcctgca

SEQ ID NO: 420416 - DNA, 16 bp, M. musculus
ggttgtcagacttggt

SEQ ID NO: 420417 - DNA, 16 bp, M. musculus
ggttgtcatgacctct

SEQ ID NO: 420418 - DNA, 16 bp, M. musculus
ggttgtcctagaactt

SEQ ID NO: 420419 - DNA, 16 bp, M. musculus
ggttgtcctctgagct

SEQ ID NO: 420420 - DNA, 16 bp, M. musculus
ggttgtccttgaactt

SEQ ID NO: 420421 - DNA, 16 bp, M. musculus
ggttgtgagctgccat

SEQ ID NO: 420422 - DNA, 16 bp, M. musculus
ggttgtggagcagggc

SEQ ID NO: 420423 - DNA, 16 bp, M. musculus
ggttgtgggaagccac

SEQ ID NO: 420424 - DNA, 16 bp, M. musculus
ggttgtggtggtgcac

SEQ ID NO: 420425 - DNA, 16 bp, M. musculus
ggttgttttcatttgc

SEQ ID NO: 420426 - DNA, 16 bp, M. musculus
ggtttaaacacacaca

SEQ ID NO: 420427 - DNA, 16 bp, M. musculus
ggtttaatccctagca

SEQ ID NO: 420428 - DNA, 16 bp, M. musculus
ggtttagcagcaagca

SEQ ID NO: 420429 - DNA, 16 bp, M. musculus
ggtttaggagtgccca

SEQ ID NO: 420430 - DNA, 16 bp, M. musculus
ggtttagtccagagtt

SEQ ID NO: 420431 - DNA, 16 bp, M. musculus
ggtttagtgcagagtc

SEQ ID NO: 420432 - DNA, 16 bp, M. musculus
ggtttattcagctcac

SEQ ID NO: 420433 - DNA, 16 bp, M. musculus
ggtttatttcatttta

SEQ ID NO: 420434 - DNA, 16 bp, M. musculus
ggtttatttggcttag

SEQ ID NO: 420435 - DNA, 16 bp, M. musculus
ggtttattttggctca

SEQ ID NO: 420436 - DNA, 16 bp, M. musculus
ggtttatttttttccc

SEQ ID NO: 420437 - DNA, 16 bp, M. musculus
ggtttcactgtgtagc

SEQ ID NO: 420438 - DNA, 16 bp, M. musculus
ggtttccactgctgtg

SEQ ID NO: 420439 - DNA, 16 bp, M. musculus
ggtttccagttttgtt

SEQ ID NO: 420440 - DNA, 16 bp, M. musculus
ggtttccatctgcacc

SEQ ID NO: 420441 - DNA, 16 bp, M. musculus
ggtttccatggaaaca

SEQ ID NO: 420442 - DNA, 16 bp, M. musculus
ggtttccctcctcctc

SEQ ID NO: 420443 - DNA, 16 bp, M. musculus
ggtttcccttccaaaa

SEQ ID NO: 420444 - DNA, 16 bp, M. musculus
ggtttccgttgctgtg

SEQ ID NO: 420445 - DNA, 16 bp, M. musculus
ggtttcctgtatgcag

SEQ ID NO: 420446 - DNA, 16 bp, M. musculus
ggtttctaccctgcct

SEQ ID NO: 420447 - DNA, 16 bp, M. musculus
ggtttctagccttagc

SEQ ID NO: 420448 - DNA, 16 bp, M. musculus
ggtttctaggagaagg

SEQ ID NO: 420449 - DNA, 16 bp, M. musculus
ggtttctattgctgtg

SEQ ID NO: 420450 - DNA, 16 bp, M. musculus
ggtttctccagctatg

SEQ ID NO: 420451 - DNA, 16 bp, M. musculus
ggtttctccaggccag

SEQ ID NO: 420452 - DNA, 16 bp, M. musculus
ggtttctctcctgtgt

SEQ ID NO: 420453 - DNA, 16 bp, M. musculus
ggtttctctgggtagt

SEQ ID NO: 420454 - DNA, 16 bp, M. musculus
ggtttctctgtatctc

SEQ ID NO: 420455 - DNA, 16 bp, M. musculus
ggtttctctgtgaatc

SEQ ID NO: 420456 - DNA, 16 bp, M. musculus
ggtttctctgtggccc

SEQ ID NO: 420457 - DNA, 16 bp, M. musculus
ggtttctctgtgtaac

SEQ ID NO: 420458 - DNA, 16 bp, M. musculus
ggtttctctgtgtctc

SEQ ID NO: 420459 - DNA, 16 bp, M. musculus
ggtttctcttccagag

SEQ ID NO: 420460 - DNA, 16 bp, M. musculus
ggtttctctttgtagc

SEQ ID NO: 420461 - DNA, 16 bp, M. musculus
ggtttctgaagacagc

SEQ ID NO: 420462 - DNA, 16 bp, M. musculus
ggtttctgagcatgtg

SEQ ID NO: 420463 - DNA, 16 bp, M. musculus
ggtttctggactaata

SEQ ID NO: 420464 - DNA, 16 bp, M. musculus
ggtttctggaggagaa

SEQ ID NO: 420465 - DNA, 16 bp, M. musculus
ggtttctggggatcaa

SEQ ID NO: 420466 - DNA, 16 bp, M. musculus
ggtttctgtctgtaag

SEQ ID NO: 420467 - DNA, 16 bp, M. musculus
ggtttctgttgcttac

SEQ ID NO: 420468 - DNA, 16 bp, M. musculus
ggtttctttatgtagc

SEQ ID NO: 420469 - DNA, 16 bp, M. musculus
ggtttctttgtgtacc

SEQ ID NO: 420470 - DNA, 16 bp, M. musculus
ggtttgaatttgaaat

SEQ ID NO: 420471 - DNA, 16 bp, M. musculus
ggtttgagccaccatg

SEQ ID NO: 420472 - DNA, 16 bp, M. musculus
ggtttgaggccagcct

SEQ ID NO: 420473 - DNA, 16 bp, M. musculus
ggtttgagtcccagca

SEQ ID NO: 420474 - DNA, 16 bp, M. musculus
ggtttgatcccaagca

SEQ ID NO: 420475 - DNA, 16 bp, M. musculus
ggtttgatccttagca

SEQ ID NO: 420476 - DNA, 16 bp, M. musculus
ggtttgattatttcct

SEQ ID NO: 420477 - DNA, 16 bp, M. musculus
ggtttgattcccagaa

SEQ ID NO: 420478 - DNA, 16 bp, M. musculus
ggtttgattcctagca

SEQ ID NO: 420479 - DNA, 16 bp, M. musculus
ggtttgatttccaaca

SEQ ID NO: 420480 - DNA, 16 bp, M. musculus
ggtttgctgggatttg

SEQ ID NO: 420481 - DNA, 16 bp, M. musculus
ggtttgctgtatattt

SEQ ID NO: 420482 - DNA, 16 bp, M. musculus
ggtttggatgaaaatg

SEQ ID NO: 420483 - DNA, 16 bp, M. musculus
ggtttggcctcagtga

SEQ ID NO: 420484 - DNA, 16 bp, M. musculus
ggtttggggctggaga

SEQ ID NO: 420485 - DNA, 16 bp, M. musculus
ggtttggtctcctcat

SEQ ID NO: 420486 - DNA, 16 bp, M. musculus
ggtttggtgcctgcag

SEQ ID NO: 420487 - DNA, 16 bp, M. musculus
ggtttggtggcacaca

SEQ ID NO: 420488 - DNA, 16 bp, M. musculus
ggtttggttcccagcc

SEQ ID NO: 420489 - DNA, 16 bp, M. musculus
ggtttgtatttattca

SEQ ID NO: 420490 - DNA, 16 bp, M. musculus
ggtttgtatttctgca

SEQ ID NO: 420491 - DNA, 16 bp, M. musculus
ggtttgtgccaccaca

SEQ ID NO: 420492 - DNA, 16 bp, M. musculus
ggtttgtgttttccca

SEQ ID NO: 420493 - DNA, 16 bp, M. musculus
ggtttgttcagcttac

SEQ ID NO: 420494 - DNA, 16 bp, M. musculus
ggttttacaattttgt

SEQ ID NO: 420495 - DNA, 16 bp, M. musculus
ggttttagttcccttg

SEQ ID NO: 420496 - DNA, 16 bp, M. musculus
ggttttatttctgtga

SEQ ID NO: 420497 - DNA, 16 bp, M. musculus
ggttttcagggtccag

SEQ ID NO: 420498 - DNA, 16 bp, M. musculus
ggttttcattattgtg

SEQ ID NO: 420499 - DNA, 16 bp, M. musculus
ggttttctgctttcct

SEQ ID NO: 420500 - DNA, 16 bp, M. musculus
ggttttcttatggtgt

SEQ ID NO: 420501 - DNA, 16 bp, M. musculus
ggttttcttttttaaa

SEQ ID NO: 420502 - DNA, 16 bp, M. musculus
ggttttgaaaaattta

SEQ ID NO: 420503 - DNA, 16 bp, M. musculus
ggttttgagaaaagca

SEQ ID NO: 420504 - DNA, 19 bp, M. musculus
ggttttgagaattaaccaa

SEQ ID NO: 420505 - DNA, 16 bp, M. musculus
ggttttgagacagggt

SEQ ID NO: 420506 - DNA, 16 bp, M. musculus
ggttttgtctttgagt

SEQ ID NO: 420507 - DNA, 16 bp, M. musculus
ggttttgtcttttact

SEQ ID NO: 420508 - DNA, 16 bp, M. musculus
ggttttgttttccaaa

SEQ ID NO: 420509 - DNA, 19 bp, M. musculus
ggtttttcaagacaggatt

SEQ ID NO: 420510 - DNA, 16 bp, M. musculus
ggtttttctgggtagc

SEQ ID NO: 420511 - DNA, 16 bp, M. musculus
ggtttttgtttttcca

SEQ ID NO: 420512 - DNA, 16 bp, M. musculus
ggtttttttaaagatt

SEQ ID NO: 420513 - DNA, 16 bp, M. musculus
ggtttttttcctttaa

SEQ ID NO: 420514 - DNA, 16 bp, M. musculus
gtaaaaaattatctaa

SEQ ID NO: 420515 - DNA, 16 bp, M. musculus
gtaaaaagagggctgg

SEQ ID NO: 420516 - DNA, 17 bp, M. musculus
gtaaaaagggctatctt

SEQ ID NO: 420517 - DNA, 16 bp, M. musculus
gtaaaaatattcaata

SEQ ID NO: 420518 - DNA, 51 bp, M. musculus
gtaaaaatggctatcttgccaaaagcaatctacagattcaatgcaatcccc

SEQ ID NO: 420519 - DNA, 16 bp, M. musculus
gtaaaacattcataca

SEQ ID NO: 420520 - DNA, 16 bp, M. musculus
gtaaaaccaaatacta

SEQ ID NO: 420521 - DNA, 16 bp, M. musculus
gtaaaaccctaagact

SEQ ID NO: 420522 - DNA, 16 bp, M. musculus
gtaaaacctttgcatt

SEQ ID NO: 420523 - DNA, 16 bp, M. musculus
gtaaaactcacaaaga

SEQ ID NO: 420524 - DNA, 16 bp, M. musculus
gtaaaagaatttattg

SEQ ID NO: 420525 - DNA, 16 bp, M. musculus
gtaaaagcaatatata

SEQ ID NO: 420526 - DNA, 16 bp, M. musculus
gtaaaagccagagggg

SEQ ID NO: 420527 - DNA, 16 bp, M. musculus
gtaaaagcctgtgagc

SEQ ID NO: 420528 - DNA, 16 bp, M. musculus
gtaaaagttgaggaaa

SEQ ID NO: 420529 - DNA, 16 bp, M. musculus
gtaaaatcaggatcag

SEQ ID NO: 420530 - DNA, 16 bp, M. musculus
gtaaaatcctttggtg

SEQ ID NO: 420531 - DNA, 16 bp, M. musculus
gtaaaatcttccaaga

SEQ ID NO: 420532 - DNA, 16 bp, M. musculus
gtaaaatgaaataaac

SEQ ID NO: 420533 - DNA, 16 bp, M. musculus
gtaaaatgcatttagt

SEQ ID NO: 420534 - DNA, 16 bp, M. musculus
gtaaaatgttttaaaa

SEQ ID NO: 420535 - DNA, 16 bp, M. musculus
gtaaaattattataga

SEQ ID NO: 420536 - DNA, 16 bp, M. musculus
gtaaaattctttgatt

SEQ ID NO: 420537 - DNA, 28 bp, M. musculus
gtaaacaagcccatgtttggtggatggc

SEQ ID NO: 420538 - DNA, 16 bp, M. musculus
gtaaacaagtagtctg

SEQ ID NO: 420539 - DNA, 16 bp, M. musculus
gtaaacatggagggac

SEQ ID NO: 420540 - DNA, 16 bp, M. musculus
gtaaacccacctattc

SEQ ID NO: 420541 - DNA, 16 bp, M. musculus
gtaaacccagcactca

SEQ ID NO: 420542 - DNA, 32 bp, M. musculus
gtaaacctgtgatgcctgaccagttcaccttt

SEQ ID NO: 420543 - DNA, 16 bp, M. musculus
gtaaagaaatctggaa

SEQ ID NO: 420544 - DNA, 16 bp, M. musculus
gtaaagcatttgtcac

SEQ ID NO: 420545 - DNA, 16 bp, M. musculus
gtaaaggcacctgctg

SEQ ID NO: 420546 - DNA, 16 bp, M. musculus
gtaaaggcgcttgctg

SEQ ID NO: 420547 - DNA, 16 bp, M. musculus
gtaaagggcttgctgt

SEQ ID NO: 420548 - DNA, 16 bp, M. musculus
gtaaagtgcttgccac

SEQ ID NO: 420549 - DNA, 16 bp, M. musculus
gtaaagtgctttcctt

SEQ ID NO: 420550 - DNA, 17 bp, M. musculus
gtaaagtggaaaatgtt

SEQ ID NO: 420551 - DNA, 16 bp, M. musculus
gtaaagttagtttgta

SEQ ID NO: 420552 - DNA, 16 bp, M. musculus
gtaaagtttcttctat

SEQ ID NO: 420553 - DNA, 16 bp, M. musculus
gtaaataaagatgtca

SEQ ID NO: 420554 - DNA, 16 bp, M. musculus
gtaaatatataaatac

SEQ ID NO: 420555 - DNA, 16 bp, M. musculus
gtaaatatatgtgttt

SEQ ID NO: 420556 - DNA, 16 bp, M. musculus
gtaaatatatttacat

SEQ ID NO: 420557 - DNA, 16 bp, M. musculus
gtaaatatctgtatct

SEQ ID NO: 420558 - DNA, 16 bp, M. musculus
gtaaatcaaaacaact

SEQ ID NO: 420559 - DNA, 16 bp, M. musculus
gtaaatccatttgttt

SEQ ID NO: 420560 - DNA, 16 bp, M. musculus
gtaaatctggccaaga

SEQ ID NO: 420561 - DNA, 16 bp, M. musculus
gtaaatcttaaaacaa

SEQ ID NO: 420562 - DNA, 16 bp, M. musculus
gtaaatgaactaaata

SEQ ID NO: 420563 - DNA, 16 bp, M. musculus
gtaaatggatggaact

SEQ ID NO: 420564 - DNA, 16 bp, M. musculus
gtaaattaaaactact

SEQ ID NO: 420565 - DNA, 16 bp, M. musculus
gtaacaacaacaacaa

SEQ ID NO: 420566 - DNA, 16 bp, M. musculus
gtaacacagactcaga

SEQ ID NO: 420567 - DNA, 16 bp, M. musculus
gtaacagtcctggctg

SEQ ID NO: 420568 - DNA, 16 bp, M. musculus
gtaacatgtgtaacat

SEQ ID NO: 420569 - DNA, 16 bp, M. musculus
gtaaccatggaaacca

SEQ ID NO: 420570 - DNA, 16 bp, M. musculus
gtaaccccaataaaat

SEQ ID NO: 420571 - DNA, 16 bp, M. musculus
gtaaccccagagctca

SEQ ID NO: 420572 - DNA, 16 bp, M. musculus
gtaaccccagcactcc

SEQ ID NO: 420573 - DNA, 16 bp, M. musculus
gtaaccctggctgccc

SEQ ID NO: 420574 - DNA, 16 bp, M. musculus
gtaaccctggctttcc

SEQ ID NO: 420575 - DNA, 19 bp, M. musculus
gtaacctcattgtaccttg

SEQ ID NO: 420576 - DNA, 16 bp, M. musculus
gtaactacagaaacca

SEQ ID NO: 420577 - DNA, 16 bp, M. musculus
gtaactccagcactta

SEQ ID NO: 420578 - DNA, 16 bp, M. musculus
gtaactccttcaatgg

SEQ ID NO: 420579 - DNA, 16 bp, M. musculus
gtaactcttataaaag

SEQ ID NO: 420580 - DNA, 16 bp, M. musculus
gtaactgaaataaata

SEQ ID NO: 420581 - DNA, 16 bp, M. musculus
gtaactgtggggcaga

SEQ ID NO: 420582 - DNA, 16 bp, M. musculus
gtaactgtgggtgtgg

SEQ ID NO: 420583 - DNA, 16 bp, M. musculus
gtaacttcgacaggag

SEQ ID NO: 420584 - DNA, 20 bp, M. musculus
gtaacttgcttgtgccttca

SEQ ID NO: 420585 - DNA, 16 bp, M. musculus
gtaacttttattcacc

SEQ ID NO: 420586 - DNA, 16 bp, M. musculus
gtaagaaattttcatt

SEQ ID NO: 420587 - DNA, 16 bp, M. musculus
gtaagaacagaagcaa

SEQ ID NO: 420588 - DNA, 16 bp, M. musculus
gtaagacccagtctca

SEQ ID NO: 420589 - DNA, 19 bp, M. musculus
gtaagacccccaaagctgg

SEQ ID NO: 420590 - DNA, 16 bp, M. musculus
gtaagaccctgtctca

SEQ ID NO: 420591 - DNA, 16 bp, M. musculus
gtaagaccttgtctca

SEQ ID NO: 420592 - DNA, 16 bp, M. musculus
gtaagagcactggctg

SEQ ID NO: 420593 - DNA, 16 bp, M. musculus
gtaagaggccatggaa

SEQ ID NO: 420594 - DNA, 16 bp, M. musculus
gtaagagtcattaagc

SEQ ID NO: 420595 - DNA, 16 bp, M. musculus
gtaagatcctgcctca

SEQ ID NO: 420596 - DNA, 16 bp, M. musculus
gtaagcacaaatcaaa

SEQ ID NO: 420597 - DNA, 16 bp, M. musculus
gtaagcagtgtgagaa

SEQ ID NO: 420598 - DNA, 16 bp, M. musculus
gtaagcatttcaaagc

SEQ ID NO: 420599 - DNA, 16 bp, M. musculus
gtaagccaggggaggc

SEQ ID NO: 420600 - DNA, 16 bp, M. musculus
gtaagccctttcctcc

SEQ ID NO: 420601 - DNA, 16 bp, M. musculus
gtaagctgctgtgtgg

SEQ ID NO: 420602 - DNA, 16 bp, M. musculus
gtaagcttagattttt

SEQ ID NO: 420603 - DNA, 16 bp, M. musculus
gtaaggaagaaaggtc

SEQ ID NO: 420604 - DNA, 16 bp, M. musculus
gtaaggcaaagaatac

SEQ ID NO: 420605 - DNA, 16 bp, M. musculus
gtaaggcagtctctag

SEQ ID NO: 420606 - DNA, 16 bp, M. musculus
gtaaggccttttctac

SEQ ID NO: 420607 - DNA, 16 bp, M. musculus
gtaaggggcttagggg

SEQ ID NO: 420608 - DNA, 16 bp, M. musculus
gtaagtgcacacacac

SEQ ID NO: 420609 - DNA, 16 bp, M. musculus
gtaagtggatggatgg

SEQ ID NO: 420610 - DNA, 16 bp, M. musculus
gtaagtgtgtgtgtgt

SEQ ID NO: 420611 - DNA, 16 bp, M. musculus
gtaagttcaaggccag

SEQ ID NO: 420612 - DNA, 17 bp, M. musculus
gtaagttcaaggccagc

SEQ ID NO: 420613 - DNA, 16 bp, M. musculus
gtaagtttgaagccag

SEQ ID NO: 420614 - DNA, 16 bp, M. musculus
gtaataaggacacatg

SEQ ID NO: 420615 - DNA, 16 bp, M. musculus
gtaatatatatgtgta

SEQ ID NO: 420616 - DNA, 16 bp, M. musculus
gtaatatggacacatg

SEQ ID NO: 420617 - DNA, 16 bp, M. musculus
gtaatcagaacaacaa

SEQ ID NO: 420618 - DNA, 16 bp, M. musculus
gtaatcccagcacttt

SEQ ID NO: 420619 - DNA, 16 bp, M. musculus
gtaatcctagcacttg

SEQ ID NO: 420620 - DNA, 16 bp, M. musculus
gtaatctctggagtca

SEQ ID NO: 420621 - DNA, 16 bp, M. musculus
gtaatgaacagcaatg

SEQ ID NO: 420622 - DNA, 16 bp, M. musculus
gtaatgagatcagatg

SEQ ID NO: 420623 - DNA, 16 bp, M. musculus
gtaatggaggagtgtt

SEQ ID NO: 420624 - DNA, 16 bp, M. musculus
gtaattctttaaaaga

SEQ ID NO: 420625 - DNA, 16 bp, M. musculus
gtaattgaggaaaatg

SEQ ID NO: 420626 - DNA, 16 bp, M. musculus
gtaattgtatcctttc

SEQ ID NO: 420627 - DNA, 16 bp, M. musculus
gtacaaagagatagga

SEQ ID NO: 420628 - DNA, 16 bp, M. musculus
gtacaaagccctgggt

SEQ ID NO: 420629 - DNA, 23 bp, M. musculus
gtacaacgagaggtctggaagcc

SEQ ID NO: 420630 - DNA, 16 bp, M. musculus
gtacaagaatgcaaat

SEQ ID NO: 420631 - DNA, 16 bp, M. musculus
gtacaagagatggaag

SEQ ID NO: 420632 - DNA, 16 bp, M. musculus
gtacaagcctgtaatc

SEQ ID NO: 420633 - DNA, 16 bp, M. musculus
gtacaagcttgctatc

SEQ ID NO: 420634 - DNA, 17 bp, M. musculus
gtacacaaactttcata

SEQ ID NO: 420635 - DNA, 16 bp, M. musculus
gtacacacatatatgt

SEQ ID NO: 420636 - DNA, 16 bp, M. musculus
gtacacacatggtaca

SEQ ID NO: 420637 - DNA, 16 bp, M. musculus
gtacacaccagaagag

SEQ ID NO: 420638 - DNA, 16 bp, M. musculus
gtacacacttgcaatc

SEQ ID NO: 420639 - DNA, 16 bp, M. musculus
gtacacagatatgcat

SEQ ID NO: 420640 - DNA, 16 bp, M. musculus
gtacacataaactcat

SEQ ID NO: 420641 - DNA, 16 bp, M. musculus
gtacacatacacatgt

SEQ ID NO: 420642 - DNA, 16 bp, M. musculus
gtacacatacatatat

SEQ ID NO: 420643 - DNA, 16 bp, M. musculus
gtacacatatacatac

SEQ ID NO: 420644 - DNA, 16 bp, M. musculus
gtacacatggtgggac

SEQ ID NO: 420645 - DNA, 16 bp, M. musculus
gtacactgtcactctc

SEQ ID NO: 420646 - DNA, 16 bp, M. musculus
gtacagaaaatttaag

SEQ ID NO: 420647 - DNA, 16 bp, M. musculus
gtacagaatacccaag

SEQ ID NO: 420648 - DNA, 16 bp, M. musculus
gtacagagacagacac

SEQ ID NO: 420649 - DNA, 16 bp, M. musculus
gtacagagacagacag

SEQ ID NO: 420650 - DNA, 16 bp, M. musculus
gtacagagctgaacaa

SEQ ID NO: 420651 - DNA, 16 bp, M. musculus
gtacagatgaggaaac

SEQ ID NO: 420652 - DNA, 16 bp, M. musculus
gtacagatggctgtga

SEQ ID NO: 420653 - DNA, 16 bp, M. musculus
gtacagatggttgtga

SEQ ID NO: 420654 - DNA, 16 bp, M. musculus
gtacagcacttgccta

SEQ ID NO: 420655 - DNA, 16 bp, M. musculus
gtacagcaggctggcc

SEQ ID NO: 420656 - DNA, 16 bp, M. musculus
gtacagcatagcttta

SEQ ID NO: 420657 - DNA, 16 bp, M. musculus
gtacagcttaatgtca

SEQ ID NO: 420658 - DNA, 16 bp, M. musculus
gtacaggaagagctga

SEQ ID NO: 420659 - DNA, 16 bp, M. musculus
gtacaggggaaaaaat

SEQ ID NO: 420660 - DNA, 16 bp, M. musculus
gtacagtgttctgcct

SEQ ID NO: 420661 - DNA, 16 bp, M. musculus
gtacataaaacaaata

SEQ ID NO: 420662 - DNA, 16 bp, M. musculus
gtacatacatacatac

SEQ ID NO: 420663 - DNA, 16 bp, M. musculus
gtacatagacatacat

SEQ ID NO: 420664 - DNA, 16 bp, M. musculus
gtacatatacatatat

SEQ ID NO: 420665 - DNA, 16 bp, M. musculus
gtacatcaaagaactc

SEQ ID NO: 420666 - DNA, 16 bp, M. musculus
gtacatcctctcccac

SEQ ID NO: 420667 - DNA, 16 bp, M. musculus
gtacatctatacaatg

SEQ ID NO: 420668 - DNA, 16 bp, M. musculus
gtacatctgaaacaat

SEQ ID NO: 420669 - DNA, 19 bp, M. musculus
gtacatctggccatttctt

SEQ ID NO: 420670 - DNA, 16 bp, M. musculus
gtacatcttctctgac

SEQ ID NO: 420671 - DNA, 16 bp, M. musculus
gtacatctttgtggat

SEQ ID NO: 420672 - DNA, 16 bp, M. musculus
gtacatgcagttttta

SEQ ID NO: 420673 - DNA, 16 bp, M. musculus
gtacatgtacacacaa

SEQ ID NO: 420674 - DNA, 16 bp, M. musculus
gtacatgtgcatatac

SEQ ID NO: 420675 - DNA, 16 bp, M. musculus
gtacatgtgtatgcac

SEQ ID NO: 420676 - DNA, 16 bp, M. musculus
gtacatgtgtgtgggt

SEQ ID NO: 420677 - DNA, 16 bp, M. musculus
gtacattaataattct

SEQ ID NO: 420678 - DNA, 16 bp, M. musculus
gtacattattatacaa

SEQ ID NO: 420679 - DNA, 22 bp, M. musculus
gtacattccaattcttctacct

SEQ ID NO: 420680 - DNA, 16 bp, M. musculus
gtaccacagtctcagg

SEQ ID NO: 420681 - DNA, 16 bp, M. musculus
gtaccaccactgcctg

SEQ ID NO: 420682 - DNA, 16 bp, M. musculus
gtaccaccatgcctgt

SEQ ID NO: 420683 - DNA, 16 bp, M. musculus
gtaccagaaagactca

SEQ ID NO: 420684 - DNA, 16 bp, M. musculus
gtaccagaaccctgat

SEQ ID NO: 420685 - DNA, 16 bp, M. musculus
gtaccaggaggtgctg

SEQ ID NO: 420686 - DNA, 16 bp, M. musculus
gtaccaggcacacatg

SEQ ID NO: 420687 - DNA, 16 bp, M. musculus
gtaccatgaggggctg

SEQ ID NO: 420688 - DNA, 16 bp, M. musculus
gtacccaaagagctga

SEQ ID NO: 420689 - DNA, 16 bp, M. musculus
gtacccaacatcaaag

SEQ ID NO: 420690 - DNA, 16 bp, M. musculus
gtacccacagaggtca

SEQ ID NO: 420691 - DNA, 16 bp, M. musculus
gtacccaggcccacag

SEQ ID NO: 420692 - DNA, 16 bp, M. musculus
gtacccatacacacac

SEQ ID NO: 420693 - DNA, 16 bp, M. musculus
gtacccccagagtttg

SEQ ID NO: 420694 - DNA, 16 bp, M. musculus
gtacccccatctgtgg

SEQ ID NO: 420695 - DNA, 16 bp, M. musculus
gtacccccccacacac

SEQ ID NO: 420696 - DNA, 16 bp, M. musculus
gtaccccctggaactc

SEQ ID NO: 420697 - DNA, 16 bp, M. musculus
gtaccccctggagctt

SEQ ID NO: 420698 - DNA, 16 bp, M. musculus
gtaccccggtgctggt

SEQ ID NO: 420699 - DNA, 17 bp, M. musculus
gtaccctcagccccacc

SEQ ID NO: 420700 - DNA, 23 bp, M. musculus
gtacctggaggatttgacctaga

SEQ ID NO: 420701 - DNA, 16 bp, M. musculus
gtaccttgggggtgtc

SEQ ID NO: 420702 - DNA, 16 bp, M. musculus
gtacctttacacaatg

SEQ ID NO: 420703 - DNA, 16 bp, M. musculus
gtacctttatggccat

SEQ ID NO: 420704 - DNA, 16 bp, M. musculus
gtactaggaactgaac

SEQ ID NO: 420705 - DNA, 16 bp, M. musculus
gtactatccctgggct

SEQ ID NO: 420706 - DNA, 16 bp, M. musculus
gtactcatgtatgaaa

SEQ ID NO: 420707 - DNA, 17 bp, M. musculus
gtactcgtgtgtgtgtg

SEQ ID NO: 420708 - DNA, 16 bp, M. musculus
gtactctggagccctt

SEQ ID NO: 420709 - DNA, 16 bp, M. musculus
gtactctgttgtgtag

SEQ ID NO: 420710 - DNA, 16 bp, M. musculus
gtactcttaatggctg

SEQ ID NO: 420711 - DNA, 16 bp, M. musculus
gtactcttacctgctg

SEQ ID NO: 420712 - DNA, 16 bp, M. musculus
gtactgaaattaaagg

SEQ ID NO: 420713 - DNA, 16 bp, M. musculus
gtactgaaggagttga

SEQ ID NO: 420714 - DNA, 16 bp, M. musculus
gtactgctgctgctgc

SEQ ID NO: 420715 - DNA, 16 bp, M. musculus
gtactggaattacagg

SEQ ID NO: 420716 - DNA, 16 bp, M. musculus
gtactggaattgcagg

SEQ ID NO: 420717 - DNA, 16 bp, M. musculus
gtactgggaataaagg

SEQ ID NO: 420718 - DNA, 16 bp, M. musculus
gtactgggaatcaaac

SEQ ID NO: 420719 - DNA, 16 bp, M. musculus
gtactgggaccctgat

SEQ ID NO: 420720 - DNA, 16 bp, M. musculus
gtactgggacttgaac

SEQ ID NO: 420721 - DNA, 16 bp, M. musculus
gtactgggagttgaac

SEQ ID NO: 420722 - DNA, 16 bp, M. musculus
gtactgggattacagg

SEQ ID NO: 420723 - DNA, 16 bp, M. musculus
gtactgggcatataaa

SEQ ID NO: 420724 - DNA, 16 bp, M. musculus
gtactgggcattgaac

SEQ ID NO: 420725 - DNA, 16 bp, M. musculus
gtactggggattgaac

SEQ ID NO: 420726 - DNA, 16 bp, M. musculus
gtactgggttctaatg

SEQ ID NO: 420727 - DNA, 16 bp, M. musculus
gtactggttgctcttc

SEQ ID NO: 420728 - DNA, 16 bp, M. musculus
gtactgtgtgcatgtg

SEQ ID NO: 420729 - DNA, 20 bp, M. musculus
gtacttccctttttaggtct

SEQ ID NO: 420730 - DNA, 16 bp, M. musculus
gtacttgggaagtaga

SEQ ID NO: 420731 - DNA, 16 bp, M. musculus
gtagaaaaagacagca

SEQ ID NO: 420732 - DNA, 16 bp, M. musculus
gtagaaaataatcaaa

SEQ ID NO: 420733 - DNA, 16 bp, M. musculus
gtagaaaatatttttt

SEQ ID NO: 420734 - DNA, 16 bp, M. musculus
gtagaaacaaacaaac

SEQ ID NO: 420735 - DNA, 16 bp, M. musculus
gtagaaacaggaggat

SEQ ID NO: 420736 - DNA, 16 bp, M. musculus
gtagaaaccccagatt

SEQ ID NO: 420737 - DNA, 16 bp, M. musculus
gtagaaacctggaggc

SEQ ID NO: 420738 - DNA, 16 bp, M. musculus
gtagaaaggatgaata

SEQ ID NO: 420739 - DNA, 16 bp, M. musculus
gtagaaatctttttaa

SEQ ID NO: 420740 - DNA, 16 bp, M. musculus
gtagaagaatgctaat

SEQ ID NO: 420741 - DNA, 16 bp, M. musculus
gtagaagaatgtgaac

SEQ ID NO: 420742 - DNA, 16 bp, M. musculus
gtagaagcaataaaga

SEQ ID NO: 420743 - DNA, 16 bp, M. musculus
gtagaagcaggaggat

SEQ ID NO: 420744 - DNA, 16 bp, M. musculus
gtagaaggaataggga

SEQ ID NO: 420745 - DNA, 16 bp, M. musculus
gtagaaggagagaacc

SEQ ID NO: 420746 - DNA, 16 bp, M. musculus
gtagaagtagtagtaa

SEQ ID NO: 420747 - DNA, 16 bp, M. musculus
gtagaatctgatgatg

SEQ ID NO: 420748 - DNA, 16 bp, M. musculus
gtagaatgcttgccca

SEQ ID NO: 420749 - DNA, 16 bp, M. musculus
gtagaattaaagataa

SEQ ID NO: 420750 - DNA, 16 bp, M. musculus
gtagacattcatcttt

SEQ ID NO: 420751 - DNA, 17 bp, M. musculus
gtagaccaggctggtcc

SEQ ID NO: 420752 - DNA, 16 bp, M. musculus
gtagacctgactgtcc

SEQ ID NO: 420753 - DNA, 16 bp, M. musculus
gtagactaatggaata

SEQ ID NO: 420754 - DNA, 16 bp, M. musculus
gtagactctacaagtt

SEQ ID NO: 420755 - DNA, 16 bp, M. musculus
gtagagaaaggacatt

SEQ ID NO: 420756 - DNA, 16 bp, M. musculus
gtagagaacttctcct

SEQ ID NO: 420757 - DNA, 16 bp, M. musculus
gtagagagaccctgtt

SEQ ID NO: 420758 - DNA, 18 bp, M. musculus
gtagagcagcctgcacag

SEQ ID NO: 420759 - DNA, 16 bp, M. musculus
gtagagcaggctgacc

SEQ ID NO: 420760 - DNA, 16 bp, M. musculus
gtagagcaggctgtcc

SEQ ID NO: 420761 - DNA, 16 bp, M. musculus
gtagagcttaccaaca

SEQ ID NO: 420762 - DNA, 16 bp, M. musculus
gtagaggaaggctact

SEQ ID NO: 420763 - DNA, 16 bp, M. musculus
gtagaggacaacaaga

SEQ ID NO: 420764 - DNA, 16 bp, M. musculus
gtagaggcaagagaat

SEQ ID NO: 420765 - DNA, 16 bp, M. musculus
gtagaggcagagaaaa

SEQ ID NO: 420766 - DNA, 16 bp, M. musculus
gtagaggccagagatc

SEQ ID NO: 420767 - DNA, 16 bp, M. musculus
gtagagggcttgccta

SEQ ID NO: 420768 - DNA, 16 bp, M. musculus
gtagagtcctttgggt

SEQ ID NO: 420769 - DNA, 16 bp, M. musculus
gtagagtgcctgccta

SEQ ID NO: 420770 - DNA, 16 bp, M. musculus
gtagagtgttgttcat

SEQ ID NO: 420771 - DNA, 16 bp, M. musculus
gtagagttggtaaaga

SEQ ID NO: 420772 - DNA, 16 bp, M. musculus
gtagagttttcctttg

SEQ ID NO: 420773 - DNA, 16 bp, M. musculus
gtagatagatgataga

SEQ ID NO: 420774 - DNA, 16 bp, M. musculus
gtagatattatcctaa

SEQ ID NO: 420775 - DNA, 16 bp, M. musculus
gtagatccttttaaga

SEQ ID NO: 420776 - DNA, 16 bp, M. musculus
gtagattttacatttg

SEQ ID NO: 420777 - DNA, 16 bp, M. musculus
gtagcaaaattacaac

SEQ ID NO: 420778 - DNA, 16 bp, M. musculus
gtagcaaacatcaaag

SEQ ID NO: 420779 - DNA, 16 bp, M. musculus
gtagcaataaaatgac

SEQ ID NO: 420780 - DNA, 16 bp, M. musculus
gtagcacagaggacag

SEQ ID NO: 420781 - DNA, 16 bp, M. musculus
gtagcagaatctcagg

SEQ ID NO: 420782 - DNA, 16 bp, M. musculus
gtagcagagggctgcc

SEQ ID NO: 420783 - DNA, 16 bp, M. musculus
gtagcagatgggaaca

SEQ ID NO: 420784 - DNA, 16 bp, M. musculus
gtagcagcagcaacaa

SEQ ID NO: 420785 - DNA, 16 bp, M. musculus
gtagcagcagcagcaa

SEQ ID NO: 420786 - DNA, 17 bp, M. musculus
gtagcagcagcagcagt

SEQ ID NO: 420787 - DNA, 16 bp, M. musculus
gtagcagcagtggcag

SEQ ID NO: 420788 - DNA, 16 bp, M. musculus
gtagcagtagcagcag

SEQ ID NO: 420789 - DNA, 16 bp, M. musculus
gtagccaagaatgact

SEQ ID NO: 420790 - DNA, 16 bp, M. musculus
gtagccaaggatgact

SEQ ID NO: 420791 - DNA, 29 bp, M. musculus
gtagccaggtcagccttggtgagtggaag

SEQ ID NO: 420792 - DNA, 16 bp, M. musculus
gtagccagtgatgcca

SEQ ID NO: 420793 - DNA, 16 bp, M. musculus
gtagcccagacccaga

SEQ ID NO: 420794 - DNA, 16 bp, M. musculus
gtagcccaggctgggc

SEQ ID NO: 420795 - DNA, 18 bp, M. musculus
gtagcccaggctgtcctg

SEQ ID NO: 420796 - DNA, 17 bp, M. musculus
gtagcccaggttgacct

SEQ ID NO: 420797 - DNA, 16 bp, M. musculus
gtagccccatccctca

SEQ ID NO: 420798 - DNA, 16 bp, M. musculus
gtagccccgtggggtg

SEQ ID NO: 420799 - DNA, 17 bp, M. musculus
gtagccctggcagtcct

SEQ ID NO: 420800 - DNA, 16 bp, M. musculus
gtagccctggctggca

SEQ ID NO: 420801 - DNA, 16 bp, M. musculus
gtagcctgggctggct

SEQ ID NO: 420802 - DNA, 16 bp, M. musculus
gtagctagagccatgg

SEQ ID NO: 420803 - DNA, 18 bp, M. musculus
gtagctatcctcagatac

SEQ ID NO: 420804 - DNA, 16 bp, M. musculus
gtagctcaggctagct

SEQ ID NO: 420805 - DNA, 16 bp, M. musculus
gtagctcagttggtaa

SEQ ID NO: 420806 - DNA, 16 bp, M. musculus
gtagctcggtggtaga

SEQ ID NO: 420807 - DNA, 16 bp, M. musculus
gtagctgagagctcac

SEQ ID NO: 420808 - DNA, 16 bp, M. musculus
gtagctgggctgcctt

SEQ ID NO: 420809 - DNA, 16 bp, M. musculus
gtagctgggtatagtg

SEQ ID NO: 420810 - DNA, 16 bp, M. musculus
gtagctgggtggtggt

SEQ ID NO: 420811 - DNA, 16 bp, M. musculus
gtagctgtagctgtag

SEQ ID NO: 420812 - DNA, 16 bp, M. musculus
gtagctgtcctggaac

SEQ ID NO: 420813 - DNA, 16 bp, M. musculus
gtagcttgatataaaa

SEQ ID NO: 420814 - DNA, 16 bp, M. musculus
gtagcttggggttctt

SEQ ID NO: 420815 - DNA, 16 bp, M. musculus
gtagctttaaagactg

SEQ ID NO: 420816 - DNA, 16 bp, M. musculus
gtaggaagagctgaga

SEQ ID NO: 420817 - DNA, 16 bp, M. musculus
gtaggactctcagcta

SEQ ID NO: 420818 - DNA, 16 bp, M. musculus
gtaggagaagatggcc

SEQ ID NO: 420819 - DNA, 16 bp, M. musculus
gtaggagggccagcac

SEQ ID NO: 420820 - DNA, 16 bp, M. musculus
gtaggcagatctctgt

SEQ ID NO: 420821 - DNA, 16 bp, M. musculus
gtaggcagatttctgt

SEQ ID NO: 420822 - DNA, 16 bp, M. musculus
gtaggccaggctggct

SEQ ID NO: 420823 - DNA, 16 bp, M. musculus
gtaggccttgaactca

SEQ ID NO: 420824 - DNA, 16 bp, M. musculus
gtaggctgcctcttca

SEQ ID NO: 420825 - DNA, 16 bp, M. musculus
gtaggcttagattttt

SEQ ID NO: 420826 - DNA, 16 bp, M. musculus
gtagggcattttccta

SEQ ID NO: 420827 - DNA, 16 bp, M. musculus
gtaggggaattcaagg

SEQ ID NO: 420828 - DNA, 16 bp, M. musculus
gtaggtaagtaggtag

SEQ ID NO: 420829 - DNA, 16 bp, M. musculus
gtaggtctctgattct

SEQ ID NO: 420830 - DNA, 16 bp, M. musculus
gtaggtgtatcactgt

SEQ ID NO: 420831 - DNA, 16 bp, M. musculus
gtaggttttattacag

SEQ ID NO: 420832 - DNA, 28 bp, M. musculus
gtagtactatgtccaattttctgaggaa

SEQ ID NO: 420833 - DNA, 16 bp, M. musculus
gtagtagatggcagga

SEQ ID NO: 420834 - DNA, 16 bp, M. musculus
gtagtataaaatgcaa

SEQ ID NO: 420835 - DNA, 16 bp, M. musculus
gtagtatctgtctttt

SEQ ID NO: 420836 - DNA, 16 bp, M. musculus
gtagtattccactgta

SEQ ID NO: 420837 - DNA, 16 bp, M. musculus
gtagtccaggctagcc

SEQ ID NO: 420838 - DNA, 16 bp, M. musculus
gtagtcccagctgtcc

SEQ ID NO: 420839 - DNA, 16 bp, M. musculus
gtagtcctgactgttc

SEQ ID NO: 420840 - DNA, 18 bp, M. musculus
gtagtctctatatagtaa

SEQ ID NO: 420841 - DNA, 16 bp, M. musculus
gtagtcttgaatttat

SEQ ID NO: 420842 - DNA, 16 bp, M. musculus
gtagtgcacaccttta

SEQ ID NO: 420843 - DNA, 16 bp, M. musculus
gtagtggtacatgcct

SEQ ID NO: 420844 - DNA, 16 bp, M. musculus
gtagtggtcaagaaga

SEQ ID NO: 420845 - DNA, 16 bp, M. musculus
gtagtgtctctctttt

SEQ ID NO: 420846 - DNA, 16 bp, M. musculus
gtagtgtcttcagcaa

SEQ ID NO: 420847 - DNA, 16 bp, M. musculus
gtagttcatttcagat

SEQ ID NO: 420848 - DNA, 16 bp, M. musculus
gtagttctggtatctt

SEQ ID NO: 420849 - DNA, 16 bp, M. musculus
gtagttcttgttctct

SEQ ID NO: 420850 - DNA, 16 bp, M. musculus
gtagttggctaggttt

SEQ ID NO: 420851 - DNA, 16 bp, M. musculus
gtagttgtgaaccacc

SEQ ID NO: 420852 - DNA, 16 bp, M. musculus
gtagttgtgagctgcc

SEQ ID NO: 420853 - DNA, 16 bp, M. musculus
gtagtttagttcctgg

SEQ ID NO: 420854 - DNA, 16 bp, M. musculus
gtagtttgaatgagaa

SEQ ID NO: 420855 - DNA, 16 bp, M. musculus
gtagttttaattttca

SEQ ID NO: 420856 - DNA, 16 bp, M. musculus
gtagttttccttctgt

SEQ ID NO: 420857 - DNA, 16 bp, M. musculus
gtagtttttatcacta

SEQ ID NO: 420858 - DNA, 16 bp, M. musculus
gtataaaatgaagttt

SEQ ID NO: 420859 - DNA, 16 bp, M. musculus
gtataaatatatcaca

SEQ ID NO: 420860 - DNA, 16 bp, M. musculus
gtataattcaaatgaa

SEQ ID NO: 420861 - DNA, 16 bp, M. musculus
gtatacaaatatacat

SEQ ID NO: 420862 - DNA, 17 bp, M. musculus
gtatacacacacataca

SEQ ID NO: 420863 - DNA, 16 bp, M. musculus
gtatacactggaatcc

SEQ ID NO: 420864 - DNA, 16 bp, M. musculus
gtatacatatatacac

SEQ ID NO: 420865 - DNA, 16 bp, M. musculus
gtatacatggaggaac

SEQ ID NO: 420866 - DNA, 16 bp, M. musculus
gtatacatgtatgtgt

SEQ ID NO: 420867 - DNA, 16 bp, M. musculus
gtataccaccaccacc

SEQ ID NO: 420868 - DNA, 16 bp, M. musculus
gtataccactcctggg

SEQ ID NO: 420869 - DNA, 16 bp, M. musculus
gtatacctctgtgggc

SEQ ID NO: 420870 - DNA, 16 bp, M. musculus
gtatactgttggcctt

SEQ ID NO: 420871 - DNA, 16 bp, M. musculus
gtatagagattgtgtg

SEQ ID NO: 420872 - DNA, 16 bp, M. musculus
gtatataaagtttgtg

SEQ ID NO: 420873 - DNA, 16 bp, M. musculus
gtatatacatacatac

SEQ ID NO: 420874 - DNA, 16 bp, M. musculus
gtatatacatatatat

SEQ ID NO: 420875 - DNA, 16 bp, M. musculus
gtatatatacatgtat

SEQ ID NO: 420876 - DNA, 16 bp, M. musculus
gtatatatatatatag

SEQ ID NO: 420877 - DNA, 16 bp, M. musculus
gtatatatatgcatac

SEQ ID NO: 420878 - DNA, 16 bp, M. musculus
gtatatatatgtgtgt

SEQ ID NO: 420879 - DNA, 16 bp, M. musculus
gtatatatgaatgtgt

SEQ ID NO: 420880 - DNA, 16 bp, M. musculus
gtatatatgtatatac

SEQ ID NO: 420881 - DNA, 16 bp, M. musculus
gtatatatgtatgtgg

SEQ ID NO: 420882 - DNA, 16 bp, M. musculus
gtatatatgtgtatgt

SEQ ID NO: 420883 - DNA, 16 bp, M. musculus
gtatatatgtgtgtgc

SEQ ID NO: 420884 - DNA, 16 bp, M. musculus
gtatatattatggctt

SEQ ID NO: 420885 - DNA, 16 bp, M. musculus
gtatatcatccatata

SEQ ID NO: 420886 - DNA, 16 bp, M. musculus
gtatatgcccaagagt

SEQ ID NO: 420887 - DNA, 16 bp, M. musculus
gtatatgcctgtgtat

SEQ ID NO: 420888 - DNA, 16 bp, M. musculus
gtatatgggatgaatc

SEQ ID NO: 420889 - DNA, 16 bp, M. musculus
gtatatgtacatatgt

SEQ ID NO: 420890 - DNA, 16 bp, M. musculus
gtatatgtatatatgt

SEQ ID NO: 420891 - DNA, 16 bp, M. musculus
gtatatgtatatgatg

SEQ ID NO: 420892 - DNA, 16 bp, M. musculus
gtatatgtattatgtg

SEQ ID NO: 420893 - DNA, 16 bp, M. musculus
gtatatgtggtgtgtg

SEQ ID NO: 420894 - DNA, 16 bp, M. musculus
gtatatgtgtatatgg

SEQ ID NO: 420895 - DNA, 16 bp, M. musculus
gtatatgtgtatatgt

SEQ ID NO: 420896 - DNA, 17 bp, M. musculus
gtatatgtgtatgtgta

SEQ ID NO: 420897 - DNA, 21 bp, M. musculus
gtatatgtgtgtgtatgtgta

SEQ ID NO: 420898 - DNA, 16 bp, M. musculus
gtatatgttcatatgt

SEQ ID NO: 420899 - DNA, 16 bp, M. musculus
gtatattatatatatg

SEQ ID NO: 420900 - DNA, 16 bp, M. musculus
gtatattatgtgtgta

SEQ ID NO: 420901 - DNA, 16 bp, M. musculus
gtatattctgtgccat

SEQ ID NO: 420902 - DNA, 16 bp, M. musculus
gtatattgctttcact

SEQ ID NO: 420903 - DNA, 16 bp, M. musculus
gtatcaaattgacaaa

SEQ ID NO: 420904 - DNA, 16 bp, M. musculus
gtatcaacaaaaataa

SEQ ID NO: 420905 - DNA, 16 bp, M. musculus
gtatcacctgggtgac

SEQ ID NO: 420906 - DNA, 16 bp, M. musculus
gtatcagaggatggga

SEQ ID NO: 420907 - DNA, 25 bp, M. musculus
gtatcagaggcagattgccctcatg

SEQ ID NO: 420908 - DNA, 16 bp, M. musculus
gtatcattaaaaaaaa

SEQ ID NO: 420909 - DNA, 26 bp, M. musculus
gtatccagagacgggcaactttcctc

SEQ ID NO: 420910 - DNA, 16 bp, M. musculus
gtatccaggacttgct

SEQ ID NO: 420911 - DNA, 16 bp, M. musculus
gtatccatgcctctgt

SEQ ID NO: 420912 - DNA, 16 bp, M. musculus
gtatcccaggtctgct

SEQ ID NO: 420913 - DNA, 16 bp, M. musculus
gtatccccagagcttc

SEQ ID NO: 420914 - DNA, 19 bp, M. musculus
gtatcctaagtttctgggc

SEQ ID NO: 420915 - DNA, 16 bp, M. musculus
gtatctatggttcctg

SEQ ID NO: 420916 - DNA, 16 bp, M. musculus
gtatctctctctctct

SEQ ID NO: 420917 - DNA, 16 bp, M. musculus
gtatctgaacaggatc

SEQ ID NO: 420918 - DNA, 16 bp, M. musculus
gtatctgatatgcagg

SEQ ID NO: 420919 - DNA, 16 bp, M. musculus
gtatctgctcacagca

SEQ ID NO: 420920 - DNA, 16 bp, M. musculus
gtatctgctgaggcct

SEQ ID NO: 420921 - DNA, 16 bp, M. musculus
gtatctgtctagatat

SEQ ID NO: 420922 - DNA, 16 bp, M. musculus
gtatctgtctgtgtat

SEQ ID NO: 420923 - DNA, 16 bp, M. musculus
gtatctgtctgtgtct

SEQ ID NO: 420924 - DNA, 16 bp, M. musculus
gtatctgtgtgtttgt

SEQ ID NO: 420925 - DNA, 16 bp, M. musculus
gtatcttgggtagtct

SEQ ID NO: 420926 - DNA, 16 bp, M. musculus
gtatcttgtatcttag

SEQ ID NO: 420927 - DNA, 16 bp, M. musculus
gtatcttttgccttgc

SEQ ID NO: 420928 - DNA, 16 bp, M. musculus
gtatgaagttttcaaa

SEQ ID NO: 420929 - DNA, 16 bp, M. musculus
gtatgaatgtgagtgt

SEQ ID NO: 420930 - DNA, 16 bp, M. musculus
gtatgaggctagcctg

SEQ ID NO: 420931 - DNA, 16 bp, M. musculus
gtatgagtgtgtatgt

SEQ ID NO: 420932 - DNA, 16 bp, M. musculus
gtatgatgtcagttat

SEQ ID NO: 420933 - DNA, 18 bp, M. musculus
gtatgcactcactgataa

SEQ ID NO: 420934 - DNA, 16 bp, M. musculus
gtatgcatacacacac

SEQ ID NO: 420935 - DNA, 16 bp, M. musculus
gtatgcatatttgtgt

SEQ ID NO: 420936 - DNA, 16 bp, M. musculus
gtatgcatgaagacag

SEQ ID NO: 420937 - DNA, 16 bp, M. musculus
gtatgcatgttcatgt

SEQ ID NO: 420938 - DNA, 16 bp, M. musculus
gtatgcattttctttg

SEQ ID NO: 420939 - DNA, 16 bp, M. musculus
gtatgccaccactgcc

SEQ ID NO: 420940 - DNA, 16 bp, M. musculus
gtatgcctcagtacag

SEQ ID NO: 420941 - DNA, 16 bp, M. musculus
gtatgctgtgccttca

SEQ ID NO: 420942 - DNA, 17 bp, M. musculus
gtatgctttgtggtggc

SEQ ID NO: 420943 - DNA, 16 bp, M. musculus
gtatggaagtgtaagc

SEQ ID NO: 420944 - DNA, 16 bp, M. musculus
gtatggaattctcaaa

SEQ ID NO: 420945 - DNA, 17 bp, M. musculus
gtatggaggtcagagga

SEQ ID NO: 420946 - DNA, 17 bp, M. musculus
gtatggctaatatagct

SEQ ID NO: 420947 - DNA, 16 bp, M. musculus
gtatggctgtttcctg

SEQ ID NO: 420948 - DNA, 18 bp, M. musculus
gtatgggtgttttgcctg

SEQ ID NO: 420949 - DNA, 16 bp, M. musculus
gtatggtgtatgctct

SEQ ID NO: 420950 - DNA, 16 bp, M. musculus
gtatgtaaatatgtat

SEQ ID NO: 420951 - DNA, 16 bp, M. musculus
gtatgtacatatgcat

SEQ ID NO: 420952 - DNA, 16 bp, M. musculus
gtatgtagcagaggat

SEQ ID NO: 420953 - DNA, 18 bp, M. musculus
gtatgtatatatatatga

SEQ ID NO: 420954 - DNA, 16 bp, M. musculus
gtatgtatatatgcat

SEQ ID NO: 420955 - DNA, 16 bp, M. musculus
gtatgtatgagtatgt

SEQ ID NO: 420956 - DNA, 16 bp, M. musculus
gtatgtatgtatagga

SEQ ID NO: 420957 - DNA, 16 bp, M. musculus
gtatgtatgtatgaaa

SEQ ID NO: 420958 - DNA, 16 bp, M. musculus
gtatgtatgtatttta

SEQ ID NO: 420959 - DNA, 16 bp, M. musculus
gtatgtatgtctgttt

SEQ ID NO: 420960 - DNA, 16 bp, M. musculus
gtatgtatgtgagcat

SEQ ID NO: 420961 - DNA, 16 bp, M. musculus
gtatgtatgtgtgagg

SEQ ID NO: 420962 - DNA, 16 bp, M. musculus
gtatgtcacatgaatt

SEQ ID NO: 420963 - DNA, 16 bp, M. musculus
gtatgtctctctgtgt

SEQ ID NO: 420964 - DNA, 16 bp, M. musculus
gtatgtctgaagacag

SEQ ID NO: 420965 - DNA, 16 bp, M. musculus
gtatgtctgtctctgt

SEQ ID NO: 420966 - DNA, 16 bp, M. musculus
gtatgtctgtgtacca

SEQ ID NO: 420967 - DNA, 16 bp, M. musculus
gtatgtctgtgtgtgc

SEQ ID NO: 420968 - DNA, 16 bp, M. musculus
gtatgtctgtgtttgt

SEQ ID NO: 420969 - DNA, 16 bp, M. musculus
gtatgtgcatatgtgc

SEQ ID NO: 420970 - DNA, 16 bp, M. musculus
gtatgtgcatgtatgc

SEQ ID NO: 420971 - DNA, 16 bp, M. musculus
gtatgtggctggagcc

SEQ ID NO: 420972 - DNA, 16 bp, M. musculus
gtatgtgggtacactg

SEQ ID NO: 420973 - DNA, 16 bp, M. musculus
gtatgtgggtagggga

SEQ ID NO: 420974 - DNA, 16 bp, M. musculus
gtatgtggtcagcatg

SEQ ID NO: 420975 - DNA, 16 bp, M. musculus
gtatgtgtaatgtgta

SEQ ID NO: 420976 - DNA, 16 bp, M. musculus
gtatgtgtatctatgt

SEQ ID NO: 420977 - DNA, 16 bp, M. musculus
gtatgtgtatgtaagt

SEQ ID NO: 420978 - DNA, 16 bp, M. musculus
gtatgtgtatgtgaga

SEQ ID NO: 420979 - DNA, 16 bp, M. musculus
gtatgtgtatgtgtgg

SEQ ID NO: 420980 - DNA, 16 bp, M. musculus
gtatgtgtattatgtg

SEQ ID NO: 420981 - DNA, 16 bp, M. musculus
gtatgtgtgcacatgt

SEQ ID NO: 420982 - DNA, 16 bp, M. musculus
gtatgtgtgtacatga

SEQ ID NO: 420983 - DNA, 16 bp, M. musculus
gtatgtgtgtaggtgt

SEQ ID NO: 420984 - DNA, 16 bp, M. musculus
gtatgtgtgtgaaggt

SEQ ID NO: 420985 - DNA, 16 bp, M. musculus
gtatgtgtgtgcatgt

SEQ ID NO: 420986 - DNA, 16 bp, M. musculus
gtatgtgtgtgcatta

SEQ ID NO: 420987 - DNA, 16 bp, M. musculus
gtatgtgtgtgtgaag

SEQ ID NO: 420988 - DNA, 16 bp, M. musculus
gtatgtgtgtgtgtac

SEQ ID NO: 420989 - DNA, 16 bp, M. musculus
gtatgtgtgtgtgtga

SEQ ID NO: 420990 - DNA, 16 bp, M. musculus
gtatgtgttcattcag

SEQ ID NO: 420991 - DNA, 16 bp, M. musculus
gtatgtgtttgtctgt

SEQ ID NO: 420992 - DNA, 16 bp, M. musculus
gtatgtttgtatatat

SEQ ID NO: 420993 - DNA, 16 bp, M. musculus
gtatgtttgtgcatgc

SEQ ID NO: 420994 - DNA, 16 bp, M. musculus
gtatgtttgtgtctgt

SEQ ID NO: 420995 - DNA, 16 bp, M. musculus
gtattagagttctcta

SEQ ID NO: 420996 - DNA, 16 bp, M. musculus
gtattcaggacttgct

SEQ ID NO: 420997 - DNA, 16 bp, M. musculus
gtattcatacacataa

SEQ ID NO: 420998 - DNA, 16 bp, M. musculus
gtattcattcttcttg

SEQ ID NO: 420999 - DNA, 16 bp, M. musculus
gtattccacaacagaa

SEQ ID NO: 421000 - DNA, 16 bp, M. musculus
gtattccagccagaga

SEQ ID NO: 421001 - DNA, 16 bp, M. musculus
gtattcctcaggtcag

SEQ ID NO: 421002 - DNA, 27 bp, M. musculus
gtattcctcaggtgagaattctttgtt

SEQ ID NO: 421003 - DNA, 16 bp, M. musculus
gtattcctcagttcag

SEQ ID NO: 421004 - DNA, 16 bp, M. musculus
gtattctgagcttcta

SEQ ID NO: 421005 - DNA, 16 bp, M. musculus
gtattctgagcttctt

SEQ ID NO: 421006 - DNA, 16 bp, M. musculus
gtattctgtcacagca

SEQ ID NO: 421007 - DNA, 16 bp, M. musculus
gtattggcttctggaa

SEQ ID NO: 421008 - DNA, 16 bp, M. musculus
gtattgggattaaaag

SEQ ID NO: 421009 - DNA, 16 bp, M. musculus
gtattggtttgccttg

SEQ ID NO: 421010 - DNA, 16 bp, M. musculus
gtattgtgtatatgtg

SEQ ID NO: 421011 - DNA, 16 bp, M. musculus
gtattgttttttaaca

SEQ ID NO: 421012 - DNA, 16 bp, M. musculus
gtatttaaaatgcatt

SEQ ID NO: 421013 - DNA, 16 bp, M. musculus
gtatttaaagaaagaa

SEQ ID NO: 421014 - DNA, 17 bp, M. musculus
gtatttaatatggtgaa

SEQ ID NO: 421015 - DNA, 16 bp, M. musculus
gtatttaatcacagca

SEQ ID NO: 421016 - DNA, 16 bp, M. musculus
gtatttacattataat

SEQ ID NO: 421017 - DNA, 16 bp, M. musculus
gtatttataactggaa

SEQ ID NO: 421018 - DNA, 16 bp, M. musculus
gtatttatgaatatat

SEQ ID NO: 421019 - DNA, 17 bp, M. musculus
gtatttatgtgtatatg

SEQ ID NO: 421020 - DNA, 16 bp, M. musculus
gtatttattttaaaag

SEQ ID NO: 421021 - DNA, 16 bp, M. musculus
gtatttccactaaaat

SEQ ID NO: 421022 - DNA, 16 bp, M. musculus
gtatttctgagtttga

SEQ ID NO: 421023 - DNA, 16 bp, M. musculus
gtatttctttatgtga

SEQ ID NO: 421024 - DNA, 16 bp, M. musculus
gtatttgaatacttag

SEQ ID NO: 421025 - DNA, 16 bp, M. musculus
gtatttggcataattc

SEQ ID NO: 421026 - DNA, 16 bp, M. musculus
gtatttgtaaatatat

SEQ ID NO: 421027 - DNA, 16 bp, M. musculus
gtattttatgtgtatg

SEQ ID NO: 421028 - DNA, 16 bp, M. musculus
gtattttattacagca

SEQ ID NO: 421029 - DNA, 16 bp, M. musculus
gtattttcaacaaata

SEQ ID NO: 421030 - DNA, 16 bp, M. musculus
gtattttcatcattta

SEQ ID NO: 421031 - DNA, 16 bp, M. musculus
gtattttcatttacat

SEQ ID NO: 421032 - DNA, 16 bp, M. musculus
gtattttctagtttca

SEQ ID NO: 421033 - DNA, 16 bp, M. musculus
gtattttcttgactga

SEQ ID NO: 421034 - DNA, 16 bp, M. musculus
gtattttctttatata

SEQ ID NO: 421035 - DNA, 16 bp, M. musculus
gtattttgctgctttt

SEQ ID NO: 421036 - DNA, 16 bp, M. musculus
gtattttgttatagca

SEQ ID NO: 421037 - DNA, 16 bp, M. musculus
gtattttgttctgcct

SEQ ID NO: 421038 - DNA, 16 bp, M. musculus
gtattttgttcttcct

SEQ ID NO: 421039 - DNA, 16 bp, M. musculus
gtatttttgcatctat

SEQ ID NO: 421040 - DNA, 16 bp, M. musculus
gtatttttgcatctgt

SEQ ID NO: 421041 - DNA, 16 bp, M. musculus
gtattttttaaaaatc

SEQ ID NO: 421042 - DNA, 16 bp, M. musculus
gtcaaaaatcaagtat

SEQ ID NO: 421043 - DNA, 16 bp, M. musculus
gtcaaaagaaagaatt

SEQ ID NO: 421044 - DNA, 16 bp, M. musculus
gtcaaaagatctttta

SEQ ID NO: 421045 - DNA, 16 bp, M. musculus
gtcaaaagttcaaggt

SEQ ID NO: 421046 - DNA, 16 bp, M. musculus
gtcaaaattctgaccc

SEQ ID NO: 421047 - DNA, 16 bp, M. musculus
gtcaaagctacacaga

SEQ ID NO: 421048 - DNA, 16 bp, M. musculus
gtcaaaggacaaaggc

SEQ ID NO: 421049 - DNA, 16 bp, M. musculus
gtcaaaggacaacttt

SEQ ID NO: 421050 - DNA, 105 bp, M. musculus
gtcaaaggagagattggtggaagtttagctagcattcggcagagttctgatgaaccatatcaggattttgtggacaggctattgatttcagctagtagaatcctt

SEQ ID NO: 421051 - DNA, 16 bp, M. musculus
gtcaaagtcactctga

SEQ ID NO: 421052 - DNA, 16 bp, M. musculus
gtcaaagtggatcaaa

SEQ ID NO: 421053 - DNA, 16 bp, M. musculus
gtcaaatcattctctg

SEQ ID NO: 421054 - DNA, 16 bp, M. musculus
gtcaacaaagttgaaa

SEQ ID NO: 421055 - DNA, 16 bp, M. musculus
gtcaacagacaccatg

SEQ ID NO: 421056 - DNA, 16 bp, M. musculus
gtcaaccattctccaa

SEQ ID NO: 421057 - DNA, 16 bp, M. musculus
gtcaaccttggctaca

SEQ ID NO: 421058 - DNA, 16 bp, M. musculus
gtcaacttgacacgag

SEQ ID NO: 421059 - DNA, 16 bp, M. musculus
gtcaacttgtcacaaa

SEQ ID NO: 421060 - DNA, 16 bp, M. musculus
gtcaactttctgtttt

SEQ ID NO: 421061 - DNA, 16 bp, M. musculus
gtcaagagctccaggg

SEQ ID NO: 421062 - DNA, 16 bp, M. musculus
gtcaagagctctgagg

SEQ ID NO: 421063 - DNA, 16 bp, M. musculus
gtcaagagctctggga

SEQ ID NO: 421064 - DNA, 16 bp, M. musculus
gtcaagctgcacatct

SEQ ID NO: 421065 - DNA, 16 bp, M. musculus
gtcaagctgcttctgg

SEQ ID NO: 421066 - DNA, 16 bp, M. musculus
gtcaagcttcaagaat

SEQ ID NO: 421067 - DNA, 16 bp, M. musculus
gtcaaggacaccatga

SEQ ID NO: 421068 - DNA, 25 bp, M. musculus
gtcaaggtcgatttgcacaacaaca

SEQ ID NO: 421069 - DNA, 16 bp, M. musculus
gtcaagtacagctgaa

SEQ ID NO: 421070 - DNA, 16 bp, M. musculus
gtcaagtctctgcagg

SEQ ID NO: 421071 - DNA, 31 bp, M. musculus
gtcaagttgacaaccaggaatagccactaca

SEQ ID NO: 421072 - DNA, 24 bp, M. musculus
gtcaatcaatctgaggagaccctc

SEQ ID NO: 421073 - DNA, 16 bp, M. musculus
gtcaatcctccaggaa

SEQ ID NO: 421074 - DNA, 16 bp, M. musculus
gtcaatctcttctatg

SEQ ID NO: 421075 - DNA, 16 bp, M. musculus
gtcaatgaaataattc

SEQ ID NO: 421076 - DNA, 16 bp, M. musculus
gtcacaaaaatataaa

SEQ ID NO: 421077 - DNA, 19 bp, M. musculus
gtcacaaaacaggcctcaa

SEQ ID NO: 421078 - DNA, 16 bp, M. musculus
gtcacaaaagaagaca

SEQ ID NO: 421079 - DNA, 16 bp, M. musculus
gtcacaaaagagcaca

SEQ ID NO: 421080 - DNA, 16 bp, M. musculus
gtcacaaagagcagct

SEQ ID NO: 421081 - DNA, 16 bp, M. musculus
gtcacaaatcccttct

SEQ ID NO: 421082 - DNA, 16 bp, M. musculus
gtcacaagctctgggg

SEQ ID NO: 421083 - DNA, 16 bp, M. musculus
gtcacaccaaggtgtt

SEQ ID NO: 421084 - DNA, 16 bp, M. musculus
gtcacaccaggcagaa

SEQ ID NO: 421085 - DNA, 16 bp, M. musculus
gtcacagacacagaca

SEQ ID NO: 421086 - DNA, 16 bp, M. musculus
gtcacagagaaaggag

SEQ ID NO: 421087 - DNA, 16 bp, M. musculus
gtcacagagatctgcc

SEQ ID NO: 421088 - DNA, 16 bp, M. musculus
gtcacagatggttgtg

SEQ ID NO: 421089 - DNA, 16 bp, M. musculus
gtcacagcactgggaa

SEQ ID NO: 421090 - DNA, 16 bp, M. musculus
gtcacagcatcaggaa

SEQ ID NO: 421091 - DNA, 16 bp, M. musculus
gtcacaggaagagaag

SEQ ID NO: 421092 - DNA, 16 bp, M. musculus
gtcacaggtgtgtgca

SEQ ID NO: 421093 - DNA, 16 bp, M. musculus
gtcacatacacacaca

SEQ ID NO: 421094 - DNA, 17 bp, M. musculus
gtcacatgaatcattct

SEQ ID NO: 421095 - DNA, 16 bp, M. musculus
gtcacatgatcatctc

SEQ ID NO: 421096 - DNA, 16 bp, M. musculus
gtcaccaaacccagaa

SEQ ID NO: 421097 - DNA, 16 bp, M. musculus
gtcaccacaatatgag

SEQ ID NO: 421098 - DNA, 16 bp, M. musculus
gtcaccacacccagct

SEQ ID NO: 421099 - DNA, 16 bp, M. musculus
gtcaccacagcctgag

SEQ ID NO: 421100 - DNA, 16 bp, M. musculus
gtcaccaccacccggc

SEQ ID NO: 421101 - DNA, 16 bp, M. musculus
gtcaccaccgcccggc

SEQ ID NO: 421102 - DNA, 16 bp, M. musculus
gtcaccactgcccagc

SEQ ID NO: 421103 - DNA, 16 bp, M. musculus
gtcaccagaaaccatg

SEQ ID NO: 421104 - DNA, 16 bp, M. musculus
gtcacccccatagact

SEQ ID NO: 421105 - DNA, 16 bp, M. musculus
gtcaccccctcccaca

SEQ ID NO: 421106 - DNA, 16 bp, M. musculus
gtcaccctcagctaca

SEQ ID NO: 421107 - DNA, 16 bp, M. musculus
gtcacccttggctaca

SEQ ID NO: 421108 - DNA, 16 bp, M. musculus
gtcacctcactcagga

SEQ ID NO: 421109 - DNA, 16 bp, M. musculus
gtcacctctcctctgg

SEQ ID NO: 421110 - DNA, 16 bp, M. musculus
gtcacctgaattttta

SEQ ID NO: 421111 - DNA, 16 bp, M. musculus
gtcacctgctgctgct

SEQ ID NO: 421112 - DNA, 16 bp, M. musculus
gtcacctggaggagag

SEQ ID NO: 421113 - DNA, 16 bp, M. musculus
gtcaccttttctccct

SEQ ID NO: 421114 - DNA, 16 bp, M. musculus
gtcaccttttgatgag

SEQ ID NO: 421115 - DNA, 16 bp, M. musculus
gtcacgccaagatatt

SEQ ID NO: 421116 - DNA, 16 bp, M. musculus
gtcactatggaaatca

SEQ ID NO: 421117 - DNA, 16 bp, M. musculus
gtcactccctgggcca

SEQ ID NO: 421118 - DNA, 16 bp, M. musculus
gtcactctcttcctgc

SEQ ID NO: 421119 - DNA, 16 bp, M. musculus
gtcactctgtccccac

SEQ ID NO: 421120 - DNA, 16 bp, M. musculus
gtcactgaagaaagaa

SEQ ID NO: 421121 - DNA, 17 bp, M. musculus
gtcactgatatatacta

SEQ ID NO: 421122 - DNA, 16 bp, M. musculus
gtcactgctgtctgta

SEQ ID NO: 421123 - DNA, 16 bp, M. musculus
gtcactggacctcttt

SEQ ID NO: 421124 - DNA, 16 bp, M. musculus
gtcactgtcttagtca

SEQ ID NO: 421125 - DNA, 16 bp, M. musculus
gtcactgtgaaggtgg

SEQ ID NO: 421126 - DNA, 16 bp, M. musculus
gtcactgtgggcatgg

SEQ ID NO: 421127 - DNA, 16 bp, M. musculus
gtcactgtgggggcgg

SEQ ID NO: 421128 - DNA, 16 bp, M. musculus
gtcactgtgggtgtgg

SEQ ID NO: 421129 - DNA, 16 bp, M. musculus
gtcactgtggtgtggg

SEQ ID NO: 421130 - DNA, 16 bp, M. musculus
gtcactgtgtagacca

SEQ ID NO: 421131 - DNA, 16 bp, M. musculus
gtcactttgtacaaag

SEQ ID NO: 421132 - DNA, 16 bp, M. musculus
gtcactttgtctgcct

SEQ ID NO: 421133 - DNA, 16 bp, M. musculus
gtcagaaacaaaacaa

SEQ ID NO: 421134 - DNA, 16 bp, M. musculus
gtcagaaacttgtgtc

SEQ ID NO: 421135 - DNA, 16 bp, M. musculus
gtcagaagaactcacc

SEQ ID NO: 421136 - DNA, 16 bp, M. musculus
gtcagaagaggagaag

SEQ ID NO: 421137 - DNA, 16 bp, M. musculus
gtcagaagagggcttc

SEQ ID NO: 421138 - DNA, 16 bp, M. musculus
gtcagaagcctgtgtc

SEQ ID NO: 421139 - DNA, 16 bp, M. musculus
gtcagaagctcagctg

SEQ ID NO: 421140 - DNA, 16 bp, M. musculus
gtcagaagctgaaaac

SEQ ID NO: 421141 - DNA, 16 bp, M. musculus
gtcagaagtctgagaa

SEQ ID NO: 421142 - DNA, 16 bp, M. musculus
gtcagaatggtgaaga

SEQ ID NO: 421143 - DNA, 16 bp, M. musculus
gtcagacacacacaca

SEQ ID NO: 421144 - DNA, 16 bp, M. musculus
gtcagacagacagaca

SEQ ID NO: 421145 - DNA, 16 bp, M. musculus
gtcagactctagaagt

SEQ ID NO: 421146 - DNA, 16 bp, M. musculus
gtcagacttggtggca

SEQ ID NO: 421147 - DNA, 16 bp, M. musculus
gtcagagaaaggggag

SEQ ID NO: 421148 - DNA, 16 bp, M. musculus
gtcagagaacaacctt

SEQ ID NO: 421149 - DNA, 16 bp, M. musculus
gtcagagaacaacttg

SEQ ID NO: 421150 - DNA, 16 bp, M. musculus
gtcagagaagatgtac

SEQ ID NO: 421151 - DNA, 16 bp, M. musculus
gtcagagaaggggaag

SEQ ID NO: 421152 - DNA, 16 bp, M. musculus
gtcagagacagagaga

SEQ ID NO: 421153 - DNA, 16 bp, M. musculus
gtcagagaccatcctg

SEQ ID NO: 421154 - DNA, 16 bp, M. musculus
gtcagagatccacctg

SEQ ID NO: 421155 - DNA, 16 bp, M. musculus
gtcagagcaagaactc

SEQ ID NO: 421156 - DNA, 16 bp, M. musculus
gtcagagcaggagctc

SEQ ID NO: 421157 - DNA, 16 bp, M. musculus
gtcagagccagagtcc

SEQ ID NO: 421158 - DNA, 16 bp, M. musculus
gtcagagccctccctg

SEQ ID NO: 421159 - DNA, 16 bp, M. musculus
gtcagagccctctctg

SEQ ID NO: 421160 - DNA, 16 bp, M. musculus
gtcagagctacacaga

SEQ ID NO: 421161 - DNA, 16 bp, M. musculus
gtcagagctggagaga

SEQ ID NO: 421162 - DNA, 16 bp, M. musculus
gtcagaggacaacttt

SEQ ID NO: 421163 - DNA, 16 bp, M. musculus
gtcagaggagctgttg

SEQ ID NO: 421164 - DNA, 16 bp, M. musculus
gtcagaggcaggaaga

SEQ ID NO: 421165 - DNA, 16 bp, M. musculus
gtcagaggccagcctg

SEQ ID NO: 421166 - DNA, 16 bp, M. musculus
gtcagagggcaacttc

SEQ ID NO: 421167 - DNA, 16 bp, M. musculus
gtcagagggcaacttt

SEQ ID NO: 421168 - DNA, 16 bp, M. musculus
gtcagaggtcaatctc

SEQ ID NO: 421169 - DNA, 16 bp, M. musculus
gtcagaggtgtgtgtg

SEQ ID NO: 421170 - DNA, 16 bp, M. musculus
gtcagagtttttgaca

SEQ ID NO: 421171 - DNA, 19 bp, M. musculus
gtcagatcccctggaactg

SEQ ID NO: 421172 - DNA, 16 bp, M. musculus
gtcagatcccctggag

SEQ ID NO: 421173 - DNA, 18 bp, M. musculus
gtcagatcttgttacaga

SEQ ID NO: 421174 - DNA, 16 bp, M. musculus
gtcagatgagattttt

SEQ ID NO: 421175 - DNA, 16 bp, M. musculus
gtcagatgctgatatt

SEQ ID NO: 421176 - DNA, 20 bp, M. musculus
gtcagattccattacagatg

SEQ ID NO: 421177 - DNA, 16 bp, M. musculus
gtcagcaccagcacca

SEQ ID NO: 421178 - DNA, 16 bp, M. musculus
gtcagcagcagcagca

SEQ ID NO: 421179 - DNA, 16 bp, M. musculus
gtcagcagcagcagct

SEQ ID NO: 421180 - DNA, 16 bp, M. musculus
gtcagcagcttttaca

SEQ ID NO: 421181 - DNA, 16 bp, M. musculus
gtcagcaggagcaacc

SEQ ID NO: 421182 - DNA, 16 bp, M. musculus
gtcagcatgtacttct

SEQ ID NO: 421183 - DNA, 16 bp, M. musculus
gtcagcattcctggga

SEQ ID NO: 421184 - DNA, 16 bp, M. musculus
gtcagcatttggaaga

SEQ ID NO: 421185 - DNA, 16 bp, M. musculus
gtcagccagccagcca

SEQ ID NO: 421186 - DNA, 16 bp, M. musculus
gtcagcctggtctaca

SEQ ID NO: 421187 - DNA, 16 bp, M. musculus
gtcagcctgttctaca

SEQ ID NO: 421188 - DNA, 16 bp, M. musculus
gtcagccttggctaca

SEQ ID NO: 421189 - DNA, 17 bp, M. musculus
gtcagcgtttggaagct

SEQ ID NO: 421190 - DNA, 16 bp, M. musculus
gtcagctgtttgttgg

SEQ ID NO: 421191 - DNA, 16 bp, M. musculus
gtcagcttgtgaggca

SEQ ID NO: 421192 - DNA, 16 bp, M. musculus
gtcaggaagcagagaa

SEQ ID NO: 421193 - DNA, 16 bp, M. musculus
gtcaggacccacaggt

SEQ ID NO: 421194 - DNA, 16 bp, M. musculus
gtcaggactggagaga

SEQ ID NO: 421195 - DNA, 16 bp, M. musculus
gtcaggagagctggcc

SEQ ID NO: 421196 - DNA, 16 bp, M. musculus
gtcaggaggcagagag

SEQ ID NO: 421197 - DNA, 16 bp, M. musculus
gtcaggcatggtaatt

SEQ ID NO: 421198 - DNA, 16 bp, M. musculus
gtcaggcatggtggca

SEQ ID NO: 421199 - DNA, 16 bp, M. musculus
gtcaggccgggttttc

SEQ ID NO: 421200 - DNA, 16 bp, M. musculus
gtcaggctcagcagca

SEQ ID NO: 421201 - DNA, 16 bp, M. musculus
gtcaggctgggctcag

SEQ ID NO: 421202 - DNA, 16 bp, M. musculus
gtcaggcttctctgga

SEQ ID NO: 421203 - DNA, 16 bp, M. musculus
gtcaggcttggcagca

SEQ ID NO: 421204 - DNA, 16 bp, M. musculus
gtcagggagcagagag

SEQ ID NO: 421205 - DNA, 16 bp, M. musculus
gtcagggcactcagca

SEQ ID NO: 421206 - DNA, 16 bp, M. musculus
gtcagggctacacagg

SEQ ID NO: 421207 - DNA, 16 bp, M. musculus
gtcaggggacaacttg

SEQ ID NO: 421208 - DNA, 16 bp, M. musculus
gtcagggtcagggtca

SEQ ID NO: 421209 - DNA, 16 bp, M. musculus
gtcagggtgttttatc

SEQ ID NO: 421210 - DNA, 16 bp, M. musculus
gtcagggtttctctgt

SEQ ID NO: 421211 - DNA, 16 bp, M. musculus
gtcaggtgaaatctta

SEQ ID NO: 421212 - DNA, 16 bp, M. musculus
gtcaggtgctgataga

SEQ ID NO: 421213 - DNA, 16 bp, M. musculus
gtcaggtgctggcaga

SEQ ID NO: 421214 - DNA, 16 bp, M. musculus
gtcaggtgtcttcctc

SEQ ID NO: 421215 - DNA, 16 bp, M. musculus
gtcaggtgtcttcctt

SEQ ID NO: 421216 - DNA, 16 bp, M. musculus
gtcaggtgtggtggta

SEQ ID NO: 421217 - DNA, 16 bp, M. musculus
gtcaggttgacaacca

SEQ ID NO: 421218 - DNA, 16 bp, M. musculus
gtcaggtttggtagca

SEQ ID NO: 421219 - DNA, 22 bp, M. musculus
gtcagtatcaccctgtgtcagt

SEQ ID NO: 421220 - DNA, 16 bp, M. musculus
gtcagtcagacagaca

SEQ ID NO: 421221 - DNA, 16 bp, M. musculus
gtcagtctgggctaca

SEQ ID NO: 421222 - DNA, 16 bp, M. musculus
gtcagtgagcaggatg

SEQ ID NO: 421223 - DNA, 16 bp, M. musculus
gtcagtgatcttaact

SEQ ID NO: 421224 - DNA, 16 bp, M. musculus
gtcagtgcagcagcag

SEQ ID NO: 421225 - DNA, 16 bp, M. musculus
gtcagtgctcttactg

SEQ ID NO: 421226 - DNA, 16 bp, M. musculus
gtcagtggtggcacat

SEQ ID NO: 421227 - DNA, 16 bp, M. musculus
gtcagtggttaaaagc

SEQ ID NO: 421228 - DNA, 16 bp, M. musculus
gtcagtgtccttaacc

SEQ ID NO: 421229 - DNA, 16 bp, M. musculus
gtcagtgtgtgtgtgt

SEQ ID NO: 421230 - DNA, 16 bp, M. musculus
gtcagttctctccttt

SEQ ID NO: 421231 - DNA, 16 bp, M. musculus
gtcataaaagaacaca

SEQ ID NO: 421232 - DNA, 16 bp, M. musculus
gtcatatatacatata

SEQ ID NO: 421233 - DNA, 16 bp, M. musculus
gtcatatatcagatat

SEQ ID NO: 421234 - DNA, 16 bp, M. musculus
gtcatcaaaacagaaa

SEQ ID NO: 421235 - DNA, 18 bp, M. musculus
gtcatcaaggtgggagca

SEQ ID NO: 421236 - DNA, 16 bp, M. musculus
gtcatcaattgcaact

SEQ ID NO: 421237 - DNA, 16 bp, M. musculus
gtcatcaccaccacca

SEQ ID NO: 421238 - DNA, 16 bp, M. musculus
gtcatcagagaaatgt

SEQ ID NO: 421239 - DNA, 16 bp, M. musculus
gtcatcagagaagaag

SEQ ID NO: 421240 - DNA, 16 bp, M. musculus
gtcatcagagagaaag

SEQ ID NO: 421241 - DNA, 16 bp, M. musculus
gtcatcagctctcctt

SEQ ID NO: 421242 - DNA, 24 bp, M. musculus
gtcatcagggaaatgcaaatcaaa

SEQ ID NO: 421243 - DNA, 16 bp, M. musculus
gtcatcagtgggaaga

SEQ ID NO: 421244 - DNA, 16 bp, M. musculus
gtcatcatcaccacca

SEQ ID NO: 421245 - DNA, 16 bp, M. musculus
gtcatcatcatcatca

SEQ ID NO: 421246 - DNA, 16 bp, M. musculus
gtcatcatcattgtca

SEQ ID NO: 421247 - DNA, 16 bp, M. musculus
gtcatcattgggagga

SEQ ID NO: 421248 - DNA, 16 bp, M. musculus
gtcatccaaggtacat

SEQ ID NO: 421249 - DNA, 16 bp, M. musculus
gtcatccagacaaaaa

SEQ ID NO: 421250 - DNA, 16 bp, M. musculus
gtcatcccagagctga

SEQ ID NO: 421251 - DNA, 16 bp, M. musculus
gtcatccccctgcctc

SEQ ID NO: 421252 - DNA, 16 bp, M. musculus
gtcatcctcctcatct

SEQ ID NO: 421253 - DNA, 16 bp, M. musculus
gtcatcctcctgcctc

SEQ ID NO: 421254 - DNA, 16 bp, M. musculus
gtcatcctggactgta

SEQ ID NO: 421255 - DNA, 16 bp, M. musculus
gtcatccttggctaca

SEQ ID NO: 421256 - DNA, 16 bp, M. musculus
gtcatctgtctgtctg

SEQ ID NO: 421257 - DNA, 16 bp, M. musculus
gtcatcttaaaaaaga

SEQ ID NO: 421258 - DNA, 16 bp, M. musculus
gtcatcttaagaaaga

SEQ ID NO: 421259 - DNA, 16 bp, M. musculus
gtcatcttcagctaca

SEQ ID NO: 421260 - DNA, 16 bp, M. musculus
gtcatctttgactaca

SEQ ID NO: 421261 - DNA, 16 bp, M. musculus
gtcatgacctacaggt

SEQ ID NO: 421262 - DNA, 16 bp, M. musculus
gtcatgctgtctgttc

SEQ ID NO: 421263 - DNA, 16 bp, M. musculus
gtcatggaatacttgg

SEQ ID NO: 421264 - DNA, 16 bp, M. musculus
gtcatggtgttccatc

SEQ ID NO: 421265 - DNA, 16 bp, M. musculus
gtcatggtgttttatc

SEQ ID NO: 421266 - DNA, 16 bp, M. musculus
gtcatgtcactgctgt

SEQ ID NO: 421267 - DNA, 16 bp, M. musculus
gtcatgtctctagctg

SEQ ID NO: 421268 - DNA, 16 bp, M. musculus
gtcatgtgatgttttc

SEQ ID NO: 421269 - DNA, 16 bp, M. musculus
gtcattcagaccctaa

SEQ ID NO: 421270 - DNA, 16 bp, M. musculus
gtcattcagtattcct

SEQ ID NO: 421271 - DNA, 16 bp, M. musculus
gtcattcattcattca

SEQ ID NO: 421272 - DNA, 16 bp, M. musculus
gtcattccaggaactg

SEQ ID NO: 421273 - DNA, 16 bp, M. musculus
gtcattcccctacact

SEQ ID NO: 421274 - DNA, 16 bp, M. musculus
gtcattcttagctaca

SEQ ID NO: 421275 - DNA, 16 bp, M. musculus
gtcattgacttgtttg

SEQ ID NO: 421276 - DNA, 16 bp, M. musculus
gtcattggggtgctgg

SEQ ID NO: 421277 - DNA, 19 bp, M. musculus
gtcattggggtgctggcca

SEQ ID NO: 421278 - DNA, 16 bp, M. musculus
gtcattggtctgtttt

SEQ ID NO: 421279 - DNA, 16 bp, M. musculus
gtcatttataagagtt

SEQ ID NO: 421280 - DNA, 16 bp, M. musculus
gtcatttgatatgcac

SEQ ID NO: 421281 - DNA, 16 bp, M. musculus
gtcatttgctctgtga

SEQ ID NO: 421282 - DNA, 16 bp, M. musculus
gtcattttattgctac

SEQ ID NO: 421283 - DNA, 16 bp, M. musculus
gtcattttcaggaaaa

SEQ ID NO: 421284 - DNA, 16 bp, M. musculus
gtcattttcttcagtg

SEQ ID NO: 421285 - DNA, 16 bp, M. musculus
gtcatttttattagat

SEQ ID NO: 421286 - DNA, 16 bp, M. musculus
gtcatttttgataact

SEQ ID NO: 421287 - DNA, 16 bp, M. musculus
gtccaaagcagcccca

SEQ ID NO: 421288 - DNA, 17 bp, M. musculus
gtccaaagggcctctct

SEQ ID NO: 421289 - DNA, 16 bp, M. musculus
gtccaacaaccctgag

SEQ ID NO: 421290 - DNA, 16 bp, M. musculus
gtccaacaaggctatc

SEQ ID NO: 421291 - DNA, 16 bp, M. musculus
gtccaacagttggctg

SEQ ID NO: 421292 - DNA, 16 bp, M. musculus
gtccaaccttttgaca

SEQ ID NO: 421293 - DNA, 16 bp, M. musculus
gtccaagcacagcggg

SEQ ID NO: 421294 - DNA, 16 bp, M. musculus
gtccaaggccagcctg

SEQ ID NO: 421295 - DNA, 16 bp, M. musculus
gtccaagtggataaag

SEQ ID NO: 421296 - DNA, 16 bp, M. musculus
gtccaatatttggctg

SEQ ID NO: 421297 - DNA, 16 bp, M. musculus
gtccaatcacaggctt

SEQ ID NO: 421298 - DNA, 49 bp, M. musculus
gtccaatgggcctctctttccagtgatggccgactaggccatcttttga

SEQ ID NO: 421299 - DNA, 16 bp, M. musculus
gtccacaccagcaccg

SEQ ID NO: 421300 - DNA, 16 bp, M. musculus
gtccacacccacagtg

SEQ ID NO: 421301 - DNA, 16 bp, M. musculus
gtccacagaactcaca

SEQ ID NO: 421302 - DNA, 16 bp, M. musculus
gtccacagaggactct

SEQ ID NO: 421303 - DNA, 16 bp, M. musculus
gtccacagtcaggaag

SEQ ID NO: 421304 - DNA, 16 bp, M. musculus
gtccacctccagtgga

SEQ ID NO: 421305 - DNA, 16 bp, M. musculus
gtccaccttctcgagt

SEQ ID NO: 421306 - DNA, 55 bp, M. musculus
gtccaccttcttgagttctttatatatgttggatattagtcccctatctgattta

SEQ ID NO: 421307 - DNA, 78 bp, M. musculus
gtccaccttcttgagttctttatatatgttggatattagtcccctatctgatttaggataggtaaagatcctttccca

SEQ ID NO: 421308 - DNA, 16 bp, M. musculus
gtccactctggactct

SEQ ID NO: 421309 - DNA, 16 bp, M. musculus
gtccagaaacatagaa

SEQ ID NO: 421310 - DNA, 16 bp, M. musculus
gtccagacaaggcagt

SEQ ID NO: 421311 - DNA, 16 bp, M. musculus
gtccagactggcctgg

SEQ ID NO: 421312 - DNA, 16 bp, M. musculus
gtccagaggggttctc

SEQ ID NO: 421313 - DNA, 16 bp, M. musculus
gtccagcaatcaaaag

SEQ ID NO: 421314 - DNA, 16 bp, M. musculus
gtccagcatggtgatt

SEQ ID NO: 421315 - DNA, 16 bp, M. musculus
gtccagcccactgtgg

SEQ ID NO: 421316 - DNA, 20 bp, M. musculus
gtccagcctggcaggcagcc

SEQ ID NO: 421317 - DNA, 16 bp, M. musculus
gtccagctatcaaaat

SEQ ID NO: 421318 - DNA, 16 bp, M. musculus
gtccagctgtctctga

SEQ ID NO: 421319 - DNA, 16 bp, M. musculus
gtccagcttagttgac

SEQ ID NO: 421320 - DNA, 16 bp, M. musculus
gtccaggaaccaaggt

SEQ ID NO: 421321 - DNA, 25 bp, M. musculus
gtccaggaatagaaaccctgactaa

SEQ ID NO: 421322 - DNA, 16 bp, M. musculus
gtccaggacagccagg

SEQ ID NO: 421323 - DNA, 16 bp, M. musculus
gtccaggaccagatgg

SEQ ID NO: 421324 - DNA, 16 bp, M. musculus
gtccaggatgctgatt

SEQ ID NO: 421325 - DNA, 16 bp, M. musculus
gtccagggacctcagg

SEQ ID NO: 421326 - DNA, 16 bp, M. musculus
gtccaggggctggaga

SEQ ID NO: 421327 - DNA, 16 bp, M. musculus
gtccagtctcttctgg

SEQ ID NO: 421328 - DNA, 16 bp, M. musculus
gtccataaccatcatg

SEQ ID NO: 421329 - DNA, 16 bp, M. musculus
gtccatcaacagaaga

SEQ ID NO: 421330 - DNA, 16 bp, M. musculus
gtccatcattgtgggg

SEQ ID NO: 421331 - DNA, 16 bp, M. musculus
gtccatccagagactg

SEQ ID NO: 421332 - DNA, 16 bp, M. musculus
gtccatccgtctgtcc

SEQ ID NO: 421333 - DNA, 16 bp, M. musculus
gtccatcctttcacct

SEQ ID NO: 421334 - DNA, 16 bp, M. musculus
gtccatcctttcgtct

SEQ ID NO: 421335 - DNA, 16 bp, M. musculus
gtccatccttttgtct

SEQ ID NO: 421336 - DNA, 16 bp, M. musculus
gtccatccttttttct

SEQ ID NO: 421337 - DNA, 16 bp, M. musculus
gtccatctgtctatct

SEQ ID NO: 421338 - DNA, 16 bp, M. musculus
gtccatgaagcccctc

SEQ ID NO: 421339 - DNA, 16 bp, M. musculus
gtccatggttgcttgg

SEQ ID NO: 421340 - DNA, 18 bp, M. musculus
gtccatgtccacccaagc

SEQ ID NO: 421341 - DNA, 16 bp, M. musculus
gtccattcattcattc

SEQ ID NO: 421342 - DNA, 16 bp, M. musculus
gtcccaaaaatttcag

SEQ ID NO: 421343 - DNA, 16 bp, M. musculus
gtcccaaagcctgaca

SEQ ID NO: 421344 - DNA, 17 bp, M. musculus
gtcccaaagtctgagta

SEQ ID NO: 421345 - DNA, 16 bp, M. musculus
gtcccaaggagctctg

SEQ ID NO: 421346 - DNA, 16 bp, M. musculus
gtcccaagtgctggga

SEQ ID NO: 421347 - DNA, 16 bp, M. musculus
gtcccacagtctttac

SEQ ID NO: 421348 - DNA, 16 bp, M. musculus
gtcccaccaacaatgg

SEQ ID NO: 421349 - DNA, 16 bp, M. musculus
gtcccacctcagagct

SEQ ID NO: 421350 - DNA, 16 bp, M. musculus
gtcccactcacagaga

SEQ ID NO: 421351 - DNA, 16 bp, M. musculus
gtcccagaatctgtgt

SEQ ID NO: 421352 - DNA, 16 bp, M. musculus
gtcccagagacctgga

SEQ ID NO: 421353 - DNA, 16 bp, M. musculus
gtcccagagatgagag

SEQ ID NO: 421354 - DNA, 16 bp, M. musculus
gtcccagatccctcag

SEQ ID NO: 421355 - DNA, 16 bp, M. musculus
gtcccagatggaggag

SEQ ID NO: 421356 - DNA, 17 bp, M. musculus
gtcccagcaaccacatg

SEQ ID NO: 421357 - DNA, 19 bp, M. musculus
gtcccagcacccacatggt

SEQ ID NO: 421358 - DNA, 16 bp, M. musculus
gtcccagcaggactaa

SEQ ID NO: 421359 - DNA, 16 bp, M. musculus
gtcccaggaagccatc

SEQ ID NO: 421360 - DNA, 16 bp, M. musculus
gtcccaggaggaagag

SEQ ID NO: 421361 - DNA, 16 bp, M. musculus
gtcccaggcaccatct

SEQ ID NO: 421362 - DNA, 16 bp, M. musculus
gtcccagggaatccaa

SEQ ID NO: 421363 - DNA, 16 bp, M. musculus
gtcccagggagctcag

SEQ ID NO: 421364 - DNA, 16 bp, M. musculus
gtcccagggagtgggg

SEQ ID NO: 421365 - DNA, 16 bp, M. musculus
gtcccagggcagccag

SEQ ID NO: 421366 - DNA, 16 bp, M. musculus
gtcccagggtctgaaa

SEQ ID NO: 421367 - DNA, 16 bp, M. musculus
gtcccagtcttcctgt

SEQ ID NO: 421368 - DNA, 16 bp, M. musculus
gtcccataattttggg

SEQ ID NO: 421369 - DNA, 16 bp, M. musculus
gtcccatgctcccaga

SEQ ID NO: 421370 - DNA, 16 bp, M. musculus
gtcccatttatttggt

SEQ ID NO: 421371 - DNA, 16 bp, M. musculus
gtcccatttgtctatt

SEQ ID NO: 421372 - DNA, 16 bp, M. musculus
gtccccaacatgttgg

SEQ ID NO: 421373 - DNA, 16 bp, M. musculus
gtccccaccagcaaga

SEQ ID NO: 421374 - DNA, 16 bp, M. musculus
gtccccacccacaggt

SEQ ID NO: 421375 - DNA, 16 bp, M. musculus
gtccccagaggacttt

SEQ ID NO: 421376 - DNA, 16 bp, M. musculus
gtccccagcacccaca

SEQ ID NO: 421377 - DNA, 16 bp, M. musculus
gtccccagcacccagg

SEQ ID NO: 421378 - DNA, 16 bp, M. musculus
gtccccaggagctccg

SEQ ID NO: 421379 - DNA, 16 bp, M. musculus
gtccccagtggagaag

SEQ ID NO: 421380 - DNA, 16 bp, M. musculus
gtccccatccactcac

SEQ ID NO: 421381 - DNA, 16 bp, M. musculus
gtcccccacaagctcc

SEQ ID NO: 421382 - DNA, 16 bp, M. musculus
gtcccccatacgcacc

SEQ ID NO: 421383 - DNA, 16 bp, M. musculus
gtcccctatgaaggag

SEQ ID NO: 421384 - DNA, 16 bp, M. musculus
gtcccctcgagaccct

SEQ ID NO: 421385 - DNA, 16 bp, M. musculus
gtcccctctctgattt

SEQ ID NO: 421386 - DNA, 16 bp, M. musculus
gtcccctggaagaaca

SEQ ID NO: 421387 - DNA, 16 bp, M. musculus
gtccccttggttcctc

SEQ ID NO: 421388 - DNA, 18 bp, M. musculus
gtcccctttaaggaggag

SEQ ID NO: 421389 - DNA, 16 bp, M. musculus
gtccccttttgtgtct

SEQ ID NO: 421390 - DNA, 16 bp, M. musculus
gtccctacctggcaca

SEQ ID NO: 421391 - DNA, 16 bp, M. musculus
gtccctattaaagaga

SEQ ID NO: 421392 - DNA, 16 bp, M. musculus
gtccctcaaccaaaaa

SEQ ID NO: 421393 - DNA, 16 bp, M. musculus
gtccctcaatccttcc

SEQ ID NO: 421394 - DNA, 16 bp, M. musculus
gtccctcagagcagaa

SEQ ID NO: 421395 - DNA, 16 bp, M. musculus
gtccctcatggggaag

SEQ ID NO: 421396 - DNA, 16 bp, M. musculus
gtccctccactggaag

SEQ ID NO: 421397 - DNA, 16 bp, M. musculus
gtccctccatccctcc

SEQ ID NO: 421398 - DNA, 16 bp, M. musculus
gtccctcctgctgact

SEQ ID NO: 421399 - DNA, 16 bp, M. musculus
gtccctctcaccctct

SEQ ID NO: 421400 - DNA, 16 bp, M. musculus
gtccctctctaccccc

SEQ ID NO: 421401 - DNA, 16 bp, M. musculus
gtccctctgagcagaa

SEQ ID NO: 421402 - DNA, 16 bp, M. musculus
gtccctgatggaggag

SEQ ID NO: 421403 - DNA, 16 bp, M. musculus
gtccctgctgctgctg

SEQ ID NO: 421404 - DNA, 16 bp, M. musculus
gtccctgctgttcttt

SEQ ID NO: 421405 - DNA, 16 bp, M. musculus
gtccctggaacccaca

SEQ ID NO: 421406 - DNA, 16 bp, M. musculus
gtccctggctctcctt

SEQ ID NO: 421407 - DNA, 16 bp, M. musculus
gtccctggctgttcct

SEQ ID NO: 421408 - DNA, 16 bp, M. musculus
gtccctgggagctatg

SEQ ID NO: 421409 - DNA, 16 bp, M. musculus
gtccctgggagctctg

SEQ ID NO: 421410 - DNA, 16 bp, M. musculus
gtccctgggaggcctg

SEQ ID NO: 421411 - DNA, 16 bp, M. musculus
gtccctggtgatctga

SEQ ID NO: 421412 - DNA, 16 bp, M. musculus
gtccctgtcctcttca

SEQ ID NO: 421413 - DNA, 16 bp, M. musculus
gtccctgtgctccatc

SEQ ID NO: 421414 - DNA, 16 bp, M. musculus
gtccctgtgtctgtct

SEQ ID NO: 421415 - DNA, 16 bp, M. musculus
gtccctgtgtgacctc

SEQ ID NO: 421416 - DNA, 16 bp, M. musculus
gtcccttggagctgga

SEQ ID NO: 421417 - DNA, 16 bp, M. musculus
gtccctttgagacatc

SEQ ID NO: 421418 - DNA, 16 bp, M. musculus
gtccctttgtgggtgg

SEQ ID NO: 421419 - DNA, 16 bp, M. musculus
gtccctttttaaggag

SEQ ID NO: 421420 - DNA, 16 bp, M. musculus
gtccctttttgtgagc

SEQ ID NO: 421421 - DNA, 16 bp, M. musculus
gtccgtccatctgtcc

SEQ ID NO: 421422 - DNA, 16 bp, M. musculus
gtccgtccgtccgtcc

SEQ ID NO: 421423 - DNA, 16 bp, M. musculus
gtccgtccttccttcc

SEQ ID NO: 421424 - DNA, 16 bp, M. musculus
gtccgtctgtccatcc

SEQ ID NO: 421425 - DNA, 16 bp, M. musculus
gtcctacatcttcatc

SEQ ID NO: 421426 - DNA, 16 bp, M. musculus
gtcctacccagctatg

SEQ ID NO: 421427 - DNA, 16 bp, M. musculus
gtcctagaattcactg

SEQ ID NO: 421428 - DNA, 16 bp, M. musculus
gtcctagcaaacacag

SEQ ID NO: 421429 - DNA, 16 bp, M. musculus
gtcctagctgtcctag

SEQ ID NO: 421430 - DNA, 16 bp, M. musculus
gtcctaggtgctataa

SEQ ID NO: 421431 - DNA, 16 bp, M. musculus
gtcctagtacttggga

SEQ ID NO: 421432 - DNA, 16 bp, M. musculus
gtcctatggaagaaca

SEQ ID NO: 421433 - DNA, 16 bp, M. musculus
gtcctcacctcccacc

SEQ ID NO: 421434 - DNA, 16 bp, M. musculus
gtcctcagctctggag

SEQ ID NO: 421435 - DNA, 16 bp, M. musculus
gtcctcatggagggga

SEQ ID NO: 421436 - DNA, 16 bp, M. musculus
gtcctcatgtcactca

SEQ ID NO: 421437 - DNA, 16 bp, M. musculus
gtcctccattccctct

SEQ ID NO: 421438 - DNA, 16 bp, M. musculus
gtcctcctgacttcct

SEQ ID NO: 421439 - DNA, 16 bp, M. musculus
gtcctcctgcctcagc

SEQ ID NO: 421440 - DNA, 16 bp, M. musculus
gtcctcctgcctcagt

SEQ ID NO: 421441 - DNA, 16 bp, M. musculus
gtcctcctgcttcagc

SEQ ID NO: 421442 - DNA, 19 bp, M. musculus
gtcctcctgtctcagcctc

SEQ ID NO: 421443 - DNA, 16 bp, M. musculus
gtcctcctttatacaa

SEQ ID NO: 421444 - DNA, 16 bp, M. musculus
gtcctctacaagagca

SEQ ID NO: 421445 - DNA, 16 bp, M. musculus
gtcctctagaagagca

SEQ ID NO: 421446 - DNA, 16 bp, M. musculus
gtcctctaggctccag

SEQ ID NO: 421447 - DNA, 16 bp, M. musculus
gtcctctataaaagca

SEQ ID NO: 421448 - DNA, 16 bp, M. musculus
gtcctctccctatgcc

SEQ ID NO: 421449 - DNA, 16 bp, M. musculus
gtcctctccttccacc

SEQ ID NO: 421450 - DNA, 16 bp, M. musculus
gtcctctgaagagcag

SEQ ID NO: 421451 - DNA, 16 bp, M. musculus
gtcctctgaaggttct

SEQ ID NO: 421452 - DNA, 16 bp, M. musculus
gtcctctgacctccag

SEQ ID NO: 421453 - DNA, 16 bp, M. musculus
gtcctctgcaagaaca

SEQ ID NO: 421454 - DNA, 16 bp, M. musculus
gtcctctgcaagagca

SEQ ID NO: 421455 - DNA, 16 bp, M. musculus
gtcctctgcagaagca

SEQ ID NO: 421456 - DNA, 16 bp, M. musculus
gtcctctgctacatat

SEQ ID NO: 421457 - DNA, 16 bp, M. musculus
gtcctctgctacttat

SEQ ID NO: 421458 - DNA, 16 bp, M. musculus
gtcctctggaagagca

SEQ ID NO: 421459 - DNA, 16 bp, M. musculus
gtcctctggaagagga

SEQ ID NO: 421460 - DNA, 16 bp, M. musculus
gtcctctggcttccat

SEQ ID NO: 421461 - DNA, 16 bp, M. musculus
gtcctctgtctctgtg

SEQ ID NO: 421462 - DNA, 16 bp, M. musculus
gtcctctgtgagaagg

SEQ ID NO: 421463 - DNA, 16 bp, M. musculus
gtcctctgtgagagca

SEQ ID NO: 421464 - DNA, 16 bp, M. musculus
gtcctctgtgtatata

SEQ ID NO: 421465 - DNA, 16 bp, M. musculus
gtcctcttaactgctg

SEQ ID NO: 421466 - DNA, 16 bp, M. musculus
gtcctcttcaagagca

SEQ ID NO: 421467 - DNA, 16 bp, M. musculus
gtcctcttctgtatat

SEQ ID NO: 421468 - DNA, 16 bp, M. musculus
gtcctcttcttcaaaa

SEQ ID NO: 421469 - DNA, 16 bp, M. musculus
gtcctcttgaagaaca

SEQ ID NO: 421470 - DNA, 16 bp, M. musculus
gtcctcttgcctcagc

SEQ ID NO: 421471 - DNA, 16 bp, M. musculus
gtcctgaaactcaatc

SEQ ID NO: 421472 - DNA, 16 bp, M. musculus
gtcctgaatttcatcc

SEQ ID NO: 421473 - DNA, 16 bp, M. musculus
gtcctgacccacaggt

SEQ ID NO: 421474 - DNA, 16 bp, M. musculus
gtcctgaccctagaag

SEQ ID NO: 421475 - DNA, 16 bp, M. musculus
gtcctgactttctttg

SEQ ID NO: 421476 - DNA, 16 bp, M. musculus
gtcctgagtgaggtaa

SEQ ID NO: 421477 - DNA, 16 bp, M. musculus
gtcctgagttcaattt

SEQ ID NO: 421478 - DNA, 16 bp, M. musculus
gtcctgatgatggtga

SEQ ID NO: 421479 - DNA, 16 bp, M. musculus
gtcctgcagatccaaa

SEQ ID NO: 421480 - DNA, 16 bp, M. musculus
gtcctgcagctttgga

SEQ ID NO: 421481 - DNA, 16 bp, M. musculus
gtcctgccctattgtt

SEQ ID NO: 421482 - DNA, 16 bp, M. musculus
gtcctgcctcttcctc

SEQ ID NO: 421483 - DNA, 16 bp, M. musculus
gtcctgccttcaagat

SEQ ID NO: 421484 - DNA, 16 bp, M. musculus
gtcctgctggtcccag

SEQ ID NO: 421485 - DNA, 16 bp, M. musculus
gtcctgcttcagcctc

SEQ ID NO: 421486 - DNA, 17 bp, M. musculus
gtcctggaaccaagatg

SEQ ID NO: 421487 - DNA, 16 bp, M. musculus
gtcctggaacccactc

SEQ ID NO: 421488 - DNA, 16 bp, M. musculus
gtcctggaactcaggc

SEQ ID NO: 421489 - DNA, 16 bp, M. musculus
gtcctggaactcagtt

SEQ ID NO: 421490 - DNA, 16 bp, M. musculus
gtcctggaactctcta

SEQ ID NO: 421491 - DNA, 16 bp, M. musculus
gtcctggaactgactc

SEQ ID NO: 421492 - DNA, 16 bp, M. musculus
gtcctggaacttgctg

SEQ ID NO: 421493 - DNA, 16 bp, M. musculus
gtcctggaattcactg

SEQ ID NO: 421494 - DNA, 16 bp, M. musculus
gtcctggagaaaggtg

SEQ ID NO: 421495 - DNA, 16 bp, M. musculus
gtcctggagagatcag

SEQ ID NO: 421496 - DNA, 16 bp, M. musculus
gtcctggatatcctgg

SEQ ID NO: 421497 - DNA, 16 bp, M. musculus
gtcctggatctcaaag

SEQ ID NO: 421498 - DNA, 16 bp, M. musculus
gtcctggattgtataa

SEQ ID NO: 421499 - DNA, 16 bp, M. musculus
gtcctggcagtcctgg

SEQ ID NO: 421500 - DNA, 16 bp, M. musculus
gtcctggctcttctgg

SEQ ID NO: 421501 - DNA, 16 bp, M. musculus
gtcctggctgtcttga

SEQ ID NO: 421502 - DNA, 16 bp, M. musculus
gtcctgggatcaaagg

SEQ ID NO: 421503 - DNA, 16 bp, M. musculus
gtcctggggtcagagt

SEQ ID NO: 421504 - DNA, 16 bp, M. musculus
gtcctgggttgcctgg

SEQ ID NO: 421505 - DNA, 16 bp, M. musculus
gtcctggtctggtccc

SEQ ID NO: 421506 - DNA, 16 bp, M. musculus
gtcctggtctgttctg

SEQ ID NO: 421507 - DNA, 16 bp, M. musculus
gtcctgtgaaggctgg

SEQ ID NO: 421508 - DNA, 16 bp, M. musculus
gtcctgtgctccatcc

SEQ ID NO: 421509 - DNA, 16 bp, M. musculus
gtcctgtggaagagca

SEQ ID NO: 421510 - DNA, 16 bp, M. musculus
gtcctgtggctggtcc

SEQ ID NO: 421511 - DNA, 16 bp, M. musculus
gtcctgtgggaacaca

SEQ ID NO: 421512 - DNA, 16 bp, M. musculus
gtcctgttgacagtgt

SEQ ID NO: 421513 - DNA, 16 bp, M. musculus
gtcctgtttatgtaac

SEQ ID NO: 421514 - DNA, 16 bp, M. musculus
gtccttaaagaaaaat

SEQ ID NO: 421515 - DNA, 16 bp, M. musculus
gtccttagatgaaatg

SEQ ID NO: 421516 - DNA, 16 bp, M. musculus
gtccttagtcctatga

SEQ ID NO: 421517 - DNA, 16 bp, M. musculus
gtccttcagaagagca

SEQ ID NO: 421518 - DNA, 16 bp, M. musculus
gtccttcagccatgga

SEQ ID NO: 421519 - DNA, 16 bp, M. musculus
gtccttccacagacct

SEQ ID NO: 421520 - DNA, 16 bp, M. musculus
gtccttccatgggtat

SEQ ID NO: 421521 - DNA, 16 bp, M. musculus
gtccttccccaactct

SEQ ID NO: 421522 - DNA, 16 bp, M. musculus
gtccttccccatctct

SEQ ID NO: 421523 - DNA, 16 bp, M. musculus
gtccttcccccagctc

SEQ ID NO: 421524 - DNA, 16 bp, M. musculus
gtccttcccctaactc

SEQ ID NO: 421525 - DNA, 16 bp, M. musculus
gtccttcccctcactc

SEQ ID NO: 421526 - DNA, 16 bp, M. musculus
gtccttcctctagctc

SEQ ID NO: 421527 - DNA, 16 bp, M. musculus
gtccttcttagaagga

SEQ ID NO: 421528 - DNA, 22 bp, M. musculus
gtccttcttggcctgggtgctg

SEQ ID NO: 421529 - DNA, 16 bp, M. musculus
gtccttggaggtcaga

SEQ ID NO: 421530 - DNA, 16 bp, M. musculus
gtccttgggaactctg

SEQ ID NO: 421531 - DNA, 16 bp, M. musculus
gtccttgggcatttca

SEQ ID NO: 421532 - DNA, 24 bp, M. musculus
gtccttgggcatttcagaaattga

SEQ ID NO: 421533 - DNA, 16 bp, M. musculus
gtccttggtcctggga

SEQ ID NO: 421534 - DNA, 16 bp, M. musculus
gtccttgtgggtgtct

SEQ ID NO: 421535 - DNA, 16 bp, M. musculus
gtccttgtgtggttta

SEQ ID NO: 421536 - DNA, 16 bp, M. musculus
gtcctttcacgtgttt

SEQ ID NO: 421537 - DNA, 16 bp, M. musculus
gtcctttcagcaagca

SEQ ID NO: 421538 - DNA, 16 bp, M. musculus
gtcctttcagccaatg

SEQ ID NO: 421539 - DNA, 16 bp, M. musculus
gtcctttgcaagagca

SEQ ID NO: 421540 - DNA, 16 bp, M. musculus
gtccttttccttcacc

SEQ ID NO: 421541 - DNA, 16 bp, M. musculus
gtcctttttttaaaaa

SEQ ID NO: 421542 - DNA, 16 bp, M. musculus
gtcggccatcattgag

SEQ ID NO: 421543 - DNA, 16 bp, M. musculus
gtcgggaggcagaggc

SEQ ID NO: 421544 - DNA, 16 bp, M. musculus
gtcgtcatccatcagt

SEQ ID NO: 421545 - DNA, 16 bp, M. musculus
gtctaaaaagtgagtt

SEQ ID NO: 421546 - DNA, 16 bp, M. musculus
gtctaaaggaaatgta

SEQ ID NO: 421547 - DNA, 16 bp, M. musculus
gtctaaaggaaattca

SEQ ID NO: 421548 - DNA, 16 bp, M. musculus
gtctaattttttacaa

SEQ ID NO: 421549 - DNA, 16 bp, M. musculus
gtctacaagaaatgca

SEQ ID NO: 421550 - DNA, 16 bp, M. musculus
gtctacacagtgaatt

SEQ ID NO: 421551 - DNA, 16 bp, M. musculus
gtctacacagtgtgtt

SEQ ID NO: 421552 - DNA, 16 bp, M. musculus
gtctacagattgagtt

SEQ ID NO: 421553 - DNA, 16 bp, M. musculus
gtctacataatgagtt

SEQ ID NO: 421554 - DNA, 16 bp, M. musculus
gtctacatagcaagct

SEQ ID NO: 421555 - DNA, 16 bp, M. musculus
gtctacattcttgagt

SEQ ID NO: 421556 - DNA, 16 bp, M. musculus
gtctactccccttggg

SEQ ID NO: 421557 - DNA, 16 bp, M. musculus
gtctactgctgggcat

SEQ ID NO: 421558 - DNA, 16 bp, M. musculus
gtctacttctctgtct

SEQ ID NO: 421559 - DNA, 16 bp, M. musculus
gtctacttgtctgtca

SEQ ID NO: 421560 - DNA, 16 bp, M. musculus
gtctagcaaacacaga

SEQ ID NO: 421561 - DNA, 16 bp, M. musculus
gtctagcttgttcttt

SEQ ID NO: 421562 - DNA, 16 bp, M. musculus
gtctaggacagccagg

SEQ ID NO: 421563 - DNA, 16 bp, M. musculus
gtctagtgacaggccc

SEQ ID NO: 421564 - DNA, 16 bp, M. musculus
gtctataatcccagca

SEQ ID NO: 421565 - DNA, 16 bp, M. musculus
gtctatattcaacaaa

SEQ ID NO: 421566 - DNA, 16 bp, M. musculus
gtctatctatctatcc

SEQ ID NO: 421567 - DNA, 16 bp, M. musculus
gtctatctgtctatgt

SEQ ID NO: 421568 - DNA, 16 bp, M. musculus
gtctatgctctgcagg

SEQ ID NO: 421569 - DNA, 16 bp, M. musculus
gtctatggagcaagtt

SEQ ID NO: 421570 - DNA, 18 bp, M. musculus
gtctatgtgtgtgtgtgt

SEQ ID NO: 421571 - DNA, 16 bp, M. musculus
gtctatttggtgttct

SEQ ID NO: 421572 - DNA, 16 bp, M. musculus
gtctatttggtgtttt

SEQ ID NO: 421573 - DNA, 16 bp, M. musculus
gtctattttttaatat

SEQ ID NO: 421574 - DNA, 16 bp, M. musculus
gtctcaaaaaacaaag

SEQ ID NO: 421575 - DNA, 16 bp, M. musculus
gtctcaaaaataagat

SEQ ID NO: 421576 - DNA, 16 bp, M. musculus
gtctcaaaaattccag

SEQ ID NO: 421577 - DNA, 16 bp, M. musculus
gtctcaaaagaaaaat

SEQ ID NO: 421578 - DNA, 16 bp, M. musculus
gtctcaaaagagagag

SEQ ID NO: 421579 - DNA, 16 bp, M. musculus
gtctcaaaatacaaag

SEQ ID NO: 421580 - DNA, 16 bp, M. musculus
gtctcaacccctttgg

SEQ ID NO: 421581 - DNA, 16 bp, M. musculus
gtctcaagtagcccag

SEQ ID NO: 421582 - DNA, 16 bp, M. musculus
gtctcaatttggggca

SEQ ID NO: 421583 - DNA, 16 bp, M. musculus
gtctcactatatagcc

SEQ ID NO: 421584 - DNA, 16 bp, M. musculus
gtctcactatgcagcc

SEQ ID NO: 421585 - DNA, 16 bp, M. musculus
gtctcactatgtaacc

SEQ ID NO: 421586 - DNA, 16 bp, M. musculus
gtctcactatgtacct

SEQ ID NO: 421587 - DNA, 16 bp, M. musculus
gtctcactatgtatcc

SEQ ID NO: 421588 - DNA, 16 bp, M. musculus
gtctcactctgtagct

SEQ ID NO: 421589 - DNA, 16 bp, M. musculus
gtctcagaaagaaaga

SEQ ID NO: 421590 - DNA, 16 bp, M. musculus
gtctcagaagaaaaaa

SEQ ID NO: 421591 - DNA, 16 bp, M. musculus
gtctcagaagagagag

SEQ ID NO: 421592 - DNA, 16 bp, M. musculus
gtctcagcaattaaga

SEQ ID NO: 421593 - DNA, 16 bp, M. musculus
gtctcaggagagagag

SEQ ID NO: 421594 - DNA, 16 bp, M. musculus
gtctcaggatggcctt

SEQ ID NO: 421595 - DNA, 16 bp, M. musculus
gtctcaggcatcccag

SEQ ID NO: 421596 - DNA, 16 bp, M. musculus
gtctcaggcatttgaa

SEQ ID NO: 421597 - DNA, 16 bp, M. musculus
gtctcaggttctgcgt

SEQ ID NO: 421598 - DNA, 16 bp, M. musculus
gtctcagtattaattt

SEQ ID NO: 421599 - DNA, 16 bp, M. musculus
gtctcagtgagcccct

SEQ ID NO: 421600 - DNA, 16 bp, M. musculus
gtctcagtggagtccg

SEQ ID NO: 421601 - DNA, 16 bp, M. musculus
gtctcagtttctccat

SEQ ID NO: 421602 - DNA, 16 bp, M. musculus
gtctcagtttgcacag

SEQ ID NO: 421603 - DNA, 16 bp, M. musculus
gtctcataagctgtgg

SEQ ID NO: 421604 - DNA, 16 bp, M. musculus
gtctcatatagcccag

SEQ ID NO: 421605 - DNA, 16 bp, M. musculus
gtctcatgtagaccag

SEQ ID NO: 421606 - DNA, 16 bp, M. musculus
gtctcatgtagctcag

SEQ ID NO: 421607 - DNA, 16 bp, M. musculus
gtctcatgtgttttgc

SEQ ID NO: 421608 - DNA, 16 bp, M. musculus
gtctcattatgcagcc

SEQ ID NO: 421609 - DNA, 16 bp, M. musculus
gtctcattttttaaaa

SEQ ID NO: 421610 - DNA, 16 bp, M. musculus
gtctccaaaataaaaa

SEQ ID NO: 421611 - DNA, 16 bp, M. musculus
gtctccaaacaaacaa

SEQ ID NO: 421612 - DNA, 16 bp, M. musculus
gtctccaaccgctctt

SEQ ID NO: 421613 - DNA, 16 bp, M. musculus
gtctccaagtggatgc

SEQ ID NO: 421614 - DNA, 16 bp, M. musculus
gtctccagcatcccac

SEQ ID NO: 421615 - DNA, 16 bp, M. musculus
gtctccagttggtgga

SEQ ID NO: 421616 - DNA, 16 bp, M. musculus
gtctccatgggcacct

SEQ ID NO: 421617 - DNA, 16 bp, M. musculus
gtctcccaaacaacaa

SEQ ID NO: 421618 - DNA, 17 bp, M. musculus
gtctcccaagtctgctg

SEQ ID NO: 421619 - DNA, 16 bp, M. musculus
gtctcccaagtgctgt

SEQ ID NO: 421620 - DNA, 16 bp, M. musculus
gtctcccactggcctg

SEQ ID NO: 421621 - DNA, 16 bp, M. musculus
gtctccccaccaaaaa

SEQ ID NO: 421622 - DNA, 16 bp, M. musculus
gtctcccctccatgaa

SEQ ID NO: 421623 - DNA, 16 bp, M. musculus
gtctccctcctcctca

SEQ ID NO: 421624 - DNA, 16 bp, M. musculus
gtctccctctattatt

SEQ ID NO: 421625 - DNA, 16 bp, M. musculus
gtctccctgtgtctct

SEQ ID NO: 421626 - DNA, 16 bp, M. musculus
gtctccctttccattt

SEQ ID NO: 421627 - DNA, 16 bp, M. musculus
gtctcctcagtgctgg

SEQ ID NO: 421628 - DNA, 16 bp, M. musculus
gtctcctcccacacct

SEQ ID NO: 421629 - DNA, 16 bp, M. musculus
gtctcctcctggctgc

SEQ ID NO: 421630 - DNA, 16 bp, M. musculus
gtctcctctggggacc

SEQ ID NO: 421631 - DNA, 16 bp, M. musculus
gtctcctgaacccctg

SEQ ID NO: 421632 - DNA, 16 bp, M. musculus
gtctcctgaatgctag

SEQ ID NO: 421633 - DNA, 16 bp, M. musculus
gtctcctgagcactgg

SEQ ID NO: 421634 - DNA, 16 bp, M. musculus
gtctcctgagtgctga

SEQ ID NO: 421635 - DNA, 16 bp, M. musculus
gtctcctgcagaaggc

SEQ ID NO: 421636 - DNA, 16 bp, M. musculus
gtctcctgtagcctag

SEQ ID NO: 421637 - DNA, 16 bp, M. musculus
gtctcgaaaaacaaaa

SEQ ID NO: 421638 - DNA, 16 bp, M. musculus
gtctctacaaggatgt

SEQ ID NO: 421639 - DNA, 17 bp, M. musculus
gtctctacaaggtccat

SEQ ID NO: 421640 - DNA, 16 bp, M. musculus
gtctctataatcataa

SEQ ID NO: 421641 - DNA, 16 bp, M. musculus
gtctctatctctctct

SEQ ID NO: 421642 - DNA, 16 bp, M. musculus
gtctctcaagagacag

SEQ ID NO: 421643 - DNA, 16 bp, M. musculus
gtctctcactgaacct

SEQ ID NO: 421644 - DNA, 16 bp, M. musculus
gtctctcagagactga

SEQ ID NO: 421645 - DNA, 16 bp, M. musculus
gtctctcaggagtact

SEQ ID NO: 421646 - DNA, 16 bp, M. musculus
gtctctcattggcttg

SEQ ID NO: 421647 - DNA, 16 bp, M. musculus
gtctctccccacacct

SEQ ID NO: 421648 - DNA, 16 bp, M. musculus
gtctctcctctcattg

SEQ ID NO: 421649 - DNA, 16 bp, M. musculus
gtctctcctggctgca

SEQ ID NO: 421650 - DNA, 16 bp, M. musculus
gtctctctctgcctcc

SEQ ID NO: 421651 - DNA, 16 bp, M. musculus
gtctctctgatgatga

SEQ ID NO: 421652 - DNA, 16 bp, M. musculus
gtctctctgcctttct

SEQ ID NO: 421653 - DNA, 16 bp, M. musculus
gtctctctgcctttta

SEQ ID NO: 421654 - DNA, 16 bp, M. musculus
gtctctctgcttctct

SEQ ID NO: 421655 - DNA, 16 bp, M. musculus
gtctctctgtctctcc

SEQ ID NO: 421656 - DNA, 16 bp, M. musculus
gtctctgaagaaagta

SEQ ID NO: 421657 - DNA, 16 bp, M. musculus
gtctctgaagaaatta

SEQ ID NO: 421658 - DNA, 16 bp, M. musculus
gtctctgaagacagct

SEQ ID NO: 421659 - DNA, 16 bp, M. musculus
gtctctgagaacccca

SEQ ID NO: 421660 - DNA, 16 bp, M. musculus
gtctctgagaggcatg

SEQ ID NO: 421661 - DNA, 16 bp, M. musculus
gtctctgagggatctg

SEQ ID NO: 421662 - DNA, 16 bp, M. musculus
gtctctgagttcgagg

SEQ ID NO: 421663 - DNA, 16 bp, M. musculus
gtctctgagtttgagg

SEQ ID NO: 421664 - DNA, 16 bp, M. musculus
gtctctgcacctgctc

SEQ ID NO: 421665 - DNA, 16 bp, M. musculus
gtctctgcatcagttc

SEQ ID NO: 421666 - DNA, 16 bp, M. musculus
gtctctgcatccatct

SEQ ID NO: 421667 - DNA, 16 bp, M. musculus
gtctctgcatggtcct

SEQ ID NO: 421668 - DNA, 16 bp, M. musculus
gtctctgcatgtgtgt

SEQ ID NO: 421669 - DNA, 16 bp, M. musculus
gtctctgcctcccaac

SEQ ID NO: 421670 - DNA, 16 bp, M. musculus
gtctctgcctctcagg

SEQ ID NO: 421671 - DNA, 16 bp, M. musculus
gtctctgcctgtctgt

SEQ ID NO: 421672 - DNA, 16 bp, M. musculus
gtctctgccttctgaa

SEQ ID NO: 421673 - DNA, 16 bp, M. musculus
gtctctgctccaccct

SEQ ID NO: 421674 - DNA, 16 bp, M. musculus
gtctctgcttcccaaa

SEQ ID NO: 421675 - DNA, 16 bp, M. musculus
gtctctgcttccctgg

SEQ ID NO: 421676 - DNA, 16 bp, M. musculus
gtctctggaatatctc

SEQ ID NO: 421677 - DNA, 16 bp, M. musculus
gtctctggatgacttt

SEQ ID NO: 421678 - DNA, 16 bp, M. musculus
gtctctggatggagct

SEQ ID NO: 421679 - DNA, 16 bp, M. musculus
gtctctggctcccaag

SEQ ID NO: 421680 - DNA, 16 bp, M. musculus
gtctctgggtggtcat

SEQ ID NO: 421681 - DNA, 16 bp, M. musculus
gtctctgggtttggtg

SEQ ID NO: 421682 - DNA, 16 bp, M. musculus
gtctctggtggctgag

SEQ ID NO: 421683 - DNA, 16 bp, M. musculus
gtctctgtatctttct

SEQ ID NO: 421684 - DNA, 16 bp, M. musculus
gtctctgtctctccat

SEQ ID NO: 421685 - DNA, 16 bp, M. musculus
gtctctgtctctgtcc

SEQ ID NO: 421686 - DNA, 16 bp, M. musculus
gtctctgtctcttcct

SEQ ID NO: 421687 - DNA, 16 bp, M. musculus
gtctctgtctgtgtct

SEQ ID NO: 421688 - DNA, 16 bp, M. musculus
gtctctgtgagttcaa

SEQ ID NO: 421689 - DNA, 16 bp, M. musculus
gtctctgtgagtttga

SEQ ID NO: 421690 - DNA, 16 bp, M. musculus
gtctctgtgattctgg

SEQ ID NO: 421691 - DNA, 16 bp, M. musculus
gtctctgtgccctttg

SEQ ID NO: 421692 - DNA, 16 bp, M. musculus
gtctctgtgcctcagt

SEQ ID NO: 421693 - DNA, 16 bp, M. musculus
gtctctgtgtctatct

SEQ ID NO: 421694 - DNA, 16 bp, M. musculus
gtctctgttgagaagt

SEQ ID NO: 421695 - DNA, 16 bp, M. musculus
gtctctgtttttatgt

SEQ ID NO: 421696 - DNA, 16 bp, M. musculus
gtctcttaactgtggg

SEQ ID NO: 421697 - DNA, 16 bp, M. musculus
gtctcttcacagcaat

SEQ ID NO: 421698 - DNA, 16 bp, M. musculus
gtctcttcccttctga

SEQ ID NO: 421699 - DNA, 16 bp, M. musculus
gtctcttctcatacct

SEQ ID NO: 421700 - DNA, 16 bp, M. musculus
gtctcttgtgagttct

SEQ ID NO: 421701 - DNA, 16 bp, M. musculus
gtctctttgcctctgt

SEQ ID NO: 421702 - DNA, 16 bp, M. musculus
gtctgaaacttgctat

SEQ ID NO: 421703 - DNA, 16 bp, M. musculus
gtctgaaagcataaca

SEQ ID NO: 421704 - DNA, 16 bp, M. musculus
gtctgaagacaatgac

SEQ ID NO: 421705 - DNA, 16 bp, M. musculus
gtctgaagacacacta

SEQ ID NO: 421706 - DNA, 16 bp, M. musculus
gtctgaagacagtgat

SEQ ID NO: 421707 - DNA, 16 bp, M. musculus
gtctgaagagagcaat

SEQ ID NO: 421708 - DNA, 16 bp, M. musculus
gtctgaagcaggagga

SEQ ID NO: 421709 - DNA, 16 bp, M. musculus
gtctgaagttcttttt

SEQ ID NO: 421710 - DNA, 16 bp, M. musculus
gtctgacaaacagcag

SEQ ID NO: 421711 - DNA, 16 bp, M. musculus
gtctgacaccttcttc

SEQ ID NO: 421712 - DNA, 16 bp, M. musculus
gtctgactcttctcca

SEQ ID NO: 421713 - DNA, 16 bp, M. musculus
gtctgagacagggttt

SEQ ID NO: 421714 - DNA, 16 bp, M. musculus
gtctgagccaccaacc

SEQ ID NO: 421715 - DNA, 16 bp, M. musculus
gtctgaggaagcagca

SEQ ID NO: 421716 - DNA, 18 bp, M. musculus
gtctgaggccagcctggg

SEQ ID NO: 421717 - DNA, 16 bp, M. musculus
gtctgagtctgtgtgt

SEQ ID NO: 421718 - DNA, 16 bp, M. musculus
gtctgatagaagtctg

SEQ ID NO: 421719 - DNA, 16 bp, M. musculus
gtctgatagacctctg

SEQ ID NO: 421720 - DNA, 16 bp, M. musculus
gtctgatgacagctac

SEQ ID NO: 421721 - DNA, 16 bp, M. musculus
gtctgatgccatcttc

SEQ ID NO: 421722 - DNA, 16 bp, M. musculus
gtctgcaccaggtcct

SEQ ID NO: 421723 - DNA, 16 bp, M. musculus
gtctgcagaaaccaaa

SEQ ID NO: 421724 - DNA, 16 bp, M. musculus
gtctgcagctgatgct

SEQ ID NO: 421725 - DNA, 16 bp, M. musculus
gtctgcagctgctgag

SEQ ID NO: 421726 - DNA, 16 bp, M. musculus
gtctgcagtgtgtgtg

SEQ ID NO: 421727 - DNA, 16 bp, M. musculus
gtctgcatcctttgtc

SEQ ID NO: 421728 - DNA, 16 bp, M. musculus
gtctgcatgacctctg

SEQ ID NO: 421729 - DNA, 16 bp, M. musculus
gtctgccactgtacca

SEQ ID NO: 421730 - DNA, 17 bp, M. musculus
gtctgccattcctttag

SEQ ID NO: 421731 - DNA, 16 bp, M. musculus
gtctgccccagaagct

SEQ ID NO: 421732 - DNA, 16 bp, M. musculus
gtctgccctctgactg

SEQ ID NO: 421733 - DNA, 16 bp, M. musculus
gtctgcctgcctgcct

SEQ ID NO: 421734 - DNA, 16 bp, M. musculus
gtctgcctgtctgtca

SEQ ID NO: 421735 - DNA, 16 bp, M. musculus
gtctgcctgtgggtct

SEQ ID NO: 421736 - DNA, 16 bp, M. musculus
gtctgcctgtttgtct

SEQ ID NO: 421737 - DNA, 16 bp, M. musculus
gtctgctaacctaggt

SEQ ID NO: 421738 - DNA, 16 bp, M. musculus
gtctgctctcctgaag

SEQ ID NO: 421739 - DNA, 16 bp, M. musculus
gtctgctgcaggagga

SEQ ID NO: 421740 - DNA, 16 bp, M. musculus
gtctgctgccctcttc

SEQ ID NO: 421741 - DNA, 16 bp, M. musculus
gtctgctgctgactga

SEQ ID NO: 421742 - DNA, 16 bp, M. musculus
gtctgcttcaagaaaa

SEQ ID NO: 421743 - DNA, 16 bp, M. musculus
gtctgcttcctgccat

SEQ ID NO: 421744 - DNA, 22 bp, M. musculus
gtctggaagttagtgagaaatt

SEQ ID NO: 421745 - DNA, 16 bp, M. musculus
gtctggagagatggct

SEQ ID NO: 421746 - DNA, 16 bp, M. musculus
gtctggagcctgcctc

SEQ ID NO: 421747 - DNA, 16 bp, M. musculus
gtctggagctcagatc

SEQ ID NO: 421748 - DNA, 16 bp, M. musculus
gtctggaggcagaggc

SEQ ID NO: 421749 - DNA, 16 bp, M. musculus
gtctggaggctcctca

SEQ ID NO: 421750 - DNA, 16 bp, M. musculus
gtctggatctcagctc

SEQ ID NO: 421751 - DNA, 16 bp, M. musculus
gtctggcatcagtgag

SEQ ID NO: 421752 - DNA, 32 bp, M. musculus
gtctggcggttcctcagaaaattggacatagt

SEQ ID NO: 421753 - DNA, 16 bp, M. musculus
gtctggctgtaggtct

SEQ ID NO: 421754 - DNA, 16 bp, M. musculus
gtctggctgtctggct

SEQ ID NO: 421755 - DNA, 16 bp, M. musculus
gtctgggaaccaagat

SEQ ID NO: 421756 - DNA, 16 bp, M. musculus
gtctgggagcagtgaa

SEQ ID NO: 421757 - DNA, 16 bp, M. musculus
gtctgggatggaaatt

SEQ ID NO: 421758 - DNA, 17 bp, M. musculus
gtctgggctcacatcca

SEQ ID NO: 421759 - DNA, 16 bp, M. musculus
gtctgggtttccccca

SEQ ID NO: 421760 - DNA, 16 bp, M. musculus
gtctggtacccatgga

SEQ ID NO: 421761 - DNA, 16 bp, M. musculus
gtctggtcacagcagt

SEQ ID NO: 421762 - DNA, 16 bp, M. musculus
gtctggtctgttcaaa

SEQ ID NO: 421763 - DNA, 16 bp, M. musculus
gtctggtgctgctgtg

SEQ ID NO: 421764 - DNA, 16 bp, M. musculus
gtctggtggggtggag

SEQ ID NO: 421765 - DNA, 16 bp, M. musculus
gtctggtggttcttca

SEQ ID NO: 421766 - DNA, 16 bp, M. musculus
gtctggtgttttccat

SEQ ID NO: 421767 - DNA, 16 bp, M. musculus
gtctgtaactccagct

SEQ ID NO: 421768 - DNA, 16 bp, M. musculus
gtctgtagaacatctg

SEQ ID NO: 421769 - DNA, 16 bp, M. musculus
gtctgtatatgtctgt

SEQ ID NO: 421770 - DNA, 16 bp, M. musculus
gtctgtatctgtttct

SEQ ID NO: 421771 - DNA, 16 bp, M. musculus
gtctgtatgtttgtgt

SEQ ID NO: 421772 - DNA, 16 bp, M. musculus
gtctgtcaattcccac

SEQ ID NO: 421773 - DNA, 16 bp, M. musculus
gtctgtcattcatcca

SEQ ID NO: 421774 - DNA, 16 bp, M. musculus
gtctgtccatccatcc

SEQ ID NO: 421775 - DNA, 16 bp, M. musculus
gtctgtccatctgtct

SEQ ID NO: 421776 - DNA, 16 bp, M. musculus
gtctgtccgtccatcc

SEQ ID NO: 421777 - DNA, 16 bp, M. musculus
gtctgtccgtccgtcc

SEQ ID NO: 421778 - DNA, 16 bp, M. musculus
gtctgtccttctgtct

SEQ ID NO: 421779 - DNA, 16 bp, M. musculus
gtctgtctctcccttt

SEQ ID NO: 421780 - DNA, 16 bp, M. musculus
gtctgtctctctcaca

SEQ ID NO: 421781 - DNA, 16 bp, M. musculus
gtctgtctctctcctc

SEQ ID NO: 421782 - DNA, 16 bp, M. musculus
gtctgtctgtatttgt

SEQ ID NO: 421783 - DNA, 16 bp, M. musculus
gtctgtctgtcacccc

SEQ ID NO: 421784 - DNA, 16 bp, M. musculus
gtctgtctgtccgtcc

SEQ ID NO: 421785 - DNA, 16 bp, M. musculus
gtctgtctgtccttcc

SEQ ID NO: 421786 - DNA, 16 bp, M. musculus
gtctgtctgtcctttc

SEQ ID NO: 421787 - DNA, 16 bp, M. musculus
gtctgtctgtctctcc

SEQ ID NO: 421788 - DNA, 16 bp, M. musculus
gtctgtctgtctgtac

SEQ ID NO: 421789 - DNA, 16 bp, M. musculus
gtctgtctgtctgtcc

SEQ ID NO: 421790 - DNA, 16 bp, M. musculus
gtctgtctgtctgtgc

SEQ ID NO: 421791 - DNA, 16 bp, M. musculus
gtctgtctgtcttttc

SEQ ID NO: 421792 - DNA, 16 bp, M. musculus
gtctgtctgtgtgagt

SEQ ID NO: 421793 - DNA, 16 bp, M. musculus
gtctgtctttctctcc

SEQ ID NO: 421794 - DNA, 16 bp, M. musculus
gtctgtgacagtggac

SEQ ID NO: 421795 - DNA, 16 bp, M. musculus
gtctgtgagtatgtgt

SEQ ID NO: 421796 - DNA, 16 bp, M. musculus
gtctgtgagtctgtgt

SEQ ID NO: 421797 - DNA, 16 bp, M. musculus
gtctgtgattggacag

SEQ ID NO: 421798 - DNA, 16 bp, M. musculus
gtctgtgcatagtcca

SEQ ID NO: 421799 - DNA, 16 bp, M. musculus
gtctgtgcatgcatgt

SEQ ID NO: 421800 - DNA, 16 bp, M. musculus
gtctgtgcatggccaa

SEQ ID NO: 421801 - DNA, 16 bp, M. musculus
gtctgtgctgccacct

SEQ ID NO: 421802 - DNA, 16 bp, M. musculus
gtctgtggccctgcag

SEQ ID NO: 421803 - DNA, 16 bp, M. musculus
gtctgtggctcctggt

SEQ ID NO: 421804 - DNA, 16 bp, M. musculus
gtctgtgggttttccc

SEQ ID NO: 421805 - DNA, 16 bp, M. musculus
gtctgtggtgcctgag

SEQ ID NO: 421806 - DNA, 16 bp, M. musculus
gtctgtgtaacatctg

SEQ ID NO: 421807 - DNA, 16 bp, M. musculus
gtctgtgtctgtctga

SEQ ID NO: 421808 - DNA, 16 bp, M. musculus
gtctgtgtctgtgtcg

SEQ ID NO: 421809 - DNA, 16 bp, M. musculus
gtctgtgtgagggtat

SEQ ID NO: 421810 - DNA, 16 bp, M. musculus
gtctgtgtgcacatgt

SEQ ID NO: 421811 - DNA, 16 bp, M. musculus
gtctgtgtgccatgtg

SEQ ID NO: 421812 - DNA, 16 bp, M. musculus
gtctgtgtggtgtatg

SEQ ID NO: 421813 - DNA, 16 bp, M. musculus
gtctgtgtgtctgtga

SEQ ID NO: 421814 - DNA, 16 bp, M. musculus
gtctgtgtgtgagtct

SEQ ID NO: 421815 - DNA, 16 bp, M. musculus
gtctgtgtgtggtatg

SEQ ID NO: 421816 - DNA, 16 bp, M. musculus
gtctgtgtgtgtctgc

SEQ ID NO: 421817 - DNA, 16 bp, M. musculus
gtctgtgtgtgtgaca

SEQ ID NO: 421818 - DNA, 16 bp, M. musculus
gtctgtgtgtttgtga

SEQ ID NO: 421819 - DNA, 16 bp, M. musculus
gtctgtgtttggaggc

SEQ ID NO: 421820 - DNA, 16 bp, M. musculus
gtctgtgtttgtatat

SEQ ID NO: 421821 - DNA, 16 bp, M. musculus
gtctgtgttttttcac

SEQ ID NO: 421822 - DNA, 16 bp, M. musculus
gtctgttgagtcctat

SEQ ID NO: 421823 - DNA, 16 bp, M. musculus
gtctgtttatcatttg

SEQ ID NO: 421824 - DNA, 16 bp, M. musculus
gtctgtttgtcactca

SEQ ID NO: 421825 - DNA, 16 bp, M. musculus
gtcttaaacccacacc

SEQ ID NO: 421826 - DNA, 16 bp, M. musculus
gtcttaaagcccactc

SEQ ID NO: 421827 - DNA, 16 bp, M. musculus
gtcttaaccactaagc

SEQ ID NO: 421828 - DNA, 17 bp, M. musculus
gtcttactgtgtagccc

SEQ ID NO: 421829 - DNA, 16 bp, M. musculus
gtcttagcagtggtga

SEQ ID NO: 421830 - DNA, 16 bp, M. musculus
gtcttaggaactgaga

SEQ ID NO: 421831 - DNA, 16 bp, M. musculus
gtcttagggtttcatt

SEQ ID NO: 421832 - DNA, 16 bp, M. musculus
gtcttataaaaaaaca

SEQ ID NO: 421833 - DNA, 16 bp, M. musculus
gtcttcaaaaaaaaaa

SEQ ID NO: 421834 - DNA, 16 bp, M. musculus
gtcttcaaccctgtca

SEQ ID NO: 421835 - DNA, 16 bp, M. musculus
gtcttcacaggagcag

SEQ ID NO: 421836 - DNA, 16 bp, M. musculus
gtcttcacaggtgaga

SEQ ID NO: 421837 - DNA, 21 bp, M. musculus
gtcttcaccaccatggagaag

SEQ ID NO: 421838 - DNA, 16 bp, M. musculus
gtcttcacctatgtct

SEQ ID NO: 421839 - DNA, 16 bp, M. musculus
gtcttcactgcctccc

SEQ ID NO: 421840 - DNA, 16 bp, M. musculus
gtcttcagagactcca

SEQ ID NO: 421841 - DNA, 16 bp, M. musculus
gtcttcagaggccaga

SEQ ID NO: 421842 - DNA, 16 bp, M. musculus
gtcttcagataaagat

SEQ ID NO: 421843 - DNA, 16 bp, M. musculus
gtcttcagcaacagag

SEQ ID NO: 421844 - DNA, 16 bp, M. musculus
gtcttcagcaataaga

SEQ ID NO: 421845 - DNA, 16 bp, M. musculus
gtcttcagcaatggag

SEQ ID NO: 421846 - DNA, 16 bp, M. musculus
gtcttcagcagtgggg

SEQ ID NO: 421847 - DNA, 16 bp, M. musculus
gtcttcatcttctcca

SEQ ID NO: 421848 - DNA, 16 bp, M. musculus
gtcttcatgaagatct

SEQ ID NO: 421849 - DNA, 16 bp, M. musculus
gtcttcatgtatgtct

SEQ ID NO: 421850 - DNA, 16 bp, M. musculus
gtcttcatgtgagact

SEQ ID NO: 421851 - DNA, 16 bp, M. musculus
gtcttcattcttcatg

SEQ ID NO: 421852 - DNA, 16 bp, M. musculus
gtcttcattggtaaaa

SEQ ID NO: 421853 - DNA, 16 bp, M. musculus
gtcttcattttcattg

SEQ ID NO: 421854 - DNA, 16 bp, M. musculus
gtcttccagaagagca

SEQ ID NO: 421855 - DNA, 16 bp, M. musculus
gtcttccaggagtgct

SEQ ID NO: 421856 - DNA, 16 bp, M. musculus
gtcttccatcccctct

SEQ ID NO: 421857 - DNA, 16 bp, M. musculus
gtcttcccatggggcc

SEQ ID NO: 421858 - DNA, 16 bp, M. musculus
gtcttccccagggaag

SEQ ID NO: 421859 - DNA, 16 bp, M. musculus
gtcttcctcagggaag

SEQ ID NO: 421860 - DNA, 16 bp, M. musculus
gtcttcctcagtcact

SEQ ID NO: 421861 - DNA, 16 bp, M. musculus
gtcttcctcttcatgt

SEQ ID NO: 421862 - DNA, 16 bp, M. musculus
gtcttcctcttcattt

SEQ ID NO: 421863 - DNA, 16 bp, M. musculus
gtcttcctgctggagt

SEQ ID NO: 421864 - DNA, 16 bp, M. musculus
gtcttccttattcttg

SEQ ID NO: 421865 - DNA, 16 bp, M. musculus
gtcttctagaagaaca

SEQ ID NO: 421866 - DNA, 16 bp, M. musculus
gtcttctcactgtgtc

SEQ ID NO: 421867 - DNA, 16 bp, M. musculus
gtcttctgaaggtcct

SEQ ID NO: 421868 - DNA, 16 bp, M. musculus
gtcttctgcaagagca

SEQ ID NO: 421869 - DNA, 16 bp, M. musculus
gtcttctgctgcaact

SEQ ID NO: 421870 - DNA, 16 bp, M. musculus
gtcttctgctgtgtct

SEQ ID NO: 421871 - DNA, 16 bp, M. musculus
gtcttctggaaaagca

SEQ ID NO: 421872 - DNA, 16 bp, M. musculus
gtcttctggaagagca

SEQ ID NO: 421873 - DNA, 16 bp, M. musculus
gtcttctggacatgac

SEQ ID NO: 421874 - DNA, 16 bp, M. musculus
gtcttctgttgcccag

SEQ ID NO: 421875 - DNA, 16 bp, M. musculus
gtcttcttcctttcca

SEQ ID NO: 421876 - DNA, 16 bp, M. musculus
gtcttcttctgacctc

SEQ ID NO: 421877 - DNA, 16 bp, M. musculus
gtcttgaaaaaaaaat

SEQ ID NO: 421878 - DNA, 16 bp, M. musculus
gtcttgaaaaaccaat

SEQ ID NO: 421879 - DNA, 16 bp, M. musculus
gtcttgaaaaaccaga

SEQ ID NO: 421880 - DNA, 16 bp, M. musculus
gtcttgaacctgagga

SEQ ID NO: 421881 - DNA, 16 bp, M. musculus
gtcttgaactgtttta

SEQ ID NO: 421882 - DNA, 16 bp, M. musculus
gtcttgaataattcct

SEQ ID NO: 421883 - DNA, 16 bp, M. musculus
gtcttgctatgtggcc

SEQ ID NO: 421884 - DNA, 16 bp, M. musculus
gtcttgcttgttcctt

SEQ ID NO: 421885 - DNA, 16 bp, M. musculus
gtcttggaactctctc

SEQ ID NO: 421886 - DNA, 16 bp, M. musculus
gtcttggaggcttact

SEQ ID NO: 421887 - DNA, 16 bp, M. musculus
gtcttggattttgtca

SEQ ID NO: 421888 - DNA, 16 bp, M. musculus
gtcttggctgccctgg

SEQ ID NO: 421889 - DNA, 16 bp, M. musculus
gtcttggtcatggtgt

SEQ ID NO: 421890 - DNA, 16 bp, M. musculus
gtcttggtgtctgttc

SEQ ID NO: 421891 - DNA, 16 bp, M. musculus
gtcttgtgcatgctgt

SEQ ID NO: 421892 - DNA, 16 bp, M. musculus
gtcttgtggaagagct

SEQ ID NO: 421893 - DNA, 16 bp, M. musculus
gtctttaaagaagaaa

SEQ ID NO: 421894 - DNA, 16 bp, M. musculus
gtctttaaagagaaaa

SEQ ID NO: 421895 - DNA, 46 bp, M. musculus
gtctttacacacataaaagcacatatagttgagagaaatgctttga

SEQ ID NO: 421896 - DNA, 16 bp, M. musculus
gtctttctgagtttgg

SEQ ID NO: 421897 - DNA, 16 bp, M. musculus
gtctttgaaacctcaa

SEQ ID NO: 421898 - DNA, 16 bp, M. musculus
gtctttgaagaaagaa

SEQ ID NO: 421899 - DNA, 16 bp, M. musculus
gtctttgagtttgtgt

SEQ ID NO: 421900 - DNA, 16 bp, M. musculus
gtctttgattcacttg

SEQ ID NO: 421901 - DNA, 16 bp, M. musculus
gtctttgtaattcctt

SEQ ID NO: 421902 - DNA, 16 bp, M. musculus
gtctttgtctgtctct

SEQ ID NO: 421903 - DNA, 16 bp, M. musculus
gtctttgtctgtgtct

SEQ ID NO: 421904 - DNA, 16 bp, M. musculus
gtctttgttcctgagg

SEQ ID NO: 421905 - DNA, 16 bp, M. musculus
gtctttgtttctgtta

SEQ ID NO: 421906 - DNA, 16 bp, M. musculus
gtctttgtttttaata

SEQ ID NO: 421907 - DNA, 16 bp, M. musculus
gtcttttaaattattt

SEQ ID NO: 421908 - DNA, 16 bp, M. musculus
gtcttttagtctatgt

SEQ ID NO: 421909 - DNA, 16 bp, M. musculus
gtcttttatttgcata

SEQ ID NO: 421910 - DNA, 16 bp, M. musculus
gtcttttctttgattg

SEQ ID NO: 421911 - DNA, 16 bp, M. musculus
gtcttttgttacctta

SEQ ID NO: 421912 - DNA, 16 bp, M. musculus
gtctttttaaaattta

SEQ ID NO: 421913 - DNA, 16 bp, M. musculus
gtcttttttaaaaaat

SEQ ID NO: 421914 - DNA, 16 bp, M. musculus
gtcttttttgaaaact

SEQ ID NO: 421915 - DNA, 16 bp, M. musculus
gtcttttttgataaca

SEQ ID NO: 421916 - DNA, 16 bp, M. musculus
gtctttttttattaga

SEQ ID NO: 421917 - DNA, 16 bp, M. musculus
gtgaaaaatcttgtgt

SEQ ID NO: 421918 - DNA, 16 bp, M. musculus
gtgaaaagggagacat

SEQ ID NO: 421919 - DNA, 16 bp, M. musculus
gtgaaaatgaagccac

SEQ ID NO: 421920 - DNA, 16 bp, M. musculus
gtgaaaatgaccaaaa

SEQ ID NO: 421921 - DNA, 16 bp, M. musculus
gtgaaacctttgcatt

SEQ ID NO: 421922 - DNA, 16 bp, M. musculus
gtgaaactaacagaag

SEQ ID NO: 421923 - DNA, 16 bp, M. musculus
gtgaaactagaaaata

SEQ ID NO: 421924 - DNA, 16 bp, M. musculus
gtgaaactgaaaagct

SEQ ID NO: 421925 - DNA, 16 bp, M. musculus
gtgaaactgtctcaaa

SEQ ID NO: 421926 - DNA, 16 bp, M. musculus
gtgaaagatgtgtatg

SEQ ID NO: 421927 - DNA, 16 bp, M. musculus
gtgaaaggacctgtga

SEQ ID NO: 421928 - DNA, 16 bp, M. musculus
gtgaaaggactcatga

SEQ ID NO: 421929 - DNA, 16 bp, M. musculus
gtgaaagggttgttca

SEQ ID NO: 421930 - DNA, 16 bp, M. musculus
gtgaaagtgcagccca

SEQ ID NO: 421931 - DNA, 16 bp, M. musculus
gtgaaagtggtgtatt

SEQ ID NO: 421932 - DNA, 16 bp, M. musculus
gtgaaagttcctttgt

SEQ ID NO: 421933 - DNA, 16 bp, M. musculus
gtgaaatcttctggga

SEQ ID NO: 421934 - DNA, 16 bp, M. musculus
gtgaaatggaaggatc

SEQ ID NO: 421935 - DNA, 16 bp, M. musculus
gtgaaatggctcagag

SEQ ID NO: 421936 - DNA, 16 bp, M. musculus
gtgaaattcccaaaga

SEQ ID NO: 421937 - DNA, 16 bp, M. musculus
gtgaaattctaccttg

SEQ ID NO: 421938 - DNA, 16 bp, M. musculus
gtgaaattcttttttt

SEQ ID NO: 421939 - DNA, 16 bp, M. musculus
gtgaaatttcagagga

SEQ ID NO: 421940 - DNA, 16 bp, M. musculus
gtgaacaagacagaca

SEQ ID NO: 421941 - DNA, 16 bp, M. musculus
gtgaacagatctgtgt

SEQ ID NO: 421942 - DNA, 16 bp, M. musculus
gtgaaccccaagactg

SEQ ID NO: 421943 - DNA, 16 bp, M. musculus
gtgaacccttggagga

SEQ ID NO: 421944 - DNA, 16 bp, M. musculus
gtgaactagctggata

SEQ ID NO: 421945 - DNA, 16 bp, M. musculus
gtgaactcaggacctc

SEQ ID NO: 421946 - DNA, 16 bp, M. musculus
gtgaacttgacacaaa

SEQ ID NO: 421947 - DNA, 16 bp, M. musculus
gtgaagaaactgaggc

SEQ ID NO: 421948 - DNA, 16 bp, M. musculus
gtgaagaattcagttg

SEQ ID NO: 421949 - DNA, 16 bp, M. musculus
gtgaagaattgtgctg

SEQ ID NO: 421950 - DNA, 17 bp, M. musculus
gtgaagacagctacagt

SEQ ID NO: 421951 - DNA, 16 bp, M. musculus
gtgaagagaaaggcca

SEQ ID NO: 421952 - DNA, 16 bp, M. musculus
gtgaagagagcatgtg

SEQ ID NO: 421953 - DNA, 16 bp, M. musculus
gtgaagagaggcagaa

SEQ ID NO: 421954 - DNA, 16 bp, M. musculus
gtgaagagcccccagt

SEQ ID NO: 421955 - DNA, 16 bp, M. musculus
gtgaagagtcccagct

SEQ ID NO: 421956 - DNA, 16 bp, M. musculus
gtgaagagtgtcattt

SEQ ID NO: 421957 - DNA, 16 bp, M. musculus
gtgaagagtgtgtgtg

SEQ ID NO: 421958 - DNA, 16 bp, M. musculus
gtgaagatctgcagtt

SEQ ID NO: 421959 - DNA, 16 bp, M. musculus
gtgaagatgaagaaat

SEQ ID NO: 421960 - DNA, 16 bp, M. musculus
gtgaagcagctggata

SEQ ID NO: 421961 - DNA, 16 bp, M. musculus
gtgaagcatgtgaagc

SEQ ID NO: 421962 - DNA, 16 bp, M. musculus
gtgaagctcaagaaga

SEQ ID NO: 421963 - DNA, 16 bp, M. musculus
gtgaaggaaaaggact

SEQ ID NO: 421964 - DNA, 16 bp, M. musculus
gtgaaggaaaatgcaa

SEQ ID NO: 421965 - DNA, 16 bp, M. musculus
gtgaaggaaatgaaca

SEQ ID NO: 421966 - DNA, 16 bp, M. musculus
gtgaaggaaggaacag

SEQ ID NO: 421967 - DNA, 16 bp, M. musculus
gtgaaggagttggaga

SEQ ID NO: 421968 - DNA, 16 bp, M. musculus
gtgaaggatttggaaa

SEQ ID NO: 421969 - DNA, 16 bp, M. musculus
gtgaaggctctattcc

SEQ ID NO: 421970 - DNA, 17 bp, M. musculus
gtgaagtctgtgtggca

SEQ ID NO: 421971 - DNA, 17 bp, M. musculus
gtgaagtggaatctcag

SEQ ID NO: 421972 - DNA, 16 bp, M. musculus
gtgaataagtgaaaaa

SEQ ID NO: 421973 - DNA, 17 bp, M. musculus
gtgaatccattttgatg

SEQ ID NO: 421974 - DNA, 23 bp, M. musculus
gtgaatccattttgatggagata

SEQ ID NO: 421975 - DNA, 16 bp, M. musculus
gtgaatctttgtgagt

SEQ ID NO: 421976 - DNA, 16 bp, M. musculus
gtgaatgaaagacaca

SEQ ID NO: 421977 - DNA, 16 bp, M. musculus
gtgaatgccaggacag

SEQ ID NO: 421978 - DNA, 16 bp, M. musculus
gtgaatgtgtacatgt

SEQ ID NO: 421979 - DNA, 16 bp, M. musculus
gtgaatgtgtgtgtga

SEQ ID NO: 421980 - DNA, 16 bp, M. musculus
gtgaattcactctcgc

SEQ ID NO: 421981 - DNA, 16 bp, M. musculus
gtgaattcagggccag

SEQ ID NO: 421982 - DNA, 16 bp, M. musculus
gtgaatttgaagtcag

SEQ ID NO: 421983 - DNA, 16 bp, M. musculus
gtgaatttgaggccag

SEQ ID NO: 421984 - DNA, 16 bp, M. musculus
gtgaatttgagggcag

SEQ ID NO: 421985 - DNA, 16 bp, M. musculus
gtgaatttgcttgctt

SEQ ID NO: 421986 - DNA, 16 bp, M. musculus
gtgaatttgtttcttt

SEQ ID NO: 421987 - DNA, 16 bp, M. musculus
gtgacaaatgctttac

SEQ ID NO: 421988 - DNA, 24 bp, M. musculus
gtgacaacctgaccatgttttggg

SEQ ID NO: 421989 - DNA, 16 bp, M. musculus
gtgacaagaaagctga

SEQ ID NO: 421990 - DNA, 16 bp, M. musculus
gtgacaaggctttgac

SEQ ID NO: 421991 - DNA, 16 bp, M. musculus
gtgacaaggtcgttat

SEQ ID NO: 421992 - DNA, 16 bp, M. musculus
gtgacacagtagatca

SEQ ID NO: 421993 - DNA, 16 bp, M. musculus
gtgacacttgtgactt

SEQ ID NO: 421994 - DNA, 16 bp, M. musculus
gtgacagacaggcaga

SEQ ID NO: 421995 - DNA, 16 bp, M. musculus
gtgacagagacaggag

SEQ ID NO: 421996 - DNA, 16 bp, M. musculus
gtgacagagagagaga

SEQ ID NO: 421997 - DNA, 16 bp, M. musculus
gtgacagatgctctca

SEQ ID NO: 421998 - DNA, 16 bp, M. musculus
gtgacagcacccatgg

SEQ ID NO: 421999 - DNA, 16 bp, M. musculus
gtgacagcagaggctg

SEQ ID NO: 422000 - DNA, 16 bp, M. musculus
gtgacagcagatggtg

SEQ ID NO: 422001 - DNA, 16 bp, M. musculus
gtgacagccagaagct

SEQ ID NO: 422002 - DNA, 16 bp, M. musculus
gtgacaggagccaggg

SEQ ID NO: 422003 - DNA, 16 bp, M. musculus
gtgacaggcatcaaga

SEQ ID NO: 422004 - DNA, 16 bp, M. musculus
gtgacagggtctcact

SEQ ID NO: 422005 - DNA, 16 bp, M. musculus
gtgacagggtcttgct

SEQ ID NO: 422006 - DNA, 16 bp, M. musculus
gtgacagtttgtatat

SEQ ID NO: 422007 - DNA, 16 bp, M. musculus
gtgacatacttcctct

SEQ ID NO: 422008 - DNA, 16 bp, M. musculus
gtgacatattcataag

SEQ ID NO: 422009 - DNA, 16 bp, M. musculus
gtgacatgaaagcaga

SEQ ID NO: 422010 - DNA, 16 bp, M. musculus
gtgaccaaagcaactc

SEQ ID NO: 422011 - DNA, 16 bp, M. musculus
gtgaccaagctcctgg

SEQ ID NO: 422012 - DNA, 16 bp, M. musculus
gtgaccaagcttctgg

SEQ ID NO: 422013 - DNA, 16 bp, M. musculus
gtgaccaagggggaaa

SEQ ID NO: 422014 - DNA, 16 bp, M. musculus
gtgaccacagaggcca

SEQ ID NO: 422015 - DNA, 16 bp, M. musculus
gtgaccacagctgctg

SEQ ID NO: 422016 - DNA, 16 bp, M. musculus
gtgaccagcctggtct

SEQ ID NO: 422017 - DNA, 16 bp, M. musculus
gtgaccagctgcctta

SEQ ID NO: 422018 - DNA, 16 bp, M. musculus
gtgaccatatgtgtat

SEQ ID NO: 422019 - DNA, 16 bp, M. musculus
gtgacccaaacccttg

SEQ ID NO: 422020 - DNA, 16 bp, M. musculus
gtgacccagtgagttt

SEQ ID NO: 422021 - DNA, 16 bp, M. musculus
gtgaccccagccataa

SEQ ID NO: 422022 - DNA, 16 bp, M. musculus
gtgaccccagcttccc

SEQ ID NO: 422023 - DNA, 16 bp, M. musculus
gtgaccccataggaaa

SEQ ID NO: 422024 - DNA, 16 bp, M. musculus
gtgacccccaaccaga

SEQ ID NO: 422025 - DNA, 16 bp, M. musculus
gtgacccctgtgaaag

SEQ ID NO: 422026 - DNA, 16 bp, M. musculus
gtgaccctaaaacttc

SEQ ID NO: 422027 - DNA, 16 bp, M. musculus
gtgaccctaatctgga

SEQ ID NO: 422028 - DNA, 16 bp, M. musculus
gtgaccctcctgtctc

SEQ ID NO: 422029 - DNA, 16 bp, M. musculus
gtgaccctcggagact

SEQ ID NO: 422030 - DNA, 16 bp, M. musculus
gtgacctcaggcaagt

SEQ ID NO: 422031 - DNA, 16 bp, M. musculus
gtgacctctgaacctt

SEQ ID NO: 422032 - DNA, 16 bp, M. musculus
gtgacctctgtgaaag

SEQ ID NO: 422033 - DNA, 16 bp, M. musculus
gtgacctctgtgactt

SEQ ID NO: 422034 - DNA, 16 bp, M. musculus
gtgaccttatttggaa

SEQ ID NO: 422035 - DNA, 16 bp, M. musculus
gtgaccttgaactcct

SEQ ID NO: 422036 - DNA, 16 bp, M. musculus
gtgaccttgggcaaat

SEQ ID NO: 422037 - DNA, 16 bp, M. musculus
gtgaccttgggcaggt

SEQ ID NO: 422038 - DNA, 16 bp, M. musculus
gtgacctttgtctgga

SEQ ID NO: 422039 - DNA, 16 bp, M. musculus
gtgactaagaagagac

SEQ ID NO: 422040 - DNA, 16 bp, M. musculus
gtgactccaaaaagaa

SEQ ID NO: 422041 - DNA, 16 bp, M. musculus
gtgactccagcttcag

SEQ ID NO: 422042 - DNA, 16 bp, M. musculus
gtgactccagttctag

SEQ ID NO: 422043 - DNA, 18 bp, M. musculus
gtgactcctacagtggtt

SEQ ID NO: 422044 - DNA, 16 bp, M. musculus
gtgactcctgtgaaag

SEQ ID NO: 422045 - DNA, 16 bp, M. musculus
gtgactctagccaagc

SEQ ID NO: 422046 - DNA, 16 bp, M. musculus
gtgactctttaatata

SEQ ID NO: 422047 - DNA, 16 bp, M. musculus
gtgactgagaaagaca

SEQ ID NO: 422048 - DNA, 16 bp, M. musculus
gtgactgtaaaacaca

SEQ ID NO: 422049 - DNA, 16 bp, M. musculus
gtgactgtgggatgac

SEQ ID NO: 422050 - DNA, 16 bp, M. musculus
gtgacttactggcttg

SEQ ID NO: 422051 - DNA, 16 bp, M. musculus
gtgacttcttttgtta

SEQ ID NO: 422052 - DNA, 16 bp, M. musculus
gtgactttagatccat

SEQ ID NO: 422053 - DNA, 16 bp, M. musculus
gtgactttggctggct

SEQ ID NO: 422054 - DNA, 16 bp, M. musculus
gtgagaaaacaccatg

SEQ ID NO: 422055 - DNA, 16 bp, M. musculus
gtgagaaaccctatgt

SEQ ID NO: 422056 - DNA, 16 bp, M. musculus
gtgagaacaggcagca

SEQ ID NO: 422057 - DNA, 16 bp, M. musculus
gtgagaagcaggaagc

SEQ ID NO: 422058 - DNA, 16 bp, M. musculus
gtgagaagctggaagc

SEQ ID NO: 422059 - DNA, 16 bp, M. musculus
gtgagacactgtctca

SEQ ID NO: 422060 - DNA, 16 bp, M. musculus
gtgagacccaatctca

SEQ ID NO: 422061 - DNA, 16 bp, M. musculus
gtgagacccccatctc

SEQ ID NO: 422062 - DNA, 16 bp, M. musculus
gtgagaccctgtctga

SEQ ID NO: 422063 - DNA, 16 bp, M. musculus
gtgagacctggtctca

SEQ ID NO: 422064 - DNA, 16 bp, M. musculus
gtgagaccttgtctca

SEQ ID NO: 422065 - DNA, 16 bp, M. musculus
gtgagaccttgtcttt

SEQ ID NO: 422066 - DNA, 16 bp, M. musculus
gtgagactaggcctgg

SEQ ID NO: 422067 - DNA, 16 bp, M. musculus
gtgagactctgtctca

SEQ ID NO: 422068 - DNA, 16 bp, M. musculus
gtgagagaaagaaatg

SEQ ID NO: 422069 - DNA, 16 bp, M. musculus
gtgagagaactgggtt

SEQ ID NO: 422070 - DNA, 16 bp, M. musculus
gtgagagacagagaaa

SEQ ID NO: 422071 - DNA, 16 bp, M. musculus
gtgagagaccctgcct

SEQ ID NO: 422072 - DNA, 16 bp, M. musculus
gtgagagactcccaga

SEQ ID NO: 422073 - DNA, 16 bp, M. musculus
gtgagagagacagaga

SEQ ID NO: 422074 - DNA, 16 bp, M. musculus
gtgagagagatgaaga

SEQ ID NO: 422075 - DNA, 16 bp, M. musculus
gtgagagagccatctt

SEQ ID NO: 422076 - DNA, 16 bp, M. musculus
gtgagagatgctcagg

SEQ ID NO: 422077 - DNA, 16 bp, M. musculus
gtgagagcagaggctg

SEQ ID NO: 422078 - DNA, 16 bp, M. musculus
gtgagagcctgtctca

SEQ ID NO: 422079 - DNA, 16 bp, M. musculus
gtgagaggagaggccc

SEQ ID NO: 422080 - DNA, 18 bp, M. musculus
gtgagaggcccagggttg

SEQ ID NO: 422081 - DNA, 16 bp, M. musculus
gtgagaggccttggaa

SEQ ID NO: 422082 - DNA, 16 bp, M. musculus
gtgagaggctcccagg

SEQ ID NO: 422083 - DNA, 16 bp, M. musculus
gtgagaggttcccagg

SEQ ID NO: 422084 - DNA, 16 bp, M. musculus
gtgagagtgtgtgtga

SEQ ID NO: 422085 - DNA, 16 bp, M. musculus
gtgagataatccagac

SEQ ID NO: 422086 - DNA, 16 bp, M. musculus
gtgagatagctcagtg

SEQ ID NO: 422087 - DNA, 16 bp, M. musculus
gtgagatgactcagtg

SEQ ID NO: 422088 - DNA, 16 bp, M. musculus
gtgagatggctcaatg

SEQ ID NO: 422089 - DNA, 16 bp, M. musculus
gtgagatgttggagca

SEQ ID NO: 422090 - DNA, 16 bp, M. musculus
gtgagattctacctca

SEQ ID NO: 422091 - DNA, 16 bp, M. musculus
gtgagcacagccttga

SEQ ID NO: 422092 - DNA, 16 bp, M. musculus
gtgagcaccaggcaca

SEQ ID NO: 422093 - DNA, 16 bp, M. musculus
gtgagcactttactga

SEQ ID NO: 422094 - DNA, 24 bp, M. musculus
gtgagcagctaatcaggagctgac

SEQ ID NO: 422095 - DNA, 16 bp, M. musculus
gtgagcatccagttct

SEQ ID NO: 422096 - DNA, 16 bp, M. musculus
gtgagcatgtgtgagt

SEQ ID NO: 422097 - DNA, 16 bp, M. musculus
gtgagcatgtgtgtat

SEQ ID NO: 422098 - DNA, 16 bp, M. musculus
gtgagcatgtgtgtgc

SEQ ID NO: 422099 - DNA, 16 bp, M. musculus
gtgagccaaaagaaac

SEQ ID NO: 422100 - DNA, 16 bp, M. musculus
gtgagccaaaataagt

SEQ ID NO: 422101 - DNA, 16 bp, M. musculus
gtgagccaacatgtgg

SEQ ID NO: 422102 - DNA, 16 bp, M. musculus
gtgagccaaggggact

SEQ ID NO: 422103 - DNA, 16 bp, M. musculus
gtgagccaccactgcc

SEQ ID NO: 422104 - DNA, 16 bp, M. musculus
gtgagccaccgtgtga

SEQ ID NO: 422105 - DNA, 16 bp, M. musculus
gtgagccaccgtgtgg

SEQ ID NO: 422106 - DNA, 16 bp, M. musculus
gtgagccaccttatgg

SEQ ID NO: 422107 - DNA, 16 bp, M. musculus
gtgagccagaataaat

SEQ ID NO: 422108 - DNA, 16 bp, M. musculus
gtgagccatgtgggtg

SEQ ID NO: 422109 - DNA, 16 bp, M. musculus
gtgagccccaggtccc

SEQ ID NO: 422110 - DNA, 16 bp, M. musculus
gtgagcctgaggccag

SEQ ID NO: 422111 - DNA, 16 bp, M. musculus
gtgagccttccaattc

SEQ ID NO: 422112 - DNA, 16 bp, M. musculus
gtgagcgaccatgtgg

SEQ ID NO: 422113 - DNA, 16 bp, M. musculus
gtgagctagctggggc

SEQ ID NO: 422114 - DNA, 16 bp, M. musculus
gtgagctccaggacat

SEQ ID NO: 422115 - DNA, 16 bp, M. musculus
gtgagctccaggccaa

SEQ ID NO: 422116 - DNA, 16 bp, M. musculus
gtgagctccaggccag

SEQ ID NO: 422117 - DNA, 16 bp, M. musculus
gtgagctccatgttca

SEQ ID NO: 422118 - DNA, 16 bp, M. musculus
gtgagctctcagcttc

SEQ ID NO: 422119 - DNA, 16 bp, M. musculus
gtgagctgcagtgtgg

SEQ ID NO: 422120 - DNA, 16 bp, M. musculus
gtgagctgccatgtga

SEQ ID NO: 422121 - DNA, 16 bp, M. musculus
gtgagctgccttgtgg

SEQ ID NO: 422122 - DNA, 16 bp, M. musculus
gtgagctgggctctcc

SEQ ID NO: 422123 - DNA, 16 bp, M. musculus
gtgagctgtcttgtgg

SEQ ID NO: 422124 - DNA, 16 bp, M. musculus
gtgagcttcaggttca

SEQ ID NO: 422125 - DNA, 16 bp, M. musculus
gtgaggaaggaaaaat

SEQ ID NO: 422126 - DNA, 16 bp, M. musculus
gtgaggactcccccac

SEQ ID NO: 422127 - DNA, 16 bp, M. musculus
gtgaggagcctctcag

SEQ ID NO: 422128 - DNA, 16 bp, M. musculus
gtgaggagctggagag

SEQ ID NO: 422129 - DNA, 16 bp, M. musculus
gtgaggaggaactggg

SEQ ID NO: 422130 - DNA, 16 bp, M. musculus
gtgaggattggtggga

SEQ ID NO: 422131 - DNA, 16 bp, M. musculus
gtgaggcaatactgga

SEQ ID NO: 422132 - DNA, 16 bp, M. musculus
gtgaggcagctggtca

SEQ ID NO: 422133 - DNA, 16 bp, M. musculus
gtgaggcattttctta

SEQ ID NO: 422134 - DNA, 16 bp, M. musculus
gtgaggccttgtctca

SEQ ID NO: 422135 - DNA, 16 bp, M. musculus
gtgaggccttgttgga

SEQ ID NO: 422136 - DNA, 16 bp, M. musculus
gtgaggctctgccaat

SEQ ID NO: 422137 - DNA, 16 bp, M. musculus
gtgaggctgaggccag

SEQ ID NO: 422138 - DNA, 16 bp, M. musculus
gtgagggaatgaaact

SEQ ID NO: 422139 - DNA, 16 bp, M. musculus
gtgagggagcaccctc

SEQ ID NO: 422140 - DNA, 16 bp, M. musculus
gtgagggcagctcctc

SEQ ID NO: 422141 - DNA, 16 bp, M. musculus
gtgaggggcaggggca

SEQ ID NO: 422142 - DNA, 16 bp, M. musculus
gtgaggtaacccacac

SEQ ID NO: 422143 - DNA, 16 bp, M. musculus
gtgaggtaactcagac

SEQ ID NO: 422144 - DNA, 16 bp, M. musculus
gtgaggtacttcctcc

SEQ ID NO: 422145 - DNA, 16 bp, M. musculus
gtgaggtccaggccag

SEQ ID NO: 422146 - DNA, 16 bp, M. musculus
gtgaggttgaggccag

SEQ ID NO: 422147 - DNA, 16 bp, M. musculus
gtgagtacgtgtgtgt

SEQ ID NO: 422148 - DNA, 16 bp, M. musculus
gtgagtatttgtgtgt

SEQ ID NO: 422149 - DNA, 16 bp, M. musculus
gtgagtattttgttca

SEQ ID NO: 422150 - DNA, 16 bp, M. musculus
gtgagtcagaggccag

SEQ ID NO: 422151 - DNA, 16 bp, M. musculus
gtgagtccaaggctag

SEQ ID NO: 422152 - DNA, 16 bp, M. musculus
gtgagtctcaggccag

SEQ ID NO: 422153 - DNA, 16 bp, M. musculus
gtgagtctgaagacag

SEQ ID NO: 422154 - DNA, 16 bp, M. musculus
gtgagtctgaagccag

SEQ ID NO: 422155 - DNA, 16 bp, M. musculus
gtgagtctgaagtcag

SEQ ID NO: 422156 - DNA, 16 bp, M. musculus
gtgagtgaaaggagag

SEQ ID NO: 422157 - DNA, 16 bp, M. musculus
gtgagtgagagagaga

SEQ ID NO: 422158 - DNA, 16 bp, M. musculus
gtgagtgcatatcatt

SEQ ID NO: 422159 - DNA, 16 bp, M. musculus
gtgagtgctgagaacc

SEQ ID NO: 422160 - DNA, 16 bp, M. musculus
gtgagtgggatgtaaa

SEQ ID NO: 422161 - DNA, 16 bp, M. musculus
gtgagtgtgcctgtgt

SEQ ID NO: 422162 - DNA, 16 bp, M. musculus
gtgagtgtgtgtgtga

SEQ ID NO: 422163 - DNA, 25 bp, M. musculus
gtgagttatttaagtccttcttgat

SEQ ID NO: 422164 - DNA, 16 bp, M. musculus
gtgagttcaaatccag

SEQ ID NO: 422165 - DNA, 16 bp, M. musculus
gtgagttcaagaccag

SEQ ID NO: 422166 - DNA, 16 bp, M. musculus
gtgagttcaaggccag

SEQ ID NO: 422167 - DNA, 17 bp, M. musculus
gtgagttcaaggctagc

SEQ ID NO: 422168 - DNA, 20 bp, M. musculus
gtgagttcaaggtcagcctg

SEQ ID NO: 422169 - DNA, 16 bp, M. musculus
gtgagttcacagccag

SEQ ID NO: 422170 - DNA, 16 bp, M. musculus
gtgagttcagagttct

SEQ ID NO: 422171 - DNA, 16 bp, M. musculus
gtgagttccaagatag

SEQ ID NO: 422172 - DNA, 16 bp, M. musculus
gtgagttccaagccag

SEQ ID NO: 422173 - DNA, 19 bp, M. musculus
gtgagttccaggacagcct

SEQ ID NO: 422174 - DNA, 16 bp, M. musculus
gtgagttccaggccaa

SEQ ID NO: 422175 - DNA, 16 bp, M. musculus
gtgagttccagggcaa

SEQ ID NO: 422176 - DNA, 16 bp, M. musculus
gtgagttcctggacag

SEQ ID NO: 422177 - DNA, 16 bp, M. musculus
gtgagttcgaggacag

SEQ ID NO: 422178 - DNA, 18 bp, M. musculus
gtgagttcgaggccagcc

SEQ ID NO: 422179 - DNA, 16 bp, M. musculus
gtgagttcttttgaga

SEQ ID NO: 422180 - DNA, 16 bp, M. musculus
gtgagttggaggccag

SEQ ID NO: 422181 - DNA, 16 bp, M. musculus
gtgagtttaagaccag

SEQ ID NO: 422182 - DNA, 16 bp, M. musculus
gtgagtttcagaacag

SEQ ID NO: 422183 - DNA, 16 bp, M. musculus
gtgagtttctgtgaaa

SEQ ID NO: 422184 - DNA, 16 bp, M. musculus
gtgagtttgagaacag

SEQ ID NO: 422185 - DNA, 16 bp, M. musculus
gtgagtttgaggccag

SEQ ID NO: 422186 - DNA, 16 bp, M. musculus
gtgagtttgaggccat

SEQ ID NO: 422187 - DNA, 16 bp, M. musculus
gtgagtttgaggctaa

SEQ ID NO: 422188 - DNA, 16 bp, M. musculus
gtgataacagcagtgt

SEQ ID NO: 422189 - DNA, 18 bp, M. musculus
gtgataaccagctcttag

SEQ ID NO: 422190 - DNA, 16 bp, M. musculus
gtgatacactttctcc

SEQ ID NO: 422191 - DNA, 16 bp, M. musculus
gtgataggattaaagg

SEQ ID NO: 422192 - DNA, 16 bp, M. musculus
gtgatataagaaagca

SEQ ID NO: 422193 - DNA, 16 bp, M. musculus
gtgatatcttcagcaa

SEQ ID NO: 422194 - DNA, 16 bp, M. musculus
gtgatatttttacttt

SEQ ID NO: 422195 - DNA, 16 bp, M. musculus
gtgatcaagggggaaa

SEQ ID NO: 422196 - DNA, 16 bp, M. musculus
gtgatcaagtggggag

SEQ ID NO: 422197 - DNA, 16 bp, M. musculus
gtgatcaatgggagag

SEQ ID NO: 422198 - DNA, 16 bp, M. musculus
gtgatcagttcaatgg

SEQ ID NO: 422199 - DNA, 16 bp, M. musculus
gtgatccaattcacat

SEQ ID NO: 422200 - DNA, 16 bp, M. musculus
gtgatcccagcactca

SEQ ID NO: 422201 - DNA, 16 bp, M. musculus
gtgatctcagaaaaca

SEQ ID NO: 422202 - DNA, 16 bp, M. musculus
gtgatcttcctgcctc

SEQ ID NO: 422203 - DNA, 40 bp, M. musculus
gtgatctttccaagtccctgaccatccagccaatccattg

SEQ ID NO: 422204 - DNA, 16 bp, M. musculus
gtgatgacgatgatga

SEQ ID NO: 422205 - DNA, 16 bp, M. musculus
gtgatgagaggatttt

SEQ ID NO: 422206 - DNA, 16 bp, M. musculus
gtgatgatgacgatga

SEQ ID NO: 422207 - DNA, 17 bp, M. musculus
gtgatgatgatgatgaa

SEQ ID NO: 422208 - DNA, 16 bp, M. musculus
gtgatgccacccctgg

SEQ ID NO: 422209 - DNA, 16 bp, M. musculus
gtgatgctgatgctga

SEQ ID NO: 422210 - DNA, 16 bp, M. musculus
gtgatggaaatgaaga

SEQ ID NO: 422211 - DNA, 16 bp, M. musculus
gtgatggaaattaaca

SEQ ID NO: 422212 - DNA, 16 bp, M. musculus
gtgatggcacatgcct

SEQ ID NO: 422213 - DNA, 16 bp, M. musculus
gtgatggcaggaatgt

SEQ ID NO: 422214 - DNA, 16 bp, M. musculus
gtgatgggtgtgaacc

SEQ ID NO: 422215 - DNA, 16 bp, M. musculus
gtgatggtaaccgtcc

SEQ ID NO: 422216 - DNA, 16 bp, M. musculus
gtgatggtgataatga

SEQ ID NO: 422217 - DNA, 16 bp, M. musculus
gtgatggtggcacatg

SEQ ID NO: 422218 - DNA, 16 bp, M. musculus
gtgatggtgtacacct

SEQ ID NO: 422219 - DNA, 16 bp, M. musculus
gtgatgtacttcctct

SEQ ID NO: 422220 - DNA, 16 bp, M. musculus
gtgatgtttggaggga

SEQ ID NO: 422221 - DNA, 16 bp, M. musculus
gtgatgttttgctgga

SEQ ID NO: 422222 - DNA, 16 bp, M. musculus
gtgattaagagcactg

SEQ ID NO: 422223 - DNA, 16 bp, M. musculus
gtgattccaccacagg

SEQ ID NO: 422224 - DNA, 16 bp, M. musculus
gtgattctagatcctg

SEQ ID NO: 422225 - DNA, 16 bp, M. musculus
gtgattctcccagaag

SEQ ID NO: 422226 - DNA, 16 bp, M. musculus
gtgattctctaaaacc

SEQ ID NO: 422227 - DNA, 16 bp, M. musculus
gtgattctgccagaag

SEQ ID NO: 422228 - DNA, 16 bp, M. musculus
gtgattgaagaagaca

SEQ ID NO: 422229 - DNA, 16 bp, M. musculus
gtgattgatgggagag

SEQ ID NO: 422230 - DNA, 16 bp, M. musculus
gtgattgatgtgggaa

SEQ ID NO: 422231 - DNA, 16 bp, M. musculus
gtgattgctgggaatt

SEQ ID NO: 422232 - DNA, 16 bp, M. musculus
gtgattgttttacctc

SEQ ID NO: 422233 - DNA, 16 bp, M. musculus
gtgatttaaataatgt

SEQ ID NO: 422234 - DNA, 16 bp, M. musculus
gtgatttcattttcat

SEQ ID NO: 422235 - DNA, 16 bp, M. musculus
gtgattttactgtgtg

SEQ ID NO: 422236 - DNA, 16 bp, M. musculus
gtgattttgaggccag

SEQ ID NO: 422237 - DNA, 16 bp, M. musculus
gtgattttgccagctg

SEQ ID NO: 422238 - DNA, 16 bp, M. musculus
gtgatttttgtgtttc

SEQ ID NO: 422239 - DNA, 16 bp, M. musculus
gtgatttttttccccc

SEQ ID NO: 422240 - DNA, 16 bp, M. musculus
gtgattttttttaaag

SEQ ID NO: 422241 - DNA, 16 bp, M. musculus
gtgattttttttccct

SEQ ID NO: 422242 - DNA, 16 bp, M. musculus
gtgcaaatatctgcat

SEQ ID NO: 422243 - DNA, 16 bp, M. musculus
gtgcaaggagatagga

SEQ ID NO: 422244 - DNA, 16 bp, M. musculus
gtgcaagtgtgcatgt

SEQ ID NO: 422245 - DNA, 16 bp, M. musculus
gtgcaagtgtgtgtgt

SEQ ID NO: 422246 - DNA, 16 bp, M. musculus
gtgcaatagtgtctgc

SEQ ID NO: 422247 - DNA, 16 bp, M. musculus
gtgcaatcccaccagc

SEQ ID NO: 422248 - DNA, 16 bp, M. musculus
gtgcacacaaaataaa

SEQ ID NO: 422249 - DNA, 16 bp, M. musculus
gtgcacacacacaaac

SEQ ID NO: 422250 - DNA, 16 bp, M. musculus
gtgcacacacactcat

SEQ ID NO: 422251 - DNA, 16 bp, M. musculus
gtgcacacagaagctg

SEQ ID NO: 422252 - DNA, 16 bp, M. musculus
gtgcacacagcacaca

SEQ ID NO: 422253 - DNA, 16 bp, M. musculus
gtgcacacaggcacac

SEQ ID NO: 422254 - DNA, 16 bp, M. musculus
gtgcacacatgtacac

SEQ ID NO: 422255 - DNA, 16 bp, M. musculus
gtgcacacctacaatc

SEQ ID NO: 422256 - DNA, 16 bp, M. musculus
gtgcacagaaatacat

SEQ ID NO: 422257 - DNA, 16 bp, M. musculus
gtgcacagacagacat

SEQ ID NO: 422258 - DNA, 16 bp, M. musculus
gtgcacagagatctgg

SEQ ID NO: 422259 - DNA, 16 bp, M. musculus
gtgcacagatatctgg

SEQ ID NO: 422260 - DNA, 16 bp, M. musculus
gtgcacagcagcagtc

SEQ ID NO: 422261 - DNA, 16 bp, M. musculus
gtgcacaggggaaaaa

SEQ ID NO: 422262 - DNA, 16 bp, M. musculus
gtgcacatacatacaa

SEQ ID NO: 422263 - DNA, 16 bp, M. musculus
gtgcacatacatgtgt

SEQ ID NO: 422264 - DNA, 16 bp, M. musculus
gtgcacatatatacat

SEQ ID NO: 422265 - DNA, 16 bp, M. musculus
gtgcacatatgtgtat

SEQ ID NO: 422266 - DNA, 16 bp, M. musculus
gtgcacatccatacat

SEQ ID NO: 422267 - DNA, 16 bp, M. musculus
gtgcacatctgtaatc

SEQ ID NO: 422268 - DNA, 16 bp, M. musculus
gtgcacatgtatgtac

SEQ ID NO: 422269 - DNA, 16 bp, M. musculus
gtgcacatgtgaatgc

SEQ ID NO: 422270 - DNA, 16 bp, M. musculus
gtgcacatgtgtatac

SEQ ID NO: 422271 - DNA, 16 bp, M. musculus
gtgcacatgtgtggct

SEQ ID NO: 422272 - DNA, 16 bp, M. musculus
gtgcacatgtgtgtgg

SEQ ID NO: 422273 - DNA, 16 bp, M. musculus
gtgcaccaacactgcc

SEQ ID NO: 422274 - DNA, 16 bp, M. musculus
gtgcaccaccaatgcc

SEQ ID NO: 422275 - DNA, 16 bp, M. musculus
gtgcaccaccacaccc

SEQ ID NO: 422276 - DNA, 16 bp, M. musculus
gtgcaccaccaccacc

SEQ ID NO: 422277 - DNA, 16 bp, M. musculus
gtgcaccaccaccgcc

SEQ ID NO: 422278 - DNA, 16 bp, M. musculus
gtgcaccaccacgccc

SEQ ID NO: 422279 - DNA, 16 bp, M. musculus
gtgcaccaccactgcc

SEQ ID NO: 422280 - DNA, 16 bp, M. musculus
gtgcaccaccactgct

SEQ ID NO: 422281 - DNA, 16 bp, M. musculus
gtgcaccaccatgtcc

SEQ ID NO: 422282 - DNA, 16 bp, M. musculus
gtgcacctgaagacag

SEQ ID NO: 422283 - DNA, 16 bp, M. musculus
gtgcacgtggaggcca

SEQ ID NO: 422284 - DNA, 16 bp, M. musculus
gtgcacgtgtgtgtat

SEQ ID NO: 422285 - DNA, 16 bp, M. musculus
gtgcagaaaacagatg

SEQ ID NO: 422286 - DNA, 16 bp, M. musculus
gtgcagaagcagaaag

SEQ ID NO: 422287 - DNA, 16 bp, M. musculus
gtgcagaattatatca

SEQ ID NO: 422288 - DNA, 16 bp, M. musculus
gtgcagaattcctaga

SEQ ID NO: 422289 - DNA, 16 bp, M. musculus
gtgcagacagaaactg

SEQ ID NO: 422290 - DNA, 16 bp, M. musculus
gtgcagacctggaatt

SEQ ID NO: 422291 - DNA, 16 bp, M. musculus
gtgcagaggtcagagg

SEQ ID NO: 422292 - DNA, 16 bp, M. musculus
gtgcagatgcctgcag

SEQ ID NO: 422293 - DNA, 16 bp, M. musculus
gtgcagcaaaatgttg

SEQ ID NO: 422294 - DNA, 16 bp, M. musculus
gtgcagcaagcacttt

SEQ ID NO: 422295 - DNA, 16 bp, M. musculus
gtgcagcaccacaccc

SEQ ID NO: 422296 - DNA, 16 bp, M. musculus
gtgcagcaggccttga

SEQ ID NO: 422297 - DNA, 16 bp, M. musculus
gtgcagccactgtgga

SEQ ID NO: 422298 - DNA, 16 bp, M. musculus
gtgcagccctggctgc

SEQ ID NO: 422299 - DNA, 16 bp, M. musculus
gtgcagcctcagctgt

SEQ ID NO: 422300 - DNA, 16 bp, M. musculus
gtgcagcctcagttac

SEQ ID NO: 422301 - DNA, 16 bp, M. musculus
gtgcaggaagaactga

SEQ ID NO: 422302 - DNA, 16 bp, M. musculus
gtgcaggaagagctga

SEQ ID NO: 422303 - DNA, 17 bp, M. musculus
gtgcaggaaggacagtg

SEQ ID NO: 422304 - DNA, 16 bp, M. musculus
gtgcaggaggagatga

SEQ ID NO: 422305 - DNA, 16 bp, M. musculus
gtgcaggaggaggtga

SEQ ID NO: 422306 - DNA, 16 bp, M. musculus
gtgcaggaggggctga

SEQ ID NO: 422307 - DNA, 16 bp, M. musculus
gtgcaggcaaaatact

SEQ ID NO: 422308 - DNA, 16 bp, M. musculus
gtgcaggcacacatgc

SEQ ID NO: 422309 - DNA, 16 bp, M. musculus
gtgcaggcagagctga

SEQ ID NO: 422310 - DNA, 16 bp, M. musculus
gtgcagggaattgaac

SEQ ID NO: 422311 - DNA, 16 bp, M. musculus
gtgcagggacaaagag

SEQ ID NO: 422312 - DNA, 16 bp, M. musculus
gtgcagggactgcttc

SEQ ID NO: 422313 - DNA, 16 bp, M. musculus
gtgcaggggaatgcca

SEQ ID NO: 422314 - DNA, 16 bp, M. musculus
gtgcagggtgcagggt

SEQ ID NO: 422315 - DNA, 16 bp, M. musculus
gtgcaggtgcctgtgg

SEQ ID NO: 422316 - DNA, 16 bp, M. musculus
gtgcaggtgtccacag

SEQ ID NO: 422317 - DNA, 16 bp, M. musculus
gtgcaggtgtgtatgt

SEQ ID NO: 422318 - DNA, 16 bp, M. musculus
gtgcaggtgtgtgtgt

SEQ ID NO: 422319 - DNA, 16 bp, M. musculus
gtgcagtagagttttt

SEQ ID NO: 422320 - DNA, 16 bp, M. musculus
gtgcagtcctggctgt

SEQ ID NO: 422321 - DNA, 16 bp, M. musculus
gtgcagtgcctgagga

SEQ ID NO: 422322 - DNA, 16 bp, M. musculus
gtgcagtgctgtggag

SEQ ID NO: 422323 - DNA, 16 bp, M. musculus
gtgcagttcagttgag

SEQ ID NO: 422324 - DNA, 16 bp, M. musculus
gtgcagtttccctcct

SEQ ID NO: 422325 - DNA, 16 bp, M. musculus
gtgcataaaataaaaa

SEQ ID NO: 422326 - DNA, 16 bp, M. musculus
gtgcatatgtgtgtgg

SEQ ID NO: 422327 - DNA, 16 bp, M. musculus
gtgcatattactttta

SEQ ID NO: 422328 - DNA, 16 bp, M. musculus
gtgcatccttttgtct

SEQ ID NO: 422329 - DNA, 16 bp, M. musculus
gtgcatctaaagacag

SEQ ID NO: 422330 - DNA, 16 bp, M. musculus
gtgcatctgtctcagc

SEQ ID NO: 422331 - DNA, 16 bp, M. musculus
gtgcatcttctctaac

SEQ ID NO: 422332 - DNA, 16 bp, M. musculus
gtgcatgcagaagcca

SEQ ID NO: 422333 - DNA, 16 bp, M. musculus
gtgcatgcagtgctca

SEQ ID NO: 422334 - DNA, 16 bp, M. musculus
gtgcatgcatgcgtgc

SEQ ID NO: 422335 - DNA, 16 bp, M. musculus
gtgcatgcctgtgatc

SEQ ID NO: 422336 - DNA, 16 bp, M. musculus
gtgcatgcctttaatg

SEQ ID NO: 422337 - DNA, 16 bp, M. musculus
gtgcatgcgtgcatgc

SEQ ID NO: 422338 - DNA, 16 bp, M. musculus
gtgcatgggattattt

SEQ ID NO: 422339 - DNA, 16 bp, M. musculus
gtgcatgtagaagcca

SEQ ID NO: 422340 - DNA, 16 bp, M. musculus
gtgcatgtatgcacac

SEQ ID NO: 422341 - DNA, 16 bp, M. musculus
gtgcatgtatgtatgc

SEQ ID NO: 422342 - DNA, 16 bp, M. musculus
gtgcatgtgcatgcat

SEQ ID NO: 422343 - DNA, 16 bp, M. musculus
gtgcatgtgctgtggt

SEQ ID NO: 422344 - DNA, 16 bp, M. musculus
gtgcatgtgtatgtgt

SEQ ID NO: 422345 - DNA, 16 bp, M. musculus
gtgcatgtgtgtatgg

SEQ ID NO: 422346 - DNA, 17 bp, M. musculus
gtgcatgtgtgtatgta

SEQ ID NO: 422347 - DNA, 16 bp, M. musculus
gtgcatgtgtgtgctt

SEQ ID NO: 422348 - DNA, 16 bp, M. musculus
gtgcatgtgtgtgtgc

SEQ ID NO: 422349 - DNA, 16 bp, M. musculus
gtgcatgtgtgtgttt

SEQ ID NO: 422350 - DNA, 16 bp, M. musculus
gtgcatgtgtgtttga

SEQ ID NO: 422351 - DNA, 16 bp, M. musculus
gtgcatgtgtgtttgc

SEQ ID NO: 422352 - DNA, 16 bp, M. musculus
gtgcatttgtgtgtga

SEQ ID NO: 422353 - DNA, 16 bp, M. musculus
gtgccaaccctgggct

SEQ ID NO: 422354 - DNA, 16 bp, M. musculus
gtgccaagaagtggga

SEQ ID NO: 422355 - DNA, 16 bp, M. musculus
gtgccaagtcctccca

SEQ ID NO: 422356 - DNA, 16 bp, M. musculus
gtgccaatggaggcca

SEQ ID NO: 422357 - DNA, 16 bp, M. musculus
gtgccacagctcttca

SEQ ID NO: 422358 - DNA, 16 bp, M. musculus
gtgccaccaatgccca

SEQ ID NO: 422359 - DNA, 16 bp, M. musculus
gtgccaccacagcccg

SEQ ID NO: 422360 - DNA, 16 bp, M. musculus
gtgccaccacagctgg

SEQ ID NO: 422361 - DNA, 16 bp, M. musculus
gtgccaccacatctgg

SEQ ID NO: 422362 - DNA, 16 bp, M. musculus
gtgccaccagtgccca

SEQ ID NO: 422363 - DNA, 16 bp, M. musculus
gtgccaccatccctgg

SEQ ID NO: 422364 - DNA, 16 bp, M. musculus
gtgccaccatgcctag

SEQ ID NO: 422365 - DNA, 16 bp, M. musculus
gtgccaccatggctgg

SEQ ID NO: 422366 - DNA, 16 bp, M. musculus
gtgccacccctgcctg

SEQ ID NO: 422367 - DNA, 16 bp, M. musculus
gtgccaccgtgcctgg

SEQ ID NO: 422368 - DNA, 16 bp, M. musculus
gtgccactccctggcc

SEQ ID NO: 422369 - DNA, 16 bp, M. musculus
gtgccactggtcaggc

SEQ ID NO: 422370 - DNA, 16 bp, M. musculus
gtgccagaagagggca

SEQ ID NO: 422371 - DNA, 16 bp, M. musculus
gtgccagcaacatttg

SEQ ID NO: 422372 - DNA, 16 bp, M. musculus
gtgccaggaactgaac

SEQ ID NO: 422373 - DNA, 16 bp, M. musculus
gtgccaggattgcagg

SEQ ID NO: 422374 - DNA, 16 bp, M. musculus
gtgccaggccagccag

SEQ ID NO: 422375 - DNA, 16 bp, M. musculus
gtgccagggtagttct

SEQ ID NO: 422376 - DNA, 16 bp, M. musculus
gtgccaggtcatctcc

SEQ ID NO: 422377 - DNA, 16 bp, M. musculus
gtgccaggtgtgccag

SEQ ID NO: 422378 - DNA, 16 bp, M. musculus
gtgccagtctctagga

SEQ ID NO: 422379 - DNA, 16 bp, M. musculus
gtgccatattttctgt

SEQ ID NO: 422380 - DNA, 16 bp, M. musculus
gtgccatccctgagca

SEQ ID NO: 422381 - DNA, 16 bp, M. musculus
gtgccatccctggact

SEQ ID NO: 422382 - DNA, 16 bp, M. musculus
gtgccatctctggact

SEQ ID NO: 422383 - DNA, 16 bp, M. musculus
gtgccattccctgggc

SEQ ID NO: 422384 - DNA, 16 bp, M. musculus
gtgcccaaggtctgct

SEQ ID NO: 422385 - DNA, 16 bp, M. musculus
gtgcccacagaggcca

SEQ ID NO: 422386 - DNA, 16 bp, M. musculus
gtgcccaccacacact

SEQ ID NO: 422387 - DNA, 16 bp, M. musculus
gtgcccatgaaggtca

SEQ ID NO: 422388 - DNA, 16 bp, M. musculus
gtgccccaccaccgcc

SEQ ID NO: 422389 - DNA, 17 bp, M. musculus
gtgccccagtgctggtg

SEQ ID NO: 422390 - DNA, 16 bp, M. musculus
gtgccccctcctcata

SEQ ID NO: 422391 - DNA, 16 bp, M. musculus
gtgcccctcccccaca

SEQ ID NO: 422392 - DNA, 17 bp, M. musculus
gtgcccctccttgtctt

SEQ ID NO: 422393 - DNA, 16 bp, M. musculus
gtgccctcttctggac

SEQ ID NO: 422394 - DNA, 16 bp, M. musculus
gtgccctcttctggtg

SEQ ID NO: 422395 - DNA, 16 bp, M. musculus
gtgcccttacccactg

SEQ ID NO: 422396 - DNA, 16 bp, M. musculus
gtgcccttggaggtca

SEQ ID NO: 422397 - DNA, 16 bp, M. musculus
gtgccctttaaactga

SEQ ID NO: 422398 - DNA, 28 bp, M. musculus
gtgccgccactagatggtgctaaacctc

SEQ ID NO: 422399 - DNA, 16 bp, M. musculus
gtgccgggaactgaac

SEQ ID NO: 422400 - DNA, 16 bp, M. musculus
gtgccggtgccggtgc

SEQ ID NO: 422401 - DNA, 16 bp, M. musculus
gtgccgtgtgtgtgtg

SEQ ID NO: 422402 - DNA, 16 bp, M. musculus
gtgcctcacaaccatc

SEQ ID NO: 422403 - DNA, 16 bp, M. musculus
gtgcctctctttccaa

SEQ ID NO: 422404 - DNA, 16 bp, M. musculus
gtgcctctgccctggc

SEQ ID NO: 422405 - DNA, 16 bp, M. musculus
gtgcctgacctcaagc

SEQ ID NO: 422406 - DNA, 16 bp, M. musculus
gtgcctgagaaataca

SEQ ID NO: 422407 - DNA, 16 bp, M. musculus
gtgcctgatcctggct

SEQ ID NO: 422408 - DNA, 16 bp, M. musculus
gtgcctgcagaggctg

SEQ ID NO: 422409 - DNA, 16 bp, M. musculus
gtgcctgcagagtcca

SEQ ID NO: 422410 - DNA, 17 bp, M. musculus
gtgcctgcctggatgct

SEQ ID NO: 422411 - DNA, 16 bp, M. musculus
gtgcctgcctgtgtgt

SEQ ID NO: 422412 - DNA, 16 bp, M. musculus
gtgcctggagcgtgtg

SEQ ID NO: 422413 - DNA, 16 bp, M. musculus
gtgcctggatgctgcc

SEQ ID NO: 422414 - DNA, 16 bp, M. musculus
gtgcctgtaacctcag

SEQ ID NO: 422415 - DNA, 16 bp, M. musculus
gtgcctgtcttctttt

SEQ ID NO: 422416 - DNA, 16 bp, M. musculus
gtgcctgtgcctgtga

SEQ ID NO: 422417 - DNA, 16 bp, M. musculus
gtgcctgtgcctgtgc

SEQ ID NO: 422418 - DNA, 16 bp, M. musculus
gtgcctgtgctggtgg

SEQ ID NO: 422419 - DNA, 16 bp, M. musculus
gtgcctgtgctgtgtg

SEQ ID NO: 422420 - DNA, 16 bp, M. musculus
gtgcctgtggaggctg

SEQ ID NO: 422421 - DNA, 16 bp, M. musculus
gtgcctgtggagtcca

SEQ ID NO: 422422 - DNA, 16 bp, M. musculus
gtgcctgtgtctgtct

SEQ ID NO: 422423 - DNA, 16 bp, M. musculus
gtgcctgtgtgtgctt

SEQ ID NO: 422424 - DNA, 16 bp, M. musculus
gtgcctgtgtgtgtgc

SEQ ID NO: 422425 - DNA, 16 bp, M. musculus
gtgcctgtgtttggtg

SEQ ID NO: 422426 - DNA, 16 bp, M. musculus
gtgccttcagaggcca

SEQ ID NO: 422427 - DNA, 18 bp, M. musculus
gtgccttcaggacctgct

SEQ ID NO: 422428 - DNA, 16 bp, M. musculus
gtgccttcatttttgt

SEQ ID NO: 422429 - DNA, 16 bp, M. musculus
gtgcctttaatcccag

SEQ ID NO: 422430 - DNA, 16 bp, M. musculus
gtgcctttaattccag

SEQ ID NO: 422431 - DNA, 16 bp, M. musculus
gtgccttttgccttgc

SEQ ID NO: 422432 - DNA, 16 bp, M. musculus
gtgcgcacgcacgcac

SEQ ID NO: 422433 - DNA, 16 bp, M. musculus
gtgcgcacgcgcgcac

SEQ ID NO: 422434 - DNA, 16 bp, M. musculus
gtgcgcatacacacac

SEQ ID NO: 422435 - DNA, 16 bp, M. musculus
gtgcgcatgcgtgtgt

SEQ ID NO: 422436 - DNA, 16 bp, M. musculus
gtgcgccaccacaccc

SEQ ID NO: 422437 - DNA, 16 bp, M. musculus
gtgcgccaccacagcc

SEQ ID NO: 422438 - DNA, 16 bp, M. musculus
gtgcgccaccaccacc

SEQ ID NO: 422439 - DNA, 16 bp, M. musculus
gtgcgccaccaccgcc

SEQ ID NO: 422440 - DNA, 16 bp, M. musculus
gtgcgccaccaccgct

SEQ ID NO: 422441 - DNA, 16 bp, M. musculus
gtgcgccaccacgccc

SEQ ID NO: 422442 - DNA, 16 bp, M. musculus
gtgcgccaccacggcc

SEQ ID NO: 422443 - DNA, 16 bp, M. musculus
gtgcgccaccactgcc

SEQ ID NO: 422444 - DNA, 16 bp, M. musculus
gtgcgccaccactgct

SEQ ID NO: 422445 - DNA, 16 bp, M. musculus
gtgcgccaccactgtc

SEQ ID NO: 422446 - DNA, 16 bp, M. musculus
gtgcgccaccagtgcc

SEQ ID NO: 422447 - DNA, 16 bp, M. musculus
gtgcgccaccatgccc

SEQ ID NO: 422448 - DNA, 16 bp, M. musculus
gtgcgcgcgcacacac

SEQ ID NO: 422449 - DNA, 16 bp, M. musculus
gtgcgcgcgcgtgtgc

SEQ ID NO: 422450 - DNA, 16 bp, M. musculus
gtgcgcgcgtgcgcgc

SEQ ID NO: 422451 - DNA, 16 bp, M. musculus
gtgcgcgtgcacacac

SEQ ID NO: 422452 - DNA, 16 bp, M. musculus
gtgcgcgtgtgtgcac

SEQ ID NO: 422453 - DNA, 16 bp, M. musculus
gtgcgcgtgtgtgtgt

SEQ ID NO: 422454 - DNA, 16 bp, M. musculus
gtgcgtcaccacgccc

SEQ ID NO: 422455 - DNA, 16 bp, M. musculus
gtgcgtgcacacacat

SEQ ID NO: 422456 - DNA, 16 bp, M. musculus
gtgcgtgcatgtgcgt

SEQ ID NO: 422457 - DNA, 16 bp, M. musculus
gtgcgtgcgcacatgt

SEQ ID NO: 422458 - DNA, 16 bp, M. musculus
gtgcgtgcgtgcgcac

SEQ ID NO: 422459 - DNA, 16 bp, M. musculus
gtgcgtgcgtgcgtgc

SEQ ID NO: 422460 - DNA, 16 bp, M. musculus
gtgcgtgcgtgtgcgc

SEQ ID NO: 422461 - DNA, 21 bp, M. musculus
gtgcgtgtgcgtgtgcgtgtg

SEQ ID NO: 422462 - DNA, 16 bp, M. musculus
gtgctaatgagttcaa

SEQ ID NO: 422463 - DNA, 16 bp, M. musculus
gtgctaccacacctgg

SEQ ID NO: 422464 - DNA, 16 bp, M. musculus
gtgctaccacgcctgg

SEQ ID NO: 422465 - DNA, 16 bp, M. musculus
gtgctagaattaaagg

SEQ ID NO: 422466 - DNA, 16 bp, M. musculus
gtgctaggattaaggg

SEQ ID NO: 422467 - DNA, 16 bp, M. musculus
gtgctaggattataag

SEQ ID NO: 422468 - DNA, 16 bp, M. musculus
gtgctaggatttgaac

SEQ ID NO: 422469 - DNA, 16 bp, M. musculus
gtgctaggcaggcact

SEQ ID NO: 422470 - DNA, 16 bp, M. musculus
gtgctagggattaaac

SEQ ID NO: 422471 - DNA, 16 bp, M. musculus
gtgctagggcacctgc

SEQ ID NO: 422472 - DNA, 16 bp, M. musculus
gtgctcaataaatgtt

SEQ ID NO: 422473 - DNA, 16 bp, M. musculus
gtgctcacacacacac

SEQ ID NO: 422474 - DNA, 16 bp, M. musculus
gtgctcagaaccaaac

SEQ ID NO: 422475 - DNA, 16 bp, M. musculus
gtgctcagctcactgt

SEQ ID NO: 422476 - DNA, 16 bp, M. musculus
gtgctcagctcacttt

SEQ ID NO: 422477 - DNA, 16 bp, M. musculus
gtgctcaggaggctga

SEQ ID NO: 422478 - DNA, 16 bp, M. musculus
gtgctccaccaccacc

SEQ ID NO: 422479 - DNA, 16 bp, M. musculus
gtgctcccagccacaa

SEQ ID NO: 422480 - DNA, 16 bp, M. musculus
gtgctcccccaccacc

SEQ ID NO: 422481 - DNA, 16 bp, M. musculus
gtgctcgtctcccact

SEQ ID NO: 422482 - DNA, 22 bp, M. musculus
gtgctctcaccaggaaggtggc

SEQ ID NO: 422483 - DNA, 16 bp, M. musculus
gtgctctctctagctt

SEQ ID NO: 422484 - DNA, 16 bp, M. musculus
gtgctctgcaagaaca

SEQ ID NO: 422485 - DNA, 16 bp, M. musculus
gtgctctggctaagct

SEQ ID NO: 422486 - DNA, 16 bp, M. musculus
gtgctctgggcaggca

SEQ ID NO: 422487 - DNA, 16 bp, M. musculus
gtgctctgtccagtgg

SEQ ID NO: 422488 - DNA, 17 bp, M. musculus
gtgctcttaaccgctga

SEQ ID NO: 422489 - DNA, 33 bp, M. musculus
gtgctcttacccactgagccatctcaccagccc

SEQ ID NO: 422490 - DNA, 16 bp, M. musculus
gtgctcttgcagagga

SEQ ID NO: 422491 - DNA, 16 bp, M. musculus
gtgctcttgcatttga

SEQ ID NO: 422492 - DNA, 16 bp, M. musculus
gtgctcttggctgctg

SEQ ID NO: 422493 - DNA, 16 bp, M. musculus
gtgctcttgtgtttgg

SEQ ID NO: 422494 - DNA, 16 bp, M. musculus
gtgctgaaagatcgag

SEQ ID NO: 422495 - DNA, 16 bp, M. musculus
gtgctgaagatcaaac

SEQ ID NO: 422496 - DNA, 16 bp, M. musculus
gtgctgaagcaggagg

SEQ ID NO: 422497 - DNA, 16 bp, M. musculus
gtgctgacccccaacc

SEQ ID NO: 422498 - DNA, 16 bp, M. musculus
gtgctgagaactgaat

SEQ ID NO: 422499 - DNA, 16 bp, M. musculus
gtgctgagaactggac

SEQ ID NO: 422500 - DNA, 16 bp, M. musculus
gtgctgagaagaaagt

SEQ ID NO: 422501 - DNA, 16 bp, M. musculus
gtgctgagaagatggt

SEQ ID NO: 422502 - DNA, 16 bp, M. musculus
gtgctgagactatagg

SEQ ID NO: 422503 - DNA, 16 bp, M. musculus
gtgctgagactgcaga

SEQ ID NO: 422504 - DNA, 16 bp, M. musculus
gtgctgagataaaagg

SEQ ID NO: 422505 - DNA, 16 bp, M. musculus
gtgctgagatcacagg

SEQ ID NO: 422506 - DNA, 16 bp, M. musculus
gtgctgagattcaagg

SEQ ID NO: 422507 - DNA, 16 bp, M. musculus
gtgctgaggattgaac

SEQ ID NO: 422508 - DNA, 16 bp, M. musculus
gtgctgcagcaggtga

SEQ ID NO: 422509 - DNA, 16 bp, M. musculus
gtgctgcagccagtga

SEQ ID NO: 422510 - DNA, 16 bp, M. musculus
gtgctgcagctggtga

SEQ ID NO: 422511 - DNA, 16 bp, M. musculus
gtgctgcccaaatatt

SEQ ID NO: 422512 - DNA, 16 bp, M. musculus
gtgctgcctcagtggc

SEQ ID NO: 422513 - DNA, 16 bp, M. musculus
gtgctgcgattaaagg

SEQ ID NO: 422514 - DNA, 16 bp, M. musculus
gtgctgctcttgcaga

SEQ ID NO: 422515 - DNA, 16 bp, M. musculus
gtgctgctgctgctgg

SEQ ID NO: 422516 - DNA, 16 bp, M. musculus
gtgctgctgctggtgg

SEQ ID NO: 422517 - DNA, 16 bp, M. musculus
gtgctgctggtgctgc

SEQ ID NO: 422518 - DNA, 16 bp, M. musculus
gtgctggaaatcaaac

SEQ ID NO: 422519 - DNA, 16 bp, M. musculus
gtgctggaaatcaaat

SEQ ID NO: 422520 - DNA, 16 bp, M. musculus
gtgctggaaattgaac

SEQ ID NO: 422521 - DNA, 16 bp, M. musculus
gtgctggaagttgaac

SEQ ID NO: 422522 - DNA, 16 bp, M. musculus
gtgctggagaaggaga

SEQ ID NO: 422523 - DNA, 16 bp, M. musculus
gtgctggagagctcgc

SEQ ID NO: 422524 - DNA, 16 bp, M. musculus
gtgctggagagctggc

SEQ ID NO: 422525 - DNA, 16 bp, M. musculus
gtgctggagtcacagg

SEQ ID NO: 422526 - DNA, 16 bp, M. musculus
gtgctggagttaaagg

SEQ ID NO: 422527 - DNA, 16 bp, M. musculus
gtgctggatcccctgg

SEQ ID NO: 422528 - DNA, 16 bp, M. musculus
gtgctggatctcctgg

SEQ ID NO: 422529 - DNA, 16 bp, M. musculus
gtgctggatggttccc

SEQ ID NO: 422530 - DNA, 16 bp, M. musculus
gtgctggcagaacctc

SEQ ID NO: 422531 - DNA, 16 bp, M. musculus
gtgctggcatctccaa

SEQ ID NO: 422532 - DNA, 16 bp, M. musculus
gtgctggctaccactg

SEQ ID NO: 422533 - DNA, 16 bp, M. musculus
gtgctggctcctgagg

SEQ ID NO: 422534 - DNA, 16 bp, M. musculus
gtgctggctgaaggag

SEQ ID NO: 422535 - DNA, 18 bp, M. musculus
gtgctgggaactgaaccc

SEQ ID NO: 422536 - DNA, 16 bp, M. musculus
gtgctgggaactgaag

SEQ ID NO: 422537 - DNA, 16 bp, M. musculus
gtgctgggaatagaac

SEQ ID NO: 422538 - DNA, 16 bp, M. musculus
gtgctgggaatcaagc

SEQ ID NO: 422539 - DNA, 16 bp, M. musculus
gtgctgggaatcgaac

SEQ ID NO: 422540 - DNA, 16 bp, M. musculus
gtgctgggaatgaagg

SEQ ID NO: 422541 - DNA, 16 bp, M. musculus
gtgctgggaatggaac

SEQ ID NO: 422542 - DNA, 16 bp, M. musculus
gtgctgggaattgaat

SEQ ID NO: 422543 - DNA, 16 bp, M. musculus
gtgctgggacccaaac

SEQ ID NO: 422544 - DNA, 16 bp, M. musculus
gtgctgggactacaag

SEQ ID NO: 422545 - DNA, 16 bp, M. musculus
gtgctgggactacagg

SEQ ID NO: 422546 - DNA, 16 bp, M. musculus
gtgctgggactgcagg

SEQ ID NO: 422547 - DNA, 16 bp, M. musculus
gtgctgggactgtagg

SEQ ID NO: 422548 - DNA, 16 bp, M. musculus
gtgctgggatcacaag

SEQ ID NO: 422549 - DNA, 16 bp, M. musculus
gtgctgggatcacaga

SEQ ID NO: 422550 - DNA, 16 bp, M. musculus
gtgctgggatctgagc

SEQ ID NO: 422551 - DNA, 16 bp, M. musculus
gtgctgggatgaaaga

SEQ ID NO: 422552 - DNA, 20 bp, M. musculus
gtgctgggattaaagatgta

SEQ ID NO: 422553 - DNA, 18 bp, M. musculus
gtgctgggattaaaggta

SEQ ID NO: 422554 - DNA, 16 bp, M. musculus
gtgctgggattaaggg

SEQ ID NO: 422555 - DNA, 16 bp, M. musculus
gtgctgggattactgg

SEQ ID NO: 422556 - DNA, 16 bp, M. musculus
gtgctgggattgaagg

SEQ ID NO: 422557 - DNA, 16 bp, M. musculus
gtgctgggattgcagg

SEQ ID NO: 422558 - DNA, 16 bp, M. musculus
gtgctgggatttaagg

SEQ ID NO: 422559 - DNA, 16 bp, M. musculus
gtgctgggcactgaac

SEQ ID NO: 422560 - DNA, 16 bp, M. musculus
gtgctgggctcacagg

SEQ ID NO: 422561 - DNA, 16 bp, M. musculus
gtgctggggagacaga

SEQ ID NO: 422562 - DNA, 16 bp, M. musculus
gtgctggggatagaac

SEQ ID NO: 422563 - DNA, 16 bp, M. musculus
gtgctggggattgaac

SEQ ID NO: 422564 - DNA, 16 bp, M. musculus
gtgctggggattgaat

SEQ ID NO: 422565 - DNA, 16 bp, M. musculus
gtgctggggtgaaagg

SEQ ID NO: 422566 - DNA, 16 bp, M. musculus
gtgctggggttacaaa

SEQ ID NO: 422567 - DNA, 16 bp, M. musculus
gtgctggggttagagg

SEQ ID NO: 422568 - DNA, 16 bp, M. musculus
gtgctggtgcacgcct

SEQ ID NO: 422569 - DNA, 16 bp, M. musculus
gtgctgtatgtgtgtg

SEQ ID NO: 422570 - DNA, 16 bp, M. musculus
gtgctgtcaagctggt

SEQ ID NO: 422571 - DNA, 16 bp, M. musculus
gtgctgtcaggctgct

SEQ ID NO: 422572 - DNA, 16 bp, M. musculus
gtgctgtcagtctgct

SEQ ID NO: 422573 - DNA, 16 bp, M. musculus
gtgctgtccaggcaag

SEQ ID NO: 422574 - DNA, 16 bp, M. musculus
gtgctgtctgtctgtc

SEQ ID NO: 422575 - DNA, 16 bp, M. musculus
gtgctgtgaagagaca

SEQ ID NO: 422576 - DNA, 16 bp, M. musculus
gtgctgtgattatagg

SEQ ID NO: 422577 - DNA, 16 bp, M. musculus
gtgctgtgctgtgctg

SEQ ID NO: 422578 - DNA, 16 bp, M. musculus
gtgctgtgctgtggtg

SEQ ID NO: 422579 - DNA, 16 bp, M. musculus
gtgctgtgctgtgttg

SEQ ID NO: 422580 - DNA, 16 bp, M. musculus
gtgctgtgttccactc

SEQ ID NO: 422581 - DNA, 16 bp, M. musculus
gtgctgttctctgtct

SEQ ID NO: 422582 - DNA, 16 bp, M. musculus
gtgcttcagtctctga

SEQ ID NO: 422583 - DNA, 16 bp, M. musculus
gtgcttcctctcccac

SEQ ID NO: 422584 - DNA, 16 bp, M. musculus
gtgcttcctgctcttc

SEQ ID NO: 422585 - DNA, 16 bp, M. musculus
gtgcttctctgcaatt

SEQ ID NO: 422586 - DNA, 16 bp, M. musculus
gtgcttcttactggct

SEQ ID NO: 422587 - DNA, 16 bp, M. musculus
gtgcttcttagccatt

SEQ ID NO: 422588 - DNA, 16 bp, M. musculus
gtgcttgcctagcacg

SEQ ID NO: 422589 - DNA, 16 bp, M. musculus
gtgcttgcctagcata

SEQ ID NO: 422590 - DNA, 16 bp, M. musculus
gtgcttgcctggcaca

SEQ ID NO: 422591 - DNA, 16 bp, M. musculus
gtgcttgccttgaaag

SEQ ID NO: 422592 - DNA, 16 bp, M. musculus
gtgcttgctaggcaag

SEQ ID NO: 422593 - DNA, 16 bp, M. musculus
gtgcttgctgcccaag

SEQ ID NO: 422594 - DNA, 16 bp, M. musculus
gtgcttgcttagcatt

SEQ ID NO: 422595 - DNA, 16 bp, M. musculus
gtgcttggaactgaat

SEQ ID NO: 422596 - DNA, 16 bp, M. musculus
gtgcttggaatcaaac

SEQ ID NO: 422597 - DNA, 16 bp, M. musculus
gtgcttgtgagtgtgt

SEQ ID NO: 422598 - DNA, 16 bp, M. musculus
gtgcttgtgcacttac

SEQ ID NO: 422599 - DNA, 16 bp, M. musculus
gtgcttgtggctctct

SEQ ID NO: 422600 - DNA, 16 bp, M. musculus
gtgctttaaaaatatt

SEQ ID NO: 422601 - DNA, 16 bp, M. musculus
gtgctttcctgcagag

SEQ ID NO: 422602 - DNA, 16 bp, M. musculus
gtgctttgcctgcatg

SEQ ID NO: 422603 - DNA, 16 bp, M. musculus
gtgcttttaaaataaa

SEQ ID NO: 422604 - DNA, 16 bp, M. musculus
gtggaaaaaaacagaa

SEQ ID NO: 422605 - DNA, 16 bp, M. musculus
gtggaaaaaaggacag

SEQ ID NO: 422606 - DNA, 17 bp, M. musculus
gtggaaaaaccttaatc

SEQ ID NO: 422607 - DNA, 16 bp, M. musculus
gtggaaaactgacttc

SEQ ID NO: 422608 - DNA, 16 bp, M. musculus
gtggaaactttaggag

SEQ ID NO: 422609 - DNA, 16 bp, M. musculus
gtggaaactttctgga

SEQ ID NO: 422610 - DNA, 16 bp, M. musculus
gtggaaagccttgtgg

SEQ ID NO: 422611 - DNA, 16 bp, M. musculus
gtggaaaggcctttat

SEQ ID NO: 422612 - DNA, 16 bp, M. musculus
gtggaaagtgtccagc

SEQ ID NO: 422613 - DNA, 16 bp, M. musculus
gtggaaatagaagcaa

SEQ ID NO: 422614 - DNA, 16 bp, M. musculus
gtggaaatgaagagaa

SEQ ID NO: 422615 - DNA, 16 bp, M. musculus
gtggaacaacaatgtg

SEQ ID NO: 422616 - DNA, 17 bp, M. musculus
gtggaacaccccagtgt

SEQ ID NO: 422617 - DNA, 16 bp, M. musculus
gtggaacagtttgtgc

SEQ ID NO: 422618 - DNA, 17 bp, M. musculus
gtggaactattcctttt

SEQ ID NO: 422619 - DNA, 16 bp, M. musculus
gtggaagaacagccag

SEQ ID NO: 422620 - DNA, 16 bp, M. musculus
gtggaagacagaggac

SEQ ID NO: 422621 - DNA, 16 bp, M. musculus
gtggaagactgacatc

SEQ ID NO: 422622 - DNA, 17 bp, M. musculus
gtggaagacttcaacaa

SEQ ID NO: 422623 - DNA, 16 bp, M. musculus
gtggaagagctgagaa

SEQ ID NO: 422624 - DNA, 16 bp, M. musculus
gtggaagatatggagg

SEQ ID NO: 422625 - DNA, 16 bp, M. musculus
gtggaagcacagagcc

SEQ ID NO: 422626 - DNA, 16 bp, M. musculus
gtggaagccagaagag

SEQ ID NO: 422627 - DNA, 16 bp, M. musculus
gtggaagctattagga

SEQ ID NO: 422628 - DNA, 16 bp, M. musculus
gtggaagctgtggtgt

SEQ ID NO: 422629 - DNA, 16 bp, M. musculus
gtggaaggagagaatg

SEQ ID NO: 422630 - DNA, 16 bp, M. musculus
gtggaaggagagagcc

SEQ ID NO: 422631 - DNA, 16 bp, M. musculus
gtggaaggcacatctg

SEQ ID NO: 422632 - DNA, 16 bp, M. musculus
gtggaagtccatgatc

SEQ ID NO: 422633 - DNA, 16 bp, M. musculus
gtggaagtttctggtt

SEQ ID NO: 422634 - DNA, 16 bp, M. musculus
gtggaatatcttttgg

SEQ ID NO: 422635 - DNA, 16 bp, M. musculus
gtggaatgtgtcccca

SEQ ID NO: 422636 - DNA, 16 bp, M. musculus
gtggacacagattgtc

SEQ ID NO: 422637 - DNA, 23 bp, M. musculus
gtggacacgttctctggctgggt

SEQ ID NO: 422638 - DNA, 16 bp, M. musculus
gtggacagccttgcct

SEQ ID NO: 422639 - DNA, 16 bp, M. musculus
gtggacattagctgtt

SEQ ID NO: 422640 - DNA, 16 bp, M. musculus
gtggaccaaggacctc

SEQ ID NO: 422641 - DNA, 16 bp, M. musculus
gtggaccaccacaccc

SEQ ID NO: 422642 - DNA, 16 bp, M. musculus
gtggacctcatggcct

SEQ ID NO: 422643 - DNA, 16 bp, M. musculus
gtggacctgtttagaa

SEQ ID NO: 422644 - DNA, 16 bp, M. musculus
gtggactgcagaaaat

SEQ ID NO: 422645 - DNA, 16 bp, M. musculus
gtggactttctattgt

SEQ ID NO: 422646 - DNA, 16 bp, M. musculus
gtggagaaaaaggagc

SEQ ID NO: 422647 - DNA, 16 bp, M. musculus
gtggagaaagagaaat

SEQ ID NO: 422648 - DNA, 16 bp, M. musculus
gtggagaaaggccatt

SEQ ID NO: 422649 - DNA, 16 bp, M. musculus
gtggagaaaggggcag

SEQ ID NO: 422650 - DNA, 16 bp, M. musculus
gtggagaagaacttca

SEQ ID NO: 422651 - DNA, 16 bp, M. musculus
gtggagaagtctctgg

SEQ ID NO: 422652 - DNA, 16 bp, M. musculus
gtggagaatggaactt

SEQ ID NO: 422653 - DNA, 16 bp, M. musculus
gtggagacagaagaat

SEQ ID NO: 422654 - DNA, 16 bp, M. musculus
gtggagacaggaggaa

SEQ ID NO: 422655 - DNA, 16 bp, M. musculus
gtggagacaggggggt

SEQ ID NO: 422656 - DNA, 16 bp, M. musculus
gtggagaccagaagag

SEQ ID NO: 422657 - DNA, 16 bp, M. musculus
gtggagactctcagag

SEQ ID NO: 422658 - DNA, 16 bp, M. musculus
gtggagagaaccaact

SEQ ID NO: 422659 - DNA, 16 bp, M. musculus
gtggagagacaggaga

SEQ ID NO: 422660 - DNA, 16 bp, M. musculus
gtggagagattgtgga

SEQ ID NO: 422661 - DNA, 16 bp, M. musculus
gtggagaggaaactgg

SEQ ID NO: 422662 - DNA, 16 bp, M. musculus
gtggagagtcctctag

SEQ ID NO: 422663 - DNA, 16 bp, M. musculus
gtggagagtcttctgg

SEQ ID NO: 422664 - DNA, 16 bp, M. musculus
gtggagatcctgcagc

SEQ ID NO: 422665 - DNA, 16 bp, M. musculus
gtggagcaagatgagg

SEQ ID NO: 422666 - DNA, 16 bp, M. musculus
gtggagcagtctctgg

SEQ ID NO: 422667 - DNA, 16 bp, M. musculus
gtggagcagttggagg

SEQ ID NO: 422668 - DNA, 16 bp, M. musculus
gtggagcatgtgtcca

SEQ ID NO: 422669 - DNA, 16 bp, M. musculus
gtggagccacctgctg

SEQ ID NO: 422670 - DNA, 25 bp, M. musculus
gtggagcctataccatccttgcccc

SEQ ID NO: 422671 - DNA, 16 bp, M. musculus
gtggagcgagatgagg

SEQ ID NO: 422672 - DNA, 16 bp, M. musculus
gtggagcggaagggac

SEQ ID NO: 422673 - DNA, 16 bp, M. musculus
gtggagctccacagaa

SEQ ID NO: 422674 - DNA, 16 bp, M. musculus
gtggagctggccctgg

SEQ ID NO: 422675 - DNA, 16 bp, M. musculus
gtggaggacaagaaag

SEQ ID NO: 422676 - DNA, 16 bp, M. musculus
gtggaggacagaggtc

SEQ ID NO: 422677 - DNA, 16 bp, M. musculus
gtggaggcaagaggat

SEQ ID NO: 422678 - DNA, 16 bp, M. musculus
gtggaggcaggaagat

SEQ ID NO: 422679 - DNA, 16 bp, M. musculus
gtggaggcaggaggat

SEQ ID NO: 422680 - DNA, 16 bp, M. musculus
gtggaggcaggggaat

SEQ ID NO: 422681 - DNA, 16 bp, M. musculus
gtggaggcaggggcat

SEQ ID NO: 422682 - DNA, 16 bp, M. musculus
gtggaggccagaaggt

SEQ ID NO: 422683 - DNA, 16 bp, M. musculus
gtggaggccagaagtc

SEQ ID NO: 422684 - DNA, 16 bp, M. musculus
gtggaggccagagggt

SEQ ID NO: 422685 - DNA, 16 bp, M. musculus
gtggaggccagcctgg

SEQ ID NO: 422686 - DNA, 16 bp, M. musculus
gtggaggcctggctgt

SEQ ID NO: 422687 - DNA, 16 bp, M. musculus
gtggaggctagaagag

SEQ ID NO: 422688 - DNA, 16 bp, M. musculus
gtggaggctggaagag

SEQ ID NO: 422689 - DNA, 16 bp, M. musculus
gtggaggctggagaga

SEQ ID NO: 422690 - DNA, 16 bp, M. musculus
gtggaggctgtgtgtg

SEQ ID NO: 422691 - DNA, 16 bp, M. musculus
gtggagggcagaggag

SEQ ID NO: 422692 - DNA, 16 bp, M. musculus
gtggaggtcagagaaa

SEQ ID NO: 422693 - DNA, 16 bp, M. musculus
gtggaggtgacagtga

SEQ ID NO: 422694 - DNA, 16 bp, M. musculus
gtggaggtgcacacct

SEQ ID NO: 422695 - DNA, 16 bp, M. musculus
gtggaggtggaggcag

SEQ ID NO: 422696 - DNA, 16 bp, M. musculus
gtggaggttggaggac

SEQ ID NO: 422697 - DNA, 16 bp, M. musculus
gtggaggtttttgatc

SEQ ID NO: 422698 - DNA, 16 bp, M. musculus
gtggagtactgctcct

SEQ ID NO: 422699 - DNA, 16 bp, M. musculus
gtggagtatgtgtcct

SEQ ID NO: 422700 - DNA, 16 bp, M. musculus
gtggagtattgctgtg

SEQ ID NO: 422701 - DNA, 16 bp, M. musculus
gtggagtcagaggaca

SEQ ID NO: 422702 - DNA, 16 bp, M. musculus
gtggagtggagccagc

SEQ ID NO: 422703 - DNA, 16 bp, M. musculus
gtggagttcctattcc

SEQ ID NO: 422704 - DNA, 16 bp, M. musculus
gtggataaggatagac

SEQ ID NO: 422705 - DNA, 16 bp, M. musculus
gtggatacattcaagg

SEQ ID NO: 422706 - DNA, 17 bp, M. musculus
gtggatcaatctgagct

SEQ ID NO: 422707 - DNA, 16 bp, M. musculus
gtggatcaggatgtaa

SEQ ID NO: 422708 - DNA, 16 bp, M. musculus
gtggatcctgaacaac

SEQ ID NO: 422709 - DNA, 16 bp, M. musculus
gtggatcgagctgctg

SEQ ID NO: 422710 - DNA, 17 bp, M. musculus
gtggatctctgagttcc

SEQ ID NO: 422711 - DNA, 16 bp, M. musculus
gtggatctctgtgagc

SEQ ID NO: 422712 - DNA, 16 bp, M. musculus
gtggatctgaatgtaa

SEQ ID NO: 422713 - DNA, 16 bp, M. musculus
gtggatctggggaaga

SEQ ID NO: 422714 - DNA, 16 bp, M. musculus
gtggatgacaagaagt

SEQ ID NO: 422715 - DNA, 16 bp, M. musculus
gtggatgagttgggga

SEQ ID NO: 422716 - DNA, 16 bp, M. musculus
gtggatgccaacaaaa

SEQ ID NO: 422717 - DNA, 16 bp, M. musculus
gtggatgccaagaagc

SEQ ID NO: 422718 - DNA, 16 bp, M. musculus
gtggatgccagcaaga

SEQ ID NO: 422719 - DNA, 16 bp, M. musculus
gtggatgctgaggagg

SEQ ID NO: 422720 - DNA, 16 bp, M. musculus
gtggatgctggagatt

SEQ ID NO: 422721 - DNA, 16 bp, M. musculus
gtggatggcacctgag

SEQ ID NO: 422722 - DNA, 16 bp, M. musculus
gtggatggccctcctg

SEQ ID NO: 422723 - DNA, 16 bp, M. musculus
gtggatgggggagcat

SEQ ID NO: 422724 - DNA, 16 bp, M. musculus
gtggatgtccctggtc

SEQ ID NO: 422725 - DNA, 16 bp, M. musculus
gtggatgtctgtgtgt

SEQ ID NO: 422726 - DNA, 16 bp, M. musculus
gtggatgtgtctgtgt

SEQ ID NO: 422727 - DNA, 16 bp, M. musculus
gtggatgtgtgtgtgc

SEQ ID NO: 422728 - DNA, 16 bp, M. musculus
gtggattccaagaagt

SEQ ID NO: 422729 - DNA, 16 bp, M. musculus
gtggattctgaggatc

SEQ ID NO: 422730 - DNA, 16 bp, M. musculus
gtggatttggagaaac

SEQ ID NO: 422731 - DNA, 16 bp, M. musculus
gtggattttccctttg

SEQ ID NO: 422732 - DNA, 16 bp, M. musculus
gtggcaaacatttcaa

SEQ ID NO: 422733 - DNA, 16 bp, M. musculus
gtggcaacaaaataat

SEQ ID NO: 422734 - DNA, 16 bp, M. musculus
gtggcaagcattttac

SEQ ID NO: 422735 - DNA, 16 bp, M. musculus
gtggcaagtactttta

SEQ ID NO: 422736 - DNA, 16 bp, M. musculus
gtggcacaggcctgtg

SEQ ID NO: 422737 - DNA, 16 bp, M. musculus
gtggcacaggcctttg

SEQ ID NO: 422738 - DNA, 16 bp, M. musculus
gtggcacagtctctgg

SEQ ID NO: 422739 - DNA, 16 bp, M. musculus
gtggcacatatcttta

SEQ ID NO: 422740 - DNA, 16 bp, M. musculus
gtggcacatgcctgtg

SEQ ID NO: 422741 - DNA, 16 bp, M. musculus
gtggcaccacacccag

SEQ ID NO: 422742 - DNA, 16 bp, M. musculus
gtggcactgcccacag

SEQ ID NO: 422743 - DNA, 16 bp, M. musculus
gtggcactgttgggag

SEQ ID NO: 422744 - DNA, 16 bp, M. musculus
gtggcactgtttgggg

SEQ ID NO: 422745 - DNA, 16 bp, M. musculus
gtggcagaaagagaag

SEQ ID NO: 422746 - DNA, 16 bp, M. musculus
gtggcagaacaggtct

SEQ ID NO: 422747 - DNA, 16 bp, M. musculus
gtggcagaatgcttgc

SEQ ID NO: 422748 - DNA, 16 bp, M. musculus
gtggcagacaaagtga

SEQ ID NO: 422749 - DNA, 16 bp, M. musculus
gtggcagagaggagaa

SEQ ID NO: 422750 - DNA, 16 bp, M. musculus
gtggcagcagttacca

SEQ ID NO: 422751 - DNA, 16 bp, M. musculus
gtggcagctcacagcc

SEQ ID NO: 422752 - DNA, 16 bp, M. musculus
gtggcagctgagatct

SEQ ID NO: 422753 - DNA, 16 bp, M. musculus
gtggcagctgtggcag

SEQ ID NO: 422754 - DNA, 16 bp, M. musculus
gtggcaggagcaggag

SEQ ID NO: 422755 - DNA, 16 bp, M. musculus
gtggcagggctggcca

SEQ ID NO: 422756 - DNA, 16 bp, M. musculus
gtggcagtacagacca

SEQ ID NO: 422757 - DNA, 16 bp, M. musculus
gtggcagtgatggtgg

SEQ ID NO: 422758 - DNA, 16 bp, M. musculus
gtggcagtggcagcag

SEQ ID NO: 422759 - DNA, 16 bp, M. musculus
gtggcagttcctcaga

SEQ ID NO: 422760 - DNA, 16 bp, M. musculus
gtggcatacacctata

SEQ ID NO: 422761 - DNA, 16 bp, M. musculus
gtggcatacatcttta

SEQ ID NO: 422762 - DNA, 16 bp, M. musculus
gtggcatgcttcctcc

SEQ ID NO: 422763 - DNA, 16 bp, M. musculus
gtggcatgtacacaca

SEQ ID NO: 422764 - DNA, 16 bp, M. musculus
gtggccaaagctgcca

SEQ ID NO: 422765 - DNA, 16 bp, M. musculus
gtggccagacaaggca

SEQ ID NO: 422766 - DNA, 16 bp, M. musculus
gtggccagccctggca

SEQ ID NO: 422767 - DNA, 16 bp, M. musculus
gtggccagcgccatgg

SEQ ID NO: 422768 - DNA, 18 bp, M. musculus
gtggccagtggtagccag

SEQ ID NO: 422769 - DNA, 16 bp, M. musculus
gtggccatggctgccc

SEQ ID NO: 422770 - DNA, 16 bp, M. musculus
gtggccatggtggcag

SEQ ID NO: 422771 - DNA, 16 bp, M. musculus
gtggccccatccccca

SEQ ID NO: 422772 - DNA, 16 bp, M. musculus
gtggccccatccctca

SEQ ID NO: 422773 - DNA, 16 bp, M. musculus
gtggccctgctggagt

SEQ ID NO: 422774 - DNA, 16 bp, M. musculus
gtggcctctctctctc

SEQ ID NO: 422775 - DNA, 16 bp, M. musculus
gtggccttggtggagt

SEQ ID NO: 422776 - DNA, 16 bp, M. musculus
gtggccttgttggtgt

SEQ ID NO: 422777 - DNA, 16 bp, M. musculus
gtggcctttctctgca

SEQ ID NO: 422778 - DNA, 16 bp, M. musculus
gtggcctttttctaca

SEQ ID NO: 422779 - DNA, 17 bp, M. musculus
gtggcctttttgactta

SEQ ID NO: 422780 - DNA, 16 bp, M. musculus
gtggctaagagcactt

SEQ ID NO: 422781 - DNA, 16 bp, M. musculus
gtggctaatggcagcc

SEQ ID NO: 422782 - DNA, 16 bp, M. musculus
gtggctatggctgtgg

SEQ ID NO: 422783 - DNA, 16 bp, M. musculus
gtggctattcagccca

SEQ ID NO: 422784 - DNA, 16 bp, M. musculus
gtggctattgtaaagg

SEQ ID NO: 422785 - DNA, 36 bp, M. musculus
gtggctcaagtagaggccttgaatagacactgcatg

SEQ ID NO: 422786 - DNA, 32 bp, M. musculus
gtggctcacaaccacccgtaatgagatctgac

SEQ ID NO: 422787 - DNA, 16 bp, M. musculus
gtggctcacaaccata

SEQ ID NO: 422788 - DNA, 17 bp, M. musculus
gtggctcacaaccatca

SEQ ID NO: 422789 - DNA, 25 bp, M. musculus
gtggctcacaaccatctgcaatgga

SEQ ID NO: 422790 - DNA, 16 bp, M. musculus
gtggctcacaaccccc

SEQ ID NO: 422791 - DNA, 16 bp, M. musculus
gtggctcacaagcacc

SEQ ID NO: 422792 - DNA, 16 bp, M. musculus
gtggctcacaagtgtc

SEQ ID NO: 422793 - DNA, 16 bp, M. musculus
gtggctcacacccacc

SEQ ID NO: 422794 - DNA, 16 bp, M. musculus
gtggctcacagccacc

SEQ ID NO: 422795 - DNA, 16 bp, M. musculus
gtggctcacagccatc

SEQ ID NO: 422796 - DNA, 16 bp, M. musculus
gtggctcacagcctcc

SEQ ID NO: 422797 - DNA, 16 bp, M. musculus
gtggctcacatgtctg

SEQ ID NO: 422798 - DNA, 16 bp, M. musculus
gtggctcaccaccacc

SEQ ID NO: 422799 - DNA, 16 bp, M. musculus
gtggctcagcaggtaa

SEQ ID NO: 422800 - DNA, 16 bp, M. musculus
gtggctcagtagtaga

SEQ ID NO: 422801 - DNA, 16 bp, M. musculus
gtggctcagtgataga

SEQ ID NO: 422802 - DNA, 16 bp, M. musculus
gtggctcataaacatc

SEQ ID NO: 422803 - DNA, 16 bp, M. musculus
gtggctcatgccttta

SEQ ID NO: 422804 - DNA, 16 bp, M. musculus
gtggctcatgcttata

SEQ ID NO: 422805 - DNA, 16 bp, M. musculus
gtggctccacccacaa

SEQ ID NO: 422806 - DNA, 16 bp, M. musculus
gtggctcctcagaaaa

SEQ ID NO: 422807 - DNA, 16 bp, M. musculus
gtggctcctgcctgac

SEQ ID NO: 422808 - DNA, 16 bp, M. musculus
gtggctcctgcctgtc

SEQ ID NO: 422809 - DNA, 16 bp, M. musculus
gtggctctcctcagtc

SEQ ID NO: 422810 - DNA, 16 bp, M. musculus
gtggctctgtgcttct

SEQ ID NO: 422811 - DNA, 16 bp, M. musculus
gtggctcttcacagca

SEQ ID NO: 422812 - DNA, 16 bp, M. musculus
gtggctgaagctgcca

SEQ ID NO: 422813 - DNA, 16 bp, M. musculus
gtggctgagtcagcaa

SEQ ID NO: 422814 - DNA, 16 bp, M. musculus
gtggctgctggggcag

SEQ ID NO: 422815 - DNA, 16 bp, M. musculus
gtggctgctgtggctg

SEQ ID NO: 422816 - DNA, 16 bp, M. musculus
gtggctgcttctgata

SEQ ID NO: 422817 - DNA, 16 bp, M. musculus
gtggctggagcacagg

SEQ ID NO: 422818 - DNA, 16 bp, M. musculus
gtggctggagccctgg

SEQ ID NO: 422819 - DNA, 16 bp, M. musculus
gtggctggatacaaga

SEQ ID NO: 422820 - DNA, 16 bp, M. musculus
gtggctgggaaggaga

SEQ ID NO: 422821 - DNA, 16 bp, M. musculus
gtggctgggagtgcag

SEQ ID NO: 422822 - DNA, 16 bp, M. musculus
gtggctggggttcatt

SEQ ID NO: 422823 - DNA, 16 bp, M. musculus
gtggctgtcttcttct

SEQ ID NO: 422824 - DNA, 16 bp, M. musculus
gtggctgtgaacaagg

SEQ ID NO: 422825 - DNA, 16 bp, M. musculus
gtggctgtggctatgg

SEQ ID NO: 422826 - DNA, 16 bp, M. musculus
gtggctgtggctgcgg

SEQ ID NO: 422827 - DNA, 16 bp, M. musculus
gtggctgtggctgtga

SEQ ID NO: 422828 - DNA, 16 bp, M. musculus
gtggctgtggctgtgt

SEQ ID NO: 422829 - DNA, 16 bp, M. musculus
gtggcttcagagaatg

SEQ ID NO: 422830 - DNA, 16 bp, M. musculus
gtggcttcccacaatg

SEQ ID NO: 422831 - DNA, 16 bp, M. musculus
gtggcttcccacacct

SEQ ID NO: 422832 - DNA, 16 bp, M. musculus
gtggcttcccttgtat

SEQ ID NO: 422833 - DNA, 16 bp, M. musculus
gtggcttctgcttcag

SEQ ID NO: 422834 - DNA, 16 bp, M. musculus
gtggcttgtgccttta

SEQ ID NO: 422835 - DNA, 16 bp, M. musculus
gtggctttaatcccag

SEQ ID NO: 422836 - DNA, 16 bp, M. musculus
gtggctttaggtctga

SEQ ID NO: 422837 - DNA, 16 bp, M. musculus
gtggctttatgtgctt

SEQ ID NO: 422838 - DNA, 17 bp, M. musculus
gtggctttgtctgctaa

SEQ ID NO: 422839 - DNA, 16 bp, M. musculus
gtggctttgttagagg

SEQ ID NO: 422840 - DNA, 16 bp, M. musculus
gtgggaaacttcaaca

SEQ ID NO: 422841 - DNA, 16 bp, M. musculus
gtgggaaaggatgtgt

SEQ ID NO: 422842 - DNA, 16 bp, M. musculus
gtgggaaagtctctgg

SEQ ID NO: 422843 - DNA, 16 bp, M. musculus
gtgggaacaaaacatc

SEQ ID NO: 422844 - DNA, 16 bp, M. musculus
gtgggaacacacacac

SEQ ID NO: 422845 - DNA, 16 bp, M. musculus
gtgggaagagggaact

SEQ ID NO: 422846 - DNA, 16 bp, M. musculus
gtgggaagatccacct

SEQ ID NO: 422847 - DNA, 16 bp, M. musculus
gtgggaaggatctggg

SEQ ID NO: 422848 - DNA, 16 bp, M. musculus
gtgggaccatccactg

SEQ ID NO: 422849 - DNA, 16 bp, M. musculus
gtgggaccatctctga

SEQ ID NO: 422850 - DNA, 16 bp, M. musculus
gtgggacgcgcacagc

SEQ ID NO: 422851 - DNA, 16 bp, M. musculus
gtgggactcctggctc

SEQ ID NO: 422852 - DNA, 16 bp, M. musculus
gtgggactgagcaact

SEQ ID NO: 422853 - DNA, 16 bp, M. musculus
gtgggagaaatagttt

SEQ ID NO: 422854 - DNA, 16 bp, M. musculus
gtgggagaagatgagc

SEQ ID NO: 422855 - DNA, 16 bp, M. musculus
gtgggagacttcaact

SEQ ID NO: 422856 - DNA, 16 bp, M. musculus
gtgggagagaggacag

SEQ ID NO: 422857 - DNA, 16 bp, M. musculus
gtgggagaggggacag

SEQ ID NO: 422858 - DNA, 16 bp, M. musculus
gtgggagcagaggctg

SEQ ID NO: 422859 - DNA, 16 bp, M. musculus
gtgggaggaggtgacc

SEQ ID NO: 422860 - DNA, 16 bp, M. musculus
gtgggagggaaggccc

SEQ ID NO: 422861 - DNA, 16 bp, M. musculus
gtgggaggggagaccc

SEQ ID NO: 422862 - DNA, 16 bp, M. musculus
gtgggagggggtgacc

SEQ ID NO: 422863 - DNA, 16 bp, M. musculus
gtgggaggtggggaca

SEQ ID NO: 422864 - DNA, 16 bp, M. musculus
gtgggagtgagtaggt

SEQ ID NO: 422865 - DNA, 17 bp, M. musculus
gtgggagtgcaggcttg

SEQ ID NO: 422866 - DNA, 16 bp, M. musculus
gtgggagttctggtag

SEQ ID NO: 422867 - DNA, 16 bp, M. musculus
gtgggatggtggagca

SEQ ID NO: 422868 - DNA, 17 bp, M. musculus
gtgggattaaaggcgtg

SEQ ID NO: 422869 - DNA, 16 bp, M. musculus
gtgggcaaagtgtgga

SEQ ID NO: 422870 - DNA, 16 bp, M. musculus
gtgggcaacagaagca

SEQ ID NO: 422871 - DNA, 16 bp, M. musculus
gtgggcagggaagtgg

SEQ ID NO: 422872 - DNA, 16 bp, M. musculus
gtgggcagtgccaccc

SEQ ID NO: 422873 - DNA, 16 bp, M. musculus
gtgggcagtgccatct

SEQ ID NO: 422874 - DNA, 16 bp, M. musculus
gtgggcatcaggcaca

SEQ ID NO: 422875 - DNA, 16 bp, M. musculus
gtgggcatcatcagaa

SEQ ID NO: 422876 - DNA, 16 bp, M. musculus
gtgggcatgggtgggt

SEQ ID NO: 422877 - DNA, 16 bp, M. musculus
gtgggcatgtctgtgg

SEQ ID NO: 422878 - DNA, 16 bp, M. musculus
gtgggccaagcattca

SEQ ID NO: 422879 - DNA, 16 bp, M. musculus
gtgggccagtgagatg

SEQ ID NO: 422880 - DNA, 16 bp, M. musculus
gtgggcctccacaagt

SEQ ID NO: 422881 - DNA, 16 bp, M. musculus
gtgggcctggagagat

SEQ ID NO: 422882 - DNA, 16 bp, M. musculus
gtgggcctgggctgta

SEQ ID NO: 422883 - DNA, 16 bp, M. musculus
gtgggcctgggttcta

SEQ ID NO: 422884 - DNA, 16 bp, M. musculus
gtgggctgggctatct

SEQ ID NO: 422885 - DNA, 16 bp, M. musculus
gtgggctttgaagtct

SEQ ID NO: 422886 - DNA, 16 bp, M. musculus
gtgggctttgaggctc

SEQ ID NO: 422887 - DNA, 16 bp, M. musculus
gtgggctttggtgata

SEQ ID NO: 422888 - DNA, 16 bp, M. musculus
gtggggaaggacagga

SEQ ID NO: 422889 - DNA, 16 bp, M. musculus
gtggggacacattctg

SEQ ID NO: 422890 - DNA, 16 bp, M. musculus
gtggggacatggaacc

SEQ ID NO: 422891 - DNA, 16 bp, M. musculus
gtggggagcaccctca

SEQ ID NO: 422892 - DNA, 17 bp, M. musculus
gtggggagctgccctca

SEQ ID NO: 422893 - DNA, 16 bp, M. musculus
gtggggagtgtggcag

SEQ ID NO: 422894 - DNA, 16 bp, M. musculus
gtggggattgaaccca

SEQ ID NO: 422895 - DNA, 16 bp, M. musculus
gtggggcagcctctgg

SEQ ID NO: 422896 - DNA, 16 bp, M. musculus
gtggggcagctgcagg

SEQ ID NO: 422897 - DNA, 16 bp, M. musculus
gtggggcagtttctgg

SEQ ID NO: 422898 - DNA, 16 bp, M. musculus
gtggggcatgcagaga

SEQ ID NO: 422899 - DNA, 16 bp, M. musculus
gtggggcattctctgg

SEQ ID NO: 422900 - DNA, 16 bp, M. musculus
gtggggccagagcaag

SEQ ID NO: 422901 - DNA, 16 bp, M. musculus
gtggggccagctctcc

SEQ ID NO: 422902 - DNA, 16 bp, M. musculus
gtggggctggagcaag

SEQ ID NO: 422903 - DNA, 16 bp, M. musculus
gtggggctgttccaca

SEQ ID NO: 422904 - DNA, 16 bp, M. musculus
gtgggggagagacaga

SEQ ID NO: 422905 - DNA, 16 bp, M. musculus
gtgggggaggatatag

SEQ ID NO: 422906 - DNA, 18 bp, M. musculus
gtgggggagtcggttccc

SEQ ID NO: 422907 - DNA, 16 bp, M. musculus
gtgggggcagggagaa

SEQ ID NO: 422908 - DNA, 16 bp, M. musculus
gtgggggcattttctt

SEQ ID NO: 422909 - DNA, 16 bp, M. musculus
gtgggggctggtgaga

SEQ ID NO: 422910 - DNA, 16 bp, M. musculus
gtgggggtatccccac

SEQ ID NO: 422911 - DNA, 16 bp, M. musculus
gtgggggtgcatgcct

SEQ ID NO: 422912 - DNA, 16 bp, M. musculus
gtgggggtgggcaatg

SEQ ID NO: 422913 - DNA, 16 bp, M. musculus
gtgggggtggggaacc

SEQ ID NO: 422914 - DNA, 16 bp, M. musculus
gtgggggtggggttca

SEQ ID NO: 422915 - DNA, 17 bp, M. musculus
gtggggtgggagtgctg

SEQ ID NO: 422916 - DNA, 16 bp, M. musculus
gtggggttgactggag

SEQ ID NO: 422917 - DNA, 16 bp, M. musculus
gtgggtacatggagcc

SEQ ID NO: 422918 - DNA, 16 bp, M. musculus
gtgggtactgggaatc

SEQ ID NO: 422919 - DNA, 16 bp, M. musculus
gtgggtagaggagcac

SEQ ID NO: 422920 - DNA, 16 bp, M. musculus
gtgggtagcagagtgg

SEQ ID NO: 422921 - DNA, 16 bp, M. musculus
gtgggtaggagcactg

SEQ ID NO: 422922 - DNA, 16 bp, M. musculus
gtgggtaggctttgag

SEQ ID NO: 422923 - DNA, 16 bp, M. musculus
gtgggtatcctgtact

SEQ ID NO: 422924 - DNA, 16 bp, M. musculus
gtgggtcacgacccct

SEQ ID NO: 422925 - DNA, 16 bp, M. musculus
gtgggtcaggcatgct

SEQ ID NO: 422926 - DNA, 16 bp, M. musculus
gtgggtctctccatct

SEQ ID NO: 422927 - DNA, 16 bp, M. musculus
gtgggtctctgtttct

SEQ ID NO: 422928 - DNA, 16 bp, M. musculus
gtgggtctgaagacag

SEQ ID NO: 422929 - DNA, 16 bp, M. musculus
gtgggtgacaccatcc

SEQ ID NO: 422930 - DNA, 16 bp, M. musculus
gtgggtgaccccatcc

SEQ ID NO: 422931 - DNA, 16 bp, M. musculus
gtgggtgctaggagct

SEQ ID NO: 422932 - DNA, 16 bp, M. musculus
gtgggtgctggaagcc

SEQ ID NO: 422933 - DNA, 16 bp, M. musculus
gtgggtgctgggaatc

SEQ ID NO: 422934 - DNA, 16 bp, M. musculus
gtgggtgctggggacc

SEQ ID NO: 422935 - DNA, 16 bp, M. musculus
gtgggtgctggggatc

SEQ ID NO: 422936 - DNA, 16 bp, M. musculus
gtgggtggaggaatgt

SEQ ID NO: 422937 - DNA, 16 bp, M. musculus
gtgggtggcaccattc

SEQ ID NO: 422938 - DNA, 16 bp, M. musculus
gtgggtggcctcatcc

SEQ ID NO: 422939 - DNA, 16 bp, M. musculus
gtgggtggctatgggg

SEQ ID NO: 422940 - DNA, 16 bp, M. musculus
gtgggtgggaccatca

SEQ ID NO: 422941 - DNA, 16 bp, M. musculus
gtgggtggggaagcag

SEQ ID NO: 422942 - DNA, 16 bp, M. musculus
gtgggtggggccatcc

SEQ ID NO: 422943 - DNA, 16 bp, M. musculus
gtgggtggggccatct

SEQ ID NO: 422944 - DNA, 16 bp, M. musculus
gtgggtgggggaacac

SEQ ID NO: 422945 - DNA, 16 bp, M. musculus
gtgggtgggtaaagga

SEQ ID NO: 422946 - DNA, 16 bp, M. musculus
gtgggtgtctgtctgt

SEQ ID NO: 422947 - DNA, 16 bp, M. musculus
gtgggtgtgaatgtgt

SEQ ID NO: 422948 - DNA, 16 bp, M. musculus
gtgggtgtgtctctga

SEQ ID NO: 422949 - DNA, 16 bp, M. musculus
gtgggttccagagatt

SEQ ID NO: 422950 - DNA, 16 bp, M. musculus
gtgggttctaggaatt

SEQ ID NO: 422951 - DNA, 16 bp, M. musculus
gtgggttctggagact

SEQ ID NO: 422952 - DNA, 16 bp, M. musculus
gtgggttctgggaatg

SEQ ID NO: 422953 - DNA, 16 bp, M. musculus
gtgggttctggggatc

SEQ ID NO: 422954 - DNA, 16 bp, M. musculus
gtgggttgcaaccctt

SEQ ID NO: 422955 - DNA, 16 bp, M. musculus
gtgggttggggagctg

SEQ ID NO: 422956 - DNA, 16 bp, M. musculus
gtgggttggggtgcag

SEQ ID NO: 422957 - DNA, 16 bp, M. musculus
gtgggtttctgcatct

SEQ ID NO: 422958 - DNA, 16 bp, M. musculus
gtgggttttccctata

SEQ ID NO: 422959 - DNA, 16 bp, M. musculus
gtgggtttttaaaaat

SEQ ID NO: 422960 - DNA, 16 bp, M. musculus
gtggtaaagcatttgc

SEQ ID NO: 422961 - DNA, 16 bp, M. musculus
gtggtaacttcaacag

SEQ ID NO: 422962 - DNA, 16 bp, M. musculus
gtggtaagtgccttta

SEQ ID NO: 422963 - DNA, 16 bp, M. musculus
gtggtacacaaacata

SEQ ID NO: 422964 - DNA, 16 bp, M. musculus
gtggtacagagacagg

SEQ ID NO: 422965 - DNA, 16 bp, M. musculus
gtggtacatacacaca

SEQ ID NO: 422966 - DNA, 16 bp, M. musculus
gtggtacatactttta

SEQ ID NO: 422967 - DNA, 16 bp, M. musculus
gtggtacatagacata

SEQ ID NO: 422968 - DNA, 16 bp, M. musculus
gtggtaccatccttgg

SEQ ID NO: 422969 - DNA, 17 bp, M. musculus
gtggtaccctccctagg

SEQ ID NO: 422970 - DNA, 16 bp, M. musculus
gtggtacgtgccttta

SEQ ID NO: 422971 - DNA, 16 bp, M. musculus
gtggtagaacacttgt

SEQ ID NO: 422972 - DNA, 16 bp, M. musculus
gtggtagaaggaaaga

SEQ ID NO: 422973 - DNA, 16 bp, M. musculus
gtggtagagctcctgc

SEQ ID NO: 422974 - DNA, 16 bp, M. musculus
gtggtagaggcaggag

SEQ ID NO: 422975 - DNA, 16 bp, M. musculus
gtggtagcacactcct

SEQ ID NO: 422976 - DNA, 16 bp, M. musculus
gtggtagcacagatct

SEQ ID NO: 422977 - DNA, 16 bp, M. musculus
gtggtagcacatacct

SEQ ID NO: 422978 - DNA, 16 bp, M. musculus
gtggtaggaattgaac

SEQ ID NO: 422979 - DNA, 16 bp, M. musculus
gtggtagtacacacct

SEQ ID NO: 422980 - DNA, 16 bp, M. musculus
gtggtatacaccttta

SEQ ID NO: 422981 - DNA, 16 bp, M. musculus
gtggtatagctgtgtc

SEQ ID NO: 422982 - DNA, 16 bp, M. musculus
gtggtatatggtgtgt

SEQ ID NO: 422983 - DNA, 16 bp, M. musculus
gtggtcaaagaagaaa

SEQ ID NO: 422984 - DNA, 16 bp, M. musculus
gtggtcaaggctgaaa

SEQ ID NO: 422985 - DNA, 16 bp, M. musculus
gtggtcagaacactct

SEQ ID NO: 422986 - DNA, 16 bp, M. musculus
gtggtcagagaacaac

SEQ ID NO: 422987 - DNA, 16 bp, M. musculus
gtggtcatgatgtttg

SEQ ID NO: 422988 - DNA, 16 bp, M. musculus
gtggtcattgctgaca

SEQ ID NO: 422989 - DNA, 16 bp, M. musculus
gtggtccagtctctgg

SEQ ID NO: 422990 - DNA, 16 bp, M. musculus
gtggtccagttcctgg

SEQ ID NO: 422991 - DNA, 16 bp, M. musculus
gtggtccatccttttg

SEQ ID NO: 422992 - DNA, 16 bp, M. musculus
gtggtcccaagaaaca

SEQ ID NO: 422993 - DNA, 16 bp, M. musculus
gtggtcctccccaggg

SEQ ID NO: 422994 - DNA, 16 bp, M. musculus
gtggtcctgggatgta

SEQ ID NO: 422995 - DNA, 16 bp, M. musculus
gtggtcctgggtgtgt

SEQ ID NO: 422996 - DNA, 16 bp, M. musculus
gtggtccttatggaca

SEQ ID NO: 422997 - DNA, 32 bp, M. musculus
gtggtcgaggtagttgatcagcaagatactag

SEQ ID NO: 422998 - DNA, 20 bp, M. musculus
gtggtctacagagtgagttc

SEQ ID NO: 422999 - DNA, 16 bp, M. musculus
gtggtctctgcctcag

SEQ ID NO: 423000 - DNA, 16 bp, M. musculus
gtggtcttattggagt

SEQ ID NO: 423001 - DNA, 16 bp, M. musculus
gtggtcttccttcttc

SEQ ID NO: 423002 - DNA, 16 bp, M. musculus
gtggtctttctgtctt

SEQ ID NO: 423003 - DNA, 16 bp, M. musculus
gtggtgaaagctgtgg

SEQ ID NO: 423004 - DNA, 16 bp, M. musculus
gtggtgacacatgcct

SEQ ID NO: 423005 - DNA, 16 bp, M. musculus
gtggtgacacccaacc

SEQ ID NO: 423006 - DNA, 16 bp, M. musculus
gtggtgacaggaaagc

SEQ ID NO: 423007 - DNA, 16 bp, M. musculus
gtggtgacctgatagg

SEQ ID NO: 423008 - DNA, 16 bp, M. musculus
gtggtgagatggctca

SEQ ID NO: 423009 - DNA, 16 bp, M. musculus
gtggtgagctgccatg

SEQ ID NO: 423010 - DNA, 16 bp, M. musculus
gtggtgaggactcaga

SEQ ID NO: 423011 - DNA, 16 bp, M. musculus
gtggtgcacaccctta

SEQ ID NO: 423012 - DNA, 16 bp, M. musculus
gtggtgcacacctata

SEQ ID NO: 423013 - DNA, 16 bp, M. musculus
gtggtgcacacctgtc

SEQ ID NO: 423014 - DNA, 16 bp, M. musculus
gtggtgcacaccttca

SEQ ID NO: 423015 - DNA, 17 bp, M. musculus
gtggtgcacgtctccaa

SEQ ID NO: 423016 - DNA, 17 bp, M. musculus
gtggtgcatgcctgtaa

SEQ ID NO: 423017 - DNA, 16 bp, M. musculus
gtggtgcatgcctttg

SEQ ID NO: 423018 - DNA, 16 bp, M. musculus
gtggtgcatgtgtgtg

SEQ ID NO: 423019 - DNA, 16 bp, M. musculus
gtggtgccatccatgg

SEQ ID NO: 423020 - DNA, 16 bp, M. musculus
gtggtgccatccctag

SEQ ID NO: 423021 - DNA, 16 bp, M. musculus
gtggtgcgtgccttta

SEQ ID NO: 423022 - DNA, 16 bp, M. musculus
gtggtgctatccctgg

SEQ ID NO: 423023 - DNA, 16 bp, M. musculus
gtggtgctgagggtga

SEQ ID NO: 423024 - DNA, 16 bp, M. musculus
gtggtgctgcacacct

SEQ ID NO: 423025 - DNA, 16 bp, M. musculus
gtggtgctgctgctgg

SEQ ID NO: 423026 - DNA, 16 bp, M. musculus
gtggtgctggagattg

SEQ ID NO: 423027 - DNA, 16 bp, M. musculus
gtggtgctggctaccg

SEQ ID NO: 423028 - DNA, 16 bp, M. musculus
gtggtgctgggaatgg

SEQ ID NO: 423029 - DNA, 16 bp, M. musculus
gtggtgctggggatgg

SEQ ID NO: 423030 - DNA, 16 bp, M. musculus
gtggtgctgtccctgg

SEQ ID NO: 423031 - DNA, 16 bp, M. musculus
gtggtggaagaactgg

SEQ ID NO: 423032 - DNA, 16 bp, M. musculus
gtggtggagagatggc

SEQ ID NO: 423033 - DNA, 16 bp, M. musculus
gtggtggaggaacaca

SEQ ID NO: 423034 - DNA, 16 bp, M. musculus
gtggtggatgactcca

SEQ ID NO: 423035 - DNA, 22 bp, M. musculus
gtggtggcacacgcctttaatt

SEQ ID NO: 423036 - DNA, 16 bp, M. musculus
gtggtggcacaggcct

SEQ ID NO: 423037 - DNA, 16 bp, M. musculus
gtggtggcacaggtct

SEQ ID NO: 423038 - DNA, 16 bp, M. musculus
gtggtggcacatgctt

SEQ ID NO: 423039 - DNA, 16 bp, M. musculus
gtggtggcaccaacag

SEQ ID NO: 423040 - DNA, 16 bp, M. musculus
gtggtggcacctgcct

SEQ ID NO: 423041 - DNA, 16 bp, M. musculus
gtggtggcagagacag

SEQ ID NO: 423042 - DNA, 16 bp, M. musculus
gtggtggcagcagtgg

SEQ ID NO: 423043 - DNA, 16 bp, M. musculus
gtggtggcagcccagg

SEQ ID NO: 423044 - DNA, 16 bp, M. musculus
gtggtggcatacacct

SEQ ID NO: 423045 - DNA, 21 bp, M. musculus
gtggtggcgcacgcctttaat

SEQ ID NO: 423046 - DNA, 16 bp, M. musculus
gtggtggcgctcacct

SEQ ID NO: 423047 - DNA, 16 bp, M. musculus
gtggtggctcacaaac

SEQ ID NO: 423048 - DNA, 17 bp, M. musculus
gtggtggctcacaacca

SEQ ID NO: 423049 - DNA, 16 bp, M. musculus
gtggtggctcacacct

SEQ ID NO: 423050 - DNA, 16 bp, M. musculus
gtggtggctcacagcc

SEQ ID NO: 423051 - DNA, 16 bp, M. musculus
gtggtggctcatgcct

SEQ ID NO: 423052 - DNA, 16 bp, M. musculus
gtggtgggctagaggg

SEQ ID NO: 423053 - DNA, 16 bp, M. musculus
gtggtggtacacacct

SEQ ID NO: 423054 - DNA, 16 bp, M. musculus
gtggtggtacacatct

SEQ ID NO: 423055 - DNA, 17 bp, M. musculus
gtggtggtacatgcctt

SEQ ID NO: 423056 - DNA, 16 bp, M. musculus
gtggtggtatatgcct

SEQ ID NO: 423057 - DNA, 16 bp, M. musculus
gtggtggtgatagtga

SEQ ID NO: 423058 - DNA, 16 bp, M. musculus
gtggtggtgcacacct

SEQ ID NO: 423059 - DNA, 16 bp, M. musculus
gtggtggtgcacgact

SEQ ID NO: 423060 - DNA, 16 bp, M. musculus
gtggtggtgcacgtct

SEQ ID NO: 423061 - DNA, 16 bp, M. musculus
gtggtggtgcatatct

SEQ ID NO: 423062 - DNA, 16 bp, M. musculus
gtggtggtgcatgcct

SEQ ID NO: 423063 - DNA, 16 bp, M. musculus
gtggtggtggcagagg

SEQ ID NO: 423064 - DNA, 16 bp, M. musculus
gtggtggtggcagcag

SEQ ID NO: 423065 - DNA, 16 bp, M. musculus
gtggtggtggcagcgg

SEQ ID NO: 423066 - DNA, 16 bp, M. musculus
gtggtggtggcagtga

SEQ ID NO: 423067 - DNA, 16 bp, M. musculus
gtggtggtggcagtgg

SEQ ID NO: 423068 - DNA, 16 bp, M. musculus
gtggtggtggcggcac

SEQ ID NO: 423069 - DNA, 16 bp, M. musculus
gtggtggtggtgaaga

SEQ ID NO: 423070 - DNA, 16 bp, M. musculus
gtggtggtggtgacag

SEQ ID NO: 423071 - DNA, 16 bp, M. musculus
gtggtggtggtgcacg

SEQ ID NO: 423072 - DNA, 16 bp, M. musculus
gtggtggtttcaatga

SEQ ID NO: 423073 - DNA, 16 bp, M. musculus
gtggtgtacacctgta

SEQ ID NO: 423074 - DNA, 16 bp, M. musculus
gtggtgtgcaggcaga

SEQ ID NO: 423075 - DNA, 16 bp, M. musculus
gtggtgtgcatttgtg

SEQ ID NO: 423076 - DNA, 16 bp, M. musculus
gtggtgtgctgtgctg

SEQ ID NO: 423077 - DNA, 16 bp, M. musculus
gtggtgtgtgtatgta

SEQ ID NO: 423078 - DNA, 16 bp, M. musculus
gtggttaaaagcactg

SEQ ID NO: 423079 - DNA, 16 bp, M. musculus
gtggttaagaatgctg

SEQ ID NO: 423080 - DNA, 16 bp, M. musculus
gtggttaagagcagtg

SEQ ID NO: 423081 - DNA, 16 bp, M. musculus
gtggttaggaagagga

SEQ ID NO: 423082 - DNA, 16 bp, M. musculus
gtggttcacaaccacc

SEQ ID NO: 423083 - DNA, 16 bp, M. musculus
gtggttcacaaccatc

SEQ ID NO: 423084 - DNA, 16 bp, M. musculus
gtggttcagagcactg

SEQ ID NO: 423085 - DNA, 16 bp, M. musculus
gtggttcagtccctgg

SEQ ID NO: 423086 - DNA, 16 bp, M. musculus
gtggttcatttctggg

SEQ ID NO: 423087 - DNA, 16 bp, M. musculus
gtggttccatctctgg

SEQ ID NO: 423088 - DNA, 16 bp, M. musculus
gtggttcctgggcttc

SEQ ID NO: 423089 - DNA, 16 bp, M. musculus
gtggttctaggttcta

SEQ ID NO: 423090 - DNA, 16 bp, M. musculus
gtggttctcaaactcc

SEQ ID NO: 423091 - DNA, 16 bp, M. musculus
gtggttctcaaccctc

SEQ ID NO: 423092 - DNA, 16 bp, M. musculus
gtggttctcagccatt

SEQ ID NO: 423093 - DNA, 16 bp, M. musculus
gtggttctcagccttt

SEQ ID NO: 423094 - DNA, 16 bp, M. musculus
gtggttctctccttcc

SEQ ID NO: 423095 - DNA, 16 bp, M. musculus
gtggttcttttattgt

SEQ ID NO: 423096 - DNA, 16 bp, M. musculus
gtggttgtacaggttt

SEQ ID NO: 423097 - DNA, 16 bp, M. musculus
gtggttgtctcaggct

SEQ ID NO: 423098 - DNA, 20 bp, M. musculus
gtggttgtgagccaccatgt

SEQ ID NO: 423099 - DNA, 16 bp, M. musculus
gtggttgtgagccatc

SEQ ID NO: 423100 - DNA, 16 bp, M. musculus
gtggttgtggctggag

SEQ ID NO: 423101 - DNA, 16 bp, M. musculus
gtggtttaagaaggaa

SEQ ID NO: 423102 - DNA, 16 bp, M. musculus
gtggtttactcccagg

SEQ ID NO: 423103 - DNA, 16 bp, M. musculus
gtggtttctgtccttg

SEQ ID NO: 423104 - DNA, 16 bp, M. musculus
gtggtttgaaaaagaa

SEQ ID NO: 423105 - DNA, 16 bp, M. musculus
gtggtttgaaggagaa

SEQ ID NO: 423106 - DNA, 16 bp, M. musculus
gtggtttgaataggta

SEQ ID NO: 423107 - DNA, 16 bp, M. musculus
gtggtttgaatgagaa

SEQ ID NO: 423108 - DNA, 16 bp, M. musculus
gtggtttgcaaattgt

SEQ ID NO: 423109 - DNA, 16 bp, M. musculus
gtggtttggatgagaa

SEQ ID NO: 423110 - DNA, 16 bp, M. musculus
gtggttttctgtgatg

SEQ ID NO: 423111 - DNA, 16 bp, M. musculus
gtggttttcttcatct

SEQ ID NO: 423112 - DNA, 16 bp, M. musculus
gtggttttttctttga

SEQ ID NO: 423113 - DNA, 16 bp, M. musculus
gtggtttttttgagac

SEQ ID NO: 423114 - DNA, 16 bp, M. musculus
gtgtaaatatctgata

SEQ ID NO: 423115 - DNA, 16 bp, M. musculus
gtgtaaatgtgtgtgc

SEQ ID NO: 423116 - DNA, 16 bp, M. musculus
gtgtaattatattata

SEQ ID NO: 423117 - DNA, 16 bp, M. musculus
gtgtaattttgctact

SEQ ID NO: 423118 - DNA, 17 bp, M. musculus
gtgtacacacatacaca

SEQ ID NO: 423119 - DNA, 16 bp, M. musculus
gtgtacacacatgtgt

SEQ ID NO: 423120 - DNA, 16 bp, M. musculus
gtgtacacatgcatgc

SEQ ID NO: 423121 - DNA, 16 bp, M. musculus
gtgtacagttatctgg

SEQ ID NO: 423122 - DNA, 16 bp, M. musculus
gtgtacatatgtgtgt

SEQ ID NO: 423123 - DNA, 16 bp, M. musculus
gtgtacatgtatgtat

SEQ ID NO: 423124 - DNA, 16 bp, M. musculus
gtgtacatgtgtctgt

SEQ ID NO: 423125 - DNA, 16 bp, M. musculus
gtgtacatgtgtgtgt

SEQ ID NO: 423126 - DNA, 17 bp, M. musculus
gtgtaccaccacacctt

SEQ ID NO: 423127 - DNA, 16 bp, M. musculus
gtgtaccaccacgccc

SEQ ID NO: 423128 - DNA, 16 bp, M. musculus
gtgtaccaccatgtct

SEQ ID NO: 423129 - DNA, 16 bp, M. musculus
gtgtaccaccattcct

SEQ ID NO: 423130 - DNA, 16 bp, M. musculus
gtgtacctgtgtatgt

SEQ ID NO: 423131 - DNA, 16 bp, M. musculus
gtgtaccttccctgcc

SEQ ID NO: 423132 - DNA, 16 bp, M. musculus
gtgtacgtgtgtgtac

SEQ ID NO: 423133 - DNA, 16 bp, M. musculus
gtgtactcacacacat

SEQ ID NO: 423134 - DNA, 16 bp, M. musculus
gtgtactctgtggttg

SEQ ID NO: 423135 - DNA, 16 bp, M. musculus
gtgtactctttgtttg

SEQ ID NO: 423136 - DNA, 16 bp, M. musculus
gtgtactggctgattt

SEQ ID NO: 423137 - DNA, 16 bp, M. musculus
gtgtacttataaataa

SEQ ID NO: 423138 - DNA, 16 bp, M. musculus
gtgtacttatatatat

SEQ ID NO: 423139 - DNA, 16 bp, M. musculus
gtgtacttgtgtgtgt

SEQ ID NO: 423140 - DNA, 16 bp, M. musculus
gtgtagcccaggctga

SEQ ID NO: 423141 - DNA, 16 bp, M. musculus
gtgtagccctgactgc

SEQ ID NO: 423142 - DNA, 16 bp, M. musculus
gtgtagccctgagtgt

SEQ ID NO: 423143 - DNA, 17 bp, M. musculus
gtgtagctctggctggc

SEQ ID NO: 423144 - DNA, 26 bp, M. musculus
gtgtagctgtcttcagacactccaga

SEQ ID NO: 423145 - DNA, 16 bp, M. musculus
gtgtaggtgctgagaa

SEQ ID NO: 423146 - DNA, 16 bp, M. musculus
gtgtagtcaggtatgg

SEQ ID NO: 423147 - DNA, 16 bp, M. musculus
gtgtataataataaat

SEQ ID NO: 423148 - DNA, 16 bp, M. musculus
gtgtataccaccactg

SEQ ID NO: 423149 - DNA, 16 bp, M. musculus
gtgtatagtgtatagt

SEQ ID NO: 423150 - DNA, 16 bp, M. musculus
gtgtatatataaatat

SEQ ID NO: 423151 - DNA, 17 bp, M. musculus
gtgtatatatatgtatg

SEQ ID NO: 423152 - DNA, 16 bp, M. musculus
gtgtatatatgtacat

SEQ ID NO: 423153 - DNA, 16 bp, M. musculus
gtgtatatatgtgtaa

SEQ ID NO: 423154 - DNA, 16 bp, M. musculus
gtgtatatgtatatga

SEQ ID NO: 423155 - DNA, 16 bp, M. musculus
gtgtatatgtatttgt

SEQ ID NO: 423156 - DNA, 16 bp, M. musculus
gtgtatatgtgtgcat

SEQ ID NO: 423157 - DNA, 17 bp, M. musculus
gtgtatatgtgtgtatt

SEQ ID NO: 423158 - DNA, 17 bp, M. musculus
gtgtatatgtgtgtgta

SEQ ID NO: 423159 - DNA, 16 bp, M. musculus
gtgtatatgtgttcat

SEQ ID NO: 423160 - DNA, 16 bp, M. musculus
gtgtatatttgcatgt

SEQ ID NO: 423161 - DNA, 16 bp, M. musculus
gtgtatcctgcacagg

SEQ ID NO: 423162 - DNA, 16 bp, M. musculus
gtgtatctcagtggta

SEQ ID NO: 423163 - DNA, 16 bp, M. musculus
gtgtatctctctgtgt

SEQ ID NO: 423164 - DNA, 16 bp, M. musculus
gtgtatctgaagacag

SEQ ID NO: 423165 - DNA, 16 bp, M. musculus
gtgtatctgtatgtct

SEQ ID NO: 423166 - DNA, 16 bp, M. musculus
gtgtatctgtatttat

SEQ ID NO: 423167 - DNA, 16 bp, M. musculus
gtgtatctgtgtgtgg

SEQ ID NO: 423168 - DNA, 16 bp, M. musculus
gtgtatgatgcctggt

SEQ ID NO: 423169 - DNA, 16 bp, M. musculus
gtgtatgcacatgcac

SEQ ID NO: 423170 - DNA, 16 bp, M. musculus
gtgtatgcatgtgtgt

SEQ ID NO: 423171 - DNA, 16 bp, M. musculus
gtgtatgcctttaacc

SEQ ID NO: 423172 - DNA, 16 bp, M. musculus
gtgtatgctctcccca

SEQ ID NO: 423173 - DNA, 16 bp, M. musculus
gtgtatgtacatatat

SEQ ID NO: 423174 - DNA, 16 bp, M. musculus
gtgtatgtatatacat

SEQ ID NO: 423175 - DNA, 16 bp, M. musculus
gtgtatgtatatatag

SEQ ID NO: 423176 - DNA, 17 bp, M. musculus
gtgtatgtatgtatatg

SEQ ID NO: 423177 - DNA, 16 bp, M. musculus
gtgtatgtatgtatgc

SEQ ID NO: 423178 - DNA, 16 bp, M. musculus
gtgtatgtatgtgatg

SEQ ID NO: 423179 - DNA, 16 bp, M. musculus
gtgtatgtatgtgcac

SEQ ID NO: 423180 - DNA, 17 bp, M. musculus
gtgtatgtatgtgtgta

SEQ ID NO: 423181 - DNA, 16 bp, M. musculus
gtgtatgtgagagaga

SEQ ID NO: 423182 - DNA, 16 bp, M. musculus
gtgtatgtgcacacat

SEQ ID NO: 423183 - DNA, 16 bp, M. musculus
gtgtatgtgcgcatgt

SEQ ID NO: 423184 - DNA, 16 bp, M. musculus
gtgtatgtgtacacat

SEQ ID NO: 423185 - DNA, 16 bp, M. musculus
gtgtatgtgtatgtgt

SEQ ID NO: 423186 - DNA, 16 bp, M. musculus
gtgtatgtgtgcatgc

SEQ ID NO: 423187 - DNA, 16 bp, M. musculus
gtgtatgtgtgtatga

SEQ ID NO: 423188 - DNA, 16 bp, M. musculus
gtgtatgtgtgtatgc

SEQ ID NO: 423189 - DNA, 16 bp, M. musculus
gtgtatgtgtgtattc

SEQ ID NO: 423190 - DNA, 16 bp, M. musculus
gtgtatgtgtgtgact

SEQ ID NO: 423191 - DNA, 16 bp, M. musculus
gtgtatgtgtgtgatg

SEQ ID NO: 423192 - DNA, 16 bp, M. musculus
gtgtatgtgtgtgctc

SEQ ID NO: 423193 - DNA, 16 bp, M. musculus
gtgtatgtgtgtgtgc

SEQ ID NO: 423194 - DNA, 16 bp, M. musculus
gtgtatgtgtgtgtta

SEQ ID NO: 423195 - DNA, 16 bp, M. musculus
gtgtatgtgtgtgttc

SEQ ID NO: 423196 - DNA, 16 bp, M. musculus
gtgtatgtgtgttatg

SEQ ID NO: 423197 - DNA, 16 bp, M. musculus
gtgtatgtgtttacat

SEQ ID NO: 423198 - DNA, 16 bp, M. musculus
gtgtattcatacatat

SEQ ID NO: 423199 - DNA, 16 bp, M. musculus
gtgtatttatatacat

SEQ ID NO: 423200 - DNA, 16 bp, M. musculus
gtgtatttccacacac

SEQ ID NO: 423201 - DNA, 16 bp, M. musculus
gtgtatttgattcttt

SEQ ID NO: 423202 - DNA, 16 bp, M. musculus
gtgtcaaagacaaaca

SEQ ID NO: 423203 - DNA, 16 bp, M. musculus
gtgtcaacctgacaca

SEQ ID NO: 423204 - DNA, 16 bp, M. musculus
gtgtcaagttgacaaa

SEQ ID NO: 423205 - DNA, 16 bp, M. musculus
gtgtcaatagagacat

SEQ ID NO: 423206 - DNA, 16 bp, M. musculus
gtgtcacacttcctcc

SEQ ID NO: 423207 - DNA, 16 bp, M. musculus
gtgtcaccactgccag

SEQ ID NO: 423208 - DNA, 16 bp, M. musculus
gtgtcaccatgcccaa

SEQ ID NO: 423209 - DNA, 16 bp, M. musculus
gtgtcagaatttggaa

SEQ ID NO: 423210 - DNA, 16 bp, M. musculus
gtgtcagagaccatcc

SEQ ID NO: 423211 - DNA, 16 bp, M. musculus
gtgtcagagctcctgg

SEQ ID NO: 423212 - DNA, 16 bp, M. musculus
gtgtcagatctcttgg

SEQ ID NO: 423213 - DNA, 16 bp, M. musculus
gtgtcaggacagccag

SEQ ID NO: 423214 - DNA, 16 bp, M. musculus
gtgtcaggatttggtg

SEQ ID NO: 423215 - DNA, 18 bp, M. musculus
gtgtcaggccgggctcag

SEQ ID NO: 423216 - DNA, 16 bp, M. musculus
gtgtcagggattggtg

SEQ ID NO: 423217 - DNA, 16 bp, M. musculus
gtgtcagggtttggag

SEQ ID NO: 423218 - DNA, 16 bp, M. musculus
gtgtcaggtcttggga

SEQ ID NO: 423219 - DNA, 16 bp, M. musculus
gtgtcatgtgatgttt

SEQ ID NO: 423220 - DNA, 16 bp, M. musculus
gtgtcattagcaaaga

SEQ ID NO: 423221 - DNA, 16 bp, M. musculus
gtgtccaagaggaagg

SEQ ID NO: 423222 - DNA, 16 bp, M. musculus
gtgtccacagaagtca

SEQ ID NO: 423223 - DNA, 16 bp, M. musculus
gtgtccacagaggtca

SEQ ID NO: 423224 - DNA, 16 bp, M. musculus
gtgtccactgtatgaa

SEQ ID NO: 423225 - DNA, 16 bp, M. musculus
gtgtccaggtgtccac

SEQ ID NO: 423226 - DNA, 16 bp, M. musculus
gtgtcccaccatgcct

SEQ ID NO: 423227 - DNA, 16 bp, M. musculus
gtgtccccaagctcca

SEQ ID NO: 423228 - DNA, 16 bp, M. musculus
gtgtccctggttactg

SEQ ID NO: 423229 - DNA, 16 bp, M. musculus
gtgtccctgtgtctgt

SEQ ID NO: 423230 - DNA, 16 bp, M. musculus
gtgtcctcaacccctc

SEQ ID NO: 423231 - DNA, 16 bp, M. musculus
gtgtcctcatatacat

SEQ ID NO: 423232 - DNA, 16 bp, M. musculus
gtgtcctccacatgcc

SEQ ID NO: 423233 - DNA, 16 bp, M. musculus
gtgtcctcctgcctca

SEQ ID NO: 423234 - DNA, 16 bp, M. musculus
gtgtcctgagtgctga

SEQ ID NO: 423235 - DNA, 16 bp, M. musculus
gtgtcctgagttcaat

SEQ ID NO: 423236 - DNA, 17 bp, M. musculus
gtgtcctggaactcact

SEQ ID NO: 423237 - DNA, 16 bp, M. musculus
gtgtcctgttcagaaa

SEQ ID NO: 423238 - DNA, 16 bp, M. musculus
gtgtccttataacaag

SEQ ID NO: 423239 - DNA, 16 bp, M. musculus
gtgtccttctcaccag

SEQ ID NO: 423240 - DNA, 16 bp, M. musculus
gtgtccttctccatct

SEQ ID NO: 423241 - DNA, 16 bp, M. musculus
gtgtccttggagacca

SEQ ID NO: 423242 - DNA, 16 bp, M. musculus
gtgtctaaagacagtg

SEQ ID NO: 423243 - DNA, 16 bp, M. musculus
gtgtctacatggtcca

SEQ ID NO: 423244 - DNA, 16 bp, M. musculus
gtgtctaggagcatgg

SEQ ID NO: 423245 - DNA, 16 bp, M. musculus
gtgtctcctctctctc

SEQ ID NO: 423246 - DNA, 16 bp, M. musculus
gtgtctctagttgcac

SEQ ID NO: 423247 - DNA, 16 bp, M. musculus
gtgtctctctctgcct

SEQ ID NO: 423248 - DNA, 16 bp, M. musculus
gtgtctctgaagagag

SEQ ID NO: 423249 - DNA, 16 bp, M. musculus
gtgtctctgtctctct

SEQ ID NO: 423250 - DNA, 16 bp, M. musculus
gtgtctctgtgtctat

SEQ ID NO: 423251 - DNA, 16 bp, M. musculus
gtgtctctgtgtgtga

SEQ ID NO: 423252 - DNA, 16 bp, M. musculus
gtgtctcttcatagca

SEQ ID NO: 423253 - DNA, 16 bp, M. musculus
gtgtctgaacacagca

SEQ ID NO: 423254 - DNA, 16 bp, M. musculus
gtgtctgaagaaagca

SEQ ID NO: 423255 - DNA, 16 bp, M. musculus
gtgtctgaagacaaca

SEQ ID NO: 423256 - DNA, 16 bp, M. musculus
gtgtctgaagacaact

SEQ ID NO: 423257 - DNA, 16 bp, M. musculus
gtgtctgaagacagat

SEQ ID NO: 423258 - DNA, 16 bp, M. musculus
gtgtctgaagacaggg

SEQ ID NO: 423259 - DNA, 16 bp, M. musculus
gtgtctgaagagagtg

SEQ ID NO: 423260 - DNA, 16 bp, M. musculus
gtgtctgaagatagcg

SEQ ID NO: 423261 - DNA, 16 bp, M. musculus
gtgtctgaggccagcc

SEQ ID NO: 423262 - DNA, 16 bp, M. musculus
gtgtctgcagatgggg

SEQ ID NO: 423263 - DNA, 16 bp, M. musculus
gtgtctgcatgtgtct

SEQ ID NO: 423264 - DNA, 16 bp, M. musculus
gtgtctgccaactctg

SEQ ID NO: 423265 - DNA, 16 bp, M. musculus
gtgtctgcctctggct

SEQ ID NO: 423266 - DNA, 16 bp, M. musculus
gtgtctgcctggctca

SEQ ID NO: 423267 - DNA, 16 bp, M. musculus
gtgtctgcgtttggtg

SEQ ID NO: 423268 - DNA, 16 bp, M. musculus
gtgtctgctgcctgtg

SEQ ID NO: 423269 - DNA, 16 bp, M. musculus
gtgtctgcttcaggga

SEQ ID NO: 423270 - DNA, 16 bp, M. musculus
gtgtctgcttgtctgt

SEQ ID NO: 423271 - DNA, 16 bp, M. musculus
gtgtctggagacagct

SEQ ID NO: 423272 - DNA, 16 bp, M. musculus
gtgtctggatggcctt

SEQ ID NO: 423273 - DNA, 16 bp, M. musculus
gtgtctgggaagggaa

SEQ ID NO: 423274 - DNA, 16 bp, M. musculus
gtgtctgggtttgctg

SEQ ID NO: 423275 - DNA, 16 bp, M. musculus
gtgtctggtgcctgca

SEQ ID NO: 423276 - DNA, 16 bp, M. musculus
gtgtctggttttatgt

SEQ ID NO: 423277 - DNA, 16 bp, M. musculus
gtgtctgtaggtgtgt

SEQ ID NO: 423278 - DNA, 16 bp, M. musculus
gtgtctgtatctgtat

SEQ ID NO: 423279 - DNA, 16 bp, M. musculus
gtgtctgtatctgtct

SEQ ID NO: 423280 - DNA, 16 bp, M. musculus
gtgtctgtatgtgtgt

SEQ ID NO: 423281 - DNA, 16 bp, M. musculus
gtgtctgtctccctct

SEQ ID NO: 423282 - DNA, 16 bp, M. musculus
gtgtctgtctctctgc

SEQ ID NO: 423283 - DNA, 16 bp, M. musculus
gtgtctgtctctgtct

SEQ ID NO: 423284 - DNA, 16 bp, M. musculus
gtgtctgtctgagtgt

SEQ ID NO: 423285 - DNA, 16 bp, M. musculus
gtgtctgtctgtgtgc

SEQ ID NO: 423286 - DNA, 16 bp, M. musculus
gtgtctgtctttgtta

SEQ ID NO: 423287 - DNA, 16 bp, M. musculus
gtgtctgtgagagaga

SEQ ID NO: 423288 - DNA, 16 bp, M. musculus
gtgtctgtgagagtgt

SEQ ID NO: 423289 - DNA, 16 bp, M. musculus
gtgtctgtgagtatgt

SEQ ID NO: 423290 - DNA, 16 bp, M. musculus
gtgtctgtgtctgtgg

SEQ ID NO: 423291 - DNA, 16 bp, M. musculus
gtgtctgtgtgagtga

SEQ ID NO: 423292 - DNA, 16 bp, M. musculus
gtgtctgtgtgctcat

SEQ ID NO: 423293 - DNA, 16 bp, M. musculus
gtgtctgtgtggaggt

SEQ ID NO: 423294 - DNA, 16 bp, M. musculus
gtgtctgtgtgtccct

SEQ ID NO: 423295 - DNA, 16 bp, M. musculus
gtgtctgtgtgtgatt

SEQ ID NO: 423296 - DNA, 16 bp, M. musculus
gtgtctgtgtgtgcat

SEQ ID NO: 423297 - DNA, 16 bp, M. musculus
gtgtctgtgtgtggat

SEQ ID NO: 423298 - DNA, 16 bp, M. musculus
gtgtctgtgtgtgtga

SEQ ID NO: 423299 - DNA, 16 bp, M. musculus
gtgtctgttatgtcct

SEQ ID NO: 423300 - DNA, 16 bp, M. musculus
gtgtctgttcccagca

SEQ ID NO: 423301 - DNA, 16 bp, M. musculus
gtgtctgttcttagca

SEQ ID NO: 423302 - DNA, 16 bp, M. musculus
gtgtcttagttacttt

SEQ ID NO: 423303 - DNA, 16 bp, M. musculus
gtgtcttcagcaatag

SEQ ID NO: 423304 - DNA, 16 bp, M. musculus
gtgtcttcatcataga

SEQ ID NO: 423305 - DNA, 16 bp, M. musculus
gtgtcttcctcacctc

SEQ ID NO: 423306 - DNA, 16 bp, M. musculus
gtgtcttcctcagtca

SEQ ID NO: 423307 - DNA, 16 bp, M. musculus
gtgtcttccttgatca

SEQ ID NO: 423308 - DNA, 16 bp, M. musculus
gtgtcttgagggttag

SEQ ID NO: 423309 - DNA, 16 bp, M. musculus
gtgtcttgcctcagca

SEQ ID NO: 423310 - DNA, 16 bp, M. musculus
gtgtctttacccactg

SEQ ID NO: 423311 - DNA, 16 bp, M. musculus
gtgtctttctcagttg

SEQ ID NO: 423312 - DNA, 16 bp, M. musculus
gtgtctttctgagtct

SEQ ID NO: 423313 - DNA, 16 bp, M. musculus
gtgtctttggttttat

SEQ ID NO: 423314 - DNA, 16 bp, M. musculus
gtgtcttttgcctcac

SEQ ID NO: 423315 - DNA, 16 bp, M. musculus
gtgtgaagagtgtgtg

SEQ ID NO: 423316 - DNA, 16 bp, M. musculus
gtgtgaaggtcagagg

SEQ ID NO: 423317 - DNA, 16 bp, M. musculus
gtgtgaaggtgtcaga

SEQ ID NO: 423318 - DNA, 16 bp, M. musculus
gtgtgaatatgtgtgc

SEQ ID NO: 423319 - DNA, 16 bp, M. musculus
gtgtgaatgtgtgtgt

SEQ ID NO: 423320 - DNA, 16 bp, M. musculus
gtgtgacagtctctgg

SEQ ID NO: 423321 - DNA, 16 bp, M. musculus
gtgtgaccttgttgga

SEQ ID NO: 423322 - DNA, 16 bp, M. musculus
gtgtgacttcttcaaa

SEQ ID NO: 423323 - DNA, 16 bp, M. musculus
gtgtgagacagacaga

SEQ ID NO: 423324 - DNA, 16 bp, M. musculus
gtgtgagcagctgcct

SEQ ID NO: 423325 - DNA, 16 bp, M. musculus
gtgtgagccaccatgt

SEQ ID NO: 423326 - DNA, 16 bp, M. musculus
gtgtgagctaccacac

SEQ ID NO: 423327 - DNA, 16 bp, M. musculus
gtgtgagggtcaatat

SEQ ID NO: 423328 - DNA, 16 bp, M. musculus
gtgtgaggtagaattt

SEQ ID NO: 423329 - DNA, 16 bp, M. musculus
gtgtgaggtggagtct

SEQ ID NO: 423330 - DNA, 16 bp, M. musculus
gtgtgaggtggtatct

SEQ ID NO: 423331 - DNA, 16 bp, M. musculus
gtgtgagtgcatgtgc

SEQ ID NO: 423332 - DNA, 16 bp, M. musculus
gtgtgagtgtctgtgt

SEQ ID NO: 423333 - DNA, 16 bp, M. musculus
gtgtgagtgtgcgtgc

SEQ ID NO: 423334 - DNA, 16 bp, M. musculus
gtgtgatgtcttcagc

SEQ ID NO: 423335 - DNA, 16 bp, M. musculus
gtgtgatgtgtgtgat

SEQ ID NO: 423336 - DNA, 16 bp, M. musculus
gtgtgcaagagagaga

SEQ ID NO: 423337 - DNA, 16 bp, M. musculus
gtgtgcacaaggccct

SEQ ID NO: 423338 - DNA, 16 bp, M. musculus
gtgtgcacacacacac

SEQ ID NO: 423339 - DNA, 16 bp, M. musculus
gtgtgcacacacacgc

SEQ ID NO: 423340 - DNA, 16 bp, M. musculus
gtgtgcacacacattt

SEQ ID NO: 423341 - DNA, 16 bp, M. musculus
gtgtgcacacacgtgc

SEQ ID NO: 423342 - DNA, 16 bp, M. musculus
gtgtgcacacatgtac

SEQ ID NO: 423343 - DNA, 16 bp, M. musculus
gtgtgcacatgcacag

SEQ ID NO: 423344 - DNA, 16 bp, M. musculus
gtgtgcacatgccaca

SEQ ID NO: 423345 - DNA, 16 bp, M. musculus
gtgtgcacatgccatg

SEQ ID NO: 423346 - DNA, 16 bp, M. musculus
gtgtgcaccaccactc

SEQ ID NO: 423347 - DNA, 16 bp, M. musculus
gtgtgcaccatcatgc

SEQ ID NO: 423348 - DNA, 16 bp, M. musculus
gtgtgcaccgccatgc

SEQ ID NO: 423349 - DNA, 16 bp, M. musculus
gtgtgcactgccacac

SEQ ID NO: 423350 - DNA, 16 bp, M. musculus
gtgtgcactgccacca

SEQ ID NO: 423351 - DNA, 16 bp, M. musculus
gtgtgcagacacacac

SEQ ID NO: 423352 - DNA, 16 bp, M. musculus
gtgtgcagaggcagag

SEQ ID NO: 423353 - DNA, 17 bp, M. musculus
gtgtgcagatggcagct

SEQ ID NO: 423354 - DNA, 16 bp, M. musculus
gtgtgcagatgtacat

SEQ ID NO: 423355 - DNA, 16 bp, M. musculus
gtgtgcagatgtgcat

SEQ ID NO: 423356 - DNA, 16 bp, M. musculus
gtgtgcaggaagccac

SEQ ID NO: 423357 - DNA, 16 bp, M. musculus
gtgtgcaggtatgtat

SEQ ID NO: 423358 - DNA, 16 bp, M. musculus
gtgtgcaggtgtgcag

SEQ ID NO: 423359 - DNA, 16 bp, M. musculus
gtgtgcaggtgtgtgc

SEQ ID NO: 423360 - DNA, 16 bp, M. musculus
gtgtgcagtgcctgca

SEQ ID NO: 423361 - DNA, 16 bp, M. musculus
gtgtgcagtgtgcagt

SEQ ID NO: 423362 - DNA, 16 bp, M. musculus
gtgtgcatatgtgtac

SEQ ID NO: 423363 - DNA, 16 bp, M. musculus
gtgtgcatatgtgtgt

SEQ ID NO: 423364 - DNA, 16 bp, M. musculus
gtgtgcatcaccacac

SEQ ID NO: 423365 - DNA, 16 bp, M. musculus
gtgtgcatctgtgtga

SEQ ID NO: 423366 - DNA, 16 bp, M. musculus
gtgtgcatgaacacac

SEQ ID NO: 423367 - DNA, 16 bp, M. musculus
gtgtgcatgcatatgg

SEQ ID NO: 423368 - DNA, 16 bp, M. musculus
gtgtgcatgcatgtga

SEQ ID NO: 423369 - DNA, 17 bp, M. musculus
gtgtgcatgcctttaat

SEQ ID NO: 423370 - DNA, 16 bp, M. musculus
gtgtgcatgtctgtct

SEQ ID NO: 423371 - DNA, 16 bp, M. musculus
gtgtgcatgtgcttgt

SEQ ID NO: 423372 - DNA, 16 bp, M. musculus
gtgtgcatgtgtgagc

SEQ ID NO: 423373 - DNA, 16 bp, M. musculus
gtgtgcatgtgtgtga

SEQ ID NO: 423374 - DNA, 16 bp, M. musculus
gtgtgcatgtgttttc

SEQ ID NO: 423375 - DNA, 16 bp, M. musculus
gtgtgcatgttcacat

SEQ ID NO: 423376 - DNA, 16 bp, M. musculus
gtgtgcatgtttgtgt

SEQ ID NO: 423377 - DNA, 16 bp, M. musculus
gtgtgcattgtgtatg

SEQ ID NO: 423378 - DNA, 16 bp, M. musculus
gtgtgcatttctcatt

SEQ ID NO: 423379 - DNA, 16 bp, M. musculus
gtgtgccaccaacgcc

SEQ ID NO: 423380 - DNA, 16 bp, M. musculus
gtgtgccaccacaccc

SEQ ID NO: 423381 - DNA, 16 bp, M. musculus
gtgtgccaccaccgcc

SEQ ID NO: 423382 - DNA, 16 bp, M. musculus
gtgtgccaccacctcc

SEQ ID NO: 423383 - DNA, 16 bp, M. musculus
gtgtgccaccacgccc

SEQ ID NO: 423384 - DNA, 16 bp, M. musculus
gtgtgccaccacgcct

SEQ ID NO: 423385 - DNA, 16 bp, M. musculus
gtgtgccaccacgctc

SEQ ID NO: 423386 - DNA, 16 bp, M. musculus
gtgtgccaccactacc

SEQ ID NO: 423387 - DNA, 16 bp, M. musculus
gtgtgccaccactgcc

SEQ ID NO: 423388 - DNA, 17 bp, M. musculus
gtgtgccaccactgcct

SEQ ID NO: 423389 - DNA, 16 bp, M. musculus
gtgtgccaccactggc

SEQ ID NO: 423390 - DNA, 16 bp, M. musculus
gtgtgccaccatgccc

SEQ ID NO: 423391 - DNA, 17 bp, M. musculus
gtgtgccaccatgcctg

SEQ ID NO: 423392 - DNA, 16 bp, M. musculus
gtgtgccactacgccc

SEQ ID NO: 423393 - DNA, 16 bp, M. musculus
gtgtgccccaccccca

SEQ ID NO: 423394 - DNA, 16 bp, M. musculus
gtgtgcccccacccac

SEQ ID NO: 423395 - DNA, 16 bp, M. musculus
gtgtgcccgtgtgtgc

SEQ ID NO: 423396 - DNA, 16 bp, M. musculus
gtgtgccctgtgtgtg

SEQ ID NO: 423397 - DNA, 16 bp, M. musculus
gtgtgcctccctcaga

SEQ ID NO: 423398 - DNA, 16 bp, M. musculus
gtgtgcctgaaaacag

SEQ ID NO: 423399 - DNA, 16 bp, M. musculus
gtgtgcctgtatgtgt

SEQ ID NO: 423400 - DNA, 16 bp, M. musculus
gtgtgcctgtgcctgt

SEQ ID NO: 423401 - DNA, 16 bp, M. musculus
gtgtgcctgtgtgtag

SEQ ID NO: 423402 - DNA, 16 bp, M. musculus
gtgtgccttgtgtgtg

SEQ ID NO: 423403 - DNA, 16 bp, M. musculus
gtgtgcgcacacgcat

SEQ ID NO: 423404 - DNA, 16 bp, M. musculus
gtgtgcgcacatgcac

SEQ ID NO: 423405 - DNA, 16 bp, M. musculus
gtgtgcgccaccactt

SEQ ID NO: 423406 - DNA, 16 bp, M. musculus
gtgtgcgccaccatgc

SEQ ID NO: 423407 - DNA, 16 bp, M. musculus
gtgtgcgccactactg

SEQ ID NO: 423408 - DNA, 16 bp, M. musculus
gtgtgcgcgcacacat

SEQ ID NO: 423409 - DNA, 16 bp, M. musculus
gtgtgcgcgcgcacgc

SEQ ID NO: 423410 - DNA, 16 bp, M. musculus
gtgtgcgcgcgtgcgc

SEQ ID NO: 423411 - DNA, 16 bp, M. musculus
gtgtgcgcgtgtatgt

SEQ ID NO: 423412 - DNA, 16 bp, M. musculus
gtgtgcgtgcacacat

SEQ ID NO: 423413 - DNA, 16 bp, M. musculus
gtgtgcgtgcgtgcac

SEQ ID NO: 423414 - DNA, 16 bp, M. musculus
gtgtgcgtgcgtgtgc

SEQ ID NO: 423415 - DNA, 16 bp, M. musculus
gtgtgcgtgtgcgcac

SEQ ID NO: 423416 - DNA, 18 bp, M. musculus
gtgtgcgtgtgtgcatgt

SEQ ID NO: 423417 - DNA, 16 bp, M. musculus
gtgtgcgtgtgtgtct

SEQ ID NO: 423418 - DNA, 16 bp, M. musculus
gtgtgctatgagggcc

SEQ ID NO: 423419 - DNA, 16 bp, M. musculus
gtgtgctcctggctgg

SEQ ID NO: 423420 - DNA, 16 bp, M. musculus
gtgtgctctgtctagt

SEQ ID NO: 423421 - DNA, 16 bp, M. musculus
gtgtgctgaatctgaa

SEQ ID NO: 423422 - DNA, 16 bp, M. musculus
gtgtgctgcagtttct

SEQ ID NO: 423423 - DNA, 16 bp, M. musculus
gtgtgctgctgctgct

SEQ ID NO: 423424 - DNA, 16 bp, M. musculus
gtgtgctggcacatgc

SEQ ID NO: 423425 - DNA, 16 bp, M. musculus
gtgtgctggctggttt

SEQ ID NO: 423426 - DNA, 16 bp, M. musculus
gtgtgctgggaactga

SEQ ID NO: 423427 - DNA, 16 bp, M. musculus
gtgtgctgggatcaca

SEQ ID NO: 423428 - DNA, 16 bp, M. musculus
gtgtgctgtcaaactg

SEQ ID NO: 423429 - DNA, 16 bp, M. musculus
gtgtgctgtctgtctg

SEQ ID NO: 423430 - DNA, 16 bp, M. musculus
gtgtgctttattgtgt

SEQ ID NO: 423431 - DNA, 16 bp, M. musculus
gtgtgctttctctagt

SEQ ID NO: 423432 - DNA, 16 bp, M. musculus
gtgtggaacacagagg

SEQ ID NO: 423433 - DNA, 16 bp, M. musculus
gtgtggaagtgtgtgt

SEQ ID NO: 423434 - DNA, 16 bp, M. musculus
gtgtggacagagggat

SEQ ID NO: 423435 - DNA, 16 bp, M. musculus
gtgtggacatgccaca

SEQ ID NO: 423436 - DNA, 16 bp, M. musculus
gtgtggacctgggcat

SEQ ID NO: 423437 - DNA, 16 bp, M. musculus
gtgtggagcagggact

SEQ ID NO: 423438 - DNA, 16 bp, M. musculus
gtgtggaggtcagatg

SEQ ID NO: 423439 - DNA, 16 bp, M. musculus
gtgtggatatgtatgt

SEQ ID NO: 423440 - DNA, 16 bp, M. musculus
gtgtggatgcttcaat

SEQ ID NO: 423441 - DNA, 16 bp, M. musculus
gtgtggatgtgtggat

SEQ ID NO: 423442 - DNA, 16 bp, M. musculus
gtgtggcaagcacctt

SEQ ID NO: 423443 - DNA, 16 bp, M. musculus
gtgtggcagcagtccc

SEQ ID NO: 423444 - DNA, 16 bp, M. musculus
gtgtggcagtctctgg

SEQ ID NO: 423445 - DNA, 16 bp, M. musculus
gtgtggcatgtgttcc

SEQ ID NO: 423446 - DNA, 16 bp, M. musculus
gtgtggccatattgga

SEQ ID NO: 423447 - DNA, 16 bp, M. musculus
gtgtggccctggggcc

SEQ ID NO: 423448 - DNA, 16 bp, M. musculus
gtgtggcctcgttgga

SEQ ID NO: 423449 - DNA, 16 bp, M. musculus
gtgtggccttattgga

SEQ ID NO: 423450 - DNA, 16 bp, M. musculus
gtgtggccttgatgga

SEQ ID NO: 423451 - DNA, 16 bp, M. musculus
gtgtggccttggagtg

SEQ ID NO: 423452 - DNA, 16 bp, M. musculus
gtgtggccttgttgga

SEQ ID NO: 423453 - DNA, 16 bp, M. musculus
gtgtggctatcagtca

SEQ ID NO: 423454 - DNA, 16 bp, M. musculus
gtgtggctctggctgt

SEQ ID NO: 423455 - DNA, 16 bp, M. musculus
gtgtggctgtcctctg

SEQ ID NO: 423456 - DNA, 30 bp, M. musculus
gtgtggcttggcatgctagagaagtagtca

SEQ ID NO: 423457 - DNA, 16 bp, M. musculus
gtgtggctttgttgga

SEQ ID NO: 423458 - DNA, 16 bp, M. musculus
gtgtgggaggagacag

SEQ ID NO: 423459 - DNA, 16 bp, M. musculus
gtgtgggcactgggaa

SEQ ID NO: 423460 - DNA, 20 bp, M. musculus
gtgtgggcccttgcgggtgt

SEQ ID NO: 423461 - DNA, 16 bp, M. musculus
gtgtgggctacagaag

SEQ ID NO: 423462 - DNA, 17 bp, M. musculus
gtgtgggctcagtgtgg

SEQ ID NO: 423463 - DNA, 16 bp, M. musculus
gtgtggggagcaggtg

SEQ ID NO: 423464 - DNA, 16 bp, M. musculus
gtgtggggcatgcaga

SEQ ID NO: 423465 - DNA, 16 bp, M. musculus
gtgtgggtgctaggaa

SEQ ID NO: 423466 - DNA, 16 bp, M. musculus
gtgtgggtgctgagaa

SEQ ID NO: 423467 - DNA, 16 bp, M. musculus
gtgtgggtggcccgtg

SEQ ID NO: 423468 - DNA, 16 bp, M. musculus
gtgtgggttccagaga

SEQ ID NO: 423469 - DNA, 16 bp, M. musculus
gtgtggtagcacacat

SEQ ID NO: 423470 - DNA, 16 bp, M. musculus
gtgtggtcctgttgga

SEQ ID NO: 423471 - DNA, 16 bp, M. musculus
gtgtggtcttactgga

SEQ ID NO: 423472 - DNA, 16 bp, M. musculus
gtgtggtcttgctgga

SEQ ID NO: 423473 - DNA, 16 bp, M. musculus
gtgtggtcttgtagga

SEQ ID NO: 423474 - DNA, 16 bp, M. musculus
gtgtggtgatgcacac

SEQ ID NO: 423475 - DNA, 16 bp, M. musculus
gtgtggtggagcacac

SEQ ID NO: 423476 - DNA, 18 bp, M. musculus
gtgtggtggcacactcct

SEQ ID NO: 423477 - DNA, 16 bp, M. musculus
gtgtggtggccagtgg

SEQ ID NO: 423478 - DNA, 16 bp, M. musculus
gtgtggtggcgcatgc

SEQ ID NO: 423479 - DNA, 16 bp, M. musculus
gtgtggtggggcacac

SEQ ID NO: 423480 - DNA, 16 bp, M. musculus
gtgtggtggtacatgc

SEQ ID NO: 423481 - DNA, 16 bp, M. musculus
gtgtggtggtgcactc

SEQ ID NO: 423482 - DNA, 16 bp, M. musculus
gtgtggtgtctgctga

SEQ ID NO: 423483 - DNA, 16 bp, M. musculus
gtgtggttatttctca

SEQ ID NO: 423484 - DNA, 16 bp, M. musculus
gtgtgtaaacacacac

SEQ ID NO: 423485 - DNA, 16 bp, M. musculus
gtgtgtaatatatgta

SEQ ID NO: 423486 - DNA, 16 bp, M. musculus
gtgtgtacatgtatat

SEQ ID NO: 423487 - DNA, 16 bp, M. musculus
gtgtgtacatgtgagc

SEQ ID NO: 423488 - DNA, 16 bp, M. musculus
gtgtgtaccaccaggc

SEQ ID NO: 423489 - DNA, 16 bp, M. musculus
gtgtgtaccatcacac

SEQ ID NO: 423490 - DNA, 16 bp, M. musculus
gtgtgtacccatgtgt

SEQ ID NO: 423491 - DNA, 16 bp, M. musculus
gtgtgtagcagtggga

SEQ ID NO: 423492 - DNA, 16 bp, M. musculus
gtgtgtagctcagtgg

SEQ ID NO: 423493 - DNA, 16 bp, M. musculus
gtgtgtaggctttctg

SEQ ID NO: 423494 - DNA, 16 bp, M. musculus
gtgtgtataaatgtat

SEQ ID NO: 423495 - DNA, 16 bp, M. musculus
gtgtgtatacaaatat

SEQ ID NO: 423496 - DNA, 16 bp, M. musculus
gtgtgtatacctgtgt

SEQ ID NO: 423497 - DNA, 16 bp, M. musculus
gtgtgtatatatacaa

SEQ ID NO: 423498 - DNA, 16 bp, M. musculus
gtgtgtatatatatga

SEQ ID NO: 423499 - DNA, 16 bp, M. musculus
gtgtgtatatatgtat

SEQ ID NO: 423500 - DNA, 16 bp, M. musculus
gtgtgtatatgtgtga

SEQ ID NO: 423501 - DNA, 17 bp, M. musculus
gtgtgtatatgtgtgta

SEQ ID NO: 423502 - DNA, 16 bp, M. musculus
gtgtgtatctgcatgt

SEQ ID NO: 423503 - DNA, 16 bp, M. musculus
gtgtgtatgaagacag

SEQ ID NO: 423504 - DNA, 16 bp, M. musculus
gtgtgtatgagtgtat

SEQ ID NO: 423505 - DNA, 16 bp, M. musculus
gtgtgtatgcacatgc

SEQ ID NO: 423506 - DNA, 16 bp, M. musculus
gtgtgtatgggtgtgc

SEQ ID NO: 423507 - DNA, 16 bp, M. musculus
gtgtgtatggtgcatg

SEQ ID NO: 423508 - DNA, 16 bp, M. musculus
gtgtgtatgtaatata

SEQ ID NO: 423509 - DNA, 16 bp, M. musculus
gtgtgtatgtatgaga

SEQ ID NO: 423510 - DNA, 16 bp, M. musculus
gtgtgtatgtatgtca

SEQ ID NO: 423511 - DNA, 16 bp, M. musculus
gtgtgtatgtatgtgc

SEQ ID NO: 423512 - DNA, 16 bp, M. musculus
gtgtgtatgtgagtga

SEQ ID NO: 423513 - DNA, 16 bp, M. musculus
gtgtgtatgtggtgta

SEQ ID NO: 423514 - DNA, 16 bp, M. musculus
gtgtgtatgtgtaaaa

SEQ ID NO: 423515 - DNA, 16 bp, M. musculus
gtgtgtatgtgtaaac

SEQ ID NO: 423516 - DNA, 16 bp, M. musculus
gtgtgtatgtgtatct

SEQ ID NO: 423517 - DNA, 16 bp, M. musculus
gtgtgtatgtgtgaga

SEQ ID NO: 423518 - DNA, 16 bp, M. musculus
gtgtgtatgtgtgtcc

SEQ ID NO: 423519 - DNA, 16 bp, M. musculus
gtgtgtatgtgtgtgc

SEQ ID NO: 423520 - DNA, 16 bp, M. musculus
gtgtgtatgtgttcgt

SEQ ID NO: 423521 - DNA, 16 bp, M. musculus
gtgtgtattatgtatg

SEQ ID NO: 423522 - DNA, 16 bp, M. musculus
gtgtgtatttatatgt

SEQ ID NO: 423523 - DNA, 16 bp, M. musculus
gtgtgtcactggaggg

SEQ ID NO: 423524 - DNA, 16 bp, M. musculus
gtgtgtcactggggtg

SEQ ID NO: 423525 - DNA, 16 bp, M. musculus
gtgtgtcactgtgaag

SEQ ID NO: 423526 - DNA, 16 bp, M. musculus
gtgtgtcactgtgtag

SEQ ID NO: 423527 - DNA, 16 bp, M. musculus
gtgtgtccatgtgtgt

SEQ ID NO: 423528 - DNA, 16 bp, M. musculus
gtgtgtccatgtttgt

SEQ ID NO: 423529 - DNA, 16 bp, M. musculus
gtgtgtccccatgtgt

SEQ ID NO: 423530 - DNA, 16 bp, M. musculus
gtgtgtccctgtgtgt

SEQ ID NO: 423531 - DNA, 16 bp, M. musculus
gtgtgtcctgaagaga

SEQ ID NO: 423532 - DNA, 16 bp, M. musculus
gtgtgtcctgtgtgtg

SEQ ID NO: 423533 - DNA, 16 bp, M. musculus
gtgtgtcgctgtgggt

SEQ ID NO: 423534 - DNA, 16 bp, M. musculus
gtgtgtctatgtgcat

SEQ ID NO: 423535 - DNA, 16 bp, M. musculus
gtgtgtctctgattct

SEQ ID NO: 423536 - DNA, 16 bp, M. musculus
gtgtgtctctgtgtgg

SEQ ID NO: 423537 - DNA, 16 bp, M. musculus
gtgtgtctgaaaatag

SEQ ID NO: 423538 - DNA, 16 bp, M. musculus
gtgtgtctgaaagcag

SEQ ID NO: 423539 - DNA, 16 bp, M. musculus
gtgtgtctgaaatcag

SEQ ID NO: 423540 - DNA, 16 bp, M. musculus
gtgtgtctgaacacag

SEQ ID NO: 423541 - DNA, 17 bp, M. musculus
gtgtgtctgaagacaga

SEQ ID NO: 423542 - DNA, 16 bp, M. musculus
gtgtgtctgaagacat

SEQ ID NO: 423543 - DNA, 16 bp, M. musculus
gtgtgtctgaagagag

SEQ ID NO: 423544 - DNA, 16 bp, M. musculus
gtgtgtctgaagtcaa

SEQ ID NO: 423545 - DNA, 16 bp, M. musculus
gtgtgtctgaatatag

SEQ ID NO: 423546 - DNA, 16 bp, M. musculus
gtgtgtctgcacatgt

SEQ ID NO: 423547 - DNA, 16 bp, M. musculus
gtgtgtctgcctgcct

SEQ ID NO: 423548 - DNA, 16 bp, M. musculus
gtgtgtctgcgtgtgt

SEQ ID NO: 423549 - DNA, 16 bp, M. musculus
gtgtgtctgctgtgtg

SEQ ID NO: 423550 - DNA, 16 bp, M. musculus
gtgtgtctggaaacag

SEQ ID NO: 423551 - DNA, 16 bp, M. musculus
gtgtgtctggagacag

SEQ ID NO: 423552 - DNA, 16 bp, M. musculus
gtgtgtctggagagag

SEQ ID NO: 423553 - DNA, 16 bp, M. musculus
gtgtgtctggagatag

SEQ ID NO: 423554 - DNA, 16 bp, M. musculus
gtgtgtctgtgtactt

SEQ ID NO: 423555 - DNA, 16 bp, M. musculus
gtgtgtctgtgtgaag

SEQ ID NO: 423556 - DNA, 16 bp, M. musculus
gtgtgtctgtgtggag

SEQ ID NO: 423557 - DNA, 16 bp, M. musculus
gtgtgtctgtgtgtcc

SEQ ID NO: 423558 - DNA, 16 bp, M. musculus
gtgtgtctgtgtgtgc

SEQ ID NO: 423559 - DNA, 16 bp, M. musculus
gtgtgtctgtgtttgc

SEQ ID NO: 423560 - DNA, 16 bp, M. musculus
gtgtgtgaatatgtga

SEQ ID NO: 423561 - DNA, 16 bp, M. musculus
gtgtgtgaatgtaata

SEQ ID NO: 423562 - DNA, 16 bp, M. musculus
gtgtgtgaatgtatgt

SEQ ID NO: 423563 - DNA, 16 bp, M. musculus
gtgtgtgaatgtggag

SEQ ID NO: 423564 - DNA, 16 bp, M. musculus
gtgtgtgaatgtgggt

SEQ ID NO: 423565 - DNA, 16 bp, M. musculus
gtgtgtgactctgtgt

SEQ ID NO: 423566 - DNA, 16 bp, M. musculus
gtgtgtgagaagacag

SEQ ID NO: 423567 - DNA, 16 bp, M. musculus
gtgtgtgagagagaag

SEQ ID NO: 423568 - DNA, 16 bp, M. musculus
gtgtgtgagagagtgt

SEQ ID NO: 423569 - DNA, 16 bp, M. musculus
gtgtgtgagtgtgggc

SEQ ID NO: 423570 - DNA, 16 bp, M. musculus
gtgtgtgatatgtggt

SEQ ID NO: 423571 - DNA, 16 bp, M. musculus
gtgtgtgatgctgctg

SEQ ID NO: 423572 - DNA, 16 bp, M. musculus
gtgtgtgcaatggtgt

SEQ ID NO: 423573 - DNA, 16 bp, M. musculus
gtgtgtgcacacgtgt

SEQ ID NO: 423574 - DNA, 16 bp, M. musculus
gtgtgtgcacagacac

SEQ ID NO: 423575 - DNA, 16 bp, M. musculus
gtgtgtgcacatgcgc

SEQ ID NO: 423576 - DNA, 16 bp, M. musculus
gtgtgtgcacatggat

SEQ ID NO: 423577 - DNA, 16 bp, M. musculus
gtgtgtgcacctgtgg

SEQ ID NO: 423578 - DNA, 16 bp, M. musculus
gtgtgtgcacctgtgt

SEQ ID NO: 423579 - DNA, 16 bp, M. musculus
gtgtgtgcacgtgcac

SEQ ID NO: 423580 - DNA, 16 bp, M. musculus
gtgtgtgcactcacac

SEQ ID NO: 423581 - DNA, 16 bp, M. musculus
gtgtgtgcaggtacat

SEQ ID NO: 423582 - DNA, 16 bp, M. musculus
gtgtgtgcaggtgcct

SEQ ID NO: 423583 - DNA, 16 bp, M. musculus
gtgtgtgcagtggtgt

SEQ ID NO: 423584 - DNA, 16 bp, M. musculus
gtgtgtgcagtgtcca

SEQ ID NO: 423585 - DNA, 16 bp, M. musculus
gtgtgtgcagtgtgta

SEQ ID NO: 423586 - DNA, 16 bp, M. musculus
gtgtgtgcatctgtgc

SEQ ID NO: 423587 - DNA, 16 bp, M. musculus
gtgtgtgcatgcaagt

SEQ ID NO: 423588 - DNA, 16 bp, M. musculus
gtgtgtgcatgcgtgc

SEQ ID NO: 423589 - DNA, 16 bp, M. musculus
gtgtgtgcatgctcat

SEQ ID NO: 423590 - DNA, 16 bp, M. musculus
gtgtgtgcatgtgctt

SEQ ID NO: 423591 - DNA, 16 bp, M. musculus
gtgtgtgcatgtgtga

SEQ ID NO: 423592 - DNA, 16 bp, M. musculus
gtgtgtgcatgtgtgc

SEQ ID NO: 423593 - DNA, 16 bp, M. musculus
gtgtgtgcatgtttgc

SEQ ID NO: 423594 - DNA, 16 bp, M. musculus
gtgtgtgcatgttttg

SEQ ID NO: 423595 - DNA, 16 bp, M. musculus
gtgtgtgccaccaagc

SEQ ID NO: 423596 - DNA, 16 bp, M. musculus
gtgtgtgccaccatgt

SEQ ID NO: 423597 - DNA, 16 bp, M. musculus
gtgtgtgccatgtgca

SEQ ID NO: 423598 - DNA, 16 bp, M. musculus
gtgtgtgcccatatgt

SEQ ID NO: 423599 - DNA, 16 bp, M. musculus
gtgtgtgcccatgcat

SEQ ID NO: 423600 - DNA, 16 bp, M. musculus
gtgtgtgcccatgtgt

SEQ ID NO: 423601 - DNA, 16 bp, M. musculus
gtgtgtgcctgcagag

SEQ ID NO: 423602 - DNA, 16 bp, M. musculus
gtgtgtgcctgcctgt

SEQ ID NO: 423603 - DNA, 16 bp, M. musculus
gtgtgtgcctgcttgt

SEQ ID NO: 423604 - DNA, 16 bp, M. musculus
gtgtgtgcctggtacc

SEQ ID NO: 423605 - DNA, 16 bp, M. musculus
gtgtgtgcgcacatgt

SEQ ID NO: 423606 - DNA, 16 bp, M. musculus
gtgtgtgcgcatgtgc

SEQ ID NO: 423607 - DNA, 16 bp, M. musculus
gtgtgtgcgcgcacgt

SEQ ID NO: 423608 - DNA, 16 bp, M. musculus
gtgtgtgcgcgcgcct

SEQ ID NO: 423609 - DNA, 17 bp, M. musculus
gtgtgtgcgcgcgcgct

SEQ ID NO: 423610 - DNA, 16 bp, M. musculus
gtgtgtgcgcgcgtgt

SEQ ID NO: 423611 - DNA, 16 bp, M. musculus
gtgtgtgcgcgtgcat

SEQ ID NO: 423612 - DNA, 16 bp, M. musculus
gtgtgtgcgcgtgcgc

SEQ ID NO: 423613 - DNA, 16 bp, M. musculus
gtgtgtgcgcgtgtgt

SEQ ID NO: 423614 - DNA, 16 bp, M. musculus
gtgtgtgcgtgtgcgc

SEQ ID NO: 423615 - DNA, 16 bp, M. musculus
gtgtgtgcgtgtgtct

SEQ ID NO: 423616 - DNA, 16 bp, M. musculus
gtgtgtgctaccatgc

SEQ ID NO: 423617 - DNA, 16 bp, M. musculus
gtgtgtgctcatgtga

SEQ ID NO: 423618 - DNA, 16 bp, M. musculus
gtgtgtgctctctgta

SEQ ID NO: 423619 - DNA, 16 bp, M. musculus
gtgtgtgctgtgacat

SEQ ID NO: 423620 - DNA, 16 bp, M. musculus
gtgtgtgctgtgtgct

SEQ ID NO: 423621 - DNA, 16 bp, M. musculus
gtgtgtgcttgtggag

SEQ ID NO: 423622 - DNA, 16 bp, M. musculus
gtgtgtggactacaga

SEQ ID NO: 423623 - DNA, 16 bp, M. musculus
gtgtgtggaggccagg

SEQ ID NO: 423624 - DNA, 16 bp, M. musculus
gtgtgtggatatgtgc

SEQ ID NO: 423625 - DNA, 16 bp, M. musculus
gtgtgtggcatgtgtg

SEQ ID NO: 423626 - DNA, 16 bp, M. musculus
gtgtgtggctccacag

SEQ ID NO: 423627 - DNA, 16 bp, M. musculus
gtgtgtgggtatatgt

SEQ ID NO: 423628 - DNA, 16 bp, M. musculus
gtgtgtggtatatgtt

SEQ ID NO: 423629 - DNA, 16 bp, M. musculus
gtgtgtggtgtgcaca

SEQ ID NO: 423630 - DNA, 16 bp, M. musculus
gtgtgtggtgttttca

SEQ ID NO: 423631 - DNA, 16 bp, M. musculus
gtgtgtgtaattttaa

SEQ ID NO: 423632 - DNA, 16 bp, M. musculus
gtgtgtgtacacactg

SEQ ID NO: 423633 - DNA, 16 bp, M. musculus
gtgtgtgtacacatgc

SEQ ID NO: 423634 - DNA, 16 bp, M. musculus
gtgtgtgtacacgtgt

SEQ ID NO: 423635 - DNA, 16 bp, M. musculus
gtgtgtgtacactgga

SEQ ID NO: 423636 - DNA, 16 bp, M. musculus
gtgtgtgtacactgta

SEQ ID NO: 423637 - DNA, 16 bp, M. musculus
gtgtgtgtacatattc

SEQ ID NO: 423638 - DNA, 16 bp, M. musculus
gtgtgtgtacatgcct

SEQ ID NO: 423639 - DNA, 16 bp, M. musculus
gtgtgtgtacgtgtgc

SEQ ID NO: 423640 - DNA, 16 bp, M. musculus
gtgtgtgtaggtgcac

SEQ ID NO: 423641 - DNA, 16 bp, M. musculus
gtgtgtgtataaatgt

SEQ ID NO: 423642 - DNA, 16 bp, M. musculus
gtgtgtgtataatatt

SEQ ID NO: 423643 - DNA, 16 bp, M. musculus
gtgtgtgtatacaaat

SEQ ID NO: 423644 - DNA, 16 bp, M. musculus
gtgtgtgtatacacat

SEQ ID NO: 423645 - DNA, 16 bp, M. musculus
gtgtgtgtataggtgt

SEQ ID NO: 423646 - DNA, 16 bp, M. musculus
gtgtgtgtatatatgt

SEQ ID NO: 423647 - DNA, 16 bp, M. musculus
gtgtgtgtatgaaata

SEQ ID NO: 423648 - DNA, 16 bp, M. musculus
gtgtgtgtatgagaca

SEQ ID NO: 423649 - DNA, 16 bp, M. musculus
gtgtgtgtatgatgtg

SEQ ID NO: 423650 - DNA, 16 bp, M. musculus
gtgtgtgtatgctgtg

SEQ ID NO: 423651 - DNA, 16 bp, M. musculus
gtgtgtgtatgtactg

SEQ ID NO: 423652 - DNA, 16 bp, M. musculus
gtgtgtgtatgtatgt

SEQ ID NO: 423653 - DNA, 16 bp, M. musculus
gtgtgtgtatgtgaga

SEQ ID NO: 423654 - DNA, 16 bp, M. musculus
gtgtgtgtatgtgtgc

SEQ ID NO: 423655 - DNA, 16 bp, M. musculus
gtgtgtgtattaaaat

SEQ ID NO: 423656 - DNA, 16 bp, M. musculus
gtgtgtgtattttaaa

SEQ ID NO: 423657 - DNA, 16 bp, M. musculus
gtgtgtgtcagaggac

SEQ ID NO: 423658 - DNA, 16 bp, M. musculus
gtgtgtgtcatgtgtg

SEQ ID NO: 423659 - DNA, 16 bp, M. musculus
gtgtgtgtccgtgtgt

SEQ ID NO: 423660 - DNA, 16 bp, M. musculus
gtgtgtgtccttgtgt

SEQ ID NO: 423661 - DNA, 16 bp, M. musculus
gtgtgtgtctgagaga

SEQ ID NO: 423662 - DNA, 16 bp, M. musculus
gtgtgtgtctgcctgc

SEQ ID NO: 423663 - DNA, 16 bp, M. musculus
gtgtgtgtctgcgtgc

SEQ ID NO: 423664 - DNA, 16 bp, M. musculus
gtgtgtgtctgtatat

SEQ ID NO: 423665 - DNA, 17 bp, M. musculus
gtgtgtgtctgtctgtg

SEQ ID NO: 423666 - DNA, 16 bp, M. musculus
gtgtgtgtctgtgcac

SEQ ID NO: 423667 - DNA, 16 bp, M. musculus
gtgtgtgtctgtgctt

SEQ ID NO: 423668 - DNA, 16 bp, M. musculus
gtgtgtgtctgtgtga

SEQ ID NO: 423669 - DNA, 17 bp, M. musculus
gtgtgtgtctgtgtgcg

SEQ ID NO: 423670 - DNA, 16 bp, M. musculus
gtgtgtgtgaagacaa

SEQ ID NO: 423671 - DNA, 16 bp, M. musculus
gtgtgtgtgaatgaag

SEQ ID NO: 423672 - DNA, 16 bp, M. musculus
gtgtgtgtgaatgcaa

SEQ ID NO: 423673 - DNA, 16 bp, M. musculus
gtgtgtgtgacacaca

SEQ ID NO: 423674 - DNA, 16 bp, M. musculus
gtgtgtgtgagaaaga

SEQ ID NO: 423675 - DNA, 16 bp, M. musculus
gtgtgtgtgagaccat

SEQ ID NO: 423676 - DNA, 16 bp, M. musculus
gtgtgtgtgagagagt

SEQ ID NO: 423677 - DNA, 16 bp, M. musculus
gtgtgtgtgagtgagc

SEQ ID NO: 423678 - DNA, 16 bp, M. musculus
gtgtgtgtgagtgtga

SEQ ID NO: 423679 - DNA, 16 bp, M. musculus
gtgtgtgtgagtgtgc

SEQ ID NO: 423680 - DNA, 16 bp, M. musculus
gtgtgtgtgcaagtgt

SEQ ID NO: 423681 - DNA, 16 bp, M. musculus
gtgtgtgtgcacagac

SEQ ID NO: 423682 - DNA, 16 bp, M. musculus
gtgtgtgtgcacaggt

SEQ ID NO: 423683 - DNA, 16 bp, M. musculus
gtgtgtgtgcacataa

SEQ ID NO: 423684 - DNA, 16 bp, M. musculus
gtgtgtgtgcacctgc

SEQ ID NO: 423685 - DNA, 16 bp, M. musculus
gtgtgtgtgcactcac

SEQ ID NO: 423686 - DNA, 16 bp, M. musculus
gtgtgtgtgcactcat

SEQ ID NO: 423687 - DNA, 16 bp, M. musculus
gtgtgtgtgcacttgc

SEQ ID NO: 423688 - DNA, 16 bp, M. musculus
gtgtgtgtgcacttgt

SEQ ID NO: 423689 - DNA, 16 bp, M. musculus
gtgtgtgtgcagaggc

SEQ ID NO: 423690 - DNA, 16 bp, M. musculus
gtgtgtgtgcaggtgt

SEQ ID NO: 423691 - DNA, 16 bp, M. musculus
gtgtgtgtgcagtgcc

SEQ ID NO: 423692 - DNA, 16 bp, M. musculus
gtgtgtgtgcatatat

SEQ ID NO: 423693 - DNA, 16 bp, M. musculus
gtgtgtgtgcatcttt

SEQ ID NO: 423694 - DNA, 16 bp, M. musculus
gtgtgtgtgcatgcgc

SEQ ID NO: 423695 - DNA, 16 bp, M. musculus
gtgtgtgtgcatgggg

SEQ ID NO: 423696 - DNA, 16 bp, M. musculus
gtgtgtgtgcatgtgc

SEQ ID NO: 423697 - DNA, 16 bp, M. musculus
gtgtgtgtgcatgtgg

SEQ ID NO: 423698 - DNA, 16 bp, M. musculus
gtgtgtgtgcctgctg

SEQ ID NO: 423699 - DNA, 16 bp, M. musculus
gtgtgtgtgcctgtgg

SEQ ID NO: 423700 - DNA, 16 bp, M. musculus
gtgtgtgtgcgcatgt

SEQ ID NO: 423701 - DNA, 18 bp, M. musculus
gtgtgtgtgcgcgcacac

SEQ ID NO: 423702 - DNA, 16 bp, M. musculus
gtgtgtgtgcgtgcgc

SEQ ID NO: 423703 - DNA, 16 bp, M. musculus
gtgtgtgtgcgtgtgc

SEQ ID NO: 423704 - DNA, 16 bp, M. musculus
gtgtgtgtgctgggat

SEQ ID NO: 423705 - DNA, 16 bp, M. musculus
gtgtgtgtggcatgtg

SEQ ID NO: 423706 - DNA, 16 bp, M. musculus
gtgtgtgtgtaaaaca

SEQ ID NO: 423707 - DNA, 16 bp, M. musculus
gtgtgtgtgtaacaca

SEQ ID NO: 423708 - DNA, 16 bp, M. musculus
gtgtgtgtgtaacagt

SEQ ID NO: 423709 - DNA, 16 bp, M. musculus
gtgtgtgtgtaacttt

SEQ ID NO: 423710 - DNA, 16 bp, M. musculus
gtgtgtgtgtaagagg

SEQ ID NO: 423711 - DNA, 16 bp, M. musculus
gtgtgtgtgtaagtgc

SEQ ID NO: 423712 - DNA, 16 bp, M. musculus
gtgtgtgtgtaatggt

SEQ ID NO: 423713 - DNA, 16 bp, M. musculus
gtgtgtgtgtacagag

SEQ ID NO: 423714 - DNA, 16 bp, M. musculus
gtgtgtgtgtagacag

SEQ ID NO: 423715 - DNA, 16 bp, M. musculus
gtgtgtgtgtagatgt

SEQ ID NO: 423716 - DNA, 16 bp, M. musculus
gtgtgtgtgtaggagc

SEQ ID NO: 423717 - DNA, 16 bp, M. musculus
gtgtgtgtgtaggcac

SEQ ID NO: 423718 - DNA, 16 bp, M. musculus
gtgtgtgtgtataaga

SEQ ID NO: 423719 - DNA, 16 bp, M. musculus
gtgtgtgtgtatcatt

SEQ ID NO: 423720 - DNA, 16 bp, M. musculus
gtgtgtgtgtatctca

SEQ ID NO: 423721 - DNA, 16 bp, M. musculus
gtgtgtgtgtatgaaa

SEQ ID NO: 423722 - DNA, 17 bp, M. musculus
gtgtgtgtgtatgagta

SEQ ID NO: 423723 - DNA, 16 bp, M. musculus
gtgtgtgtgtatgcat

SEQ ID NO: 423724 - DNA, 16 bp, M. musculus
gtgtgtgtgtatgcga

SEQ ID NO: 423725 - DNA, 16 bp, M. musculus
gtgtgtgtgtatgtga

SEQ ID NO: 423726 - DNA, 16 bp, M. musculus
gtgtgtgtgtcaggaa

SEQ ID NO: 423727 - DNA, 16 bp, M. musculus
gtgtgtgtgtcagggg

SEQ ID NO: 423728 - DNA, 16 bp, M. musculus
gtgtgtgtgtccatcc

SEQ ID NO: 423729 - DNA, 16 bp, M. musculus
gtgtgtgtgtcctctg

SEQ ID NO: 423730 - DNA, 16 bp, M. musculus
gtgtgtgtgtccttgc

SEQ ID NO: 423731 - DNA, 16 bp, M. musculus
gtgtgtgtgtctggta

SEQ ID NO: 423732 - DNA, 16 bp, M. musculus
gtgtgtgtgtcttgta

SEQ ID NO: 423733 - DNA, 16 bp, M. musculus
gtgtgtgtgtgaagcc

SEQ ID NO: 423734 - DNA, 16 bp, M. musculus
gtgtgtgtgtgacctt

SEQ ID NO: 423735 - DNA, 22 bp, M. musculus
gtgtgtgtgtgagagagagaca

SEQ ID NO: 423736 - DNA, 16 bp, M. musculus
gtgtgtgtgtgatcag

SEQ ID NO: 423737 - DNA, 16 bp, M. musculus
gtgtgtgtgtgatgag

SEQ ID NO: 423738 - DNA, 16 bp, M. musculus
gtgtgtgtgtgatgct

SEQ ID NO: 423739 - DNA, 16 bp, M. musculus
gtgtgtgtgtgatgta

SEQ ID NO: 423740 - DNA, 16 bp, M. musculus
gtgtgtgtgtgcaaat

SEQ ID NO: 423741 - DNA, 16 bp, M. musculus
gtgtgtgtgtgcaagg

SEQ ID NO: 423742 - DNA, 17 bp, M. musculus
gtgtgtgtgtgcacatt

SEQ ID NO: 423743 - DNA, 16 bp, M. musculus
gtgtgtgtgtgcagaa

SEQ ID NO: 423744 - DNA, 16 bp, M. musculus
gtgtgtgtgtgcagga

SEQ ID NO: 423745 - DNA, 16 bp, M. musculus
gtgtgtgtgtgcatat

SEQ ID NO: 423746 - DNA, 18 bp, M. musculus
gtgtgtgtgtgcatatgt

SEQ ID NO: 423747 - DNA, 16 bp, M. musculus
gtgtgtgtgtgcatgc

SEQ ID NO: 423748 - DNA, 16 bp, M. musculus
gtgtgtgtgtgccatg

SEQ ID NO: 423749 - DNA, 16 bp, M. musculus
gtgtgtgtgtgcccct

SEQ ID NO: 423750 - DNA, 16 bp, M. musculus
gtgtgtgtgtgcgcaa

SEQ ID NO: 423751 - DNA, 16 bp, M. musculus
gtgtgtgtgtgcgcac

SEQ ID NO: 423752 - DNA, 22 bp, M. musculus
gtgtgtgtgtgcgcgcgcgcgt

SEQ ID NO: 423753 - DNA, 20 bp, M. musculus
gtgtgtgtgtgcgcgcgtgt

SEQ ID NO: 423754 - DNA, 16 bp, M. musculus
gtgtgtgtgtgctctt

SEQ ID NO: 423755 - DNA, 16 bp, M. musculus
gtgtgtgtgtgctgct

SEQ ID NO: 423756 - DNA, 16 bp, M. musculus
gtgtgtgtgtgcttct

SEQ ID NO: 423757 - DNA, 16 bp, M. musculus
gtgtgtgtgtggcagt

SEQ ID NO: 423758 - DNA, 16 bp, M. musculus
gtgtgtgtgtgtacag

SEQ ID NO: 423759 - DNA, 16 bp, M. musculus
gtgtgtgtgtgtagca

SEQ ID NO: 423760 - DNA, 16 bp, M. musculus
gtgtgtgtgtgtcata

SEQ ID NO: 423761 - DNA, 16 bp, M. musculus
gtgtgtgtgtgtccat

SEQ ID NO: 423762 - DNA, 16 bp, M. musculus
gtgtgtgtgtgtctgc

SEQ ID NO: 423763 - DNA, 16 bp, M. musculus
gtgtgtgtgtgtctta

SEQ ID NO: 423764 - DNA, 16 bp, M. musculus
gtgtgtgtgtgtgaaa

SEQ ID NO: 423765 - DNA, 16 bp, M. musculus
gtgtgtgtgtgtgagc

SEQ ID NO: 423766 - DNA, 16 bp, M. musculus
gtgtgtgtgtgtgcat

SEQ ID NO: 423767 - DNA, 16 bp, M. musculus
gtgtgtgtgtgtgccg

SEQ ID NO: 423768 - DNA, 22 bp, M. musculus
gtgtgtgtgtgtgcgcgtgtgc

SEQ ID NO: 423769 - DNA, 16 bp, M. musculus
gtgtgtgtgtgttaga

SEQ ID NO: 423770 - DNA, 16 bp, M. musculus
gtgtgtgtgtgttccc

SEQ ID NO: 423771 - DNA, 16 bp, M. musculus
gtgtgtgtgttacaca

SEQ ID NO: 423772 - DNA, 16 bp, M. musculus
gtgtgtgtgttacatc

SEQ ID NO: 423773 - DNA, 16 bp, M. musculus
gtgtgtgtgttacatg

SEQ ID NO: 423774 - DNA, 16 bp, M. musculus
gtgtgtgtgttcacat

SEQ ID NO: 423775 - DNA, 16 bp, M. musculus
gtgtgtgtgttcaggc

SEQ ID NO: 423776 - DNA, 16 bp, M. musculus
gtgtgtgtgttctgag

SEQ ID NO: 423777 - DNA, 16 bp, M. musculus
gtgtgtgtgttctgta

SEQ ID NO: 423778 - DNA, 16 bp, M. musculus
gtgtgtgtgttgtcag

SEQ ID NO: 423779 - DNA, 16 bp, M. musculus
gtgtgtgtgtttaagg

SEQ ID NO: 423780 - DNA, 16 bp, M. musculus
gtgtgtgtgtttctcc

SEQ ID NO: 423781 - DNA, 16 bp, M. musculus
gtgtgtgtgtttgcac

SEQ ID NO: 423782 - DNA, 16 bp, M. musculus
gtgtgtgtgtttggaa

SEQ ID NO: 423783 - DNA, 16 bp, M. musculus
gtgtgtgtgttttacc

SEQ ID NO: 423784 - DNA, 16 bp, M. musculus
gtgtgtgtgttttcca

SEQ ID NO: 423785 - DNA, 16 bp, M. musculus
gtgtgtgtgttttgaa

SEQ ID NO: 423786 - DNA, 16 bp, M. musculus
gtgtgtgttcatctct

SEQ ID NO: 423787 - DNA, 16 bp, M. musculus
gtgtgtgttctctgtg

SEQ ID NO: 423788 - DNA, 16 bp, M. musculus
gtgtgtgttgcataca

SEQ ID NO: 423789 - DNA, 16 bp, M. musculus
gtgtgtgttgtgtgca

SEQ ID NO: 423790 - DNA, 16 bp, M. musculus
gtgtgtgtttatttca

SEQ ID NO: 423791 - DNA, 16 bp, M. musculus
gtgtgtgtttgcattt

SEQ ID NO: 423792 - DNA, 16 bp, M. musculus
gtgtgtgttttaaaat

SEQ ID NO: 423793 - DNA, 16 bp, M. musculus
gtgtgttcatgcacac

SEQ ID NO: 423794 - DNA, 16 bp, M. musculus
gtgtgttcatgcatgc

SEQ ID NO: 423795 - DNA, 16 bp, M. musculus
gtgtgttcatttgtga

SEQ ID NO: 423796 - DNA, 16 bp, M. musculus
gtgtgttctttgtgac

SEQ ID NO: 423797 - DNA, 16 bp, M. musculus
gtgtgttgaagactcc

SEQ ID NO: 423798 - DNA, 16 bp, M. musculus
gtgtgttgcctggtag

SEQ ID NO: 423799 - DNA, 16 bp, M. musculus
gtgtgttgggcccagg

SEQ ID NO: 423800 - DNA, 16 bp, M. musculus
gtgtgtttacattttc

SEQ ID NO: 423801 - DNA, 16 bp, M. musculus
gtgtgtttacgtgtgt

SEQ ID NO: 423802 - DNA, 16 bp, M. musculus
gtgtgtttatatacat

SEQ ID NO: 423803 - DNA, 16 bp, M. musculus
gtgtgtttatgtacat

SEQ ID NO: 423804 - DNA, 16 bp, M. musculus
gtgtgtttatgtctgt

SEQ ID NO: 423805 - DNA, 16 bp, M. musculus
gtgtgtttatgtgtct

SEQ ID NO: 423806 - DNA, 16 bp, M. musculus
gtgtgtttcagtgtgt

SEQ ID NO: 423807 - DNA, 16 bp, M. musculus
gtgtgtttctgagtgt

SEQ ID NO: 423808 - DNA, 16 bp, M. musculus
gtgtgtttctgtgtat

SEQ ID NO: 423809 - DNA, 16 bp, M. musculus
gtgtgtttgtgtacat

SEQ ID NO: 423810 - DNA, 16 bp, M. musculus
gtgtgtttgtgtatga

SEQ ID NO: 423811 - DNA, 16 bp, M. musculus
gtgttaaagtctccca

SEQ ID NO: 423812 - DNA, 16 bp, M. musculus
gtgttagttagggttt

SEQ ID NO: 423813 - DNA, 16 bp, M. musculus
gtgttcaaatacataa

SEQ ID NO: 423814 - DNA, 16 bp, M. musculus
gtgttcaaatcccagc

SEQ ID NO: 423815 - DNA, 16 bp, M. musculus
gtgttcaagtctccca

SEQ ID NO: 423816 - DNA, 16 bp, M. musculus
gtgttcaccaccacac

SEQ ID NO: 423817 - DNA, 16 bp, M. musculus
gtgttcatagcagtct

SEQ ID NO: 423818 - DNA, 16 bp, M. musculus
gtgttcattcagaggt

SEQ ID NO: 423819 - DNA, 16 bp, M. musculus
gtgttcattcttcttg

SEQ ID NO: 423820 - DNA, 16 bp, M. musculus
gtgttcccataaaaca

SEQ ID NO: 423821 - DNA, 16 bp, M. musculus
gtgttcccctctactg

SEQ ID NO: 423822 - DNA, 16 bp, M. musculus
gtgttcctccaccacc

SEQ ID NO: 423823 - DNA, 16 bp, M. musculus
gtgttcctcttttccc

SEQ ID NO: 423824 - DNA, 30 bp, M. musculus
gtgttcctgaataaacctgcttgaagaagg

SEQ ID NO: 423825 - DNA, 16 bp, M. musculus
gtgttcctgcaaggga

SEQ ID NO: 423826 - DNA, 16 bp, M. musculus
gtgttcctggattcgg

SEQ ID NO: 423827 - DNA, 16 bp, M. musculus
gtgttctagtttcatt

SEQ ID NO: 423828 - DNA, 16 bp, M. musculus
gtgttctctggaagag

SEQ ID NO: 423829 - DNA, 16 bp, M. musculus
gtgttctgcctgcctg

SEQ ID NO: 423830 - DNA, 16 bp, M. musculus
gtgttcttctacatgc

SEQ ID NO: 423831 - DNA, 16 bp, M. musculus
gtgttcttgagctcct

SEQ ID NO: 423832 - DNA, 16 bp, M. musculus
gtgttcttgctcagac

SEQ ID NO: 423833 - DNA, 16 bp, M. musculus
gtgttgaagtgtccca

SEQ ID NO: 423834 - DNA, 16 bp, M. musculus
gtgttgagattacaag

SEQ ID NO: 423835 - DNA, 16 bp, M. musculus
gtgttgagggtctcat

SEQ ID NO: 423836 - DNA, 16 bp, M. musculus
gtgttgcaggattttc

SEQ ID NO: 423837 - DNA, 16 bp, M. musculus
gtgttggaaggactct

SEQ ID NO: 423838 - DNA, 16 bp, M. musculus
gtgttggagatgccag

SEQ ID NO: 423839 - DNA, 16 bp, M. musculus
gtgttggagcccctgg

SEQ ID NO: 423840 - DNA, 16 bp, M. musculus
gtgttggcatcaggac

SEQ ID NO: 423841 - DNA, 16 bp, M. musculus
gtgttggccaactact

SEQ ID NO: 423842 - DNA, 16 bp, M. musculus
gtgttggctcaactgg

SEQ ID NO: 423843 - DNA, 16 bp, M. musculus
gtgttgggaacagaac

SEQ ID NO: 423844 - DNA, 16 bp, M. musculus
gtgttgggaactgaac

SEQ ID NO: 423845 - DNA, 16 bp, M. musculus
gtgttgggagcctcat

SEQ ID NO: 423846 - DNA, 16 bp, M. musculus
gtgttgggattaaaga

SEQ ID NO: 423847 - DNA, 16 bp, M. musculus
gtgttgggattatagg

SEQ ID NO: 423848 - DNA, 16 bp, M. musculus
gtgttggggttttccc

SEQ ID NO: 423849 - DNA, 16 bp, M. musculus
gtgttggtgctgggaa

SEQ ID NO: 423850 - DNA, 16 bp, M. musculus
gtgttggtgtttttca

SEQ ID NO: 423851 - DNA, 16 bp, M. musculus
gtgttgtccagtttcc

SEQ ID NO: 423852 - DNA, 16 bp, M. musculus
gtgttgtccttgttca

SEQ ID NO: 423853 - DNA, 16 bp, M. musculus
gtgttgtgtgcacatg

SEQ ID NO: 423854 - DNA, 16 bp, M. musculus
gtgttgtgttttataa

SEQ ID NO: 423855 - DNA, 16 bp, M. musculus
gtgttgtgttttgtca

SEQ ID NO: 423856 - DNA, 16 bp, M. musculus
gtgttgttgttgctgc

SEQ ID NO: 423857 - DNA, 16 bp, M. musculus
gtgttgttttcagcaa

SEQ ID NO: 423858 - DNA, 16 bp, M. musculus
gtgtttaaaaacaaaa

SEQ ID NO: 423859 - DNA, 16 bp, M. musculus
gtgtttacaaaggcag

SEQ ID NO: 423860 - DNA, 16 bp, M. musculus
gtgtttatacatgtgt

SEQ ID NO: 423861 - DNA, 16 bp, M. musculus
gtgtttatatctgtgt

SEQ ID NO: 423862 - DNA, 16 bp, M. musculus
gtgtttctcaaattgt

SEQ ID NO: 423863 - DNA, 16 bp, M. musculus
gtgtttctgaagacag

SEQ ID NO: 423864 - DNA, 16 bp, M. musculus
gtgtttctgagacttc

SEQ ID NO: 423865 - DNA, 16 bp, M. musculus
gtgtttgaaagtgatg

SEQ ID NO: 423866 - DNA, 16 bp, M. musculus
gtgtttgaagacagct

SEQ ID NO: 423867 - DNA, 16 bp, M. musculus
gtgtttgaagacagtg

SEQ ID NO: 423868 - DNA, 16 bp, M. musculus
gtgtttgagaccagcc

SEQ ID NO: 423869 - DNA, 16 bp, M. musculus
gtgtttgagagatctg

SEQ ID NO: 423870 - DNA, 16 bp, M. musculus
gtgtttgaggccagcc

SEQ ID NO: 423871 - DNA, 16 bp, M. musculus
gtgtttgcaagtgaat

SEQ ID NO: 423872 - DNA, 16 bp, M. musculus
gtgtttgcctcagcaa

SEQ ID NO: 423873 - DNA, 16 bp, M. musculus
gtgtttgcttcatttt

SEQ ID NO: 423874 - DNA, 16 bp, M. musculus
gtgtttgcttgcatgt

SEQ ID NO: 423875 - DNA, 16 bp, M. musculus
gtgtttggtcacagca

SEQ ID NO: 423876 - DNA, 16 bp, M. musculus
gtgtttggttgatgtc

SEQ ID NO: 423877 - DNA, 16 bp, M. musculus
gtgtttgtacaagcct

SEQ ID NO: 423878 - DNA, 16 bp, M. musculus
gtgtttgtatatgtgc

SEQ ID NO: 423879 - DNA, 16 bp, M. musculus
gtgtttgtatctgtat

SEQ ID NO: 423880 - DNA, 16 bp, M. musculus
gtgtttgtatgtatgc

SEQ ID NO: 423881 - DNA, 16 bp, M. musculus
gtgtttgtcatagcaa

SEQ ID NO: 423882 - DNA, 16 bp, M. musculus
gtgtttgtctctctct

SEQ ID NO: 423883 - DNA, 16 bp, M. musculus
gtgtttgtgtatatat

SEQ ID NO: 423884 - DNA, 16 bp, M. musculus
gtgtttgtgtatcaag

SEQ ID NO: 423885 - DNA, 16 bp, M. musculus
gtgtttgtgtctgtat

SEQ ID NO: 423886 - DNA, 17 bp, M. musculus
gtgtttgtgtgtcaagt

SEQ ID NO: 423887 - DNA, 16 bp, M. musculus
gtgtttgtgtgtctgc

SEQ ID NO: 423888 - DNA, 16 bp, M. musculus
gtgtttgtgtgtgaga

SEQ ID NO: 423889 - DNA, 16 bp, M. musculus
gtgtttgttgcaagga

SEQ ID NO: 423890 - DNA, 16 bp, M. musculus
gtgttttaaaatgttg

SEQ ID NO: 423891 - DNA, 16 bp, M. musculus
gtgttttcaagtggat

SEQ ID NO: 423892 - DNA, 16 bp, M. musculus
gtgttttctgaaagca

SEQ ID NO: 423893 - DNA, 16 bp, M. musculus
gtgttttctttcactg

SEQ ID NO: 423894 - DNA, 16 bp, M. musculus
gtgttttgagatttag

SEQ ID NO: 423895 - DNA, 16 bp, M. musculus
gtgttttgcctgtgtg

SEQ ID NO: 423896 - DNA, 16 bp, M. musculus
gtgttttgccttcatg

SEQ ID NO: 423897 - DNA, 16 bp, M. musculus
gtgttttgctaaagca

SEQ ID NO: 423898 - DNA, 16 bp, M. musculus
gtgttttggattcctt

SEQ ID NO: 423899 - DNA, 16 bp, M. musculus
gtgttttgtcacagca

SEQ ID NO: 423900 - DNA, 16 bp, M. musculus
gtgttttgtctacatg

SEQ ID NO: 423901 - DNA, 16 bp, M. musculus
gtgttttgtctgcatg

SEQ ID NO: 423902 - DNA, 16 bp, M. musculus
gtgttttgtctgcatt

SEQ ID NO: 423903 - DNA, 16 bp, M. musculus
gtgttttgttcaggac

SEQ ID NO: 423904 - DNA, 16 bp, M. musculus
gtgttttgttcccagt

SEQ ID NO: 423905 - DNA, 16 bp, M. musculus
gtgttttgtttacatg

SEQ ID NO: 423906 - DNA, 16 bp, M. musculus
gtgtttttaaccactg

SEQ ID NO: 423907 - DNA, 16 bp, M. musculus
gtgtttttgcctgcat

SEQ ID NO: 423908 - DNA, 16 bp, M. musculus
gtgtttttgtgagact

SEQ ID NO: 423909 - DNA, 16 bp, M. musculus
gttaaaaatgtcaaaa

SEQ ID NO: 423910 - DNA, 16 bp, M. musculus
gttaaaagaactggct

SEQ ID NO: 423911 - DNA, 16 bp, M. musculus
gttaaaataaaaacag

SEQ ID NO: 423912 - DNA, 16 bp, M. musculus
gttaaaattttgaaga

SEQ ID NO: 423913 - DNA, 16 bp, M. musculus
gttaaacaaaatcaag

SEQ ID NO: 423914 - DNA, 20 bp, M. musculus
gttaaaggctaggctcacaa

SEQ ID NO: 423915 - DNA, 16 bp, M. musculus
gttaaaggtcagcctg

SEQ ID NO: 423916 - DNA, 16 bp, M. musculus
gttaaaggtgcttgct

SEQ ID NO: 423917 - DNA, 16 bp, M. musculus
gttaaagttagcattc

SEQ ID NO: 423918 - DNA, 16 bp, M. musculus
gttaaatatacagaaa

SEQ ID NO: 423919 - DNA, 16 bp, M. musculus
gttaaatgctttcttt

SEQ ID NO: 423920 - DNA, 16 bp, M. musculus
gttaaatgttgtcctt

SEQ ID NO: 423921 - DNA, 16 bp, M. musculus
gttaacacaaaactag

SEQ ID NO: 423922 - DNA, 16 bp, M. musculus
gttaacagaatcacag

SEQ ID NO: 423923 - DNA, 16 bp, M. musculus
gttaacatgtctctca

SEQ ID NO: 423924 - DNA, 16 bp, M. musculus
gttaacccagacccca

SEQ ID NO: 423925 - DNA, 16 bp, M. musculus
gttaactgaggtggga

SEQ ID NO: 423926 - DNA, 16 bp, M. musculus
gttaagaaaaaggatt

SEQ ID NO: 423927 - DNA, 16 bp, M. musculus
gttaagaaaatgccct

SEQ ID NO: 423928 - DNA, 16 bp, M. musculus
gttaagaacactggat

SEQ ID NO: 423929 - DNA, 16 bp, M. musculus
gttaagaacactggct

SEQ ID NO: 423930 - DNA, 16 bp, M. musculus
gttaagaacacttgct

SEQ ID NO: 423931 - DNA, 26 bp, M. musculus
gttaagaatgagagaggacaaggtgg

SEQ ID NO: 423932 - DNA, 16 bp, M. musculus
gttaagagcaatggct

SEQ ID NO: 423933 - DNA, 16 bp, M. musculus
gttaagagcacagact

SEQ ID NO: 423934 - DNA, 16 bp, M. musculus
gttaagagcacaggct

SEQ ID NO: 423935 - DNA, 16 bp, M. musculus
gttaagagcactaact

SEQ ID NO: 423936 - DNA, 19 bp, M. musculus
gttaagagcactgactgcc

SEQ ID NO: 423937 - DNA, 16 bp, M. musculus
gttaagagcacttgct

SEQ ID NO: 423938 - DNA, 16 bp, M. musculus
gttaagagcagtgact

SEQ ID NO: 423939 - DNA, 16 bp, M. musculus
gttaagagcattgact

SEQ ID NO: 423940 - DNA, 16 bp, M. musculus
gttaagagcattggct

SEQ ID NO: 423941 - DNA, 16 bp, M. musculus
gttaagagcatttgct

SEQ ID NO: 423942 - DNA, 23 bp, M. musculus
gttaagagcgccgactgctcttc

SEQ ID NO: 423943 - DNA, 16 bp, M. musculus
gttaagagcgcttgct

SEQ ID NO: 423944 - DNA, 16 bp, M. musculus
gttaagagtactttct

SEQ ID NO: 423945 - DNA, 16 bp, M. musculus
gttaagggctggagag

SEQ ID NO: 423946 - DNA, 16 bp, M. musculus
gttaataggaaaagga

SEQ ID NO: 423947 - DNA, 16 bp, M. musculus
gttaatcccagcactc

SEQ ID NO: 423948 - DNA, 16 bp, M. musculus
gttaatgaaaatgaag

SEQ ID NO: 423949 - DNA, 17 bp, M. musculus
gttaatgaccctgagca

SEQ ID NO: 423950 - DNA, 16 bp, M. musculus
gttaatgacctggtga

SEQ ID NO: 423951 - DNA, 16 bp, M. musculus
gttaattagttggatg

SEQ ID NO: 423952 - DNA, 16 bp, M. musculus
gttaattctattttcc

SEQ ID NO: 423953 - DNA, 16 bp, M. musculus
gttaattgaaatggga

SEQ ID NO: 423954 - DNA, 16 bp, M. musculus
gttaattgagatggga

SEQ ID NO: 423955 - DNA, 16 bp, M. musculus
gttaattttttatcca

SEQ ID NO: 423956 - DNA, 16 bp, M. musculus
gttacaaaatttggct

SEQ ID NO: 423957 - DNA, 16 bp, M. musculus
gttacaaagacaaatt

SEQ ID NO: 423958 - DNA, 16 bp, M. musculus
gttacaacattaggaa

SEQ ID NO: 423959 - DNA, 16 bp, M. musculus
gttacaatatttataa

SEQ ID NO: 423960 - DNA, 16 bp, M. musculus
gttacagacaactgtg

SEQ ID NO: 423961 - DNA, 20 bp, M. musculus
gttacagccattgtggtgtc

SEQ ID NO: 423962 - DNA, 16 bp, M. musculus
gttacaggatatttga

SEQ ID NO: 423963 - DNA, 16 bp, M. musculus
gttacaggtgggtgtg

SEQ ID NO: 423964 - DNA, 16 bp, M. musculus
gttacatcaaggtgtt

SEQ ID NO: 423965 - DNA, 16 bp, M. musculus
gttaccagtgacatca

SEQ ID NO: 423966 - DNA, 17 bp, M. musculus
gttacctcactcaggat

SEQ ID NO: 423967 - DNA, 20 bp, M. musculus
gttacctcactcaggatgat

SEQ ID NO: 423968 - DNA, 16 bp, M. musculus
gttaccttggtcatga

SEQ ID NO: 423969 - DNA, 16 bp, M. musculus
gttacgagcactgact

SEQ ID NO: 423970 - DNA, 16 bp, M. musculus
gttactcacaggagca

SEQ ID NO: 423971 - DNA, 16 bp, M. musculus
gttactggttttgaag

SEQ ID NO: 423972 - DNA, 16 bp, M. musculus
gttactgttgttgttt

SEQ ID NO: 423973 - DNA, 16 bp, M. musculus
gttacttgaccttctt

SEQ ID NO: 423974 - DNA, 16 bp, M. musculus
gttactttaaaaaaaa

SEQ ID NO: 423975 - DNA, 16 bp, M. musculus
gttactttgctgctgt

SEQ ID NO: 423976 - DNA, 16 bp, M. musculus
gttagaaatggttgtg

SEQ ID NO: 423977 - DNA, 16 bp, M. musculus
gttagagaaggaactg

SEQ ID NO: 423978 - DNA, 16 bp, M. musculus
gttagagaccagcctg

SEQ ID NO: 423979 - DNA, 16 bp, M. musculus
gttagagaggcagaga

SEQ ID NO: 423980 - DNA, 16 bp, M. musculus
gttagagatgtcagag

SEQ ID NO: 423981 - DNA, 16 bp, M. musculus
gttagagattgatttt

SEQ ID NO: 423982 - DNA, 16 bp, M. musculus
gttagaggaagtatgt

SEQ ID NO: 423983 - DNA, 16 bp, M. musculus
gttagaggccagcctg

SEQ ID NO: 423984 - DNA, 16 bp, M. musculus
gttagagttacaacaa

SEQ ID NO: 423985 - DNA, 16 bp, M. musculus
gttagcatgtagaata

SEQ ID NO: 423986 - DNA, 16 bp, M. musculus
gttagcctcaaacttg

SEQ ID NO: 423987 - DNA, 16 bp, M. musculus
gttagcctctatgagc

SEQ ID NO: 423988 - DNA, 16 bp, M. musculus
gttagccttaaactca

SEQ ID NO: 423989 - DNA, 16 bp, M. musculus
gttagctgcttctgtc

SEQ ID NO: 423990 - DNA, 16 bp, M. musculus
gttaggaaaattttct

SEQ ID NO: 423991 - DNA, 16 bp, M. musculus
gttaggaaggctgaga

SEQ ID NO: 423992 - DNA, 17 bp, M. musculus
gttaggacatctttcca

SEQ ID NO: 423993 - DNA, 16 bp, M. musculus
gttaggagcactggct

SEQ ID NO: 423994 - DNA, 16 bp, M. musculus
gttaggaggtgtggcc

SEQ ID NO: 423995 - DNA, 20 bp, M. musculus
gttaggatctttttgcattt

SEQ ID NO: 423996 - DNA, 16 bp, M. musculus
gttaggatgaggtgtt

SEQ ID NO: 423997 - DNA, 16 bp, M. musculus
gttaggattttgatgg

SEQ ID NO: 423998 - DNA, 16 bp, M. musculus
gttagtggaacacaac

SEQ ID NO: 423999 - DNA, 16 bp, M. musculus
gttagtgtcacaccaa

SEQ ID NO: 424000 - DNA, 16 bp, M. musculus
gttagttcattatcat

SEQ ID NO: 424001 - DNA, 16 bp, M. musculus
gttagttgatactgtt

SEQ ID NO: 424002 - DNA, 16 bp, M. musculus
gttagtttcagattgg

SEQ ID NO: 424003 - DNA, 16 bp, M. musculus
gttagtttccctgtgt

SEQ ID NO: 424004 - DNA, 16 bp, M. musculus
gttagttttctaaatg

SEQ ID NO: 424005 - DNA, 17 bp, M. musculus
gttataaaagcagcgcc

SEQ ID NO: 424006 - DNA, 16 bp, M. musculus
gttataaataaagctg

SEQ ID NO: 424007 - DNA, 16 bp, M. musculus
gttataagcacacaat

SEQ ID NO: 424008 - DNA, 17 bp, M. musculus
gttatacccaacagact

SEQ ID NO: 424009 - DNA, 16 bp, M. musculus
gttatagtgacagaaa

SEQ ID NO: 424010 - DNA, 16 bp, M. musculus
gttatataaagagaaa

SEQ ID NO: 424011 - DNA, 16 bp, M. musculus
gttatatatatgtata

SEQ ID NO: 424012 - DNA, 16 bp, M. musculus
gttatatgtaagtaca

SEQ ID NO: 424013 - DNA, 16 bp, M. musculus
gttatatgtgtatgta

SEQ ID NO: 424014 - DNA, 16 bp, M. musculus
gttatcaaaaaatata

SEQ ID NO: 424015 - DNA, 16 bp, M. musculus
gttatcaacttgacac

SEQ ID NO: 424016 - DNA, 24 bp, M. musculus
gttatcagtagttctgaatgttag

SEQ ID NO: 424017 - DNA, 16 bp, M. musculus
gttatcatcagcattt

SEQ ID NO: 424018 - DNA, 16 bp, M. musculus
gttatcatgtaggaga

SEQ ID NO: 424019 - DNA, 16 bp, M. musculus
gttatccttggctaca

SEQ ID NO: 424020 - DNA, 16 bp, M. musculus
gttatctgtccagaaa

SEQ ID NO: 424021 - DNA, 16 bp, M. musculus
gttatcttcagctaca

SEQ ID NO: 424022 - DNA, 16 bp, M. musculus
gttatgaaaaaaaatg

SEQ ID NO: 424023 - DNA, 16 bp, M. musculus
gttatgaaacaaatgt

SEQ ID NO: 424024 - DNA, 16 bp, M. musculus
gttatgaaacataatg

SEQ ID NO: 424025 - DNA, 16 bp, M. musculus
gttatgaagtagaaat

SEQ ID NO: 424026 - DNA, 16 bp, M. musculus
gttatgaattgtaata

SEQ ID NO: 424027 - DNA, 16 bp, M. musculus
gttatgagctgccatg

SEQ ID NO: 424028 - DNA, 16 bp, M. musculus
gttatggatttcttca

SEQ ID NO: 424029 - DNA, 16 bp, M. musculus
gttatgtcctcatatt

SEQ ID NO: 424030 - DNA, 16 bp, M. musculus
gttatgttgtagcttc

SEQ ID NO: 424031 - DNA, 16 bp, M. musculus
gttattaaaaacaagg

SEQ ID NO: 424032 - DNA, 16 bp, M. musculus
gttattattattacta

SEQ ID NO: 424033 - DNA, 16 bp, M. musculus
gttattatttttccaa

SEQ ID NO: 424034 - DNA, 16 bp, M. musculus
gttattgaagaccatc

SEQ ID NO: 424035 - DNA, 16 bp, M. musculus
gttattgctgttgttg

SEQ ID NO: 424036 - DNA, 16 bp, M. musculus
gttattgtcatataga

SEQ ID NO: 424037 - DNA, 16 bp, M. musculus
gttattgttgcttcct

SEQ ID NO: 424038 - DNA, 16 bp, M. musculus
gttatttaacatggaa

SEQ ID NO: 424039 - DNA, 16 bp, M. musculus
gttatttcattttctg

SEQ ID NO: 424040 - DNA, 16 bp, M. musculus
gttatttcctagaaca

SEQ ID NO: 424041 - DNA, 16 bp, M. musculus
gttatttcctgttatt

SEQ ID NO: 424042 - DNA, 16 bp, M. musculus
gttattttgaaaacaa

SEQ ID NO: 424043 - DNA, 16 bp, M. musculus
gttatttttcaagaca

SEQ ID NO: 424044 - DNA, 16 bp, M. musculus
gttatttttgttgctg

SEQ ID NO: 424045 - DNA, 16 bp, M. musculus
gttattttttaaaaag

SEQ ID NO: 424046 - DNA, 16 bp, M. musculus
gttcaaaccaaggcag

SEQ ID NO: 424047 - DNA, 16 bp, M. musculus
gttcaaagaaaaacaa

SEQ ID NO: 424048 - DNA, 16 bp, M. musculus
gttcaaagccaacctg

SEQ ID NO: 424049 - DNA, 16 bp, M. musculus
gttcaaagccagtctt

SEQ ID NO: 424050 - DNA, 16 bp, M. musculus
gttcaacctatcccag

SEQ ID NO: 424051 - DNA, 16 bp, M. musculus
gttcaactccttcacc

SEQ ID NO: 424052 - DNA, 16 bp, M. musculus
gttcaagaaattttcc

SEQ ID NO: 424053 - DNA, 18 bp, M. musculus
gttcaagacagggtttct

SEQ ID NO: 424054 - DNA, 16 bp, M. musculus
gttcaagaccaaccta

SEQ ID NO: 424055 - DNA, 16 bp, M. musculus
gttcaagactagcctg

SEQ ID NO: 424056 - DNA, 16 bp, M. musculus
gttcaagagcagcctg

SEQ ID NO: 424057 - DNA, 16 bp, M. musculus
gttcaagatcaacctg

SEQ ID NO: 424058 - DNA, 16 bp, M. musculus
gttcaagatcattctt

SEQ ID NO: 424059 - DNA, 16 bp, M. musculus
gttcaaggacaaccag

SEQ ID NO: 424060 - DNA, 16 bp, M. musculus
gttcaaggacagactg

SEQ ID NO: 424061 - DNA, 31 bp, M. musculus
gttcaaggagtattcattcaaagaaagtcac

SEQ ID NO: 424062 - DNA, 19 bp, M. musculus
gttcaaggagtggccagag

SEQ ID NO: 424063 - DNA, 16 bp, M. musculus
gttcaaggatagcctg

SEQ ID NO: 424064 - DNA, 16 bp, M. musculus
gttcaaggcaagtctg

SEQ ID NO: 424065 - DNA, 16 bp, M. musculus
gttcaaggccagccta

SEQ ID NO: 424066 - DNA, 16 bp, M. musculus
gttcaaggccagcctc

SEQ ID NO: 424067 - DNA, 18 bp, M. musculus
gttcaaggccagcctgga

SEQ ID NO: 424068 - DNA, 16 bp, M. musculus
gttcaaggccaggctt

SEQ ID NO: 424069 - DNA, 16 bp, M. musculus
gttcaaggccatcctt

SEQ ID NO: 424070 - DNA, 16 bp, M. musculus
gttcaaggctagcttg

SEQ ID NO: 424071 - DNA, 16 bp, M. musculus
gttcaaggctatcctg

SEQ ID NO: 424072 - DNA, 16 bp, M. musculus
gttcaaggtcacccta

SEQ ID NO: 424073 - DNA, 16 bp, M. musculus
gttcaaggtcagtctt

SEQ ID NO: 424074 - DNA, 16 bp, M. musculus
gttcaaggtcagttta

SEQ ID NO: 424075 - DNA, 16 bp, M. musculus
gttcaaggtcatcctt

SEQ ID NO: 424076 - DNA, 16 bp, M. musculus
gttcaaggttagcctc

SEQ ID NO: 424077 - DNA, 16 bp, M. musculus
gttcaagtctcagcaa

SEQ ID NO: 424078 - DNA, 16 bp, M. musculus
gttcaatccccaaaac

SEQ ID NO: 424079 - DNA, 16 bp, M. musculus
gttcaatccccaacaa

SEQ ID NO: 424080 - DNA, 16 bp, M. musculus
gttcaatctattacta

SEQ ID NO: 424081 - DNA, 16 bp, M. musculus
gttcaattccagcacc

SEQ ID NO: 424082 - DNA, 16 bp, M. musculus
gttcaattccatctcc

SEQ ID NO: 424083 - DNA, 16 bp, M. musculus
gttcaattcccagcat

SEQ ID NO: 424084 - DNA, 16 bp, M. musculus
gttcaattcctagcac

SEQ ID NO: 424085 - DNA, 16 bp, M. musculus
gttcaattcctagtac

SEQ ID NO: 424086 - DNA, 16 bp, M. musculus
gttcaattctcagcac

SEQ ID NO: 424087 - DNA, 16 bp, M. musculus
gttcacaactgtaact

SEQ ID NO: 424088 - DNA, 16 bp, M. musculus
gttcacacagaagatg

SEQ ID NO: 424089 - DNA, 16 bp, M. musculus
gttcacacctgtaatc

SEQ ID NO: 424090 - DNA, 16 bp, M. musculus
gttcacagcaatgaaa

SEQ ID NO: 424091 - DNA, 16 bp, M. musculus
gttcacagctgcctgt

SEQ ID NO: 424092 - DNA, 16 bp, M. musculus
gttcacagggccccca

SEQ ID NO: 424093 - DNA, 16 bp, M. musculus
gttcacaggtcagaac

SEQ ID NO: 424094 - DNA, 16 bp, M. musculus
gttcaccttacattgc

SEQ ID NO: 424095 - DNA, 16 bp, M. musculus
gttcactcagggggtc

SEQ ID NO: 424096 - DNA, 16 bp, M. musculus
gttcagaaaattttcc

SEQ ID NO: 424097 - DNA, 16 bp, M. musculus
gttcagacaaaaaaaa

SEQ ID NO: 424098 - DNA, 16 bp, M. musculus
gttcagacctcagctc

SEQ ID NO: 424099 - DNA, 16 bp, M. musculus
gttcagagatctgcct

SEQ ID NO: 424100 - DNA, 16 bp, M. musculus
gttcagagattcagtc

SEQ ID NO: 424101 - DNA, 16 bp, M. musculus
gttcagaggacagctt

SEQ ID NO: 424102 - DNA, 16 bp, M. musculus
gttcagattctgagag

SEQ ID NO: 424103 - DNA, 16 bp, M. musculus
gttcagcagttaagag

SEQ ID NO: 424104 - DNA, 16 bp, M. musculus
gttcagcatgtctgac

SEQ ID NO: 424105 - DNA, 16 bp, M. musculus
gttcagccactgttgc

SEQ ID NO: 424106 - DNA, 16 bp, M. musculus
gttcagccagcaactg

SEQ ID NO: 424107 - DNA, 16 bp, M. musculus
gttcagctcccagcat

SEQ ID NO: 424108 - DNA, 16 bp, M. musculus
gttcagctctgagtcc

SEQ ID NO: 424109 - DNA, 16 bp, M. musculus
gttcagctgtctctgg

SEQ ID NO: 424110 - DNA, 16 bp, M. musculus
gttcaggaatctttcc

SEQ ID NO: 424111 - DNA, 16 bp, M. musculus
gttcaggacagccaga

SEQ ID NO: 424112 - DNA, 23 bp, M. musculus
gttcaggacagtatgtcagaaac

SEQ ID NO: 424113 - DNA, 16 bp, M. musculus
gttcaggaggagctga

SEQ ID NO: 424114 - DNA, 16 bp, M. musculus
gttcaggaggctgagg

SEQ ID NO: 424115 - DNA, 16 bp, M. musculus
gttcaggtcccagcac

SEQ ID NO: 424116 - DNA, 16 bp, M. musculus
gttcagtagtatcagg

SEQ ID NO: 424117 - DNA, 16 bp, M. musculus
gttcagtccccagaat

SEQ ID NO: 424118 - DNA, 16 bp, M. musculus
gttcagtccccagcac

SEQ ID NO: 424119 - DNA, 16 bp, M. musculus
gttcagtcctcagcac

SEQ ID NO: 424120 - DNA, 16 bp, M. musculus
gttcagttcccaacac

SEQ ID NO: 424121 - DNA, 16 bp, M. musculus
gttcagttcccagaac

SEQ ID NO: 424122 - DNA, 16 bp, M. musculus
gttcagttcccagcat

SEQ ID NO: 424123 - DNA, 16 bp, M. musculus
gttcagttcctaacac

SEQ ID NO: 424124 - DNA, 16 bp, M. musculus
gttcagttcctagcac

SEQ ID NO: 424125 - DNA, 16 bp, M. musculus
gttcagttcctagcat

SEQ ID NO: 424126 - DNA, 16 bp, M. musculus
gttcagttcctagtac

SEQ ID NO: 424127 - DNA, 16 bp, M. musculus
gttcagttctcaacac

SEQ ID NO: 424128 - DNA, 16 bp, M. musculus
gttcagttctcagcac

SEQ ID NO: 424129 - DNA, 16 bp, M. musculus
gttcagttggtaaagt

SEQ ID NO: 424130 - DNA, 16 bp, M. musculus
gttcagtttccacctg

SEQ ID NO: 424131 - DNA, 88 bp, M. musculus
gttcagtttccactaaggcccaatagcaggccaagagctgtttttcaaagggagaatagttgtctgcagatgatggtagagctttgct

SEQ ID NO: 424132 - DNA, 16 bp, M. musculus
gttcagtttccagcac

SEQ ID NO: 424133 - DNA, 16 bp, M. musculus
gttcagtttctagcac

SEQ ID NO: 424134 - DNA, 16 bp, M. musculus
gttcataaccatctat

SEQ ID NO: 424135 - DNA, 16 bp, M. musculus
gttcatatatttgaat

SEQ ID NO: 424136 - DNA, 16 bp, M. musculus
gttcatcagcaaagga

SEQ ID NO: 424137 - DNA, 16 bp, M. musculus
gttcatctctgtgaag

SEQ ID NO: 424138 - DNA, 16 bp, M. musculus
gttcatcttctctgac

SEQ ID NO: 424139 - DNA, 16 bp, M. musculus
gttcatgcatgtgtat

SEQ ID NO: 424140 - DNA, 17 bp, M. musculus
gttcatgctctggttgg

SEQ ID NO: 424141 - DNA, 16 bp, M. musculus
gttcatggccagcctg

SEQ ID NO: 424142 - DNA, 16 bp, M. musculus
gttcatgtctgtaatc

SEQ ID NO: 424143 - DNA, 16 bp, M. musculus
gttcatgtgcatcttt

SEQ ID NO: 424144 - DNA, 16 bp, M. musculus
gttcattaatgatatt

SEQ ID NO: 424145 - DNA, 17 bp, M. musculus
gttcattaccatcggct

SEQ ID NO: 424146 - DNA, 16 bp, M. musculus
gttcattgcagtgact

SEQ ID NO: 424147 - DNA, 16 bp, M. musculus
gttcattggccagcca

SEQ ID NO: 424148 - DNA, 16 bp, M. musculus
gttcattgtggcttta

SEQ ID NO: 424149 - DNA, 16 bp, M. musculus
gttcatttaaacatca

SEQ ID NO: 424150 - DNA, 16 bp, M. musculus
gttcatttgtgtgtga

SEQ ID NO: 424151 - DNA, 16 bp, M. musculus
gttcattttccacatg

SEQ ID NO: 424152 - DNA, 16 bp, M. musculus
gttcattttgatttgc

SEQ ID NO: 424153 - DNA, 16 bp, M. musculus
gttcattttttaatat

SEQ ID NO: 424154 - DNA, 18 bp, M. musculus
gttccaactcaattcttc

SEQ ID NO: 424155 - DNA, 16 bp, M. musculus
gttccaagaacattct

SEQ ID NO: 424156 - DNA, 16 bp, M. musculus
gttccacagcctccca

SEQ ID NO: 424157 - DNA, 16 bp, M. musculus
gttccacccccagcac

SEQ ID NO: 424158 - DNA, 16 bp, M. musculus
gttccacctgcctctg

SEQ ID NO: 424159 - DNA, 16 bp, M. musculus
gttccagaacaaccag

SEQ ID NO: 424160 - DNA, 16 bp, M. musculus
gttccagaacagccaa

SEQ ID NO: 424161 - DNA, 16 bp, M. musculus
gttccagacagggttt

SEQ ID NO: 424162 - DNA, 16 bp, M. musculus
gttccagagacagctg

SEQ ID NO: 424163 - DNA, 16 bp, M. musculus
gttccagagacctggg

SEQ ID NO: 424164 - DNA, 16 bp, M. musculus
gttccagagcagccag

SEQ ID NO: 424165 - DNA, 16 bp, M. musculus
gttccagagccctctg

SEQ ID NO: 424166 - DNA, 16 bp, M. musculus
gttccagagggatgag

SEQ ID NO: 424167 - DNA, 16 bp, M. musculus
gttccagcactcggga

SEQ ID NO: 424168 - DNA, 16 bp, M. musculus
gttccagccccagaaa

SEQ ID NO: 424169 - DNA, 16 bp, M. musculus
gttccagccctgggtc

SEQ ID NO: 424170 - DNA, 16 bp, M. musculus
gttccaggaaagccaa

SEQ ID NO: 424171 - DNA, 16 bp, M. musculus
gttccaggaagccagg

SEQ ID NO: 424172 - DNA, 16 bp, M. musculus
gttccaggacagatag

SEQ ID NO: 424173 - DNA, 16 bp, M. musculus
gttccaggacagcaag

SEQ ID NO: 424174 - DNA, 16 bp, M. musculus
gttccaggacagcagg

SEQ ID NO: 424175 - DNA, 16 bp, M. musculus
gttccaggacagccca

SEQ ID NO: 424176 - DNA, 16 bp, M. musculus
gttccaggacatcaag

SEQ ID NO: 424177 - DNA, 16 bp, M. musculus
gttccaggaccctgcc

SEQ ID NO: 424178 - DNA, 18 bp, M. musculus
gttccaggactccctgga

SEQ ID NO: 424179 - DNA, 16 bp, M. musculus
gttccaggagatctgg

SEQ ID NO: 424180 - DNA, 16 bp, M. musculus
gttccaggagctgaag

SEQ ID NO: 424181 - DNA, 16 bp, M. musculus
gttccaggagttctga

SEQ ID NO: 424182 - DNA, 16 bp, M. musculus
gttccaggatacccag

SEQ ID NO: 424183 - DNA, 16 bp, M. musculus
gttccaggccagctgg

SEQ ID NO: 424184 - DNA, 16 bp, M. musculus
gttccaggcctgcctg

SEQ ID NO: 424185 - DNA, 16 bp, M. musculus
gttccagggaatccaa

SEQ ID NO: 424186 - DNA, 16 bp, M. musculus
gttccagggaatccag

SEQ ID NO: 424187 - DNA, 16 bp, M. musculus
gttccagggaatctgg

SEQ ID NO: 424188 - DNA, 16 bp, M. musculus
gttccagggactctga

SEQ ID NO: 424189 - DNA, 16 bp, M. musculus
gttccagggattgaac

SEQ ID NO: 424190 - DNA, 16 bp, M. musculus
gttccagggcagccag

SEQ ID NO: 424191 - DNA, 16 bp, M. musculus
gttccagggcagcctg

SEQ ID NO: 424192 - DNA, 16 bp, M. musculus
gttccaggtcagccag

SEQ ID NO: 424193 - DNA, 16 bp, M. musculus
gttccaggtcatccag

SEQ ID NO: 424194 - DNA, 16 bp, M. musculus
gttccagtatagccag

SEQ ID NO: 424195 - DNA, 16 bp, M. musculus
gttccagtatctgaga

SEQ ID NO: 424196 - DNA, 16 bp, M. musculus
gttccagtccagccag

SEQ ID NO: 424197 - DNA, 16 bp, M. musculus
gttccagtggatctga

SEQ ID NO: 424198 - DNA, 16 bp, M. musculus
gttccatccatttatc

SEQ ID NO: 424199 - DNA, 16 bp, M. musculus
gttccatcccataatt

SEQ ID NO: 424200 - DNA, 16 bp, M. musculus
gttccatccccagcac

SEQ ID NO: 424201 - DNA, 16 bp, M. musculus
gttccatgccagcctg

SEQ ID NO: 424202 - DNA, 16 bp, M. musculus
gttccatgtgttttgc

SEQ ID NO: 424203 - DNA, 16 bp, M. musculus
gttccattcccagcac

SEQ ID NO: 424204 - DNA, 16 bp, M. musculus
gttccattcctagcac

SEQ ID NO: 424205 - DNA, 16 bp, M. musculus
gttcccaacacccaca

SEQ ID NO: 424206 - DNA, 16 bp, M. musculus
gttcccaacacctaca

SEQ ID NO: 424207 - DNA, 16 bp, M. musculus
gttcccactggcaggt

SEQ ID NO: 424208 - DNA, 16 bp, M. musculus
gttcccactggtgggt

SEQ ID NO: 424209 - DNA, 16 bp, M. musculus
gttcccagaacacaca

SEQ ID NO: 424210 - DNA, 16 bp, M. musculus
gttcccagataaaaga

SEQ ID NO: 424211 - DNA, 16 bp, M. musculus
gttcccagcacacata

SEQ ID NO: 424212 - DNA, 16 bp, M. musculus
gttcccagcacccaag

SEQ ID NO: 424213 - DNA, 16 bp, M. musculus
gttcccagcacccata

SEQ ID NO: 424214 - DNA, 16 bp, M. musculus
gttcccagcaccctca

SEQ ID NO: 424215 - DNA, 16 bp, M. musculus
gttcccagcactgaaa

SEQ ID NO: 424216 - DNA, 17 bp, M. musculus
gttcccatccttgtatt

SEQ ID NO: 424217 - DNA, 16 bp, M. musculus
gttcccattctttctg

SEQ ID NO: 424218 - DNA, 16 bp, M. musculus
gttcccctatcctggg

SEQ ID NO: 424219 - DNA, 16 bp, M. musculus
gttcccctggactggg

SEQ ID NO: 424220 - DNA, 17 bp, M. musculus
gttcccctgtactgagg

SEQ ID NO: 424221 - DNA, 16 bp, M. musculus
gttcccctttataatc

SEQ ID NO: 424222 - DNA, 16 bp, M. musculus
gttccctataccctcc

SEQ ID NO: 424223 - DNA, 16 bp, M. musculus
gttccctgagccctgg

SEQ ID NO: 424224 - DNA, 16 bp, M. musculus
gttccctgtgtgtgtg

SEQ ID NO: 424225 - DNA, 16 bp, M. musculus
gttcctagcacccaca

SEQ ID NO: 424226 - DNA, 16 bp, M. musculus
gttcctaggagctctg

SEQ ID NO: 424227 - DNA, 16 bp, M. musculus
gttcctagtacccaca

SEQ ID NO: 424228 - DNA, 18 bp, M. musculus
gttcctcagaaaactgga

SEQ ID NO: 424229 - DNA, 16 bp, M. musculus
gttcctccatgtgtac

SEQ ID NO: 424230 - DNA, 16 bp, M. musculus
gttcctctctggtatg

SEQ ID NO: 424231 - DNA, 16 bp, M. musculus
gttcctctgaaaattg

SEQ ID NO: 424232 - DNA, 16 bp, M. musculus
gttcctcttggaaggt

SEQ ID NO: 424233 - DNA, 16 bp, M. musculus
gttcctctttctccat

SEQ ID NO: 424234 - DNA, 16 bp, M. musculus
gttcctgaaacccatg

SEQ ID NO: 424235 - DNA, 16 bp, M. musculus
gttcctgcagcagctt

SEQ ID NO: 424236 - DNA, 16 bp, M. musculus
gttcctgccatgactt

SEQ ID NO: 424237 - DNA, 16 bp, M. musculus
gttcctgcctccaggt

SEQ ID NO: 424238 - DNA, 16 bp, M. musculus
gttcctgccttggctt

SEQ ID NO: 424239 - DNA, 16 bp, M. musculus
gttcctgctctgactt

SEQ ID NO: 424240 - DNA, 16 bp, M. musculus
gttcctgctggcaaaa

SEQ ID NO: 424241 - DNA, 16 bp, M. musculus
gttcctggcaaacaca

SEQ ID NO: 424242 - DNA, 16 bp, M. musculus
gttcctggccatccag

SEQ ID NO: 424243 - DNA, 16 bp, M. musculus
gttcctggctggcctc

SEQ ID NO: 424244 - DNA, 16 bp, M. musculus
gttcctgggcaggtgg

SEQ ID NO: 424245 - DNA, 16 bp, M. musculus
gttcctgtcctcactg

SEQ ID NO: 424246 - DNA, 16 bp, M. musculus
gttcctgtcctgtgtg

SEQ ID NO: 424247 - DNA, 16 bp, M. musculus
gttcctgtctacaagc

SEQ ID NO: 424248 - DNA, 16 bp, M. musculus
gttcctgtctctgcct

SEQ ID NO: 424249 - DNA, 16 bp, M. musculus
gttcctgtcttgattt

SEQ ID NO: 424250 - DNA, 16 bp, M. musculus
gttcctgtgaaggctc

SEQ ID NO: 424251 - DNA, 16 bp, M. musculus
gttcctgtgagctctg

SEQ ID NO: 424252 - DNA, 16 bp, M. musculus
gttcctgtgccctgtg

SEQ ID NO: 424253 - DNA, 16 bp, M. musculus
gttccttgtatatatt

SEQ ID NO: 424254 - DNA, 16 bp, M. musculus
gttcctttctctgtga

SEQ ID NO: 424255 - DNA, 16 bp, M. musculus
gttcctttgtccctgt

SEQ ID NO: 424256 - DNA, 16 bp, M. musculus
gttcgagaccagcctg

SEQ ID NO: 424257 - DNA, 16 bp, M. musculus
gttcgaggccaatctg

SEQ ID NO: 424258 - DNA, 16 bp, M. musculus
gttcgaggccagtgtg

SEQ ID NO: 424259 - DNA, 16 bp, M. musculus
gttcgattcccagcac

SEQ ID NO: 424260 - DNA, 16 bp, M. musculus
gttcggagcagagcct

SEQ ID NO: 424261 - DNA, 16 bp, M. musculus
gttcggttcccagcac

SEQ ID NO: 424262 - DNA, 16 bp, M. musculus
gttctacaacttcatc

SEQ ID NO: 424263 - DNA, 16 bp, M. musculus
gttctacacagagaaa

SEQ ID NO: 424264 - DNA, 16 bp, M. musculus
gttctacatccagatc

SEQ ID NO: 424265 - DNA, 16 bp, M. musculus
gttctacatcttcatc

SEQ ID NO: 424266 - DNA, 16 bp, M. musculus
gttctacctctgagct

SEQ ID NO: 424267 - DNA, 16 bp, M. musculus
gttctagaagaaagca

SEQ ID NO: 424268 - DNA, 16 bp, M. musculus
gttctagaggagcaga

SEQ ID NO: 424269 - DNA, 16 bp, M. musculus
gttctaggacagcctg

SEQ ID NO: 424270 - DNA, 16 bp, M. musculus
gttctaggccagtctg

SEQ ID NO: 424271 - DNA, 16 bp, M. musculus
gttctaggccatcctg

SEQ ID NO: 424272 - DNA, 16 bp, M. musculus
gttctataagaaagca

SEQ ID NO: 424273 - DNA, 16 bp, M. musculus
gttctataagaaagta

SEQ ID NO: 424274 - DNA, 16 bp, M. musculus
gttctataggcttctt

SEQ ID NO: 424275 - DNA, 16 bp, M. musculus
gttctatcagaccttg

SEQ ID NO: 424276 - DNA, 16 bp, M. musculus
gttctatcagaccttt

SEQ ID NO: 424277 - DNA, 16 bp, M. musculus
gttctatctgcatgta

SEQ ID NO: 424278 - DNA, 16 bp, M. musculus
gttctatgaagccaca

SEQ ID NO: 424279 - DNA, 16 bp, M. musculus
gttctattgtaaaagg

SEQ ID NO: 424280 - DNA, 16 bp, M. musculus
gttctcaaactcctgg

SEQ ID NO: 424281 - DNA, 16 bp, M. musculus
gttctcaactggaagc

SEQ ID NO: 424282 - DNA, 16 bp, M. musculus
gttctcacagagaaag

SEQ ID NO: 424283 - DNA, 16 bp, M. musculus
gttctcagataaaaga

SEQ ID NO: 424284 - DNA, 16 bp, M. musculus
gttctcagcaccctca

SEQ ID NO: 424285 - DNA, 16 bp, M. musculus
gttctcagcctgtggg

SEQ ID NO: 424286 - DNA, 16 bp, M. musculus
gttctcagctgtgcct

SEQ ID NO: 424287 - DNA, 16 bp, M. musculus
gttctcagggaggagg

SEQ ID NO: 424288 - DNA, 16 bp, M. musculus
gttctcatctcatgga

SEQ ID NO: 424289 - DNA, 16 bp, M. musculus
gttctcatcttgtgga

SEQ ID NO: 424290 - DNA, 16 bp, M. musculus
gttctccagggcagga

SEQ ID NO: 424291 - DNA, 16 bp, M. musculus
gttctcccatatttct

SEQ ID NO: 424292 - DNA, 16 bp, M. musculus
gttctcccccacccac

SEQ ID NO: 424293 - DNA, 16 bp, M. musculus
gttctcctacaggatc

SEQ ID NO: 424294 - DNA, 16 bp, M. musculus
gttctcctctttcagg

SEQ ID NO: 424295 - DNA, 16 bp, M. musculus
gttctcctgcctcagt

SEQ ID NO: 424296 - DNA, 16 bp, M. musculus
gttctccttcaagaca

SEQ ID NO: 424297 - DNA, 16 bp, M. musculus
gttctctagaaaagca

SEQ ID NO: 424298 - DNA, 16 bp, M. musculus
gttctctagaggaaca

SEQ ID NO: 424299 - DNA, 16 bp, M. musculus
gttctctcctatggaa

SEQ ID NO: 424300 - DNA, 16 bp, M. musculus
gttctctcctgccacc

SEQ ID NO: 424301 - DNA, 16 bp, M. musculus
gttctctccttccacc

SEQ ID NO: 424302 - DNA, 16 bp, M. musculus
gttctctccttccagc

SEQ ID NO: 424303 - DNA, 16 bp, M. musculus
gttctctccttctacc

SEQ ID NO: 424304 - DNA, 16 bp, M. musculus
gttctctccttctgct

SEQ ID NO: 424305 - DNA, 16 bp, M. musculus
gttctctctagtttct

SEQ ID NO: 424306 - DNA, 16 bp, M. musculus
gttctctctgtgtctc

SEQ ID NO: 424307 - DNA, 16 bp, M. musculus
gttctctcttcccacc

SEQ ID NO: 424308 - DNA, 16 bp, M. musculus
gttctctgaaaaagca

SEQ ID NO: 424309 - DNA, 16 bp, M. musculus
gttctctgagaggctt

SEQ ID NO: 424310 - DNA, 16 bp, M. musculus
gttctctgattaagtc

SEQ ID NO: 424311 - DNA, 16 bp, M. musculus
gttctctgcaggagca

SEQ ID NO: 424312 - DNA, 16 bp, M. musculus
gttctctgctcttctg

SEQ ID NO: 424313 - DNA, 16 bp, M. musculus
gttctcttctaccatg

SEQ ID NO: 424314 - DNA, 16 bp, M. musculus
gttctcttcttccatc

SEQ ID NO: 424315 - DNA, 16 bp, M. musculus
gttctgaaaaggctga

SEQ ID NO: 424316 - DNA, 16 bp, M. musculus
gttctgaaattattgt

SEQ ID NO: 424317 - DNA, 16 bp, M. musculus
gttctgaattcataca

SEQ ID NO: 424318 - DNA, 16 bp, M. musculus
gttctgaggatcaaac

SEQ ID NO: 424319 - DNA, 16 bp, M. musculus
gttctgattttcattt

SEQ ID NO: 424320 - DNA, 16 bp, M. musculus
gttctgcaaaaactat

SEQ ID NO: 424321 - DNA, 16 bp, M. musculus
gttctgcatcttcatc

SEQ ID NO: 424322 - DNA, 16 bp, M. musculus
gttctgcatctttatc

SEQ ID NO: 424323 - DNA, 16 bp, M. musculus
gttctgccatgtggct

SEQ ID NO: 424324 - DNA, 16 bp, M. musculus
gttctgcctctctcag

SEQ ID NO: 424325 - DNA, 16 bp, M. musculus
gttctgcctctctcca

SEQ ID NO: 424326 - DNA, 16 bp, M. musculus
gttctgcctgggctgc

SEQ ID NO: 424327 - DNA, 16 bp, M. musculus
gttctgctcccagcac

SEQ ID NO: 424328 - DNA, 16 bp, M. musculus
gttctgctgctgctgc

SEQ ID NO: 424329 - DNA, 16 bp, M. musculus
gttctgctgtttgctg

SEQ ID NO: 424330 - DNA, 16 bp, M. musculus
gttctggaactctctt

SEQ ID NO: 424331 - DNA, 16 bp, M. musculus
gttctggaggctgaga

SEQ ID NO: 424332 - DNA, 16 bp, M. musculus
gttctggaggggaaac

SEQ ID NO: 424333 - DNA, 16 bp, M. musculus
gttctggagtgtctga

SEQ ID NO: 424334 - DNA, 16 bp, M. musculus
gttctggctcagcctg

SEQ ID NO: 424335 - DNA, 16 bp, M. musculus
gttctggcttagcctg

SEQ ID NO: 424336 - DNA, 16 bp, M. musculus
gttctgggaattaaac

SEQ ID NO: 424337 - DNA, 16 bp, M. musculus
gttctgggacagccag

SEQ ID NO: 424338 - DNA, 16 bp, M. musculus
gttctggggaatctga

SEQ ID NO: 424339 - DNA, 16 bp, M. musculus
gttctggttccgcctc

SEQ ID NO: 424340 - DNA, 16 bp, M. musculus
gttctgtaagaaagca

SEQ ID NO: 424341 - DNA, 16 bp, M. musculus
gttctgtatatatatt

SEQ ID NO: 424342 - DNA, 16 bp, M. musculus
gttctgtgactccaga

SEQ ID NO: 424343 - DNA, 16 bp, M. musculus
gttctgtgactttaga

SEQ ID NO: 424344 - DNA, 16 bp, M. musculus
gttctgtggttaagag

SEQ ID NO: 424345 - DNA, 16 bp, M. musculus
gttctgttcaggaaat

SEQ ID NO: 424346 - DNA, 16 bp, M. musculus
gttctgttctgttctc

SEQ ID NO: 424347 - DNA, 16 bp, M. musculus
gttctgttgcttgctg

SEQ ID NO: 424348 - DNA, 16 bp, M. musculus
gttctgtttctctaga

SEQ ID NO: 424349 - DNA, 16 bp, M. musculus
gttctgtttctttaga

SEQ ID NO: 424350 - DNA, 16 bp, M. musculus
gttcttaaccaccgag

SEQ ID NO: 424351 - DNA, 16 bp, M. musculus
gttcttaggacaatta

SEQ ID NO: 424352 - DNA, 16 bp, M. musculus
gttcttatgctggctt

SEQ ID NO: 424353 - DNA, 16 bp, M. musculus
gttcttattgttgttc

SEQ ID NO: 424354 - DNA, 17 bp, M. musculus
gttcttcagaaggcagt

SEQ ID NO: 424355 - DNA, 16 bp, M. musculus
gttcttcagatctcca

SEQ ID NO: 424356 - DNA, 16 bp, M. musculus
gttcttcatcccattc

SEQ ID NO: 424357 - DNA, 16 bp, M. musculus
gttcttccagagcctg

SEQ ID NO: 424358 - DNA, 16 bp, M. musculus
gttcttccagaggacc

SEQ ID NO: 424359 - DNA, 16 bp, M. musculus
gttcttccagcatccc

SEQ ID NO: 424360 - DNA, 16 bp, M. musculus
gttcttccaggggacc

SEQ ID NO: 424361 - DNA, 16 bp, M. musculus
gttcttcccaagcttc

SEQ ID NO: 424362 - DNA, 16 bp, M. musculus
gttcttcctgagtttc

SEQ ID NO: 424363 - DNA, 16 bp, M. musculus
gttcttcctggctggt

SEQ ID NO: 424364 - DNA, 16 bp, M. musculus
gttcttgctaactgaa

SEQ ID NO: 424365 - DNA, 17 bp, M. musculus
gttcttgctcatttata

SEQ ID NO: 424366 - DNA, 16 bp, M. musculus
gttcttggagaggacc

SEQ ID NO: 424367 - DNA, 16 bp, M. musculus
gttcttggattttgtt

SEQ ID NO: 424368 - DNA, 16 bp, M. musculus
gttcttggccagattt

SEQ ID NO: 424369 - DNA, 16 bp, M. musculus
gttcttggccctggtg

SEQ ID NO: 424370 - DNA, 16 bp, M. musculus
gttcttggtcatgatg

SEQ ID NO: 424371 - DNA, 16 bp, M. musculus
gttcttgtagagaacc

SEQ ID NO: 424372 - DNA, 16 bp, M. musculus
gttcttgtccatggga

SEQ ID NO: 424373 - DNA, 19 bp, M. musculus
gttcttgttggtgcacagc

SEQ ID NO: 424374 - DNA, 16 bp, M. musculus
gttctttatacatttt

SEQ ID NO: 424375 - DNA, 16 bp, M. musculus
gttctttcagacagta

SEQ ID NO: 424376 - DNA, 16 bp, M. musculus
gttctttcatttggag

SEQ ID NO: 424377 - DNA, 16 bp, M. musculus
gttctttccagctcct

SEQ ID NO: 424378 - DNA, 17 bp, M. musculus
gttctttccagtttctg

SEQ ID NO: 424379 - DNA, 16 bp, M. musculus
gttctttccatgtctt

SEQ ID NO: 424380 - DNA, 16 bp, M. musculus
gttctttccattttct

SEQ ID NO: 424381 - DNA, 16 bp, M. musculus
gttctttccttccact

SEQ ID NO: 424382 - DNA, 16 bp, M. musculus
gttctttctgagctct

SEQ ID NO: 424383 - DNA, 16 bp, M. musculus
gttctttgaaaagatt

SEQ ID NO: 424384 - DNA, 16 bp, M. musculus
gttctttgaaagagca

SEQ ID NO: 424385 - DNA, 16 bp, M. musculus
gttctttgagaatttc

SEQ ID NO: 424386 - DNA, 16 bp, M. musculus
gttctttggagcaact

SEQ ID NO: 424387 - DNA, 16 bp, M. musculus
gttctttgtaaattct

SEQ ID NO: 424388 - DNA, 16 bp, M. musculus
gttctttgtatagttc

SEQ ID NO: 424389 - DNA, 16 bp, M. musculus
gttctttgtatgtatt

SEQ ID NO: 424390 - DNA, 16 bp, M. musculus
gttcttttcaggaaaa

SEQ ID NO: 424391 - DNA, 16 bp, M. musculus
gttcttttgccttcag

SEQ ID NO: 424392 - DNA, 16 bp, M. musculus
gttcttttgctgtgaa

SEQ ID NO: 424393 - DNA, 16 bp, M. musculus
gttcttttgggattgg

SEQ ID NO: 424394 - DNA, 16 bp, M. musculus
gttctttttttaaaaa

SEQ ID NO: 424395 - DNA, 16 bp, M. musculus
gttgaaaaagctgtct

SEQ ID NO: 424396 - DNA, 16 bp, M. musculus
gttgaaaaatctggtg

SEQ ID NO: 424397 - DNA, 16 bp, M. musculus
gttgaaaatctttgtt

SEQ ID NO: 424398 - DNA, 16 bp, M. musculus
gttgaaacgtatctca

SEQ ID NO: 424399 - DNA, 16 bp, M. musculus
gttgaaagatttcttt

SEQ ID NO: 424400 - DNA, 16 bp, M. musculus
gttgaaagtctatttc

SEQ ID NO: 424401 - DNA, 16 bp, M. musculus
gttgaacagtttttca

SEQ ID NO: 424402 - DNA, 16 bp, M. musculus
gttgaagatgcttttt

SEQ ID NO: 424403 - DNA, 16 bp, M. musculus
gttgaaggaggtgtgg

SEQ ID NO: 424404 - DNA, 16 bp, M. musculus
gttgaattagggaaga

SEQ ID NO: 424405 - DNA, 16 bp, M. musculus
gttgacactgttgctc

SEQ ID NO: 424406 - DNA, 16 bp, M. musculus
gttgacatggaagctg

SEQ ID NO: 424407 - DNA, 16 bp, M. musculus
gttgacctcaaactca

SEQ ID NO: 424408 - DNA, 16 bp, M. musculus
gttgactgtgagcatc

SEQ ID NO: 424409 - DNA, 16 bp, M. musculus
gttgacttcagccctg

SEQ ID NO: 424410 - DNA, 16 bp, M. musculus
gttgactttatttagc

SEQ ID NO: 424411 - DNA, 16 bp, M. musculus
gttgagaaacactgct

SEQ ID NO: 424412 - DNA, 16 bp, M. musculus
gttgagaaaggccatt

SEQ ID NO: 424413 - DNA, 16 bp, M. musculus
gttgagaaccactagt

SEQ ID NO: 424414 - DNA, 16 bp, M. musculus
gttgagaaccactgcc

SEQ ID NO: 424415 - DNA, 16 bp, M. musculus
gttgagaaccattggt

SEQ ID NO: 424416 - DNA, 16 bp, M. musculus
gttgagaactgctact

SEQ ID NO: 424417 - DNA, 16 bp, M. musculus
gttgagaatcactggt

SEQ ID NO: 424418 - DNA, 17 bp, M. musculus
gttgagacaggatctct

SEQ ID NO: 424419 - DNA, 16 bp, M. musculus
gttgagccagcactat

SEQ ID NO: 424420 - DNA, 16 bp, M. musculus
gttgagccatcttgcc

SEQ ID NO: 424421 - DNA, 16 bp, M. musculus
gttgaggcagggggat

SEQ ID NO: 424422 - DNA, 16 bp, M. musculus
gttgaggtctttaatc

SEQ ID NO: 424423 - DNA, 16 bp, M. musculus
gttgaggtgcccagga

SEQ ID NO: 424424 - DNA, 16 bp, M. musculus
gttgatcttagggcct

SEQ ID NO: 424425 - DNA, 16 bp, M. musculus
gttgatgatgatgatg

SEQ ID NO: 424426 - DNA, 16 bp, M. musculus
gttgatgatggtggtg

SEQ ID NO: 424427 - DNA, 16 bp, M. musculus
gttgatgctaattctg

SEQ ID NO: 424428 - DNA, 16 bp, M. musculus
gttgatggacatttgg

SEQ ID NO: 424429 - DNA, 16 bp, M. musculus
gttgatggatggatgg

SEQ ID NO: 424430 - DNA, 16 bp, M. musculus
gttgattatctcaaag

SEQ ID NO: 424431 - DNA, 16 bp, M. musculus
gttgattctctccttc

SEQ ID NO: 424432 - DNA, 16 bp, M. musculus
gttgattgattgattg

SEQ ID NO: 424433 - DNA, 16 bp, M. musculus
gttgattttcctgaat

SEQ ID NO: 424434 - DNA, 16 bp, M. musculus
gttgatttttaaaaaa

SEQ ID NO: 424435 - DNA, 16 bp, M. musculus
gttgatttttactgta

SEQ ID NO: 424436 - DNA, 16 bp, M. musculus
gttgcaaacctcttca

SEQ ID NO: 424437 - DNA, 16 bp, M. musculus
gttgcaaagagaagtt

SEQ ID NO: 424438 - DNA, 16 bp, M. musculus
gttgcagaggatctga

SEQ ID NO: 424439 - DNA, 16 bp, M. musculus
gttgcagggaccacat

SEQ ID NO: 424440 - DNA, 16 bp, M. musculus
gttgcagtaggtgtgg

SEQ ID NO: 424441 - DNA, 16 bp, M. musculus
gttgcatatcagatat

SEQ ID NO: 424442 - DNA, 16 bp, M. musculus
gttgccaagacaacag

SEQ ID NO: 424443 - DNA, 16 bp, M. musculus
gttgccacagtctctg

SEQ ID NO: 424444 - DNA, 16 bp, M. musculus
gttgccagcacccaca

SEQ ID NO: 424445 - DNA, 16 bp, M. musculus
gttgccatagcaacag

SEQ ID NO: 424446 - DNA, 16 bp, M. musculus
gttgccatctgggttc

SEQ ID NO: 424447 - DNA, 16 bp, M. musculus
gttgccatggcaactg

SEQ ID NO: 424448 - DNA, 16 bp, M. musculus
gttgccccacccccac

SEQ ID NO: 424449 - DNA, 16 bp, M. musculus
gttgccctctgacctc

SEQ ID NO: 424450 - DNA, 16 bp, M. musculus
gttgccctctgacctt

SEQ ID NO: 424451 - DNA, 16 bp, M. musculus
gttgcccttggttgcc

SEQ ID NO: 424452 - DNA, 18 bp, M. musculus
gttgcctcactttgagtt

SEQ ID NO: 424453 - DNA, 16 bp, M. musculus
gttgcctggaggtcag

SEQ ID NO: 424454 - DNA, 16 bp, M. musculus
gttgcctgtgtgagta

SEQ ID NO: 424455 - DNA, 16 bp, M. musculus
gttgccttcacacagg

SEQ ID NO: 424456 - DNA, 16 bp, M. musculus
gttgccttctgacttc

SEQ ID NO: 424457 - DNA, 16 bp, M. musculus
gttgcctttttaaaaa

SEQ ID NO: 424458 - DNA, 26 bp, M. musculus
gttgcgagctgctggcggccgcaaca

SEQ ID NO: 424459 - DNA, 16 bp, M. musculus
gttgctaaaaaaaaaa

SEQ ID NO: 424460 - DNA, 16 bp, M. musculus
gttgctaaaattcctt

SEQ ID NO: 424461 - DNA, 16 bp, M. musculus
gttgctactttataat

SEQ ID NO: 424462 - DNA, 16 bp, M. musculus
gttgctaggaatcaaa

SEQ ID NO: 424463 - DNA, 16 bp, M. musculus
gttgctatgataaaat

SEQ ID NO: 424464 - DNA, 16 bp, M. musculus
gttgctcagtcccatg

SEQ ID NO: 424465 - DNA, 16 bp, M. musculus
gttgctctctgacctc

SEQ ID NO: 424466 - DNA, 16 bp, M. musculus
gttgctctggcagagg

SEQ ID NO: 424467 - DNA, 16 bp, M. musculus
gttgctctgtgtagcc

SEQ ID NO: 424468 - DNA, 16 bp, M. musculus
gttgctgaaaattgaa

SEQ ID NO: 424469 - DNA, 16 bp, M. musculus
gttgctgaagacaaca

SEQ ID NO: 424470 - DNA, 16 bp, M. musculus
gttgctgacaggagcc

SEQ ID NO: 424471 - DNA, 16 bp, M. musculus
gttgctgagaatcaaa

SEQ ID NO: 424472 - DNA, 16 bp, M. musculus
gttgctgctgctcctg

SEQ ID NO: 424473 - DNA, 16 bp, M. musculus
gttgctgctgctgcca

SEQ ID NO: 424474 - DNA, 16 bp, M. musculus
gttgctgctgctgcct

SEQ ID NO: 424475 - DNA, 16 bp, M. musculus
gttgctgctgctgctc

SEQ ID NO: 424476 - DNA, 16 bp, M. musculus
gttgctgctgctgttg

SEQ ID NO: 424477 - DNA, 16 bp, M. musculus
gttgctgctgttgctg

SEQ ID NO: 424478 - DNA, 16 bp, M. musculus
gttgctgctttgtcct

SEQ ID NO: 424479 - DNA, 16 bp, M. musculus
gttgctggcatttgaa

SEQ ID NO: 424480 - DNA, 16 bp, M. musculus
gttgctgggattttaa

SEQ ID NO: 424481 - DNA, 16 bp, M. musculus
gttgctgtccttattc

SEQ ID NO: 424482 - DNA, 16 bp, M. musculus
gttgctgtcttcaaac

SEQ ID NO: 424483 - DNA, 16 bp, M. musculus
gttgctgtgacaaaaa

SEQ ID NO: 424484 - DNA, 16 bp, M. musculus
gttgctgtgataaagc

SEQ ID NO: 424485 - DNA, 16 bp, M. musculus
gttgctgtgctaaaac

SEQ ID NO: 424486 - DNA, 16 bp, M. musculus
gttgctgttgttttat

SEQ ID NO: 424487 - DNA, 16 bp, M. musculus
gttgcttctgcagcct

SEQ ID NO: 424488 - DNA, 16 bp, M. musculus
gttgcttgctcaaata

SEQ ID NO: 424489 - DNA, 16 bp, M. musculus
gttgcttgtttccatt

SEQ ID NO: 424490 - DNA, 16 bp, M. musculus
gttggaaaaaacaaaa

SEQ ID NO: 424491 - DNA, 16 bp, M. musculus
gttggaagaagctgag

SEQ ID NO: 424492 - DNA, 16 bp, M. musculus
gttggaatgggtatgt

SEQ ID NO: 424493 - DNA, 16 bp, M. musculus
gttggaattttgatgg

SEQ ID NO: 424494 - DNA, 16 bp, M. musculus
gttggaatttttgaga

SEQ ID NO: 424495 - DNA, 16 bp, M. musculus
gttggacaagcttgca

SEQ ID NO: 424496 - DNA, 16 bp, M. musculus
gttggacatcagtggg

SEQ ID NO: 424497 - DNA, 16 bp, M. musculus
gttggaccagcaccat

SEQ ID NO: 424498 - DNA, 16 bp, M. musculus
gttggaccatccagag

SEQ ID NO: 424499 - DNA, 16 bp, M. musculus
gttggacctggagggt

SEQ ID NO: 424500 - DNA, 16 bp, M. musculus
gttggacttgaactca

SEQ ID NO: 424501 - DNA, 16 bp, M. musculus
gttggagaaagtgtat

SEQ ID NO: 424502 - DNA, 16 bp, M. musculus
gttggagaaggagctg

SEQ ID NO: 424503 - DNA, 16 bp, M. musculus
gttggagaaggtgtgt

SEQ ID NO: 424504 - DNA, 16 bp, M. musculus
gttggagaagtgaccc

SEQ ID NO: 424505 - DNA, 16 bp, M. musculus
gttggagagaatgtgg

SEQ ID NO: 424506 - DNA, 16 bp, M. musculus
gttggagagatggctc

SEQ ID NO: 424507 - DNA, 16 bp, M. musculus
gttggagtagctgtgg

SEQ ID NO: 424508 - DNA, 16 bp, M. musculus
gttggagtaggtgtgc

SEQ ID NO: 424509 - DNA, 16 bp, M. musculus
gttggatcagaactcc

SEQ ID NO: 424510 - DNA, 17 bp, M. musculus
gttggatctcatggagg

SEQ ID NO: 424511 - DNA, 16 bp, M. musculus
gttggatcttatcaaa

SEQ ID NO: 424512 - DNA, 16 bp, M. musculus
gttggatgagatgaca

SEQ ID NO: 424513 - DNA, 16 bp, M. musculus
gttggattcccagcat

SEQ ID NO: 424514 - DNA, 16 bp, M. musculus
gttggccatcaatgag

SEQ ID NO: 424515 - DNA, 16 bp, M. musculus
gttggccattccctca

SEQ ID NO: 424516 - DNA, 16 bp, M. musculus
gttggcctcaaactcc

SEQ ID NO: 424517 - DNA, 16 bp, M. musculus
gttggcctccaactca

SEQ ID NO: 424518 - DNA, 16 bp, M. musculus
gttggctaaacaagtg

SEQ ID NO: 424519 - DNA, 16 bp, M. musculus
gttggctgagagcatc

SEQ ID NO: 424520 - DNA, 16 bp, M. musculus
gttgggaatctttgtt

SEQ ID NO: 424521 - DNA, 16 bp, M. musculus
gttgggaatgtagctc

SEQ ID NO: 424522 - DNA, 16 bp, M. musculus
gttgggacatcttctg

SEQ ID NO: 424523 - DNA, 16 bp, M. musculus
gttgggagccaccatg

SEQ ID NO: 424524 - DNA, 16 bp, M. musculus
gttgggccctccccca

SEQ ID NO: 424525 - DNA, 16 bp, M. musculus
gttgggctggtgagat

SEQ ID NO: 424526 - DNA, 16 bp, M. musculus
gttggggaagttttct

SEQ ID NO: 424527 - DNA, 16 bp, M. musculus
gttggggacagatgtt

SEQ ID NO: 424528 - DNA, 16 bp, M. musculus
gttggggagcagagag

SEQ ID NO: 424529 - DNA, 16 bp, M. musculus
gttggggagcagggga

SEQ ID NO: 424530 - DNA, 37 bp, M. musculus
gttggggcatcttctggatatatgcccaggagaggta

SEQ ID NO: 424531 - DNA, 16 bp, M. musculus
gttgggggggtcacca

SEQ ID NO: 424532 - DNA, 16 bp, M. musculus
gttggggtatccagaa

SEQ ID NO: 424533 - DNA, 16 bp, M. musculus
gttggggtccaggagt

SEQ ID NO: 424534 - DNA, 16 bp, M. musculus
gttgggtcagtcactg

SEQ ID NO: 424535 - DNA, 16 bp, M. musculus
gttgggtcctctttgt

SEQ ID NO: 424536 - DNA, 16 bp, M. musculus
gttgggtcctgtttac

SEQ ID NO: 424537 - DNA, 16 bp, M. musculus
gttgggtctcctggaa

SEQ ID NO: 424538 - DNA, 16 bp, M. musculus
gttgggtgccattttg

SEQ ID NO: 424539 - DNA, 16 bp, M. musculus
gttggtaggatgcttg

SEQ ID NO: 424540 - DNA, 16 bp, M. musculus
gttggtccctcctgct

SEQ ID NO: 424541 - DNA, 16 bp, M. musculus
gttggtctacagagtg

SEQ ID NO: 424542 - DNA, 16 bp, M. musculus
gttggtctggaacttg

SEQ ID NO: 424543 - DNA, 16 bp, M. musculus
gttggtcttccctctt

SEQ ID NO: 424544 - DNA, 16 bp, M. musculus
gttggtgaagatgtgg

SEQ ID NO: 424545 - DNA, 16 bp, M. musculus
gttggtggagtgttta

SEQ ID NO: 424546 - DNA, 16 bp, M. musculus
gttggtggatttctgt

SEQ ID NO: 424547 - DNA, 16 bp, M. musculus
gttggtggcccagtct

SEQ ID NO: 424548 - DNA, 16 bp, M. musculus
gttggtgggaatgcag

SEQ ID NO: 424549 - DNA, 16 bp, M. musculus
gttggtgtccaggttt

SEQ ID NO: 424550 - DNA, 16 bp, M. musculus
gttggtgtgattgcaa

SEQ ID NO: 424551 - DNA, 16 bp, M. musculus
gttggttactcctaca

SEQ ID NO: 424552 - DNA, 16 bp, M. musculus
gttggttcctgggatg

SEQ ID NO: 424553 - DNA, 16 bp, M. musculus
gttggttcttgccttc

SEQ ID NO: 424554 - DNA, 16 bp, M. musculus
gttggttgacactgtt

SEQ ID NO: 424555 - DNA, 16 bp, M. musculus
gttggttttcaagaca

SEQ ID NO: 424556 - DNA, 16 bp, M. musculus
gttgtacaagaaagca

SEQ ID NO: 424557 - DNA, 16 bp, M. musculus
gttgtacctgcttgca

SEQ ID NO: 424558 - DNA, 16 bp, M. musculus
gttgtacttatgtatt

SEQ ID NO: 424559 - DNA, 16 bp, M. musculus
gttgtcacacaggaat

SEQ ID NO: 424560 - DNA, 16 bp, M. musculus
gttgtcagcagtccag

SEQ ID NO: 424561 - DNA, 16 bp, M. musculus
gttgtcaggaaatcag

SEQ ID NO: 424562 - DNA, 16 bp, M. musculus
gttgtcaggcttgaca

SEQ ID NO: 424563 - DNA, 16 bp, M. musculus
gttgtcatggaaacag

SEQ ID NO: 424564 - DNA, 16 bp, M. musculus
gttgtcatggcaacag

SEQ ID NO: 424565 - DNA, 16 bp, M. musculus
gttgtccgagtgtgtt

SEQ ID NO: 424566 - DNA, 16 bp, M. musculus
gttgtcctctaacctt

SEQ ID NO: 424567 - DNA, 16 bp, M. musculus
gttgtcctctgacgtc

SEQ ID NO: 424568 - DNA, 16 bp, M. musculus
gttgtcctgaaactca

SEQ ID NO: 424569 - DNA, 16 bp, M. musculus
gttgtcctgtgtgaag

SEQ ID NO: 424570 - DNA, 16 bp, M. musculus
gttgtccttataaaag

SEQ ID NO: 424571 - DNA, 16 bp, M. musculus
gttgtccttgaacttg

SEQ ID NO: 424572 - DNA, 16 bp, M. musculus
gttgtctccatggcac

SEQ ID NO: 424573 - DNA, 16 bp, M. musculus
gttgtctccctttttg

SEQ ID NO: 424574 - DNA, 16 bp, M. musculus
gttgtctctgatgcag

SEQ ID NO: 424575 - DNA, 16 bp, M. musculus
gttgtctctgcaaata

SEQ ID NO: 424576 - DNA, 17 bp, M. musculus
gttgtctctgttaagag

SEQ ID NO: 424577 - DNA, 16 bp, M. musculus
gttgtctggaaatcag

SEQ ID NO: 424578 - DNA, 16 bp, M. musculus
gttgtctggagccgaa

SEQ ID NO: 424579 - DNA, 16 bp, M. musculus
gttgtctgtgagcatc

SEQ ID NO: 424580 - DNA, 16 bp, M. musculus
gttgtcttagttactt

SEQ ID NO: 424581 - DNA, 16 bp, M. musculus
gttgtcttctgacctc

SEQ ID NO: 424582 - DNA, 16 bp, M. musculus
gttgtgagacttttaa

SEQ ID NO: 424583 - DNA, 16 bp, M. musculus
gttgtgagcaccatgt

SEQ ID NO: 424584 - DNA, 16 bp, M. musculus
gttgtgagccaccgta

SEQ ID NO: 424585 - DNA, 17 bp, M. musculus
gttgtgagccaccgtgt

SEQ ID NO: 424586 - DNA, 16 bp, M. musculus
gttgtgagccactgga

SEQ ID NO: 424587 - DNA, 16 bp, M. musculus
gttgtgagctacccag

SEQ ID NO: 424588 - DNA, 16 bp, M. musculus
gttgtgagctgctata

SEQ ID NO: 424589 - DNA, 16 bp, M. musculus
gttgtgataaaacact

SEQ ID NO: 424590 - DNA, 16 bp, M. musculus
gttgtgatgatggtga

SEQ ID NO: 424591 - DNA, 16 bp, M. musculus
gttgtggaatgtttag

SEQ ID NO: 424592 - DNA, 16 bp, M. musculus
gttgtggatgccaaga

SEQ ID NO: 424593 - DNA, 16 bp, M. musculus
gttgtggatggccctg

SEQ ID NO: 424594 - DNA, 16 bp, M. musculus
gttgtggcacacacct

SEQ ID NO: 424595 - DNA, 16 bp, M. musculus
gttgtggcttattttc

SEQ ID NO: 424596 - DNA, 16 bp, M. musculus
gttgtggtgactccca

SEQ ID NO: 424597 - DNA, 16 bp, M. musculus
gttgtggtggcacaca

SEQ ID NO: 424598 - DNA, 16 bp, M. musculus
gttgtggtggtttgaa

SEQ ID NO: 424599 - DNA, 16 bp, M. musculus
gttgtgtctgaagaga

SEQ ID NO: 424600 - DNA, 16 bp, M. musculus
gttgtgtcttcagcaa

SEQ ID NO: 424601 - DNA, 16 bp, M. musculus
gttgtgtgtatatgtg

SEQ ID NO: 424602 - DNA, 16 bp, M. musculus
gttgttaacaaagaat

SEQ ID NO: 424603 - DNA, 16 bp, M. musculus
gttgttacagttggca

SEQ ID NO: 424604 - DNA, 16 bp, M. musculus
gttgttactgttgtta

SEQ ID NO: 424605 - DNA, 16 bp, M. musculus
gttgttagagatggaa

SEQ ID NO: 424606 - DNA, 16 bp, M. musculus
gttgttatacttgtct

SEQ ID NO: 424607 - DNA, 16 bp, M. musculus
gttgttattgttgttc

SEQ ID NO: 424608 - DNA, 16 bp, M. musculus
gttgttcctcccatgg

SEQ ID NO: 424609 - DNA, 16 bp, M. musculus
gttgttctctggcctc

SEQ ID NO: 424610 - DNA, 16 bp, M. musculus
gttgttctctttaaaa

SEQ ID NO: 424611 - DNA, 16 bp, M. musculus
gttgttgctgctgctt

SEQ ID NO: 424612 - DNA, 16 bp, M. musculus
gttgttgggaattgat

SEQ ID NO: 424613 - DNA, 16 bp, M. musculus
gttgttgtctcttaga

SEQ ID NO: 424614 - DNA, 16 bp, M. musculus
gttgttgttgttactg

SEQ ID NO: 424615 - DNA, 16 bp, M. musculus
gttgttgttgttttac

SEQ ID NO: 424616 - DNA, 16 bp, M. musculus
gttgtttacctaattt

SEQ ID NO: 424617 - DNA, 16 bp, M. musculus
gttgtttacctgtgtt

SEQ ID NO: 424618 - DNA, 16 bp, M. musculus
gttgtttatcagctat

SEQ ID NO: 424619 - DNA, 16 bp, M. musculus
gttgtttatgttcttg

SEQ ID NO: 424620 - DNA, 16 bp, M. musculus
gttgtttctgtctgaa

SEQ ID NO: 424621 - DNA, 37 bp, M. musculus
gttgttttgatttgcatttccctgatgattaaggatg

SEQ ID NO: 424622 - DNA, 16 bp, M. musculus
gttgtttttcctatag

SEQ ID NO: 424623 - DNA, 16 bp, M. musculus
gttgtttttgttgcta

SEQ ID NO: 424624 - DNA, 16 bp, M. musculus
gtttaaaaacaaacaa

SEQ ID NO: 424625 - DNA, 16 bp, M. musculus
gtttaaaagcttgaag

SEQ ID NO: 424626 - DNA, 16 bp, M. musculus
gtttaactagaatttg

SEQ ID NO: 424627 - DNA, 16 bp, M. musculus
gtttaactgaggaggg

SEQ ID NO: 424628 - DNA, 16 bp, M. musculus
gtttaagaaattgtat

SEQ ID NO: 424629 - DNA, 16 bp, M. musculus
gtttaagagcactggc

SEQ ID NO: 424630 - DNA, 16 bp, M. musculus
gtttaaggccaagcat

SEQ ID NO: 424631 - DNA, 16 bp, M. musculus
gtttaaggtcatcctt

SEQ ID NO: 424632 - DNA, 16 bp, M. musculus
gtttaatatggaagct

SEQ ID NO: 424633 - DNA, 16 bp, M. musculus
gtttaatcccagcact

SEQ ID NO: 424634 - DNA, 16 bp, M. musculus
gtttaatccctgggag

SEQ ID NO: 424635 - DNA, 16 bp, M. musculus
gtttaatcctagcact

SEQ ID NO: 424636 - DNA, 16 bp, M. musculus
gtttaatcctcagcac

SEQ ID NO: 424637 - DNA, 16 bp, M. musculus
gtttaattctttgaat

SEQ ID NO: 424638 - DNA, 16 bp, M. musculus
gtttacaaaagagata

SEQ ID NO: 424639 - DNA, 16 bp, M. musculus
gtttacacttccacat

SEQ ID NO: 424640 - DNA, 16 bp, M. musculus
gtttacatactggatt

SEQ ID NO: 424641 - DNA, 16 bp, M. musculus
gtttacatttccaatg

SEQ ID NO: 424642 - DNA, 16 bp, M. musculus
gtttacttggctcaca

SEQ ID NO: 424643 - DNA, 16 bp, M. musculus
gtttactttctgtttc

SEQ ID NO: 424644 - DNA, 16 bp, M. musculus
gtttagaagtagttct

SEQ ID NO: 424645 - DNA, 16 bp, M. musculus
gtttagagtaaataaa

SEQ ID NO: 424646 - DNA, 16 bp, M. musculus
gtttagatcattaacc

SEQ ID NO: 424647 - DNA, 16 bp, M. musculus
gtttagatttgtgatt

SEQ ID NO: 424648 - DNA, 16 bp, M. musculus
gtttaggaaattatat

SEQ ID NO: 424649 - DNA, 16 bp, M. musculus
gtttagtccactgtca

SEQ ID NO: 424650 - DNA, 16 bp, M. musculus
gtttagtccctgagag

SEQ ID NO: 424651 - DNA, 16 bp, M. musculus
gtttagttctcagcac

SEQ ID NO: 424652 - DNA, 60 bp, M. musculus
gtttataatagccagaagctggaaagaacccagatgcccctcaacagaggaatggataca

SEQ ID NO: 424653 - DNA, 16 bp, M. musculus
gtttatatgttgcaca

SEQ ID NO: 424654 - DNA, 17 bp, M. musculus
gtttatcagactctgca

SEQ ID NO: 424655 - DNA, 16 bp, M. musculus
gtttattcagcttata

SEQ ID NO: 424656 - DNA, 16 bp, M. musculus
gtttatttggcttatt

SEQ ID NO: 424657 - DNA, 16 bp, M. musculus
gtttatttggtgctgg

SEQ ID NO: 424658 - DNA, 16 bp, M. musculus
gtttattttctaaaga

SEQ ID NO: 424659 - DNA, 16 bp, M. musculus
gtttattttctcaaag

SEQ ID NO: 424660 - DNA, 16 bp, M. musculus
gtttcaaaaaagaaaa

SEQ ID NO: 424661 - DNA, 16 bp, M. musculus
gtttcaaaaaagccca

SEQ ID NO: 424662 - DNA, 16 bp, M. musculus
gtttcaaaaatcaaaa

SEQ ID NO: 424663 - DNA, 16 bp, M. musculus
gtttcaaaacaaacaa

SEQ ID NO: 424664 - DNA, 16 bp, M. musculus
gtttcaaaacacaaaa

SEQ ID NO: 424665 - DNA, 16 bp, M. musculus
gtttcaaaagcccact

SEQ ID NO: 424666 - DNA, 16 bp, M. musculus
gtttcaacaatgttaa

SEQ ID NO: 424667 - DNA, 16 bp, M. musculus
gtttcactatgcagcc

SEQ ID NO: 424668 - DNA, 16 bp, M. musculus
gtttcactgccctgtt

SEQ ID NO: 424669 - DNA, 16 bp, M. musculus
gtttcactgtgcagcc

SEQ ID NO: 424670 - DNA, 16 bp, M. musculus
gtttcactgtgtgtgt

SEQ ID NO: 424671 - DNA, 16 bp, M. musculus
gtttcactttttaaaa

SEQ ID NO: 424672 - DNA, 16 bp, M. musculus
gtttcagaggcttaat

SEQ ID NO: 424673 - DNA, 16 bp, M. musculus
gtttcagaggtttcag

SEQ ID NO: 424674 - DNA, 16 bp, M. musculus
gtttcagctgctgcca

SEQ ID NO: 424675 - DNA, 16 bp, M. musculus
gtttcaggtcagccag

SEQ ID NO: 424676 - DNA, 16 bp, M. musculus
gtttcagtctgctgct

SEQ ID NO: 424677 - DNA, 16 bp, M. musculus
gtttcagtggtcagat

SEQ ID NO: 424678 - DNA, 16 bp, M. musculus
gtttcagtgtgtgtgt

SEQ ID NO: 424679 - DNA, 16 bp, M. musculus
gtttcagtttctctgg

SEQ ID NO: 424680 - DNA, 16 bp, M. musculus
gtttcatgatgtccca

SEQ ID NO: 424681 - DNA, 16 bp, M. musculus
gtttcatgtattttac

SEQ ID NO: 424682 - DNA, 16 bp, M. musculus
gtttcattgagaagag

SEQ ID NO: 424683 - DNA, 16 bp, M. musculus
gtttcattggctgagg

SEQ ID NO: 424684 - DNA, 16 bp, M. musculus
gtttcatttctgttgc

SEQ ID NO: 424685 - DNA, 16 bp, M. musculus
gtttccagcccccaca

SEQ ID NO: 424686 - DNA, 16 bp, M. musculus
gtttccagcttctgga

SEQ ID NO: 424687 - DNA, 16 bp, M. musculus
gtttccaggaatgaaa

SEQ ID NO: 424688 - DNA, 16 bp, M. musculus
gtttccaggcaacaat

SEQ ID NO: 424689 - DNA, 16 bp, M. musculus
gtttccaggggcagaa

SEQ ID NO: 424690 - DNA, 16 bp, M. musculus
gtttccatggagacca

SEQ ID NO: 424691 - DNA, 16 bp, M. musculus
gtttccatggtcatgg

SEQ ID NO: 424692 - DNA, 16 bp, M. musculus
gtttccatgtggcttt

SEQ ID NO: 424693 - DNA, 16 bp, M. musculus
gtttccccacccaccc

SEQ ID NO: 424694 - DNA, 16 bp, M. musculus
gtttccccactttctc

SEQ ID NO: 424695 - DNA, 16 bp, M. musculus
gtttcccccaaactct

SEQ ID NO: 424696 - DNA, 16 bp, M. musculus
gtttccccgtgaatgt

SEQ ID NO: 424697 - DNA, 16 bp, M. musculus
gtttcccctcaaaaaa

SEQ ID NO: 424698 - DNA, 16 bp, M. musculus
gtttcccctccagaaa

SEQ ID NO: 424699 - DNA, 16 bp, M. musculus
gtttcccctctgcaaa

SEQ ID NO: 424700 - DNA, 16 bp, M. musculus
gtttccctccatgtgt

SEQ ID NO: 424701 - DNA, 16 bp, M. musculus
gtttccctccctcctg

SEQ ID NO: 424702 - DNA, 16 bp, M. musculus
gtttccctgcctgcca

SEQ ID NO: 424703 - DNA, 16 bp, M. musculus
gtttccctgtatgtga

SEQ ID NO: 424704 - DNA, 16 bp, M. musculus
gtttccctgtgtagcc

SEQ ID NO: 424705 - DNA, 16 bp, M. musculus
gtttcctcctccaagt

SEQ ID NO: 424706 - DNA, 16 bp, M. musculus
gtttcctctcagaaaa

SEQ ID NO: 424707 - DNA, 16 bp, M. musculus
gtttcctcttcccaga

SEQ ID NO: 424708 - DNA, 16 bp, M. musculus
gtttcctgacctgctt

SEQ ID NO: 424709 - DNA, 16 bp, M. musculus
gtttcctgccttgagt

SEQ ID NO: 424710 - DNA, 16 bp, M. musculus
gtttcctgcttggtgg

SEQ ID NO: 424711 - DNA, 16 bp, M. musculus
gtttccttatggcatt

SEQ ID NO: 424712 - DNA, 16 bp, M. musculus
gtttccttccttgtat

SEQ ID NO: 424713 - DNA, 16 bp, M. musculus
gtttcctttgctgtga

SEQ ID NO: 424714 - DNA, 16 bp, M. musculus
gtttctacctccccag

SEQ ID NO: 424715 - DNA, 16 bp, M. musculus
gtttctactccacctt

SEQ ID NO: 424716 - DNA, 16 bp, M. musculus
gtttctagaacattct

SEQ ID NO: 424717 - DNA, 16 bp, M. musculus
gtttctatctacagag

SEQ ID NO: 424718 - DNA, 16 bp, M. musculus
gtttctatctccagag

SEQ ID NO: 424719 - DNA, 16 bp, M. musculus
gtttctattgctgtga

SEQ ID NO: 424720 - DNA, 16 bp, M. musculus
gtttctatttgatgta

SEQ ID NO: 424721 - DNA, 16 bp, M. musculus
gtttctcagaaaaaaa

SEQ ID NO: 424722 - DNA, 16 bp, M. musculus
gtttctccatttatgg

SEQ ID NO: 424723 - DNA, 16 bp, M. musculus
gtttctccctggaagg

SEQ ID NO: 424724 - DNA, 16 bp, M. musculus
gtttctccttgtagcc

SEQ ID NO: 424725 - DNA, 16 bp, M. musculus
gtttctctccttccac

SEQ ID NO: 424726 - DNA, 16 bp, M. musculus
gtttctctccttttag

SEQ ID NO: 424727 - DNA, 16 bp, M. musculus
gtttctctgtgtaact

SEQ ID NO: 424728 - DNA, 16 bp, M. musculus
gtttctctgtgtcctg

SEQ ID NO: 424729 - DNA, 16 bp, M. musculus
gtttctctgttgctgt

SEQ ID NO: 424730 - DNA, 16 bp, M. musculus
gtttctcttgcagagg

SEQ ID NO: 424731 - DNA, 16 bp, M. musculus
gtttctctttgtagcc

SEQ ID NO: 424732 - DNA, 16 bp, M. musculus
gtttctgaaactgctg

SEQ ID NO: 424733 - DNA, 16 bp, M. musculus
gtttctgaactaagtc

SEQ ID NO: 424734 - DNA, 16 bp, M. musculus
gtttctgatcaaggct

SEQ ID NO: 424735 - DNA, 16 bp, M. musculus
gtttctgattttgtta

SEQ ID NO: 424736 - DNA, 16 bp, M. musculus
gtttctgcacagcaaa

SEQ ID NO: 424737 - DNA, 16 bp, M. musculus
gtttctgccagtcttt

SEQ ID NO: 424738 - DNA, 16 bp, M. musculus
gtttctgctgtgcctg

SEQ ID NO: 424739 - DNA, 16 bp, M. musculus
gtttctggctattatg

SEQ ID NO: 424740 - DNA, 16 bp, M. musculus
gtttctgggaattaaa

SEQ ID NO: 424741 - DNA, 16 bp, M. musculus
gtttctgtagtccaca

SEQ ID NO: 424742 - DNA, 16 bp, M. musculus
gtttctgtatttgttc

SEQ ID NO: 424743 - DNA, 16 bp, M. musculus
gtttctgtctgtgccc

SEQ ID NO: 424744 - DNA, 16 bp, M. musculus
gtttctgtctgtgtct

SEQ ID NO: 424745 - DNA, 16 bp, M. musculus
gtttctgtctttgtat

SEQ ID NO: 424746 - DNA, 16 bp, M. musculus
gtttctgtgaactttt

SEQ ID NO: 424747 - DNA, 16 bp, M. musculus
gtttctgtgagtttgt

SEQ ID NO: 424748 - DNA, 16 bp, M. musculus
gtttctgtggtgctgg

SEQ ID NO: 424749 - DNA, 16 bp, M. musculus
gtttctgtgtctgtct

SEQ ID NO: 424750 - DNA, 16 bp, M. musculus
gtttctgttgctatga

SEQ ID NO: 424751 - DNA, 16 bp, M. musculus
gtttctgttgctatgt

SEQ ID NO: 424752 - DNA, 16 bp, M. musculus
gtttctgttgctgaga

SEQ ID NO: 424753 - DNA, 16 bp, M. musculus
gtttctgttgctgtga

SEQ ID NO: 424754 - DNA, 16 bp, M. musculus
gtttctgttgctgtgg

SEQ ID NO: 424755 - DNA, 16 bp, M. musculus
gtttctgtttggaggc

SEQ ID NO: 424756 - DNA, 16 bp, M. musculus
gtttcttactggcttg

SEQ ID NO: 424757 - DNA, 16 bp, M. musculus
gtttcttctggatcaa

SEQ ID NO: 424758 - DNA, 16 bp, M. musculus
gtttcttgtagcccag

SEQ ID NO: 424759 - DNA, 16 bp, M. musculus
gtttctttaataaatg

SEQ ID NO: 424760 - DNA, 16 bp, M. musculus
gtttctttgcaacatc

SEQ ID NO: 424761 - DNA, 16 bp, M. musculus
gtttctttggaaactc

SEQ ID NO: 424762 - DNA, 16 bp, M. musculus
gtttctttgtgcagcc

SEQ ID NO: 424763 - DNA, 16 bp, M. musculus
gtttctttgtgtagct

SEQ ID NO: 424764 - DNA, 16 bp, M. musculus
gtttcttttatcattg

SEQ ID NO: 424765 - DNA, 16 bp, M. musculus
gtttgaaaagactcct

SEQ ID NO: 424766 - DNA, 16 bp, M. musculus
gtttgaaaggaggaaa

SEQ ID NO: 424767 - DNA, 16 bp, M. musculus
gtttgaaatgtaaatg

SEQ ID NO: 424768 - DNA, 16 bp, M. musculus
gtttgaacccagggcc

SEQ ID NO: 424769 - DNA, 17 bp, M. musculus
gtttgaagccagcctgg

SEQ ID NO: 424770 - DNA, 16 bp, M. musculus
gtttgagaagtattga

SEQ ID NO: 424771 - DNA, 17 bp, M. musculus
gtttgagacaaggtctt

SEQ ID NO: 424772 - DNA, 16 bp, M. musculus
gtttgagacagaatct

SEQ ID NO: 424773 - DNA, 16 bp, M. musculus
gtttgagaccagtctg

SEQ ID NO: 424774 - DNA, 16 bp, M. musculus
gtttgagagcagcctg

SEQ ID NO: 424775 - DNA, 16 bp, M. musculus
gtttgagatggggtct

SEQ ID NO: 424776 - DNA, 16 bp, M. musculus
gtttgagattaaaggt

SEQ ID NO: 424777 - DNA, 16 bp, M. musculus
gtttgagcatttgaaa

SEQ ID NO: 424778 - DNA, 16 bp, M. musculus
gtttgaggacagcttg

SEQ ID NO: 424779 - DNA, 16 bp, M. musculus
gtttgaggccagcccg

SEQ ID NO: 424780 - DNA, 16 bp, M. musculus
gtttgaggccagcctc

SEQ ID NO: 424781 - DNA, 16 bp, M. musculus
gtttgaggctcttctc

SEQ ID NO: 424782 - DNA, 16 bp, M. musculus
gtttgaggtcatcctg

SEQ ID NO: 424783 - DNA, 16 bp, M. musculus
gtttgaggttagcctg

SEQ ID NO: 424784 - DNA, 16 bp, M. musculus
gtttgagtcccagaac

SEQ ID NO: 424785 - DNA, 16 bp, M. musculus
gtttgagtgaaatatt

SEQ ID NO: 424786 - DNA, 16 bp, M. musculus
gtttgagtgcttggcc

SEQ ID NO: 424787 - DNA, 16 bp, M. musculus
gtttgatcagcaccat

SEQ ID NO: 424788 - DNA, 16 bp, M. musculus
gtttgatccccagaaa

SEQ ID NO: 424789 - DNA, 16 bp, M. musculus
gtttgatgtggagttc

SEQ ID NO: 424790 - DNA, 16 bp, M. musculus
gtttgattattttcct

SEQ ID NO: 424791 - DNA, 16 bp, M. musculus
gtttgattcccaacac

SEQ ID NO: 424792 - DNA, 16 bp, M. musculus
gtttgattccccagca

SEQ ID NO: 424793 - DNA, 16 bp, M. musculus
gtttgattcctggaac

SEQ ID NO: 424794 - DNA, 16 bp, M. musculus
gtttgattctcagcac

SEQ ID NO: 424795 - DNA, 16 bp, M. musculus
gtttgatttttcaaga

SEQ ID NO: 424796 - DNA, 16 bp, M. musculus
gtttgcaagatcaatg

SEQ ID NO: 424797 - DNA, 16 bp, M. musculus
gtttgcaaggatttta

SEQ ID NO: 424798 - DNA, 16 bp, M. musculus
gtttgcacaaagaatg

SEQ ID NO: 424799 - DNA, 16 bp, M. musculus
gtttgcacactcagga

SEQ ID NO: 424800 - DNA, 17 bp, M. musculus
gtttgccagtcagcagg

SEQ ID NO: 424801 - DNA, 16 bp, M. musculus
gtttgcccagatggtt

SEQ ID NO: 424802 - DNA, 16 bp, M. musculus
gtttgcctctgcctcc

SEQ ID NO: 424803 - DNA, 16 bp, M. musculus
gtttgcctgtctgtct

SEQ ID NO: 424804 - DNA, 16 bp, M. musculus
gtttgcctgtgtgtgt

SEQ ID NO: 424805 - DNA, 17 bp, M. musculus
gtttgctaggccccagc

SEQ ID NO: 424806 - DNA, 21 bp, M. musculus
gtttgctaggccccggcatag

SEQ ID NO: 424807 - DNA, 16 bp, M. musculus
gtttgctaggcccctg

SEQ ID NO: 424808 - DNA, 16 bp, M. musculus
gtttgctcctcctgct

SEQ ID NO: 424809 - DNA, 16 bp, M. musculus
gtttgctgacaggagc

SEQ ID NO: 424810 - DNA, 16 bp, M. musculus
gtttgctttccattat

SEQ ID NO: 424811 - DNA, 16 bp, M. musculus
gtttgctttctattat

SEQ ID NO: 424812 - DNA, 16 bp, M. musculus
gtttggaaagttttct

SEQ ID NO: 424813 - DNA, 16 bp, M. musculus
gtttggaatacctaag

SEQ ID NO: 424814 - DNA, 16 bp, M. musculus
gtttggagctaaaaca

SEQ ID NO: 424815 - DNA, 16 bp, M. musculus
gtttggagctgaaaca

SEQ ID NO: 424816 - DNA, 16 bp, M. musculus
gtttggattcccagca

SEQ ID NO: 424817 - DNA, 16 bp, M. musculus
gtttggcaattcctca

SEQ ID NO: 424818 - DNA, 16 bp, M. musculus
gtttgggggcagcctg

SEQ ID NO: 424819 - DNA, 16 bp, M. musculus
gtttgggtttttgaga

SEQ ID NO: 424820 - DNA, 16 bp, M. musculus
gtttggtctgttgcta

SEQ ID NO: 424821 - DNA, 16 bp, M. musculus
gtttggtgactgaata

SEQ ID NO: 424822 - DNA, 16 bp, M. musculus
gtttggtggctgataa

SEQ ID NO: 424823 - DNA, 16 bp, M. musculus
gtttggtggttcttca

SEQ ID NO: 424824 - DNA, 16 bp, M. musculus
gtttggtggtttctca

SEQ ID NO: 424825 - DNA, 16 bp, M. musculus
gtttggttcccaacac

SEQ ID NO: 424826 - DNA, 16 bp, M. musculus
gtttggttcccagctc

SEQ ID NO: 424827 - DNA, 16 bp, M. musculus
gtttggttcccaggac

SEQ ID NO: 424828 - DNA, 16 bp, M. musculus
gtttgtaagaagaagt

SEQ ID NO: 424829 - DNA, 16 bp, M. musculus
gtttgtaataataaaa

SEQ ID NO: 424830 - DNA, 16 bp, M. musculus
gtttgtacaggaatag

SEQ ID NO: 424831 - DNA, 16 bp, M. musculus
gtttgtatgtgctcag

SEQ ID NO: 424832 - DNA, 16 bp, M. musculus
gtttgtctttgtcact

SEQ ID NO: 424833 - DNA, 16 bp, M. musculus
gtttgtcttttcttca

SEQ ID NO: 424834 - DNA, 16 bp, M. musculus
gtttgtgaagttttct

SEQ ID NO: 424835 - DNA, 16 bp, M. musculus
gtttgtgcacatgtat

SEQ ID NO: 424836 - DNA, 16 bp, M. musculus
gtttgtgcatttgtgt

SEQ ID NO: 424837 - DNA, 16 bp, M. musculus
gtttgtggccaacctg

SEQ ID NO: 424838 - DNA, 16 bp, M. musculus
gtttgtgtcatgttga

SEQ ID NO: 424839 - DNA, 16 bp, M. musculus
gtttgtgtgtcaagtt

SEQ ID NO: 424840 - DNA, 16 bp, M. musculus
gtttgtgtgtgcatgc

SEQ ID NO: 424841 - DNA, 16 bp, M. musculus
gtttgtgtttcctcag

SEQ ID NO: 424842 - DNA, 16 bp, M. musculus
gtttgttcataataaa

SEQ ID NO: 424843 - DNA, 16 bp, M. musculus
gtttgttgaaagaaga

SEQ ID NO: 424844 - DNA, 16 bp, M. musculus
gtttgttgaaggatca

SEQ ID NO: 424845 - DNA, 16 bp, M. musculus
gtttgttggaggatta

SEQ ID NO: 424846 - DNA, 16 bp, M. musculus
gtttgtttatatacta

SEQ ID NO: 424847 - DNA, 16 bp, M. musculus
gtttgtttgtataata

SEQ ID NO: 424848 - DNA, 16 bp, M. musculus
gtttgtttgtgacaga

SEQ ID NO: 424849 - DNA, 16 bp, M. musculus
gtttgttttatcctat

SEQ ID NO: 424850 - DNA, 16 bp, M. musculus
gtttgttttgagtcag

SEQ ID NO: 424851 - DNA, 16 bp, M. musculus
gtttgtttttaaacaa

SEQ ID NO: 424852 - DNA, 16 bp, M. musculus
gtttgttttttaaagc

SEQ ID NO: 424853 - DNA, 16 bp, M. musculus
gtttgttttttcaaaa

SEQ ID NO: 424854 - DNA, 16 bp, M. musculus
gttttaaaaaacaaaa

SEQ ID NO: 424855 - DNA, 16 bp, M. musculus
gttttaaaaacaaaaa

SEQ ID NO: 424856 - DNA, 16 bp, M. musculus
gttttaaaaacaaaca

SEQ ID NO: 424857 - DNA, 16 bp, M. musculus
gttttaaaaataactt

SEQ ID NO: 424858 - DNA, 16 bp, M. musculus
gttttaaagaaatgaa

SEQ ID NO: 424859 - DNA, 16 bp, M. musculus
gttttaaagcccacac

SEQ ID NO: 424860 - DNA, 16 bp, M. musculus
gttttacaggatgcca

SEQ ID NO: 424861 - DNA, 16 bp, M. musculus
gttttactgctatgaa

SEQ ID NO: 424862 - DNA, 16 bp, M. musculus
gttttagaaaagcagt

SEQ ID NO: 424863 - DNA, 16 bp, M. musculus
gttttagaagttttta

SEQ ID NO: 424864 - DNA, 16 bp, M. musculus
gttttagacagggtct

SEQ ID NO: 424865 - DNA, 16 bp, M. musculus
gttttagagatgccag

SEQ ID NO: 424866 - DNA, 19 bp, M. musculus
gttttagcccttgccgtga

SEQ ID NO: 424867 - DNA, 16 bp, M. musculus
gttttagctcttttgt

SEQ ID NO: 424868 - DNA, 16 bp, M. musculus
gttttaggccagtctg

SEQ ID NO: 424869 - DNA, 17 bp, M. musculus
gttttagttgtcactgt

SEQ ID NO: 424870 - DNA, 17 bp, M. musculus
gttttataagagagcag

SEQ ID NO: 424871 - DNA, 16 bp, M. musculus
gttttatacaattaaa

SEQ ID NO: 424872 - DNA, 16 bp, M. musculus
gttttatctgatcctg

SEQ ID NO: 424873 - DNA, 16 bp, M. musculus
gttttatgtggagatc

SEQ ID NO: 424874 - DNA, 16 bp, M. musculus
gttttatgttgaaaaa

SEQ ID NO: 424875 - DNA, 16 bp, M. musculus
gttttatgttgaagtt

SEQ ID NO: 424876 - DNA, 16 bp, M. musculus
gttttattgctgggaa

SEQ ID NO: 424877 - DNA, 16 bp, M. musculus
gttttattgctgttaa

SEQ ID NO: 424878 - DNA, 16 bp, M. musculus
gttttattttcaaaat

SEQ ID NO: 424879 - DNA, 16 bp, M. musculus
gttttcaacattttgt

SEQ ID NO: 424880 - DNA, 16 bp, M. musculus
gttttcacaagatgat

SEQ ID NO: 424881 - DNA, 16 bp, M. musculus
gttttcagagaagggg

SEQ ID NO: 424882 - DNA, 16 bp, M. musculus
gttttcagatggtctt

SEQ ID NO: 424883 - DNA, 16 bp, M. musculus
gttttcagatgtgctg

SEQ ID NO: 424884 - DNA, 16 bp, M. musculus
gttttcagcctctgag

SEQ ID NO: 424885 - DNA, 16 bp, M. musculus
gttttcagtgaaacag

SEQ ID NO: 424886 - DNA, 16 bp, M. musculus
gttttcatacaatata

SEQ ID NO: 424887 - DNA, 16 bp, M. musculus
gttttcatatacttca

SEQ ID NO: 424888 - DNA, 16 bp, M. musculus
gttttcatgactcacc

SEQ ID NO: 424889 - DNA, 16 bp, M. musculus
gttttcattttaaata

SEQ ID NO: 424890 - DNA, 16 bp, M. musculus
gttttccaagacagag

SEQ ID NO: 424891 - DNA, 16 bp, M. musculus
gttttccaagtaatgg

SEQ ID NO: 424892 - DNA, 16 bp, M. musculus
gttttccagcctttct

SEQ ID NO: 424893 - DNA, 16 bp, M. musculus
gttttccagcctttta

SEQ ID NO: 424894 - DNA, 16 bp, M. musculus
gttttccagttttgat

SEQ ID NO: 424895 - DNA, 16 bp, M. musculus
gttttccatctatttt

SEQ ID NO: 424896 - DNA, 16 bp, M. musculus
gttttcccctttccat

SEQ ID NO: 424897 - DNA, 16 bp, M. musculus
gttttccctccaaaaa

SEQ ID NO: 424898 - DNA, 16 bp, M. musculus
gttttccctctgcaaa

SEQ ID NO: 424899 - DNA, 16 bp, M. musculus
gttttccctttattgt

SEQ ID NO: 424900 - DNA, 16 bp, M. musculus
gttttcctggaattct

SEQ ID NO: 424901 - DNA, 16 bp, M. musculus
gttttcctgttattct

SEQ ID NO: 424902 - DNA, 16 bp, M. musculus
gttttccttcacgtgg

SEQ ID NO: 424903 - DNA, 16 bp, M. musculus
gttttccttcatgtgg

SEQ ID NO: 424904 - DNA, 16 bp, M. musculus
gttttcctttttaaaa

SEQ ID NO: 424905 - DNA, 16 bp, M. musculus
gttttctaaggagaga

SEQ ID NO: 424906 - DNA, 16 bp, M. musculus
gttttctccttccacc

SEQ ID NO: 424907 - DNA, 16 bp, M. musculus
gttttctcttttaaaa

SEQ ID NO: 424908 - DNA, 16 bp, M. musculus
gttttctctttttaaa

SEQ ID NO: 424909 - DNA, 16 bp, M. musculus
gttttctgaaagcaca

SEQ ID NO: 424910 - DNA, 16 bp, M. musculus
gttttctgagacaagg

SEQ ID NO: 424911 - DNA, 16 bp, M. musculus
gttttctgagacagag

SEQ ID NO: 424912 - DNA, 16 bp, M. musculus
gttttctgatttaaaa

SEQ ID NO: 424913 - DNA, 16 bp, M. musculus
gttttctgcttcccca

SEQ ID NO: 424914 - DNA, 16 bp, M. musculus
gttttctgtctccaga

SEQ ID NO: 424915 - DNA, 16 bp, M. musculus
gttttctgtctggtgg

SEQ ID NO: 424916 - DNA, 16 bp, M. musculus
gttttctgtttttcca

SEQ ID NO: 424917 - DNA, 16 bp, M. musculus
gttttcttcattgctt

SEQ ID NO: 424918 - DNA, 16 bp, M. musculus
gttttcttgtcccagg

SEQ ID NO: 424919 - DNA, 16 bp, M. musculus
gttttgaaaagcattt

SEQ ID NO: 424920 - DNA, 16 bp, M. musculus
gttttgaaacaaggtt

SEQ ID NO: 424921 - DNA, 16 bp, M. musculus
gttttgaaacagggtt

SEQ ID NO: 424922 - DNA, 16 bp, M. musculus
gttttgacacagggtt

SEQ ID NO: 424923 - DNA, 16 bp, M. musculus
gttttgactattattt

SEQ ID NO: 424924 - DNA, 16 bp, M. musculus
gttttgagaaaaaaaa

SEQ ID NO: 424925 - DNA, 16 bp, M. musculus
gttttgagccaccata

SEQ ID NO: 424926 - DNA, 16 bp, M. musculus
gttttgaggttttaaa

SEQ ID NO: 424927 - DNA, 16 bp, M. musculus
gttttgagtttgaggc

SEQ ID NO: 424928 - DNA, 16 bp, M. musculus
gttttgatcatggtgt

SEQ ID NO: 424929 - DNA, 16 bp, M. musculus
gttttgcagcctttca

SEQ ID NO: 424930 - DNA, 16 bp, M. musculus
gttttgcatttctctg

SEQ ID NO: 424931 - DNA, 16 bp, M. musculus
gttttgcctgtatatg

SEQ ID NO: 424932 - DNA, 16 bp, M. musculus
gttttgctgatgttct

SEQ ID NO: 424933 - DNA, 16 bp, M. musculus
gttttgctgctgtgaa

SEQ ID NO: 424934 - DNA, 16 bp, M. musculus
gttttgctgggcatag

SEQ ID NO: 424935 - DNA, 16 bp, M. musculus
gttttgcttgcagcag

SEQ ID NO: 424936 - DNA, 16 bp, M. musculus
gttttgctttgcattt

SEQ ID NO: 424937 - DNA, 16 bp, M. musculus
gttttgcttttaaatt

SEQ ID NO: 424938 - DNA, 16 bp, M. musculus
gttttggagacaggct

SEQ ID NO: 424939 - DNA, 16 bp, M. musculus
gttttggagaggaaac

SEQ ID NO: 424940 - DNA, 16 bp, M. musculus
gttttggataatggtt

SEQ ID NO: 424941 - DNA, 16 bp, M. musculus
gttttggatttcatca

SEQ ID NO: 424942 - DNA, 25 bp, M. musculus
gttttgggctaatatccacttatca

SEQ ID NO: 424943 - DNA, 16 bp, M. musculus
gttttgggggctggag

SEQ ID NO: 424944 - DNA, 16 bp, M. musculus
gttttggtcaacttga

SEQ ID NO: 424945 - DNA, 16 bp, M. musculus
gttttggtttttcaag

SEQ ID NO: 424946 - DNA, 16 bp, M. musculus
gttttgtaagcttctt

SEQ ID NO: 424947 - DNA, 16 bp, M. musculus
gttttgtaggtgagtt

SEQ ID NO: 424948 - DNA, 16 bp, M. musculus
gttttgtcatggaata

SEQ ID NO: 424949 - DNA, 16 bp, M. musculus
gttttgtccaattcca

SEQ ID NO: 424950 - DNA, 16 bp, M. musculus
gttttgtctgcatatg

SEQ ID NO: 424951 - DNA, 16 bp, M. musculus
gttttgtgtcaggaaa

SEQ ID NO: 424952 - DNA, 16 bp, M. musculus
gttttgttaataaaag

SEQ ID NO: 424953 - DNA, 16 bp, M. musculus
gttttgttcttgccct

SEQ ID NO: 424954 - DNA, 16 bp, M. musculus
gttttgttcttttaaa

SEQ ID NO: 424955 - DNA, 16 bp, M. musculus
gttttgttgctgtgaa

SEQ ID NO: 424956 - DNA, 16 bp, M. musculus
gttttgttgtggaaaa

SEQ ID NO: 424957 - DNA, 16 bp, M. musculus
gttttgtttacatgta

SEQ ID NO: 424958 - DNA, 16 bp, M. musculus
gttttgtttcagtttg

SEQ ID NO: 424959 - DNA, 16 bp, M. musculus
gttttgtttcatttca

SEQ ID NO: 424960 - DNA, 16 bp, M. musculus
gttttgtttccagaca

SEQ ID NO: 424961 - DNA, 16 bp, M. musculus
gttttgttttaaaaag

SEQ ID NO: 424962 - DNA, 16 bp, M. musculus
gttttgttttaaatct

SEQ ID NO: 424963 - DNA, 16 bp, M. musculus
gttttgttttctgaat

SEQ ID NO: 424964 - DNA, 16 bp, M. musculus
gttttgttttctgtag

SEQ ID NO: 424965 - DNA, 19 bp, M. musculus
gttttgttttgagacaggg

SEQ ID NO: 424966 - DNA, 16 bp, M. musculus
gttttgttttgtaaaa

SEQ ID NO: 424967 - DNA, 16 bp, M. musculus
gttttgttttgttaca

SEQ ID NO: 424968 - DNA, 16 bp, M. musculus
gttttgtttttaacat

SEQ ID NO: 424969 - DNA, 16 bp, M. musculus
gttttgtttttccaaa

SEQ ID NO: 424970 - DNA, 16 bp, M. musculus
gttttgtttttcctga

SEQ ID NO: 424971 - DNA, 16 bp, M. musculus
gtttttaaaaagcaaa

SEQ ID NO: 424972 - DNA, 16 bp, M. musculus
gtttttaaaacttcta

SEQ ID NO: 424973 - DNA, 16 bp, M. musculus
gtttttaaaagatttc

SEQ ID NO: 424974 - DNA, 16 bp, M. musculus
gtttttaaacactgaa

SEQ ID NO: 424975 - DNA, 16 bp, M. musculus
gtttttaaagaaaaac

SEQ ID NO: 424976 - DNA, 16 bp, M. musculus
gtttttaaaggaaaga

SEQ ID NO: 424977 - DNA, 16 bp, M. musculus
gtttttaaagtgtgtg

SEQ ID NO: 424978 - DNA, 16 bp, M. musculus
gtttttaaatgatctt

SEQ ID NO: 424979 - DNA, 16 bp, M. musculus
gtttttaatagctgaa

SEQ ID NO: 424980 - DNA, 16 bp, M. musculus
gtttttaatcctagca

SEQ ID NO: 424981 - DNA, 16 bp, M. musculus
gtttttaatgacttct

SEQ ID NO: 424982 - DNA, 16 bp, M. musculus
gtttttagcttctcct

SEQ ID NO: 424983 - DNA, 16 bp, M. musculus
gtttttataagatttg

SEQ ID NO: 424984 - DNA, 16 bp, M. musculus
gtttttattatacaga

SEQ ID NO: 424985 - DNA, 16 bp, M. musculus
gtttttattttcaaat

SEQ ID NO: 424986 - DNA, 16 bp, M. musculus
gtttttcaaaacctac

SEQ ID NO: 424987 - DNA, 22 bp, M. musculus
gtttttcaagacagggtttctt

SEQ ID NO: 424988 - DNA, 16 bp, M. musculus
gtttttcagaaaattg

SEQ ID NO: 424989 - DNA, 16 bp, M. musculus
gtttttcccttcccta

SEQ ID NO: 424990 - DNA, 16 bp, M. musculus
gtttttctatatagcc

SEQ ID NO: 424991 - DNA, 16 bp, M. musculus
gtttttctatgtagct

SEQ ID NO: 424992 - DNA, 16 bp, M. musculus
gtttttctcagaattc

SEQ ID NO: 424993 - DNA, 16 bp, M. musculus
gtttttctccactcca

SEQ ID NO: 424994 - DNA, 16 bp, M. musculus
gtttttctctcaaact

SEQ ID NO: 424995 - DNA, 16 bp, M. musculus
gtttttctcttagaaa

SEQ ID NO: 424996 - DNA, 16 bp, M. musculus
gtttttctggaagctg

SEQ ID NO: 424997 - DNA, 16 bp, M. musculus
gtttttctgtagccct

SEQ ID NO: 424998 - DNA, 16 bp, M. musculus
gtttttcttcagaaaa

SEQ ID NO: 424999 - DNA, 16 bp, M. musculus
gtttttctttgtagcc

SEQ ID NO: 425000 - DNA, 16 bp, M. musculus
gtttttgaaacagaat

SEQ ID NO: 425001 - DNA, 16 bp, M. musculus
gtttttgagacagagc

SEQ ID NO: 425002 - DNA, 16 bp, M. musculus
gtttttgagacagggc

SEQ ID NO: 425003 - DNA, 16 bp, M. musculus
gtttttgatttcttca

SEQ ID NO: 425004 - DNA, 16 bp, M. musculus
gtttttgctatccaag

SEQ ID NO: 425005 - DNA, 16 bp, M. musculus
gtttttggaagggaaa

SEQ ID NO: 425006 - DNA, 16 bp, M. musculus
gtttttggagacaggg

SEQ ID NO: 425007 - DNA, 16 bp, M. musculus
gtttttgttctttgaa

SEQ ID NO: 425008 - DNA, 16 bp, M. musculus
gtttttgttttctaag

SEQ ID NO: 425009 - DNA, 16 bp, M. musculus
gtttttgtttttgcca

SEQ ID NO: 425010 - DNA, 16 bp, M. musculus
gttttttaaaagaaac

SEQ ID NO: 425011 - DNA, 16 bp, M. musculus
gttttttcaagacaag

SEQ ID NO: 425012 - DNA, 16 bp, M. musculus
gttttttcaagacagt

SEQ ID NO: 425013 - DNA, 16 bp, M. musculus
gttttttccacagcct

SEQ ID NO: 425014 - DNA, 16 bp, M. musculus
gttttttcccaattct

SEQ ID NO: 425015 - DNA, 16 bp, M. musculus
gttttttctgctatct

SEQ ID NO: 425016 - DNA, 23 bp, M. musculus
gttttttgagacagggtttctct

SEQ ID NO: 425017 - DNA, 16 bp, M. musculus
gtttttttaaaacaaa

SEQ ID NO: 425018 - DNA, 16 bp, M. musculus
gtttttttcaaaacag

SEQ ID NO: 425019 - DNA, 16 bp, M. musculus
gtttttttccccccat

SEQ ID NO: 425020 - DNA, 19 bp, M. musculus
gtttttttgagacaaggtt

SEQ ID NO: 425021 - DNA, 16 bp, M. musculus
gttttttttaaaagaa

SEQ ID NO: 425022 - DNA, 16 bp, M. musculus
gttttttttcccccca

SEQ ID NO: 425023 - DNA, 16 bp, M. musculus
gtttttttttcaagac

SEQ ID NO: 425024 - DNA, 16 bp, M. musculus
gttttttttttaaagc

SEQ ID NO: 425025 - DNA, 16 bp, M. musculus
gttttttttttcccca

SEQ ID NO: 425026 - DNA, 16 bp, M. musculus
gttttttttttgagac

SEQ ID NO: 425027 - DNA, 16 bp, M. musculus
taaaaaaaaaatgctt

SEQ ID NO: 425028 - DNA, 16 bp, M. musculus
taaaaaaatacactct

SEQ ID NO: 425029 - DNA, 16 bp, M. musculus
taaaaaaatgaacatt

SEQ ID NO: 425030 - DNA, 16 bp, M. musculus
taaaaaaatggggctc

SEQ ID NO: 425031 - DNA, 16 bp, M. musculus
taaaaaaattactgaa

SEQ ID NO: 425032 - DNA, 16 bp, M. musculus
taaaaaacagattttt

SEQ ID NO: 425033 - DNA, 16 bp, M. musculus
taaaaaacttccttca

SEQ ID NO: 425034 - DNA, 16 bp, M. musculus
taaaaaaggactgcag

SEQ ID NO: 425035 - DNA, 16 bp, M. musculus
taaaaaatattttgag

SEQ ID NO: 425036 - DNA, 16 bp, M. musculus
taaaaaatgagaaggc

SEQ ID NO: 425037 - DNA, 16 bp, M. musculus
taaaaaatggagtata

SEQ ID NO: 425038 - DNA, 16 bp, M. musculus
taaaaaatggctatct

SEQ ID NO: 425039 - DNA, 16 bp, M. musculus
taaaaaatgtgggaaa

SEQ ID NO: 425040 - DNA, 16 bp, M. musculus
taaaaaatgttttcaa

SEQ ID NO: 425041 - DNA, 16 bp, M. musculus
taaaaaattcatgtga

SEQ ID NO: 425042 - DNA, 16 bp, M. musculus
taaaaaattggctttt

SEQ ID NO: 425043 - DNA, 16 bp, M. musculus
taaaaacaaagacatt

SEQ ID NO: 425044 - DNA, 16 bp, M. musculus
taaaaacaaggacatc

SEQ ID NO: 425045 - DNA, 16 bp, M. musculus
taaaaacaagtttttc

SEQ ID NO: 425046 - DNA, 16 bp, M. musculus
taaaaacaatgacctc

SEQ ID NO: 425047 - DNA, 16 bp, M. musculus
taaaaacaatgtattt

SEQ ID NO: 425048 - DNA, 16 bp, M. musculus
taaaaacaattttgtt

SEQ ID NO: 425049 - DNA, 16 bp, M. musculus
taaaaacagaaacatt

SEQ ID NO: 425050 - DNA, 16 bp, M. musculus
taaaaacagtgacttt

SEQ ID NO: 425051 - DNA, 16 bp, M. musculus
taaaaacatacatgca

SEQ ID NO: 425052 - DNA, 16 bp, M. musculus
taaaaacatcttttaa

SEQ ID NO: 425053 - DNA, 16 bp, M. musculus
taaaaacatgaaaatt

SEQ ID NO: 425054 - DNA, 16 bp, M. musculus
taaaaacatggttaat

SEQ ID NO: 425055 - DNA, 16 bp, M. musculus
taaaaaccacatgatc

SEQ ID NO: 425056 - DNA, 16 bp, M. musculus
taaaaaccatcattaa

SEQ ID NO: 425057 - DNA, 16 bp, M. musculus
taaaaacccctagctt

SEQ ID NO: 425058 - DNA, 16 bp, M. musculus
taaaaacccttattaa

SEQ ID NO: 425059 - DNA, 16 bp, M. musculus
taaaaactgaaaatat

SEQ ID NO: 425060 - DNA, 16 bp, M. musculus
taaaaactgcatcatg

SEQ ID NO: 425061 - DNA, 16 bp, M. musculus
taaaaacttaactctt

SEQ ID NO: 425062 - DNA, 16 bp, M. musculus
taaaaactttatttca

SEQ ID NO: 425063 - DNA, 16 bp, M. musculus
taaaaagaaaacattt

SEQ ID NO: 425064 - DNA, 16 bp, M. musculus
taaaaagaaactggag

SEQ ID NO: 425065 - DNA, 16 bp, M. musculus
taaaaagaaattcttt

SEQ ID NO: 425066 - DNA, 16 bp, M. musculus
taaaaagagtgaattt

SEQ ID NO: 425067 - DNA, 16 bp, M. musculus
taaaaagatataaact

SEQ ID NO: 425068 - DNA, 16 bp, M. musculus
taaaaagcaaaatatt

SEQ ID NO: 425069 - DNA, 16 bp, M. musculus
taaaaagcatgaattt

SEQ ID NO: 425070 - DNA, 16 bp, M. musculus
taaaaagccaacattc

SEQ ID NO: 425071 - DNA, 16 bp, M. musculus
taaaaagctcaagtct

SEQ ID NO: 425072 - DNA, 16 bp, M. musculus
taaaaagggaactaac

SEQ ID NO: 425073 - DNA, 16 bp, M. musculus
taaaaagggaattaga

SEQ ID NO: 425074 - DNA, 16 bp, M. musculus
taaaaaggtttttaaa

SEQ ID NO: 425075 - DNA, 16 bp, M. musculus
taaaaagtaaaattct

SEQ ID NO: 425076 - DNA, 16 bp, M. musculus
taaaaataaagacatt

SEQ ID NO: 425077 - DNA, 16 bp, M. musculus
taaaaataaatcttct

SEQ ID NO: 425078 - DNA, 16 bp, M. musculus
taaaaataagctattt

SEQ ID NO: 425079 - DNA, 16 bp, M. musculus
taaaaatacaggagaa

SEQ ID NO: 425080 - DNA, 16 bp, M. musculus
taaaaatagccatctt

SEQ ID NO: 425081 - DNA, 16 bp, M. musculus
taaaaatagttttctt

SEQ ID NO: 425082 - DNA, 16 bp, M. musculus
taaaaatatttctgtg

SEQ ID NO: 425083 - DNA, 16 bp, M. musculus
taaaaatcaagacaat

SEQ ID NO: 425084 - DNA, 16 bp, M. musculus
taaaaatcacatttat

SEQ ID NO: 425085 - DNA, 16 bp, M. musculus
taaaaatctgtgtgtg

SEQ ID NO: 425086 - DNA, 16 bp, M. musculus
taaaaatgaaacattt

SEQ ID NO: 425087 - DNA, 16 bp, M. musculus
taaaaatgaaagcttt

SEQ ID NO: 425088 - DNA, 16 bp, M. musculus
taaaaatgaccctgag

SEQ ID NO: 425089 - DNA, 16 bp, M. musculus
taaaaatgataaacag

SEQ ID NO: 425090 - DNA, 16 bp, M. musculus
taaaaatgcaaattaa

SEQ ID NO: 425091 - DNA, 16 bp, M. musculus
taaaaatgccttttaa

SEQ ID NO: 425092 - DNA, 16 bp, M. musculus
taaaaatggctatatt

SEQ ID NO: 425093 - DNA, 16 bp, M. musculus
taaaaatgggcatctt

SEQ ID NO: 425094 - DNA, 16 bp, M. musculus
taaaaatggtgtgtgt

SEQ ID NO: 425095 - DNA, 16 bp, M. musculus
taaaaatggttttaaa

SEQ ID NO: 425096 - DNA, 16 bp, M. musculus
taaaaatgtctatctt

SEQ ID NO: 425097 - DNA, 16 bp, M. musculus
taaaaatgtgtgtctt

SEQ ID NO: 425098 - DNA, 16 bp, M. musculus
taaaaatgtttttcat

SEQ ID NO: 425099 - DNA, 16 bp, M. musculus
taaaaattaaaggggc

SEQ ID NO: 425100 - DNA, 16 bp, M. musculus
taaaaattataccaga

SEQ ID NO: 425101 - DNA, 16 bp, M. musculus
taaaaattctttgttt

SEQ ID NO: 425102 - DNA, 16 bp, M. musculus
taaaaattgccttggt

SEQ ID NO: 425103 - DNA, 16 bp, M. musculus
taaaaattggttattt

SEQ ID NO: 425104 - DNA, 16 bp, M. musculus
taaaaatttggagatg

SEQ ID NO: 425105 - DNA, 16 bp, M. musculus
taaaacaaaaatgctt

SEQ ID NO: 425106 - DNA, 16 bp, M. musculus
taaaacaaaagtttta

SEQ ID NO: 425107 - DNA, 16 bp, M. musculus
taaaacaaccttgaga

SEQ ID NO: 425108 - DNA, 16 bp, M. musculus
taaaacaatatcctaa

SEQ ID NO: 425109 - DNA, 16 bp, M. musculus
taaaacacatttattt

SEQ ID NO: 425110 - DNA, 16 bp, M. musculus
taaaacaccatggcca

SEQ ID NO: 425111 - DNA, 16 bp, M. musculus
taaaacagaaaatgga

SEQ ID NO: 425112 - DNA, 16 bp, M. musculus
taaaacagaaaattca

SEQ ID NO: 425113 - DNA, 16 bp, M. musculus
taaaacatccctgcat

SEQ ID NO: 425114 - DNA, 16 bp, M. musculus
taaaacatgaatctaa

SEQ ID NO: 425115 - DNA, 16 bp, M. musculus
taaaacatgtaaatat

SEQ ID NO: 425116 - DNA, 16 bp, M. musculus
taaaacattctttaaa

SEQ ID NO: 425117 - DNA, 16 bp, M. musculus
taaaacatttaaatgt

SEQ ID NO: 425118 - DNA, 16 bp, M. musculus
taaaacatttatttgt

SEQ ID NO: 425119 - DNA, 16 bp, M. musculus
taaaacattttaatga

SEQ ID NO: 425120 - DNA, 16 bp, M. musculus
taaaacattttcttaa

SEQ ID NO: 425121 - DNA, 16 bp, M. musculus
taaaaccactctgaaa

SEQ ID NO: 425122 - DNA, 16 bp, M. musculus
taaaaccataaactgt

SEQ ID NO: 425123 - DNA, 16 bp, M. musculus
taaaaccttgtcctgc

SEQ ID NO: 425124 - DNA, 16 bp, M. musculus
taaaactactgtggtg

SEQ ID NO: 425125 - DNA, 16 bp, M. musculus
taaaactatccagtag

SEQ ID NO: 425126 - DNA, 16 bp, M. musculus
taaaactatttttgtt

SEQ ID NO: 425127 - DNA, 16 bp, M. musculus
taaaactcttggaaag

SEQ ID NO: 425128 - DNA, 16 bp, M. musculus
taaaactgcaaagttt

SEQ ID NO: 425129 - DNA, 16 bp, M. musculus
taaaactggaattcct

SEQ ID NO: 425130 - DNA, 16 bp, M. musculus
taaaactgtgctttga

SEQ ID NO: 425131 - DNA, 16 bp, M. musculus
taaaacttcatttaaa

SEQ ID NO: 425132 - DNA, 16 bp, M. musculus
taaaacttctaattta

SEQ ID NO: 425133 - DNA, 16 bp, M. musculus
taaaacttgttttaaa

SEQ ID NO: 425134 - DNA, 16 bp, M. musculus
taaaactttatctgct

SEQ ID NO: 425135 - DNA, 16 bp, M. musculus
taaaactttttaaaag

SEQ ID NO: 425136 - DNA, 16 bp, M. musculus
taaaactttttgaaaa

SEQ ID NO: 425137 - DNA, 16 bp, M. musculus
taaaagaaaaactcca

SEQ ID NO: 425138 - DNA, 16 bp, M. musculus
taaaagaaaaacttta

SEQ ID NO: 425139 - DNA, 16 bp, M. musculus
taaaagaaaacatcta

SEQ ID NO: 425140 - DNA, 16 bp, M. musculus
taaaagaaaatagcca

SEQ ID NO: 425141 - DNA, 16 bp, M. musculus
taaaagaaacacattt

SEQ ID NO: 425142 - DNA, 16 bp, M. musculus
taaaagaaacttttat

SEQ ID NO: 425143 - DNA, 16 bp, M. musculus
taaaagaaatgttttt

SEQ ID NO: 425144 - DNA, 16 bp, M. musculus
taaaagaacactgttg

SEQ ID NO: 425145 - DNA, 16 bp, M. musculus
taaaagaacagctgga

SEQ ID NO: 425146 - DNA, 16 bp, M. musculus
taaaagaacccatact

SEQ ID NO: 425147 - DNA, 16 bp, M. musculus
taaaagaacttcaggg

SEQ ID NO: 425148 - DNA, 16 bp, M. musculus
taaaagaagaagctgt

SEQ ID NO: 425149 - DNA, 16 bp, M. musculus
taaaagaagtcattag

SEQ ID NO: 425150 - DNA, 16 bp, M. musculus
taaaagaatacatttt

SEQ ID NO: 425151 - DNA, 16 bp, M. musculus
taaaagacacagaaac

SEQ ID NO: 425152 - DNA, 16 bp, M. musculus
taaaagacttttaatt

SEQ ID NO: 425153 - DNA, 16 bp, M. musculus
taaaagagacagaaga

SEQ ID NO: 425154 - DNA, 16 bp, M. musculus
taaaagagagcaagga

SEQ ID NO: 425155 - DNA, 16 bp, M. musculus
taaaagagtatcatta

SEQ ID NO: 425156 - DNA, 16 bp, M. musculus
taaaagatctagaaaa

SEQ ID NO: 425157 - DNA, 16 bp, M. musculus
taaaagatgttaactc

SEQ ID NO: 425158 - DNA, 16 bp, M. musculus
taaaagattgttttaa

SEQ ID NO: 425159 - DNA, 16 bp, M. musculus
taaaagatttatttgt

SEQ ID NO: 425160 - DNA, 16 bp, M. musculus
taaaagatttgtatga

SEQ ID NO: 425161 - DNA, 16 bp, M. musculus
taaaagcaacaacaac

SEQ ID NO: 425162 - DNA, 16 bp, M. musculus
taaaagcaacaagatt

SEQ ID NO: 425163 - DNA, 16 bp, M. musculus
taaaagcacaggctgc

SEQ ID NO: 425164 - DNA, 16 bp, M. musculus
taaaagcacctgttct

SEQ ID NO: 425165 - DNA, 16 bp, M. musculus
taaaagcagaagcaaa

SEQ ID NO: 425166 - DNA, 16 bp, M. musculus
taaaagcagtaaggga

SEQ ID NO: 425167 - DNA, 16 bp, M. musculus
taaaagccataaggga

SEQ ID NO: 425168 - DNA, 16 bp, M. musculus
taaaagctcaccctga

SEQ ID NO: 425169 - DNA, 16 bp, M. musculus
taaaagctttgcaatt

SEQ ID NO: 425170 - DNA, 16 bp, M. musculus
taaaaggaaactggtt

SEQ ID NO: 425171 - DNA, 16 bp, M. musculus
taaaaggagagaatca

SEQ ID NO: 425172 - DNA, 16 bp, M. musculus
taaaaggagatcaagg

SEQ ID NO: 425173 - DNA, 16 bp, M. musculus
taaaaggatttttaaa

SEQ ID NO: 425174 - DNA, 16 bp, M. musculus
taaaaggtttttcttt

SEQ ID NO: 425175 - DNA, 16 bp, M. musculus
taaaagtaaatctttt

SEQ ID NO: 425176 - DNA, 16 bp, M. musculus
taaaagtacttttaaa

SEQ ID NO: 425177 - DNA, 16 bp, M. musculus
taaaagtatttgctgc

SEQ ID NO: 425178 - DNA, 16 bp, M. musculus
taaaagtcacttttat

SEQ ID NO: 425179 - DNA, 16 bp, M. musculus
taaaagtcatgaaaag

SEQ ID NO: 425180 - DNA, 16 bp, M. musculus
taaaagtcattatttt

SEQ ID NO: 425181 - DNA, 16 bp, M. musculus
taaaagtcttgtaaag

SEQ ID NO: 425182 - DNA, 16 bp, M. musculus
taaaagtgatttttaa

SEQ ID NO: 425183 - DNA, 16 bp, M. musculus
taaaagtggctatgaa

SEQ ID NO: 425184 - DNA, 16 bp, M. musculus
taaaagtttaaatgta

SEQ ID NO: 425185 - DNA, 16 bp, M. musculus
taaaagttttgatgtt

SEQ ID NO: 425186 - DNA, 16 bp, M. musculus
taaaataaaaatgcta

SEQ ID NO: 425187 - DNA, 16 bp, M. musculus
taaaataaaagtacat

SEQ ID NO: 425188 - DNA, 16 bp, M. musculus
taaaataaaatactgt

SEQ ID NO: 425189 - DNA, 16 bp, M. musculus
taaaataaagcaatat

SEQ ID NO: 425190 - DNA, 16 bp, M. musculus
taaaataaatacatga

SEQ ID NO: 425191 - DNA, 16 bp, M. musculus
taaaataaatgttttg

SEQ ID NO: 425192 - DNA, 16 bp, M. musculus
taaaataacattttca

SEQ ID NO: 425193 - DNA, 16 bp, M. musculus
taaaatacattggtgg

SEQ ID NO: 425194 - DNA, 16 bp, M. musculus
taaaatacattgtaaa

SEQ ID NO: 425195 - DNA, 16 bp, M. musculus
taaaatactacatttt

SEQ ID NO: 425196 - DNA, 16 bp, M. musculus
taaaatactttggttt

SEQ ID NO: 425197 - DNA, 16 bp, M. musculus
taaaatagatattgga

SEQ ID NO: 425198 - DNA, 16 bp, M. musculus
taaaatagtcttttaa

SEQ ID NO: 425199 - DNA, 16 bp, M. musculus
taaaatagttttgaaa

SEQ ID NO: 425200 - DNA, 16 bp, M. musculus
taaaatatattctttc

SEQ ID NO: 425201 - DNA, 16 bp, M. musculus
taaaatatatttggaa

SEQ ID NO: 425202 - DNA, 16 bp, M. musculus
taaaatatattttcca

SEQ ID NO: 425203 - DNA, 16 bp, M. musculus
taaaatatattttggt

SEQ ID NO: 425204 - DNA, 16 bp, M. musculus
taaaatatcatcctga

SEQ ID NO: 425205 - DNA, 16 bp, M. musculus
taaaatatctttaaga

SEQ ID NO: 425206 - DNA, 16 bp, M. musculus
taaaatatgtttttca

SEQ ID NO: 425207 - DNA, 16 bp, M. musculus
taaaatatttcttcct

SEQ ID NO: 425208 - DNA, 16 bp, M. musculus
taaaatatttgggaaa

SEQ ID NO: 425209 - DNA, 16 bp, M. musculus
taaaatattttcaaca

SEQ ID NO: 425210 - DNA, 16 bp, M. musculus
taaaatattttccatt

SEQ ID NO: 425211 - DNA, 16 bp, M. musculus
taaaatattttgaaga

SEQ ID NO: 425212 - DNA, 16 bp, M. musculus
taaaatattttgagtt

SEQ ID NO: 425213 - DNA, 16 bp, M. musculus
taaaatatttttcttg

SEQ ID NO: 425214 - DNA, 16 bp, M. musculus
taaaatcaactttcaa

SEQ ID NO: 425215 - DNA, 16 bp, M. musculus
taaaatcacagaagaa

SEQ ID NO: 425216 - DNA, 16 bp, M. musculus
taaaatcagaaaatat

SEQ ID NO: 425217 - DNA, 16 bp, M. musculus
taaaatcagaagtgaa

SEQ ID NO: 425218 - DNA, 16 bp, M. musculus
taaaatcatcagaaaa

SEQ ID NO: 425219 - DNA, 16 bp, M. musculus
taaaatcatctttcaa

SEQ ID NO: 425220 - DNA, 16 bp, M. musculus
taaaatccagtctttt

SEQ ID NO: 425221 - DNA, 16 bp, M. musculus
taaaatctaagtggat

SEQ ID NO: 425222 - DNA, 16 bp, M. musculus
taaaatctgatgaaat

SEQ ID NO: 425223 - DNA, 16 bp, M. musculus
taaaatctgtatttca

SEQ ID NO: 425224 - DNA, 16 bp, M. musculus
taaaatgaaacttttt

SEQ ID NO: 425225 - DNA, 16 bp, M. musculus
taaaatgaaatttcaa

SEQ ID NO: 425226 - DNA, 16 bp, M. musculus
taaaatgaagcaaaag

SEQ ID NO: 425227 - DNA, 16 bp, M. musculus
taaaatgacttcctta

SEQ ID NO: 425228 - DNA, 16 bp, M. musculus
taaaatgctggaaaac

SEQ ID NO: 425229 - DNA, 16 bp, M. musculus
taaaatggatttttaa

SEQ ID NO: 425230 - DNA, 16 bp, M. musculus
taaaatgtaaacaaag

SEQ ID NO: 425231 - DNA, 16 bp, M. musculus
taaaatgtaccagaga

SEQ ID NO: 425232 - DNA, 16 bp, M. musculus
taaaatgtacttttat

SEQ ID NO: 425233 - DNA, 16 bp, M. musculus
taaaatgtatgtttat

SEQ ID NO: 425234 - DNA, 16 bp, M. musculus
taaaatgtatttgtaa

SEQ ID NO: 425235 - DNA, 16 bp, M. musculus
taaaatgtattttcat

SEQ ID NO: 425236 - DNA, 16 bp, M. musculus
taaaatgtcaatactt

SEQ ID NO: 425237 - DNA, 16 bp, M. musculus
taaaatgtcttttctt

SEQ ID NO: 425238 - DNA, 18 bp, M. musculus
taaaatgtgtgtgtgtgt

SEQ ID NO: 425239 - DNA, 16 bp, M. musculus
taaaatgtgtgttttt

SEQ ID NO: 425240 - DNA, 16 bp, M. musculus
taaaatgtgttgtttt

SEQ ID NO: 425241 - DNA, 16 bp, M. musculus
taaaatgttctataaa

SEQ ID NO: 425242 - DNA, 16 bp, M. musculus
taaaatgttctctaga

SEQ ID NO: 425243 - DNA, 16 bp, M. musculus
taaaatgttgaaattt

SEQ ID NO: 425244 - DNA, 16 bp, M. musculus
taaaatgttgaataat

SEQ ID NO: 425245 - DNA, 16 bp, M. musculus
taaaatgtttacaaaa

SEQ ID NO: 425246 - DNA, 16 bp, M. musculus
taaaatgttttaaaag

SEQ ID NO: 425247 - DNA, 16 bp, M. musculus
taaaattaactttcaa

SEQ ID NO: 425248 - DNA, 16 bp, M. musculus
taaaattaattttcca

SEQ ID NO: 425249 - DNA, 16 bp, M. musculus
taaaattagaatcaag

SEQ ID NO: 425250 - DNA, 16 bp, M. musculus
taaaattaggtatttt

SEQ ID NO: 425251 - DNA, 16 bp, M. musculus
taaaattatgttttct

SEQ ID NO: 425252 - DNA, 16 bp, M. musculus
taaaattatttccatt

SEQ ID NO: 425253 - DNA, 16 bp, M. musculus
taaaattattttcttg

SEQ ID NO: 425254 - DNA, 19 bp, M. musculus
taaaattcaatggcttaat

SEQ ID NO: 425255 - DNA, 16 bp, M. musculus
taaaattcacatggaa

SEQ ID NO: 425256 - DNA, 16 bp, M. musculus
taaaattccactgtgt

SEQ ID NO: 425257 - DNA, 16 bp, M. musculus
taaaattctgaaaaat

SEQ ID NO: 425258 - DNA, 16 bp, M. musculus
taaaattctgcactaa

SEQ ID NO: 425259 - DNA, 16 bp, M. musculus
taaaattctttgaaaa

SEQ ID NO: 425260 - DNA, 16 bp, M. musculus
taaaattgcattttaa

SEQ ID NO: 425261 - DNA, 16 bp, M. musculus
taaaattggaaacaat

SEQ ID NO: 425262 - DNA, 16 bp, M. musculus
taaaattgtaagcaag

SEQ ID NO: 425263 - DNA, 16 bp, M. musculus
taaaattgtgtgtgtg

SEQ ID NO: 425264 - DNA, 16 bp, M. musculus
taaaattgttttcaaa

SEQ ID NO: 425265 - DNA, 16 bp, M. musculus
taaaattgttttcatt

SEQ ID NO: 425266 - DNA, 16 bp, M. musculus
taaaattgtttttaag

SEQ ID NO: 425267 - DNA, 16 bp, M. musculus
taaaatttacatttca

SEQ ID NO: 425268 - DNA, 16 bp, M. musculus
taaaatttcagtctct

SEQ ID NO: 425269 - DNA, 16 bp, M. musculus
taaaatttgcatttat

SEQ ID NO: 425270 - DNA, 16 bp, M. musculus
taaaattttcatttcc

SEQ ID NO: 425271 - DNA, 16 bp, M. musculus
taaaattttctagaaa

SEQ ID NO: 425272 - DNA, 16 bp, M. musculus
taaaattttgtaatgt

SEQ ID NO: 425273 - DNA, 16 bp, M. musculus
taaacaaactgagaaa

SEQ ID NO: 425274 - DNA, 16 bp, M. musculus
taaacaaaggataaac

SEQ ID NO: 425275 - DNA, 16 bp, M. musculus
taaacaaatatttgtt

SEQ ID NO: 425276 - DNA, 16 bp, M. musculus
taaacaacaacagcaa

SEQ ID NO: 425277 - DNA, 16 bp, M. musculus
taaacaacttaaagaa

SEQ ID NO: 425278 - DNA, 16 bp, M. musculus
taaacaacttcaggaa

SEQ ID NO: 425279 - DNA, 16 bp, M. musculus
taaacaagcccatatt

SEQ ID NO: 425280 - DNA, 16 bp, M. musculus
taaacaagtaaaagag

SEQ ID NO: 425281 - DNA, 16 bp, M. musculus
taaacaagtgaaggaa

SEQ ID NO: 425282 - DNA, 16 bp, M. musculus
taaacacacatgtata

SEQ ID NO: 425283 - DNA, 16 bp, M. musculus
taaacacagtgaaact

SEQ ID NO: 425284 - DNA, 16 bp, M. musculus
taaacacatatacata

SEQ ID NO: 425285 - DNA, 16 bp, M. musculus
taaacacatatgcata

SEQ ID NO: 425286 - DNA, 16 bp, M. musculus
taaacaccttttgcag

SEQ ID NO: 425287 - DNA, 16 bp, M. musculus
taaacactgaaactca

SEQ ID NO: 425288 - DNA, 16 bp, M. musculus
taaacagacctataac

SEQ ID NO: 425289 - DNA, 16 bp, M. musculus
taaacagaccttgaca

SEQ ID NO: 425290 - DNA, 16 bp, M. musculus
taaacagagaattatc

SEQ ID NO: 425291 - DNA, 16 bp, M. musculus
taaacagatttctcaa

SEQ ID NO: 425292 - DNA, 16 bp, M. musculus
taaacagcaaaatgtt

SEQ ID NO: 425293 - DNA, 16 bp, M. musculus
taaacagctttaatga

SEQ ID NO: 425294 - DNA, 16 bp, M. musculus
taaacaggaccagaaa

SEQ ID NO: 425295 - DNA, 16 bp, M. musculus
taaacaggtaaaagcc

SEQ ID NO: 425296 - DNA, 16 bp, M. musculus
taaacagttccatttc

SEQ ID NO: 425297 - DNA, 16 bp, M. musculus
taaacagtttgtaata

SEQ ID NO: 425298 - DNA, 16 bp, M. musculus
taaacatagcataatg

SEQ ID NO: 425299 - DNA, 16 bp, M. musculus
taaacatagttgagca

SEQ ID NO: 425300 - DNA, 16 bp, M. musculus
taaacatgataaaaat

SEQ ID NO: 425301 - DNA, 16 bp, M. musculus
taaacatgtatttatt

SEQ ID NO: 425302 - DNA, 16 bp, M. musculus
taaacattagatggag

SEQ ID NO: 425303 - DNA, 16 bp, M. musculus
taaacattcacacaca

SEQ ID NO: 425304 - DNA, 16 bp, M. musculus
taaacattgagccttg

SEQ ID NO: 425305 - DNA, 16 bp, M. musculus
taaacatttgtttatt

SEQ ID NO: 425306 - DNA, 16 bp, M. musculus
taaacattttaaatgt

SEQ ID NO: 425307 - DNA, 16 bp, M. musculus
taaacattttagtatt

SEQ ID NO: 425308 - DNA, 16 bp, M. musculus
taaacattttcctttt

SEQ ID NO: 425309 - DNA, 16 bp, M. musculus
taaacattttcttttg

SEQ ID NO: 425310 - DNA, 16 bp, M. musculus
taaacatttttaaaag

SEQ ID NO: 425311 - DNA, 16 bp, M. musculus
taaaccaaatggacct

SEQ ID NO: 425312 - DNA, 16 bp, M. musculus
taaaccaaccagaccc

SEQ ID NO: 425313 - DNA, 16 bp, M. musculus
taaaccactatataaa

SEQ ID NO: 425314 - DNA, 16 bp, M. musculus
taaaccagagacactg

SEQ ID NO: 425315 - DNA, 16 bp, M. musculus
taaaccagataaacag

SEQ ID NO: 425316 - DNA, 16 bp, M. musculus
taaaccaggctggcct

SEQ ID NO: 425317 - DNA, 16 bp, M. musculus
taaaccatcactgcat

SEQ ID NO: 425318 - DNA, 16 bp, M. musculus
taaaccatctaaactg

SEQ ID NO: 425319 - DNA, 16 bp, M. musculus
taaaccatctctgcat

SEQ ID NO: 425320 - DNA, 16 bp, M. musculus
taaaccatctctgtat

SEQ ID NO: 425321 - DNA, 16 bp, M. musculus
taaaccatgagctata

SEQ ID NO: 425322 - DNA, 16 bp, M. musculus
taaacccacacaccta

SEQ ID NO: 425323 - DNA, 16 bp, M. musculus
taaacccagagctcac

SEQ ID NO: 425324 - DNA, 16 bp, M. musculus
taaacccctgaaactg

SEQ ID NO: 425325 - DNA, 16 bp, M. musculus
taaacccttagtcaga

SEQ ID NO: 425326 - DNA, 16 bp, M. musculus
taaaccctttcctcac

SEQ ID NO: 425327 - DNA, 16 bp, M. musculus
taaaccctttcctctc

SEQ ID NO: 425328 - DNA, 16 bp, M. musculus
taaaccctttctttct

SEQ ID NO: 425329 - DNA, 16 bp, M. musculus
taaacctaaccaagaa

SEQ ID NO: 425330 - DNA, 16 bp, M. musculus
taaacctctataacac

SEQ ID NO: 425331 - DNA, 16 bp, M. musculus
taaacctggctggcct

SEQ ID NO: 425332 - DNA, 16 bp, M. musculus
taaacctttctggaaa

SEQ ID NO: 425333 - DNA, 16 bp, M. musculus
taaaccttttaaaaat

SEQ ID NO: 425334 - DNA, 16 bp, M. musculus
taaaccttttcttccc

SEQ ID NO: 425335 - DNA, 16 bp, M. musculus
taaacctttttttaaa

SEQ ID NO: 425336 - DNA, 16 bp, M. musculus
taaacgaatggaatga

SEQ ID NO: 425337 - DNA, 16 bp, M. musculus
taaactagaaatatct

SEQ ID NO: 425338 - DNA, 16 bp, M. musculus
taaactattcttgctt

SEQ ID NO: 425339 - DNA, 16 bp, M. musculus
taaactcaaagacaaa

SEQ ID NO: 425340 - DNA, 16 bp, M. musculus
taaactcaagagaatg

SEQ ID NO: 425341 - DNA, 16 bp, M. musculus
taaactcattggttca

SEQ ID NO: 425342 - DNA, 16 bp, M. musculus
taaactcctccccagt

SEQ ID NO: 425343 - DNA, 16 bp, M. musculus
taaactctaaaaagcc

SEQ ID NO: 425344 - DNA, 16 bp, M. musculus
taaactctaaaaagta

SEQ ID NO: 425345 - DNA, 16 bp, M. musculus
taaactctgtgtgtgt

SEQ ID NO: 425346 - DNA, 16 bp, M. musculus
taaactctttcctctt

SEQ ID NO: 425347 - DNA, 16 bp, M. musculus
taaactggaagtcata

SEQ ID NO: 425348 - DNA, 16 bp, M. musculus
taaacttctatttcaa

SEQ ID NO: 425349 - DNA, 16 bp, M. musculus
taaacttgataaacaa

SEQ ID NO: 425350 - DNA, 16 bp, M. musculus
taaacttgttttaaaa

SEQ ID NO: 425351 - DNA, 16 bp, M. musculus
taaactttcttttaaa

SEQ ID NO: 425352 - DNA, 16 bp, M. musculus
taaactttgttttgtt

SEQ ID NO: 425353 - DNA, 16 bp, M. musculus
taaagaaaaaacattt

SEQ ID NO: 425354 - DNA, 16 bp, M. musculus
taaagaaaaacaggga

SEQ ID NO: 425355 - DNA, 16 bp, M. musculus
taaagaaaaacatttc

SEQ ID NO: 425356 - DNA, 16 bp, M. musculus
taaagaaaaacttgaa

SEQ ID NO: 425357 - DNA, 16 bp, M. musculus
taaagaaaaagatgcc

SEQ ID NO: 425358 - DNA, 16 bp, M. musculus
taaagaaaacatccaa

SEQ ID NO: 425359 - DNA, 16 bp, M. musculus
taaagaaaactgaaat

SEQ ID NO: 425360 - DNA, 16 bp, M. musculus
taaagaaaatacagga

SEQ ID NO: 425361 - DNA, 16 bp, M. musculus
taaagaaaatatccaa

SEQ ID NO: 425362 - DNA, 16 bp, M. musculus
taaagaaaatatccat

SEQ ID NO: 425363 - DNA, 16 bp, M. musculus
taaagaaaatatggta

SEQ ID NO: 425364 - DNA, 16 bp, M. musculus
taaagaaaatgaagcc

SEQ ID NO: 425365 - DNA, 16 bp, M. musculus
taaagaaaatgcaaag

SEQ ID NO: 425366 - DNA, 16 bp, M. musculus
taaagaaaatgtcaaa

SEQ ID NO: 425367 - DNA, 16 bp, M. musculus
taaagaaaatgtttct

SEQ ID NO: 425368 - DNA, 16 bp, M. musculus
taaagaaaattgactc

SEQ ID NO: 425369 - DNA, 16 bp, M. musculus
taaagaaaatttcaaa

SEQ ID NO: 425370 - DNA, 16 bp, M. musculus
taaagaaactggagaa

SEQ ID NO: 425371 - DNA, 16 bp, M. musculus
taaagaaagaaaatgc

SEQ ID NO: 425372 - DNA, 16 bp, M. musculus
taaagaaagagatgcc

SEQ ID NO: 425373 - DNA, 16 bp, M. musculus
taaagaaataaatctt

SEQ ID NO: 425374 - DNA, 16 bp, M. musculus
taaagaaatcacagag

SEQ ID NO: 425375 - DNA, 16 bp, M. musculus
taaagaaatccagaaa

SEQ ID NO: 425376 - DNA, 16 bp, M. musculus
taaagaaatgcaggag

SEQ ID NO: 425377 - DNA, 16 bp, M. musculus
taaagaaatgttttta

SEQ ID NO: 425378 - DNA, 16 bp, M. musculus
taaagaaattaaaggc

SEQ ID NO: 425379 - DNA, 16 bp, M. musculus
taaagaaattgctgag

SEQ ID NO: 425380 - DNA, 16 bp, M. musculus
taaagaacattatttt

SEQ ID NO: 425381 - DNA, 16 bp, M. musculus
taaagaactacagaaa

SEQ ID NO: 425382 - DNA, 16 bp, M. musculus
taaagaactccaaata

SEQ ID NO: 425383 - DNA, 16 bp, M. musculus
taaagaagaaattctc

SEQ ID NO: 425384 - DNA, 16 bp, M. musculus
taaagaagaatgtgag

SEQ ID NO: 425385 - DNA, 16 bp, M. musculus
taaagaagatcttaga

SEQ ID NO: 425386 - DNA, 16 bp, M. musculus
taaagaagcaaaggaa

SEQ ID NO: 425387 - DNA, 16 bp, M. musculus
taaagaagccagaaaa

SEQ ID NO: 425388 - DNA, 16 bp, M. musculus
taaagaatatctcaga

SEQ ID NO: 425389 - DNA, 16 bp, M. musculus
taaagaatgctcccca

SEQ ID NO: 425390 - DNA, 16 bp, M. musculus
taaagaatgtagcaaa

SEQ ID NO: 425391 - DNA, 16 bp, M. musculus
taaagaatgttctaga

SEQ ID NO: 425392 - DNA, 16 bp, M. musculus
taaagaattgtgttag

SEQ ID NO: 425393 - DNA, 16 bp, M. musculus
taaagacacaagctct

SEQ ID NO: 425394 - DNA, 16 bp, M. musculus
taaagacagataatgg

SEQ ID NO: 425395 - DNA, 16 bp, M. musculus
taaagacaggtttatt

SEQ ID NO: 425396 - DNA, 16 bp, M. musculus
taaagacatatgccac

SEQ ID NO: 425397 - DNA, 16 bp, M. musculus
taaagacctgagtttg

SEQ ID NO: 425398 - DNA, 16 bp, M. musculus
taaagaccttttccca

SEQ ID NO: 425399 - DNA, 16 bp, M. musculus
taaagactggcaggaa

SEQ ID NO: 425400 - DNA, 16 bp, M. musculus
taaagactgtaggact

SEQ ID NO: 425401 - DNA, 16 bp, M. musculus
taaagacttgaagttc

SEQ ID NO: 425402 - DNA, 16 bp, M. musculus
taaagacttttatttt

SEQ ID NO: 425403 - DNA, 16 bp, M. musculus
taaagagaaaacacat

SEQ ID NO: 425404 - DNA, 16 bp, M. musculus
taaagagacattgctt

SEQ ID NO: 425405 - DNA, 16 bp, M. musculus
taaagagatttatttt

SEQ ID NO: 425406 - DNA, 16 bp, M. musculus
taaagagcaagttcca

SEQ ID NO: 425407 - DNA, 16 bp, M. musculus
taaagagcactgactg

SEQ ID NO: 425408 - DNA, 16 bp, M. musculus
taaagagccaatgaaa

SEQ ID NO: 425409 - DNA, 16 bp, M. musculus
taaagagctaaacaga

SEQ ID NO: 425410 - DNA, 16 bp, M. musculus
taaagaggaagcagaa

SEQ ID NO: 425411 - DNA, 16 bp, M. musculus
taaagaggatctcaga

SEQ ID NO: 425412 - DNA, 16 bp, M. musculus
taaagaggccacctcc

SEQ ID NO: 425413 - DNA, 16 bp, M. musculus
taaagagtattggtat

SEQ ID NO: 425414 - DNA, 16 bp, M. musculus
taaagatatttactgg

SEQ ID NO: 425415 - DNA, 16 bp, M. musculus
taaagatcaggaattc

SEQ ID NO: 425416 - DNA, 16 bp, M. musculus
taaagatctcttccca

SEQ ID NO: 425417 - DNA, 20 bp, M. musculus
taaagatgagggagacaaaa

SEQ ID NO: 425418 - DNA, 16 bp, M. musculus
taaagatgcttgccac

SEQ ID NO: 425419 - DNA, 16 bp, M. musculus
taaagatgtatttgtt

SEQ ID NO: 425420 - DNA, 16 bp, M. musculus
taaagattattatgat

SEQ ID NO: 425421 - DNA, 16 bp, M. musculus
taaagattcttctaat

SEQ ID NO: 425422 - DNA, 16 bp, M. musculus
taaagattgtgggact

SEQ ID NO: 425423 - DNA, 16 bp, M. musculus
taaagatttatttagt

SEQ ID NO: 425424 - DNA, 16 bp, M. musculus
taaagatttatttcta

SEQ ID NO: 425425 - DNA, 16 bp, M. musculus
taaagatttgtttgtt

SEQ ID NO: 425426 - DNA, 16 bp, M. musculus
taaagatttttttctt

SEQ ID NO: 425427 - DNA, 16 bp, M. musculus
taaagcaaaagcaaga

SEQ ID NO: 425428 - DNA, 16 bp, M. musculus
taaagcaattttaaaa

SEQ ID NO: 425429 - DNA, 16 bp, M. musculus
taaagcacacacacac

SEQ ID NO: 425430 - DNA, 16 bp, M. musculus
taaagcactcaagaag

SEQ ID NO: 425431 - DNA, 16 bp, M. musculus
taaagcacttgccatg

SEQ ID NO: 425432 - DNA, 16 bp, M. musculus
taaagcacttgcctag

SEQ ID NO: 425433 - DNA, 16 bp, M. musculus
taaagcagacacagga

SEQ ID NO: 425434 - DNA, 16 bp, M. musculus
taaagcagagactgaa

SEQ ID NO: 425435 - DNA, 16 bp, M. musculus
taaagcagcagcagca

SEQ ID NO: 425436 - DNA, 16 bp, M. musculus
taaagcagtgcttctc

SEQ ID NO: 425437 - DNA, 16 bp, M. musculus
taaagcagtggttttc

SEQ ID NO: 425438 - DNA, 16 bp, M. musculus
taaagcatttaaaaaa

SEQ ID NO: 425439 - DNA, 16 bp, M. musculus
taaagcatttaaaata

SEQ ID NO: 425440 - DNA, 16 bp, M. musculus
taaagcatttattaaa

SEQ ID NO: 425441 - DNA, 16 bp, M. musculus
taaagccaggttctgc

SEQ ID NO: 425442 - DNA, 16 bp, M. musculus
taaagccagtgttcca

SEQ ID NO: 425443 - DNA, 16 bp, M. musculus
taaagcctttgcacat

SEQ ID NO: 425444 - DNA, 21 bp, M. musculus
taaagctcaaagcacacattg

SEQ ID NO: 425445 - DNA, 16 bp, M. musculus
taaagctcaaagcaga

SEQ ID NO: 425446 - DNA, 16 bp, M. musculus
taaagctgtactacag

SEQ ID NO: 425447 - DNA, 16 bp, M. musculus
taaagctgtacttcag

SEQ ID NO: 425448 - DNA, 16 bp, M. musculus
taaagctgttgcctat

SEQ ID NO: 425449 - DNA, 16 bp, M. musculus
taaagctttgtggaat

SEQ ID NO: 425450 - DNA, 16 bp, M. musculus
taaaggaaaacatcta

SEQ ID NO: 425451 - DNA, 16 bp, M. musculus
taaaggaaaacatgta

SEQ ID NO: 425452 - DNA, 16 bp, M. musculus
taaaggaaaacatttt

SEQ ID NO: 425453 - DNA, 16 bp, M. musculus
taaaggaaacactttc

SEQ ID NO: 425454 - DNA, 16 bp, M. musculus
taaaggaaactggctt

SEQ ID NO: 425455 - DNA, 16 bp, M. musculus
taaaggaaatacagag

SEQ ID NO: 425456 - DNA, 16 bp, M. musculus
taaaggaaatacatgg

SEQ ID NO: 425457 - DNA, 16 bp, M. musculus
taaaggaactttagta

SEQ ID NO: 425458 - DNA, 16 bp, M. musculus
taaaggaagtcaggac

SEQ ID NO: 425459 - DNA, 27 bp, M. musculus
taaaggaatttattgatgacttacagt

SEQ ID NO: 425460 - DNA, 16 bp, M. musculus
taaaggaatttttaaa

SEQ ID NO: 425461 - DNA, 16 bp, M. musculus
taaaggacccagatgt

SEQ ID NO: 425462 - DNA, 16 bp, M. musculus
taaaggactgaaggag

SEQ ID NO: 425463 - DNA, 16 bp, M. musculus
taaaggagcttgctgc

SEQ ID NO: 425464 - DNA, 16 bp, M. musculus
taaaggagtctgcaac

SEQ ID NO: 425465 - DNA, 16 bp, M. musculus
taaaggagtgtgccac

SEQ ID NO: 425466 - DNA, 16 bp, M. musculus
taaaggagttatttat

SEQ ID NO: 425467 - DNA, 16 bp, M. musculus
taaaggatgaggttct

SEQ ID NO: 425468 - DNA, 16 bp, M. musculus
taaaggcaagtgccac

SEQ ID NO: 425469 - DNA, 16 bp, M. musculus
taaaggcacacaccac

SEQ ID NO: 425470 - DNA, 16 bp, M. musculus
taaaggcagatctatt

SEQ ID NO: 425471 - DNA, 16 bp, M. musculus
taaaggcatacactac

SEQ ID NO: 425472 - DNA, 19 bp, M. musculus
taaaggcatgtgccaccat

SEQ ID NO: 425473 - DNA, 16 bp, M. musculus
taaaggcatgtgccat

SEQ ID NO: 425474 - DNA, 16 bp, M. musculus
taaaggcatttgccac

SEQ ID NO: 425475 - DNA, 16 bp, M. musculus
taaaggcatttgctgc

SEQ ID NO: 425476 - DNA, 16 bp, M. musculus
taaaggcctacaccac

SEQ ID NO: 425477 - DNA, 17 bp, M. musculus
taaaggcgtgtgctact

SEQ ID NO: 425478 - DNA, 16 bp, M. musculus
taaaggcttccccata

SEQ ID NO: 425479 - DNA, 16 bp, M. musculus
taaaggcttctagctg

SEQ ID NO: 425480 - DNA, 16 bp, M. musculus
taaaggcttgcaccac

SEQ ID NO: 425481 - DNA, 16 bp, M. musculus
taaaggctttttagaa

SEQ ID NO: 425482 - DNA, 16 bp, M. musculus
taaagggtgagctgga

SEQ ID NO: 425483 - DNA, 17 bp, M. musculus
taaagggttctcttaag

SEQ ID NO: 425484 - DNA, 16 bp, M. musculus
taaagggttggaaaaa

SEQ ID NO: 425485 - DNA, 16 bp, M. musculus
taaaggtatttgctgc

SEQ ID NO: 425486 - DNA, 16 bp, M. musculus
taaaggtatttttaaa

SEQ ID NO: 425487 - DNA, 17 bp, M. musculus
taaaggtcagtctgcag

SEQ ID NO: 425488 - DNA, 16 bp, M. musculus
taaaggtctggaaaac

SEQ ID NO: 425489 - DNA, 16 bp, M. musculus
taaaggtgcgcaccac

SEQ ID NO: 425490 - DNA, 16 bp, M. musculus
taaaggtgtgcattac

SEQ ID NO: 425491 - DNA, 16 bp, M. musculus
taaaggtgtgtactaa

SEQ ID NO: 425492 - DNA, 16 bp, M. musculus
taaaggtgtgtgctac

SEQ ID NO: 425493 - DNA, 16 bp, M. musculus
taaaggtgtttgccac

SEQ ID NO: 425494 - DNA, 16 bp, M. musculus
taaaggttctttggaa

SEQ ID NO: 425495 - DNA, 16 bp, M. musculus
taaagtaacatataaa

SEQ ID NO: 425496 - DNA, 16 bp, M. musculus
taaagtacttgtcaca

SEQ ID NO: 425497 - DNA, 16 bp, M. musculus
taaagtcaaatttaaa

SEQ ID NO: 425498 - DNA, 16 bp, M. musculus
taaagtctattttgtc

SEQ ID NO: 425499 - DNA, 16 bp, M. musculus
taaagtctcttctgag

SEQ ID NO: 425500 - DNA, 16 bp, M. musculus
taaagtgcttgctgaa

SEQ ID NO: 425501 - DNA, 16 bp, M. musculus
taaagtgtttgccaca

SEQ ID NO: 425502 - DNA, 16 bp, M. musculus
taaagttcttttaaaa

SEQ ID NO: 425503 - DNA, 16 bp, M. musculus
taaagttgaaccttga

SEQ ID NO: 425504 - DNA, 16 bp, M. musculus
taaagttgaagttgcc

SEQ ID NO: 425505 - DNA, 16 bp, M. musculus
taaagttgatctgtct

SEQ ID NO: 425506 - DNA, 16 bp, M. musculus
taaagttgccaacagc

SEQ ID NO: 425507 - DNA, 16 bp, M. musculus
taaagttgctgaggtg

SEQ ID NO: 425508 - DNA, 16 bp, M. musculus
taaagtttaaataatg

SEQ ID NO: 425509 - DNA, 16 bp, M. musculus
taaagtttctttcatg

SEQ ID NO: 425510 - DNA, 16 bp, M. musculus
taaataaaaatctcag

SEQ ID NO: 425511 - DNA, 16 bp, M. musculus
taaataaaaatgacat

SEQ ID NO: 425512 - DNA, 16 bp, M. musculus
taaataaaagcatttt

SEQ ID NO: 425513 - DNA, 16 bp, M. musculus
taaataaaataagcat

SEQ ID NO: 425514 - DNA, 16 bp, M. musculus
taaataaaatatgcaa

SEQ ID NO: 425515 - DNA, 16 bp, M. musculus
taaataaaatgtcatt

SEQ ID NO: 425516 - DNA, 16 bp, M. musculus
taaataaactctttct

SEQ ID NO: 425517 - DNA, 16 bp, M. musculus
taaataaagcaaatat

SEQ ID NO: 425518 - DNA, 16 bp, M. musculus
taaataaagctgctgt

SEQ ID NO: 425519 - DNA, 16 bp, M. musculus
taaataaagtctttaa

SEQ ID NO: 425520 - DNA, 16 bp, M. musculus
taaataaataaaagct

SEQ ID NO: 425521 - DNA, 16 bp, M. musculus
taaataaataaatctg

SEQ ID NO: 425522 - DNA, 16 bp, M. musculus
taaataaatacataga

SEQ ID NO: 425523 - DNA, 16 bp, M. musculus
taaataaatcctttct

SEQ ID NO: 425524 - DNA, 16 bp, M. musculus
taaataaatctttgag

SEQ ID NO: 425525 - DNA, 16 bp, M. musculus
taaataaatctttttg

SEQ ID NO: 425526 - DNA, 16 bp, M. musculus
taaataaatgcataca

SEQ ID NO: 425527 - DNA, 16 bp, M. musculus
taaataaatgcattaa

SEQ ID NO: 425528 - DNA, 16 bp, M. musculus
taaataaatgtaactt

SEQ ID NO: 425529 - DNA, 16 bp, M. musculus
taaataaatgtctgta

SEQ ID NO: 425530 - DNA, 16 bp, M. musculus
taaataaatgtgtttt

SEQ ID NO: 425531 - DNA, 16 bp, M. musculus
taaataagtaaatctt

SEQ ID NO: 425532 - DNA, 16 bp, M. musculus
taaataatagaaagcc

SEQ ID NO: 425533 - DNA, 16 bp, M. musculus
taaataatgatgatga

SEQ ID NO: 425534 - DNA, 16 bp, M. musculus
taaataattcactaca

SEQ ID NO: 425535 - DNA, 16 bp, M. musculus
taaatacacatgtata

SEQ ID NO: 425536 - DNA, 57 bp, M. musculus
taaatacacctgtgtacatgactggtttttaaatacacctgtgtacatgactggttt

SEQ ID NO: 425537 - DNA, 16 bp, M. musculus
taaatacagaagtaga

SEQ ID NO: 425538 - DNA, 16 bp, M. musculus
taaatacatacatatg

SEQ ID NO: 425539 - DNA, 16 bp, M. musculus
taaatacatgaatgaa

SEQ ID NO: 425540 - DNA, 16 bp, M. musculus
taaatacatgtaataa

SEQ ID NO: 425541 - DNA, 16 bp, M. musculus
taaatacatgtttaaa

SEQ ID NO: 425542 - DNA, 16 bp, M. musculus
taaatagaattttcaa

SEQ ID NO: 425543 - DNA, 16 bp, M. musculus
taaatagcctgggttg

SEQ ID NO: 425544 - DNA, 16 bp, M. musculus
taaatagtgttttact

SEQ ID NO: 425545 - DNA, 16 bp, M. musculus
taaatagttttggaga

SEQ ID NO: 425546 - DNA, 16 bp, M. musculus
taaatatacatatatg

SEQ ID NO: 425547 - DNA, 16 bp, M. musculus
taaatatagtaaaagc

SEQ ID NO: 425548 - DNA, 16 bp, M. musculus
taaatatataagtaca

SEQ ID NO: 425549 - DNA, 16 bp, M. musculus
taaatatatacatgta

SEQ ID NO: 425550 - DNA, 16 bp, M. musculus
taaatatatatacatg

SEQ ID NO: 425551 - DNA, 16 bp, M. musculus
taaatatcttaaagaa

SEQ ID NO: 425552 - DNA, 16 bp, M. musculus
taaatatgtaaaatgt

SEQ ID NO: 425553 - DNA, 16 bp, M. musculus
taaatatgtatatatg

SEQ ID NO: 425554 - DNA, 16 bp, M. musculus
taaatatgttttctat

SEQ ID NO: 425555 - DNA, 16 bp, M. musculus
taaatattgccacctg

SEQ ID NO: 425556 - DNA, 16 bp, M. musculus
taaatatttaccctta

SEQ ID NO: 425557 - DNA, 16 bp, M. musculus
taaatatttagaaggc

SEQ ID NO: 425558 - DNA, 16 bp, M. musculus
taaatatttcacattt

SEQ ID NO: 425559 - DNA, 16 bp, M. musculus
taaatatttgaaatgt

SEQ ID NO: 425560 - DNA, 16 bp, M. musculus
taaatatttgctgaat

SEQ ID NO: 425561 - DNA, 16 bp, M. musculus
taaatattttattgag

SEQ ID NO: 425562 - DNA, 16 bp, M. musculus
taaatcagaaagaaag

SEQ ID NO: 425563 - DNA, 16 bp, M. musculus
taaatcagtttttaaa

SEQ ID NO: 425564 - DNA, 16 bp, M. musculus
taaatcataatgtaaa

SEQ ID NO: 425565 - DNA, 16 bp, M. musculus
taaatccagcacttgg

SEQ ID NO: 425566 - DNA, 16 bp, M. musculus
taaatctaataaaaga

SEQ ID NO: 425567 - DNA, 16 bp, M. musculus
taaatctatctatcta

SEQ ID NO: 425568 - DNA, 16 bp, M. musculus
taaatctatttctttc

SEQ ID NO: 425569 - DNA, 16 bp, M. musculus
taaatctcctttttct

SEQ ID NO: 425570 - DNA, 16 bp, M. musculus
taaatctgtgttccca

SEQ ID NO: 425571 - DNA, 16 bp, M. musculus
taaatctgttttttaa

SEQ ID NO: 425572 - DNA, 16 bp, M. musculus
taaatcttcaaaaaag

SEQ ID NO: 425573 - DNA, 16 bp, M. musculus
taaatcttgaaagaaa

SEQ ID NO: 425574 - DNA, 16 bp, M. musculus
taaatcttggctgaat

SEQ ID NO: 425575 - DNA, 16 bp, M. musculus
taaatcttggggatga

SEQ ID NO: 425576 - DNA, 16 bp, M. musculus
taaatctttaaaaaga

SEQ ID NO: 425577 - DNA, 16 bp, M. musculus
taaatctttaaaaatg

SEQ ID NO: 425578 - DNA, 16 bp, M. musculus
taaatctttctttaaa

SEQ ID NO: 425579 - DNA, 16 bp, M. musculus
taaatcttttttaaag

SEQ ID NO: 425580 - DNA, 16 bp, M. musculus
taaatgaaagaagcca

SEQ ID NO: 425581 - DNA, 16 bp, M. musculus
taaatgaaataaaacc

SEQ ID NO: 425582 - DNA, 16 bp, M. musculus
taaatgaaatgaatga

SEQ ID NO: 425583 - DNA, 16 bp, M. musculus
taaatgaagaatatac

SEQ ID NO: 425584 - DNA, 16 bp, M. musculus
taaatgaagagaatat

SEQ ID NO: 425585 - DNA, 16 bp, M. musculus
taaatgaatcatattt

SEQ ID NO: 425586 - DNA, 16 bp, M. musculus
taaatgaatctttggg

SEQ ID NO: 425587 - DNA, 16 bp, M. musculus
taaatgaatgaatgag

SEQ ID NO: 425588 - DNA, 16 bp, M. musculus
taaatgacacagagac

SEQ ID NO: 425589 - DNA, 16 bp, M. musculus
taaatgaccctttcac

SEQ ID NO: 425590 - DNA, 16 bp, M. musculus
taaatgactatgagca

SEQ ID NO: 425591 - DNA, 16 bp, M. musculus
taaatgagttattaaa

SEQ ID NO: 425592 - DNA, 16 bp, M. musculus
taaatgagtttttaaa

SEQ ID NO: 425593 - DNA, 16 bp, M. musculus
taaatgataggtagat

SEQ ID NO: 425594 - DNA, 16 bp, M. musculus
taaatgcagaaaaagc

SEQ ID NO: 425595 - DNA, 16 bp, M. musculus
taaatgcatattttat

SEQ ID NO: 425596 - DNA, 16 bp, M. musculus
taaatgcattcttttt

SEQ ID NO: 425597 - DNA, 16 bp, M. musculus
taaatgcatttttaaa

SEQ ID NO: 425598 - DNA, 16 bp, M. musculus
taaatgctttcattta

SEQ ID NO: 425599 - DNA, 16 bp, M. musculus
taaatgcttttcaaaa

SEQ ID NO: 425600 - DNA, 16 bp, M. musculus
taaatgctttttaaaa

SEQ ID NO: 425601 - DNA, 16 bp, M. musculus
taaatggaaattttaa

SEQ ID NO: 425602 - DNA, 16 bp, M. musculus
taaatggagagaaatg

SEQ ID NO: 425603 - DNA, 16 bp, M. musculus
taaatggattaaggaa

SEQ ID NO: 425604 - DNA, 16 bp, M. musculus
taaatgtaacaaaaat

SEQ ID NO: 425605 - DNA, 16 bp, M. musculus
taaatgtaactttaaa

SEQ ID NO: 425606 - DNA, 16 bp, M. musculus
taaatgtaattttgct

SEQ ID NO: 425607 - DNA, 17 bp, M. musculus
taaatgtaccacatatt

SEQ ID NO: 425608 - DNA, 16 bp, M. musculus
taaatgtagaaaagga

SEQ ID NO: 425609 - DNA, 16 bp, M. musculus
taaatgtatgtatgta

SEQ ID NO: 425610 - DNA, 16 bp, M. musculus
taaatgtattttacat

SEQ ID NO: 425611 - DNA, 16 bp, M. musculus
taaatgtatttttctt

SEQ ID NO: 425612 - DNA, 16 bp, M. musculus
taaatgtcttttccat

SEQ ID NO: 425613 - DNA, 16 bp, M. musculus
taaatgtgaccccaca

SEQ ID NO: 425614 - DNA, 16 bp, M. musculus
taaatgtgatttaaaa

SEQ ID NO: 425615 - DNA, 16 bp, M. musculus
taaatgtgattttaaa

SEQ ID NO: 425616 - DNA, 16 bp, M. musculus
taaatgtggaaaatac

SEQ ID NO: 425617 - DNA, 16 bp, M. musculus
taaatgtgggtagcac

SEQ ID NO: 425618 - DNA, 16 bp, M. musculus
taaatgtgtacacaca

SEQ ID NO: 425619 - DNA, 16 bp, M. musculus
taaatgtgtatatata

SEQ ID NO: 425620 - DNA, 16 bp, M. musculus
taaatgtgtgtctgtg

SEQ ID NO: 425621 - DNA, 16 bp, M. musculus
taaatgtgtgtgtgtg

SEQ ID NO: 425622 - DNA, 16 bp, M. musculus
taaatgtgtgtttgtg

SEQ ID NO: 425623 - DNA, 16 bp, M. musculus
taaatgtttgttgaat

SEQ ID NO: 425624 - DNA, 16 bp, M. musculus
taaatgttttccttga

SEQ ID NO: 425625 - DNA, 16 bp, M. musculus
taaattaaagactttt

SEQ ID NO: 425626 - DNA, 16 bp, M. musculus
taaattcattgtgttt

SEQ ID NO: 425627 - DNA, 16 bp, M. musculus
taaattctgggattaa

SEQ ID NO: 425628 - DNA, 16 bp, M. musculus
taaattgaattatttg

SEQ ID NO: 425629 - DNA, 16 bp, M. musculus
taaattgccaaatata

SEQ ID NO: 425630 - DNA, 16 bp, M. musculus
taaattgcttttctca

SEQ ID NO: 425631 - DNA, 16 bp, M. musculus
taaatttcagcaattt

SEQ ID NO: 425632 - DNA, 16 bp, M. musculus
taaatttcccatttga

SEQ ID NO: 425633 - DNA, 16 bp, M. musculus
taaatttcctcagttt

SEQ ID NO: 425634 - DNA, 16 bp, M. musculus
taaatttctttcttca

SEQ ID NO: 425635 - DNA, 16 bp, M. musculus
taaatttgaggccagc

SEQ ID NO: 425636 - DNA, 16 bp, M. musculus
taaatttgcttctttt

SEQ ID NO: 425637 - DNA, 16 bp, M. musculus
taaatttggtacctgg

SEQ ID NO: 425638 - DNA, 16 bp, M. musculus
taaatttgtatcaata

SEQ ID NO: 425639 - DNA, 16 bp, M. musculus
taaatttgtgtttaaa

SEQ ID NO: 425640 - DNA, 16 bp, M. musculus
taaattttgtccttta

SEQ ID NO: 425641 - DNA, 16 bp, M. musculus
taaattttgttttgtc

SEQ ID NO: 425642 - DNA, 16 bp, M. musculus
taacaaaataaatagt

SEQ ID NO: 425643 - DNA, 16 bp, M. musculus
taacaaaataccagaa

SEQ ID NO: 425644 - DNA, 16 bp, M. musculus
taacaaaatactcaca

SEQ ID NO: 425645 - DNA, 16 bp, M. musculus
taacaaaatcagaatt

SEQ ID NO: 425646 - DNA, 16 bp, M. musculus
taacaacaaaaatgat

SEQ ID NO: 425647 - DNA, 16 bp, M. musculus
taacaacaacagcagc

SEQ ID NO: 425648 - DNA, 16 bp, M. musculus
taacaactgtctttaa

SEQ ID NO: 425649 - DNA, 16 bp, M. musculus
taacaagaactgactc

SEQ ID NO: 425650 - DNA, 16 bp, M. musculus
taacaagcacaaagaa

SEQ ID NO: 425651 - DNA, 16 bp, M. musculus
taacaagctgaaggac

SEQ ID NO: 425652 - DNA, 16 bp, M. musculus
taacaattaatgaaaa

SEQ ID NO: 425653 - DNA, 16 bp, M. musculus
taacaattatgtaaat

SEQ ID NO: 425654 - DNA, 16 bp, M. musculus
taacacaagaggttta

SEQ ID NO: 425655 - DNA, 16 bp, M. musculus
taacacagcaacagct

SEQ ID NO: 425656 - DNA, 16 bp, M. musculus
taacagaaatcaacaa

SEQ ID NO: 425657 - DNA, 16 bp, M. musculus
taacagaacttatgaa

SEQ ID NO: 425658 - DNA, 16 bp, M. musculus
taacagaggggaagct

SEQ ID NO: 425659 - DNA, 16 bp, M. musculus
taacagagtatcatta

SEQ ID NO: 425660 - DNA, 16 bp, M. musculus
taacagatatccacag

SEQ ID NO: 425661 - DNA, 16 bp, M. musculus
taacagcaagggtgga

SEQ ID NO: 425662 - DNA, 16 bp, M. musculus
taacagcagcagcagc

SEQ ID NO: 425663 - DNA, 16 bp, M. musculus
taacaggaagcaagaa

SEQ ID NO: 425664 - DNA, 16 bp, M. musculus
taacaggagcaaaatt

SEQ ID NO: 425665 - DNA, 16 bp, M. musculus
taacagggaggacatt

SEQ ID NO: 425666 - DNA, 16 bp, M. musculus
taacagtagcaaaatt

SEQ ID NO: 425667 - DNA, 16 bp, M. musculus
taacagttaatgaaaa

SEQ ID NO: 425668 - DNA, 16 bp, M. musculus
taacagttacctaggc

SEQ ID NO: 425669 - DNA, 16 bp, M. musculus
taacatagtaaaaaat

SEQ ID NO: 425670 - DNA, 16 bp, M. musculus
taacatcaaatggggt

SEQ ID NO: 425671 - DNA, 16 bp, M. musculus
taacatcaattggtat

SEQ ID NO: 425672 - DNA, 16 bp, M. musculus
taacatcatcatcatc

SEQ ID NO: 425673 - DNA, 16 bp, M. musculus
taacatctcagaccaa

SEQ ID NO: 425674 - DNA, 16 bp, M. musculus
taacatgtatatatat

SEQ ID NO: 425675 - DNA, 16 bp, M. musculus
taacatgtttaggtat

SEQ ID NO: 425676 - DNA, 16 bp, M. musculus
taacatttaaagtgta

SEQ ID NO: 425677 - DNA, 16 bp, M. musculus
taacatttgaaaatgt

SEQ ID NO: 425678 - DNA, 16 bp, M. musculus
taacattttctttaaa

SEQ ID NO: 425679 - DNA, 16 bp, M. musculus
taacattttgttattt

SEQ ID NO: 425680 - DNA, 16 bp, M. musculus
taaccaaaagcaactt

SEQ ID NO: 425681 - DNA, 16 bp, M. musculus
taaccaacaactttct

SEQ ID NO: 425682 - DNA, 16 bp, M. musculus
taaccaagaaactatt

SEQ ID NO: 425683 - DNA, 16 bp, M. musculus
taaccaagcttttaga

SEQ ID NO: 425684 - DNA, 16 bp, M. musculus
taaccaagtggaaaca

SEQ ID NO: 425685 - DNA, 16 bp, M. musculus
taaccaatgtggtaaa

SEQ ID NO: 425686 - DNA, 17 bp, M. musculus
taaccaatgtggtaaaa

SEQ ID NO: 425687 - DNA, 16 bp, M. musculus
taaccacacaacagaa

SEQ ID NO: 425688 - DNA, 24 bp, M. musculus
taaccacatggtggctcacaacca

SEQ ID NO: 425689 - DNA, 16 bp, M. musculus
taaccactgagcaatc

SEQ ID NO: 425690 - DNA, 16 bp, M. musculus
taaccactgagccatt

SEQ ID NO: 425691 - DNA, 16 bp, M. musculus
taaccactgagcccca

SEQ ID NO: 425692 - DNA, 16 bp, M. musculus
taaccactgagctatc

SEQ ID NO: 425693 - DNA, 16 bp, M. musculus
taaccactgtgccatc

SEQ ID NO: 425694 - DNA, 16 bp, M. musculus
taaccagagggcagag

SEQ ID NO: 425695 - DNA, 16 bp, M. musculus
taaccaggcaagactt

SEQ ID NO: 425696 - DNA, 16 bp, M. musculus
taaccagtacctcccg

SEQ ID NO: 425697 - DNA, 16 bp, M. musculus
taaccagttcacccag

SEQ ID NO: 425698 - DNA, 16 bp, M. musculus
taacccaaaacatcca

SEQ ID NO: 425699 - DNA, 16 bp, M. musculus
taacccaaaccatcca

SEQ ID NO: 425700 - DNA, 16 bp, M. musculus
taacccagatgcccct

SEQ ID NO: 425701 - DNA, 16 bp, M. musculus
taacccaggctggcct

SEQ ID NO: 425702 - DNA, 16 bp, M. musculus
taacccaggctggctt

SEQ ID NO: 425703 - DNA, 16 bp, M. musculus
taacccaggctggtct

SEQ ID NO: 425704 - DNA, 16 bp, M. musculus
taacccaggctgtcct

SEQ ID NO: 425705 - DNA, 16 bp, M. musculus
taacccatgctggcct

SEQ ID NO: 425706 - DNA, 16 bp, M. musculus
taaccccagagcttcc

SEQ ID NO: 425707 - DNA, 16 bp, M. musculus
taaccccagctgtgtc

SEQ ID NO: 425708 - DNA, 16 bp, M. musculus
taaccccagtgctggg

SEQ ID NO: 425709 - DNA, 16 bp, M. musculus
taaccctgtaacccag

SEQ ID NO: 425710 - DNA, 16 bp, M. musculus
taaccgtaattttgct

SEQ ID NO: 425711 - DNA, 16 bp, M. musculus
taacctagtcacaaaa

SEQ ID NO: 425712 - DNA, 16 bp, M. musculus
taacctatgacatcca

SEQ ID NO: 425713 - DNA, 16 bp, M. musculus
taacctctgtggttct

SEQ ID NO: 425714 - DNA, 16 bp, M. musculus
taacctgcctgtttcc

SEQ ID NO: 425715 - DNA, 16 bp, M. musculus
taacctgggctacatg

SEQ ID NO: 425716 - DNA, 16 bp, M. musculus
taacctgggctcacag

SEQ ID NO: 425717 - DNA, 72 bp, M. musculus
taaccttgcagcactggggagatgtccagcgcattgcatccaaccagtctgtggatgtcaggaagaggcgct

SEQ ID NO: 425718 - DNA, 30 bp, M. musculus
taacggcgaatgtgggcgcggctcccaaca

SEQ ID NO: 425719 - DNA, 16 bp, M. musculus
taactaagacacatac

SEQ ID NO: 425720 - DNA, 16 bp, M. musculus
taactaagcaacttgt

SEQ ID NO: 425721 - DNA, 16 bp, M. musculus
taactaaggactattt

SEQ ID NO: 425722 - DNA, 16 bp, M. musculus
taactacagttccagg

SEQ ID NO: 425723 - DNA, 16 bp, M. musculus
taactacattttaaaa

SEQ ID NO: 425724 - DNA, 16 bp, M. musculus
taactacttcctgctg

SEQ ID NO: 425725 - DNA, 16 bp, M. musculus
taactattgagccatc

SEQ ID NO: 425726 - DNA, 16 bp, M. musculus
taactcaggctagcct

SEQ ID NO: 425727 - DNA, 16 bp, M. musculus
taactcagtggtagag

SEQ ID NO: 425728 - DNA, 16 bp, M. musculus
taactcatgatgatgg

SEQ ID NO: 425729 - DNA, 17 bp, M. musculus
taactcatgtccttgga

SEQ ID NO: 425730 - DNA, 16 bp, M. musculus
taactccaactccagg

SEQ ID NO: 425731 - DNA, 16 bp, M. musculus
taactccaagatctga

SEQ ID NO: 425732 - DNA, 16 bp, M. musculus
taactccaattccagg

SEQ ID NO: 425733 - DNA, 16 bp, M. musculus
taactccaattctagg

SEQ ID NO: 425734 - DNA, 16 bp, M. musculus
taactccagagcagag

SEQ ID NO: 425735 - DNA, 16 bp, M. musculus
taactccagattttat

SEQ ID NO: 425736 - DNA, 16 bp, M. musculus
taactccagctccaag

SEQ ID NO: 425737 - DNA, 16 bp, M. musculus
taactccagctccagg

SEQ ID NO: 425738 - DNA, 16 bp, M. musculus
taactccagctctagg

SEQ ID NO: 425739 - DNA, 16 bp, M. musculus
taactccagctctgag

SEQ ID NO: 425740 - DNA, 16 bp, M. musculus
taactccagtgctagg

SEQ ID NO: 425741 - DNA, 16 bp, M. musculus
taactccagttacaag

SEQ ID NO: 425742 - DNA, 16 bp, M. musculus
taactccagttccaga

SEQ ID NO: 425743 - DNA, 16 bp, M. musculus
taactccagttccagg

SEQ ID NO: 425744 - DNA, 16 bp, M. musculus
taactccagttctagg

SEQ ID NO: 425745 - DNA, 16 bp, M. musculus
taactccagttctcag

SEQ ID NO: 425746 - DNA, 16 bp, M. musculus
taactccagtttcagg

SEQ ID NO: 425747 - DNA, 16 bp, M. musculus
taactccagttttggg

SEQ ID NO: 425748 - DNA, 16 bp, M. musculus
taactcgagttccagg

SEQ ID NO: 425749 - DNA, 16 bp, M. musculus
taactctagtcccagg

SEQ ID NO: 425750 - DNA, 16 bp, M. musculus
taactctagttccaaa

SEQ ID NO: 425751 - DNA, 16 bp, M. musculus
taactctagttccagg

SEQ ID NO: 425752 - DNA, 16 bp, M. musculus
taactctctctctctc

SEQ ID NO: 425753 - DNA, 16 bp, M. musculus
taactctgaagaattg

SEQ ID NO: 425754 - DNA, 16 bp, M. musculus
taactctggttttgag

SEQ ID NO: 425755 - DNA, 16 bp, M. musculus
taactctgtagactag

SEQ ID NO: 425756 - DNA, 16 bp, M. musculus
taactcttccattgtg

SEQ ID NO: 425757 - DNA, 16 bp, M. musculus
taactcttcctgagga

SEQ ID NO: 425758 - DNA, 16 bp, M. musculus
taactcttctgaaatg

SEQ ID NO: 425759 - DNA, 16 bp, M. musculus
taactctttaaaaaat

SEQ ID NO: 425760 - DNA, 25 bp, M. musculus
taactgaaaatatataggaagccta

SEQ ID NO: 425761 - DNA, 16 bp, M. musculus
taactgaaaatggaat

SEQ ID NO: 425762 - DNA, 16 bp, M. musculus
taactgaatctaagaa

SEQ ID NO: 425763 - DNA, 16 bp, M. musculus
taactgcaattttgct

SEQ ID NO: 425764 - DNA, 17 bp, M. musculus
taactgctgagccatcc

SEQ ID NO: 425765 - DNA, 16 bp, M. musculus
taactgctgagccatg

SEQ ID NO: 425766 - DNA, 16 bp, M. musculus
taactgctgggccatc

SEQ ID NO: 425767 - DNA, 16 bp, M. musculus
taactggactgcctgg

SEQ ID NO: 425768 - DNA, 16 bp, M. musculus
taactggagctgtgtc

SEQ ID NO: 425769 - DNA, 16 bp, M. musculus
taactgtagcaaaatt

SEQ ID NO: 425770 - DNA, 16 bp, M. musculus
taactgtagttttgct

SEQ ID NO: 425771 - DNA, 16 bp, M. musculus
taactgtcatcagaga

SEQ ID NO: 425772 - DNA, 16 bp, M. musculus
taactgtcctctgaga

SEQ ID NO: 425773 - DNA, 16 bp, M. musculus
taactgtgagcatcca

SEQ ID NO: 425774 - DNA, 16 bp, M. musculus
taactgtggcttcata

SEQ ID NO: 425775 - DNA, 16 bp, M. musculus
taactgtggggatgga

SEQ ID NO: 425776 - DNA, 16 bp, M. musculus
taactgtgtgtgtgtg

SEQ ID NO: 425777 - DNA, 25 bp, M. musculus
taactgttaatctttaactgaactt

SEQ ID NO: 425778 - DNA, 16 bp, M. musculus
taactgttattttaaa

SEQ ID NO: 425779 - DNA, 16 bp, M. musculus
taactgttttttaaaa

SEQ ID NO: 425780 - DNA, 16 bp, M. musculus
taacttcagttctagg

SEQ ID NO: 425781 - DNA, 16 bp, M. musculus
taacttctctgggtct

SEQ ID NO: 425782 - DNA, 16 bp, M. musculus
taacttctgtaagttt

SEQ ID NO: 425783 - DNA, 16 bp, M. musculus
taacttgatatgccat

SEQ ID NO: 425784 - DNA, 16 bp, M. musculus
taacttgatttttttc

SEQ ID NO: 425785 - DNA, 16 bp, M. musculus
taacttggaaaaaaaa

SEQ ID NO: 425786 - DNA, 16 bp, M. musculus
taacttggcacagatg

SEQ ID NO: 425787 - DNA, 16 bp, M. musculus
taacttgtaaaataaa

SEQ ID NO: 425788 - DNA, 16 bp, M. musculus
taactttgaaaacata

SEQ ID NO: 425789 - DNA, 16 bp, M. musculus
taactttgaactcctg

SEQ ID NO: 425790 - DNA, 16 bp, M. musculus
taactttgatgtgtat

SEQ ID NO: 425791 - DNA, 16 bp, M. musculus
taactttggtatgtgg

SEQ ID NO: 425792 - DNA, 16 bp, M. musculus
taactttggtttggaa

SEQ ID NO: 425793 - DNA, 16 bp, M. musculus
taacttttcctcgggt

SEQ ID NO: 425794 - DNA, 16 bp, M. musculus
taacttttgaaatata

SEQ ID NO: 425795 - DNA, 16 bp, M. musculus
taacttttgagcctca

SEQ ID NO: 425796 - DNA, 16 bp, M. musculus
taactttttaaaaaca

SEQ ID NO: 425797 - DNA, 16 bp, M. musculus
taactttttaaagttt

SEQ ID NO: 425798 - DNA, 16 bp, M. musculus
taacttttttattaga

SEQ ID NO: 425799 - DNA, 16 bp, M. musculus
taagaaaatattttgt

SEQ ID NO: 425800 - DNA, 16 bp, M. musculus
taagaaaatgattttt

SEQ ID NO: 425801 - DNA, 16 bp, M. musculus
taagaaaatgccccca

SEQ ID NO: 425802 - DNA, 16 bp, M. musculus
taagaaaatgcctccc

SEQ ID NO: 425803 - DNA, 16 bp, M. musculus
taagaaaatgtcctat

SEQ ID NO: 425804 - DNA, 16 bp, M. musculus
taagaaaatgtctcca

SEQ ID NO: 425805 - DNA, 16 bp, M. musculus
taagaaactccacata

SEQ ID NO: 425806 - DNA, 16 bp, M. musculus
taagaaactttttttt

SEQ ID NO: 425807 - DNA, 16 bp, M. musculus
taagaaagaaattagg

SEQ ID NO: 425808 - DNA, 16 bp, M. musculus
taagaaagaagttggt

SEQ ID NO: 425809 - DNA, 16 bp, M. musculus
taagaaagcacactga

SEQ ID NO: 425810 - DNA, 16 bp, M. musculus
taagaaagccagaaga

SEQ ID NO: 425811 - DNA, 16 bp, M. musculus
taagaaaggatttatt

SEQ ID NO: 425812 - DNA, 16 bp, M. musculus
taagaacaaaatcaac

SEQ ID NO: 425813 - DNA, 16 bp, M. musculus
taagaacaacaacaac

SEQ ID NO: 425814 - DNA, 16 bp, M. musculus
taagaacacattaaag

SEQ ID NO: 425815 - DNA, 16 bp, M. musculus
taagaacactgacttt

SEQ ID NO: 425816 - DNA, 16 bp, M. musculus
taagaacagagaactg

SEQ ID NO: 425817 - DNA, 16 bp, M. musculus
taagaacagagagaaa

SEQ ID NO: 425818 - DNA, 16 bp, M. musculus
taagaacatattttaa

SEQ ID NO: 425819 - DNA, 16 bp, M. musculus
taagaacctgtacagc

SEQ ID NO: 425820 - DNA, 17 bp, M. musculus
taagaacttctacctgt

SEQ ID NO: 425821 - DNA, 16 bp, M. musculus
taagaagaaagaagac

SEQ ID NO: 425822 - DNA, 16 bp, M. musculus
taagaagaacataaat

SEQ ID NO: 425823 - DNA, 16 bp, M. musculus
taagaagacaggatat

SEQ ID NO: 425824 - DNA, 16 bp, M. musculus
taagaagaccagcagt

SEQ ID NO: 425825 - DNA, 16 bp, M. musculus
taagaagctgagagaa

SEQ ID NO: 425826 - DNA, 16 bp, M. musculus
taagaagctggaaaga

SEQ ID NO: 425827 - DNA, 16 bp, M. musculus
taagaagcttacagaa

SEQ ID NO: 425828 - DNA, 16 bp, M. musculus
taagaaggaaccagag

SEQ ID NO: 425829 - DNA, 16 bp, M. musculus
taagaaggaccaaagt

SEQ ID NO: 425830 - DNA, 16 bp, M. musculus
taagaaggattctgag

SEQ ID NO: 425831 - DNA, 16 bp, M. musculus
taagaagtgtaacaag

SEQ ID NO: 425832 - DNA, 16 bp, M. musculus
taagaagtgtggcctt

SEQ ID NO: 425833 - DNA, 16 bp, M. musculus
taagaagtgtgtgtgt

SEQ ID NO: 425834 - DNA, 16 bp, M. musculus
taagaatactggctgt

SEQ ID NO: 425835 - DNA, 16 bp, M. musculus
taagaatatgtttttg

SEQ ID NO: 425836 - DNA, 16 bp, M. musculus
taagaatgaagatttt

SEQ ID NO: 425837 - DNA, 16 bp, M. musculus
taagaatgtgtttttg

SEQ ID NO: 425838 - DNA, 16 bp, M. musculus
taagaattccttgttc

SEQ ID NO: 425839 - DNA, 16 bp, M. musculus
taagaattgtttttgt

SEQ ID NO: 425840 - DNA, 16 bp, M. musculus
taagaatttcatgaag

SEQ ID NO: 425841 - DNA, 16 bp, M. musculus
taagaattttatacat

SEQ ID NO: 425842 - DNA, 16 bp, M. musculus
taagaattttatgaat

SEQ ID NO: 425843 - DNA, 16 bp, M. musculus
taagacaaaaaggaca

SEQ ID NO: 425844 - DNA, 16 bp, M. musculus
taagacaaaacagcaa

SEQ ID NO: 425845 - DNA, 16 bp, M. musculus
taagacaagttggtac

SEQ ID NO: 425846 - DNA, 16 bp, M. musculus
taagacagccagagct

SEQ ID NO: 425847 - DNA, 16 bp, M. musculus
taagacagggtctcat

SEQ ID NO: 425848 - DNA, 16 bp, M. musculus
taagacattttaaatt

SEQ ID NO: 425849 - DNA, 16 bp, M. musculus
taagaccatcaaaaaa

SEQ ID NO: 425850 - DNA, 16 bp, M. musculus
taagaccatcagaaat

SEQ ID NO: 425851 - DNA, 16 bp, M. musculus
taagaccctcatccta

SEQ ID NO: 425852 - DNA, 16 bp, M. musculus
taagaccctgtcttga

SEQ ID NO: 425853 - DNA, 16 bp, M. musculus
taagacctgtgatgag

SEQ ID NO: 425854 - DNA, 16 bp, M. musculus
taagactgctatgaac

SEQ ID NO: 425855 - DNA, 23 bp, M. musculus
taagactggtgttcactttgtga

SEQ ID NO: 425856 - DNA, 16 bp, M. musculus
taagactgtctcaaaa

SEQ ID NO: 425857 - DNA, 16 bp, M. musculus
taagacttgcattggt

SEQ ID NO: 425858 - DNA, 16 bp, M. musculus
taagagaaaactcata

SEQ ID NO: 425859 - DNA, 16 bp, M. musculus
taagagaaagccaaca

SEQ ID NO: 425860 - DNA, 16 bp, M. musculus
taagagaaaggactga

SEQ ID NO: 425861 - DNA, 16 bp, M. musculus
taagagaaatcaaaga

SEQ ID NO: 425862 - DNA, 16 bp, M. musculus
taagagaacaaaaatt

SEQ ID NO: 425863 - DNA, 16 bp, M. musculus
taagagaactgactgc

SEQ ID NO: 425864 - DNA, 16 bp, M. musculus
taagagactgaatttt

SEQ ID NO: 425865 - DNA, 16 bp, M. musculus
taagagagcaagctga

SEQ ID NO: 425866 - DNA, 16 bp, M. musculus
taagagagctgtttca

SEQ ID NO: 425867 - DNA, 16 bp, M. musculus
taagagatataaagga

SEQ ID NO: 425868 - DNA, 16 bp, M. musculus
taagagatgtggcctt

SEQ ID NO: 425869 - DNA, 16 bp, M. musculus
taagagcaaagcttca

SEQ ID NO: 425870 - DNA, 20 bp, M. musculus
taagagcaccaactgctctt

SEQ ID NO: 425871 - DNA, 20 bp, M. musculus
taagagcaccgactgctctt

SEQ ID NO: 425872 - DNA, 22 bp, M. musculus
taagagcaccggactgctcttc

SEQ ID NO: 425873 - DNA, 16 bp, M. musculus
taagagcactaactgc

SEQ ID NO: 425874 - DNA, 16 bp, M. musculus
taagagcactcactgt

SEQ ID NO: 425875 - DNA, 16 bp, M. musculus
taagagcactgactga

SEQ ID NO: 425876 - DNA, 17 bp, M. musculus
taagagcactgactgca

SEQ ID NO: 425877 - DNA, 20 bp, M. musculus
taagagcactgactgctctt

SEQ ID NO: 425878 - DNA, 18 bp, M. musculus
taagagcactgactgctt

SEQ ID NO: 425879 - DNA, 16 bp, M. musculus
taagagcactgactgg

SEQ ID NO: 425880 - DNA, 19 bp, M. musculus
taagagcactgactgttct

SEQ ID NO: 425881 - DNA, 16 bp, M. musculus
taagagcactggctgg

SEQ ID NO: 425882 - DNA, 16 bp, M. musculus
taagagcacttgactg

SEQ ID NO: 425883 - DNA, 16 bp, M. musculus
taagagcacttgctgt

SEQ ID NO: 425884 - DNA, 16 bp, M. musculus
taagagcagcccagat

SEQ ID NO: 425885 - DNA, 16 bp, M. musculus
taagagcaggtaaact

SEQ ID NO: 425886 - DNA, 16 bp, M. musculus
taagagcagtccagat

SEQ ID NO: 425887 - DNA, 16 bp, M. musculus
taagagccagagagaa

SEQ ID NO: 425888 - DNA, 16 bp, M. musculus
taagagccagagggaa

SEQ ID NO: 425889 - DNA, 16 bp, M. musculus
taagagccctgactgc

SEQ ID NO: 425890 - DNA, 16 bp, M. musculus
taagagccctggctgt

SEQ ID NO: 425891 - DNA, 16 bp, M. musculus
taagagcccttccttc

SEQ ID NO: 425892 - DNA, 16 bp, M. musculus
taagagcgctgactgt

SEQ ID NO: 425893 - DNA, 16 bp, M. musculus
taagagctcttccaga

SEQ ID NO: 425894 - DNA, 16 bp, M. musculus
taagagctgcccagat

SEQ ID NO: 425895 - DNA, 17 bp, M. musculus
taagaggaaaactcata

SEQ ID NO: 425896 - DNA, 16 bp, M. musculus
taagaggcagatggag

SEQ ID NO: 425897 - DNA, 16 bp, M. musculus
taagaggtggagccta

SEQ ID NO: 425898 - DNA, 16 bp, M. musculus
taagagtgagaggccc

SEQ ID NO: 425899 - DNA, 16 bp, M. musculus
taagataaaaatctca

SEQ ID NO: 425900 - DNA, 16 bp, M. musculus
taagatataatttcct

SEQ ID NO: 425901 - DNA, 16 bp, M. musculus
taagatatccagcttg

SEQ ID NO: 425902 - DNA, 16 bp, M. musculus
taagatatgttatatt

SEQ ID NO: 425903 - DNA, 16 bp, M. musculus
taagatatttttcttt

SEQ ID NO: 425904 - DNA, 18 bp, M. musculus
taagatcactaaggagca

SEQ ID NO: 425905 - DNA, 16 bp, M. musculus
taagatcatctcagag

SEQ ID NO: 425906 - DNA, 21 bp, M. musculus
taagatcatggtttcctcccc

SEQ ID NO: 425907 - DNA, 21 bp, M. musculus
taagatcctcaccctagttgc

SEQ ID NO: 425908 - DNA, 16 bp, M. musculus
taagatcttgtctcaa

SEQ ID NO: 425909 - DNA, 16 bp, M. musculus
taagatgaagcaaaaa

SEQ ID NO: 425910 - DNA, 16 bp, M. musculus
taagatggagagcaat

SEQ ID NO: 425911 - DNA, 16 bp, M. musculus
taagatggctcagtgg

SEQ ID NO: 425912 - DNA, 16 bp, M. musculus
taagattctatctcaa

SEQ ID NO: 425913 - DNA, 16 bp, M. musculus
taagattgagaatgga

SEQ ID NO: 425914 - DNA, 16 bp, M. musculus
taagattttaaaacaa

SEQ ID NO: 425915 - DNA, 16 bp, M. musculus
taagattttaagattt

SEQ ID NO: 425916 - DNA, 16 bp, M. musculus
taagcaaagaattttc

SEQ ID NO: 425917 - DNA, 16 bp, M. musculus
taagcaagtgctctac

SEQ ID NO: 425918 - DNA, 16 bp, M. musculus
taagcaatgtggtaaa

SEQ ID NO: 425919 - DNA, 17 bp, M. musculus
taagcacaaaaggaatt

SEQ ID NO: 425920 - DNA, 16 bp, M. musculus
taagcacatcataaca

SEQ ID NO: 425921 - DNA, 16 bp, M. musculus
taagcagagggcacag

SEQ ID NO: 425922 - DNA, 16 bp, M. musculus
taagcagatcctggtg

SEQ ID NO: 425923 - DNA, 16 bp, M. musculus
taagcagcaaagtgtt

SEQ ID NO: 425924 - DNA, 16 bp, M. musculus
taagcagcagcagcag

SEQ ID NO: 425925 - DNA, 16 bp, M. musculus
taagcagcatccctcc

SEQ ID NO: 425926 - DNA, 16 bp, M. musculus
taagcaggaagcagag

SEQ ID NO: 425927 - DNA, 22 bp, M. musculus
taagcatgaagagggagactta

SEQ ID NO: 425928 - DNA, 16 bp, M. musculus
taagcattatttttaa

SEQ ID NO: 425929 - DNA, 16 bp, M. musculus
taagccaaataaactt

SEQ ID NO: 425930 - DNA, 16 bp, M. musculus
taagccaatctaataa

SEQ ID NO: 425931 - DNA, 19 bp, M. musculus
taagccagccccaattaaa

SEQ ID NO: 425932 - DNA, 16 bp, M. musculus
taagccaggcatggtg

SEQ ID NO: 425933 - DNA, 16 bp, M. musculus
taagccaggtgtggtg

SEQ ID NO: 425934 - DNA, 16 bp, M. musculus
taagccatctccccag

SEQ ID NO: 425935 - DNA, 16 bp, M. musculus
taagccatctctctag

SEQ ID NO: 425936 - DNA, 16 bp, M. musculus
taagcccatttgtttc

SEQ ID NO: 425937 - DNA, 16 bp, M. musculus
taagcctgaagacctg

SEQ ID NO: 425938 - DNA, 16 bp, M. musculus
taagcctgacaacctg

SEQ ID NO: 425939 - DNA, 16 bp, M. musculus
taagcctgatgacctg

SEQ ID NO: 425940 - DNA, 17 bp, M. musculus
taagcctgcattggtga

SEQ ID NO: 425941 - DNA, 16 bp, M. musculus
taagctaaaataaaat

SEQ ID NO: 425942 - DNA, 16 bp, M. musculus
taagctaccatgtggt

SEQ ID NO: 425943 - DNA, 16 bp, M. musculus
taagctattaaaaaca

SEQ ID NO: 425944 - DNA, 16 bp, M. musculus
taagctctaccataaa

SEQ ID NO: 425945 - DNA, 16 bp, M. musculus
taagctctcatctttc

SEQ ID NO: 425946 - DNA, 16 bp, M. musculus
taagctgaagtgccca

SEQ ID NO: 425947 - DNA, 16 bp, M. musculus
taagctggccctgaga

SEQ ID NO: 425948 - DNA, 16 bp, M. musculus
taagctgtttaggttt

SEQ ID NO: 425949 - DNA, 16 bp, M. musculus
taagcttaagatgagg

SEQ ID NO: 425950 - DNA, 16 bp, M. musculus
taagcttgttcaatat

SEQ ID NO: 425951 - DNA, 16 bp, M. musculus
taagctttgcagtttc

SEQ ID NO: 425952 - DNA, 16 bp, M. musculus
taaggaaaaagccaaa

SEQ ID NO: 425953 - DNA, 16 bp, M. musculus
taaggaaaggggataa

SEQ ID NO: 425954 - DNA, 16 bp, M. musculus
taaggaaatagaagca

SEQ ID NO: 425955 - DNA, 16 bp, M. musculus
taaggaaatgtgcttt

SEQ ID NO: 425956 - DNA, 16 bp, M. musculus
taaggaagaaaggtca

SEQ ID NO: 425957 - DNA, 16 bp, M. musculus
taaggaagaatgaagt

SEQ ID NO: 425958 - DNA, 16 bp, M. musculus
taaggaagcagaggca

SEQ ID NO: 425959 - DNA, 16 bp, M. musculus
taaggaatatatatat

SEQ ID NO: 425960 - DNA, 18 bp, M. musculus
taaggaatcccagtaata

SEQ ID NO: 425961 - DNA, 16 bp, M. musculus
taaggaatttattcat

SEQ ID NO: 425962 - DNA, 16 bp, M. musculus
taaggacaacatttaa

SEQ ID NO: 425963 - DNA, 16 bp, M. musculus
taaggacagatgctcc

SEQ ID NO: 425964 - DNA, 20 bp, M. musculus
taaggacttgtaactcctta

SEQ ID NO: 425965 - DNA, 16 bp, M. musculus
taaggagctgaaggag

SEQ ID NO: 425966 - DNA, 16 bp, M. musculus
taaggaggaaagaagt

SEQ ID NO: 425967 - DNA, 16 bp, M. musculus
taaggatgcaatatga

SEQ ID NO: 425968 - DNA, 16 bp, M. musculus
taaggatgttgaacaa

SEQ ID NO: 425969 - DNA, 16 bp, M. musculus
taaggattctgaacat

SEQ ID NO: 425970 - DNA, 16 bp, M. musculus
taaggcactggcagag

SEQ ID NO: 425971 - DNA, 16 bp, M. musculus
taaggcagaccaatac

SEQ ID NO: 425972 - DNA, 16 bp, M. musculus
taaggcagcacagagt

SEQ ID NO: 425973 - DNA, 16 bp, M. musculus
taaggcagcccagtta

SEQ ID NO: 425974 - DNA, 16 bp, M. musculus
taaggcaggaagatgg

SEQ ID NO: 425975 - DNA, 16 bp, M. musculus
taaggcagtgtttctc

SEQ ID NO: 425976 - DNA, 16 bp, M. musculus
taaggcatcaacaaat

SEQ ID NO: 425977 - DNA, 16 bp, M. musculus
taaggccagcctgggc

SEQ ID NO: 425978 - DNA, 16 bp, M. musculus
taaggctcagaaacaa

SEQ ID NO: 425979 - DNA, 16 bp, M. musculus
taaggctctgtgtgtg

SEQ ID NO: 425980 - DNA, 16 bp, M. musculus
taaggctgaccttcaa

SEQ ID NO: 425981 - DNA, 16 bp, M. musculus
taaggctgttcttcaa

SEQ ID NO: 425982 - DNA, 16 bp, M. musculus
taaggctgttgaacat

SEQ ID NO: 425983 - DNA, 16 bp, M. musculus
taagggaagaaggtca

SEQ ID NO: 425984 - DNA, 16 bp, M. musculus
taaggtcaaaaattca

SEQ ID NO: 425985 - DNA, 16 bp, M. musculus
taaggtcagatctaag

SEQ ID NO: 425986 - DNA, 16 bp, M. musculus
taaggtcttctatctg

SEQ ID NO: 425987 - DNA, 17 bp, M. musculus
taaggttctcaggtata

SEQ ID NO: 425988 - DNA, 16 bp, M. musculus
taagtaaaattttcat

SEQ ID NO: 425989 - DNA, 16 bp, M. musculus
taagtaaacaagtaaa

SEQ ID NO: 425990 - DNA, 16 bp, M. musculus
taagtaaagaaaatgt

SEQ ID NO: 425991 - DNA, 18 bp, M. musculus
taagtaaccaatcattat

SEQ ID NO: 425992 - DNA, 16 bp, M. musculus
taagtaagcaaataaa

SEQ ID NO: 425993 - DNA, 23 bp, M. musculus
taagtacactgtagctgtcctca

SEQ ID NO: 425994 - DNA, 16 bp, M. musculus
taagtactcaataaat

SEQ ID NO: 425995 - DNA, 16 bp, M. musculus
taagtatctgtgtttt

SEQ ID NO: 425996 - DNA, 16 bp, M. musculus
taagtcacacacacac

SEQ ID NO: 425997 - DNA, 16 bp, M. musculus
taagtcatctccccag

SEQ ID NO: 425998 - DNA, 16 bp, M. musculus
taagtccctgaagaaa

SEQ ID NO: 425999 - DNA, 16 bp, M. musculus
taagtctgcctttata

SEQ ID NO: 426000 - DNA, 16 bp, M. musculus
taagtctttgaagaaa

SEQ ID NO: 426001 - DNA, 16 bp, M. musculus
taagtcttttaaaaaa

SEQ ID NO: 426002 - DNA, 16 bp, M. musculus
taagtgaaataagtca

SEQ ID NO: 426003 - DNA, 16 bp, M. musculus
taagtgagatccaagc

SEQ ID NO: 426004 - DNA, 16 bp, M. musculus
taagtgagttattaat

SEQ ID NO: 426005 - DNA, 41 bp, M. musculus
taagtgataatcggctctgctcagggttgttggacagttaa

SEQ ID NO: 426006 - DNA, 16 bp, M. musculus
taagtgcaagagaggc

SEQ ID NO: 426007 - DNA, 16 bp, M. musculus
taagtgccttcataaa

SEQ ID NO: 426008 - DNA, 16 bp, M. musculus
taagtgctgagattaa

SEQ ID NO: 426009 - DNA, 16 bp, M. musculus
taagtggagagaagct

SEQ ID NO: 426010 - DNA, 21 bp, M. musculus
taagtggatattagccccaaa

SEQ ID NO: 426011 - DNA, 16 bp, M. musculus
taagtggatcaaaaac

SEQ ID NO: 426012 - DNA, 16 bp, M. musculus
taagtggatcaagaac

SEQ ID NO: 426013 - DNA, 33 bp, M. musculus
taagtggatgctcacagtcagctattggatgga

SEQ ID NO: 426014 - DNA, 17 bp, M. musculus
taagtggattaaggaac

SEQ ID NO: 426015 - DNA, 16 bp, M. musculus
taagtgtccttgtggt

SEQ ID NO: 426016 - DNA, 16 bp, M. musculus
taagtgtgaagagtgt

SEQ ID NO: 426017 - DNA, 16 bp, M. musculus
taagtgtggtggcaca

SEQ ID NO: 426018 - DNA, 16 bp, M. musculus
taagttatgattctag

SEQ ID NO: 426019 - DNA, 16 bp, M. musculus
taagttcaaggtcagc

SEQ ID NO: 426020 - DNA, 16 bp, M. musculus
taagttccagggcagc

SEQ ID NO: 426021 - DNA, 16 bp, M. musculus
taagttctaggccagc

SEQ ID NO: 426022 - DNA, 36 bp, M. musculus
taagttctgtgactctagagaaccctgactaataca

SEQ ID NO: 426023 - DNA, 16 bp, M. musculus
taagtttctgtttcca

SEQ ID NO: 426024 - DNA, 16 bp, M. musculus
taagtttgaggctagc

SEQ ID NO: 426025 - DNA, 16 bp, M. musculus
taagtttgcttctttt

SEQ ID NO: 426026 - DNA, 16 bp, M. musculus
taagtttgtgtgtgtg

SEQ ID NO: 426027 - DNA, 16 bp, M. musculus
taagttttccatttcc

SEQ ID NO: 426028 - DNA, 16 bp, M. musculus
taagtttttaaaatga

SEQ ID NO: 426029 - DNA, 16 bp, M. musculus
taataaaaatgaagac

SEQ ID NO: 426030 - DNA, 16 bp, M. musculus
taataaaactccaaag

SEQ ID NO: 426031 - DNA, 16 bp, M. musculus
taataaaagcaactta

SEQ ID NO: 426032 - DNA, 16 bp, M. musculus
taataaaatgcttatt

SEQ ID NO: 426033 - DNA, 16 bp, M. musculus
taataaaattgtcctc

SEQ ID NO: 426034 - DNA, 16 bp, M. musculus
taataaaattgtcctt

SEQ ID NO: 426035 - DNA, 16 bp, M. musculus
taataaagctcttaaa

SEQ ID NO: 426036 - DNA, 16 bp, M. musculus
taataaaggaaaacat

SEQ ID NO: 426037 - DNA, 16 bp, M. musculus
taataaagggaaaact

SEQ ID NO: 426038 - DNA, 16 bp, M. musculus
taataaagtgttcccg

SEQ ID NO: 426039 - DNA, 16 bp, M. musculus
taataaagtgttttca

SEQ ID NO: 426040 - DNA, 16 bp, M. musculus
taataaatatttgctg

SEQ ID NO: 426041 - DNA, 16 bp, M. musculus
taataactcacttaaa

SEQ ID NO: 426042 - DNA, 16 bp, M. musculus
taataagtggatatta

SEQ ID NO: 426043 - DNA, 16 bp, M. musculus
taataatgatgatgat

SEQ ID NO: 426044 - DNA, 16 bp, M. musculus
taataatgttttcttt

SEQ ID NO: 426045 - DNA, 16 bp, M. musculus
taataattttgttgaa

SEQ ID NO: 426046 - DNA, 16 bp, M. musculus
taatacaacaagaagc

SEQ ID NO: 426047 - DNA, 16 bp, M. musculus
taatagaaagcaaaca

SEQ ID NO: 426048 - DNA, 16 bp, M. musculus
taatagaaagctaaca

SEQ ID NO: 426049 - DNA, 16 bp, M. musculus
taatagaaggaaaatt

SEQ ID NO: 426050 - DNA, 16 bp, M. musculus
taatagaatgccaaca

SEQ ID NO: 426051 - DNA, 16 bp, M. musculus
taatagatagatagat

SEQ ID NO: 426052 - DNA, 16 bp, M. musculus
taatagatatggatct

SEQ ID NO: 426053 - DNA, 16 bp, M. musculus
taatagcagcagcagc

SEQ ID NO: 426054 - DNA, 20 bp, M. musculus
taatagccagaaactggaaa

SEQ ID NO: 426055 - DNA, 16 bp, M. musculus
taatagctttttaaaa

SEQ ID NO: 426056 - DNA, 16 bp, M. musculus
taataggaaaagcata

SEQ ID NO: 426057 - DNA, 16 bp, M. musculus
taatagttgtgctcaa

SEQ ID NO: 426058 - DNA, 16 bp, M. musculus
taatataaaattcctt

SEQ ID NO: 426059 - DNA, 16 bp, M. musculus
taatataaatgtgtgt

SEQ ID NO: 426060 - DNA, 16 bp, M. musculus
taatatatgtgtaata

SEQ ID NO: 426061 - DNA, 16 bp, M. musculus
taatatccaatatata

SEQ ID NO: 426062 - DNA, 20 bp, M. musculus
taatatccacttatcagtga

SEQ ID NO: 426063 - DNA, 16 bp, M. musculus
taatatccacttatta

SEQ ID NO: 426064 - DNA, 16 bp, M. musculus
taatatccatttatta

SEQ ID NO: 426065 - DNA, 16 bp, M. musculus
taatatcctccagata

SEQ ID NO: 426066 - DNA, 16 bp, M. musculus
taatatcctggccttt

SEQ ID NO: 426067 - DNA, 16 bp, M. musculus
taatatggaagtgtaa

SEQ ID NO: 426068 - DNA, 16 bp, M. musculus
taatatggtaaaaatg

SEQ ID NO: 426069 - DNA, 16 bp, M. musculus
taatatgtatagatga

SEQ ID NO: 426070 - DNA, 16 bp, M. musculus
taatatgtgtatgtgt

SEQ ID NO: 426071 - DNA, 16 bp, M. musculus
taatatgtgtgtgtgt

SEQ ID NO: 426072 - DNA, 16 bp, M. musculus
taatattcatttatca

SEQ ID NO: 426073 - DNA, 16 bp, M. musculus
taatattctatcctta

SEQ ID NO: 426074 - DNA, 16 bp, M. musculus
taatattctttctctg

SEQ ID NO: 426075 - DNA, 16 bp, M. musculus
taatattgattgtcaa

SEQ ID NO: 426076 - DNA, 16 bp, M. musculus
taatattgtgaaaatg

SEQ ID NO: 426077 - DNA, 16 bp, M. musculus
taatatttccaatctt

SEQ ID NO: 426078 - DNA, 16 bp, M. musculus
taatattttaatgtca

SEQ ID NO: 426079 - DNA, 16 bp, M. musculus
taatcaaaatgcagag

SEQ ID NO: 426080 - DNA, 19 bp, M. musculus
taatcaaagaattgctcaa

SEQ ID NO: 426081 - DNA, 16 bp, M. musculus
taatcaaagcagtata

SEQ ID NO: 426082 - DNA, 16 bp, M. musculus
taatcaagaaaatgta

SEQ ID NO: 426083 - DNA, 16 bp, M. musculus
taatcacaattgcaga

SEQ ID NO: 426084 - DNA, 16 bp, M. musculus
taatcacagcacttag

SEQ ID NO: 426085 - DNA, 16 bp, M. musculus
taatcacagcatttgg

SEQ ID NO: 426086 - DNA, 16 bp, M. musculus
taatcaccatgcctga

SEQ ID NO: 426087 - DNA, 16 bp, M. musculus
taatcagaatatatta

SEQ ID NO: 426088 - DNA, 16 bp, M. musculus
taatcagcaggaaata

SEQ ID NO: 426089 - DNA, 16 bp, M. musculus
taatcagtctccaaat

SEQ ID NO: 426090 - DNA, 17 bp, M. musculus
taatcatttagcaaaaa

SEQ ID NO: 426091 - DNA, 16 bp, M. musculus
taatccaaccattttg

SEQ ID NO: 426092 - DNA, 16 bp, M. musculus
taatccacacaaagac

SEQ ID NO: 426093 - DNA, 16 bp, M. musculus
taatccatcatgacca

SEQ ID NO: 426094 - DNA, 16 bp, M. musculus
taatcccaacactggg

SEQ ID NO: 426095 - DNA, 16 bp, M. musculus
taatcccagcacctag

SEQ ID NO: 426096 - DNA, 16 bp, M. musculus
taatcccagcattcag

SEQ ID NO: 426097 - DNA, 16 bp, M. musculus
taatcccagcattggg

SEQ ID NO: 426098 - DNA, 16 bp, M. musculus
taatcccagcatttga

SEQ ID NO: 426099 - DNA, 16 bp, M. musculus
taatcccaggacttgg

SEQ ID NO: 426100 - DNA, 16 bp, M. musculus
taatcccagtactagg

SEQ ID NO: 426101 - DNA, 16 bp, M. musculus
taatcccagtgctgtg

SEQ ID NO: 426102 - DNA, 16 bp, M. musculus
taatcccggcactcag

SEQ ID NO: 426103 - DNA, 16 bp, M. musculus
taatccctgcactcag

SEQ ID NO: 426104 - DNA, 16 bp, M. musculus
taatcctagtatttgg

SEQ ID NO: 426105 - DNA, 16 bp, M. musculus
taatcctatcactcag

SEQ ID NO: 426106 - DNA, 16 bp, M. musculus
taatcctcaagagact

SEQ ID NO: 426107 - DNA, 16 bp, M. musculus
taatcctgcagagatt

SEQ ID NO: 426108 - DNA, 16 bp, M. musculus
taatcctggctatcct

SEQ ID NO: 426109 - DNA, 16 bp, M. musculus
taatccttctcaaaca

SEQ ID NO: 426110 - DNA, 16 bp, M. musculus
taatcctttcaaacag

SEQ ID NO: 426111 - DNA, 16 bp, M. musculus
taatctagagatgatt

SEQ ID NO: 426112 - DNA, 16 bp, M. musculus
taatctatatatctat

SEQ ID NO: 426113 - DNA, 16 bp, M. musculus
taatctcaacactcaa

SEQ ID NO: 426114 - DNA, 16 bp, M. musculus
taatctcacataaatt

SEQ ID NO: 426115 - DNA, 16 bp, M. musculus
taatctcagaaaataa

SEQ ID NO: 426116 - DNA, 16 bp, M. musculus
taatctcagcactaga

SEQ ID NO: 426117 - DNA, 16 bp, M. musculus
taatctcagcacttgg

SEQ ID NO: 426118 - DNA, 17 bp, M. musculus
taatctccttagtggca

SEQ ID NO: 426119 - DNA, 16 bp, M. musculus
taatcttctggaatcc

SEQ ID NO: 426120 - DNA, 16 bp, M. musculus
taatcttgtctccaaa

SEQ ID NO: 426121 - DNA, 16 bp, M. musculus
taatgaaaatgaagct

SEQ ID NO: 426122 - DNA, 16 bp, M. musculus
taatgaaacaaatgga

SEQ ID NO: 426123 - DNA, 16 bp, M. musculus
taatgaaaccctgtct

SEQ ID NO: 426124 - DNA, 16 bp, M. musculus
taatgaaactttaaaa

SEQ ID NO: 426125 - DNA, 16 bp, M. musculus
taatgaaagacagaaa

SEQ ID NO: 426126 - DNA, 16 bp, M. musculus
taatgaaagagatgcc

SEQ ID NO: 426127 - DNA, 16 bp, M. musculus
taatgaagtcattgtt

SEQ ID NO: 426128 - DNA, 16 bp, M. musculus
taatgaatgtggatgc

SEQ ID NO: 426129 - DNA, 16 bp, M. musculus
taatgacatgcatgta

SEQ ID NO: 426130 - DNA, 16 bp, M. musculus
taatgactttcctctt

SEQ ID NO: 426131 - DNA, 16 bp, M. musculus
taatgagaaagattaa

SEQ ID NO: 426132 - DNA, 16 bp, M. musculus
taatgagactgtctca

SEQ ID NO: 426133 - DNA, 16 bp, M. musculus
taatgagatatgatgc

SEQ ID NO: 426134 - DNA, 16 bp, M. musculus
taatgagatcctgtct

SEQ ID NO: 426135 - DNA, 16 bp, M. musculus
taatgagatcggatgc

SEQ ID NO: 426136 - DNA, 16 bp, M. musculus
taatgaggtgatcatg

SEQ ID NO: 426137 - DNA, 18 bp, M. musculus
taatgagtctagctaagg

SEQ ID NO: 426138 - DNA, 16 bp, M. musculus
taatgataaaaccttt

SEQ ID NO: 426139 - DNA, 16 bp, M. musculus
taatgataatgataat

SEQ ID NO: 426140 - DNA, 16 bp, M. musculus
taatgatgatgatgtt

SEQ ID NO: 426141 - DNA, 16 bp, M. musculus
taatgatgatggtgat

SEQ ID NO: 426142 - DNA, 16 bp, M. musculus
taatgatgttttaaaa

SEQ ID NO: 426143 - DNA, 16 bp, M. musculus
taatgattatcaattt

SEQ ID NO: 426144 - DNA, 16 bp, M. musculus
taatgattctttaaat

SEQ ID NO: 426145 - DNA, 16 bp, M. musculus
taatgcagtctcaggt

SEQ ID NO: 426146 - DNA, 16 bp, M. musculus
taatgcatttgatgtt

SEQ ID NO: 426147 - DNA, 16 bp, M. musculus
taatgccaagaagtgc

SEQ ID NO: 426148 - DNA, 16 bp, M. musculus
taatgccagttccagg

SEQ ID NO: 426149 - DNA, 16 bp, M. musculus
taatgccttggccctg

SEQ ID NO: 426150 - DNA, 16 bp, M. musculus
taatgctagcacttgg

SEQ ID NO: 426151 - DNA, 16 bp, M. musculus
taatgctatgagcctt

SEQ ID NO: 426152 - DNA, 16 bp, M. musculus
taatgctgccaatcca

SEQ ID NO: 426153 - DNA, 16 bp, M. musculus
taatgctgcttatatt

SEQ ID NO: 426154 - DNA, 16 bp, M. musculus
taatgctggttagctg

SEQ ID NO: 426155 - DNA, 16 bp, M. musculus
taatgctgtggccctt

SEQ ID NO: 426156 - DNA, 16 bp, M. musculus
taatgctttcaagaga

SEQ ID NO: 426157 - DNA, 16 bp, M. musculus
taatggaagagaaagc

SEQ ID NO: 426158 - DNA, 16 bp, M. musculus
taatggaatgaacctc

SEQ ID NO: 426159 - DNA, 16 bp, M. musculus
taatggaatgattaat

SEQ ID NO: 426160 - DNA, 16 bp, M. musculus
taatggagtactattc

SEQ ID NO: 426161 - DNA, 16 bp, M. musculus
taatggatggctgtga

SEQ ID NO: 426162 - DNA, 16 bp, M. musculus
taatgggatctgatga

SEQ ID NO: 426163 - DNA, 16 bp, M. musculus
taatggtcaagaagca

SEQ ID NO: 426164 - DNA, 16 bp, M. musculus
taatgtaaatgaggaa

SEQ ID NO: 426165 - DNA, 16 bp, M. musculus
taatgtacagtcctaa

SEQ ID NO: 426166 - DNA, 16 bp, M. musculus
taatgtactgtaagat

SEQ ID NO: 426167 - DNA, 16 bp, M. musculus
taatgtataatatgta

SEQ ID NO: 426168 - DNA, 16 bp, M. musculus
taatgtatgctctctc

SEQ ID NO: 426169 - DNA, 16 bp, M. musculus
taatgtatttccaata

SEQ ID NO: 426170 - DNA, 16 bp, M. musculus
taatgtatttttctat

SEQ ID NO: 426171 - DNA, 16 bp, M. musculus
taatgtcagcactcag

SEQ ID NO: 426172 - DNA, 16 bp, M. musculus
taatgtcaggaattgg

SEQ ID NO: 426173 - DNA, 16 bp, M. musculus
taatgtccctgtgccc

SEQ ID NO: 426174 - DNA, 16 bp, M. musculus
taatgtctggctgtga

SEQ ID NO: 426175 - DNA, 16 bp, M. musculus
taatgtgattttaaaa

SEQ ID NO: 426176 - DNA, 16 bp, M. musculus
taatgtgctcttggat

SEQ ID NO: 426177 - DNA, 16 bp, M. musculus
taatgtgggtgctggg

SEQ ID NO: 426178 - DNA, 16 bp, M. musculus
taatgtgtatatatgt

SEQ ID NO: 426179 - DNA, 16 bp, M. musculus
taatgtgtttttaaaa

SEQ ID NO: 426180 - DNA, 16 bp, M. musculus
taatgtttctaatatt

SEQ ID NO: 426181 - DNA, 16 bp, M. musculus
taatgttttattaaag

SEQ ID NO: 426182 - DNA, 16 bp, M. musculus
taattaaaataactga

SEQ ID NO: 426183 - DNA, 16 bp, M. musculus
taattaaaatatctga

SEQ ID NO: 426184 - DNA, 16 bp, M. musculus
taattaaagaagagat

SEQ ID NO: 426185 - DNA, 16 bp, M. musculus
taattaagaaaatacc

SEQ ID NO: 426186 - DNA, 16 bp, M. musculus
taattaataaaatgtc

SEQ ID NO: 426187 - DNA, 16 bp, M. musculus
taattaattcacttta

SEQ ID NO: 426188 - DNA, 16 bp, M. musculus
taattacaatatttct

SEQ ID NO: 426189 - DNA, 16 bp, M. musculus
taattacatcattccc

SEQ ID NO: 426190 - DNA, 34 bp, M. musculus
taattacatggagatcagtcaacaaaattgtaaa

SEQ ID NO: 426191 - DNA, 16 bp, M. musculus
taattacatttcaaat

SEQ ID NO: 426192 - DNA, 16 bp, M. musculus
taattagcaggaagta

SEQ ID NO: 426193 - DNA, 16 bp, M. musculus
taattagcctctccct

SEQ ID NO: 426194 - DNA, 16 bp, M. musculus
taattaggatgttgtc

SEQ ID NO: 426195 - DNA, 16 bp, M. musculus
taattagtactgaata

SEQ ID NO: 426196 - DNA, 16 bp, M. musculus
taattatattgtaatc

SEQ ID NO: 426197 - DNA, 16 bp, M. musculus
taattatcagggaaat

SEQ ID NO: 426198 - DNA, 16 bp, M. musculus
taattcacaaaatcag

SEQ ID NO: 426199 - DNA, 16 bp, M. musculus
taattcagacattttg

SEQ ID NO: 426200 - DNA, 16 bp, M. musculus
taattcagctttttac

SEQ ID NO: 426201 - DNA, 17 bp, M. musculus
taattcattaagaaaat

SEQ ID NO: 426202 - DNA, 16 bp, M. musculus
taattccaacattcag

SEQ ID NO: 426203 - DNA, 16 bp, M. musculus
taattccaactctact

SEQ ID NO: 426204 - DNA, 16 bp, M. musculus
taattccagcactcaa

SEQ ID NO: 426205 - DNA, 16 bp, M. musculus
taattccagcactcac

SEQ ID NO: 426206 - DNA, 16 bp, M. musculus
taattccagcacttgg

SEQ ID NO: 426207 - DNA, 16 bp, M. musculus
taattccagcagtcag

SEQ ID NO: 426208 - DNA, 16 bp, M. musculus
taattccagctccaag

SEQ ID NO: 426209 - DNA, 16 bp, M. musculus
taattccaggagatgg

SEQ ID NO: 426210 - DNA, 16 bp, M. musculus
taattccagtcccaga

SEQ ID NO: 426211 - DNA, 16 bp, M. musculus
taattccagtcccagg

SEQ ID NO: 426212 - DNA, 16 bp, M. musculus
taattccagttccagg

SEQ ID NO: 426213 - DNA, 16 bp, M. musculus
taattccagtttcaga

SEQ ID NO: 426214 - DNA, 16 bp, M. musculus
taattcctctacatcc

SEQ ID NO: 426215 - DNA, 16 bp, M. musculus
taattcctttaaaaaa

SEQ ID NO: 426216 - DNA, 16 bp, M. musculus
taattctaaaaagtct

SEQ ID NO: 426217 - DNA, 16 bp, M. musculus
taattctagcccttgg

SEQ ID NO: 426218 - DNA, 16 bp, M. musculus
taattctagtcccagg

SEQ ID NO: 426219 - DNA, 16 bp, M. musculus
taattctagttctagg

SEQ ID NO: 426220 - DNA, 16 bp, M. musculus
taattctgatgattct

SEQ ID NO: 426221 - DNA, 16 bp, M. musculus
taattctgctactgtt

SEQ ID NO: 426222 - DNA, 16 bp, M. musculus
taattctggcacttgg

SEQ ID NO: 426223 - DNA, 16 bp, M. musculus
taattctgtgaagaat

SEQ ID NO: 426224 - DNA, 16 bp, M. musculus
taattctttaagaatt

SEQ ID NO: 426225 - DNA, 16 bp, M. musculus
taattctttgtctagg

SEQ ID NO: 426226 - DNA, 16 bp, M. musculus
taattgaaatgtaaat

SEQ ID NO: 426227 - DNA, 16 bp, M. musculus
taattgaactttttat

SEQ ID NO: 426228 - DNA, 16 bp, M. musculus
taattgaagagaaagt

SEQ ID NO: 426229 - DNA, 17 bp, M. musculus
taattgagagtttggct

SEQ ID NO: 426230 - DNA, 16 bp, M. musculus
taattgatgcttttgt

SEQ ID NO: 426231 - DNA, 16 bp, M. musculus
taattgcacttttaat

SEQ ID NO: 426232 - DNA, 16 bp, M. musculus
taattgcttatttatt

SEQ ID NO: 426233 - DNA, 16 bp, M. musculus
taattgctttttaaaa

SEQ ID NO: 426234 - DNA, 17 bp, M. musculus
taattggacatatcaaa

SEQ ID NO: 426235 - DNA, 16 bp, M. musculus
taattgttttccttta

SEQ ID NO: 426236 - DNA, 16 bp, M. musculus
taatttatttcttcag

SEQ ID NO: 426237 - DNA, 16 bp, M. musculus
taatttcagcacttgg

SEQ ID NO: 426238 - DNA, 17 bp, M. musculus
taatttctacacattgg

SEQ ID NO: 426239 - DNA, 16 bp, M. musculus
taatttctttagttct

SEQ ID NO: 426240 - DNA, 16 bp, M. musculus
taatttctttcagaga

SEQ ID NO: 426241 - DNA, 24 bp, M. musculus
taatttctttctcagcctgtttat

SEQ ID NO: 426242 - DNA, 16 bp, M. musculus
taatttgagttctttt

SEQ ID NO: 426243 - DNA, 16 bp, M. musculus
taatttgatttcattt

SEQ ID NO: 426244 - DNA, 16 bp, M. musculus
taatttgcatttcttt

SEQ ID NO: 426245 - DNA, 16 bp, M. musculus
taatttgtatattttc

SEQ ID NO: 426246 - DNA, 16 bp, M. musculus
taatttgtgaaacaca

SEQ ID NO: 426247 - DNA, 16 bp, M. musculus
taatttgtttaaaact

SEQ ID NO: 426248 - DNA, 16 bp, M. musculus
taattttaaaaaagca

SEQ ID NO: 426249 - DNA, 16 bp, M. musculus
taattttaaaaagtca

SEQ ID NO: 426250 - DNA, 16 bp, M. musculus
taattttaattgagaa

SEQ ID NO: 426251 - DNA, 16 bp, M. musculus
taattttactactgtt

SEQ ID NO: 426252 - DNA, 16 bp, M. musculus
taattttagtggaatt

SEQ ID NO: 426253 - DNA, 16 bp, M. musculus
taattttattttcagt

SEQ ID NO: 426254 - DNA, 16 bp, M. musculus
taattttcaaatgaaa

SEQ ID NO: 426255 - DNA, 16 bp, M. musculus
taattttcttaaagaa

SEQ ID NO: 426256 - DNA, 16 bp, M. musculus
taattttcttgaagat

SEQ ID NO: 426257 - DNA, 16 bp, M. musculus
taattttgatactgtt

SEQ ID NO: 426258 - DNA, 16 bp, M. musculus
taattttgctactctt

SEQ ID NO: 426259 - DNA, 16 bp, M. musculus
taattttgctactgct

SEQ ID NO: 426260 - DNA, 16 bp, M. musculus
taattttgctactgtt

SEQ ID NO: 426261 - DNA, 16 bp, M. musculus
taattttgctactttt

SEQ ID NO: 426262 - DNA, 16 bp, M. musculus
taattttgcttttaaa

SEQ ID NO: 426263 - DNA, 16 bp, M. musculus
taattttgtattcagc

SEQ ID NO: 426264 - DNA, 16 bp, M. musculus
taattttgttactctt

SEQ ID NO: 426265 - DNA, 16 bp, M. musculus
taatttttaaaagtca

SEQ ID NO: 426266 - DNA, 16 bp, M. musculus
taatttttatgttcat

SEQ ID NO: 426267 - DNA, 16 bp, M. musculus
taatttttgtctttga

SEQ ID NO: 426268 - DNA, 16 bp, M. musculus
taatttttttctaaga

SEQ ID NO: 426269 - DNA, 16 bp, M. musculus
taatttttttgagaca

SEQ ID NO: 426270 - DNA, 16 bp, M. musculus
taattttttttcagaa

SEQ ID NO: 426271 - DNA, 16 bp, M. musculus
tacaaaaaaaaatgtg

SEQ ID NO: 426272 - DNA, 16 bp, M. musculus
tacaaaaaggccattg

SEQ ID NO: 426273 - DNA, 16 bp, M. musculus
tacaaaaatccatcaa

SEQ ID NO: 426274 - DNA, 16 bp, M. musculus
tacaaaacagaggaat

SEQ ID NO: 426275 - DNA, 16 bp, M. musculus
tacaaaatgtacagtt

SEQ ID NO: 426276 - DNA, 16 bp, M. musculus
tacaaacacaaagaca

SEQ ID NO: 426277 - DNA, 17 bp, M. musculus
tacaaacaccttggcca

SEQ ID NO: 426278 - DNA, 16 bp, M. musculus
tacaaacatgcatgca

SEQ ID NO: 426279 - DNA, 16 bp, M. musculus
tacaaaccaccacatt

SEQ ID NO: 426280 - DNA, 16 bp, M. musculus
tacaaaccactcttaa

SEQ ID NO: 426281 - DNA, 16 bp, M. musculus
tacaaagaaacacaca

SEQ ID NO: 426282 - DNA, 16 bp, M. musculus
tacaaagaacacaaga

SEQ ID NO: 426283 - DNA, 16 bp, M. musculus
tacaaagaacccaaga

SEQ ID NO: 426284 - DNA, 16 bp, M. musculus
tacaaagaactcaaaa

SEQ ID NO: 426285 - DNA, 16 bp, M. musculus
tacaaagaagatctaa

SEQ ID NO: 426286 - DNA, 16 bp, M. musculus
tacaaagaataaacag

SEQ ID NO: 426287 - DNA, 16 bp, M. musculus
tacaaagaatcaacaa

SEQ ID NO: 426288 - DNA, 16 bp, M. musculus
tacaaagaatcaagaa

SEQ ID NO: 426289 - DNA, 16 bp, M. musculus
tacaaagacaaaattt

SEQ ID NO: 426290 - DNA, 16 bp, M. musculus
tacaaagacaaagttt

SEQ ID NO: 426291 - DNA, 16 bp, M. musculus
tacaaagagaaactct

SEQ ID NO: 426292 - DNA, 16 bp, M. musculus
tacaaagagaaattta

SEQ ID NO: 426293 - DNA, 16 bp, M. musculus
tacaaagagagaccct

SEQ ID NO: 426294 - DNA, 16 bp, M. musculus
tacaaagagttccagg

SEQ ID NO: 426295 - DNA, 16 bp, M. musculus
tacaaagcaagttctg

SEQ ID NO: 426296 - DNA, 16 bp, M. musculus
tacaaagtgagacact

SEQ ID NO: 426297 - DNA, 16 bp, M. musculus
tacaaagtttacgtgt

SEQ ID NO: 426298 - DNA, 16 bp, M. musculus
tacaaagttttaaaat

SEQ ID NO: 426299 - DNA, 16 bp, M. musculus
tacaaatacatgcaca

SEQ ID NO: 426300 - DNA, 16 bp, M. musculus
tacaaatatatgtaca

SEQ ID NO: 426301 - DNA, 16 bp, M. musculus
tacaaatatgtatata

SEQ ID NO: 426302 - DNA, 16 bp, M. musculus
tacaaatcccagcaac

SEQ ID NO: 426303 - DNA, 16 bp, M. musculus
tacaaatgaaataaat

SEQ ID NO: 426304 - DNA, 16 bp, M. musculus
tacaaatgacaaatgg

SEQ ID NO: 426305 - DNA, 16 bp, M. musculus
tacaaatgcatacaca

SEQ ID NO: 426306 - DNA, 16 bp, M. musculus
tacaaatgcatatata

SEQ ID NO: 426307 - DNA, 16 bp, M. musculus
tacaaatggttgtgag

SEQ ID NO: 426308 - DNA, 16 bp, M. musculus
tacaaatgtgtagagg

SEQ ID NO: 426309 - DNA, 16 bp, M. musculus
tacaaattgagttcca

SEQ ID NO: 426310 - DNA, 16 bp, M. musculus
tacaaattgcttctga

SEQ ID NO: 426311 - DNA, 16 bp, M. musculus
tacaaattggaaagaa

SEQ ID NO: 426312 - DNA, 16 bp, M. musculus
tacaacaacaacagca

SEQ ID NO: 426313 - DNA, 16 bp, M. musculus
tacaacaacagcaaca

SEQ ID NO: 426314 - DNA, 16 bp, M. musculus
tacaacaagaacttca

SEQ ID NO: 426315 - DNA, 16 bp, M. musculus
tacaacatattttgat

SEQ ID NO: 426316 - DNA, 16 bp, M. musculus
tacaacatcccacaga

SEQ ID NO: 426317 - DNA, 16 bp, M. musculus
tacaacatttttaaaa

SEQ ID NO: 426318 - DNA, 19 bp, M. musculus
tacaaccactctggaaatc

SEQ ID NO: 426319 - DNA, 16 bp, M. musculus
tacaaccatttgccta

SEQ ID NO: 426320 - DNA, 51 bp, M. musculus
tacaaccctcaaggacagggtattgttgagcgtgcgcatcgcaccctcaaa

SEQ ID NO: 426321 - DNA, 18 bp, M. musculus
tacaaccttgcaatccca

SEQ ID NO: 426322 - DNA, 16 bp, M. musculus
tacaactggagttaca

SEQ ID NO: 426323 - DNA, 16 bp, M. musculus
tacaagaaaatcaaga

SEQ ID NO: 426324 - DNA, 16 bp, M. musculus
tacaagaaataacatt

SEQ ID NO: 426325 - DNA, 16 bp, M. musculus
tacaagaagaagaaga

SEQ ID NO: 426326 - DNA, 16 bp, M. musculus
tacaagaccatcctct

SEQ ID NO: 426327 - DNA, 16 bp, M. musculus
tacaagagactaaaat

SEQ ID NO: 426328 - DNA, 16 bp, M. musculus
tacaagcctatggggg

SEQ ID NO: 426329 - DNA, 16 bp, M. musculus
tacaagctgggcagtg

SEQ ID NO: 426330 - DNA, 16 bp, M. musculus
tacaagctgtcctctg

SEQ ID NO: 426331 - DNA, 21 bp, M. musculus
tacaaggagataggaatggat

SEQ ID NO: 426332 - DNA, 16 bp, M. musculus
tacaaggagatatgaa

SEQ ID NO: 426333 - DNA, 16 bp, M. musculus
tacaaggagcctacag

SEQ ID NO: 426334 - DNA, 16 bp, M. musculus
tacaaggagggaaatt

SEQ ID NO: 426335 - DNA, 16 bp, M. musculus
tacaaggccctgggtt

SEQ ID NO: 426336 - DNA, 16 bp, M. musculus
tacaagggctggagag

SEQ ID NO: 426337 - DNA, 21 bp, M. musculus
tacaaggggatcatgttctag

SEQ ID NO: 426338 - DNA, 41 bp, M. musculus
tacaagtagtaaagaaaaccaatagggtacaataagcactg

SEQ ID NO: 426339 - DNA, 16 bp, M. musculus
tacaagtggatcaaag

SEQ ID NO: 426340 - DNA, 16 bp, M. musculus
tacaagttgtcctttg

SEQ ID NO: 426341 - DNA, 16 bp, M. musculus
tacaagtttgaggcca

SEQ ID NO: 426342 - DNA, 16 bp, M. musculus
tacaataaaatgtttt

SEQ ID NO: 426343 - DNA, 16 bp, M. musculus
tacaataaactttctc

SEQ ID NO: 426344 - DNA, 16 bp, M. musculus
tacaataaataaatgt

SEQ ID NO: 426345 - DNA, 16 bp, M. musculus
tacaatatttttaaag

SEQ ID NO: 426346 - DNA, 16 bp, M. musculus
tacaatccacagacac

SEQ ID NO: 426347 - DNA, 16 bp, M. musculus
tacaatcccatcagca

SEQ ID NO: 426348 - DNA, 16 bp, M. musculus
tacaatctaatctagg

SEQ ID NO: 426349 - DNA, 16 bp, M. musculus
tacaatctttctgccc

SEQ ID NO: 426350 - DNA, 16 bp, M. musculus
tacaatgaaaacatta

SEQ ID NO: 426351 - DNA, 16 bp, M. musculus
tacaatgtaaataaat

SEQ ID NO: 426352 - DNA, 16 bp, M. musculus
tacaatgtattttgat

SEQ ID NO: 426353 - DNA, 16 bp, M. musculus
tacaatgtcttttttt

SEQ ID NO: 426354 - DNA, 16 bp, M. musculus
tacaatgttgaacagg

SEQ ID NO: 426355 - DNA, 16 bp, M. musculus
tacaatgttttgtttt

SEQ ID NO: 426356 - DNA, 16 bp, M. musculus
tacaattatatcatct

SEQ ID NO: 426357 - DNA, 16 bp, M. musculus
tacaattcaaagacca

SEQ ID NO: 426358 - DNA, 16 bp, M. musculus
tacaattgacctcttg

SEQ ID NO: 426359 - DNA, 16 bp, M. musculus
tacaatttgcaaaacg

SEQ ID NO: 426360 - DNA, 16 bp, M. musculus
tacaattttttaaaga

SEQ ID NO: 426361 - DNA, 16 bp, M. musculus
tacacaaacaagtatt

SEQ ID NO: 426362 - DNA, 16 bp, M. musculus
tacacaaactttcata

SEQ ID NO: 426363 - DNA, 16 bp, M. musculus
tacacaaagaaaacct

SEQ ID NO: 426364 - DNA, 16 bp, M. musculus
tacacaaagaagaaat

SEQ ID NO: 426365 - DNA, 16 bp, M. musculus
tacacaatgaaaccct

SEQ ID NO: 426366 - DNA, 19 bp, M. musculus
tacacaatggagtactacc

SEQ ID NO: 426367 - DNA, 31 bp, M. musculus
tacacaatggagtactactcagctattaaaa

SEQ ID NO: 426368 - DNA, 16 bp, M. musculus
tacacacaatacacac

SEQ ID NO: 426369 - DNA, 16 bp, M. musculus
tacacacacacacact

SEQ ID NO: 426370 - DNA, 16 bp, M. musculus
tacacacacacataca

SEQ ID NO: 426371 - DNA, 16 bp, M. musculus
tacacacacacatatg

SEQ ID NO: 426372 - DNA, 16 bp, M. musculus
tacacacacactcaca

SEQ ID NO: 426373 - DNA, 16 bp, M. musculus
tacacacacagacaca

SEQ ID NO: 426374 - DNA, 16 bp, M. musculus
tacacacacagagaga

SEQ ID NO: 426375 - DNA, 16 bp, M. musculus
tacacacacatacaca

SEQ ID NO: 426376 - DNA, 17 bp, M. musculus
tacacacacatatatac

SEQ ID NO: 426377 - DNA, 16 bp, M. musculus
tacacacacatgcatg

SEQ ID NO: 426378 - DNA, 16 bp, M. musculus
tacacacaccatttct

SEQ ID NO: 426379 - DNA, 16 bp, M. musculus
tacacacacgcacaca

SEQ ID NO: 426380 - DNA, 16 bp, M. musculus
tacacacactcaaaca

SEQ ID NO: 426381 - DNA, 16 bp, M. musculus
tacacacactcacaga

SEQ ID NO: 426382 - DNA, 16 bp, M. musculus
tacacacagaaactct

SEQ ID NO: 426383 - DNA, 16 bp, M. musculus
tacacacagacacaca

SEQ ID NO: 426384 - DNA, 16 bp, M. musculus
tacacacagagaaaaa

SEQ ID NO: 426385 - DNA, 16 bp, M. musculus
tacacacataattaaa

SEQ ID NO: 426386 - DNA, 16 bp, M. musculus
tacacacatacacaca

SEQ ID NO: 426387 - DNA, 16 bp, M. musculus
tacacacatacacata

SEQ ID NO: 426388 - DNA, 17 bp, M. musculus
tacacacatacatacac

SEQ ID NO: 426389 - DNA, 16 bp, M. musculus
tacacacatgcacaca

SEQ ID NO: 426390 - DNA, 16 bp, M. musculus
tacacacccactcaca

SEQ ID NO: 426391 - DNA, 16 bp, M. musculus
tacacactacacacac

SEQ ID NO: 426392 - DNA, 16 bp, M. musculus
tacacactggagaaaa

SEQ ID NO: 426393 - DNA, 16 bp, M. musculus
tacacactgtgtgtgt

SEQ ID NO: 426394 - DNA, 16 bp, M. musculus
tacacagaaaaaccct

SEQ ID NO: 426395 - DNA, 16 bp, M. musculus
tacacagaaaataaat

SEQ ID NO: 426396 - DNA, 16 bp, M. musculus
tacacagaaacacaga

SEQ ID NO: 426397 - DNA, 16 bp, M. musculus
tacacagaaacacata

SEQ ID NO: 426398 - DNA, 16 bp, M. musculus
tacacagaaataaata

SEQ ID NO: 426399 - DNA, 16 bp, M. musculus
tacacagaaatttacc

SEQ ID NO: 426400 - DNA, 16 bp, M. musculus
tacacagaactcaaaa

SEQ ID NO: 426401 - DNA, 16 bp, M. musculus
tacacagacacacaca

SEQ ID NO: 426402 - DNA, 16 bp, M. musculus
tacacagacatacaag

SEQ ID NO: 426403 - DNA, 16 bp, M. musculus
tacacagaccctaaga

SEQ ID NO: 426404 - DNA, 16 bp, M. musculus
tacacagagaaacaca

SEQ ID NO: 426405 - DNA, 16 bp, M. musculus
tacacagagaaacact

SEQ ID NO: 426406 - DNA, 16 bp, M. musculus
tacacagagaaaccaa

SEQ ID NO: 426407 - DNA, 16 bp, M. musculus
tacacagagaaaccca

SEQ ID NO: 426408 - DNA, 16 bp, M. musculus
tacacagagaaacccc

SEQ ID NO: 426409 - DNA, 16 bp, M. musculus
tacacagagaatccct

SEQ ID NO: 426410 - DNA, 16 bp, M. musculus
tacacagagagaaacc

SEQ ID NO: 426411 - DNA, 16 bp, M. musculus
tacacagagagttcaa

SEQ ID NO: 426412 - DNA, 16 bp, M. musculus
tacacagatatacatg

SEQ ID NO: 426413 - DNA, 16 bp, M. musculus
tacacagcaagtttca

SEQ ID NO: 426414 - DNA, 16 bp, M. musculus
tacacagcacagcaca

SEQ ID NO: 426415 - DNA, 16 bp, M. musculus
tacacagccctggctg

SEQ ID NO: 426416 - DNA, 16 bp, M. musculus
tacacagcctgttctt

SEQ ID NO: 426417 - DNA, 16 bp, M. musculus
tacacaggaacacagt

SEQ ID NO: 426418 - DNA, 16 bp, M. musculus
tacacaggaatacaca

SEQ ID NO: 426419 - DNA, 16 bp, M. musculus
tacacagtaagaccct

SEQ ID NO: 426420 - DNA, 16 bp, M. musculus
tacacagtcaccaaac

SEQ ID NO: 426421 - DNA, 16 bp, M. musculus
tacacagtgaattcca

SEQ ID NO: 426422 - DNA, 16 bp, M. musculus
tacacagtgagactct

SEQ ID NO: 426423 - DNA, 16 bp, M. musculus
tacacagtgagactgt

SEQ ID NO: 426424 - DNA, 16 bp, M. musculus
tacacagtgaggccct

SEQ ID NO: 426425 - DNA, 16 bp, M. musculus
tacacagtgagttcaa

SEQ ID NO: 426426 - DNA, 16 bp, M. musculus
tacacagtgggaccct

SEQ ID NO: 426427 - DNA, 16 bp, M. musculus
tacacagttgtgagct

SEQ ID NO: 426428 - DNA, 16 bp, M. musculus
tacacataataggagt

SEQ ID NO: 426429 - DNA, 16 bp, M. musculus
tacacatacaaacatg

SEQ ID NO: 426430 - DNA, 16 bp, M. musculus
tacacatacacaagca

SEQ ID NO: 426431 - DNA, 16 bp, M. musculus
tacacatacacccaca

SEQ ID NO: 426432 - DNA, 16 bp, M. musculus
tacacatacagacaca

SEQ ID NO: 426433 - DNA, 17 bp, M. musculus
tacacatacatacacat

SEQ ID NO: 426434 - DNA, 16 bp, M. musculus
tacacatacattaaaa

SEQ ID NO: 426435 - DNA, 16 bp, M. musculus
tacacatatacataca

SEQ ID NO: 426436 - DNA, 16 bp, M. musculus
tacacatatattcatt

SEQ ID NO: 426437 - DNA, 16 bp, M. musculus
tacacatatgcacaca

SEQ ID NO: 426438 - DNA, 16 bp, M. musculus
tacacatatgtaacaa

SEQ ID NO: 426439 - DNA, 16 bp, M. musculus
tacacatccatccatc

SEQ ID NO: 426440 - DNA, 16 bp, M. musculus
tacacatgcaagcaaa

SEQ ID NO: 426441 - DNA, 16 bp, M. musculus
tacacatgcacataca

SEQ ID NO: 426442 - DNA, 16 bp, M. musculus
tacacatgcagacaca

SEQ ID NO: 426443 - DNA, 16 bp, M. musculus
tacacatgcaggcaaa

SEQ ID NO: 426444 - DNA, 16 bp, M. musculus
tacacatgcatgcaca

SEQ ID NO: 426445 - DNA, 16 bp, M. musculus
tacacatggaaggacc

SEQ ID NO: 426446 - DNA, 16 bp, M. musculus
tacacatggagggacc

SEQ ID NO: 426447 - DNA, 16 bp, M. musculus
tacacatggtgcacag

SEQ ID NO: 426448 - DNA, 16 bp, M. musculus
tacacatgtacatatg

SEQ ID NO: 426449 - DNA, 16 bp, M. musculus
tacacatgtgtatgca

SEQ ID NO: 426450 - DNA, 16 bp, M. musculus
tacacatgtgtatgtg

SEQ ID NO: 426451 - DNA, 16 bp, M. musculus
tacacatgtgtgtgtg

SEQ ID NO: 426452 - DNA, 16 bp, M. musculus
tacacattatatatat

SEQ ID NO: 426453 - DNA, 16 bp, M. musculus
tacacattggagtact

SEQ ID NO: 426454 - DNA, 16 bp, M. musculus
tacacatttaaaattt

SEQ ID NO: 426455 - DNA, 16 bp, M. musculus
tacacatttttttaaa

SEQ ID NO: 426456 - DNA, 16 bp, M. musculus
tacaccacaagccatt

SEQ ID NO: 426457 - DNA, 16 bp, M. musculus
tacaccaccacacctg

SEQ ID NO: 426458 - DNA, 16 bp, M. musculus
tacaccaccacatctg

SEQ ID NO: 426459 - DNA, 16 bp, M. musculus
tacaccaccatgcctg

SEQ ID NO: 426460 - DNA, 16 bp, M. musculus
tacaccactgaagaaa

SEQ ID NO: 426461 - DNA, 16 bp, M. musculus
tacaccactggggagg

SEQ ID NO: 426462 - DNA, 16 bp, M. musculus
tacaccagagcaggtg

SEQ ID NO: 426463 - DNA, 16 bp, M. musculus
tacaccaggctggcct

SEQ ID NO: 426464 - DNA, 16 bp, M. musculus
tacacccatatacagg

SEQ ID NO: 426465 - DNA, 16 bp, M. musculus
tacacctataatccca

SEQ ID NO: 426466 - DNA, 16 bp, M. musculus
tacacctgagtggcag

SEQ ID NO: 426467 - DNA, 16 bp, M. musculus
tacacctggacccctt

SEQ ID NO: 426468 - DNA, 16 bp, M. musculus
tacacctgtaatccca

SEQ ID NO: 426469 - DNA, 16 bp, M. musculus
tacaccttccctgaaa

SEQ ID NO: 426470 - DNA, 16 bp, M. musculus
tacacctttaattcta

SEQ ID NO: 426471 - DNA, 16 bp, M. musculus
tacacgcacacatgca

SEQ ID NO: 426472 - DNA, 16 bp, M. musculus
tacacgcacgcacgca

SEQ ID NO: 426473 - DNA, 16 bp, M. musculus
tacacgtggaagctga

SEQ ID NO: 426474 - DNA, 16 bp, M. musculus
tacacgtgtgtgtgtg

SEQ ID NO: 426475 - DNA, 17 bp, M. musculus
tacactaacaaggattt

SEQ ID NO: 426476 - DNA, 16 bp, M. musculus
tacactcacaaacaca

SEQ ID NO: 426477 - DNA, 16 bp, M. musculus
tacactcacacacaca

SEQ ID NO: 426478 - DNA, 16 bp, M. musculus
tacactcaggaggcag

SEQ ID NO: 426479 - DNA, 16 bp, M. musculus
tacactcaggctgagg

SEQ ID NO: 426480 - DNA, 16 bp, M. musculus
tacactctggaaatca

SEQ ID NO: 426481 - DNA, 16 bp, M. musculus
tacactgaggcattga

SEQ ID NO: 426482 - DNA, 16 bp, M. musculus
tacactgcagctgtcc

SEQ ID NO: 426483 - DNA, 16 bp, M. musculus
tacactggggcataga

SEQ ID NO: 426484 - DNA, 16 bp, M. musculus
tacactgtaactgtct

SEQ ID NO: 426485 - DNA, 16 bp, M. musculus
tacactgtagctgtat

SEQ ID NO: 426486 - DNA, 21 bp, M. musculus
tacactgtagctgtcttcaga

SEQ ID NO: 426487 - DNA, 19 bp, M. musculus
tacactgtagctgtcttct

SEQ ID NO: 426488 - DNA, 18 bp, M. musculus
tacactgtagctgtcttt

SEQ ID NO: 426489 - DNA, 16 bp, M. musculus
tacactgtagctgttc

SEQ ID NO: 426490 - DNA, 21 bp, M. musculus
tacactgtagttgtcttcaga

SEQ ID NO: 426491 - DNA, 16 bp, M. musculus
tacactgtgggacaca

SEQ ID NO: 426492 - DNA, 16 bp, M. musculus
tacactgttaaaattg

SEQ ID NO: 426493 - DNA, 16 bp, M. musculus
tacactttgtgtgtgt

SEQ ID NO: 426494 - DNA, 16 bp, M. musculus
tacacttttaatctca

SEQ ID NO: 426495 - DNA, 16 bp, M. musculus
tacagaaaaccacaaa

SEQ ID NO: 426496 - DNA, 16 bp, M. musculus
tacagaaaacccacct

SEQ ID NO: 426497 - DNA, 16 bp, M. musculus
tacagaaaataaaagg

SEQ ID NO: 426498 - DNA, 16 bp, M. musculus
tacagaaaatgtgaca

SEQ ID NO: 426499 - DNA, 16 bp, M. musculus
tacagaaaatttaaaa

SEQ ID NO: 426500 - DNA, 16 bp, M. musculus
tacagaaagagttcca

SEQ ID NO: 426501 - DNA, 16 bp, M. musculus
tacagaaagcacccaa

SEQ ID NO: 426502 - DNA, 16 bp, M. musculus
tacagaaataaatgtt

SEQ ID NO: 426503 - DNA, 16 bp, M. musculus
tacagaaatccatcat

SEQ ID NO: 426504 - DNA, 16 bp, M. musculus
tacagaacaaaggaag

SEQ ID NO: 426505 - DNA, 16 bp, M. musculus
tacagaacactgctaa

SEQ ID NO: 426506 - DNA, 16 bp, M. musculus
tacagaacattttgtc

SEQ ID NO: 426507 - DNA, 16 bp, M. musculus
tacagaactaaactga

SEQ ID NO: 426508 - DNA, 16 bp, M. musculus
tacagaactccaaaga

SEQ ID NO: 426509 - DNA, 63 bp, M. musculus
tacagaactccaaatagactggaccagaaaagaaattcctcccgacacataataatcagaaca

SEQ ID NO: 426510 - DNA, 22 bp, M. musculus
tacagaagcgagaagcgagctg

SEQ ID NO: 426511 - DNA, 16 bp, M. musculus
tacagaagctttccaa

SEQ ID NO: 426512 - DNA, 16 bp, M. musculus
tacagaagctttttag

SEQ ID NO: 426513 - DNA, 16 bp, M. musculus
tacagaagttgctgtg

SEQ ID NO: 426514 - DNA, 16 bp, M. musculus
tacagaagtttcctct

SEQ ID NO: 426515 - DNA, 16 bp, M. musculus
tacagaagttttgcag

SEQ ID NO: 426516 - DNA, 16 bp, M. musculus
tacagaataaaaactc

SEQ ID NO: 426517 - DNA, 16 bp, M. musculus
tacagaatatccagga

SEQ ID NO: 426518 - DNA, 16 bp, M. musculus
tacagaatcaactaag

SEQ ID NO: 426519 - DNA, 16 bp, M. musculus
tacagaatgagaccct

SEQ ID NO: 426520 - DNA, 16 bp, M. musculus
tacagaatgagtttta

SEQ ID NO: 426521 - DNA, 16 bp, M. musculus
tacagaattttttaaa

SEQ ID NO: 426522 - DNA, 16 bp, M. musculus
tacagacaacaaaccc

SEQ ID NO: 426523 - DNA, 16 bp, M. musculus
tacagacacccacagt

SEQ ID NO: 426524 - DNA, 16 bp, M. musculus
tacagacactaacaga

SEQ ID NO: 426525 - DNA, 16 bp, M. musculus
tacagacatgtataca

SEQ ID NO: 426526 - DNA, 16 bp, M. musculus
tacagacctatcaaat

SEQ ID NO: 426527 - DNA, 16 bp, M. musculus
tacagactgagttcca

SEQ ID NO: 426528 - DNA, 16 bp, M. musculus
tacagagaaaccctct

SEQ ID NO: 426529 - DNA, 16 bp, M. musculus
tacagagaagccctgt

SEQ ID NO: 426530 - DNA, 17 bp, M. musculus
tacagagacaaaatctg

SEQ ID NO: 426531 - DNA, 16 bp, M. musculus
tacagagacaaagtgt

SEQ ID NO: 426532 - DNA, 16 bp, M. musculus
tacagagacacacaca

SEQ ID NO: 426533 - DNA, 16 bp, M. musculus
tacagagacagacata

SEQ ID NO: 426534 - DNA, 16 bp, M. musculus
tacagagacaggcaga

SEQ ID NO: 426535 - DNA, 16 bp, M. musculus
tacagagacaggttga

SEQ ID NO: 426536 - DNA, 16 bp, M. musculus
tacagagaccttgtct

SEQ ID NO: 426537 - DNA, 16 bp, M. musculus
tacagagagaattcca

SEQ ID NO: 426538 - DNA, 16 bp, M. musculus
tacagagagagagaga

SEQ ID NO: 426539 - DNA, 16 bp, M. musculus
tacagagagagagtag

SEQ ID NO: 426540 - DNA, 16 bp, M. musculus
tacagagagagtttca

SEQ ID NO: 426541 - DNA, 16 bp, M. musculus
tacagagatggctcag

SEQ ID NO: 426542 - DNA, 23 bp, M. musculus
tacagagcaagaaccaggatagc

SEQ ID NO: 426543 - DNA, 16 bp, M. musculus
tacagagctaaagaaa

SEQ ID NO: 426544 - DNA, 16 bp, M. musculus
tacagaggaggcagca

SEQ ID NO: 426545 - DNA, 16 bp, M. musculus
tacagaggccagctgt

SEQ ID NO: 426546 - DNA, 16 bp, M. musculus
tacagaggccatggag

SEQ ID NO: 426547 - DNA, 16 bp, M. musculus
tacagagggagttcca

SEQ ID NO: 426548 - DNA, 16 bp, M. musculus
tacagaggtcagaaaa

SEQ ID NO: 426549 - DNA, 18 bp, M. musculus
tacagagtgaattccagg

SEQ ID NO: 426550 - DNA, 16 bp, M. musculus
tacagagttcagaaga

SEQ ID NO: 426551 - DNA, 16 bp, M. musculus
tacagataagaaaaca

SEQ ID NO: 426552 - DNA, 16 bp, M. musculus
tacagatacttgtgag

SEQ ID NO: 426553 - DNA, 16 bp, M. musculus
tacagatagttgtgag

SEQ ID NO: 426554 - DNA, 16 bp, M. musculus
tacagatatttcattt

SEQ ID NO: 426555 - DNA, 16 bp, M. musculus
tacagatcttacactt

SEQ ID NO: 426556 - DNA, 16 bp, M. musculus
tacagatgaaatcatg

SEQ ID NO: 426557 - DNA, 16 bp, M. musculus
tacagatgaggaaact

SEQ ID NO: 426558 - DNA, 16 bp, M. musculus
tacagatgcacacatg

SEQ ID NO: 426559 - DNA, 16 bp, M. musculus
tacagatggctgtgag

SEQ ID NO: 426560 - DNA, 16 bp, M. musculus
tacagatggctgtggg

SEQ ID NO: 426561 - DNA, 16 bp, M. musculus
tacagatggttgtgag

SEQ ID NO: 426562 - DNA, 16 bp, M. musculus
tacagatgtggaaact

SEQ ID NO: 426563 - DNA, 16 bp, M. musculus
tacagatgtttgtgaa

SEQ ID NO: 426564 - DNA, 16 bp, M. musculus
tacagattggggaaaa

SEQ ID NO: 426565 - DNA, 16 bp, M. musculus
tacagatttctttcct

SEQ ID NO: 426566 - DNA, 16 bp, M. musculus
tacagattttatttat

SEQ ID NO: 426567 - DNA, 16 bp, M. musculus
tacagcaaatggagac

SEQ ID NO: 426568 - DNA, 16 bp, M. musculus
tacagcaagcactctt

SEQ ID NO: 426569 - DNA, 16 bp, M. musculus
tacagccaattactgg

SEQ ID NO: 426570 - DNA, 16 bp, M. musculus
tacagcctgattttat

SEQ ID NO: 426571 - DNA, 27 bp, M. musculus
tacagctacagtgtactcacatacata

SEQ ID NO: 426572 - DNA, 16 bp, M. musculus
tacagctatgctgggg

SEQ ID NO: 426573 - DNA, 16 bp, M. musculus
tacagctcatctctca

SEQ ID NO: 426574 - DNA, 16 bp, M. musculus
tacagctcctgcctcc

SEQ ID NO: 426575 - DNA, 16 bp, M. musculus
tacagctccttgggta

SEQ ID NO: 426576 - DNA, 27 bp, M. musculus
tacagctctcttccccagcagcttctt

SEQ ID NO: 426577 - DNA, 16 bp, M. musculus
tacagctgaggaatgt

SEQ ID NO: 426578 - DNA, 16 bp, M. musculus
tacagctgcagcacaa

SEQ ID NO: 426579 - DNA, 16 bp, M. musculus
tacagcttgaggtcag

SEQ ID NO: 426580 - DNA, 16 bp, M. musculus
tacagctttttaaaaa

SEQ ID NO: 426581 - DNA, 16 bp, M. musculus
tacaggaaaacacaat

SEQ ID NO: 426582 - DNA, 16 bp, M. musculus
tacaggaaaatacagt

SEQ ID NO: 426583 - DNA, 16 bp, M. musculus
tacaggaaatcacttg

SEQ ID NO: 426584 - DNA, 16 bp, M. musculus
tacaggaatgtgggtg

SEQ ID NO: 426585 - DNA, 16 bp, M. musculus
tacaggagaaaaattc

SEQ ID NO: 426586 - DNA, 16 bp, M. musculus
tacaggagaagctctc

SEQ ID NO: 426587 - DNA, 16 bp, M. musculus
tacaggagctggagag

SEQ ID NO: 426588 - DNA, 16 bp, M. musculus
tacaggaggacacagg

SEQ ID NO: 426589 - DNA, 16 bp, M. musculus
tacaggaggacactgc

SEQ ID NO: 426590 - DNA, 16 bp, M. musculus
tacaggaggtggcctc

SEQ ID NO: 426591 - DNA, 16 bp, M. musculus
tacaggcaaatatgca

SEQ ID NO: 426592 - DNA, 16 bp, M. musculus
tacaggcaaatgaatg

SEQ ID NO: 426593 - DNA, 16 bp, M. musculus
tacaggcagagctgag

SEQ ID NO: 426594 - DNA, 16 bp, M. musculus
tacaggcagttgtaag

SEQ ID NO: 426595 - DNA, 24 bp, M. musculus
tacaggcatctggagcctagagga

SEQ ID NO: 426596 - DNA, 16 bp, M. musculus
tacaggcttgctcctc

SEQ ID NO: 426597 - DNA, 16 bp, M. musculus
tacagggatgatagca

SEQ ID NO: 426598 - DNA, 16 bp, M. musculus
tacagggcaagttcca

SEQ ID NO: 426599 - DNA, 16 bp, M. musculus
tacaggggaaggacag

SEQ ID NO: 426600 - DNA, 16 bp, M. musculus
tacaggggaaggccag

SEQ ID NO: 426601 - DNA, 16 bp, M. musculus
tacagggtttctctgt

SEQ ID NO: 426602 - DNA, 16 bp, M. musculus
tacaggtacacacaca

SEQ ID NO: 426603 - DNA, 16 bp, M. musculus
tacaggtctgacagat

SEQ ID NO: 426604 - DNA, 16 bp, M. musculus
tacaggtgtgagccac

SEQ ID NO: 426605 - DNA, 16 bp, M. musculus
tacaggttctccctcc

SEQ ID NO: 426606 - DNA, 16 bp, M. musculus
tacaggttgggatgta

SEQ ID NO: 426607 - DNA, 16 bp, M. musculus
tacaggtttttaaaat

SEQ ID NO: 426608 - DNA, 16 bp, M. musculus
tacagtaaacccatct

SEQ ID NO: 426609 - DNA, 16 bp, M. musculus
tacagtacttgaagtt

SEQ ID NO: 426610 - DNA, 16 bp, M. musculus
tacagtagaggatttc

SEQ ID NO: 426611 - DNA, 16 bp, M. musculus
tacagtagcaaaatta

SEQ ID NO: 426612 - DNA, 16 bp, M. musculus
tacagtatactcatat

SEQ ID NO: 426613 - DNA, 17 bp, M. musculus
tacagtccagaattgga

SEQ ID NO: 426614 - DNA, 16 bp, M. musculus
tacagtgagactctgt

SEQ ID NO: 426615 - DNA, 16 bp, M. musculus
tacagtgagctttcat

SEQ ID NO: 426616 - DNA, 16 bp, M. musculus
tacagtggaggagctg

SEQ ID NO: 426617 - DNA, 16 bp, M. musculus
tacagtggataaatgt

SEQ ID NO: 426618 - DNA, 21 bp, M. musculus
tacagtgtactcacatacatt

SEQ ID NO: 426619 - DNA, 16 bp, M. musculus
tacagtgtactcatat

SEQ ID NO: 426620 - DNA, 16 bp, M. musculus
tacagtgtacttacat

SEQ ID NO: 426621 - DNA, 16 bp, M. musculus
tacagtgtacttatgt

SEQ ID NO: 426622 - DNA, 16 bp, M. musculus
tacagtgtgagaccct

SEQ ID NO: 426623 - DNA, 16 bp, M. musculus
tacagtgtgtgtgtgt

SEQ ID NO: 426624 - DNA, 16 bp, M. musculus
tacagtgtgttttgat

SEQ ID NO: 426625 - DNA, 16 bp, M. musculus
tacagttatttttatt

SEQ ID NO: 426626 - DNA, 16 bp, M. musculus
tacagttcctcaagtt

SEQ ID NO: 426627 - DNA, 16 bp, M. musculus
tacagttcctcatgcc

SEQ ID NO: 426628 - DNA, 16 bp, M. musculus
tacagttcttcatgtt

SEQ ID NO: 426629 - DNA, 16 bp, M. musculus
tacagtttctcatgtt

SEQ ID NO: 426630 - DNA, 16 bp, M. musculus
tacagttttgttttat

SEQ ID NO: 426631 - DNA, 16 bp, M. musculus
tacataaaacagagta

SEQ ID NO: 426632 - DNA, 16 bp, M. musculus
tacataaaagaacaca

SEQ ID NO: 426633 - DNA, 16 bp, M. musculus
tacataaacaaactca

SEQ ID NO: 426634 - DNA, 16 bp, M. musculus
tacataaacatacatg

SEQ ID NO: 426635 - DNA, 16 bp, M. musculus
tacataaatacatgca

SEQ ID NO: 426636 - DNA, 16 bp, M. musculus
tacataaatatacatg

SEQ ID NO: 426637 - DNA, 16 bp, M. musculus
tacataaattcattgt

SEQ ID NO: 426638 - DNA, 16 bp, M. musculus
tacataacaagttcca

SEQ ID NO: 426639 - DNA, 16 bp, M. musculus
tacataacatgcatgt

SEQ ID NO: 426640 - DNA, 16 bp, M. musculus
tacataatgagacctt

SEQ ID NO: 426641 - DNA, 16 bp, M. musculus
tacataatgagactct

SEQ ID NO: 426642 - DNA, 16 bp, M. musculus
tacatacaagtacaca

SEQ ID NO: 426643 - DNA, 16 bp, M. musculus
tacatacaatgcatgt

SEQ ID NO: 426644 - DNA, 16 bp, M. musculus
tacatacacacacaca

SEQ ID NO: 426645 - DNA, 16 bp, M. musculus
tacatacacacacact

SEQ ID NO: 426646 - DNA, 17 bp, M. musculus
tacatacacacatatat

SEQ ID NO: 426647 - DNA, 16 bp, M. musculus
tacatacacatgtaca

SEQ ID NO: 426648 - DNA, 16 bp, M. musculus
tacatacaccacacac

SEQ ID NO: 426649 - DNA, 16 bp, M. musculus
tacatacacgcaggca

SEQ ID NO: 426650 - DNA, 16 bp, M. musculus
tacatacatacaaaca

SEQ ID NO: 426651 - DNA, 16 bp, M. musculus
tacatacatacataaa

SEQ ID NO: 426652 - DNA, 16 bp, M. musculus
tacatacatacataag

SEQ ID NO: 426653 - DNA, 16 bp, M. musculus
tacatacatacatgct

SEQ ID NO: 426654 - DNA, 16 bp, M. musculus
tacatacatataatgt

SEQ ID NO: 426655 - DNA, 16 bp, M. musculus
tacatacatatacata

SEQ ID NO: 426656 - DNA, 16 bp, M. musculus
tacatacatgagcaca

SEQ ID NO: 426657 - DNA, 16 bp, M. musculus
tacatacatgcaggca

SEQ ID NO: 426658 - DNA, 16 bp, M. musculus
tacatacatgcataat

SEQ ID NO: 426659 - DNA, 16 bp, M. musculus
tacatacatgtaagca

SEQ ID NO: 426660 - DNA, 16 bp, M. musculus
tacatacatgtacaca

SEQ ID NO: 426661 - DNA, 16 bp, M. musculus
tacatacatgtatgta

SEQ ID NO: 426662 - DNA, 16 bp, M. musculus
tacatacatgtgtaca

SEQ ID NO: 426663 - DNA, 16 bp, M. musculus
tacatacatgtgtgtt

SEQ ID NO: 426664 - DNA, 16 bp, M. musculus
tacatacattttaaat

SEQ ID NO: 426665 - DNA, 16 bp, M. musculus
tacatactgaaattct

SEQ ID NO: 426666 - DNA, 16 bp, M. musculus
tacatacttatataca

SEQ ID NO: 426667 - DNA, 16 bp, M. musculus
tacatagagaaaccct

SEQ ID NO: 426668 - DNA, 16 bp, M. musculus
tacatagctgaggatg

SEQ ID NO: 426669 - DNA, 16 bp, M. musculus
tacatagggagttcca

SEQ ID NO: 426670 - DNA, 16 bp, M. musculus
tacataggtaggtagg

SEQ ID NO: 426671 - DNA, 16 bp, M. musculus
tacatagtaagaccct

SEQ ID NO: 426672 - DNA, 16 bp, M. musculus
tacatagtaagagcct

SEQ ID NO: 426673 - DNA, 16 bp, M. musculus
tacatagtcctggctg

SEQ ID NO: 426674 - DNA, 16 bp, M. musculus
tacatagtgaattcca

SEQ ID NO: 426675 - DNA, 16 bp, M. musculus
tacatagtgagaccct

SEQ ID NO: 426676 - DNA, 16 bp, M. musculus
tacatagtgaggccct

SEQ ID NO: 426677 - DNA, 16 bp, M. musculus
tacatagtgagttcag

SEQ ID NO: 426678 - DNA, 16 bp, M. musculus
tacatagtgagtttca

SEQ ID NO: 426679 - DNA, 16 bp, M. musculus
tacatagtgagtttga

SEQ ID NO: 426680 - DNA, 16 bp, M. musculus
tacatagtggaaggag

SEQ ID NO: 426681 - DNA, 16 bp, M. musculus
tacatataagtgaccc

SEQ ID NO: 426682 - DNA, 16 bp, M. musculus
tacatatacacacaca

SEQ ID NO: 426683 - DNA, 16 bp, M. musculus
tacatatacacacatt

SEQ ID NO: 426684 - DNA, 17 bp, M. musculus
tacatatacacatacac

SEQ ID NO: 426685 - DNA, 16 bp, M. musculus
tacatatacacatata

SEQ ID NO: 426686 - DNA, 16 bp, M. musculus
tacatatacagctaga

SEQ ID NO: 426687 - DNA, 16 bp, M. musculus
tacatatacataccta

SEQ ID NO: 426688 - DNA, 16 bp, M. musculus
tacatatagatatgta

SEQ ID NO: 426689 - DNA, 17 bp, M. musculus
tacatatatacacacat

SEQ ID NO: 426690 - DNA, 16 bp, M. musculus
tacatatatacacata

SEQ ID NO: 426691 - DNA, 16 bp, M. musculus
tacatatatacataat

SEQ ID NO: 426692 - DNA, 16 bp, M. musculus
tacatatatacatact

SEQ ID NO: 426693 - DNA, 16 bp, M. musculus
tacatatatatatgca

SEQ ID NO: 426694 - DNA, 16 bp, M. musculus
tacatatatatatgtg

SEQ ID NO: 426695 - DNA, 16 bp, M. musculus
tacatatatatcttat

SEQ ID NO: 426696 - DNA, 16 bp, M. musculus
tacatatatatgaatg

SEQ ID NO: 426697 - DNA, 16 bp, M. musculus
tacatatatatgtata

SEQ ID NO: 426698 - DNA, 16 bp, M. musculus
tacatatatgtacaaa

SEQ ID NO: 426699 - DNA, 16 bp, M. musculus
tacatatatgtatatg

SEQ ID NO: 426700 - DNA, 16 bp, M. musculus
tacatatatgtctgtg

SEQ ID NO: 426701 - DNA, 16 bp, M. musculus
tacatatgaaaataaa

SEQ ID NO: 426702 - DNA, 16 bp, M. musculus
tacatatgcacatatt

SEQ ID NO: 426703 - DNA, 20 bp, M. musculus
tacatatgcagctaaagaca

SEQ ID NO: 426704 - DNA, 17 bp, M. musculus
tacatatgcagctagaa

SEQ ID NO: 426705 - DNA, 17 bp, M. musculus
tacatatgcagctagag

SEQ ID NO: 426706 - DNA, 16 bp, M. musculus
tacatatgtaatacat

SEQ ID NO: 426707 - DNA, 16 bp, M. musculus
tacatatgtaatatat

SEQ ID NO: 426708 - DNA, 16 bp, M. musculus
tacatatgtacataca

SEQ ID NO: 426709 - DNA, 16 bp, M. musculus
tacatatgtatatttt

SEQ ID NO: 426710 - DNA, 16 bp, M. musculus
tacatatgtatgtatg

SEQ ID NO: 426711 - DNA, 16 bp, M. musculus
tacatatgtgtacata

SEQ ID NO: 426712 - DNA, 16 bp, M. musculus
tacatattatatatgt

SEQ ID NO: 426713 - DNA, 16 bp, M. musculus
tacatatttatcaccc

SEQ ID NO: 426714 - DNA, 16 bp, M. musculus
tacatatttctattca

SEQ ID NO: 426715 - DNA, 16 bp, M. musculus
tacatattttaaaatg

SEQ ID NO: 426716 - DNA, 16 bp, M. musculus
tacatcaagtctctgt

SEQ ID NO: 426717 - DNA, 16 bp, M. musculus
tacatcagcaagattt

SEQ ID NO: 426718 - DNA, 16 bp, M. musculus
tacatcatcaccagct

SEQ ID NO: 426719 - DNA, 16 bp, M. musculus
tacatcatcatcatca

SEQ ID NO: 426720 - DNA, 16 bp, M. musculus
tacatcattcattaca

SEQ ID NO: 426721 - DNA, 16 bp, M. musculus
tacatccaagaaaaca

SEQ ID NO: 426722 - DNA, 16 bp, M. musculus
tacatcccaagtgctg

SEQ ID NO: 426723 - DNA, 16 bp, M. musculus
tacatccctctcactg

SEQ ID NO: 426724 - DNA, 16 bp, M. musculus
tacatcctagaaaaag

SEQ ID NO: 426725 - DNA, 16 bp, M. musculus
tacatctgaaaaaaaa

SEQ ID NO: 426726 - DNA, 16 bp, M. musculus
tacatctgctacatat

SEQ ID NO: 426727 - DNA, 21 bp, M. musculus
tacatctggccatttcttctt

SEQ ID NO: 426728 - DNA, 16 bp, M. musculus
tacatctgtaatccca

SEQ ID NO: 426729 - DNA, 16 bp, M. musculus
tacatctgtctgtctg

SEQ ID NO: 426730 - DNA, 16 bp, M. musculus
tacatcttcatctgga

SEQ ID NO: 426731 - DNA, 18 bp, M. musculus
tacatctttaggagcaag

SEQ ID NO: 426732 - DNA, 16 bp, M. musculus
tacatgaaaccctgtc

SEQ ID NO: 426733 - DNA, 16 bp, M. musculus
tacatgaaactgaaga

SEQ ID NO: 426734 - DNA, 16 bp, M. musculus
tacatgaagaaaatat

SEQ ID NO: 426735 - DNA, 16 bp, M. musculus
tacatgaatatatttt

SEQ ID NO: 426736 - DNA, 16 bp, M. musculus
tacatgaatgcacaca

SEQ ID NO: 426737 - DNA, 16 bp, M. musculus
tacatgactttaatcc

SEQ ID NO: 426738 - DNA, 16 bp, M. musculus
tacatgagaccctatc

SEQ ID NO: 426739 - DNA, 16 bp, M. musculus
tacatgagaccttgtc

SEQ ID NO: 426740 - DNA, 16 bp, M. musculus
tacatgagatcctgtt

SEQ ID NO: 426741 - DNA, 16 bp, M. musculus
tacatgaggacccagc

SEQ ID NO: 426742 - DNA, 16 bp, M. musculus
tacatgagtatgtgtg

SEQ ID NO: 426743 - DNA, 16 bp, M. musculus
tacatgcaaacacaca

SEQ ID NO: 426744 - DNA, 16 bp, M. musculus
tacatgcacacacaca

SEQ ID NO: 426745 - DNA, 16 bp, M. musculus
tacatgcacacacatg

SEQ ID NO: 426746 - DNA, 16 bp, M. musculus
tacatgcacatacaca

SEQ ID NO: 426747 - DNA, 16 bp, M. musculus
tacatgcacatacact

SEQ ID NO: 426748 - DNA, 16 bp, M. musculus
tacatgcacatgtgca

SEQ ID NO: 426749 - DNA, 16 bp, M. musculus
tacatgcatacacaca

SEQ ID NO: 426750 - DNA, 16 bp, M. musculus
tacatgcatacatact

SEQ ID NO: 426751 - DNA, 16 bp, M. musculus
tacatgcatacattca

SEQ ID NO: 426752 - DNA, 16 bp, M. musculus
tacatgcattcatgca

SEQ ID NO: 426753 - DNA, 16 bp, M. musculus
tacatgccacacacac

SEQ ID NO: 426754 - DNA, 16 bp, M. musculus
tacatgcctacacaca

SEQ ID NO: 426755 - DNA, 16 bp, M. musculus
tacatgcctggtaccc

SEQ ID NO: 426756 - DNA, 16 bp, M. musculus
tacatgcctgtaatcc

SEQ ID NO: 426757 - DNA, 16 bp, M. musculus
tacatgcctgtgtgtg

SEQ ID NO: 426758 - DNA, 16 bp, M. musculus
tacatgctaacagcca

SEQ ID NO: 426759 - DNA, 16 bp, M. musculus
tacatgctaggcaagc

SEQ ID NO: 426760 - DNA, 16 bp, M. musculus
tacatggactgggctg

SEQ ID NO: 426761 - DNA, 16 bp, M. musculus
tacatggaggcaaaac

SEQ ID NO: 426762 - DNA, 16 bp, M. musculus
tacatggctctgtggt

SEQ ID NO: 426763 - DNA, 16 bp, M. musculus
tacatggcttgggctg

SEQ ID NO: 426764 - DNA, 16 bp, M. musculus
tacatgggtgctggga

SEQ ID NO: 426765 - DNA, 16 bp, M. musculus
tacatggtaagaccct

SEQ ID NO: 426766 - DNA, 16 bp, M. musculus
tacatggtgattttct

SEQ ID NO: 426767 - DNA, 16 bp, M. musculus
tacatggtgcacagac

SEQ ID NO: 426768 - DNA, 16 bp, M. musculus
tacatggtggaagaag

SEQ ID NO: 426769 - DNA, 16 bp, M. musculus
tacatggtggctcaca

SEQ ID NO: 426770 - DNA, 16 bp, M. musculus
tacatgtaataaaaat

SEQ ID NO: 426771 - DNA, 16 bp, M. musculus
tacatgtaataataaa

SEQ ID NO: 426772 - DNA, 16 bp, M. musculus
tacatgtaattaaaaa

SEQ ID NO: 426773 - DNA, 16 bp, M. musculus
tacatgtacactcaca

SEQ ID NO: 426774 - DNA, 16 bp, M. musculus
tacatgtatataatta

SEQ ID NO: 426775 - DNA, 16 bp, M. musculus
tacatgtatatatata

SEQ ID NO: 426776 - DNA, 16 bp, M. musculus
tacatgtatgaaaatg

SEQ ID NO: 426777 - DNA, 16 bp, M. musculus
tacatgtatgaacaca

SEQ ID NO: 426778 - DNA, 16 bp, M. musculus
tacatgtatgcacaca

SEQ ID NO: 426779 - DNA, 16 bp, M. musculus
tacatgtatgtatttt

SEQ ID NO: 426780 - DNA, 16 bp, M. musculus
tacatgtccttttggg

SEQ ID NO: 426781 - DNA, 16 bp, M. musculus
tacatgtgaaggccag

SEQ ID NO: 426782 - DNA, 16 bp, M. musculus
tacatgtgcacacata

SEQ ID NO: 426783 - DNA, 16 bp, M. musculus
tacatgtgtatatgca

SEQ ID NO: 426784 - DNA, 16 bp, M. musculus
tacatgtgtgtatatg

SEQ ID NO: 426785 - DNA, 16 bp, M. musculus
tacatgtgtgtggagg

SEQ ID NO: 426786 - DNA, 16 bp, M. musculus
tacatgtgtgtgtaca

SEQ ID NO: 426787 - DNA, 16 bp, M. musculus
tacatgtgtgtgtgca

SEQ ID NO: 426788 - DNA, 16 bp, M. musculus
tacatgtttgtgtgca

SEQ ID NO: 426789 - DNA, 16 bp, M. musculus
tacatgttttctctca

SEQ ID NO: 426790 - DNA, 16 bp, M. musculus
tacatgtttttaatgt

SEQ ID NO: 426791 - DNA, 16 bp, M. musculus
tacattatatacacac

SEQ ID NO: 426792 - DNA, 16 bp, M. musculus
tacattatgtgagaaa

SEQ ID NO: 426793 - DNA, 16 bp, M. musculus
tacattcacacacaca

SEQ ID NO: 426794 - DNA, 16 bp, M. musculus
tacattcatataatgt

SEQ ID NO: 426795 - DNA, 16 bp, M. musculus
tacattcatgcaggca

SEQ ID NO: 426796 - DNA, 16 bp, M. musculus
tacattcattttcctt

SEQ ID NO: 426797 - DNA, 16 bp, M. musculus
tacattccaaatattg

SEQ ID NO: 426798 - DNA, 16 bp, M. musculus
tacattctcaccagca

SEQ ID NO: 426799 - DNA, 17 bp, M. musculus
tacattctctagctcct

SEQ ID NO: 426800 - DNA, 16 bp, M. musculus
tacattgaaaatcttc

SEQ ID NO: 426801 - DNA, 16 bp, M. musculus
tacattgcttttatta

SEQ ID NO: 426802 - DNA, 16 bp, M. musculus
tacattggggtccctg

SEQ ID NO: 426803 - DNA, 16 bp, M. musculus
tacattgtatacatgt

SEQ ID NO: 426804 - DNA, 16 bp, M. musculus
tacattgtcactggct

SEQ ID NO: 426805 - DNA, 16 bp, M. musculus
tacattgtgagaccct

SEQ ID NO: 426806 - DNA, 16 bp, M. musculus
tacattgtgcttatag

SEQ ID NO: 426807 - DNA, 16 bp, M. musculus
tacatttaaatgttat

SEQ ID NO: 426808 - DNA, 16 bp, M. musculus
tacatttaatacattt

SEQ ID NO: 426809 - DNA, 16 bp, M. musculus
tacatttaatttgatg

SEQ ID NO: 426810 - DNA, 16 bp, M. musculus
tacatttacacagtgg

SEQ ID NO: 426811 - DNA, 16 bp, M. musculus
tacatttatataatgg

SEQ ID NO: 426812 - DNA, 16 bp, M. musculus
tacatttattcatttg

SEQ ID NO: 426813 - DNA, 16 bp, M. musculus
tacatttattgacttg

SEQ ID NO: 426814 - DNA, 16 bp, M. musculus
tacatttcaaaggtta

SEQ ID NO: 426815 - DNA, 18 bp, M. musculus
tacatttcaaatgctatc

SEQ ID NO: 426816 - DNA, 16 bp, M. musculus
tacatttcaatgttat

SEQ ID NO: 426817 - DNA, 16 bp, M. musculus
tacatttcagatgttt

SEQ ID NO: 426818 - DNA, 16 bp, M. musculus
tacatttccatccctg

SEQ ID NO: 426819 - DNA, 16 bp, M. musculus
tacatttctttaaaaa

SEQ ID NO: 426820 - DNA, 16 bp, M. musculus
tacatttgcagctgga

SEQ ID NO: 426821 - DNA, 16 bp, M. musculus
tacatttgtagggttt

SEQ ID NO: 426822 - DNA, 16 bp, M. musculus
tacatttgtatgtata

SEQ ID NO: 426823 - DNA, 16 bp, M. musculus
tacatttgtgtttgtg

SEQ ID NO: 426824 - DNA, 16 bp, M. musculus
tacatttgttaatttt

SEQ ID NO: 426825 - DNA, 16 bp, M. musculus
tacattttaaaagata

SEQ ID NO: 426826 - DNA, 16 bp, M. musculus
tacattttaaatgtca

SEQ ID NO: 426827 - DNA, 16 bp, M. musculus
tacattttaataaatg

SEQ ID NO: 426828 - DNA, 16 bp, M. musculus
tacattttaattgaaa

SEQ ID NO: 426829 - DNA, 16 bp, M. musculus
tacattttataaaaca

SEQ ID NO: 426830 - DNA, 16 bp, M. musculus
tacattttatttgtat

SEQ ID NO: 426831 - DNA, 16 bp, M. musculus
tacattttcaaaatta

SEQ ID NO: 426832 - DNA, 16 bp, M. musculus
tacattttcatctgaa

SEQ ID NO: 426833 - DNA, 16 bp, M. musculus
tacattttcttctaaa

SEQ ID NO: 426834 - DNA, 16 bp, M. musculus
tacattttgaattttt

SEQ ID NO: 426835 - DNA, 16 bp, M. musculus
tacattttgagacttt

SEQ ID NO: 426836 - DNA, 16 bp, M. musculus
tacattttgtatatta

SEQ ID NO: 426837 - DNA, 16 bp, M. musculus
tacattttgttttaaa

SEQ ID NO: 426838 - DNA, 16 bp, M. musculus
tacatttttaaacaaa

SEQ ID NO: 426839 - DNA, 16 bp, M. musculus
tacatttttattgaaa

SEQ ID NO: 426840 - DNA, 16 bp, M. musculus
tacatttttctcagca

SEQ ID NO: 426841 - DNA, 16 bp, M. musculus
tacattttttaaagtt

SEQ ID NO: 426842 - DNA, 16 bp, M. musculus
tacatttttttaaatg

SEQ ID NO: 426843 - DNA, 16 bp, M. musculus
taccaaaaagcaatct

SEQ ID NO: 426844 - DNA, 16 bp, M. musculus
taccaaaggagaaaca

SEQ ID NO: 426845 - DNA, 16 bp, M. musculus
taccaaagtgtggaca

SEQ ID NO: 426846 - DNA, 16 bp, M. musculus
taccaaagttatatca

SEQ ID NO: 426847 - DNA, 16 bp, M. musculus
taccaaatgagattat

SEQ ID NO: 426848 - DNA, 16 bp, M. musculus
taccaaattttcttta

SEQ ID NO: 426849 - DNA, 16 bp, M. musculus
taccaacagaaaccag

SEQ ID NO: 426850 - DNA, 16 bp, M. musculus
taccaacccagccaca

SEQ ID NO: 426851 - DNA, 16 bp, M. musculus
taccaacctaagacag

SEQ ID NO: 426852 - DNA, 16 bp, M. musculus
taccaactgagctaca

SEQ ID NO: 426853 - DNA, 16 bp, M. musculus
taccaactgggaacca

SEQ ID NO: 426854 - DNA, 16 bp, M. musculus
taccaagaagaactct

SEQ ID NO: 426855 - DNA, 16 bp, M. musculus
taccaagacagagaga

SEQ ID NO: 426856 - DNA, 16 bp, M. musculus
taccaagatgaaccct

SEQ ID NO: 426857 - DNA, 16 bp, M. musculus
taccaagtgctaggat

SEQ ID NO: 426858 - DNA, 16 bp, M. musculus
taccaatcctaaatct

SEQ ID NO: 426859 - DNA, 17 bp, M. musculus
taccacaaaaacagtct

SEQ ID NO: 426860 - DNA, 16 bp, M. musculus
taccacaacacaccag

SEQ ID NO: 426861 - DNA, 16 bp, M. musculus
taccacaccagcccca

SEQ ID NO: 426862 - DNA, 17 bp, M. musculus
taccacaccagttccag

SEQ ID NO: 426863 - DNA, 16 bp, M. musculus
taccacacccaaagtc

SEQ ID NO: 426864 - DNA, 16 bp, M. musculus
taccacacctggcttt

SEQ ID NO: 426865 - DNA, 16 bp, M. musculus
taccacagagccccca

SEQ ID NO: 426866 - DNA, 16 bp, M. musculus
taccacagatggagaa

SEQ ID NO: 426867 - DNA, 16 bp, M. musculus
taccacatgtatgcag

SEQ ID NO: 426868 - DNA, 16 bp, M. musculus
taccaccaaaggccag

SEQ ID NO: 426869 - DNA, 16 bp, M. musculus
taccaccaagcctggc

SEQ ID NO: 426870 - DNA, 16 bp, M. musculus
taccaccacacctggc

SEQ ID NO: 426871 - DNA, 16 bp, M. musculus
taccaccaccagcagc

SEQ ID NO: 426872 - DNA, 16 bp, M. musculus
taccaccactgccacc

SEQ ID NO: 426873 - DNA, 16 bp, M. musculus
taccaccatcatcatc

SEQ ID NO: 426874 - DNA, 16 bp, M. musculus
taccactcccactatt

SEQ ID NO: 426875 - DNA, 32 bp, M. musculus
taccactcccactattcggccatttcccttat

SEQ ID NO: 426876 - DNA, 16 bp, M. musculus
taccactgagccactc

SEQ ID NO: 426877 - DNA, 16 bp, M. musculus
taccactgagctatac

SEQ ID NO: 426878 - DNA, 16 bp, M. musculus
taccactgagctatat

SEQ ID NO: 426879 - DNA, 16 bp, M. musculus
taccactgagttacat

SEQ ID NO: 426880 - DNA, 16 bp, M. musculus
taccactgcccagctg

SEQ ID NO: 426881 - DNA, 16 bp, M. musculus
taccagaccaccatgg

SEQ ID NO: 426882 - DNA, 16 bp, M. musculus
taccagagataaccag

SEQ ID NO: 426883 - DNA, 16 bp, M. musculus
taccagagatggagaa

SEQ ID NO: 426884 - DNA, 16 bp, M. musculus
taccagatatttacat

SEQ ID NO: 426885 - DNA, 16 bp, M. musculus
taccagatggccaaag

SEQ ID NO: 426886 - DNA, 16 bp, M. musculus
taccagcacacacaca

SEQ ID NO: 426887 - DNA, 17 bp, M. musculus
taccagcatcagataca

SEQ ID NO: 426888 - DNA, 16 bp, M. musculus
taccagcccagtgatg

SEQ ID NO: 426889 - DNA, 16 bp, M. musculus
taccagctcaaactct

SEQ ID NO: 426890 - DNA, 16 bp, M. musculus
taccaggcatgcacat

SEQ ID NO: 426891 - DNA, 22 bp, M. musculus
taccaggctggcctcgaactca

SEQ ID NO: 426892 - DNA, 16 bp, M. musculus
taccaggtcctctgca

SEQ ID NO: 426893 - DNA, 16 bp, M. musculus
taccagtaccacgcag

SEQ ID NO: 426894 - DNA, 16 bp, M. musculus
taccagtctctgcaga

SEQ ID NO: 426895 - DNA, 16 bp, M. musculus
taccagtgacatcatg

SEQ ID NO: 426896 - DNA, 16 bp, M. musculus
taccagttggcccagt

SEQ ID NO: 426897 - DNA, 16 bp, M. musculus
taccagtttcttctgc

SEQ ID NO: 426898 - DNA, 16 bp, M. musculus
taccataaaattattt

SEQ ID NO: 426899 - DNA, 16 bp, M. musculus
taccatacagttttta

SEQ ID NO: 426900 - DNA, 16 bp, M. musculus
taccatagatggaaaa

SEQ ID NO: 426901 - DNA, 16 bp, M. musculus
taccatatacaaccac

SEQ ID NO: 426902 - DNA, 19 bp, M. musculus
taccatatggttgctggga

SEQ ID NO: 426903 - DNA, 16 bp, M. musculus
taccatattgatttcc

SEQ ID NO: 426904 - DNA, 16 bp, M. musculus
taccatctgcaaaaag

SEQ ID NO: 426905 - DNA, 16 bp, M. musculus
taccatgagatgctga

SEQ ID NO: 426906 - DNA, 24 bp, M. musculus
taccatgcagtttttatcacaatt

SEQ ID NO: 426907 - DNA, 16 bp, M. musculus
taccatggagttttta

SEQ ID NO: 426908 - DNA, 27 bp, M. musculus
taccatggggagataaaaatcttagtc

SEQ ID NO: 426909 - DNA, 16 bp, M. musculus
taccatgtggattcca

SEQ ID NO: 426910 - DNA, 24 bp, M. musculus
taccatgtggttgctgggaattga

SEQ ID NO: 426911 - DNA, 16 bp, M. musculus
taccatgtgtactgcc

SEQ ID NO: 426912 - DNA, 16 bp, M. musculus
taccattgatgagtat

SEQ ID NO: 426913 - DNA, 16 bp, M. musculus
tacccaacaaccacat

SEQ ID NO: 426914 - DNA, 16 bp, M. musculus
tacccaagaagctaaa

SEQ ID NO: 426915 - DNA, 16 bp, M. musculus
tacccaaggagcaaaa

SEQ ID NO: 426916 - DNA, 16 bp, M. musculus
tacccaaggagctaag

SEQ ID NO: 426917 - DNA, 16 bp, M. musculus
tacccaataaaagaaa

SEQ ID NO: 426918 - DNA, 16 bp, M. musculus
tacccaatcaaggtga

SEQ ID NO: 426919 - DNA, 16 bp, M. musculus
tacccacaatgggctg

SEQ ID NO: 426920 - DNA, 16 bp, M. musculus
tacccacagaagccag

SEQ ID NO: 426921 - DNA, 16 bp, M. musculus
tacccacagagaagtg

SEQ ID NO: 426922 - DNA, 16 bp, M. musculus
tacccacagtcctggg

SEQ ID NO: 426923 - DNA, 16 bp, M. musculus
tacccacataaaaagc

SEQ ID NO: 426924 - DNA, 16 bp, M. musculus
tacccactgcaccatc

SEQ ID NO: 426925 - DNA, 16 bp, M. musculus
tacccacttctgcctc

SEQ ID NO: 426926 - DNA, 16 bp, M. musculus
tacccagagactgccc

SEQ ID NO: 426927 - DNA, 16 bp, M. musculus
tacccagatgatgctc

SEQ ID NO: 426928 - DNA, 16 bp, M. musculus
tacccagatggaaatg

SEQ ID NO: 426929 - DNA, 16 bp, M. musculus
tacccagtacccacat

SEQ ID NO: 426930 - DNA, 16 bp, M. musculus
tacccatacacacaaa

SEQ ID NO: 426931 - DNA, 16 bp, M. musculus
tacccatacatacaca

SEQ ID NO: 426932 - DNA, 16 bp, M. musculus
tacccatttaaaaaaa

SEQ ID NO: 426933 - DNA, 16 bp, M. musculus
taccccaagagcagga

SEQ ID NO: 426934 - DNA, 16 bp, M. musculus
taccccagacccaatc

SEQ ID NO: 426935 - DNA, 16 bp, M. musculus
taccccagagctccca

SEQ ID NO: 426936 - DNA, 16 bp, M. musculus
taccccagagctctgg

SEQ ID NO: 426937 - DNA, 16 bp, M. musculus
taccccagtcccactc

SEQ ID NO: 426938 - DNA, 16 bp, M. musculus
taccccatggtgtctt

SEQ ID NO: 426939 - DNA, 16 bp, M. musculus
tacccccagaactcct

SEQ ID NO: 426940 - DNA, 16 bp, M. musculus
tacccccagggctccc

SEQ ID NO: 426941 - DNA, 16 bp, M. musculus
tacccctggctgtcct

SEQ ID NO: 426942 - DNA, 16 bp, M. musculus
tacccgctgagccatt

SEQ ID NO: 426943 - DNA, 20 bp, M. musculus
tacccggggatccatcccat

SEQ ID NO: 426944 - DNA, 16 bp, M. musculus
taccctccccatgccc

SEQ ID NO: 426945 - DNA, 16 bp, M. musculus
taccctccctctgccc

SEQ ID NO: 426946 - DNA, 16 bp, M. musculus
taccctccctctgctc

SEQ ID NO: 426947 - DNA, 16 bp, M. musculus
taccctctaagccatc

SEQ ID NO: 426948 - DNA, 16 bp, M. musculus
taccctctccctgccc

SEQ ID NO: 426949 - DNA, 16 bp, M. musculus
taccctgccccccact

SEQ ID NO: 426950 - DNA, 16 bp, M. musculus
taccctgcccctgccc

SEQ ID NO: 426951 - DNA, 16 bp, M. musculus
taccctggagctggag

SEQ ID NO: 426952 - DNA, 16 bp, M. musculus
taccctggtctacata

SEQ ID NO: 426953 - DNA, 16 bp, M. musculus
taccctgtgtgagttc

SEQ ID NO: 426954 - DNA, 27 bp, M. musculus
tacccttggcacatgcgcagattattt

SEQ ID NO: 426955 - DNA, 25 bp, M. musculus
taccgagctaatcttagagctgcac

SEQ ID NO: 426956 - DNA, 19 bp, M. musculus
tacctaaacatgttaaaag

SEQ ID NO: 426957 - DNA, 16 bp, M. musculus
tacctaaggacccagc

SEQ ID NO: 426958 - DNA, 16 bp, M. musculus
tacctaataaaatatt

SEQ ID NO: 426959 - DNA, 16 bp, M. musculus
tacctaccaagccatc

SEQ ID NO: 426960 - DNA, 16 bp, M. musculus
tacctacctacctact

SEQ ID NO: 426961 - DNA, 19 bp, M. musculus
tacctacctacctatctac

SEQ ID NO: 426962 - DNA, 16 bp, M. musculus
tacctactcaacattg

SEQ ID NO: 426963 - DNA, 16 bp, M. musculus
tacctactccagcaag

SEQ ID NO: 426964 - DNA, 16 bp, M. musculus
tacctataatcccagc

SEQ ID NO: 426965 - DNA, 16 bp, M. musculus
tacctatcaaggtctc

SEQ ID NO: 426966 - DNA, 16 bp, M. musculus
tacctatgaatacatg

SEQ ID NO: 426967 - DNA, 16 bp, M. musculus
tacctcaacagaagaa

SEQ ID NO: 426968 - DNA, 17 bp, M. musculus
tacctcactcagcatga

SEQ ID NO: 426969 - DNA, 16 bp, M. musculus
tacctcactgaagatg

SEQ ID NO: 426970 - DNA, 16 bp, M. musculus
tacctcagactgaaag

SEQ ID NO: 426971 - DNA, 16 bp, M. musculus
tacctcagggacaaag

SEQ ID NO: 426972 - DNA, 16 bp, M. musculus
tacctcattaaggatg

SEQ ID NO: 426973 - DNA, 16 bp, M. musculus
tacctcatttacatat

SEQ ID NO: 426974 - DNA, 16 bp, M. musculus
tacctcccaagagctg

SEQ ID NO: 426975 - DNA, 16 bp, M. musculus
tacctccctagtgctg

SEQ ID NO: 426976 - DNA, 16 bp, M. musculus
tacctcctatagccag

SEQ ID NO: 426977 - DNA, 16 bp, M. musculus
tacctcctccctgtcc

SEQ ID NO: 426978 - DNA, 16 bp, M. musculus
tacctctacccatgga

SEQ ID NO: 426979 - DNA, 16 bp, M. musculus
tacctctgactcattc

SEQ ID NO: 426980 - DNA, 16 bp, M. musculus
tacctctgcttcccaa

SEQ ID NO: 426981 - DNA, 16 bp, M. musculus
tacctctgtgtgtgtg

SEQ ID NO: 426982 - DNA, 16 bp, M. musculus
tacctcttcacaatgg

SEQ ID NO: 426983 - DNA, 16 bp, M. musculus
tacctgaaggtctagg

SEQ ID NO: 426984 - DNA, 16 bp, M. musculus
tacctgaggaatgtca

SEQ ID NO: 426985 - DNA, 16 bp, M. musculus
tacctgcctttaatcc

SEQ ID NO: 426986 - DNA, 16 bp, M. musculus
tacctgctgagccatt

SEQ ID NO: 426987 - DNA, 16 bp, M. musculus
tacctgctgggaaagg

SEQ ID NO: 426988 - DNA, 16 bp, M. musculus
tacctgcttctcagca

SEQ ID NO: 426989 - DNA, 16 bp, M. musculus
tacctggatactgcca

SEQ ID NO: 426990 - DNA, 16 bp, M. musculus
tacctggcataccctg

SEQ ID NO: 426991 - DNA, 16 bp, M. musculus
tacctggctgtcctgg

SEQ ID NO: 426992 - DNA, 17 bp, M. musculus
tacctgggcaacaagga

SEQ ID NO: 426993 - DNA, 16 bp, M. musculus
tacctgggcaccttcc

SEQ ID NO: 426994 - DNA, 16 bp, M. musculus
tacctgggtttgtgac

SEQ ID NO: 426995 - DNA, 16 bp, M. musculus
tacctggtatctctct

SEQ ID NO: 426996 - DNA, 16 bp, M. musculus
tacctggttcctgtaa

SEQ ID NO: 426997 - DNA, 16 bp, M. musculus
tacctgtaatcccagt

SEQ ID NO: 426998 - DNA, 16 bp, M. musculus
tacctgtactcacagg

SEQ ID NO: 426999 - DNA, 16 bp, M. musculus
tacctgtctcctgaga

SEQ ID NO: 427000 - DNA, 16 bp, M. musculus
tacctgtgtgtatatg

SEQ ID NO: 427001 - DNA, 16 bp, M. musculus
tacctgtgtgtgcctg

SEQ ID NO: 427002 - DNA, 16 bp, M. musculus
tacctgtgtgtgtgtg

SEQ ID NO: 427003 - DNA, 16 bp, M. musculus
taccttattaaaaaag

SEQ ID NO: 427004 - DNA, 16 bp, M. musculus
taccttccaaacatca

SEQ ID NO: 427005 - DNA, 16 bp, M. musculus
taccttccaagtactg

SEQ ID NO: 427006 - DNA, 16 bp, M. musculus
taccttctgtttgtat

SEQ ID NO: 427007 - DNA, 16 bp, M. musculus
taccttcttcaatttc

SEQ ID NO: 427008 - DNA, 16 bp, M. musculus
taccttggtaaaggaa

SEQ ID NO: 427009 - DNA, 16 bp, M. musculus
taccttggtttctcca

SEQ ID NO: 427010 - DNA, 16 bp, M. musculus
tacctttcctaaatca

SEQ ID NO: 427011 - DNA, 16 bp, M. musculus
tacctttgttctcagt

SEQ ID NO: 427012 - DNA, 16 bp, M. musculus
tacctttttcagggag

SEQ ID NO: 427013 - DNA, 16 bp, M. musculus
tacctttttggttgtg

SEQ ID NO: 427014 - DNA, 26 bp, M. musculus
tacgaaggggttgccgtcctaggtac

SEQ ID NO: 427015 - DNA, 16 bp, M. musculus
tacgcaggcacagggg

SEQ ID NO: 427016 - DNA, 16 bp, M. musculus
tacggagacaaagtgt

SEQ ID NO: 427017 - DNA, 16 bp, M. musculus
tacggataataggagt

SEQ ID NO: 427018 - DNA, 16 bp, M. musculus
tacgggggaagtggac

SEQ ID NO: 427019 - DNA, 16 bp, M. musculus
tacgtatatatgtgta

SEQ ID NO: 427020 - DNA, 16 bp, M. musculus
tacgtgcatgcacaca

SEQ ID NO: 427021 - DNA, 17 bp, M. musculus
tacgtgtgtgtacgtgt

SEQ ID NO: 427022 - DNA, 16 bp, M. musculus
tactaaaaggaaaaat

SEQ ID NO: 427023 - DNA, 16 bp, M. musculus
tactaaaatattatct

SEQ ID NO: 427024 - DNA, 16 bp, M. musculus
tactaaaatctatatt

SEQ ID NO: 427025 - DNA, 16 bp, M. musculus
tactaaagttccttta

SEQ ID NO: 427026 - DNA, 16 bp, M. musculus
tactaacaatgaaatc

SEQ ID NO: 427027 - DNA, 24 bp, M. musculus
tactaacagaaatcaagaccactc

SEQ ID NO: 427028 - DNA, 16 bp, M. musculus
tactaacagaaatcag

SEQ ID NO: 427029 - DNA, 16 bp, M. musculus
tactaacataaaccaa

SEQ ID NO: 427030 - DNA, 16 bp, M. musculus
tactaactgagctaca

SEQ ID NO: 427031 - DNA, 18 bp, M. musculus
tactaaggagcttaatga

SEQ ID NO: 427032 - DNA, 16 bp, M. musculus
tactaaggatgttgaa

SEQ ID NO: 427033 - DNA, 16 bp, M. musculus
tactaaggtcatatct

SEQ ID NO: 427034 - DNA, 16 bp, M. musculus
tactaatcttttgtgg

SEQ ID NO: 427035 - DNA, 16 bp, M. musculus
tactaatttctgtctt

SEQ ID NO: 427036 - DNA, 16 bp, M. musculus
tactacaaaagcctat

SEQ ID NO: 427037 - DNA, 25 bp, M. musculus
tactacagagcaattgtgataaaaa

SEQ ID NO: 427038 - DNA, 17 bp, M. musculus
tactactactactacta

SEQ ID NO: 427039 - DNA, 16 bp, M. musculus
tactactactattatt

SEQ ID NO: 427040 - DNA, 19 bp, M. musculus
tactactcagcaattaaaa

SEQ ID NO: 427041 - DNA, 16 bp, M. musculus
tactactcttccagag

SEQ ID NO: 427042 - DNA, 16 bp, M. musculus
tactactgctgctgct

SEQ ID NO: 427043 - DNA, 17 bp, M. musculus
tactacttagctattaa

SEQ ID NO: 427044 - DNA, 17 bp, M. musculus
tactagaccttcaaaga

SEQ ID NO: 427045 - DNA, 16 bp, M. musculus
tactagggatcaaact

SEQ ID NO: 427046 - DNA, 16 bp, M. musculus
tactagttagttcata

SEQ ID NO: 427047 - DNA, 16 bp, M. musculus
tactataaccagcaaa

SEQ ID NO: 427048 - DNA, 17 bp, M. musculus
tactatacccagcaaaa

SEQ ID NO: 427049 - DNA, 16 bp, M. musculus
tactataggtgtgtgg

SEQ ID NO: 427050 - DNA, 16 bp, M. musculus
tactatatatgtatgt

SEQ ID NO: 427051 - DNA, 16 bp, M. musculus
tactatattaatcatg

SEQ ID NO: 427052 - DNA, 16 bp, M. musculus
tactatcctgatgctg

SEQ ID NO: 427053 - DNA, 16 bp, M. musculus
tactatgtagcccagg

SEQ ID NO: 427054 - DNA, 16 bp, M. musculus
tactattcaaattatt

SEQ ID NO: 427055 - DNA, 16 bp, M. musculus
tactcaacaaaagtag

SEQ ID NO: 427056 - DNA, 16 bp, M. musculus
tactcaaccattaaaa

SEQ ID NO: 427057 - DNA, 16 bp, M. musculus
tactcaagagacagag

SEQ ID NO: 427058 - DNA, 16 bp, M. musculus
tactcaagaggctgag

SEQ ID NO: 427059 - DNA, 16 bp, M. musculus
tactcaaggtgcacaa

SEQ ID NO: 427060 - DNA, 16 bp, M. musculus
tactcaataaatattt

SEQ ID NO: 427061 - DNA, 16 bp, M. musculus
tactcacaagaggaaa

SEQ ID NO: 427062 - DNA, 16 bp, M. musculus
tactcacagatcagtg

SEQ ID NO: 427063 - DNA, 16 bp, M. musculus
tactcacaggagaaaa

SEQ ID NO: 427064 - DNA, 16 bp, M. musculus
tactcacatacataca

SEQ ID NO: 427065 - DNA, 16 bp, M. musculus
tactcaccttcaagga

SEQ ID NO: 427066 - DNA, 16 bp, M. musculus
tactcacggcaagggc

SEQ ID NO: 427067 - DNA, 16 bp, M. musculus
tactcactgataactt

SEQ ID NO: 427068 - DNA, 18 bp, M. musculus
tactcagctattaaaaaa

SEQ ID NO: 427069 - DNA, 18 bp, M. musculus
tactcagctattaaaaac

SEQ ID NO: 427070 - DNA, 17 bp, M. musculus
tactcagctattaaaac

SEQ ID NO: 427071 - DNA, 16 bp, M. musculus
tactcagtgataactt

SEQ ID NO: 427072 - DNA, 16 bp, M. musculus
tactcatacatgaaat

SEQ ID NO: 427073 - DNA, 16 bp, M. musculus
tactcatagccaacca

SEQ ID NO: 427074 - DNA, 16 bp, M. musculus
tactcatataaaacaa

SEQ ID NO: 427075 - DNA, 17 bp, M. musculus
tactcatcactgtgctg

SEQ ID NO: 427076 - DNA, 16 bp, M. musculus
tactcatctacataaa

SEQ ID NO: 427077 - DNA, 16 bp, M. musculus
tactcatgtgtgtgtg

SEQ ID NO: 427078 - DNA, 16 bp, M. musculus
tactccaataaagcca

SEQ ID NO: 427079 - DNA, 16 bp, M. musculus
tactccaccaaggcca

SEQ ID NO: 427080 - DNA, 16 bp, M. musculus
tactccagatgaattt

SEQ ID NO: 427081 - DNA, 16 bp, M. musculus
tactccagttccaggg

SEQ ID NO: 427082 - DNA, 16 bp, M. musculus
tactccatggcctctg

SEQ ID NO: 427083 - DNA, 16 bp, M. musculus
tactccattgtgcaaa

SEQ ID NO: 427084 - DNA, 16 bp, M. musculus
tactccctggaccaag

SEQ ID NO: 427085 - DNA, 16 bp, M. musculus
tactcctatggggctg

SEQ ID NO: 427086 - DNA, 16 bp, M. musculus
tactcctgagcatgag

SEQ ID NO: 427087 - DNA, 16 bp, M. musculus
tactcctgatctcttt

SEQ ID NO: 427088 - DNA, 16 bp, M. musculus
tactcctggctcaaca

SEQ ID NO: 427089 - DNA, 16 bp, M. musculus
tactcgaagtcctagc

SEQ ID NO: 427090 - DNA, 33 bp, M. musculus
tactctcagtaccttacagaacctcattatcat

SEQ ID NO: 427091 - DNA, 16 bp, M. musculus
tactctctctagtttc

SEQ ID NO: 427092 - DNA, 16 bp, M. musculus
tactctcttaccctct

SEQ ID NO: 427093 - DNA, 16 bp, M. musculus
tactctcttgcctctt

SEQ ID NO: 427094 - DNA, 16 bp, M. musculus
tactctgaaaatcagt

SEQ ID NO: 427095 - DNA, 16 bp, M. musculus
tactcttccacaagac

SEQ ID NO: 427096 - DNA, 16 bp, M. musculus
tactcttccagaggtc

SEQ ID NO: 427097 - DNA, 16 bp, M. musculus
tactcttgcagaggac

SEQ ID NO: 427098 - DNA, 16 bp, M. musculus
tactcttgcagagggc

SEQ ID NO: 427099 - DNA, 16 bp, M. musculus
tactgaaaatttcatt

SEQ ID NO: 427100 - DNA, 16 bp, M. musculus
tactgaacattttatc

SEQ ID NO: 427101 - DNA, 16 bp, M. musculus
tactgaagggaccctg

SEQ ID NO: 427102 - DNA, 16 bp, M. musculus
tactgacacacacaca

SEQ ID NO: 427103 - DNA, 16 bp, M. musculus
tactgacttgcttctc

SEQ ID NO: 427104 - DNA, 16 bp, M. musculus
tactgagactctgtct

SEQ ID NO: 427105 - DNA, 16 bp, M. musculus
tactgatgagtctttt

SEQ ID NO: 427106 - DNA, 16 bp, M. musculus
tactgattttgtttct

SEQ ID NO: 427107 - DNA, 16 bp, M. musculus
tactgcaacttgatat

SEQ ID NO: 427108 - DNA, 16 bp, M. musculus
tactgccctcttctgg

SEQ ID NO: 427109 - DNA, 16 bp, M. musculus
tactgcctgttccagg

SEQ ID NO: 427110 - DNA, 16 bp, M. musculus
tactgcctgtttggtg

SEQ ID NO: 427111 - DNA, 16 bp, M. musculus
tactgctcttccagag

SEQ ID NO: 427112 - DNA, 16 bp, M. musculus
tactgctgatgccaag

SEQ ID NO: 427113 - DNA, 16 bp, M. musculus
tactgctgctgctgtt

SEQ ID NO: 427114 - DNA, 16 bp, M. musculus
tactgctttaattgca

SEQ ID NO: 427115 - DNA, 16 bp, M. musculus
tactggaaaccaaact

SEQ ID NO: 427116 - DNA, 16 bp, M. musculus
tactggaacctcactg

SEQ ID NO: 427117 - DNA, 16 bp, M. musculus
tactggactctaccag

SEQ ID NO: 427118 - DNA, 16 bp, M. musculus
tactggatgaagcctc

SEQ ID NO: 427119 - DNA, 16 bp, M. musculus
tactggcatctagtgg

SEQ ID NO: 427120 - DNA, 16 bp, M. musculus
tactggctgctcttcc

SEQ ID NO: 427121 - DNA, 16 bp, M. musculus
tactggctgctcttgc

SEQ ID NO: 427122 - DNA, 16 bp, M. musculus
tactggcttgctcctt

SEQ ID NO: 427123 - DNA, 16 bp, M. musculus
tactggcttgttttcc

SEQ ID NO: 427124 - DNA, 16 bp, M. musculus
tactggcttgttttgt

SEQ ID NO: 427125 - DNA, 16 bp, M. musculus
tactggctttcaggca

SEQ ID NO: 427126 - DNA, 16 bp, M. musculus
tactgggacaactgat

SEQ ID NO: 427127 - DNA, 16 bp, M. musculus
tactgggaccctgatt

SEQ ID NO: 427128 - DNA, 16 bp, M. musculus
tactgggagacttcaa

SEQ ID NO: 427129 - DNA, 16 bp, M. musculus
tactgggattaaatgc

SEQ ID NO: 427130 - DNA, 16 bp, M. musculus
tactgggattccaggt

SEQ ID NO: 427131 - DNA, 16 bp, M. musculus
tactggggaaaaaaaa

SEQ ID NO: 427132 - DNA, 16 bp, M. musculus
tactggtgtgaggtag

SEQ ID NO: 427133 - DNA, 16 bp, M. musculus
tactggttagttcata

SEQ ID NO: 427134 - DNA, 16 bp, M. musculus
tactgtagaggaatgt

SEQ ID NO: 427135 - DNA, 18 bp, M. musculus
tactgtagctgtcttcag

SEQ ID NO: 427136 - DNA, 19 bp, M. musculus
tactgtagctgtcttcaga

SEQ ID NO: 427137 - DNA, 16 bp, M. musculus
tactgtatgtgcctat

SEQ ID NO: 427138 - DNA, 16 bp, M. musculus
tactgtattgtattgt

SEQ ID NO: 427139 - DNA, 16 bp, M. musculus
tactgtatttataaac

SEQ ID NO: 427140 - DNA, 16 bp, M. musculus
tactgtcaataaaaca

SEQ ID NO: 427141 - DNA, 16 bp, M. musculus
tactgtgaagagacac

SEQ ID NO: 427142 - DNA, 16 bp, M. musculus
tactgtgcagtgtgtg

SEQ ID NO: 427143 - DNA, 16 bp, M. musculus
tactgtgtactgtgta

SEQ ID NO: 427144 - DNA, 16 bp, M. musculus
tactgtgtagccctgg

SEQ ID NO: 427145 - DNA, 16 bp, M. musculus
tactgtgtgaaaagga

SEQ ID NO: 427146 - DNA, 16 bp, M. musculus
tactgtgttcctgtgt

SEQ ID NO: 427147 - DNA, 16 bp, M. musculus
tactgtgtttaaatat

SEQ ID NO: 427148 - DNA, 16 bp, M. musculus
tactgttctcaacatt

SEQ ID NO: 427149 - DNA, 16 bp, M. musculus
tactgttcttggtgat

SEQ ID NO: 427150 - DNA, 16 bp, M. musculus
tactgttgtttgtttg

SEQ ID NO: 427151 - DNA, 16 bp, M. musculus
tactgtttggctgtgg

SEQ ID NO: 427152 - DNA, 16 bp, M. musculus
tactgtttgtgtgttg

SEQ ID NO: 427153 - DNA, 16 bp, M. musculus
tactgtttttcttcct

SEQ ID NO: 427154 - DNA, 16 bp, M. musculus
tacttaataaacattt

SEQ ID NO: 427155 - DNA, 16 bp, M. musculus
tacttaataatttgct

SEQ ID NO: 427156 - DNA, 16 bp, M. musculus
tacttacatatattta

SEQ ID NO: 427157 - DNA, 16 bp, M. musculus
tacttacatttttaaa

SEQ ID NO: 427158 - DNA, 16 bp, M. musculus
tacttactggcttgct

SEQ ID NO: 427159 - DNA, 16 bp, M. musculus
tacttagcatcatcag

SEQ ID NO: 427160 - DNA, 16 bp, M. musculus
tacttagtgagtttca

SEQ ID NO: 427161 - DNA, 16 bp, M. musculus
tacttatatacttata

SEQ ID NO: 427162 - DNA, 16 bp, M. musculus
tacttatatgtataca

SEQ ID NO: 427163 - DNA, 16 bp, M. musculus
tacttcaaaggaactt

SEQ ID NO: 427164 - DNA, 16 bp, M. musculus
tacttcaacaagacca

SEQ ID NO: 427165 - DNA, 16 bp, M. musculus
tacttcaatgtccctc

SEQ ID NO: 427166 - DNA, 16 bp, M. musculus
tacttcactgtcttct

SEQ ID NO: 427167 - DNA, 16 bp, M. musculus
tacttcaggtttcctt

SEQ ID NO: 427168 - DNA, 16 bp, M. musculus
tacttcagtccttccc

SEQ ID NO: 427169 - DNA, 16 bp, M. musculus
tacttcagtgaagctg

SEQ ID NO: 427170 - DNA, 16 bp, M. musculus
tacttcatactcatca

SEQ ID NO: 427171 - DNA, 16 bp, M. musculus
tacttcatttctccct

SEQ ID NO: 427172 - DNA, 16 bp, M. musculus
tacttccctatcaata

SEQ ID NO: 427173 - DNA, 16 bp, M. musculus
tacttcctactgatta

SEQ ID NO: 427174 - DNA, 16 bp, M. musculus
tacttcctccagcaag

SEQ ID NO: 427175 - DNA, 16 bp, M. musculus
tacttcctctttgttc

SEQ ID NO: 427176 - DNA, 16 bp, M. musculus
tacttcctgctggtta

SEQ ID NO: 427177 - DNA, 16 bp, M. musculus
tacttccttttgttct

SEQ ID NO: 427178 - DNA, 16 bp, M. musculus
tacttctcaggaagac

SEQ ID NO: 427179 - DNA, 16 bp, M. musculus
tacttctccaacacca

SEQ ID NO: 427180 - DNA, 16 bp, M. musculus
tacttctgggagacca

SEQ ID NO: 427181 - DNA, 16 bp, M. musculus
tacttgaagatccagc

SEQ ID NO: 427182 - DNA, 16 bp, M. musculus
tacttgagaccttgtc

SEQ ID NO: 427183 - DNA, 16 bp, M. musculus
tacttgatcatgttga

SEQ ID NO: 427184 - DNA, 16 bp, M. musculus
tacttgatcgtggtga

SEQ ID NO: 427185 - DNA, 16 bp, M. musculus
tacttgcagcacagaa

SEQ ID NO: 427186 - DNA, 16 bp, M. musculus
tacttgcatctatggt

SEQ ID NO: 427187 - DNA, 16 bp, M. musculus
tacttgctgagtcatc

SEQ ID NO: 427188 - DNA, 16 bp, M. musculus
tacttggaagacagag

SEQ ID NO: 427189 - DNA, 16 bp, M. musculus
tacttggcatttttcc

SEQ ID NO: 427190 - DNA, 16 bp, M. musculus
tacttgggaaactgag

SEQ ID NO: 427191 - DNA, 16 bp, M. musculus
tacttgggaagctgag

SEQ ID NO: 427192 - DNA, 16 bp, M. musculus
tacttgggaggctgaa

SEQ ID NO: 427193 - DNA, 16 bp, M. musculus
tacttgggaggctgag

SEQ ID NO: 427194 - DNA, 16 bp, M. musculus
tacttggtggctcaca

SEQ ID NO: 427195 - DNA, 16 bp, M. musculus
tacttgtggctgtctt

SEQ ID NO: 427196 - DNA, 16 bp, M. musculus
tacttgtgtgtatgtg

SEQ ID NO: 427197 - DNA, 16 bp, M. musculus
tactttaaaaagtaaa

SEQ ID NO: 427198 - DNA, 16 bp, M. musculus
tactttattcaaatgc

SEQ ID NO: 427199 - DNA, 16 bp, M. musculus
tactttattgggttct

SEQ ID NO: 427200 - DNA, 16 bp, M. musculus
tactttccctcccagg

SEQ ID NO: 427201 - DNA, 17 bp, M. musculus
tactttctctagctcct

SEQ ID NO: 427202 - DNA, 17 bp, M. musculus
tactttctctaggtcct

SEQ ID NO: 427203 - DNA, 16 bp, M. musculus
tactttctttatatac

SEQ ID NO: 427204 - DNA, 16 bp, M. musculus
tactttgaaatctttt

SEQ ID NO: 427205 - DNA, 16 bp, M. musculus
tactttgacttcttca

SEQ ID NO: 427206 - DNA, 16 bp, M. musculus
tactttgatgttgtct

SEQ ID NO: 427207 - DNA, 16 bp, M. musculus
tactttgctgaagttg

SEQ ID NO: 427208 - DNA, 16 bp, M. musculus
tactttggtgtctcca

SEQ ID NO: 427209 - DNA, 16 bp, M. musculus
tactttgtgggttctt

SEQ ID NO: 427210 - DNA, 16 bp, M. musculus
tacttttaaaaaaatc

SEQ ID NO: 427211 - DNA, 16 bp, M. musculus
tacttttaaaaagtgt

SEQ ID NO: 427212 - DNA, 16 bp, M. musculus
tacttttaaagataaa

SEQ ID NO: 427213 - DNA, 16 bp, M. musculus
tacttttatgtatatg

SEQ ID NO: 427214 - DNA, 16 bp, M. musculus
tacttttctgaatttc

SEQ ID NO: 427215 - DNA, 16 bp, M. musculus
tacttttgtattgctg

SEQ ID NO: 427216 - DNA, 16 bp, M. musculus
tactttttaaaaaaca

SEQ ID NO: 427217 - DNA, 16 bp, M. musculus
tactttttaaaaactt

SEQ ID NO: 427218 - DNA, 16 bp, M. musculus
tactttttattgaaaa

SEQ ID NO: 427219 - DNA, 16 bp, M. musculus
tactttttttaaagaa

SEQ ID NO: 427220 - DNA, 16 bp, M. musculus
tagaaaaaaatcaatt

SEQ ID NO: 427221 - DNA, 16 bp, M. musculus
tagaaaaaatggctat

SEQ ID NO: 427222 - DNA, 16 bp, M. musculus
tagaaaaagcaggaaa

SEQ ID NO: 427223 - DNA, 16 bp, M. musculus
tagaaaaatatttcat

SEQ ID NO: 427224 - DNA, 16 bp, M. musculus
tagaaaaatattttca

SEQ ID NO: 427225 - DNA, 16 bp, M. musculus
tagaaaaatattttct

SEQ ID NO: 427226 - DNA, 16 bp, M. musculus
tagaaaaatgtgaatc

SEQ ID NO: 427227 - DNA, 16 bp, M. musculus
tagaaaacaaacagga

SEQ ID NO: 427228 - DNA, 16 bp, M. musculus
tagaaaacaggcttct

SEQ ID NO: 427229 - DNA, 16 bp, M. musculus
tagaaaacattgacaa

SEQ ID NO: 427230 - DNA, 16 bp, M. musculus
tagaaaacatttcaaa

SEQ ID NO: 427231 - DNA, 16 bp, M. musculus
tagaaaaccatccatt

SEQ ID NO: 427232 - DNA, 16 bp, M. musculus
tagaaaacctaaaaga

SEQ ID NO: 427233 - DNA, 16 bp, M. musculus
tagaaaacctagaaaa

SEQ ID NO: 427234 - DNA, 16 bp, M. musculus
tagaaaactcccgatc

SEQ ID NO: 427235 - DNA, 16 bp, M. musculus
tagaaaagaaactgac

SEQ ID NO: 427236 - DNA, 16 bp, M. musculus
tagaaaagaggaagtc

SEQ ID NO: 427237 - DNA, 16 bp, M. musculus
tagaaaagcagagaga

SEQ ID NO: 427238 - DNA, 16 bp, M. musculus
tagaaaagcagttcct

SEQ ID NO: 427239 - DNA, 16 bp, M. musculus
tagaaaatattgtcca

SEQ ID NO: 427240 - DNA, 16 bp, M. musculus
tagaaaatgaaagcaa

SEQ ID NO: 427241 - DNA, 16 bp, M. musculus
tagaaaatgcaagaaa

SEQ ID NO: 427242 - DNA, 16 bp, M. musculus
tagaaaattccagaaa

SEQ ID NO: 427243 - DNA, 16 bp, M. musculus
tagaaacaaaatatat

SEQ ID NO: 427244 - DNA, 16 bp, M. musculus
tagaaacacattttac

SEQ ID NO: 427245 - DNA, 16 bp, M. musculus
tagaaacagttattaa

SEQ ID NO: 427246 - DNA, 16 bp, M. musculus
tagaaacatgtccatt

SEQ ID NO: 427247 - DNA, 22 bp, M. musculus
tagaaaccctgactaagacacc

SEQ ID NO: 427248 - DNA, 22 bp, M. musculus
tagaaaccctgactaagacact

SEQ ID NO: 427249 - DNA, 16 bp, M. musculus
tagaaaccctgactat

SEQ ID NO: 427250 - DNA, 16 bp, M. musculus
tagaaactggaaataa

SEQ ID NO: 427251 - DNA, 16 bp, M. musculus
tagaaactggagctag

SEQ ID NO: 427252 - DNA, 16 bp, M. musculus
tagaaagaacacatca

SEQ ID NO: 427253 - DNA, 16 bp, M. musculus
tagaaagacagaaaga

SEQ ID NO: 427254 - DNA, 16 bp, M. musculus
tagaaagagcaagaaa

SEQ ID NO: 427255 - DNA, 16 bp, M. musculus
tagaaagagtcattaa

SEQ ID NO: 427256 - DNA, 16 bp, M. musculus
tagaaagatcaggaat

SEQ ID NO: 427257 - DNA, 16 bp, M. musculus
tagaaaggaaaacatt

SEQ ID NO: 427258 - DNA, 16 bp, M. musculus
tagaaaggcaggggga

SEQ ID NO: 427259 - DNA, 16 bp, M. musculus
tagaaagggaaatttg

SEQ ID NO: 427260 - DNA, 16 bp, M. musculus
tagaaaggtagagaga

SEQ ID NO: 427261 - DNA, 16 bp, M. musculus
tagaaagtcccagaga

SEQ ID NO: 427262 - DNA, 16 bp, M. musculus
tagaaataaaaatact

SEQ ID NO: 427263 - DNA, 16 bp, M. musculus
tagaaataaatatttg

SEQ ID NO: 427264 - DNA, 16 bp, M. musculus
tagaaatagaaaacct

SEQ ID NO: 427265 - DNA, 16 bp, M. musculus
tagaaatagttcattg

SEQ ID NO: 427266 - DNA, 16 bp, M. musculus
tagaaatcagcatctg

SEQ ID NO: 427267 - DNA, 16 bp, M. musculus
tagaaatcattaaaga

SEQ ID NO: 427268 - DNA, 16 bp, M. musculus
tagaaatcctttcatt

SEQ ID NO: 427269 - DNA, 16 bp, M. musculus
tagaaatggagaagag

SEQ ID NO: 427270 - DNA, 16 bp, M. musculus
tagaaatggagttaca

SEQ ID NO: 427271 - DNA, 16 bp, M. musculus
tagaaatgtcagagaa

SEQ ID NO: 427272 - DNA, 16 bp, M. musculus
tagaacaagaagaagc

SEQ ID NO: 427273 - DNA, 16 bp, M. musculus
tagaacaatttaataa

SEQ ID NO: 427274 - DNA, 16 bp, M. musculus
tagaacacccaaaata

SEQ ID NO: 427275 - DNA, 16 bp, M. musculus
tagaacacttgcctag

SEQ ID NO: 427276 - DNA, 16 bp, M. musculus
tagaacacttgcctgg

SEQ ID NO: 427277 - DNA, 16 bp, M. musculus
tagaacagaaccaagg

SEQ ID NO: 427278 - DNA, 16 bp, M. musculus
tagaacagagaaggaa

SEQ ID NO: 427279 - DNA, 16 bp, M. musculus
tagaacagcagtggct

SEQ ID NO: 427280 - DNA, 16 bp, M. musculus
tagaacaggctggcct

SEQ ID NO: 427281 - DNA, 16 bp, M. musculus
tagaaccaagggcctc

SEQ ID NO: 427282 - DNA, 16 bp, M. musculus
tagaacccaagactaa

SEQ ID NO: 427283 - DNA, 16 bp, M. musculus
tagaaccttcacaggg

SEQ ID NO: 427284 - DNA, 16 bp, M. musculus
tagaactagaaaatat

SEQ ID NO: 427285 - DNA, 16 bp, M. musculus
tagaactcaatgaaaa

SEQ ID NO: 427286 - DNA, 16 bp, M. musculus
tagaactcactatgta

SEQ ID NO: 427287 - DNA, 16 bp, M. musculus
tagaactcagaaattc

SEQ ID NO: 427288 - DNA, 16 bp, M. musculus
tagaactcagagattc

SEQ ID NO: 427289 - DNA, 16 bp, M. musculus
tagaactctcagctac

SEQ ID NO: 427290 - DNA, 16 bp, M. musculus
tagaactcttggcttc

SEQ ID NO: 427291 - DNA, 16 bp, M. musculus
tagaactgaagatcca

SEQ ID NO: 427292 - DNA, 16 bp, M. musculus
tagaacttgctatgta

SEQ ID NO: 427293 - DNA, 16 bp, M. musculus
tagaacttgctgtgta

SEQ ID NO: 427294 - DNA, 16 bp, M. musculus
tagaactttcaggtgt

SEQ ID NO: 427295 - DNA, 16 bp, M. musculus
tagaagaaaacttcac

SEQ ID NO: 427296 - DNA, 16 bp, M. musculus
tagaagaaaaggaagc

SEQ ID NO: 427297 - DNA, 16 bp, M. musculus
tagaagaaaatgtccc

SEQ ID NO: 427298 - DNA, 16 bp, M. musculus
tagaagaaagcaaaga

SEQ ID NO: 427299 - DNA, 16 bp, M. musculus
tagaagaacatatccc

SEQ ID NO: 427300 - DNA, 16 bp, M. musculus
tagaagaagctgaaga

SEQ ID NO: 427301 - DNA, 16 bp, M. musculus
tagaagaatgtgaata

SEQ ID NO: 427302 - DNA, 16 bp, M. musculus
tagaagaatgttgttt

SEQ ID NO: 427303 - DNA, 16 bp, M. musculus
tagaagacaaagtggg

SEQ ID NO: 427304 - DNA, 16 bp, M. musculus
tagaagacagtgaaga

SEQ ID NO: 427305 - DNA, 16 bp, M. musculus
tagaagacattaaaaa

SEQ ID NO: 427306 - DNA, 16 bp, M. musculus
tagaagacccaagata

SEQ ID NO: 427307 - DNA, 16 bp, M. musculus
tagaagactttaaaga

SEQ ID NO: 427308 - DNA, 16 bp, M. musculus
tagaagagaaagtgtg

SEQ ID NO: 427309 - DNA, 16 bp, M. musculus
tagaagagaaggtggg

SEQ ID NO: 427310 - DNA, 16 bp, M. musculus
tagaagagagctaaga

SEQ ID NO: 427311 - DNA, 16 bp, M. musculus
tagaagagagtgaaga

SEQ ID NO: 427312 - DNA, 16 bp, M. musculus
tagaagagagtgagga

SEQ ID NO: 427313 - DNA, 16 bp, M. musculus
tagaagagatagtggg

SEQ ID NO: 427314 - DNA, 16 bp, M. musculus
tagaagagcaaccagt

SEQ ID NO: 427315 - DNA, 16 bp, M. musculus
tagaagagcagtcagt

SEQ ID NO: 427316 - DNA, 16 bp, M. musculus
tagaagaggaagcaga

SEQ ID NO: 427317 - DNA, 16 bp, M. musculus
tagaagagggcaccag

SEQ ID NO: 427318 - DNA, 16 bp, M. musculus
tagaagagggcatcag

SEQ ID NO: 427319 - DNA, 16 bp, M. musculus
tagaagagttggggga

SEQ ID NO: 427320 - DNA, 16 bp, M. musculus
tagaagatgaaggcct

SEQ ID NO: 427321 - DNA, 16 bp, M. musculus
tagaagatttaaagaa

SEQ ID NO: 427322 - DNA, 16 bp, M. musculus
tagaagcagaggggag

SEQ ID NO: 427323 - DNA, 16 bp, M. musculus
tagaagcaggaagagg

SEQ ID NO: 427324 - DNA, 16 bp, M. musculus
tagaagcagggggaga

SEQ ID NO: 427325 - DNA, 16 bp, M. musculus
tagaagctgaaataaa

SEQ ID NO: 427326 - DNA, 16 bp, M. musculus
tagaagcttcatccct

SEQ ID NO: 427327 - DNA, 16 bp, M. musculus
tagaaggaaaacttca

SEQ ID NO: 427328 - DNA, 16 bp, M. musculus
tagaaggaaagaactg

SEQ ID NO: 427329 - DNA, 16 bp, M. musculus
tagaaggactaggagg

SEQ ID NO: 427330 - DNA, 16 bp, M. musculus
tagaaggagaaaactg

SEQ ID NO: 427331 - DNA, 16 bp, M. musculus
tagaaggagactcaga

SEQ ID NO: 427332 - DNA, 16 bp, M. musculus
tagaaggagagaatgg

SEQ ID NO: 427333 - DNA, 16 bp, M. musculus
tagaagggaaaacaaa

SEQ ID NO: 427334 - DNA, 16 bp, M. musculus
tagaagggaggttaaa

SEQ ID NO: 427335 - DNA, 16 bp, M. musculus
tagaaggggcaacaaa

SEQ ID NO: 427336 - DNA, 16 bp, M. musculus
tagaagggggaatgaa

SEQ ID NO: 427337 - DNA, 16 bp, M. musculus
tagaaggtgtggtctt

SEQ ID NO: 427338 - DNA, 16 bp, M. musculus
tagaagtagaagttac

SEQ ID NO: 427339 - DNA, 16 bp, M. musculus
tagaagtcagaggtca

SEQ ID NO: 427340 - DNA, 16 bp, M. musculus
tagaagttggttctct

SEQ ID NO: 427341 - DNA, 16 bp, M. musculus
tagaagtttctacttc

SEQ ID NO: 427342 - DNA, 16 bp, M. musculus
tagaagtttctagaaa

SEQ ID NO: 427343 - DNA, 16 bp, M. musculus
tagaatagaatttatt

SEQ ID NO: 427344 - DNA, 16 bp, M. musculus
tagaatagtttattta

SEQ ID NO: 427345 - DNA, 16 bp, M. musculus
tagaatataggaatct

SEQ ID NO: 427346 - DNA, 16 bp, M. musculus
tagaatatcttttttt

SEQ ID NO: 427347 - DNA, 16 bp, M. musculus
tagaatcccaaagaag

SEQ ID NO: 427348 - DNA, 16 bp, M. musculus
tagaatcttctgtgtt

SEQ ID NO: 427349 - DNA, 16 bp, M. musculus
tagaatgaatatatat

SEQ ID NO: 427350 - DNA, 16 bp, M. musculus
tagaatgcttgcctaa

SEQ ID NO: 427351 - DNA, 16 bp, M. musculus
tagaatgttagaatgt

SEQ ID NO: 427352 - DNA, 16 bp, M. musculus
tagaattacagatatg

SEQ ID NO: 427353 - DNA, 16 bp, M. musculus
tagaattagaaagagc

SEQ ID NO: 427354 - DNA, 16 bp, M. musculus
tagaattcactttgta

SEQ ID NO: 427355 - DNA, 16 bp, M. musculus
tagaattgattgcata

SEQ ID NO: 427356 - DNA, 16 bp, M. musculus
tagaatttctttttaa

SEQ ID NO: 427357 - DNA, 16 bp, M. musculus
tagaattttctagaag

SEQ ID NO: 427358 - DNA, 16 bp, M. musculus
tagaatttttaaggtc

SEQ ID NO: 427359 - DNA, 16 bp, M. musculus
tagacaaaatggtgaa

SEQ ID NO: 427360 - DNA, 16 bp, M. musculus
tagacaaagctggcct

SEQ ID NO: 427361 - DNA, 16 bp, M. musculus
tagacaaatactctac

SEQ ID NO: 427362 - DNA, 16 bp, M. musculus
tagacaaggatgacct

SEQ ID NO: 427363 - DNA, 16 bp, M. musculus
tagacaaggctggcct

SEQ ID NO: 427364 - DNA, 16 bp, M. musculus
tagacacaacagaaga

SEQ ID NO: 427365 - DNA, 16 bp, M. musculus
tagacacacagacaca

SEQ ID NO: 427366 - DNA, 16 bp, M. musculus
tagacacatgcacaca

SEQ ID NO: 427367 - DNA, 16 bp, M. musculus
tagacagaagcagctg

SEQ ID NO: 427368 - DNA, 16 bp, M. musculus
tagacagattccaggt

SEQ ID NO: 427369 - DNA, 16 bp, M. musculus
tagacagggtttctct

SEQ ID NO: 427370 - DNA, 16 bp, M. musculus
tagacagtgctgcctc

SEQ ID NO: 427371 - DNA, 16 bp, M. musculus
tagacagttgtgaact

SEQ ID NO: 427372 - DNA, 16 bp, M. musculus
tagacatcaagaaaac

SEQ ID NO: 427373 - DNA, 16 bp, M. musculus
tagacatggtggcaca

SEQ ID NO: 427374 - DNA, 16 bp, M. musculus
tagacattctgactgg

SEQ ID NO: 427375 - DNA, 16 bp, M. musculus
tagacatttattaaat

SEQ ID NO: 427376 - DNA, 16 bp, M. musculus
tagaccaaactggcct

SEQ ID NO: 427377 - DNA, 16 bp, M. musculus
tagaccaagctgacct

SEQ ID NO: 427378 - DNA, 16 bp, M. musculus
tagaccaagctgccct

SEQ ID NO: 427379 - DNA, 16 bp, M. musculus
tagaccaagctggcct

SEQ ID NO: 427380 - DNA, 16 bp, M. musculus
tagaccaagctggtct

SEQ ID NO: 427381 - DNA, 16 bp, M. musculus
tagaccaaggtggcct

SEQ ID NO: 427382 - DNA, 16 bp, M. musculus
tagaccacgctggcct

SEQ ID NO: 427383 - DNA, 16 bp, M. musculus
tagaccagactaacct

SEQ ID NO: 427384 - DNA, 16 bp, M. musculus
tagaccagactgacct

SEQ ID NO: 427385 - DNA, 16 bp, M. musculus
tagaccagactggcct

SEQ ID NO: 427386 - DNA, 16 bp, M. musculus
tagaccagactggctt

SEQ ID NO: 427387 - DNA, 16 bp, M. musculus
tagaccagactgtcct

SEQ ID NO: 427388 - DNA, 16 bp, M. musculus
tagaccagattggcct

SEQ ID NO: 427389 - DNA, 16 bp, M. musculus
tagaccagcctggcct

SEQ ID NO: 427390 - DNA, 16 bp, M. musculus
tagaccagcctggtct

SEQ ID NO: 427391 - DNA, 16 bp, M. musculus
tagaccaggaggggaa

SEQ ID NO: 427392 - DNA, 16 bp, M. musculus
tagaccaggatggtct

SEQ ID NO: 427393 - DNA, 16 bp, M. musculus
tagaccaggctaacct

SEQ ID NO: 427394 - DNA, 16 bp, M. musculus
tagaccaggctagcct

SEQ ID NO: 427395 - DNA, 16 bp, M. musculus
tagaccaggctatcct

SEQ ID NO: 427396 - DNA, 16 bp, M. musculus
tagaccaggctcagaa

SEQ ID NO: 427397 - DNA, 16 bp, M. musculus
tagaccaggctcgcct

SEQ ID NO: 427398 - DNA, 16 bp, M. musculus
tagaccaggctgcctc

SEQ ID NO: 427399 - DNA, 16 bp, M. musculus
tagaccaggctggatt

SEQ ID NO: 427400 - DNA, 16 bp, M. musculus
tagaccaggctggcca

SEQ ID NO: 427401 - DNA, 16 bp, M. musculus
tagaccaggctggccc

SEQ ID NO: 427402 - DNA, 16 bp, M. musculus
tagaccaggctggtct

SEQ ID NO: 427403 - DNA, 16 bp, M. musculus
tagaccaggctgtcct

SEQ ID NO: 427404 - DNA, 16 bp, M. musculus
tagaccaggttagcct

SEQ ID NO: 427405 - DNA, 16 bp, M. musculus
tagaccaggttggcct

SEQ ID NO: 427406 - DNA, 16 bp, M. musculus
tagaccaggttggtct

SEQ ID NO: 427407 - DNA, 16 bp, M. musculus
tagaccagtctgacct

SEQ ID NO: 427408 - DNA, 16 bp, M. musculus
tagaccatgctggcct

SEQ ID NO: 427409 - DNA, 16 bp, M. musculus
tagacccttggggctc

SEQ ID NO: 427410 - DNA, 16 bp, M. musculus
tagaccgggctggcct

SEQ ID NO: 427411 - DNA, 16 bp, M. musculus
tagacctggctggcct

SEQ ID NO: 427412 - DNA, 16 bp, M. musculus
tagactacatagtaag

SEQ ID NO: 427413 - DNA, 16 bp, M. musculus
tagactaggctagcct

SEQ ID NO: 427414 - DNA, 16 bp, M. musculus
tagactaggctggcct

SEQ ID NO: 427415 - DNA, 16 bp, M. musculus
tagactcaactgtgta

SEQ ID NO: 427416 - DNA, 16 bp, M. musculus
tagactgcctgctgag

SEQ ID NO: 427417 - DNA, 16 bp, M. musculus
tagactggctggtcag

SEQ ID NO: 427418 - DNA, 16 bp, M. musculus
tagacttctcaccaga

SEQ ID NO: 427419 - DNA, 16 bp, M. musculus
tagacttgagcttagt

SEQ ID NO: 427420 - DNA, 16 bp, M. musculus
tagactttttaaaaaa

SEQ ID NO: 427421 - DNA, 16 bp, M. musculus
tagagaaaatcaacaa

SEQ ID NO: 427422 - DNA, 16 bp, M. musculus
tagagaaaccctgtct

SEQ ID NO: 427423 - DNA, 16 bp, M. musculus
tagagaaaccttgtct

SEQ ID NO: 427424 - DNA, 16 bp, M. musculus
tagagaaagaactgaa

SEQ ID NO: 427425 - DNA, 16 bp, M. musculus
tagagaaagatgaaca

SEQ ID NO: 427426 - DNA, 16 bp, M. musculus
tagagaaagcaagaaa

SEQ ID NO: 427427 - DNA, 17 bp, M. musculus
tagagaaagcacctaag

SEQ ID NO: 427428 - DNA, 16 bp, M. musculus
tagagaaaggccactg

SEQ ID NO: 427429 - DNA, 16 bp, M. musculus
tagagaaaggcctttg

SEQ ID NO: 427430 - DNA, 16 bp, M. musculus
tagagaaagggctgaa

SEQ ID NO: 427431 - DNA, 16 bp, M. musculus
tagagaaataagacaa

SEQ ID NO: 427432 - DNA, 16 bp, M. musculus
tagagaaattacctaa

SEQ ID NO: 427433 - DNA, 16 bp, M. musculus
tagagaacaaaggctg

SEQ ID NO: 427434 - DNA, 16 bp, M. musculus
tagagaactccagacc

SEQ ID NO: 427435 - DNA, 16 bp, M. musculus
tagagaactttcggga

SEQ ID NO: 427436 - DNA, 16 bp, M. musculus
tagagaagaaagggtt

SEQ ID NO: 427437 - DNA, 16 bp, M. musculus
tagagaagagcctgag

SEQ ID NO: 427438 - DNA, 16 bp, M. musculus
tagagaagcaaaaaga

SEQ ID NO: 427439 - DNA, 16 bp, M. musculus
tagagaagccctgtct

SEQ ID NO: 427440 - DNA, 16 bp, M. musculus
tagagaatgtagccaa

SEQ ID NO: 427441 - DNA, 16 bp, M. musculus
tagagacacagctcta

SEQ ID NO: 427442 - DNA, 16 bp, M. musculus
tagagacagagagaca

SEQ ID NO: 427443 - DNA, 16 bp, M. musculus
tagagacagagagaga

SEQ ID NO: 427444 - DNA, 16 bp, M. musculus
tagagacaggcagatc

SEQ ID NO: 427445 - DNA, 16 bp, M. musculus
tagagacagttgtgag

SEQ ID NO: 427446 - DNA, 20 bp, M. musculus
tagagacctataggaatctc

SEQ ID NO: 427447 - DNA, 16 bp, M. musculus
tagagacctgtttcct

SEQ ID NO: 427448 - DNA, 16 bp, M. musculus
tagagactgccatatc

SEQ ID NO: 427449 - DNA, 26 bp, M. musculus
tagagactgccatatccagggatcca

SEQ ID NO: 427450 - DNA, 18 bp, M. musculus
tagagactgccatatccg

SEQ ID NO: 427451 - DNA, 16 bp, M. musculus
tagagagacctggtct

SEQ ID NO: 427452 - DNA, 16 bp, M. musculus
tagagagaccttatct

SEQ ID NO: 427453 - DNA, 16 bp, M. musculus
tagagagaccttgtct

SEQ ID NO: 427454 - DNA, 16 bp, M. musculus
tagagagatgactcag

SEQ ID NO: 427455 - DNA, 16 bp, M. musculus
tagagagatggctcag

SEQ ID NO: 427456 - DNA, 16 bp, M. musculus
tagagaggaaggagcc

SEQ ID NO: 427457 - DNA, 16 bp, M. musculus
tagagaggcagaggca

SEQ ID NO: 427458 - DNA, 16 bp, M. musculus
tagagaggctgaggca

SEQ ID NO: 427459 - DNA, 16 bp, M. musculus
tagagaggtctgagat

SEQ ID NO: 427460 - DNA, 16 bp, M. musculus
tagagatagagataga

SEQ ID NO: 427461 - DNA, 16 bp, M. musculus
tagagatcaaggggga

SEQ ID NO: 427462 - DNA, 16 bp, M. musculus
tagagatcagaagaca

SEQ ID NO: 427463 - DNA, 16 bp, M. musculus
tagagatctacttgcc

SEQ ID NO: 427464 - DNA, 21 bp, M. musculus
tagagatctgcctgcctctgc

SEQ ID NO: 427465 - DNA, 16 bp, M. musculus
tagagatggacccaac

SEQ ID NO: 427466 - DNA, 16 bp, M. musculus
tagagatggagcaaga

SEQ ID NO: 427467 - DNA, 46 bp, M. musculus
tagagattattgtgtcttggttcagctttttccaaattttagtatt

SEQ ID NO: 427468 - DNA, 16 bp, M. musculus
tagagcacacctccag

SEQ ID NO: 427469 - DNA, 16 bp, M. musculus
tagagcactggctgtt

SEQ ID NO: 427470 - DNA, 16 bp, M. musculus
tagagcagccagtgct

SEQ ID NO: 427471 - DNA, 16 bp, M. musculus
tagagcaggctggcct

SEQ ID NO: 427472 - DNA, 16 bp, M. musculus
tagagcatttgcctag

SEQ ID NO: 427473 - DNA, 16 bp, M. musculus
tagagcattttcttaa

SEQ ID NO: 427474 - DNA, 16 bp, M. musculus
tagagccaggcatggt

SEQ ID NO: 427475 - DNA, 16 bp, M. musculus
tagagcccaggctggc

SEQ ID NO: 427476 - DNA, 16 bp, M. musculus
tagagctgagatggaa

SEQ ID NO: 427477 - DNA, 16 bp, M. musculus
tagagctggccctgga

SEQ ID NO: 427478 - DNA, 16 bp, M. musculus
tagagctgggtgtggt

SEQ ID NO: 427479 - DNA, 16 bp, M. musculus
tagagctttgccattg

SEQ ID NO: 427480 - DNA, 16 bp, M. musculus
tagaggaagacactca

SEQ ID NO: 427481 - DNA, 16 bp, M. musculus
tagaggacagaggaca

SEQ ID NO: 427482 - DNA, 16 bp, M. musculus
tagaggacattaagaa

SEQ ID NO: 427483 - DNA, 16 bp, M. musculus
tagaggagaaagtgcg

SEQ ID NO: 427484 - DNA, 16 bp, M. musculus
tagaggaggctggcct

SEQ ID NO: 427485 - DNA, 16 bp, M. musculus
tagaggatgtggagaa

SEQ ID NO: 427486 - DNA, 16 bp, M. musculus
tagaggcagagaaagc

SEQ ID NO: 427487 - DNA, 16 bp, M. musculus
tagaggcagaggcagg

SEQ ID NO: 427488 - DNA, 16 bp, M. musculus
tagaggcaggaagatg

SEQ ID NO: 427489 - DNA, 16 bp, M. musculus
tagaggcagggggagg

SEQ ID NO: 427490 - DNA, 16 bp, M. musculus
tagaggcaggtggatc

SEQ ID NO: 427491 - DNA, 16 bp, M. musculus
tagaggctgagaaagc

SEQ ID NO: 427492 - DNA, 16 bp, M. musculus
tagaggctgaggcagg

SEQ ID NO: 427493 - DNA, 16 bp, M. musculus
tagagggcacagaaac

SEQ ID NO: 427494 - DNA, 16 bp, M. musculus
tagaggtcagaggtca

SEQ ID NO: 427495 - DNA, 17 bp, M. musculus
tagaggtcctgagttca

SEQ ID NO: 427496 - DNA, 29 bp, M. musculus
tagaggtgcacaatgctctggccactcct

SEQ ID NO: 427497 - DNA, 16 bp, M. musculus
tagagtactactcagc

SEQ ID NO: 427498 - DNA, 17 bp, M. musculus
tagagtcacagaactta

SEQ ID NO: 427499 - DNA, 16 bp, M. musculus
tagagtcatgtgtttg

SEQ ID NO: 427500 - DNA, 21 bp, M. musculus
tagagtcttcacaatgaaaca

SEQ ID NO: 427501 - DNA, 16 bp, M. musculus
tagagtgagaccctgt

SEQ ID NO: 427502 - DNA, 16 bp, M. musculus
tagagtgagttccaag

SEQ ID NO: 427503 - DNA, 16 bp, M. musculus
tagagtgagttccagg

SEQ ID NO: 427504 - DNA, 16 bp, M. musculus
tagagtgctacagagg

SEQ ID NO: 427505 - DNA, 16 bp, M. musculus
tagagtgctgttcagt

SEQ ID NO: 427506 - DNA, 16 bp, M. musculus
tagagtgcttgcctac

SEQ ID NO: 427507 - DNA, 16 bp, M. musculus
tagagtggctactcca

SEQ ID NO: 427508 - DNA, 16 bp, M. musculus
tagagtgtttgcctac

SEQ ID NO: 427509 - DNA, 16 bp, M. musculus
tagagtgtttgcctgg

SEQ ID NO: 427510 - DNA, 16 bp, M. musculus
tagagttagagatggt

SEQ ID NO: 427511 - DNA, 16 bp, M. musculus
tagagttatctgggaa

SEQ ID NO: 427512 - DNA, 16 bp, M. musculus
tagagttcaccctagg

SEQ ID NO: 427513 - DNA, 16 bp, M. musculus
tagagtttattcaggg

SEQ ID NO: 427514 - DNA, 16 bp, M. musculus
tagataatcattatcc

SEQ ID NO: 427515 - DNA, 16 bp, M. musculus
tagatacagatacaga

SEQ ID NO: 427516 - DNA, 16 bp, M. musculus
tagatagatactgttt

SEQ ID NO: 427517 - DNA, 17 bp, M. musculus
tagatagatagatagac

SEQ ID NO: 427518 - DNA, 21 bp, M. musculus
tagatagatagatagatagaa

SEQ ID NO: 427519 - DNA, 24 bp, M. musculus
tagatagatagatagatagataat

SEQ ID NO: 427520 - DNA, 29 bp, M. musculus
tagatagatagatagatagatagatatta

SEQ ID NO: 427521 - DNA, 27 bp, M. musculus
tagatagatagatagatagatagatga

SEQ ID NO: 427522 - DNA, 26 bp, M. musculus
tagatagatagatagatagatagatt

SEQ ID NO: 427523 - DNA, 18 bp, M. musculus
tagatagatagatagatc

SEQ ID NO: 427524 - DNA, 16 bp, M. musculus
tagatagatagatgta

SEQ ID NO: 427525 - DNA, 16 bp, M. musculus
tagatagatagattaa

SEQ ID NO: 427526 - DNA, 16 bp, M. musculus
tagatagatatttaga

SEQ ID NO: 427527 - DNA, 16 bp, M. musculus
tagatagatattttta

SEQ ID NO: 427528 - DNA, 16 bp, M. musculus
tagatatagacataga

SEQ ID NO: 427529 - DNA, 16 bp, M. musculus
tagatatattctttat

SEQ ID NO: 427530 - DNA, 16 bp, M. musculus
tagatatgatagctgc

SEQ ID NO: 427531 - DNA, 16 bp, M. musculus
tagatattctgtactt

SEQ ID NO: 427532 - DNA, 16 bp, M. musculus
tagatattttacaaca

SEQ ID NO: 427533 - DNA, 16 bp, M. musculus
tagatattttatttac

SEQ ID NO: 427534 - DNA, 16 bp, M. musculus
tagatcaagatgtaga

SEQ ID NO: 427535 - DNA, 16 bp, M. musculus
tagatcagactggcct

SEQ ID NO: 427536 - DNA, 16 bp, M. musculus
tagatcagcctggcct

SEQ ID NO: 427537 - DNA, 16 bp, M. musculus
tagatcaggctggcct

SEQ ID NO: 427538 - DNA, 16 bp, M. musculus
tagatcaggctgtcct

SEQ ID NO: 427539 - DNA, 27 bp, M. musculus
tagatccttggacttccattcacagct

SEQ ID NO: 427540 - DNA, 16 bp, M. musculus
tagatctaaagtcact

SEQ ID NO: 427541 - DNA, 16 bp, M. musculus
tagatctctgagttcc

SEQ ID NO: 427542 - DNA, 16 bp, M. musculus
tagatctctgagtttg

SEQ ID NO: 427543 - DNA, 16 bp, M. musculus
tagatgaaaatgaaga

SEQ ID NO: 427544 - DNA, 16 bp, M. musculus
tagatgaagaaaatgt

SEQ ID NO: 427545 - DNA, 16 bp, M. musculus
tagatgaagatgtaga

SEQ ID NO: 427546 - DNA, 16 bp, M. musculus
tagatgagaaagtggg

SEQ ID NO: 427547 - DNA, 16 bp, M. musculus
tagatgagaatgaaga

SEQ ID NO: 427548 - DNA, 16 bp, M. musculus
tagatgagaatggaga

SEQ ID NO: 427549 - DNA, 16 bp, M. musculus
tagatgaggaaactga

SEQ ID NO: 427550 - DNA, 16 bp, M. musculus
tagatgagtagtattc

SEQ ID NO: 427551 - DNA, 16 bp, M. musculus
tagatgatgatgatga

SEQ ID NO: 427552 - DNA, 16 bp, M. musculus
tagatgattgctttaa

SEQ ID NO: 427553 - DNA, 16 bp, M. musculus
tagatgcaagcatctc

SEQ ID NO: 427554 - DNA, 16 bp, M. musculus
tagatgctgaaaaatc

SEQ ID NO: 427555 - DNA, 16 bp, M. musculus
tagatggaattagaaa

SEQ ID NO: 427556 - DNA, 16 bp, M. musculus
tagatggtaggtaggt

SEQ ID NO: 427557 - DNA, 16 bp, M. musculus
tagatgtagatagata

SEQ ID NO: 427558 - DNA, 16 bp, M. musculus
tagatgtggaagatgg

SEQ ID NO: 427559 - DNA, 16 bp, M. musculus
tagatgttatacagac

SEQ ID NO: 427560 - DNA, 16 bp, M. musculus
tagattaatattatct

SEQ ID NO: 427561 - DNA, 16 bp, M. musculus
tagattacttataata

SEQ ID NO: 427562 - DNA, 16 bp, M. musculus
tagattcccccagaaa

SEQ ID NO: 427563 - DNA, 16 bp, M. musculus
tagattcctgtctgca

SEQ ID NO: 427564 - DNA, 33 bp, M. musculus
tagattctccttgctgggatgtcctattttcac

SEQ ID NO: 427565 - DNA, 16 bp, M. musculus
tagattgaaccagaaa

SEQ ID NO: 427566 - DNA, 16 bp, M. musculus
tagattgcttttaaca

SEQ ID NO: 427567 - DNA, 16 bp, M. musculus
tagattgcttttgcaa

SEQ ID NO: 427568 - DNA, 32 bp, M. musculus
tagattgcttttggcaagatagccatttttac

SEQ ID NO: 427569 - DNA, 16 bp, M. musculus
tagatttctgagttcg

SEQ ID NO: 427570 - DNA, 16 bp, M. musculus
tagatttggttttgtc

SEQ ID NO: 427571 - DNA, 16 bp, M. musculus
tagattttctttaaaa

SEQ ID NO: 427572 - DNA, 16 bp, M. musculus
tagattttgtcagttg

SEQ ID NO: 427573 - DNA, 16 bp, M. musculus
tagatttttcaaagcc

SEQ ID NO: 427574 - DNA, 16 bp, M. musculus
tagatttttttccatt

SEQ ID NO: 427575 - DNA, 16 bp, M. musculus
tagcaaacacataact

SEQ ID NO: 427576 - DNA, 16 bp, M. musculus
tagcaaaggactgcct

SEQ ID NO: 427577 - DNA, 16 bp, M. musculus
tagcaaatgcttttaa

SEQ ID NO: 427578 - DNA, 16 bp, M. musculus
tagcaaattccaggcc

SEQ ID NO: 427579 - DNA, 16 bp, M. musculus
tagcaacaaaaacaat

SEQ ID NO: 427580 - DNA, 16 bp, M. musculus
tagcaacaaaaataat

SEQ ID NO: 427581 - DNA, 16 bp, M. musculus
tagcaacaatcaagct

SEQ ID NO: 427582 - DNA, 16 bp, M. musculus
tagcaacacccatgat

SEQ ID NO: 427583 - DNA, 16 bp, M. musculus
tagcaacagcagcagc

SEQ ID NO: 427584 - DNA, 16 bp, M. musculus
tagcaaccaaggagca

SEQ ID NO: 427585 - DNA, 16 bp, M. musculus
tagcaagaaaaagctg

SEQ ID NO: 427586 - DNA, 16 bp, M. musculus
tagcaagaaactggaa

SEQ ID NO: 427587 - DNA, 16 bp, M. musculus
tagcaagaactcttct

SEQ ID NO: 427588 - DNA, 16 bp, M. musculus
tagcaagatttttttt

SEQ ID NO: 427589 - DNA, 16 bp, M. musculus
tagcaagcactctacc

SEQ ID NO: 427590 - DNA, 36 bp, M. musculus
tagcaagcccaaggccctgggttcggtcctcagctc

SEQ ID NO: 427591 - DNA, 16 bp, M. musculus
tagcaaggatgtggag

SEQ ID NO: 427592 - DNA, 16 bp, M. musculus
tagcaagggagaggga

SEQ ID NO: 427593 - DNA, 16 bp, M. musculus
tagcaagtgggaactt

SEQ ID NO: 427594 - DNA, 16 bp, M. musculus
tagcaagttccaggtc

SEQ ID NO: 427595 - DNA, 16 bp, M. musculus
tagcaatttggaacta

SEQ ID NO: 427596 - DNA, 16 bp, M. musculus
tagcacaagctggcct

SEQ ID NO: 427597 - DNA, 20 bp, M. musculus
tagcacaagtcgaaaggctt

SEQ ID NO: 427598 - DNA, 16 bp, M. musculus
tagcacacaggaagcc

SEQ ID NO: 427599 - DNA, 16 bp, M. musculus
tagcacactcctttaa

SEQ ID NO: 427600 - DNA, 16 bp, M. musculus
tagcacagtggttctc

SEQ ID NO: 427601 - DNA, 16 bp, M. musculus
tagcacatgcctttaa

SEQ ID NO: 427602 - DNA, 16 bp, M. musculus
tagcactctccttggt

SEQ ID NO: 427603 - DNA, 16 bp, M. musculus
tagcactgaaggaaaa

SEQ ID NO: 427604 - DNA, 16 bp, M. musculus
tagcacttaggaagct

SEQ ID NO: 427605 - DNA, 16 bp, M. musculus
tagcagaacactgact

SEQ ID NO: 427606 - DNA, 16 bp, M. musculus
tagcagaactgacagc

SEQ ID NO: 427607 - DNA, 16 bp, M. musculus
tagcagaagatagcct

SEQ ID NO: 427608 - DNA, 16 bp, M. musculus
tagcagacagaggcag

SEQ ID NO: 427609 - DNA, 16 bp, M. musculus
tagcagagcctcacag

SEQ ID NO: 427610 - DNA, 16 bp, M. musculus
tagcagaggatagcct

SEQ ID NO: 427611 - DNA, 16 bp, M. musculus
tagcagatgctggtga

SEQ ID NO: 427612 - DNA, 16 bp, M. musculus
tagcagatgtgcagct

SEQ ID NO: 427613 - DNA, 16 bp, M. musculus
tagcagcagcagcaac

SEQ ID NO: 427614 - DNA, 16 bp, M. musculus
tagcagcagcagcagc

SEQ ID NO: 427615 - DNA, 20 bp, M. musculus
tagcagcagcagcagcagta

SEQ ID NO: 427616 - DNA, 16 bp, M. musculus
tagcagcagcagtggc

SEQ ID NO: 427617 - DNA, 16 bp, M. musculus
tagcagcagtagcagc

SEQ ID NO: 427618 - DNA, 17 bp, M. musculus
tagcagccttcagatga

SEQ ID NO: 427619 - DNA, 16 bp, M. musculus
tagcagctttattcac

SEQ ID NO: 427620 - DNA, 16 bp, M. musculus
tagcaggaatctttcc

SEQ ID NO: 427621 - DNA, 16 bp, M. musculus
tagcaggagccatgga

SEQ ID NO: 427622 - DNA, 16 bp, M. musculus
tagcaggtgtgcagct

SEQ ID NO: 427623 - DNA, 16 bp, M. musculus
tagcagtagcagcagc

SEQ ID NO: 427624 - DNA, 25 bp, M. musculus
tagcagttattgtcacacagcactg

SEQ ID NO: 427625 - DNA, 16 bp, M. musculus
tagcatactttcaaat

SEQ ID NO: 427626 - DNA, 16 bp, M. musculus
tagcatatgcctttaa

SEQ ID NO: 427627 - DNA, 16 bp, M. musculus
tagcatcccttccaag

SEQ ID NO: 427628 - DNA, 16 bp, M. musculus
tagcatgagggtctta

SEQ ID NO: 427629 - DNA, 16 bp, M. musculus
tagcatggtggcacat

SEQ ID NO: 427630 - DNA, 16 bp, M. musculus
tagcatgtatgaggcc

SEQ ID NO: 427631 - DNA, 16 bp, M. musculus
tagcatgtctgttggt

SEQ ID NO: 427632 - DNA, 16 bp, M. musculus
tagcattattattatt

SEQ ID NO: 427633 - DNA, 16 bp, M. musculus
tagcattggtttctgt

SEQ ID NO: 427634 - DNA, 16 bp, M. musculus
tagcatttattttatt

SEQ ID NO: 427635 - DNA, 16 bp, M. musculus
tagcatttgaaatgaa

SEQ ID NO: 427636 - DNA, 16 bp, M. musculus
tagcattttaaatgta

SEQ ID NO: 427637 - DNA, 16 bp, M. musculus
tagcattttctttctt

SEQ ID NO: 427638 - DNA, 17 bp, M. musculus
tagccaaactaactaaa

SEQ ID NO: 427639 - DNA, 16 bp, M. musculus
tagccaaactaagtaa

SEQ ID NO: 427640 - DNA, 16 bp, M. musculus
tagccaagaagatcct

SEQ ID NO: 427641 - DNA, 16 bp, M. musculus
tagccaaggatagcct

SEQ ID NO: 427642 - DNA, 16 bp, M. musculus
tagccaaggctacaca

SEQ ID NO: 427643 - DNA, 16 bp, M. musculus
tagccaaggctggtct

SEQ ID NO: 427644 - DNA, 16 bp, M. musculus
tagccaagggtgacct

SEQ ID NO: 427645 - DNA, 16 bp, M. musculus
tagccacaggttcttg

SEQ ID NO: 427646 - DNA, 16 bp, M. musculus
tagccactgggccatc

SEQ ID NO: 427647 - DNA, 17 bp, M. musculus
tagccagagctacatag

SEQ ID NO: 427648 - DNA, 16 bp, M. musculus
tagccagaggctggaa

SEQ ID NO: 427649 - DNA, 16 bp, M. musculus
tagccagcctctgcct

SEQ ID NO: 427650 - DNA, 16 bp, M. musculus
tagccaggagctggaa

SEQ ID NO: 427651 - DNA, 16 bp, M. musculus
tagccagggctacata

SEQ ID NO: 427652 - DNA, 16 bp, M. musculus
tagccagggcttcaca

SEQ ID NO: 427653 - DNA, 16 bp, M. musculus
tagccaggtatgctcc

SEQ ID NO: 427654 - DNA, 16 bp, M. musculus
tagccaggtggtggtg

SEQ ID NO: 427655 - DNA, 16 bp, M. musculus
tagccagtacaccatc

SEQ ID NO: 427656 - DNA, 16 bp, M. musculus
tagccagtgctcttaa

SEQ ID NO: 427657 - DNA, 16 bp, M. musculus
tagccatcaagaaaat

SEQ ID NO: 427658 - DNA, 16 bp, M. musculus
tagccatcaaggaaat

SEQ ID NO: 427659 - DNA, 16 bp, M. musculus
tagccattctaattgg

SEQ ID NO: 427660 - DNA, 16 bp, M. musculus
tagcccaagctggtct

SEQ ID NO: 427661 - DNA, 16 bp, M. musculus
tagcccaatctggcct

SEQ ID NO: 427662 - DNA, 16 bp, M. musculus
tagcccagactggcct

SEQ ID NO: 427663 - DNA, 16 bp, M. musculus
tagcccagcccagccc

SEQ ID NO: 427664 - DNA, 16 bp, M. musculus
tagcccagcctagcct

SEQ ID NO: 427665 - DNA, 16 bp, M. musculus
tagcccagcctggcct

SEQ ID NO: 427666 - DNA, 16 bp, M. musculus
tagcccaggataacct

SEQ ID NO: 427667 - DNA, 16 bp, M. musculus
tagcccaggctaacct

SEQ ID NO: 427668 - DNA, 16 bp, M. musculus
tagcccaggctaccct

SEQ ID NO: 427669 - DNA, 16 bp, M. musculus
tagcccaggctagcct

SEQ ID NO: 427670 - DNA, 16 bp, M. musculus
tagcccaggctagctg

SEQ ID NO: 427671 - DNA, 16 bp, M. musculus
tagcccaggctagctt

SEQ ID NO: 427672 - DNA, 16 bp, M. musculus
tagcccaggctcacct

SEQ ID NO: 427673 - DNA, 16 bp, M. musculus
tagcccaggctgatct

SEQ ID NO: 427674 - DNA, 16 bp, M. musculus
tagcccaggctggccc

SEQ ID NO: 427675 - DNA, 16 bp, M. musculus
tagcccaggctggcct

SEQ ID NO: 427676 - DNA, 16 bp, M. musculus
tagcccaggctggctt

SEQ ID NO: 427677 - DNA, 16 bp, M. musculus
tagcccaggctggtct

SEQ ID NO: 427678 - DNA, 16 bp, M. musculus
tagcccaggggctggg

SEQ ID NO: 427679 - DNA, 16 bp, M. musculus
tagcccagggtgacct

SEQ ID NO: 427680 - DNA, 16 bp, M. musculus
tagcccaggttggcct

SEQ ID NO: 427681 - DNA, 16 bp, M. musculus
tagcccagtctggcct

SEQ ID NO: 427682 - DNA, 16 bp, M. musculus
tagcccatgctgacct

SEQ ID NO: 427683 - DNA, 16 bp, M. musculus
tagcccatgctggcct

SEQ ID NO: 427684 - DNA, 16 bp, M. musculus
tagccccagctggcct

SEQ ID NO: 427685 - DNA, 16 bp, M. musculus
tagccccccccccaaa

SEQ ID NO: 427686 - DNA, 16 bp, M. musculus
tagccctacagagact

SEQ ID NO: 427687 - DNA, 16 bp, M. musculus
tagccctagctgtctt

SEQ ID NO: 427688 - DNA, 16 bp, M. musculus
tagccctctactggat

SEQ ID NO: 427689 - DNA, 16 bp, M. musculus
tagccctcttttggat

SEQ ID NO: 427690 - DNA, 16 bp, M. musculus
tagccctgacattccc

SEQ ID NO: 427691 - DNA, 16 bp, M. musculus
tagccctgactggcct

SEQ ID NO: 427692 - DNA, 16 bp, M. musculus
tagccctgactgtctt

SEQ ID NO: 427693 - DNA, 16 bp, M. musculus
tagccctgcctgtcct

SEQ ID NO: 427694 - DNA, 16 bp, M. musculus
tagccctggagctaat

SEQ ID NO: 427695 - DNA, 16 bp, M. musculus
tagccctggccatcct

SEQ ID NO: 427696 - DNA, 16 bp, M. musculus
tagccctggctgccct

SEQ ID NO: 427697 - DNA, 16 bp, M. musculus
tagccctggctgcctt

SEQ ID NO: 427698 - DNA, 16 bp, M. musculus
tagccctggctggcct

SEQ ID NO: 427699 - DNA, 16 bp, M. musculus
tagccctggctgtact

SEQ ID NO: 427700 - DNA, 16 bp, M. musculus
tagccctggctgtccc

SEQ ID NO: 427701 - DNA, 22 bp, M. musculus
tagccctggctgtcctggcact

SEQ ID NO: 427702 - DNA, 16 bp, M. musculus
tagccctggctgttgt

SEQ ID NO: 427703 - DNA, 16 bp, M. musculus
tagccctggttgtctt

SEQ ID NO: 427704 - DNA, 16 bp, M. musculus
tagcccttcttgtcct

SEQ ID NO: 427705 - DNA, 16 bp, M. musculus
tagcctaggctgtcct

SEQ ID NO: 427706 - DNA, 16 bp, M. musculus
tagcctatttgtcaaa

SEQ ID NO: 427707 - DNA, 16 bp, M. musculus
tagcctcatgggatat

SEQ ID NO: 427708 - DNA, 16 bp, M. musculus
tagcctcggctggcat

SEQ ID NO: 427709 - DNA, 16 bp, M. musculus
tagcctctcccaggga

SEQ ID NO: 427710 - DNA, 16 bp, M. musculus
tagcctctgagggcac

SEQ ID NO: 427711 - DNA, 17 bp, M. musculus
tagcctctggtactaca

SEQ ID NO: 427712 - DNA, 16 bp, M. musculus
tagcctctgtcagcca

SEQ ID NO: 427713 - DNA, 16 bp, M. musculus
tagcctggaatttgct

SEQ ID NO: 427714 - DNA, 16 bp, M. musculus
tagcctggcagtggtg

SEQ ID NO: 427715 - DNA, 18 bp, M. musculus
tagcctgggctacatagc

SEQ ID NO: 427716 - DNA, 16 bp, M. musculus
tagcctggtctacaga

SEQ ID NO: 427717 - DNA, 16 bp, M. musculus
tagcctggtctacata

SEQ ID NO: 427718 - DNA, 16 bp, M. musculus
tagcctggtggtggtg

SEQ ID NO: 427719 - DNA, 16 bp, M. musculus
tagcctggtgtacaca

SEQ ID NO: 427720 - DNA, 16 bp, M. musculus
tagcctgtgtcaaatt

SEQ ID NO: 427721 - DNA, 16 bp, M. musculus
tagcctgtgtcaagtt

SEQ ID NO: 427722 - DNA, 16 bp, M. musculus
tagcctgttctacata

SEQ ID NO: 427723 - DNA, 16 bp, M. musculus
tagccttgaactcaca

SEQ ID NO: 427724 - DNA, 16 bp, M. musculus
tagccttgaactcaga

SEQ ID NO: 427725 - DNA, 16 bp, M. musculus
tagccttgaactcatt

SEQ ID NO: 427726 - DNA, 16 bp, M. musculus
tagccttgaactcttg

SEQ ID NO: 427727 - DNA, 16 bp, M. musculus
tagccttgaacttgca

SEQ ID NO: 427728 - DNA, 16 bp, M. musculus
tagccttgactgtcct

SEQ ID NO: 427729 - DNA, 16 bp, M. musculus
tagccttggatgactg

SEQ ID NO: 427730 - DNA, 16 bp, M. musculus
tagccttggtttctat

SEQ ID NO: 427731 - DNA, 16 bp, M. musculus
tagcctttgctgtcct

SEQ ID NO: 427732 - DNA, 17 bp, M. musculus
tagcggccttcagatga

SEQ ID NO: 427733 - DNA, 17 bp, M. musculus
tagctaacatacaccat

SEQ ID NO: 427734 - DNA, 16 bp, M. musculus
tagctaagacttcaag

SEQ ID NO: 427735 - DNA, 16 bp, M. musculus
tagctacagttccagg

SEQ ID NO: 427736 - DNA, 16 bp, M. musculus
tagctaggaaatgaaa

SEQ ID NO: 427737 - DNA, 16 bp, M. musculus
tagctagggctacata

SEQ ID NO: 427738 - DNA, 16 bp, M. musculus
tagctatatcaggctt

SEQ ID NO: 427739 - DNA, 16 bp, M. musculus
tagctatcacaaataa

SEQ ID NO: 427740 - DNA, 16 bp, M. musculus
tagctatcttcagaca

SEQ ID NO: 427741 - DNA, 16 bp, M. musculus
tagctatgaatatcat

SEQ ID NO: 427742 - DNA, 16 bp, M. musculus
tagctattgtgactag

SEQ ID NO: 427743 - DNA, 16 bp, M. musculus
tagctcacaaccatcc

SEQ ID NO: 427744 - DNA, 16 bp, M. musculus
tagctcagactggtct

SEQ ID NO: 427745 - DNA, 16 bp, M. musculus
tagctcaggatgacct

SEQ ID NO: 427746 - DNA, 16 bp, M. musculus
tagctcaggctagcct

SEQ ID NO: 427747 - DNA, 16 bp, M. musculus
tagctcaggttagcct

SEQ ID NO: 427748 - DNA, 16 bp, M. musculus
tagctcaggttggcct

SEQ ID NO: 427749 - DNA, 16 bp, M. musculus
tagctcagtgatagag

SEQ ID NO: 427750 - DNA, 16 bp, M. musculus
tagctcagtgattaaa

SEQ ID NO: 427751 - DNA, 16 bp, M. musculus
tagctcagtggcagag

SEQ ID NO: 427752 - DNA, 16 bp, M. musculus
tagctcagtggtagag

SEQ ID NO: 427753 - DNA, 16 bp, M. musculus
tagctcagtggtggag

SEQ ID NO: 427754 - DNA, 16 bp, M. musculus
tagctcagttggtaaa

SEQ ID NO: 427755 - DNA, 16 bp, M. musculus
tagctcagttggtaga

SEQ ID NO: 427756 - DNA, 16 bp, M. musculus
tagctcagttgtagag

SEQ ID NO: 427757 - DNA, 16 bp, M. musculus
tagctccagatacata

SEQ ID NO: 427758 - DNA, 16 bp, M. musculus
tagctcccttctcaaa

SEQ ID NO: 427759 - DNA, 16 bp, M. musculus
tagctcccttttcaaa

SEQ ID NO: 427760 - DNA, 16 bp, M. musculus
tagctcctccagcacc

SEQ ID NO: 427761 - DNA, 16 bp, M. musculus
tagctcctgaaaagat

SEQ ID NO: 427762 - DNA, 16 bp, M. musculus
tagctccttagctagg

SEQ ID NO: 427763 - DNA, 16 bp, M. musculus
tagctctaatagaaga

SEQ ID NO: 427764 - DNA, 23 bp, M. musculus
tagctctgaagcaggtgaagaat

SEQ ID NO: 427765 - DNA, 28 bp, M. musculus
tagctctgaagggtctactagtgacagc

SEQ ID NO: 427766 - DNA, 16 bp, M. musculus
tagctctgactggcct

SEQ ID NO: 427767 - DNA, 16 bp, M. musculus
tagctctgagctccat

SEQ ID NO: 427768 - DNA, 16 bp, M. musculus
tagctctggccatcct

SEQ ID NO: 427769 - DNA, 16 bp, M. musculus
tagctctggctgccct

SEQ ID NO: 427770 - DNA, 16 bp, M. musculus
tagctctggctgtccc

SEQ ID NO: 427771 - DNA, 16 bp, M. musculus
tagctgaagagctatt

SEQ ID NO: 427772 - DNA, 16 bp, M. musculus
tagctgaagatgactt

SEQ ID NO: 427773 - DNA, 16 bp, M. musculus
tagctgaagatggcct

SEQ ID NO: 427774 - DNA, 16 bp, M. musculus
tagctgagacaaaagg

SEQ ID NO: 427775 - DNA, 16 bp, M. musculus
tagctgagagtgacct

SEQ ID NO: 427776 - DNA, 16 bp, M. musculus
tagctgagctggtcag

SEQ ID NO: 427777 - DNA, 16 bp, M. musculus
tagctgaggataacct

SEQ ID NO: 427778 - DNA, 16 bp, M. musculus
tagctgaggctagcct

SEQ ID NO: 427779 - DNA, 16 bp, M. musculus
tagctgaggtgggaag

SEQ ID NO: 427780 - DNA, 24 bp, M. musculus
tagctgcatatgtatcagaagatg

SEQ ID NO: 427781 - DNA, 16 bp, M. musculus
tagctgccctggaact

SEQ ID NO: 427782 - DNA, 16 bp, M. musculus
tagctgccttcagata

SEQ ID NO: 427783 - DNA, 16 bp, M. musculus
tagctgccttgagagg

SEQ ID NO: 427784 - DNA, 16 bp, M. musculus
tagctgctgggagagg

SEQ ID NO: 427785 - DNA, 16 bp, M. musculus
tagctggaattacagg

SEQ ID NO: 427786 - DNA, 16 bp, M. musculus
tagctggactgcagcc

SEQ ID NO: 427787 - DNA, 16 bp, M. musculus
tagctggagagagttg

SEQ ID NO: 427788 - DNA, 16 bp, M. musculus
tagctggatatacaat

SEQ ID NO: 427789 - DNA, 16 bp, M. musculus
tagctgggattacagg

SEQ ID NO: 427790 - DNA, 16 bp, M. musculus
tagctgggcagaagag

SEQ ID NO: 427791 - DNA, 16 bp, M. musculus
tagctgggcagactct

SEQ ID NO: 427792 - DNA, 16 bp, M. musculus
tagctggggatgaaga

SEQ ID NO: 427793 - DNA, 16 bp, M. musculus
tagctgggtcttcatg

SEQ ID NO: 427794 - DNA, 16 bp, M. musculus
tagctgggtgtggtgg

SEQ ID NO: 427795 - DNA, 16 bp, M. musculus
tagctgtaaagtaaag

SEQ ID NO: 427796 - DNA, 16 bp, M. musculus
tagctgtcctagaact

SEQ ID NO: 427797 - DNA, 16 bp, M. musculus
tagctgtcctctgaga

SEQ ID NO: 427798 - DNA, 16 bp, M. musculus
tagctgtctcctcaga

SEQ ID NO: 427799 - DNA, 16 bp, M. musculus
tagctgtctctgtgag

SEQ ID NO: 427800 - DNA, 17 bp, M. musculus
tagctgtctcttgtgag

SEQ ID NO: 427801 - DNA, 18 bp, M. musculus
tagctgtcttcagacacc

SEQ ID NO: 427802 - DNA, 16 bp, M. musculus
tagctgtcttggaact

SEQ ID NO: 427803 - DNA, 16 bp, M. musculus
tagctgtgtggccttg

SEQ ID NO: 427804 - DNA, 16 bp, M. musculus
tagctgttaagtaaag

SEQ ID NO: 427805 - DNA, 16 bp, M. musculus
tagctgttctgactgg

SEQ ID NO: 427806 - DNA, 16 bp, M. musculus
tagcttagcttagctt

SEQ ID NO: 427807 - DNA, 16 bp, M. musculus
tagcttagtggtagag

SEQ ID NO: 427808 - DNA, 16 bp, M. musculus
tagcttccctgtcatt

SEQ ID NO: 427809 - DNA, 16 bp, M. musculus
tagcttcctcttttcc

SEQ ID NO: 427810 - DNA, 16 bp, M. musculus
tagcttcctgagttct

SEQ ID NO: 427811 - DNA, 16 bp, M. musculus
tagcttctgatattac

SEQ ID NO: 427812 - DNA, 16 bp, M. musculus
tagcttctgtagtcca

SEQ ID NO: 427813 - DNA, 16 bp, M. musculus
tagcttgctaagcctg

SEQ ID NO: 427814 - DNA, 16 bp, M. musculus
tagctttagctgtcct

SEQ ID NO: 427815 - DNA, 16 bp, M. musculus
tagctttatgttttct

SEQ ID NO: 427816 - DNA, 16 bp, M. musculus
tagctttctcttgtga

SEQ ID NO: 427817 - DNA, 16 bp, M. musculus
tagctttgactgtcct

SEQ ID NO: 427818 - DNA, 16 bp, M. musculus
tagctttggctggcct

SEQ ID NO: 427819 - DNA, 16 bp, M. musculus
tagctttggctttcct

SEQ ID NO: 427820 - DNA, 16 bp, M. musculus
tagctttgggaagttt

SEQ ID NO: 427821 - DNA, 16 bp, M. musculus
tagcttttagaatttt

SEQ ID NO: 427822 - DNA, 17 bp, M. musculus
tagcttttattagagaa

SEQ ID NO: 427823 - DNA, 16 bp, M. musculus
taggaaaaaaaatcat

SEQ ID NO: 427824 - DNA, 16 bp, M. musculus
taggaaaaaaaattca

SEQ ID NO: 427825 - DNA, 16 bp, M. musculus
taggaaaaaacagcaa

SEQ ID NO: 427826 - DNA, 16 bp, M. musculus
taggaaaacaggaaaa

SEQ ID NO: 427827 - DNA, 16 bp, M. musculus
taggaaaatggatgga

SEQ ID NO: 427828 - DNA, 16 bp, M. musculus
taggaaacagctatat

SEQ ID NO: 427829 - DNA, 16 bp, M. musculus
taggaaactctacaag

SEQ ID NO: 427830 - DNA, 16 bp, M. musculus
taggaaagaaacctgg

SEQ ID NO: 427831 - DNA, 16 bp, M. musculus
taggaaagaaagaaca

SEQ ID NO: 427832 - DNA, 16 bp, M. musculus
taggaaaggctgaaag

SEQ ID NO: 427833 - DNA, 16 bp, M. musculus
taggaaaggggataga

SEQ ID NO: 427834 - DNA, 16 bp, M. musculus
taggaaccaaactctg

SEQ ID NO: 427835 - DNA, 16 bp, M. musculus
taggaactgaatccag

SEQ ID NO: 427836 - DNA, 16 bp, M. musculus
taggaagaaacaagct

SEQ ID NO: 427837 - DNA, 16 bp, M. musculus
taggaagaaagtttta

SEQ ID NO: 427838 - DNA, 16 bp, M. musculus
taggaagagaggcccc

SEQ ID NO: 427839 - DNA, 16 bp, M. musculus
taggaagagtttcttt

SEQ ID NO: 427840 - DNA, 16 bp, M. musculus
taggaagatccacctt

SEQ ID NO: 427841 - DNA, 16 bp, M. musculus
taggaaggttgagaag

SEQ ID NO: 427842 - DNA, 16 bp, M. musculus
taggaagtgtggcttt

SEQ ID NO: 427843 - DNA, 16 bp, M. musculus
taggaatatgaaagac

SEQ ID NO: 427844 - DNA, 16 bp, M. musculus
taggaatatgtttttg

SEQ ID NO: 427845 - DNA, 16 bp, M. musculus
taggaatggcccccat

SEQ ID NO: 427846 - DNA, 16 bp, M. musculus
taggaatgttgagaac

SEQ ID NO: 427847 - DNA, 16 bp, M. musculus
taggaatttttttctt

SEQ ID NO: 427848 - DNA, 16 bp, M. musculus
taggacaagctaataa

SEQ ID NO: 427849 - DNA, 16 bp, M. musculus
taggacagccaaggct

SEQ ID NO: 427850 - DNA, 16 bp, M. musculus
taggacagccagggat

SEQ ID NO: 427851 - DNA, 16 bp, M. musculus
taggacagccagggct

SEQ ID NO: 427852 - DNA, 16 bp, M. musculus
taggaccaccactgct

SEQ ID NO: 427853 - DNA, 17 bp, M. musculus
taggaccaccagcccag

SEQ ID NO: 427854 - DNA, 16 bp, M. musculus
taggaccaccagccta

SEQ ID NO: 427855 - DNA, 16 bp, M. musculus
taggaccatctctggg

SEQ ID NO: 427856 - DNA, 18 bp, M. musculus
taggacctctggtgagtg

SEQ ID NO: 427857 - DNA, 16 bp, M. musculus
taggactacacagaga

SEQ ID NO: 427858 - DNA, 16 bp, M. musculus
taggactttgaacaaa

SEQ ID NO: 427859 - DNA, 16 bp, M. musculus
taggagaagactggct

SEQ ID NO: 427860 - DNA, 16 bp, M. musculus
taggagctggggagat

SEQ ID NO: 427861 - DNA, 29 bp, M. musculus
taggagcttggaagataatgttgagaaca

SEQ ID NO: 427862 - DNA, 16 bp, M. musculus
taggaggagagaccct

SEQ ID NO: 427863 - DNA, 16 bp, M. musculus
taggaggcagagacaa

SEQ ID NO: 427864 - DNA, 16 bp, M. musculus
taggaggcagaggtag

SEQ ID NO: 427865 - DNA, 16 bp, M. musculus
taggaggccaaggcag

SEQ ID NO: 427866 - DNA, 16 bp, M. musculus
taggaggccagaagag

SEQ ID NO: 427867 - DNA, 16 bp, M. musculus
taggagtcagaggcag

SEQ ID NO: 427868 - DNA, 16 bp, M. musculus
taggagtgctgggatt

SEQ ID NO: 427869 - DNA, 16 bp, M. musculus
taggagtgggtaggta

SEQ ID NO: 427870 - DNA, 16 bp, M. musculus
taggagtgtagctcag

SEQ ID NO: 427871 - DNA, 16 bp, M. musculus
taggagttgatgagaa

SEQ ID NO: 427872 - DNA, 16 bp, M. musculus
taggatagataaagat

SEQ ID NO: 427873 - DNA, 16 bp, M. musculus
taggatatctgatatg

SEQ ID NO: 427874 - DNA, 16 bp, M. musculus
taggatctcatgtagc

SEQ ID NO: 427875 - DNA, 16 bp, M. musculus
taggatcttatataca

SEQ ID NO: 427876 - DNA, 16 bp, M. musculus
taggatgagggtctta

SEQ ID NO: 427877 - DNA, 16 bp, M. musculus
taggatgatgttggct

SEQ ID NO: 427878 - DNA, 16 bp, M. musculus
taggattaaaggcgta

SEQ ID NO: 427879 - DNA, 16 bp, M. musculus
taggattacaggcata

SEQ ID NO: 427880 - DNA, 16 bp, M. musculus
taggattacaggcctg

SEQ ID NO: 427881 - DNA, 16 bp, M. musculus
taggattttccctgtc

SEQ ID NO: 427882 - DNA, 16 bp, M. musculus
taggcaaaggccttct

SEQ ID NO: 427883 - DNA, 16 bp, M. musculus
taggcaagccagatta

SEQ ID NO: 427884 - DNA, 31 bp, M. musculus
taggcacagttcattggctcaggactacatt

SEQ ID NO: 427885 - DNA, 16 bp, M. musculus
taggcagatctctgag

SEQ ID NO: 427886 - DNA, 16 bp, M. musculus
taggcagatctctgtg

SEQ ID NO: 427887 - DNA, 16 bp, M. musculus
taggcagatgctctac

SEQ ID NO: 427888 - DNA, 16 bp, M. musculus
taggcaggcagacaga

SEQ ID NO: 427889 - DNA, 16 bp, M. musculus
taggcatctttattca

SEQ ID NO: 427890 - DNA, 16 bp, M. musculus
taggccacacctactc

SEQ ID NO: 427891 - DNA, 16 bp, M. musculus
taggccagaagagggc

SEQ ID NO: 427892 - DNA, 16 bp, M. musculus
taggccagccaggact

SEQ ID NO: 427893 - DNA, 16 bp, M. musculus
taggccagcctggcta

SEQ ID NO: 427894 - DNA, 16 bp, M. musculus
taggccagctagggct

SEQ ID NO: 427895 - DNA, 16 bp, M. musculus
taggccaggctggcct

SEQ ID NO: 427896 - DNA, 16 bp, M. musculus
taggccatattgaacc

SEQ ID NO: 427897 - DNA, 16 bp, M. musculus
taggccatgtgcttct

SEQ ID NO: 427898 - DNA, 16 bp, M. musculus
taggcccaggtgtggt

SEQ ID NO: 427899 - DNA, 16 bp, M. musculus
taggcccagtgtccca

SEQ ID NO: 427900 - DNA, 16 bp, M. musculus
taggcctgatcatgct

SEQ ID NO: 427901 - DNA, 16 bp, M. musculus
taggctacatgaaacc

SEQ ID NO: 427902 - DNA, 16 bp, M. musculus
taggctaggctggcca

SEQ ID NO: 427903 - DNA, 16 bp, M. musculus
taggctcaagacagag

SEQ ID NO: 427904 - DNA, 16 bp, M. musculus
taggctcaaggtgctc

SEQ ID NO: 427905 - DNA, 16 bp, M. musculus
taggctcacaaccaaa

SEQ ID NO: 427906 - DNA, 16 bp, M. musculus
taggctccaccggcac

SEQ ID NO: 427907 - DNA, 16 bp, M. musculus
taggctctgccccaca

SEQ ID NO: 427908 - DNA, 16 bp, M. musculus
taggctgacctcaaac

SEQ ID NO: 427909 - DNA, 16 bp, M. musculus
taggctgaccttgaac

SEQ ID NO: 427910 - DNA, 16 bp, M. musculus
taggctgagcaagcca

SEQ ID NO: 427911 - DNA, 16 bp, M. musculus
taggctggcctagaat

SEQ ID NO: 427912 - DNA, 20 bp, M. musculus
taggctggcctcaaactcaa

SEQ ID NO: 427913 - DNA, 22 bp, M. musculus
taggctggcctcaaactcagag

SEQ ID NO: 427914 - DNA, 19 bp, M. musculus
taggctggcctcgaactca

SEQ ID NO: 427915 - DNA, 16 bp, M. musculus
taggctggccttgaat

SEQ ID NO: 427916 - DNA, 16 bp, M. musculus
taggctgttttgaaat

SEQ ID NO: 427917 - DNA, 16 bp, M. musculus
taggcttaggcttagg

SEQ ID NO: 427918 - DNA, 16 bp, M. musculus
taggcttggctgtcct

SEQ ID NO: 427919 - DNA, 16 bp, M. musculus
tagggaaaagtctcga

SEQ ID NO: 427920 - DNA, 16 bp, M. musculus
tagggaaagcagagaa

SEQ ID NO: 427921 - DNA, 16 bp, M. musculus
tagggaacaaaataca

SEQ ID NO: 427922 - DNA, 16 bp, M. musculus
tagggaacaaaatacc

SEQ ID NO: 427923 - DNA, 16 bp, M. musculus
tagggaagcaccctca

SEQ ID NO: 427924 - DNA, 16 bp, M. musculus
tagggaagcagggtgg

SEQ ID NO: 427925 - DNA, 16 bp, M. musculus
tagggaagtggggcgg

SEQ ID NO: 427926 - DNA, 16 bp, M. musculus
tagggagtttagaggt

SEQ ID NO: 427927 - DNA, 16 bp, M. musculus
tagggagtttttggag

SEQ ID NO: 427928 - DNA, 16 bp, M. musculus
tagggatccatcccac

SEQ ID NO: 427929 - DNA, 16 bp, M. musculus
tagggatgaaactcag

SEQ ID NO: 427930 - DNA, 16 bp, M. musculus
tagggcaagggctaaa

SEQ ID NO: 427931 - DNA, 16 bp, M. musculus
tagggcatggggaggg

SEQ ID NO: 427932 - DNA, 16 bp, M. musculus
tagggcctcacacatg

SEQ ID NO: 427933 - DNA, 16 bp, M. musculus
tagggccttgcacatg

SEQ ID NO: 427934 - DNA, 16 bp, M. musculus
tagggctgagtgtttc

SEQ ID NO: 427935 - DNA, 16 bp, M. musculus
tagggctgcaaacccc

SEQ ID NO: 427936 - DNA, 16 bp, M. musculus
tagggctgcagagatg

SEQ ID NO: 427937 - DNA, 16 bp, M. musculus
tagggctggggctggg

SEQ ID NO: 427938 - DNA, 16 bp, M. musculus
taggggaagggggtgc

SEQ ID NO: 427939 - DNA, 16 bp, M. musculus
taggggaattcctggg

SEQ ID NO: 427940 - DNA, 16 bp, M. musculus
taggggaattctaggg

SEQ ID NO: 427941 - DNA, 16 bp, M. musculus
taggggaatttcaggg

SEQ ID NO: 427942 - DNA, 16 bp, M. musculus
taggggagatgtcaca

SEQ ID NO: 427943 - DNA, 16 bp, M. musculus
taggggatttttgaag

SEQ ID NO: 427944 - DNA, 16 bp, M. musculus
taggggctgaagagat

SEQ ID NO: 427945 - DNA, 17 bp, M. musculus
tagggggagtcctcttt

SEQ ID NO: 427946 - DNA, 16 bp, M. musculus
tagggggatgccagga

SEQ ID NO: 427947 - DNA, 16 bp, M. musculus
taggggggtttcagag

SEQ ID NO: 427948 - DNA, 16 bp, M. musculus
taggggtatagctcag

SEQ ID NO: 427949 - DNA, 16 bp, M. musculus
taggggtcaaactcag

SEQ ID NO: 427950 - DNA, 16 bp, M. musculus
tagggtctcactgtgt

SEQ ID NO: 427951 - DNA, 18 bp, M. musculus
tagggtgtgaaatcctta

SEQ ID NO: 427952 - DNA, 16 bp, M. musculus
tagggttatttgattc

SEQ ID NO: 427953 - DNA, 16 bp, M. musculus
tagggtttctattgct

SEQ ID NO: 427954 - DNA, 16 bp, M. musculus
taggtacctggtatct

SEQ ID NO: 427955 - DNA, 16 bp, M. musculus
taggtagataaataga

SEQ ID NO: 427956 - DNA, 19 bp, M. musculus
taggtaggtaggtaggtag

SEQ ID NO: 427957 - DNA, 16 bp, M. musculus
taggtatagaagaaag

SEQ ID NO: 427958 - DNA, 26 bp, M. musculus
taggtatattaatgattcttttatta

SEQ ID NO: 427959 - DNA, 16 bp, M. musculus
taggtatgggaggaga

SEQ ID NO: 427960 - DNA, 16 bp, M. musculus
taggtattttattcat

SEQ ID NO: 427961 - DNA, 16 bp, M. musculus
taggtattttcctcac

SEQ ID NO: 427962 - DNA, 16 bp, M. musculus
taggtcaaaagttttg

SEQ ID NO: 427963 - DNA, 16 bp, M. musculus
taggtcagagtttttg

SEQ ID NO: 427964 - DNA, 17 bp, M. musculus
taggtccctttttgtga

SEQ ID NO: 427965 - DNA, 16 bp, M. musculus
taggtcctgagttcaa

SEQ ID NO: 427966 - DNA, 16 bp, M. musculus
taggtctctgtgagtt

SEQ ID NO: 427967 - DNA, 16 bp, M. musculus
taggtgacagcagatg

SEQ ID NO: 427968 - DNA, 16 bp, M. musculus
taggtgactcccagct

SEQ ID NO: 427969 - DNA, 16 bp, M. musculus
taggtgcatcctctcc

SEQ ID NO: 427970 - DNA, 17 bp, M. musculus
taggtgctaggacagaa

SEQ ID NO: 427971 - DNA, 16 bp, M. musculus
taggtgctcaataaat

SEQ ID NO: 427972 - DNA, 16 bp, M. musculus
taggtgctggaaattg

SEQ ID NO: 427973 - DNA, 18 bp, M. musculus
taggtggatttctgagtt

SEQ ID NO: 427974 - DNA, 17 bp, M. musculus
taggtggcatgggagtg

SEQ ID NO: 427975 - DNA, 16 bp, M. musculus
taggtgggtaaggatt

SEQ ID NO: 427976 - DNA, 16 bp, M. musculus
taggtggtatggcctt

SEQ ID NO: 427977 - DNA, 16 bp, M. musculus
taggtgtctctggctg

SEQ ID NO: 427978 - DNA, 16 bp, M. musculus
taggtgtggccttgtg

SEQ ID NO: 427979 - DNA, 16 bp, M. musculus
taggtgtggtggcaca

SEQ ID NO: 427980 - DNA, 16 bp, M. musculus
taggttaaactccttg

SEQ ID NO: 427981 - DNA, 16 bp, M. musculus
taggtttcaaacctgg

SEQ ID NO: 427982 - DNA, 31 bp, M. musculus
taggtttggtcttctcattgtgtcctggatt

SEQ ID NO: 427983 - DNA, 17 bp, M. musculus
taggtttttgttattcc

SEQ ID NO: 427984 - DNA, 16 bp, M. musculus
tagtaaaaatcctttc

SEQ ID NO: 427985 - DNA, 16 bp, M. musculus
tagtaaaggcagagaa

SEQ ID NO: 427986 - DNA, 16 bp, M. musculus
tagtaaagttttaggt

SEQ ID NO: 427987 - DNA, 16 bp, M. musculus
tagtaagattcttttt

SEQ ID NO: 427988 - DNA, 16 bp, M. musculus
tagtaagtaataactc

SEQ ID NO: 427989 - DNA, 16 bp, M. musculus
tagtaatcattttatt

SEQ ID NO: 427990 - DNA, 16 bp, M. musculus
tagtacaacttcaaaa

SEQ ID NO: 427991 - DNA, 16 bp, M. musculus
tagtactccactgtgt

SEQ ID NO: 427992 - DNA, 16 bp, M. musculus
tagtagatattttctt

SEQ ID NO: 427993 - DNA, 16 bp, M. musculus
tagtaggaatatggaa

SEQ ID NO: 427994 - DNA, 17 bp, M. musculus
tagtagtagtagtagta

SEQ ID NO: 427995 - DNA, 16 bp, M. musculus
tagtagtggtggtagt

SEQ ID NO: 427996 - DNA, 16 bp, M. musculus
tagtataagaaaagat

SEQ ID NO: 427997 - DNA, 16 bp, M. musculus
tagtataattaagtga

SEQ ID NO: 427998 - DNA, 16 bp, M. musculus
tagtatacaagctaaa

SEQ ID NO: 427999 - DNA, 16 bp, M. musculus
tagtatagtagtagta

SEQ ID NO: 428000 - DNA, 16 bp, M. musculus
tagtatatacaaagcc

SEQ ID NO: 428001 - DNA, 17 bp, M. musculus
tagtattatgtccaatt

SEQ ID NO: 428002 - DNA, 16 bp, M. musculus
tagtattgtgtgtgtg

SEQ ID NO: 428003 - DNA, 16 bp, M. musculus
tagtcaaattgacaac

SEQ ID NO: 428004 - DNA, 17 bp, M. musculus
tagtcaacctgccacca

SEQ ID NO: 428005 - DNA, 16 bp, M. musculus
tagtcaagagcagaga

SEQ ID NO: 428006 - DNA, 16 bp, M. musculus
tagtcaaggataacct

SEQ ID NO: 428007 - DNA, 16 bp, M. musculus
tagtcaatcagcttat

SEQ ID NO: 428008 - DNA, 16 bp, M. musculus
tagtcacagctccaaa

SEQ ID NO: 428009 - DNA, 17 bp, M. musculus
tagtcagaagctggaaa

SEQ ID NO: 428010 - DNA, 16 bp, M. musculus
tagtcagtgctcttaa

SEQ ID NO: 428011 - DNA, 16 bp, M. musculus
tagtcattgtttttaa

SEQ ID NO: 428012 - DNA, 16 bp, M. musculus
tagtcatttttactat

SEQ ID NO: 428013 - DNA, 16 bp, M. musculus
tagtccaagctggcct

SEQ ID NO: 428014 - DNA, 16 bp, M. musculus
tagtccagactgacct

SEQ ID NO: 428015 - DNA, 16 bp, M. musculus
tagtccagactggcct

SEQ ID NO: 428016 - DNA, 16 bp, M. musculus
tagtccagcctggcct

SEQ ID NO: 428017 - DNA, 17 bp, M. musculus
tagtccagcttgtttct

SEQ ID NO: 428018 - DNA, 16 bp, M. musculus
tagtccaggatggcct

SEQ ID NO: 428019 - DNA, 16 bp, M. musculus
tagtccaggctagcct

SEQ ID NO: 428020 - DNA, 16 bp, M. musculus
tagtccaggctggcct

SEQ ID NO: 428021 - DNA, 16 bp, M. musculus
tagtccaggctggctt

SEQ ID NO: 428022 - DNA, 16 bp, M. musculus
tagtccatcttctgat

SEQ ID NO: 428023 - DNA, 16 bp, M. musculus
tagtccatgctggctt

SEQ ID NO: 428024 - DNA, 16 bp, M. musculus
tagtccattattgtca

SEQ ID NO: 428025 - DNA, 16 bp, M. musculus
tagtcccagcacccag

SEQ ID NO: 428026 - DNA, 16 bp, M. musculus
tagtcccagcagaggc

SEQ ID NO: 428027 - DNA, 16 bp, M. musculus
tagtcccaggactcag

SEQ ID NO: 428028 - DNA, 16 bp, M. musculus
tagtcccctatgtgat

SEQ ID NO: 428029 - DNA, 17 bp, M. musculus
tagtccctgggagctct

SEQ ID NO: 428030 - DNA, 16 bp, M. musculus
tagtcctgactggcct

SEQ ID NO: 428031 - DNA, 16 bp, M. musculus
tagtcctgcctggcct

SEQ ID NO: 428032 - DNA, 16 bp, M. musculus
tagtcctgcctgggag

SEQ ID NO: 428033 - DNA, 16 bp, M. musculus
tagtcctggctatcct

SEQ ID NO: 428034 - DNA, 16 bp, M. musculus
tagtcctggctgacct

SEQ ID NO: 428035 - DNA, 16 bp, M. musculus
tagtcctggctgtctt

SEQ ID NO: 428036 - DNA, 16 bp, M. musculus
tagtccttgctgtcct

SEQ ID NO: 428037 - DNA, 16 bp, M. musculus
tagtctaggctggcct

SEQ ID NO: 428038 - DNA, 16 bp, M. musculus
tagtctcaggagagag

SEQ ID NO: 428039 - DNA, 16 bp, M. musculus
tagtctcaggcagact

SEQ ID NO: 428040 - DNA, 16 bp, M. musculus
tagtctcctgagtgct

SEQ ID NO: 428041 - DNA, 16 bp, M. musculus
tagtctctggcgagaa

SEQ ID NO: 428042 - DNA, 16 bp, M. musculus
tagtctctgtctgtct

SEQ ID NO: 428043 - DNA, 16 bp, M. musculus
tagtctgattgtttca

SEQ ID NO: 428044 - DNA, 16 bp, M. musculus
tagtctgcacaggtaa

SEQ ID NO: 428045 - DNA, 16 bp, M. musculus
tagtctgctttctgtt

SEQ ID NO: 428046 - DNA, 29 bp, M. musculus
tagtctgtgcttccgacatggtaatatac

SEQ ID NO: 428047 - DNA, 16 bp, M. musculus
tagtcttcaaaaacat

SEQ ID NO: 428048 - DNA, 16 bp, M. musculus
tagtcttcaaaagcat

SEQ ID NO: 428049 - DNA, 16 bp, M. musculus
tagtcttctccaaagt

SEQ ID NO: 428050 - DNA, 16 bp, M. musculus
tagtgaaacacacaca

SEQ ID NO: 428051 - DNA, 16 bp, M. musculus
tagtgaattccaggcc

SEQ ID NO: 428052 - DNA, 16 bp, M. musculus
tagtgagaattttggt

SEQ ID NO: 428053 - DNA, 16 bp, M. musculus
tagtgagaccccatct

SEQ ID NO: 428054 - DNA, 16 bp, M. musculus
tagtgagactcttgtc

SEQ ID NO: 428055 - DNA, 16 bp, M. musculus
tagtgagactttatgg

SEQ ID NO: 428056 - DNA, 16 bp, M. musculus
tagtgagatcatgtct

SEQ ID NO: 428057 - DNA, 16 bp, M. musculus
tagtgagatcctatct

SEQ ID NO: 428058 - DNA, 17 bp, M. musculus
tagtgagatggctcagc

SEQ ID NO: 428059 - DNA, 16 bp, M. musculus
tagtgagattctatct

SEQ ID NO: 428060 - DNA, 17 bp, M. musculus
tagtgagttcaaggaca

SEQ ID NO: 428061 - DNA, 16 bp, M. musculus
tagtgagttcaaggcc

SEQ ID NO: 428062 - DNA, 16 bp, M. musculus
tagtgagttccaggat

SEQ ID NO: 428063 - DNA, 16 bp, M. musculus
tagtgagttccaggct

SEQ ID NO: 428064 - DNA, 16 bp, M. musculus
tagtgagttccaggtc

SEQ ID NO: 428065 - DNA, 18 bp, M. musculus
tagtgagttctagaccag

SEQ ID NO: 428066 - DNA, 16 bp, M. musculus
tagtgatgtcagtgat

SEQ ID NO: 428067 - DNA, 16 bp, M. musculus
tagtgatgttttgact

SEQ ID NO: 428068 - DNA, 16 bp, M. musculus
tagtgcaactccctgg

SEQ ID NO: 428069 - DNA, 16 bp, M. musculus
tagtgcataaccaatc

SEQ ID NO: 428070 - DNA, 16 bp, M. musculus
tagtgccacccacagt

SEQ ID NO: 428071 - DNA, 16 bp, M. musculus
tagtgcctgagctgtt

SEQ ID NO: 428072 - DNA, 16 bp, M. musculus
tagtgctactgaactg

SEQ ID NO: 428073 - DNA, 16 bp, M. musculus
tagtgctgagattaaa

SEQ ID NO: 428074 - DNA, 16 bp, M. musculus
tagtgctgctgctgct

SEQ ID NO: 428075 - DNA, 16 bp, M. musculus
tagtgcttgcctagca

SEQ ID NO: 428076 - DNA, 16 bp, M. musculus
tagtggagtggatcaa

SEQ ID NO: 428077 - DNA, 16 bp, M. musculus
tagtgggaggagaggc

SEQ ID NO: 428078 - DNA, 16 bp, M. musculus
tagtggtctccatctg

SEQ ID NO: 428079 - DNA, 17 bp, M. musculus
tagtggttaagagcact

SEQ ID NO: 428080 - DNA, 16 bp, M. musculus
tagtggttttcattga

SEQ ID NO: 428081 - DNA, 17 bp, M. musculus
tagtgtactcacatata

SEQ ID NO: 428082 - DNA, 16 bp, M. musculus
tagtgtcagaccttgg

SEQ ID NO: 428083 - DNA, 16 bp, M. musculus
tagtgtctgtctttga

SEQ ID NO: 428084 - DNA, 16 bp, M. musculus
tagtgtcttttgcctt

SEQ ID NO: 428085 - DNA, 16 bp, M. musculus
tagtgtgtctagctaa

SEQ ID NO: 428086 - DNA, 16 bp, M. musculus
tagtgttggagtttgg

SEQ ID NO: 428087 - DNA, 16 bp, M. musculus
tagtgtttgctctctc

SEQ ID NO: 428088 - DNA, 16 bp, M. musculus
tagttaaaatggccat

SEQ ID NO: 428089 - DNA, 16 bp, M. musculus
tagttaaggttttatt

SEQ ID NO: 428090 - DNA, 16 bp, M. musculus
tagttatgtgtgtgtg

SEQ ID NO: 428091 - DNA, 17 bp, M. musculus
tagttcaattcccagca

SEQ ID NO: 428092 - DNA, 16 bp, M. musculus
tagttcagtgatagag

SEQ ID NO: 428093 - DNA, 16 bp, M. musculus
tagttcatatttatgt

SEQ ID NO: 428094 - DNA, 16 bp, M. musculus
tagttccaggacagac

SEQ ID NO: 428095 - DNA, 16 bp, M. musculus
tagttccaggacagcc

SEQ ID NO: 428096 - DNA, 19 bp, M. musculus
tagttccaggggatccaac

SEQ ID NO: 428097 - DNA, 16 bp, M. musculus
tagttctcatggcaat

SEQ ID NO: 428098 - DNA, 16 bp, M. musculus
tagttctctggagtct

SEQ ID NO: 428099 - DNA, 16 bp, M. musculus
tagttcttgggaaata

SEQ ID NO: 428100 - DNA, 16 bp, M. musculus
tagttctttctgtttc

SEQ ID NO: 428101 - DNA, 16 bp, M. musculus
tagttgaatctgttgg

SEQ ID NO: 428102 - DNA, 16 bp, M. musculus
tagttgaccagtctgt

SEQ ID NO: 428103 - DNA, 16 bp, M. musculus
tagttgagataatatt

SEQ ID NO: 428104 - DNA, 16 bp, M. musculus
tagttgagctgcattt

SEQ ID NO: 428105 - DNA, 16 bp, M. musculus
tagttgatactgttgg

SEQ ID NO: 428106 - DNA, 16 bp, M. musculus
tagttggtggttcaga

SEQ ID NO: 428107 - DNA, 18 bp, M. musculus
tagttgtctctggttaga

SEQ ID NO: 428108 - DNA, 17 bp, M. musculus
tagttgtcttcagatac

SEQ ID NO: 428109 - DNA, 16 bp, M. musculus
tagtttaaatatgctt

SEQ ID NO: 428110 - DNA, 17 bp, M. musculus
tagtttataatgttgtt

SEQ ID NO: 428111 - DNA, 16 bp, M. musculus
tagtttatattgctgt

SEQ ID NO: 428112 - DNA, 16 bp, M. musculus
tagtttcccctttgaa

SEQ ID NO: 428113 - DNA, 16 bp, M. musculus
tagtttccttataaaa

SEQ ID NO: 428114 - DNA, 16 bp, M. musculus
tagtttccttgaaact

SEQ ID NO: 428115 - DNA, 16 bp, M. musculus
tagtttctctccattt

SEQ ID NO: 428116 - DNA, 16 bp, M. musculus
tagtttctctgtgtag

SEQ ID NO: 428117 - DNA, 16 bp, M. musculus
tagtttctgggactta

SEQ ID NO: 428118 - DNA, 16 bp, M. musculus
tagtttctgtttccac

SEQ ID NO: 428119 - DNA, 16 bp, M. musculus
tagtttctgtttccag

SEQ ID NO: 428120 - DNA, 16 bp, M. musculus
tagtttctttttgggg

SEQ ID NO: 428121 - DNA, 16 bp, M. musculus
tagtttgatttctgtt

SEQ ID NO: 428122 - DNA, 16 bp, M. musculus
tagtttgtagaaggaa

SEQ ID NO: 428123 - DNA, 16 bp, M. musculus
tagtttgttcagaact

SEQ ID NO: 428124 - DNA, 16 bp, M. musculus
tagttttatcatggaa

SEQ ID NO: 428125 - DNA, 16 bp, M. musculus
tagttttatgtcaact

SEQ ID NO: 428126 - DNA, 16 bp, M. musculus
tagttttcatttttaa

SEQ ID NO: 428127 - DNA, 16 bp, M. musculus
tagttttctctctgaa

SEQ ID NO: 428128 - DNA, 16 bp, M. musculus
tagttttcttcctgtt

SEQ ID NO: 428129 - DNA, 16 bp, M. musculus
tataaaaacacatttt

SEQ ID NO: 428130 - DNA, 16 bp, M. musculus
tataaaaatgtcttta

SEQ ID NO: 428131 - DNA, 16 bp, M. musculus
tataaaacaaaaatgc

SEQ ID NO: 428132 - DNA, 16 bp, M. musculus
tataaaagacagcatt

SEQ ID NO: 428133 - DNA, 68 bp, M. musculus
tataaaagagagccggtgtcattaactctggccctgctgttgggaggacttactatgggcggcatagc

SEQ ID NO: 428134 - DNA, 16 bp, M. musculus
tataaaagctttattt

SEQ ID NO: 428135 - DNA, 16 bp, M. musculus
tataaaagtacaagaa

SEQ ID NO: 428136 - DNA, 16 bp, M. musculus
tataaaatacattttg

SEQ ID NO: 428137 - DNA, 16 bp, M. musculus
tataaaatagaaacag

SEQ ID NO: 428138 - DNA, 16 bp, M. musculus
tataaaatgaagttta

SEQ ID NO: 428139 - DNA, 16 bp, M. musculus
tataaaatgtctttaa

SEQ ID NO: 428140 - DNA, 16 bp, M. musculus
tataaacatgtatgca

SEQ ID NO: 428141 - DNA, 16 bp, M. musculus
tataaaccaaccagac

SEQ ID NO: 428142 - DNA, 16 bp, M. musculus
tataaaccctaggaaa

SEQ ID NO: 428143 - DNA, 16 bp, M. musculus
tataaactcatggaaa

SEQ ID NO: 428144 - DNA, 16 bp, M. musculus
tataaagaaaaacatt

SEQ ID NO: 428145 - DNA, 16 bp, M. musculus
tataaagaaaatatca

SEQ ID NO: 428146 - DNA, 16 bp, M. musculus
tataaagaaattaagg

SEQ ID NO: 428147 - DNA, 16 bp, M. musculus
tataaagaattcaaaa

SEQ ID NO: 428148 - DNA, 16 bp, M. musculus
tataaagacaatattt

SEQ ID NO: 428149 - DNA, 16 bp, M. musculus
tataaagctcaagtct

SEQ ID NO: 428150 - DNA, 16 bp, M. musculus
tataaaggaaaccatt

SEQ ID NO: 428151 - DNA, 16 bp, M. musculus
tataaagtacaagaga

SEQ ID NO: 428152 - DNA, 16 bp, M. musculus
tataaagtgagttcta

SEQ ID NO: 428153 - DNA, 16 bp, M. musculus
tataaagtttatgtgt

SEQ ID NO: 428154 - DNA, 16 bp, M. musculus
tataaagttttcaata

SEQ ID NO: 428155 - DNA, 16 bp, M. musculus
tataaataaaactgct

SEQ ID NO: 428156 - DNA, 16 bp, M. musculus
tataaatacagcctgc

SEQ ID NO: 428157 - DNA, 16 bp, M. musculus
tataaatacatcttta

SEQ ID NO: 428158 - DNA, 16 bp, M. musculus
tataaataggactcag

SEQ ID NO: 428159 - DNA, 16 bp, M. musculus
tataaatatgtgtgtg

SEQ ID NO: 428160 - DNA, 16 bp, M. musculus
tataaatcaataaatg

SEQ ID NO: 428161 - DNA, 16 bp, M. musculus
tataaatctgactaat

SEQ ID NO: 428162 - DNA, 16 bp, M. musculus
tataaatgacatttaa

SEQ ID NO: 428163 - DNA, 16 bp, M. musculus
tataaatgaggaaaat

SEQ ID NO: 428164 - DNA, 16 bp, M. musculus
tataaatgagtatata

SEQ ID NO: 428165 - DNA, 16 bp, M. musculus
tataaatgctagagcc

SEQ ID NO: 428166 - DNA, 16 bp, M. musculus
tataaatggaattata

SEQ ID NO: 428167 - DNA, 16 bp, M. musculus
tataaatggttgtgag

SEQ ID NO: 428168 - DNA, 16 bp, M. musculus
tataaatgtatgtata

SEQ ID NO: 428169 - DNA, 23 bp, M. musculus
tataaatgtgagccagataatca

SEQ ID NO: 428170 - DNA, 16 bp, M. musculus
tataaatgtgtatata

SEQ ID NO: 428171 - DNA, 16 bp, M. musculus
tataaatgtgtgcatg

SEQ ID NO: 428172 - DNA, 16 bp, M. musculus
tataaatgtgtgtata

SEQ ID NO: 428173 - DNA, 16 bp, M. musculus
tataacaagcacacat

SEQ ID NO: 428174 - DNA, 16 bp, M. musculus
tataacaagttgctta

SEQ ID NO: 428175 - DNA, 16 bp, M. musculus
tataacagagaaaccc

SEQ ID NO: 428176 - DNA, 16 bp, M. musculus
tataacagaggatggc

SEQ ID NO: 428177 - DNA, 16 bp, M. musculus
tataacagcaatagaa

SEQ ID NO: 428178 - DNA, 16 bp, M. musculus
tataacagccctggct

SEQ ID NO: 428179 - DNA, 16 bp, M. musculus
tataacattttaaatg

SEQ ID NO: 428180 - DNA, 16 bp, M. musculus
tataaccctggctggc

SEQ ID NO: 428181 - DNA, 16 bp, M. musculus
tataacctcagcactt

SEQ ID NO: 428182 - DNA, 16 bp, M. musculus
tataacctggtttctg

SEQ ID NO: 428183 - DNA, 16 bp, M. musculus
tataacctgttttctg

SEQ ID NO: 428184 - DNA, 16 bp, M. musculus
tataactatgtatata

SEQ ID NO: 428185 - DNA, 16 bp, M. musculus
tataactccagctcca

SEQ ID NO: 428186 - DNA, 16 bp, M. musculus
tataactgtctgtaac

SEQ ID NO: 428187 - DNA, 16 bp, M. musculus
tataacttaaaatatc

SEQ ID NO: 428188 - DNA, 16 bp, M. musculus
tataacttcttgagtt

SEQ ID NO: 428189 - DNA, 16 bp, M. musculus
tataagaaaataggct

SEQ ID NO: 428190 - DNA, 16 bp, M. musculus
tataagaaaggaggct

SEQ ID NO: 428191 - DNA, 16 bp, M. musculus
tataagaacaaatgtt

SEQ ID NO: 428192 - DNA, 16 bp, M. musculus
tataagaacaacattt

SEQ ID NO: 428193 - DNA, 16 bp, M. musculus
tataagaatatgcttt

SEQ ID NO: 428194 - DNA, 16 bp, M. musculus
tataagagtaattgtg

SEQ ID NO: 428195 - DNA, 16 bp, M. musculus
tataagatacactttg

SEQ ID NO: 428196 - DNA, 16 bp, M. musculus
tataagatacattttg

SEQ ID NO: 428197 - DNA, 16 bp, M. musculus
tataagattgagaatt

SEQ ID NO: 428198 - DNA, 16 bp, M. musculus
tataagcaaataaaat

SEQ ID NO: 428199 - DNA, 16 bp, M. musculus
tataagcatccacttc

SEQ ID NO: 428200 - DNA, 16 bp, M. musculus
tataaggaaaacattt

SEQ ID NO: 428201 - DNA, 17 bp, M. musculus
tataaggagataggaat

SEQ ID NO: 428202 - DNA, 16 bp, M. musculus
tataaggggaaaaggt

SEQ ID NO: 428203 - DNA, 16 bp, M. musculus
tataagtatgcatgtg

SEQ ID NO: 428204 - DNA, 16 bp, M. musculus
tataataaaagaactt

SEQ ID NO: 428205 - DNA, 16 bp, M. musculus
tataataaaggaattt

SEQ ID NO: 428206 - DNA, 16 bp, M. musculus
tataataaagtgtttt

SEQ ID NO: 428207 - DNA, 16 bp, M. musculus
tataatatattacaca

SEQ ID NO: 428208 - DNA, 16 bp, M. musculus
tataatcatagatatt

SEQ ID NO: 428209 - DNA, 16 bp, M. musculus
tataatcccaacactc

SEQ ID NO: 428210 - DNA, 16 bp, M. musculus
tataatggtttgtata

SEQ ID NO: 428211 - DNA, 21 bp, M. musculus
tataatgtgcagtcctaatga

SEQ ID NO: 428212 - DNA, 16 bp, M. musculus
tataatgtgttttaaa

SEQ ID NO: 428213 - DNA, 16 bp, M. musculus
tataatgttacttata

SEQ ID NO: 428214 - DNA, 16 bp, M. musculus
tataattaacaagtca

SEQ ID NO: 428215 - DNA, 16 bp, M. musculus
tataattccaattcca

SEQ ID NO: 428216 - DNA, 16 bp, M. musculus
tataattctacacctg

SEQ ID NO: 428217 - DNA, 16 bp, M. musculus
tataattctgataggc

SEQ ID NO: 428218 - DNA, 16 bp, M. musculus
tataattgttcctgtc

SEQ ID NO: 428219 - DNA, 16 bp, M. musculus
tataattttaaaagct

SEQ ID NO: 428220 - DNA, 16 bp, M. musculus
tataatttttcccctt

SEQ ID NO: 428221 - DNA, 16 bp, M. musculus
tatacaaaataaaatg

SEQ ID NO: 428222 - DNA, 16 bp, M. musculus
tatacaaacatgcaca

SEQ ID NO: 428223 - DNA, 16 bp, M. musculus
tatacaaagatttata

SEQ ID NO: 428224 - DNA, 16 bp, M. musculus
tatacaaataaatgca

SEQ ID NO: 428225 - DNA, 16 bp, M. musculus
tatacaaatacacaca

SEQ ID NO: 428226 - DNA, 16 bp, M. musculus
tatacaactgtaacat

SEQ ID NO: 428227 - DNA, 16 bp, M. musculus
tatacaatatattttg

SEQ ID NO: 428228 - DNA, 16 bp, M. musculus
tatacaatgtatcttg

SEQ ID NO: 428229 - DNA, 16 bp, M. musculus
tatacacaagcacaca

SEQ ID NO: 428230 - DNA, 16 bp, M. musculus
tatacacacacacata

SEQ ID NO: 428231 - DNA, 16 bp, M. musculus
tatacacacacataat

SEQ ID NO: 428232 - DNA, 16 bp, M. musculus
tatacacacactcata

SEQ ID NO: 428233 - DNA, 16 bp, M. musculus
tatacacacatacaca

SEQ ID NO: 428234 - DNA, 16 bp, M. musculus
tatacacacatgcaaa

SEQ ID NO: 428235 - DNA, 16 bp, M. musculus
tatacacacatgtgca

SEQ ID NO: 428236 - DNA, 16 bp, M. musculus
tatacacagaaacaca

SEQ ID NO: 428237 - DNA, 16 bp, M. musculus
tatacacagacataca

SEQ ID NO: 428238 - DNA, 16 bp, M. musculus
tatacacagagataca

SEQ ID NO: 428239 - DNA, 16 bp, M. musculus
tatacacatacacaaa

SEQ ID NO: 428240 - DNA, 16 bp, M. musculus
tatacacatacatgca

SEQ ID NO: 428241 - DNA, 16 bp, M. musculus
tatacacatatacatg

SEQ ID NO: 428242 - DNA, 16 bp, M. musculus
tatacacatatagata

SEQ ID NO: 428243 - DNA, 16 bp, M. musculus
tatacacatatatact

SEQ ID NO: 428244 - DNA, 16 bp, M. musculus
tatacacatatatgaa

SEQ ID NO: 428245 - DNA, 16 bp, M. musculus
tatacacatgtataaa

SEQ ID NO: 428246 - DNA, 16 bp, M. musculus
tatacacctttaattc

SEQ ID NO: 428247 - DNA, 16 bp, M. musculus
tatacacgtatacata

SEQ ID NO: 428248 - DNA, 16 bp, M. musculus
tatacagagaaacccc

SEQ ID NO: 428249 - DNA, 17 bp, M. musculus
tatacagagaaacccta

SEQ ID NO: 428250 - DNA, 16 bp, M. musculus
tatacagagaaactgt

SEQ ID NO: 428251 - DNA, 16 bp, M. musculus
tatacagagaaatcct

SEQ ID NO: 428252 - DNA, 16 bp, M. musculus
tatacagagaaatctt

SEQ ID NO: 428253 - DNA, 16 bp, M. musculus
tatacagagacataaa

SEQ ID NO: 428254 - DNA, 16 bp, M. musculus
tatacagctagaaaca

SEQ ID NO: 428255 - DNA, 16 bp, M. musculus
tatacataaaatagaa

SEQ ID NO: 428256 - DNA, 16 bp, M. musculus
tatacataaacatgta

SEQ ID NO: 428257 - DNA, 16 bp, M. musculus
tatacatacacaaaca

SEQ ID NO: 428258 - DNA, 17 bp, M. musculus
tatacatacatacacat

SEQ ID NO: 428259 - DNA, 19 bp, M. musculus
tatacatacatacatacac

SEQ ID NO: 428260 - DNA, 16 bp, M. musculus
tatacatacatataca

SEQ ID NO: 428261 - DNA, 19 bp, M. musculus
tatacatacatatatacat

SEQ ID NO: 428262 - DNA, 16 bp, M. musculus
tatacatacatgtgtg

SEQ ID NO: 428263 - DNA, 16 bp, M. musculus
tatacatagatatata

SEQ ID NO: 428264 - DNA, 16 bp, M. musculus
tatacatatataaaga

SEQ ID NO: 428265 - DNA, 18 bp, M. musculus
tatacatatatacatatg

SEQ ID NO: 428266 - DNA, 16 bp, M. musculus
tatacatatatataca

SEQ ID NO: 428267 - DNA, 16 bp, M. musculus
tatacatatatatgca

SEQ ID NO: 428268 - DNA, 16 bp, M. musculus
tatacatatatatgga

SEQ ID NO: 428269 - DNA, 16 bp, M. musculus
tatacatatatattgt

SEQ ID NO: 428270 - DNA, 16 bp, M. musculus
tatacatatattcaca

SEQ ID NO: 428271 - DNA, 16 bp, M. musculus
tatacatatatttatg

SEQ ID NO: 428272 - DNA, 16 bp, M. musculus
tatacatatgaataca

SEQ ID NO: 428273 - DNA, 16 bp, M. musculus
tatacatatgtgtgtg

SEQ ID NO: 428274 - DNA, 16 bp, M. musculus
tatacatgcaagtaaa

SEQ ID NO: 428275 - DNA, 16 bp, M. musculus
tatacatgtaaatatt

SEQ ID NO: 428276 - DNA, 16 bp, M. musculus
tatacatgtgcatgca

SEQ ID NO: 428277 - DNA, 16 bp, M. musculus
tatacatgtgtatata

SEQ ID NO: 428278 - DNA, 16 bp, M. musculus
tatacattatgtatat

SEQ ID NO: 428279 - DNA, 16 bp, M. musculus
tatacattcatatgta

SEQ ID NO: 428280 - DNA, 16 bp, M. musculus
tatacattttaggaag

SEQ ID NO: 428281 - DNA, 16 bp, M. musculus
tataccaggctcctgt

SEQ ID NO: 428282 - DNA, 16 bp, M. musculus
tataccaggctggcct

SEQ ID NO: 428283 - DNA, 16 bp, M. musculus
tataccatgtttggtt

SEQ ID NO: 428284 - DNA, 16 bp, M. musculus
tatacccagcaaatct

SEQ ID NO: 428285 - DNA, 16 bp, M. musculus
tatacctgcacacaca

SEQ ID NO: 428286 - DNA, 16 bp, M. musculus
tatacctgcatgccag

SEQ ID NO: 428287 - DNA, 16 bp, M. musculus
tatacctgggtcttca

SEQ ID NO: 428288 - DNA, 16 bp, M. musculus
tatacctgtaattcca

SEQ ID NO: 428289 - DNA, 16 bp, M. musculus
tatacctgtctgtctg

SEQ ID NO: 428290 - DNA, 16 bp, M. musculus
tatacgtatatatata

SEQ ID NO: 428291 - DNA, 16 bp, M. musculus
tatacgtgtatgtgtg

SEQ ID NO: 428292 - DNA, 16 bp, M. musculus
tatactaaaattggaa

SEQ ID NO: 428293 - DNA, 16 bp, M. musculus
tatactaagaactcaa

SEQ ID NO: 428294 - DNA, 16 bp, M. musculus
tatactcatcactaga

SEQ ID NO: 428295 - DNA, 16 bp, M. musculus
tatactccttcatcat

SEQ ID NO: 428296 - DNA, 16 bp, M. musculus
tatactctcaaagcct

SEQ ID NO: 428297 - DNA, 35 bp, M. musculus
tatactctcagttcccatccacgcacagcaggcca

SEQ ID NO: 428298 - DNA, 16 bp, M. musculus
tatactctgagggtta

SEQ ID NO: 428299 - DNA, 16 bp, M. musculus
tatactggggcataaa

SEQ ID NO: 428300 - DNA, 16 bp, M. musculus
tatactgtggctgtct

SEQ ID NO: 428301 - DNA, 16 bp, M. musculus
tatagaaaatgtggtt

SEQ ID NO: 428302 - DNA, 16 bp, M. musculus
tatagaaagaaatcaa

SEQ ID NO: 428303 - DNA, 17 bp, M. musculus
tatagaacacacacaca

SEQ ID NO: 428304 - DNA, 16 bp, M. musculus
tatagaacattttacc

SEQ ID NO: 428305 - DNA, 16 bp, M. musculus
tatagaacccatcttt

SEQ ID NO: 428306 - DNA, 16 bp, M. musculus
tatagaaggacaatat

SEQ ID NO: 428307 - DNA, 16 bp, M. musculus
tatagaagggaaacaa

SEQ ID NO: 428308 - DNA, 16 bp, M. musculus
tatagacagacagaca

SEQ ID NO: 428309 - DNA, 16 bp, M. musculus
tatagagaatatatat

SEQ ID NO: 428310 - DNA, 16 bp, M. musculus
tatagagcaggctagc

SEQ ID NO: 428311 - DNA, 16 bp, M. musculus
tatagagggagttcca

SEQ ID NO: 428312 - DNA, 16 bp, M. musculus
tatagatagatgatag

SEQ ID NO: 428313 - DNA, 16 bp, M. musculus
tatagatatgtacata

SEQ ID NO: 428314 - DNA, 16 bp, M. musculus
tatagatatgtgtgta

SEQ ID NO: 428315 - DNA, 37 bp, M. musculus
tatagatgcaaccaacctggacattttgctagagaat

SEQ ID NO: 428316 - DNA, 16 bp, M. musculus
tatagatgggtgtgag

SEQ ID NO: 428317 - DNA, 16 bp, M. musculus
tatagatggttgggag

SEQ ID NO: 428318 - DNA, 16 bp, M. musculus
tatagatggttgtgag

SEQ ID NO: 428319 - DNA, 16 bp, M. musculus
tatagatgtctgtgag

SEQ ID NO: 428320 - DNA, 16 bp, M. musculus
tatagcacttgaagtt

SEQ ID NO: 428321 - DNA, 16 bp, M. musculus
tatagcatcactacaa

SEQ ID NO: 428322 - DNA, 16 bp, M. musculus
tatagcattagaaatg

SEQ ID NO: 428323 - DNA, 16 bp, M. musculus
tatagccctggctggc

SEQ ID NO: 428324 - DNA, 16 bp, M. musculus
tatagccctggctgtc

SEQ ID NO: 428325 - DNA, 16 bp, M. musculus
tatagctatttgttct

SEQ ID NO: 428326 - DNA, 16 bp, M. musculus
tatagctcaggggtag

SEQ ID NO: 428327 - DNA, 16 bp, M. musculus
tatagctcagtggtag

SEQ ID NO: 428328 - DNA, 16 bp, M. musculus
tatagctgggtcttca

SEQ ID NO: 428329 - DNA, 16 bp, M. musculus
tataggaaacttttgg

SEQ ID NO: 428330 - DNA, 16 bp, M. musculus
tataggaagatccagc

SEQ ID NO: 428331 - DNA, 16 bp, M. musculus
tataggactgtttaaa

SEQ ID NO: 428332 - DNA, 32 bp, M. musculus
tataggagagagatttttgaatgttagcaatg

SEQ ID NO: 428333 - DNA, 16 bp, M. musculus
tataggattcctgagt

SEQ ID NO: 428334 - DNA, 16 bp, M. musculus
tataggccaggctagc

SEQ ID NO: 428335 - DNA, 17 bp, M. musculus
tataggtggaacaacat

SEQ ID NO: 428336 - DNA, 16 bp, M. musculus
tataggtggttgtgag

SEQ ID NO: 428337 - DNA, 16 bp, M. musculus
tataggtttcttgtat

SEQ ID NO: 428338 - DNA, 16 bp, M. musculus
tatagtaaaaacaaac

SEQ ID NO: 428339 - DNA, 16 bp, M. musculus
tatagtatatagtata

SEQ ID NO: 428340 - DNA, 16 bp, M. musculus
tatagtcctggctggc

SEQ ID NO: 428341 - DNA, 16 bp, M. musculus
tatagtgagttccagg

SEQ ID NO: 428342 - DNA, 16 bp, M. musculus
tatagtggactttcag

SEQ ID NO: 428343 - DNA, 16 bp, M. musculus
tatagtgtatatgtgt

SEQ ID NO: 428344 - DNA, 16 bp, M. musculus
tatagttatatagtta

SEQ ID NO: 428345 - DNA, 16 bp, M. musculus
tatagttccttgtgtt

SEQ ID NO: 428346 - DNA, 16 bp, M. musculus
tatagtttagaattta

SEQ ID NO: 428347 - DNA, 16 bp, M. musculus
tatataaaaaccactc

SEQ ID NO: 428348 - DNA, 16 bp, M. musculus
tatataaaggaaggct

SEQ ID NO: 428349 - DNA, 16 bp, M. musculus
tatataaataaaagac

SEQ ID NO: 428350 - DNA, 16 bp, M. musculus
tatataaatacaacct

SEQ ID NO: 428351 - DNA, 16 bp, M. musculus
tatataaatacacaca

SEQ ID NO: 428352 - DNA, 16 bp, M. musculus
tatataaatatcacat

SEQ ID NO: 428353 - DNA, 16 bp, M. musculus
tatataaatgctaagg

SEQ ID NO: 428354 - DNA, 16 bp, M. musculus
tatataaatgtatgta

SEQ ID NO: 428355 - DNA, 16 bp, M. musculus
tatataacatgcatat

SEQ ID NO: 428356 - DNA, 16 bp, M. musculus
tatataacattttcta

SEQ ID NO: 428357 - DNA, 16 bp, M. musculus
tatataagcaacacca

SEQ ID NO: 428358 - DNA, 16 bp, M. musculus
tatataagcagcacca

SEQ ID NO: 428359 - DNA, 16 bp, M. musculus
tatataagtacactgt

SEQ ID NO: 428360 - DNA, 16 bp, M. musculus
tatataatgagttcca

SEQ ID NO: 428361 - DNA, 16 bp, M. musculus
tatataatgtgtgtgt

SEQ ID NO: 428362 - DNA, 16 bp, M. musculus
tatatacaaagaattc

SEQ ID NO: 428363 - DNA, 16 bp, M. musculus
tatatacaaatgtata

SEQ ID NO: 428364 - DNA, 16 bp, M. musculus
tatatacacaagcaca

SEQ ID NO: 428365 - DNA, 16 bp, M. musculus
tatatacacacataca

SEQ ID NO: 428366 - DNA, 16 bp, M. musculus
tatatacacacccaca

SEQ ID NO: 428367 - DNA, 16 bp, M. musculus
tatatacacatacaca

SEQ ID NO: 428368 - DNA, 16 bp, M. musculus
tatatacagaatattt

SEQ ID NO: 428369 - DNA, 16 bp, M. musculus
tatatacagatatgta

SEQ ID NO: 428370 - DNA, 16 bp, M. musculus
tatatacatacataca

SEQ ID NO: 428371 - DNA, 16 bp, M. musculus
tatatacatacatttt

SEQ ID NO: 428372 - DNA, 16 bp, M. musculus
tatatacatatacata

SEQ ID NO: 428373 - DNA, 16 bp, M. musculus
tatatacatatacatt

SEQ ID NO: 428374 - DNA, 16 bp, M. musculus
tatatacatatagata

SEQ ID NO: 428375 - DNA, 16 bp, M. musculus
tatatacatatataca

SEQ ID NO: 428376 - DNA, 16 bp, M. musculus
tatatacatatatatg

SEQ ID NO: 428377 - DNA, 16 bp, M. musculus
tatatacatatattca

SEQ ID NO: 428378 - DNA, 16 bp, M. musculus
tatatacatctatata

SEQ ID NO: 428379 - DNA, 16 bp, M. musculus
tatatacatgcataga

SEQ ID NO: 428380 - DNA, 16 bp, M. musculus
tatatacatgtataca

SEQ ID NO: 428381 - DNA, 16 bp, M. musculus
tatatacatgtatata

SEQ ID NO: 428382 - DNA, 16 bp, M. musculus
tatatacatgtattat

SEQ ID NO: 428383 - DNA, 16 bp, M. musculus
tatatacatgtgtatt

SEQ ID NO: 428384 - DNA, 16 bp, M. musculus
tatatacatttttgtt

SEQ ID NO: 428385 - DNA, 35 bp, M. musculus
tatataccacttccatttgataatagactgctgct

SEQ ID NO: 428386 - DNA, 16 bp, M. musculus
tatatacctatgtata

SEQ ID NO: 428387 - DNA, 16 bp, M. musculus
tatatactatatatac

SEQ ID NO: 428388 - DNA, 16 bp, M. musculus
tatatactatatttgt

SEQ ID NO: 428389 - DNA, 16 bp, M. musculus
tatatagaaaaaccct

SEQ ID NO: 428390 - DNA, 16 bp, M. musculus
tatatagaagaatgaa

SEQ ID NO: 428391 - DNA, 16 bp, M. musculus
tatatagatatagaca

SEQ ID NO: 428392 - DNA, 16 bp, M. musculus
tatatagcaagaccct

SEQ ID NO: 428393 - DNA, 16 bp, M. musculus
tatatagcaagacctt

SEQ ID NO: 428394 - DNA, 16 bp, M. musculus
tatatagccctagctg

SEQ ID NO: 428395 - DNA, 16 bp, M. musculus
tatatagccttggctg

SEQ ID NO: 428396 - DNA, 16 bp, M. musculus
tatatagctcaggctg

SEQ ID NO: 428397 - DNA, 16 bp, M. musculus
tatatagtaagaccct

SEQ ID NO: 428398 - DNA, 16 bp, M. musculus
tatatagtatatacat

SEQ ID NO: 428399 - DNA, 16 bp, M. musculus
tatatagtgaaaccct

SEQ ID NO: 428400 - DNA, 16 bp, M. musculus
tatatataaaatctcc

SEQ ID NO: 428401 - DNA, 16 bp, M. musculus
tatatataaagaactg

SEQ ID NO: 428402 - DNA, 16 bp, M. musculus
tatatataatgtgtgt

SEQ ID NO: 428403 - DNA, 16 bp, M. musculus
tatatatacacaaatg

SEQ ID NO: 428404 - DNA, 16 bp, M. musculus
tatatatacacacata

SEQ ID NO: 428405 - DNA, 16 bp, M. musculus
tatatatacatatgca

SEQ ID NO: 428406 - DNA, 18 bp, M. musculus
tatatatacatatgtatg

SEQ ID NO: 428407 - DNA, 16 bp, M. musculus
tatatatactatgtat

SEQ ID NO: 428408 - DNA, 16 bp, M. musculus
tatatatacttacata

SEQ ID NO: 428409 - DNA, 16 bp, M. musculus
tatatatagagagaaa

SEQ ID NO: 428410 - DNA, 16 bp, M. musculus
tatatatagtgtatat

SEQ ID NO: 428411 - DNA, 16 bp, M. musculus
tatatatataaaacag

SEQ ID NO: 428412 - DNA, 16 bp, M. musculus
tatatatataaactgt

SEQ ID NO: 428413 - DNA, 18 bp, M. musculus
tatatatatacatacaca

SEQ ID NO: 428414 - DNA, 16 bp, M. musculus
tatatatatacatagt

SEQ ID NO: 428415 - DNA, 16 bp, M. musculus
tatatatatagtgaga

SEQ ID NO: 428416 - DNA, 16 bp, M. musculus
tatatatatataaagc

SEQ ID NO: 428417 - DNA, 16 bp, M. musculus
tatatatatataccat

SEQ ID NO: 428418 - DNA, 16 bp, M. musculus
tatatatatatacctg

SEQ ID NO: 428419 - DNA, 16 bp, M. musculus
tatatatatataggtt

SEQ ID NO: 428420 - DNA, 16 bp, M. musculus
tatatatatatatagc

SEQ ID NO: 428421 - DNA, 16 bp, M. musculus
tatatatatatatctc

SEQ ID NO: 428422 - DNA, 16 bp, M. musculus
tatatatatatatgca

SEQ ID NO: 428423 - DNA, 16 bp, M. musculus
tatatatatatatggt

SEQ ID NO: 428424 - DNA, 16 bp, M. musculus
tatatatatatattcc

SEQ ID NO: 428425 - DNA, 16 bp, M. musculus
tatatatatatcagct

SEQ ID NO: 428426 - DNA, 16 bp, M. musculus
tatatatatatcccat

SEQ ID NO: 428427 - DNA, 16 bp, M. musculus
tatatatatatccttc

SEQ ID NO: 428428 - DNA, 16 bp, M. musculus
tatatatatatgatag

SEQ ID NO: 428429 - DNA, 16 bp, M. musculus
tatatatatatgcaaa

SEQ ID NO: 428430 - DNA, 16 bp, M. musculus
tatatatatatgcata

SEQ ID NO: 428431 - DNA, 16 bp, M. musculus
tatatatatatgctca

SEQ ID NO: 428432 - DNA, 16 bp, M. musculus
tatatatatatggtat

SEQ ID NO: 428433 - DNA, 16 bp, M. musculus
tatatatatatggtta

SEQ ID NO: 428434 - DNA, 16 bp, M. musculus
tatatatatatgtgat

SEQ ID NO: 428435 - DNA, 16 bp, M. musculus
tatatatatattggat

SEQ ID NO: 428436 - DNA, 16 bp, M. musculus
tatatatatcacaaat

SEQ ID NO: 428437 - DNA, 16 bp, M. musculus
tatatatatctataca

SEQ ID NO: 428438 - DNA, 16 bp, M. musculus
tatatatatctatatc

SEQ ID NO: 428439 - DNA, 16 bp, M. musculus
tatatatatggacata

SEQ ID NO: 428440 - DNA, 16 bp, M. musculus
tatatatatggtatat

SEQ ID NO: 428441 - DNA, 16 bp, M. musculus
tatatatatgtaagta

SEQ ID NO: 428442 - DNA, 16 bp, M. musculus
tatatatatgtactat

SEQ ID NO: 428443 - DNA, 16 bp, M. musculus
tatatatatgtctgtg

SEQ ID NO: 428444 - DNA, 16 bp, M. musculus
tatatatatttgtttc

SEQ ID NO: 428445 - DNA, 16 bp, M. musculus
tatatatcatgtatgt

SEQ ID NO: 428446 - DNA, 16 bp, M. musculus
tatatatccagaagat

SEQ ID NO: 428447 - DNA, 16 bp, M. musculus
tatatatccctggctg

SEQ ID NO: 428448 - DNA, 16 bp, M. musculus
tatatatctatatatg

SEQ ID NO: 428449 - DNA, 16 bp, M. musculus
tatatatcttcaacaa

SEQ ID NO: 428450 - DNA, 16 bp, M. musculus
tatatatgactatata

SEQ ID NO: 428451 - DNA, 16 bp, M. musculus
tatatatgatgtatat

SEQ ID NO: 428452 - DNA, 16 bp, M. musculus
tatatatgcaaatata

SEQ ID NO: 428453 - DNA, 16 bp, M. musculus
tatatatgcacacaaa

SEQ ID NO: 428454 - DNA, 16 bp, M. musculus
tatatatgcacatgct

SEQ ID NO: 428455 - DNA, 16 bp, M. musculus
tatatatgcagtggca

SEQ ID NO: 428456 - DNA, 16 bp, M. musculus
tatatatgcataaata

SEQ ID NO: 428457 - DNA, 16 bp, M. musculus
tatatatgcatacaca

SEQ ID NO: 428458 - DNA, 16 bp, M. musculus
tatatatgcatatatg

SEQ ID NO: 428459 - DNA, 16 bp, M. musculus
tatatatgcatatttg

SEQ ID NO: 428460 - DNA, 16 bp, M. musculus
tatatatgcatgtata

SEQ ID NO: 428461 - DNA, 16 bp, M. musculus
tatatatggatctatt

SEQ ID NO: 428462 - DNA, 16 bp, M. musculus
tatatatgggtgtttt

SEQ ID NO: 428463 - DNA, 16 bp, M. musculus
tatatatgtaagtgtg

SEQ ID NO: 428464 - DNA, 16 bp, M. musculus
tatatatgtaatgtat

SEQ ID NO: 428465 - DNA, 16 bp, M. musculus
tatatatgtacatatg

SEQ ID NO: 428466 - DNA, 16 bp, M. musculus
tatatatgtatagaaa

SEQ ID NO: 428467 - DNA, 16 bp, M. musculus
tatatatgtatataag

SEQ ID NO: 428468 - DNA, 16 bp, M. musculus
tatatatgtgcaaata

SEQ ID NO: 428469 - DNA, 16 bp, M. musculus
tatatatgtggctgga

SEQ ID NO: 428470 - DNA, 16 bp, M. musculus
tatatatgtgtctgtg

SEQ ID NO: 428471 - DNA, 16 bp, M. musculus
tatatatgtgtgttta

SEQ ID NO: 428472 - DNA, 16 bp, M. musculus
tatatatgttacttga

SEQ ID NO: 428473 - DNA, 16 bp, M. musculus
tatatatgttgaatat

SEQ ID NO: 428474 - DNA, 16 bp, M. musculus
tatatattacatacat

SEQ ID NO: 428475 - DNA, 16 bp, M. musculus
tatatattatgggtgt

SEQ ID NO: 428476 - DNA, 16 bp, M. musculus
tatatattcagtatat

SEQ ID NO: 428477 - DNA, 16 bp, M. musculus
tatatattcatattca

SEQ ID NO: 428478 - DNA, 16 bp, M. musculus
tatatattcattctgt

SEQ ID NO: 428479 - DNA, 16 bp, M. musculus
tatatattgcatatat

SEQ ID NO: 428480 - DNA, 16 bp, M. musculus
tatatattgctaaata

SEQ ID NO: 428481 - DNA, 16 bp, M. musculus
tatatattggatatta

SEQ ID NO: 428482 - DNA, 16 bp, M. musculus
tatatattggctatta

SEQ ID NO: 428483 - DNA, 16 bp, M. musculus
tatatattttagatag

SEQ ID NO: 428484 - DNA, 16 bp, M. musculus
tatatattttatatgc

SEQ ID NO: 428485 - DNA, 16 bp, M. musculus
tatatcagaaaaaaat

SEQ ID NO: 428486 - DNA, 16 bp, M. musculus
tatatcagtgacccta

SEQ ID NO: 428487 - DNA, 16 bp, M. musculus
tatatcagtgtttatt

SEQ ID NO: 428488 - DNA, 16 bp, M. musculus
tatatccaaacttatg

SEQ ID NO: 428489 - DNA, 16 bp, M. musculus
tatatccagaagctgt

SEQ ID NO: 428490 - DNA, 16 bp, M. musculus
tatatcctatcagatc

SEQ ID NO: 428491 - DNA, 16 bp, M. musculus
tatatcctgattacag

SEQ ID NO: 428492 - DNA, 16 bp, M. musculus
tatatccttctgtttt

SEQ ID NO: 428493 - DNA, 16 bp, M. musculus
tatatccttttgattt

SEQ ID NO: 428494 - DNA, 16 bp, M. musculus
tatatctatatatatc

SEQ ID NO: 428495 - DNA, 16 bp, M. musculus
tatatctcaggcagtc

SEQ ID NO: 428496 - DNA, 16 bp, M. musculus
tatatctcccttgttt

SEQ ID NO: 428497 - DNA, 16 bp, M. musculus
tatatctctatatata

SEQ ID NO: 428498 - DNA, 16 bp, M. musculus
tatatctctatgtgga

SEQ ID NO: 428499 - DNA, 16 bp, M. musculus
tatatctgactggagt

SEQ ID NO: 428500 - DNA, 16 bp, M. musculus
tatatctggccacttt

SEQ ID NO: 428501 - DNA, 16 bp, M. musculus
tatatctgtaccccat

SEQ ID NO: 428502 - DNA, 16 bp, M. musculus
tatatctgtatatcta

SEQ ID NO: 428503 - DNA, 16 bp, M. musculus
tatatctttataccat

SEQ ID NO: 428504 - DNA, 16 bp, M. musculus
tatatctttctggcaa

SEQ ID NO: 428505 - DNA, 16 bp, M. musculus
tatatgaaattgtcaa

SEQ ID NO: 428506 - DNA, 16 bp, M. musculus
tatatgactgtgagca

SEQ ID NO: 428507 - DNA, 16 bp, M. musculus
tatatgacttttaaaa

SEQ ID NO: 428508 - DNA, 16 bp, M. musculus
tatatgagaaaagaat

SEQ ID NO: 428509 - DNA, 16 bp, M. musculus
tatatgagcctaaggg

SEQ ID NO: 428510 - DNA, 16 bp, M. musculus
tatatgagtacactgt

SEQ ID NO: 428511 - DNA, 17 bp, M. musculus
tatatgagtacactgtt

SEQ ID NO: 428512 - DNA, 16 bp, M. musculus
tatatgagtatgtgtg

SEQ ID NO: 428513 - DNA, 16 bp, M. musculus
tatatgatgtatgata

SEQ ID NO: 428514 - DNA, 16 bp, M. musculus
tatatgcaaatattcc

SEQ ID NO: 428515 - DNA, 16 bp, M. musculus
tatatgcacacagaga

SEQ ID NO: 428516 - DNA, 16 bp, M. musculus
tatatgcacatgcatg

SEQ ID NO: 428517 - DNA, 16 bp, M. musculus
tatatgcaccagtaca

SEQ ID NO: 428518 - DNA, 16 bp, M. musculus
tatatgcatatagtat

SEQ ID NO: 428519 - DNA, 16 bp, M. musculus
tatatgcatatatatg

SEQ ID NO: 428520 - DNA, 16 bp, M. musculus
tatatgcatatatatt

SEQ ID NO: 428521 - DNA, 16 bp, M. musculus
tatatgcatatgtgtg

SEQ ID NO: 428522 - DNA, 16 bp, M. musculus
tatatgcatgcatata

SEQ ID NO: 428523 - DNA, 16 bp, M. musculus
tatatgccatgtgtgt

SEQ ID NO: 428524 - DNA, 16 bp, M. musculus
tatatgcccaagagtg

SEQ ID NO: 428525 - DNA, 16 bp, M. musculus
tatatgcccaggaata

SEQ ID NO: 428526 - DNA, 23 bp, M. musculus
tatatgcccaggagaggtattgc

SEQ ID NO: 428527 - DNA, 24 bp, M. musculus
tatatgccccagtacaggggaacg

SEQ ID NO: 428528 - DNA, 16 bp, M. musculus
tatatgcgtgtgtgtg

SEQ ID NO: 428529 - DNA, 21 bp, M. musculus
tatatgctcaggagaggtatt

SEQ ID NO: 428530 - DNA, 16 bp, M. musculus
tatatggccagttttg

SEQ ID NO: 428531 - DNA, 17 bp, M. musculus
tatatgggagcaacttg

SEQ ID NO: 428532 - DNA, 16 bp, M. musculus
tatatggttgcagttc

SEQ ID NO: 428533 - DNA, 16 bp, M. musculus
tatatggttttgttca

SEQ ID NO: 428534 - DNA, 16 bp, M. musculus
tatatgtaagtacaca

SEQ ID NO: 428535 - DNA, 16 bp, M. musculus
tatatgtacatataat

SEQ ID NO: 428536 - DNA, 16 bp, M. musculus
tatatgtacatataca

SEQ ID NO: 428537 - DNA, 16 bp, M. musculus
tatatgtacattatat

SEQ ID NO: 428538 - DNA, 16 bp, M. musculus
tatatgtagaaaaaga

SEQ ID NO: 428539 - DNA, 16 bp, M. musculus
tatatgtagatataga

SEQ ID NO: 428540 - DNA, 16 bp, M. musculus
tatatgtatacacaaa

SEQ ID NO: 428541 - DNA, 17 bp, M. musculus
tatatgtatacacacac

SEQ ID NO: 428542 - DNA, 16 bp, M. musculus
tatatgtatacacata

SEQ ID NO: 428543 - DNA, 16 bp, M. musculus
tatatgtatacatata

SEQ ID NO: 428544 - DNA, 16 bp, M. musculus
tatatgtatacatgtg

SEQ ID NO: 428545 - DNA, 16 bp, M. musculus
tatatgtatataatct

SEQ ID NO: 428546 - DNA, 16 bp, M. musculus
tatatgtatatatacc

SEQ ID NO: 428547 - DNA, 16 bp, M. musculus
tatatgtatatatatc

SEQ ID NO: 428548 - DNA, 16 bp, M. musculus
tatatgtatatatgca

SEQ ID NO: 428549 - DNA, 16 bp, M. musculus
tatatgtatatgtaca

SEQ ID NO: 428550 - DNA, 17 bp, M. musculus
tatatgtatatgtatat

SEQ ID NO: 428551 - DNA, 16 bp, M. musculus
tatatgtatatgtatg

SEQ ID NO: 428552 - DNA, 20 bp, M. musculus
tatatgtatatgtgtgtata

SEQ ID NO: 428553 - DNA, 16 bp, M. musculus
tatatgtatattatag

SEQ ID NO: 428554 - DNA, 16 bp, M. musculus
tatatgtatattttca

SEQ ID NO: 428555 - DNA, 16 bp, M. musculus
tatatgtatgtgtatt

SEQ ID NO: 428556 - DNA, 16 bp, M. musculus
tatatgtctaggagtg

SEQ ID NO: 428557 - DNA, 16 bp, M. musculus
tatatgtgaaatatat

SEQ ID NO: 428558 - DNA, 16 bp, M. musculus
tatatgtgacatgaaa

SEQ ID NO: 428559 - DNA, 16 bp, M. musculus
tatatgtgatatatat

SEQ ID NO: 428560 - DNA, 16 bp, M. musculus
tatatgtgcacacaca

SEQ ID NO: 428561 - DNA, 16 bp, M. musculus
tatatgtgcatatata

SEQ ID NO: 428562 - DNA, 16 bp, M. musculus
tatatgtgtatgcaca

SEQ ID NO: 428563 - DNA, 16 bp, M. musculus
tatatgtgtgagtatg

SEQ ID NO: 428564 - DNA, 16 bp, M. musculus
tatatgtgtgcacaca

SEQ ID NO: 428565 - DNA, 16 bp, M. musculus
tatatgtgtgtacact

SEQ ID NO: 428566 - DNA, 16 bp, M. musculus
tatatgtgtgtacata

SEQ ID NO: 428567 - DNA, 16 bp, M. musculus
tatatgtgtgtataca

SEQ ID NO: 428568 - DNA, 16 bp, M. musculus
tatatgtgtgtatata

SEQ ID NO: 428569 - DNA, 16 bp, M. musculus
tatatgtgtgtatgtt

SEQ ID NO: 428570 - DNA, 16 bp, M. musculus
tatatgtgtgtattat

SEQ ID NO: 428571 - DNA, 16 bp, M. musculus
tatatgtgtgtgtgga

SEQ ID NO: 428572 - DNA, 55 bp, M. musculus
tatatgttgataaaactggattagttaaagatagcattgccaaggttactgccag

SEQ ID NO: 428573 - DNA, 16 bp, M. musculus
tatatgtttgtgtata

SEQ ID NO: 428574 - DNA, 16 bp, M. musculus
tatattaaatagatag

SEQ ID NO: 428575 - DNA, 16 bp, M. musculus
tatattatattcatgt

SEQ ID NO: 428576 - DNA, 16 bp, M. musculus
tatattatgcataata

SEQ ID NO: 428577 - DNA, 16 bp, M. musculus
tatattcacacacaca

SEQ ID NO: 428578 - DNA, 16 bp, M. musculus
tatattcacatatgca

SEQ ID NO: 428579 - DNA, 16 bp, M. musculus
tatattcagaaaaaaa

SEQ ID NO: 428580 - DNA, 16 bp, M. musculus
tatattcatagatcag

SEQ ID NO: 428581 - DNA, 16 bp, M. musculus
tatattcatatattca

SEQ ID NO: 428582 - DNA, 16 bp, M. musculus
tatattcatatgcata

SEQ ID NO: 428583 - DNA, 16 bp, M. musculus
tatattcatatgtgta

SEQ ID NO: 428584 - DNA, 16 bp, M. musculus
tatattcatgtatata

SEQ ID NO: 428585 - DNA, 16 bp, M. musculus
tatattctgtaatata

SEQ ID NO: 428586 - DNA, 16 bp, M. musculus
tatattcttgggtgtg

SEQ ID NO: 428587 - DNA, 16 bp, M. musculus
tatattgcttttatca

SEQ ID NO: 428588 - DNA, 16 bp, M. musculus
tatattggtcatatac

SEQ ID NO: 428589 - DNA, 16 bp, M. musculus
tatattgtaccatccc

SEQ ID NO: 428590 - DNA, 16 bp, M. musculus
tatatttaaaaagcaa

SEQ ID NO: 428591 - DNA, 16 bp, M. musculus
tatatttacacatata

SEQ ID NO: 428592 - DNA, 16 bp, M. musculus
tatatttatacacaaa

SEQ ID NO: 428593 - DNA, 16 bp, M. musculus
tatatttatatacaca

SEQ ID NO: 428594 - DNA, 16 bp, M. musculus
tatatttatgcatttt

SEQ ID NO: 428595 - DNA, 16 bp, M. musculus
tatatttatttttgca

SEQ ID NO: 428596 - DNA, 16 bp, M. musculus
tatatttctaaataca

SEQ ID NO: 428597 - DNA, 16 bp, M. musculus
tatatttctactgtgt

SEQ ID NO: 428598 - DNA, 16 bp, M. musculus
tatatttctgtatata

SEQ ID NO: 428599 - DNA, 16 bp, M. musculus
tatatttgcatatata

SEQ ID NO: 428600 - DNA, 16 bp, M. musculus
tatatttgcttattta

SEQ ID NO: 428601 - DNA, 16 bp, M. musculus
tatatttgctttaaaa

SEQ ID NO: 428602 - DNA, 16 bp, M. musculus
tatatttgtatataca

SEQ ID NO: 428603 - DNA, 16 bp, M. musculus
tatatttgtgtgtatg

SEQ ID NO: 428604 - DNA, 16 bp, M. musculus
tatattttaaaggaaa

SEQ ID NO: 428605 - DNA, 16 bp, M. musculus
tatattttaaatgcta

SEQ ID NO: 428606 - DNA, 16 bp, M. musculus
tatattttcaaactca

SEQ ID NO: 428607 - DNA, 16 bp, M. musculus
tatattttcaaataca

SEQ ID NO: 428608 - DNA, 16 bp, M. musculus
tatattttcaaatgtt

SEQ ID NO: 428609 - DNA, 16 bp, M. musculus
tatattttccaaataa

SEQ ID NO: 428610 - DNA, 16 bp, M. musculus
tatattttcttctcag

SEQ ID NO: 428611 - DNA, 16 bp, M. musculus
tatattttgaaagcca

SEQ ID NO: 428612 - DNA, 16 bp, M. musculus
tatattttgcatatat

SEQ ID NO: 428613 - DNA, 16 bp, M. musculus
tatattttgtggaaaa

SEQ ID NO: 428614 - DNA, 16 bp, M. musculus
tatattttgttacatt

SEQ ID NO: 428615 - DNA, 16 bp, M. musculus
tatatttttcaaaacc

SEQ ID NO: 428616 - DNA, 16 bp, M. musculus
tatatttttctcaaaa

SEQ ID NO: 428617 - DNA, 16 bp, M. musculus
tatcaaaatgtttaca

SEQ ID NO: 428618 - DNA, 16 bp, M. musculus
tatcaaagaaccagct

SEQ ID NO: 428619 - DNA, 16 bp, M. musculus
tatcaacagagcttga

SEQ ID NO: 428620 - DNA, 16 bp, M. musculus
tatcaacccaccttgg

SEQ ID NO: 428621 - DNA, 16 bp, M. musculus
tatcaactaactagac

SEQ ID NO: 428622 - DNA, 16 bp, M. musculus
tatcaactgagccatc

SEQ ID NO: 428623 - DNA, 16 bp, M. musculus
tatcaagaactcaaga

SEQ ID NO: 428624 - DNA, 16 bp, M. musculus
tatcaaggaaatgcaa

SEQ ID NO: 428625 - DNA, 16 bp, M. musculus
tatcaaggcaggaaca

SEQ ID NO: 428626 - DNA, 16 bp, M. musculus
tatcaagtggcttctt

SEQ ID NO: 428627 - DNA, 16 bp, M. musculus
tatcaagttaaatgga

SEQ ID NO: 428628 - DNA, 16 bp, M. musculus
tatcaagttgcagtag

SEQ ID NO: 428629 - DNA, 16 bp, M. musculus
tatcaataaattctca

SEQ ID NO: 428630 - DNA, 56 bp, M. musculus
tatcaatcatgtcccactataagctccattgccttgacgtgggaatcctctgaagg

SEQ ID NO: 428631 - DNA, 56 bp, M. musculus
tatcaatcatgtcccactataagctccgttgccttgacgtgggaatcctctgaagg

SEQ ID NO: 428632 - DNA, 16 bp, M. musculus
tatcaatgagtacata

SEQ ID NO: 428633 - DNA, 16 bp, M. musculus
tatcaatggaaggagt

SEQ ID NO: 428634 - DNA, 16 bp, M. musculus
tatcaattggccctga

SEQ ID NO: 428635 - DNA, 16 bp, M. musculus
tatcacaaagaaagga

SEQ ID NO: 428636 - DNA, 17 bp, M. musculus
tatcacagagctctaaa

SEQ ID NO: 428637 - DNA, 16 bp, M. musculus
tatcacagcaaacagc

SEQ ID NO: 428638 - DNA, 16 bp, M. musculus
tatcaccaaaagaaat

SEQ ID NO: 428639 - DNA, 16 bp, M. musculus
tatcaccatcaccacc

SEQ ID NO: 428640 - DNA, 17 bp, M. musculus
tatcaccatcatcacca

SEQ ID NO: 428641 - DNA, 16 bp, M. musculus
tatcaccatcatcatc

SEQ ID NO: 428642 - DNA, 16 bp, M. musculus
tatcaccattgctctg

SEQ ID NO: 428643 - DNA, 16 bp, M. musculus
tatcacctatcatcta

SEQ ID NO: 428644 - DNA, 16 bp, M. musculus
tatcactcacacacac

SEQ ID NO: 428645 - DNA, 16 bp, M. musculus
tatcactccactggga

SEQ ID NO: 428646 - DNA, 16 bp, M. musculus
tatcactgagtaaaga

SEQ ID NO: 428647 - DNA, 16 bp, M. musculus
tatcagagcttttttg

SEQ ID NO: 428648 - DNA, 16 bp, M. musculus
tatcagataccctgca

SEQ ID NO: 428649 - DNA, 16 bp, M. musculus
tatcagataccctgga

SEQ ID NO: 428650 - DNA, 16 bp, M. musculus
tatcagatatcctaca

SEQ ID NO: 428651 - DNA, 16 bp, M. musculus
tatcagatattaaaat

SEQ ID NO: 428652 - DNA, 16 bp, M. musculus
tatcagatgtgcagct

SEQ ID NO: 428653 - DNA, 16 bp, M. musculus
tatcagattccctgga

SEQ ID NO: 428654 - DNA, 16 bp, M. musculus
tatcagccaaccagac

SEQ ID NO: 428655 - DNA, 16 bp, M. musculus
tatcagctgcaagaag

SEQ ID NO: 428656 - DNA, 16 bp, M. musculus
tatcaggcagctcaca

SEQ ID NO: 428657 - DNA, 16 bp, M. musculus
tatcaggccttggagc

SEQ ID NO: 428658 - DNA, 16 bp, M. musculus
tatcaggggctggaga

SEQ ID NO: 428659 - DNA, 16 bp, M. musculus
tatcagggtcctgtca

SEQ ID NO: 428660 - DNA, 16 bp, M. musculus
tatcaggtaagaatta

SEQ ID NO: 428661 - DNA, 16 bp, M. musculus
tatcaggtgtcttcct

SEQ ID NO: 428662 - DNA, 16 bp, M. musculus
tatcagtagacctggg

SEQ ID NO: 428663 - DNA, 17 bp, M. musculus
tatcagtcttaaggagt

SEQ ID NO: 428664 - DNA, 16 bp, M. musculus
tatcagtgggaggaga

SEQ ID NO: 428665 - DNA, 16 bp, M. musculus
tatcagtgtaactgtg

SEQ ID NO: 428666 - DNA, 16 bp, M. musculus
tatcagtgtgtgtgtg

SEQ ID NO: 428667 - DNA, 17 bp, M. musculus
tatcagttaaagcttta

SEQ ID NO: 428668 - DNA, 16 bp, M. musculus
tatcataatgaaaaat

SEQ ID NO: 428669 - DNA, 16 bp, M. musculus
tatcatacagatctct

SEQ ID NO: 428670 - DNA, 16 bp, M. musculus
tatcatagagaaagaa

SEQ ID NO: 428671 - DNA, 16 bp, M. musculus
tatcatagatgaagaa

SEQ ID NO: 428672 - DNA, 16 bp, M. musculus
tatcatatattatatg

SEQ ID NO: 428673 - DNA, 16 bp, M. musculus
tatcatatcatcagca

SEQ ID NO: 428674 - DNA, 16 bp, M. musculus
tatcatcaaagtggga

SEQ ID NO: 428675 - DNA, 16 bp, M. musculus
tatcatcaaggcagga

SEQ ID NO: 428676 - DNA, 16 bp, M. musculus
tatcatcaaggtggga

SEQ ID NO: 428677 - DNA, 16 bp, M. musculus
tatcatcagagaggct

SEQ ID NO: 428678 - DNA, 16 bp, M. musculus
tatcatcatggaagga

SEQ ID NO: 428679 - DNA, 16 bp, M. musculus
tatcatcattgtggga

SEQ ID NO: 428680 - DNA, 16 bp, M. musculus
tatcatccaaaaatgc

SEQ ID NO: 428681 - DNA, 16 bp, M. musculus
tatcatcctgagcgag

SEQ ID NO: 428682 - DNA, 16 bp, M. musculus
tatcatcctgagtgag

SEQ ID NO: 428683 - DNA, 16 bp, M. musculus
tatcatcgtcatcatc

SEQ ID NO: 428684 - DNA, 16 bp, M. musculus
tatcatctgtctgtct

SEQ ID NO: 428685 - DNA, 17 bp, M. musculus
tatcatgaacccctgga

SEQ ID NO: 428686 - DNA, 17 bp, M. musculus
tatcatgtttatgtatg

SEQ ID NO: 428687 - DNA, 16 bp, M. musculus
tatcattatcatcatc

SEQ ID NO: 428688 - DNA, 16 bp, M. musculus
tatcattgagaagtgt

SEQ ID NO: 428689 - DNA, 16 bp, M. musculus
tatcattgctgtgatg

SEQ ID NO: 428690 - DNA, 16 bp, M. musculus
tatcattgttcctcct

SEQ ID NO: 428691 - DNA, 16 bp, M. musculus
tatcatttaaatagtt

SEQ ID NO: 428692 - DNA, 16 bp, M. musculus
tatcatttgagatgta

SEQ ID NO: 428693 - DNA, 16 bp, M. musculus
tatcatttgctgaaag

SEQ ID NO: 428694 - DNA, 16 bp, M. musculus
tatcattttgttttag

SEQ ID NO: 428695 - DNA, 16 bp, M. musculus
tatccaagaaaagaaa

SEQ ID NO: 428696 - DNA, 16 bp, M. musculus
tatccaagcaggcatg

SEQ ID NO: 428697 - DNA, 16 bp, M. musculus
tatccacatgtagaag

SEQ ID NO: 428698 - DNA, 31 bp, M. musculus
tatccaccattatgggccccttgataatact

SEQ ID NO: 428699 - DNA, 16 bp, M. musculus
tatccacccacccact

SEQ ID NO: 428700 - DNA, 16 bp, M. musculus
tatccacttataactg

SEQ ID NO: 428701 - DNA, 16 bp, M. musculus
tatccagagactacca

SEQ ID NO: 428702 - DNA, 16 bp, M. musculus
tatccagagatgggca

SEQ ID NO: 428703 - DNA, 24 bp, M. musculus
tatccaggaaatccaggacacaat

SEQ ID NO: 428704 - DNA, 16 bp, M. musculus
tatccaggaactgaat

SEQ ID NO: 428705 - DNA, 21 bp, M. musculus
tatccaggacaagaaatgtga

SEQ ID NO: 428706 - DNA, 16 bp, M. musculus
tatccagggcttactg

SEQ ID NO: 428707 - DNA, 16 bp, M. musculus
tatccaggttctccag

SEQ ID NO: 428708 - DNA, 16 bp, M. musculus
tatccagtctttcaca

SEQ ID NO: 428709 - DNA, 16 bp, M. musculus
tatccatccatccatc

SEQ ID NO: 428710 - DNA, 17 bp, M. musculus
tatccatccatccatct

SEQ ID NO: 428711 - DNA, 16 bp, M. musculus
tatccatctatctatt

SEQ ID NO: 428712 - DNA, 16 bp, M. musculus
tatccatgaggtgttt

SEQ ID NO: 428713 - DNA, 16 bp, M. musculus
tatccattactctgtt

SEQ ID NO: 428714 - DNA, 16 bp, M. musculus
tatccattcctctgat

SEQ ID NO: 428715 - DNA, 16 bp, M. musculus
tatccattggatggag

SEQ ID NO: 428716 - DNA, 16 bp, M. musculus
tatcccaaaagctgtt

SEQ ID NO: 428717 - DNA, 16 bp, M. musculus
tatcccaaaagtaccc

SEQ ID NO: 428718 - DNA, 19 bp, M. musculus
tatcccaaaagtcccttat

SEQ ID NO: 428719 - DNA, 16 bp, M. musculus
tatcccaagatatttt

SEQ ID NO: 428720 - DNA, 16 bp, M. musculus
tatcccagaatcctct

SEQ ID NO: 428721 - DNA, 16 bp, M. musculus
tatcccagaattcttt

SEQ ID NO: 428722 - DNA, 16 bp, M. musculus
tatcccagactcttcc

SEQ ID NO: 428723 - DNA, 19 bp, M. musculus
tatcccagcacttgggagg

SEQ ID NO: 428724 - DNA, 16 bp, M. musculus
tatcccaggctggcct

SEQ ID NO: 428725 - DNA, 16 bp, M. musculus
tatcccaggctggctt

SEQ ID NO: 428726 - DNA, 16 bp, M. musculus
tatcccatcatccctc

SEQ ID NO: 428727 - DNA, 16 bp, M. musculus
tatcccattcatccta

SEQ ID NO: 428728 - DNA, 16 bp, M. musculus
tatcccatttttaata

SEQ ID NO: 428729 - DNA, 16 bp, M. musculus
tatccccagagttccc

SEQ ID NO: 428730 - DNA, 16 bp, M. musculus
tatcccccactttctc

SEQ ID NO: 428731 - DNA, 17 bp, M. musculus
tatcccccttcccggtt

SEQ ID NO: 428732 - DNA, 16 bp, M. musculus
tatcccccttccctgt

SEQ ID NO: 428733 - DNA, 16 bp, M. musculus
tatcccctaataaaac

SEQ ID NO: 428734 - DNA, 18 bp, M. musculus
tatcccctttcctagttt

SEQ ID NO: 428735 - DNA, 16 bp, M. musculus
tatcccctttcctatt

SEQ ID NO: 428736 - DNA, 16 bp, M. musculus
tatcccctttgctagt

SEQ ID NO: 428737 - DNA, 16 bp, M. musculus
tatcccctttttgggt

SEQ ID NO: 428738 - DNA, 16 bp, M. musculus
tatcccgtgcaatgag

SEQ ID NO: 428739 - DNA, 16 bp, M. musculus
tatccctatctctatc

SEQ ID NO: 428740 - DNA, 16 bp, M. musculus
tatccctcttcctggt

SEQ ID NO: 428741 - DNA, 16 bp, M. musculus
tatccctgaggtgggt

SEQ ID NO: 428742 - DNA, 16 bp, M. musculus
tatccctgcatccctg

SEQ ID NO: 428743 - DNA, 16 bp, M. musculus
tatccctggctgccct

SEQ ID NO: 428744 - DNA, 16 bp, M. musculus
tatccctgggatgaaa

SEQ ID NO: 428745 - DNA, 16 bp, M. musculus
tatcccttcaaactgt

SEQ ID NO: 428746 - DNA, 16 bp, M. musculus
tatcccttcttctcag

SEQ ID NO: 428747 - DNA, 16 bp, M. musculus
tatccctttttgcaga

SEQ ID NO: 428748 - DNA, 18 bp, M. musculus
tatcctaggtttattgtt

SEQ ID NO: 428749 - DNA, 16 bp, M. musculus
tatcctgaaactcact

SEQ ID NO: 428750 - DNA, 16 bp, M. musculus
tatcctgaatcagata

SEQ ID NO: 428751 - DNA, 16 bp, M. musculus
tatcctgaatgtcccc

SEQ ID NO: 428752 - DNA, 16 bp, M. musculus
tatcctgagcttttgt

SEQ ID NO: 428753 - DNA, 17 bp, M. musculus
tatcctgagtgaggtaa

SEQ ID NO: 428754 - DNA, 16 bp, M. musculus
tatcctggaactcact

SEQ ID NO: 428755 - DNA, 16 bp, M. musculus
tatcctggagctcttg

SEQ ID NO: 428756 - DNA, 16 bp, M. musculus
tatcctggctgtcctg

SEQ ID NO: 428757 - DNA, 16 bp, M. musculus
tatcctgtactttgtg

SEQ ID NO: 428758 - DNA, 16 bp, M. musculus
tatcctgtgtatcaga

SEQ ID NO: 428759 - DNA, 16 bp, M. musculus
tatcctgttgttgccc

SEQ ID NO: 428760 - DNA, 16 bp, M. musculus
tatccttgaactcatt

SEQ ID NO: 428761 - DNA, 16 bp, M. musculus
tatccttgggaagagt

SEQ ID NO: 428762 - DNA, 16 bp, M. musculus
tatccttgtgttttag

SEQ ID NO: 428763 - DNA, 16 bp, M. musculus
tatcctttctttccca

SEQ ID NO: 428764 - DNA, 16 bp, M. musculus
tatcctttttgtagag

SEQ ID NO: 428765 - DNA, 16 bp, M. musculus
tatcgagggcagggag

SEQ ID NO: 428766 - DNA, 16 bp, M. musculus
tatcgtcatcatcatc

SEQ ID NO: 428767 - DNA, 17 bp, M. musculus
tatctaaaggacccaga

SEQ ID NO: 428768 - DNA, 16 bp, M. musculus
tatctaataaaaaaag

SEQ ID NO: 428769 - DNA, 16 bp, M. musculus
tatctaataaaaactt

SEQ ID NO: 428770 - DNA, 16 bp, M. musculus
tatctaataaagcaga

SEQ ID NO: 428771 - DNA, 16 bp, M. musculus
tatctacaataaaacc

SEQ ID NO: 428772 - DNA, 16 bp, M. musculus
tatctaccatctatct

SEQ ID NO: 428773 - DNA, 17 bp, M. musculus
tatctacttatcagtga

SEQ ID NO: 428774 - DNA, 17 bp, M. musculus
tatctagagactatcca

SEQ ID NO: 428775 - DNA, 16 bp, M. musculus
tatctagagactatct

SEQ ID NO: 428776 - DNA, 16 bp, M. musculus
tatctagatacttcat

SEQ ID NO: 428777 - DNA, 16 bp, M. musculus
tatctaggttgtttct

SEQ ID NO: 428778 - DNA, 16 bp, M. musculus
tatctagtctcaggtt

SEQ ID NO: 428779 - DNA, 16 bp, M. musculus
tatctagtgttggggg

SEQ ID NO: 428780 - DNA, 16 bp, M. musculus
tatctatacatataca

SEQ ID NO: 428781 - DNA, 16 bp, M. musculus
tatctatatctatcta

SEQ ID NO: 428782 - DNA, 16 bp, M. musculus
tatctatcacctatct

SEQ ID NO: 428783 - DNA, 16 bp, M. musculus
tatctatcatctatat

SEQ ID NO: 428784 - DNA, 16 bp, M. musculus
tatctatcatctgtct

SEQ ID NO: 428785 - DNA, 16 bp, M. musculus
tatctatctatataaa

SEQ ID NO: 428786 - DNA, 16 bp, M. musculus
tatctatctatcaata

SEQ ID NO: 428787 - DNA, 16 bp, M. musculus
tatctatctatcatat

SEQ ID NO: 428788 - DNA, 23 bp, M. musculus
tatctatctatctatctatctca

SEQ ID NO: 428789 - DNA, 16 bp, M. musculus
tatctatctatctatt

SEQ ID NO: 428790 - DNA, 16 bp, M. musculus
tatctatctatctcta

SEQ ID NO: 428791 - DNA, 16 bp, M. musculus
tatctatctatgtgtc

SEQ ID NO: 428792 - DNA, 16 bp, M. musculus
tatctatgtatatata

SEQ ID NO: 428793 - DNA, 16 bp, M. musculus
tatctatgtgtatgta

SEQ ID NO: 428794 - DNA, 17 bp, M. musculus
tatctcactaaggatga

SEQ ID NO: 428795 - DNA, 16 bp, M. musculus
tatctcaggatgatgg

SEQ ID NO: 428796 - DNA, 16 bp, M. musculus
tatctcaggctggcct

SEQ ID NO: 428797 - DNA, 16 bp, M. musculus
tatctcaggctggctt

SEQ ID NO: 428798 - DNA, 16 bp, M. musculus
tatctcagttggtaga

SEQ ID NO: 428799 - DNA, 16 bp, M. musculus
tatctcatggagacat

SEQ ID NO: 428800 - DNA, 16 bp, M. musculus
tatctcatttaaaaaa

SEQ ID NO: 428801 - DNA, 19 bp, M. musculus
tatctcccagcctccagat

SEQ ID NO: 428802 - DNA, 17 bp, M. musculus
tatctcctgtgtgagat

SEQ ID NO: 428803 - DNA, 16 bp, M. musculus
tatctccttggactaa

SEQ ID NO: 428804 - DNA, 19 bp, M. musculus
tatctctaattggacagat

SEQ ID NO: 428805 - DNA, 16 bp, M. musculus
tatctctagttgcata

SEQ ID NO: 428806 - DNA, 16 bp, M. musculus
tatctctatttctatc

SEQ ID NO: 428807 - DNA, 17 bp, M. musculus
tatctctcaggttaagt

SEQ ID NO: 428808 - DNA, 16 bp, M. musculus
tatctctccagcccca

SEQ ID NO: 428809 - DNA, 16 bp, M. musculus
tatctctctatatata

SEQ ID NO: 428810 - DNA, 16 bp, M. musculus
tatctctgcttcctga

SEQ ID NO: 428811 - DNA, 16 bp, M. musculus
tatctctgtaaaactg

SEQ ID NO: 428812 - DNA, 16 bp, M. musculus
tatctctgtgtctctg

SEQ ID NO: 428813 - DNA, 16 bp, M. musculus
tatctcttaatttcaa

SEQ ID NO: 428814 - DNA, 16 bp, M. musculus
tatctcttagaagcct

SEQ ID NO: 428815 - DNA, 18 bp, M. musculus
tatctcttgtattctgtt

SEQ ID NO: 428816 - DNA, 16 bp, M. musculus
tatctgaaaagaggga

SEQ ID NO: 428817 - DNA, 16 bp, M. musculus
tatctgaaaggaagga

SEQ ID NO: 428818 - DNA, 16 bp, M. musculus
tatctgaaggatatca

SEQ ID NO: 428819 - DNA, 16 bp, M. musculus
tatctgaatagtattc

SEQ ID NO: 428820 - DNA, 16 bp, M. musculus
tatctgacaagaagca

SEQ ID NO: 428821 - DNA, 16 bp, M. musculus
tatctgagaggaggga

SEQ ID NO: 428822 - DNA, 16 bp, M. musculus
tatctgaggatccatc

SEQ ID NO: 428823 - DNA, 16 bp, M. musculus
tatctgataaaggatt

SEQ ID NO: 428824 - DNA, 16 bp, M. musculus
tatctgatcacactgt

SEQ ID NO: 428825 - DNA, 16 bp, M. musculus
tatctgatgagccatc

SEQ ID NO: 428826 - DNA, 16 bp, M. musculus
tatctgcagaggccag

SEQ ID NO: 428827 - DNA, 16 bp, M. musculus
tatctgcatctgtttt

SEQ ID NO: 428828 - DNA, 16 bp, M. musculus
tatctgcatgtacatc

SEQ ID NO: 428829 - DNA, 16 bp, M. musculus
tatctgcatgtatgta

SEQ ID NO: 428830 - DNA, 16 bp, M. musculus
tatctgccaaggaaag

SEQ ID NO: 428831 - DNA, 16 bp, M. musculus
tatctgcctagaaatt

SEQ ID NO: 428832 - DNA, 16 bp, M. musculus
tatctgcctgcctgcc

SEQ ID NO: 428833 - DNA, 16 bp, M. musculus
tatctgcctgtctctg

SEQ ID NO: 428834 - DNA, 16 bp, M. musculus
tatctgctgagccatt

SEQ ID NO: 428835 - DNA, 16 bp, M. musculus
tatctgcttcaggaaa

SEQ ID NO: 428836 - DNA, 16 bp, M. musculus
tatctggaaggcacat

SEQ ID NO: 428837 - DNA, 16 bp, M. musculus
tatctggagttcagac

SEQ ID NO: 428838 - DNA, 16 bp, M. musculus
tatctggatcttgaga

SEQ ID NO: 428839 - DNA, 16 bp, M. musculus
tatctggccttcccca

SEQ ID NO: 428840 - DNA, 18 bp, M. musculus
tatctggcgtttggacct

SEQ ID NO: 428841 - DNA, 16 bp, M. musculus
tatctgggtccattca

SEQ ID NO: 428842 - DNA, 16 bp, M. musculus
tatctgtaaaatccat

SEQ ID NO: 428843 - DNA, 17 bp, M. musculus
tatctgtatctgtatct

SEQ ID NO: 428844 - DNA, 16 bp, M. musculus
tatctgtatgataaaa

SEQ ID NO: 428845 - DNA, 16 bp, M. musculus
tatctgtctatcatct

SEQ ID NO: 428846 - DNA, 16 bp, M. musculus
tatctgtcttcagaca

SEQ ID NO: 428847 - DNA, 16 bp, M. musculus
tatctgtcttgaaaat

SEQ ID NO: 428848 - DNA, 16 bp, M. musculus
tatctgtgaggtgttt

SEQ ID NO: 428849 - DNA, 16 bp, M. musculus
tatctgtggattcaag

SEQ ID NO: 428850 - DNA, 16 bp, M. musculus
tatctgtgtaaaatct

SEQ ID NO: 428851 - DNA, 16 bp, M. musculus
tatctgtgtatatgta

SEQ ID NO: 428852 - DNA, 16 bp, M. musculus
tatctgtgtccctttg

SEQ ID NO: 428853 - DNA, 16 bp, M. musculus
tatctgtgtgtctgtg

SEQ ID NO: 428854 - DNA, 16 bp, M. musculus
tatctgtgtgtgtgag

SEQ ID NO: 428855 - DNA, 16 bp, M. musculus
tatctgtgttttccaa

SEQ ID NO: 428856 - DNA, 16 bp, M. musculus
tatcttacagatcttt

SEQ ID NO: 428857 - DNA, 16 bp, M. musculus
tatcttacccattctg

SEQ ID NO: 428858 - DNA, 19 bp, M. musculus
tatcttatatcttgggtat

SEQ ID NO: 428859 - DNA, 16 bp, M. musculus
tatcttcacatccttt

SEQ ID NO: 428860 - DNA, 16 bp, M. musculus
tatcttcatttaaaaa

SEQ ID NO: 428861 - DNA, 16 bp, M. musculus
tatcttctagggaaaa

SEQ ID NO: 428862 - DNA, 16 bp, M. musculus
tatcttctattgggtt

SEQ ID NO: 428863 - DNA, 16 bp, M. musculus
tatcttctggaaatag

SEQ ID NO: 428864 - DNA, 16 bp, M. musculus
tatcttcttggagacc

SEQ ID NO: 428865 - DNA, 16 bp, M. musculus
tatcttgcaggcagga

SEQ ID NO: 428866 - DNA, 16 bp, M. musculus
tatcttgctgtgactc

SEQ ID NO: 428867 - DNA, 16 bp, M. musculus
tatcttgggcattctg

SEQ ID NO: 428868 - DNA, 16 bp, M. musculus
tatcttgggggggggg

SEQ ID NO: 428869 - DNA, 16 bp, M. musculus
tatcttgtcacagcaa

SEQ ID NO: 428870 - DNA, 16 bp, M. musculus
tatcttgtgtatccaa

SEQ ID NO: 428871 - DNA, 16 bp, M. musculus
tatcttgttgagtttc

SEQ ID NO: 428872 - DNA, 16 bp, M. musculus
tatcttgttggttttc

SEQ ID NO: 428873 - DNA, 16 bp, M. musculus
tatcttgttttttaaa

SEQ ID NO: 428874 - DNA, 16 bp, M. musculus
tatctttcaacaaatc

SEQ ID NO: 428875 - DNA, 16 bp, M. musculus
tatctttccactgatg

SEQ ID NO: 428876 - DNA, 16 bp, M. musculus
tatcttttaaaatgtt

SEQ ID NO: 428877 - DNA, 16 bp, M. musculus
tatcttttcctttctg

SEQ ID NO: 428878 - DNA, 16 bp, M. musculus
tatgaaaaaaatggat

SEQ ID NO: 428879 - DNA, 16 bp, M. musculus
tatgaaaacattttta

SEQ ID NO: 428880 - DNA, 16 bp, M. musculus
tatgaaaaccagaaga

SEQ ID NO: 428881 - DNA, 16 bp, M. musculus
tatgaaaatatatttc

SEQ ID NO: 428882 - DNA, 16 bp, M. musculus
tatgaaaatattttgt

SEQ ID NO: 428883 - DNA, 16 bp, M. musculus
tatgaaaattcatcaa

SEQ ID NO: 428884 - DNA, 16 bp, M. musculus
tatgaaactcaaaaag

SEQ ID NO: 428885 - DNA, 16 bp, M. musculus
tatgaaactgtcaaag

SEQ ID NO: 428886 - DNA, 16 bp, M. musculus
tatgaaagaaaacatg

SEQ ID NO: 428887 - DNA, 16 bp, M. musculus
tatgaaagaaaaggat

SEQ ID NO: 428888 - DNA, 16 bp, M. musculus
tatgaaagcagtgcta

SEQ ID NO: 428889 - DNA, 16 bp, M. musculus
tatgaaagctagccag

SEQ ID NO: 428890 - DNA, 16 bp, M. musculus
tatgaaagctcattgt

SEQ ID NO: 428891 - DNA, 16 bp, M. musculus
tatgaaagggttgttc

SEQ ID NO: 428892 - DNA, 16 bp, M. musculus
tatgaaataatgatta

SEQ ID NO: 428893 - DNA, 16 bp, M. musculus
tatgaaattctcaaaa

SEQ ID NO: 428894 - DNA, 16 bp, M. musculus
tatgaaattctgaggc

SEQ ID NO: 428895 - DNA, 16 bp, M. musculus
tatgaaattcttggtc

SEQ ID NO: 428896 - DNA, 16 bp, M. musculus
tatgaaatttcagagg

SEQ ID NO: 428897 - DNA, 16 bp, M. musculus
tatgaacagagcagca

SEQ ID NO: 428898 - DNA, 16 bp, M. musculus
tatgaacatagcatgt

SEQ ID NO: 428899 - DNA, 16 bp, M. musculus
tatgaacatagtggaa

SEQ ID NO: 428900 - DNA, 16 bp, M. musculus
tatgaacatcatggag

SEQ ID NO: 428901 - DNA, 16 bp, M. musculus
tatgaacattgtggaa

SEQ ID NO: 428902 - DNA, 16 bp, M. musculus
tatgaaccaaatgaat

SEQ ID NO: 428903 - DNA, 16 bp, M. musculus
tatgaactaaccacta

SEQ ID NO: 428904 - DNA, 16 bp, M. musculus
tatgaactaaccagta

SEQ ID NO: 428905 - DNA, 16 bp, M. musculus
tatgaactgtccttcc

SEQ ID NO: 428906 - DNA, 16 bp, M. musculus
tatgaagaaaaacatt

SEQ ID NO: 428907 - DNA, 16 bp, M. musculus
tatgaagaaacaagat

SEQ ID NO: 428908 - DNA, 16 bp, M. musculus
tatgaagagctgtggc

SEQ ID NO: 428909 - DNA, 16 bp, M. musculus
tatgaagataaagtgt

SEQ ID NO: 428910 - DNA, 16 bp, M. musculus
tatgaagatgtacttt

SEQ ID NO: 428911 - DNA, 16 bp, M. musculus
tatgaagcagagatgg

SEQ ID NO: 428912 - DNA, 16 bp, M. musculus
tatgaagccacagtta

SEQ ID NO: 428913 - DNA, 16 bp, M. musculus
tatgaataatgctgct

SEQ ID NO: 428914 - DNA, 16 bp, M. musculus
tatgaatacactgtag

SEQ ID NO: 428915 - DNA, 16 bp, M. musculus
tatgaatacatgcaag

SEQ ID NO: 428916 - DNA, 17 bp, M. musculus
tatgaatagtctctaga

SEQ ID NO: 428917 - DNA, 16 bp, M. musculus
tatgaatatagtagaa

SEQ ID NO: 428918 - DNA, 16 bp, M. musculus
tatgaatatatatgca

SEQ ID NO: 428919 - DNA, 16 bp, M. musculus
tatgaatatgtgtgtg

SEQ ID NO: 428920 - DNA, 16 bp, M. musculus
tatgaatatttataca

SEQ ID NO: 428921 - DNA, 16 bp, M. musculus
tatgaatcaaaagatg

SEQ ID NO: 428922 - DNA, 16 bp, M. musculus
tatgaatgtaactagt

SEQ ID NO: 428923 - DNA, 16 bp, M. musculus
tatgaatgtcagcagt

SEQ ID NO: 428924 - DNA, 16 bp, M. musculus
tatgaatgttttgcct

SEQ ID NO: 428925 - DNA, 16 bp, M. musculus
tatgaatttttctctt

SEQ ID NO: 428926 - DNA, 16 bp, M. musculus
tatgaattttttgaca

SEQ ID NO: 428927 - DNA, 16 bp, M. musculus
tatgacaagatcttca

SEQ ID NO: 428928 - DNA, 16 bp, M. musculus
tatgacaagcacttta

SEQ ID NO: 428929 - DNA, 16 bp, M. musculus
tatgacaatgacatct

SEQ ID NO: 428930 - DNA, 16 bp, M. musculus
tatgacaccaaagatg

SEQ ID NO: 428931 - DNA, 16 bp, M. musculus
tatgacatttttatac

SEQ ID NO: 428932 - DNA, 17 bp, M. musculus
tatgaccgctatgtggc

SEQ ID NO: 428933 - DNA, 16 bp, M. musculus
tatgactattttgttt

SEQ ID NO: 428934 - DNA, 16 bp, M. musculus
tatgagaatgccaagg

SEQ ID NO: 428935 - DNA, 16 bp, M. musculus
tatgagaattttattg

SEQ ID NO: 428936 - DNA, 16 bp, M. musculus
tatgagacactgtctc

SEQ ID NO: 428937 - DNA, 16 bp, M. musculus
tatgagaccctgtctc

SEQ ID NO: 428938 - DNA, 16 bp, M. musculus
tatgagactttttttt

SEQ ID NO: 428939 - DNA, 16 bp, M. musculus
tatgagagaagaatga

SEQ ID NO: 428940 - DNA, 16 bp, M. musculus
tatgagagagaaaagt

SEQ ID NO: 428941 - DNA, 16 bp, M. musculus
tatgagagtgctaatg

SEQ ID NO: 428942 - DNA, 16 bp, M. musculus
tatgagatatttacat

SEQ ID NO: 428943 - DNA, 16 bp, M. musculus
tatgagcatccacttt

SEQ ID NO: 428944 - DNA, 16 bp, M. musculus
tatgagcctatgagga

SEQ ID NO: 428945 - DNA, 16 bp, M. musculus
tatgaggaaaactcat

SEQ ID NO: 428946 - DNA, 18 bp, M. musculus
tatgaggaagtcaggtgc

SEQ ID NO: 428947 - DNA, 16 bp, M. musculus
tatgaggctggagaga

SEQ ID NO: 428948 - DNA, 32 bp, M. musculus
tatgagggacagacaaatcagattgattttcc

SEQ ID NO: 428949 - DNA, 16 bp, M. musculus
tatgaggtgctgaaaa

SEQ ID NO: 428950 - DNA, 16 bp, M. musculus
tatgagtacagcagaa

SEQ ID NO: 428951 - DNA, 16 bp, M. musculus
tatgagtactctatct

SEQ ID NO: 428952 - DNA, 16 bp, M. musculus
tatgagtattttgcct

SEQ ID NO: 428953 - DNA, 16 bp, M. musculus
tatgagtattttgtct

SEQ ID NO: 428954 - DNA, 16 bp, M. musculus
tatgagtcaccatgtg

SEQ ID NO: 428955 - DNA, 16 bp, M. musculus
tatgagtgctttgctt

SEQ ID NO: 428956 - DNA, 16 bp, M. musculus
tatgagtggtgtgtgt

SEQ ID NO: 428957 - DNA, 16 bp, M. musculus
tatgagtgtgtacatg

SEQ ID NO: 428958 - DNA, 16 bp, M. musculus
tatgagtgtgtgtgtg

SEQ ID NO: 428959 - DNA, 16 bp, M. musculus
tatgagtgttttgcct

SEQ ID NO: 428960 - DNA, 16 bp, M. musculus
tatgagttagaggcca

SEQ ID NO: 428961 - DNA, 16 bp, M. musculus
tatgagttcatatgtg

SEQ ID NO: 428962 - DNA, 16 bp, M. musculus
tatgagttgccatggt

SEQ ID NO: 428963 - DNA, 16 bp, M. musculus
tatgataaaaactaca

SEQ ID NO: 428964 - DNA, 16 bp, M. musculus
tatgataaatcaacca

SEQ ID NO: 428965 - DNA, 16 bp, M. musculus
tatgatatgatgtgat

SEQ ID NO: 428966 - DNA, 16 bp, M. musculus
tatgatcctagcactt

SEQ ID NO: 428967 - DNA, 16 bp, M. musculus
tatgatcttcctgcct

SEQ ID NO: 428968 - DNA, 16 bp, M. musculus
tatgatcttcgcaaga

SEQ ID NO: 428969 - DNA, 16 bp, M. musculus
tatgatggactggatg

SEQ ID NO: 428970 - DNA, 16 bp, M. musculus
tatgatgtgtatatat

SEQ ID NO: 428971 - DNA, 16 bp, M. musculus
tatgattttaatttct

SEQ ID NO: 428972 - DNA, 16 bp, M. musculus
tatgatttttactact

SEQ ID NO: 428973 - DNA, 16 bp, M. musculus
tatgattttttaaaag

SEQ ID NO: 428974 - DNA, 16 bp, M. musculus
tatgcaaaatataagg

SEQ ID NO: 428975 - DNA, 16 bp, M. musculus
tatgcaaacacataca

SEQ ID NO: 428976 - DNA, 16 bp, M. musculus
tatgcaaagacaaaga

SEQ ID NO: 428977 - DNA, 16 bp, M. musculus
tatgcaaatgaagcat

SEQ ID NO: 428978 - DNA, 16 bp, M. musculus
tatgcaacaaaatgct

SEQ ID NO: 428979 - DNA, 16 bp, M. musculus
tatgcaaccagagaca

SEQ ID NO: 428980 - DNA, 16 bp, M. musculus
tatgcaatagtgtctg

SEQ ID NO: 428981 - DNA, 16 bp, M. musculus
tatgcaatgtattttg

SEQ ID NO: 428982 - DNA, 16 bp, M. musculus
tatgcacaagcacaca

SEQ ID NO: 428983 - DNA, 16 bp, M. musculus
tatgcacacacacaca

SEQ ID NO: 428984 - DNA, 16 bp, M. musculus
tatgcacagacaggct

SEQ ID NO: 428985 - DNA, 16 bp, M. musculus
tatgcacatacactca

SEQ ID NO: 428986 - DNA, 16 bp, M. musculus
tatgcacatctgtgtg

SEQ ID NO: 428987 - DNA, 16 bp, M. musculus
tatgcacatgaatgca

SEQ ID NO: 428988 - DNA, 19 bp, M. musculus
tatgcactcactgataagc

SEQ ID NO: 428989 - DNA, 16 bp, M. musculus
tatgcagacagacatg

SEQ ID NO: 428990 - DNA, 16 bp, M. musculus
tatgcagacatacatg

SEQ ID NO: 428991 - DNA, 16 bp, M. musculus
tatgcagaccaggcta

SEQ ID NO: 428992 - DNA, 16 bp, M. musculus
tatgcagcagaagatg

SEQ ID NO: 428993 - DNA, 16 bp, M. musculus
tatgcagccctggttg

SEQ ID NO: 428994 - DNA, 16 bp, M. musculus
tatgcagctgctgggg

SEQ ID NO: 428995 - DNA, 16 bp, M. musculus
tatgcagctggaatca

SEQ ID NO: 428996 - DNA, 16 bp, M. musculus
tatgcaggaggtgaca

SEQ ID NO: 428997 - DNA, 16 bp, M. musculus
tatgcaggatgtctga

SEQ ID NO: 428998 - DNA, 16 bp, M. musculus
tatgcaggcaaaacac

SEQ ID NO: 428999 - DNA, 16 bp, M. musculus
tatgcaggccaggctg

SEQ ID NO: 429000 - DNA, 16 bp, M. musculus
tatgcaggccctgtgc

SEQ ID NO: 429001 - DNA, 16 bp, M. musculus
tatgcagtgcctggca

SEQ ID NO: 429002 - DNA, 16 bp, M. musculus
tatgcatacaaacaca

SEQ ID NO: 429003 - DNA, 16 bp, M. musculus
tatgcatacacacaca

SEQ ID NO: 429004 - DNA, 16 bp, M. musculus
tatgcatacacataca

SEQ ID NO: 429005 - DNA, 16 bp, M. musculus
tatgcatacatataaa

SEQ ID NO: 429006 - DNA, 16 bp, M. musculus
tatgcatactatcata

SEQ ID NO: 429007 - DNA, 16 bp, M. musculus
tatgcatctctgtgtg

SEQ ID NO: 429008 - DNA, 16 bp, M. musculus
tatgcatgcatgaatt

SEQ ID NO: 429009 - DNA, 16 bp, M. musculus
tatgcatgcatgcaca

SEQ ID NO: 429010 - DNA, 16 bp, M. musculus
tatgcatgcatgtgca

SEQ ID NO: 429011 - DNA, 16 bp, M. musculus
tatgcatgtaaacatt

SEQ ID NO: 429012 - DNA, 16 bp, M. musculus
tatgcatgtatgtatg

SEQ ID NO: 429013 - DNA, 16 bp, M. musculus
tatgcatgttttatat

SEQ ID NO: 429014 - DNA, 16 bp, M. musculus
tatgcattcatacata

SEQ ID NO: 429015 - DNA, 16 bp, M. musculus
tatgccaccaccacct

SEQ ID NO: 429016 - DNA, 16 bp, M. musculus
tatgccaccatgcctg

SEQ ID NO: 429017 - DNA, 16 bp, M. musculus
tatgccagatgaattt

SEQ ID NO: 429018 - DNA, 16 bp, M. musculus
tatgccagcaggattt

SEQ ID NO: 429019 - DNA, 16 bp, M. musculus
tatgccatcacaccca

SEQ ID NO: 429020 - DNA, 16 bp, M. musculus
tatgccatcactgcct

SEQ ID NO: 429021 - DNA, 16 bp, M. musculus
tatgccatggcacatg

SEQ ID NO: 429022 - DNA, 16 bp, M. musculus
tatgcccacagtgaca

SEQ ID NO: 429023 - DNA, 16 bp, M. musculus
tatgcccaccacagca

SEQ ID NO: 429024 - DNA, 16 bp, M. musculus
tatgcccaggtgtggt

SEQ ID NO: 429025 - DNA, 20 bp, M. musculus
tatgccccagtacaggagaa

SEQ ID NO: 429026 - DNA, 16 bp, M. musculus
tatgccctcttctggt

SEQ ID NO: 429027 - DNA, 16 bp, M. musculus
tatgccctggcaatga

SEQ ID NO: 429028 - DNA, 16 bp, M. musculus
tatgcctataatccca

SEQ ID NO: 429029 - DNA, 16 bp, M. musculus
tatgcctctctctctc

SEQ ID NO: 429030 - DNA, 16 bp, M. musculus
tatgcctgtatgtatg

SEQ ID NO: 429031 - DNA, 16 bp, M. musculus
tatgccttctcttggg

SEQ ID NO: 429032 - DNA, 16 bp, M. musculus
tatgcctttaatccta

SEQ ID NO: 429033 - DNA, 16 bp, M. musculus
tatgcctttagtccca

SEQ ID NO: 429034 - DNA, 16 bp, M. musculus
tatgcctttttaaaaa

SEQ ID NO: 429035 - DNA, 16 bp, M. musculus
tatgctaagcaagcac

SEQ ID NO: 429036 - DNA, 16 bp, M. musculus
tatgctatggtgtcag

SEQ ID NO: 429037 - DNA, 16 bp, M. musculus
tatgctcaaaatgcaa

SEQ ID NO: 429038 - DNA, 16 bp, M. musculus
tatgctcaagctctgc

SEQ ID NO: 429039 - DNA, 16 bp, M. musculus
tatgctcttccccaca

SEQ ID NO: 429040 - DNA, 16 bp, M. musculus
tatgctgagcactcac

SEQ ID NO: 429041 - DNA, 16 bp, M. musculus
tatgctgctagagaca

SEQ ID NO: 429042 - DNA, 16 bp, M. musculus
tatgctggctggtttt

SEQ ID NO: 429043 - DNA, 16 bp, M. musculus
tatgctgtaaggctga

SEQ ID NO: 429044 - DNA, 16 bp, M. musculus
tatgctgtctgcttgg

SEQ ID NO: 429045 - DNA, 16 bp, M. musculus
tatgctgttctgtgct

SEQ ID NO: 429046 - DNA, 16 bp, M. musculus
tatgcttgtgtgcatg

SEQ ID NO: 429047 - DNA, 16 bp, M. musculus
tatgcttttgttcatt

SEQ ID NO: 429048 - DNA, 16 bp, M. musculus
tatggaaaacaaaaca

SEQ ID NO: 429049 - DNA, 16 bp, M. musculus
tatggaaatattttaa

SEQ ID NO: 429050 - DNA, 16 bp, M. musculus
tatggaaatcagtgtg

SEQ ID NO: 429051 - DNA, 16 bp, M. musculus
tatggaaatctgtcaa

SEQ ID NO: 429052 - DNA, 16 bp, M. musculus
tatggaacctgaaaag

SEQ ID NO: 429053 - DNA, 16 bp, M. musculus
tatggaacctgaagag

SEQ ID NO: 429054 - DNA, 16 bp, M. musculus
tatggactcacagaga

SEQ ID NO: 429055 - DNA, 16 bp, M. musculus
tatggactgagcaggt

SEQ ID NO: 429056 - DNA, 16 bp, M. musculus
tatggagaaagaggaa

SEQ ID NO: 429057 - DNA, 16 bp, M. musculus
tatggagacaaaggat

SEQ ID NO: 429058 - DNA, 16 bp, M. musculus
tatggagagagtgggc

SEQ ID NO: 429059 - DNA, 16 bp, M. musculus
tatggagcagagattg

SEQ ID NO: 429060 - DNA, 16 bp, M. musculus
tatggagctgaagggt

SEQ ID NO: 429061 - DNA, 16 bp, M. musculus
tatggaggacaggtga

SEQ ID NO: 429062 - DNA, 16 bp, M. musculus
tatggaggcattgtct

SEQ ID NO: 429063 - DNA, 16 bp, M. musculus
tatggaggccagagat

SEQ ID NO: 429064 - DNA, 16 bp, M. musculus
tatggagggctgcagc

SEQ ID NO: 429065 - DNA, 16 bp, M. musculus
tatggatacatccaca

SEQ ID NO: 429066 - DNA, 16 bp, M. musculus
tatggatataacttct

SEQ ID NO: 429067 - DNA, 16 bp, M. musculus
tatggatatgtgtgtg

SEQ ID NO: 429068 - DNA, 16 bp, M. musculus
tatggatattttgcct

SEQ ID NO: 429069 - DNA, 16 bp, M. musculus
tatggatcaaaagatg

SEQ ID NO: 429070 - DNA, 16 bp, M. musculus
tatggatccagatgta

SEQ ID NO: 429071 - DNA, 16 bp, M. musculus
tatggatgccaacaag

SEQ ID NO: 429072 - DNA, 16 bp, M. musculus
tatggatgtgtatata

SEQ ID NO: 429073 - DNA, 16 bp, M. musculus
tatggattccagaaga

SEQ ID NO: 429074 - DNA, 16 bp, M. musculus
tatggcagcaggcagg

SEQ ID NO: 429075 - DNA, 16 bp, M. musculus
tatggcattttctcaa

SEQ ID NO: 429076 - DNA, 16 bp, M. musculus
tatggccaaggtattt

SEQ ID NO: 429077 - DNA, 16 bp, M. musculus
tatggccaaggtgttt

SEQ ID NO: 429078 - DNA, 16 bp, M. musculus
tatggccagtttgaga

SEQ ID NO: 429079 - DNA, 16 bp, M. musculus
tatggccttggtggag

SEQ ID NO: 429080 - DNA, 16 bp, M. musculus
tatggctattttgcct

SEQ ID NO: 429081 - DNA, 16 bp, M. musculus
tatggctctcatctca

SEQ ID NO: 429082 - DNA, 16 bp, M. musculus
tatggctggagccatg

SEQ ID NO: 429083 - DNA, 16 bp, M. musculus
tatgggaacaaaacac

SEQ ID NO: 429084 - DNA, 16 bp, M. musculus
tatgggaacttttgaa

SEQ ID NO: 429085 - DNA, 16 bp, M. musculus
tatgggaaggcccagc

SEQ ID NO: 429086 - DNA, 16 bp, M. musculus
tatgggacagaatgaa

SEQ ID NO: 429087 - DNA, 16 bp, M. musculus
tatgggagccattttt

SEQ ID NO: 429088 - DNA, 16 bp, M. musculus
tatgggatgaaccccc

SEQ ID NO: 429089 - DNA, 16 bp, M. musculus
tatgggatggaaccca

SEQ ID NO: 429090 - DNA, 16 bp, M. musculus
tatgggatggacaccc

SEQ ID NO: 429091 - DNA, 16 bp, M. musculus
tatgggatggatcccc

SEQ ID NO: 429092 - DNA, 16 bp, M. musculus
tatgggatgtggaaga

SEQ ID NO: 429093 - DNA, 17 bp, M. musculus
tatgggccttaaattcc

SEQ ID NO: 429094 - DNA, 16 bp, M. musculus
tatggggactttggaa

SEQ ID NO: 429095 - DNA, 16 bp, M. musculus
tatggggctacaaacc

SEQ ID NO: 429096 - DNA, 16 bp, M. musculus
tatgggggacttttgg

SEQ ID NO: 429097 - DNA, 16 bp, M. musculus
tatggggtgctgggga

SEQ ID NO: 429098 - DNA, 16 bp, M. musculus
tatggggttgccatct

SEQ ID NO: 429099 - DNA, 16 bp, M. musculus
tatgggtacagaggaa

SEQ ID NO: 429100 - DNA, 19 bp, M. musculus
tatgggtcaatcctccagg

SEQ ID NO: 429101 - DNA, 16 bp, M. musculus
tatgggtctgagctag

SEQ ID NO: 429102 - DNA, 16 bp, M. musculus
tatgggtgtgtatgtg

SEQ ID NO: 429103 - DNA, 16 bp, M. musculus
tatgggttcatttctg

SEQ ID NO: 429104 - DNA, 16 bp, M. musculus
tatggtaaagcctttg

SEQ ID NO: 429105 - DNA, 16 bp, M. musculus
tatggtacatttatac

SEQ ID NO: 429106 - DNA, 16 bp, M. musculus
tatggtagtatatata

SEQ ID NO: 429107 - DNA, 16 bp, M. musculus
tatggtatatatgtat

SEQ ID NO: 429108 - DNA, 16 bp, M. musculus
tatggtatatgtatgt

SEQ ID NO: 429109 - DNA, 16 bp, M. musculus
tatggtgagatgggag

SEQ ID NO: 429110 - DNA, 16 bp, M. musculus
tatggtggcacacatc

SEQ ID NO: 429111 - DNA, 16 bp, M. musculus
tatggtggtttgaata

SEQ ID NO: 429112 - DNA, 16 bp, M. musculus
tatggtgtatatgtat

SEQ ID NO: 429113 - DNA, 16 bp, M. musculus
tatggttagttttgga

SEQ ID NO: 429114 - DNA, 16 bp, M. musculus
tatggttgggggtcac

SEQ ID NO: 429115 - DNA, 16 bp, M. musculus
tatggttttcagaaca

SEQ ID NO: 429116 - DNA, 16 bp, M. musculus
tatggtttttaacttt

SEQ ID NO: 429117 - DNA, 16 bp, M. musculus
tatgtaaaacaggctg

SEQ ID NO: 429118 - DNA, 18 bp, M. musculus
tatgtaaagactgtggga

SEQ ID NO: 429119 - DNA, 16 bp, M. musculus
tatgtaaatacacaca

SEQ ID NO: 429120 - DNA, 16 bp, M. musculus
tatgtaaatcaggctg

SEQ ID NO: 429121 - DNA, 16 bp, M. musculus
tatgtaaatgtgtgtg

SEQ ID NO: 429122 - DNA, 16 bp, M. musculus
tatgtaaatgtttata

SEQ ID NO: 429123 - DNA, 16 bp, M. musculus
tatgtaacaaaaatta

SEQ ID NO: 429124 - DNA, 16 bp, M. musculus
tatgtaacccaggctg

SEQ ID NO: 429125 - DNA, 16 bp, M. musculus
tatgtaaccctggctg

SEQ ID NO: 429126 - DNA, 16 bp, M. musculus
tatgtaatggtgtcag

SEQ ID NO: 429127 - DNA, 16 bp, M. musculus
tatgtacaatatattt

SEQ ID NO: 429128 - DNA, 16 bp, M. musculus
tatgtacacacagata

SEQ ID NO: 429129 - DNA, 16 bp, M. musculus
tatgtacaggtgtgtg

SEQ ID NO: 429130 - DNA, 16 bp, M. musculus
tatgtacataaatata

SEQ ID NO: 429131 - DNA, 16 bp, M. musculus
tatgtacatacaaata

SEQ ID NO: 429132 - DNA, 16 bp, M. musculus
tatgtacatataattt

SEQ ID NO: 429133 - DNA, 16 bp, M. musculus
tatgtacatatgtaat

SEQ ID NO: 429134 - DNA, 16 bp, M. musculus
tatgtacatatgtatt

SEQ ID NO: 429135 - DNA, 16 bp, M. musculus
tatgtacatattatat

SEQ ID NO: 429136 - DNA, 16 bp, M. musculus
tatgtacatgtataca

SEQ ID NO: 429137 - DNA, 16 bp, M. musculus
tatgtacatgtgttta

SEQ ID NO: 429138 - DNA, 16 bp, M. musculus
tatgtacattttaaat

SEQ ID NO: 429139 - DNA, 16 bp, M. musculus
tatgtaccatgtatgt

SEQ ID NO: 429140 - DNA, 16 bp, M. musculus
tatgtaccctctgaaa

SEQ ID NO: 429141 - DNA, 18 bp, M. musculus
tatgtactcactgataac

SEQ ID NO: 429142 - DNA, 16 bp, M. musculus
tatgtagaacaagctg

SEQ ID NO: 429143 - DNA, 16 bp, M. musculus
tatgtagaccacactg

SEQ ID NO: 429144 - DNA, 16 bp, M. musculus
tatgtagaccagacta

SEQ ID NO: 429145 - DNA, 16 bp, M. musculus
tatgtagaccagactg

SEQ ID NO: 429146 - DNA, 16 bp, M. musculus
tatgtagaccaggctt

SEQ ID NO: 429147 - DNA, 16 bp, M. musculus
tatgtagactaggcta

SEQ ID NO: 429148 - DNA, 16 bp, M. musculus
tatgtagactaggctg

SEQ ID NO: 429149 - DNA, 16 bp, M. musculus
tatgtagagagaccct

SEQ ID NO: 429150 - DNA, 16 bp, M. musculus
tatgtagagcagactg

SEQ ID NO: 429151 - DNA, 16 bp, M. musculus
tatgtagatcaggttg

SEQ ID NO: 429152 - DNA, 16 bp, M. musculus
tatgtagatctggctg

SEQ ID NO: 429153 - DNA, 16 bp, M. musculus
tatgtagatttgtgca

SEQ ID NO: 429154 - DNA, 16 bp, M. musculus
tatgtagcagcagatg

SEQ ID NO: 429155 - DNA, 16 bp, M. musculus
tatgtagccctggctg

SEQ ID NO: 429156 - DNA, 16 bp, M. musculus
tatgtagccctggttg

SEQ ID NO: 429157 - DNA, 16 bp, M. musculus
tatgtagccgaggatg

SEQ ID NO: 429158 - DNA, 16 bp, M. musculus
tatgtagccttggctg

SEQ ID NO: 429159 - DNA, 16 bp, M. musculus
tatgtagctcaggatg

SEQ ID NO: 429160 - DNA, 16 bp, M. musculus
tatgtagctcatgctg

SEQ ID NO: 429161 - DNA, 16 bp, M. musculus
tatgtagctctagctg

SEQ ID NO: 429162 - DNA, 16 bp, M. musculus
tatgtagctctggttg

SEQ ID NO: 429163 - DNA, 16 bp, M. musculus
tatgtagctgagaatg

SEQ ID NO: 429164 - DNA, 16 bp, M. musculus
tatgtagctgaggcta

SEQ ID NO: 429165 - DNA, 16 bp, M. musculus
tatgtagctgagggtg

SEQ ID NO: 429166 - DNA, 16 bp, M. musculus
tatgtaggtaggtagg

SEQ ID NO: 429167 - DNA, 16 bp, M. musculus
tatgtagtgagaccct

SEQ ID NO: 429168 - DNA, 16 bp, M. musculus
tatgtagttctggctg

SEQ ID NO: 429169 - DNA, 16 bp, M. musculus
tatgtagttgaggctg

SEQ ID NO: 429170 - DNA, 16 bp, M. musculus
tatgtataacaataaa

SEQ ID NO: 429171 - DNA, 16 bp, M. musculus
tatgtataagtatata

SEQ ID NO: 429172 - DNA, 16 bp, M. musculus
tatgtataatgtatat

SEQ ID NO: 429173 - DNA, 16 bp, M. musculus
tatgtataatgtgtat

SEQ ID NO: 429174 - DNA, 16 bp, M. musculus
tatgtatacataaaat

SEQ ID NO: 429175 - DNA, 16 bp, M. musculus
tatgtatagtgtatat

SEQ ID NO: 429176 - DNA, 16 bp, M. musculus
tatgtatagtgtgtat

SEQ ID NO: 429177 - DNA, 16 bp, M. musculus
tatgtatatacaaata

SEQ ID NO: 429178 - DNA, 16 bp, M. musculus
tatgtatatagtatgt

SEQ ID NO: 429179 - DNA, 16 bp, M. musculus
tatgtatatataatgt

SEQ ID NO: 429180 - DNA, 16 bp, M. musculus
tatgtatatatacata

SEQ ID NO: 429181 - DNA, 16 bp, M. musculus
tatgtatatatatatc

SEQ ID NO: 429182 - DNA, 16 bp, M. musculus
tatgtatatatatgta

SEQ ID NO: 429183 - DNA, 16 bp, M. musculus
tatgtatatatgtgtg

SEQ ID NO: 429184 - DNA, 16 bp, M. musculus
tatgtatatgactaca

SEQ ID NO: 429185 - DNA, 16 bp, M. musculus
tatgtatatgagtaca

SEQ ID NO: 429186 - DNA, 16 bp, M. musculus
tatgtatatgagtgct

SEQ ID NO: 429187 - DNA, 16 bp, M. musculus
tatgtatatgagtgtt

SEQ ID NO: 429188 - DNA, 16 bp, M. musculus
tatgtatatgtagtat

SEQ ID NO: 429189 - DNA, 16 bp, M. musculus
tatgtatatgtatcta

SEQ ID NO: 429190 - DNA, 16 bp, M. musculus
tatgtatatgtttgtg

SEQ ID NO: 429191 - DNA, 16 bp, M. musculus
tatgtatattttcatt

SEQ ID NO: 429192 - DNA, 16 bp, M. musculus
tatgtatcaataaaat

SEQ ID NO: 429193 - DNA, 16 bp, M. musculus
tatgtatcaattaaaa

SEQ ID NO: 429194 - DNA, 16 bp, M. musculus
tatgtatgaaaatgcc

SEQ ID NO: 429195 - DNA, 16 bp, M. musculus
tatgtatgaatgtttt

SEQ ID NO: 429196 - DNA, 16 bp, M. musculus
tatgtatgagtgtttt

SEQ ID NO: 429197 - DNA, 16 bp, M. musculus
tatgtatgcatacatg

SEQ ID NO: 429198 - DNA, 16 bp, M. musculus
tatgtatgcatataaa

SEQ ID NO: 429199 - DNA, 16 bp, M. musculus
tatgtatgcatatgta

SEQ ID NO: 429200 - DNA, 16 bp, M. musculus
tatgtatgcatgcatc

SEQ ID NO: 429201 - DNA, 16 bp, M. musculus
tatgtatgcatgtttt

SEQ ID NO: 429202 - DNA, 16 bp, M. musculus
tatgtatggatatttt

SEQ ID NO: 429203 - DNA, 16 bp, M. musculus
tatgtatgtaagtatg

SEQ ID NO: 429204 - DNA, 16 bp, M. musculus
tatgtatgtaatatat

SEQ ID NO: 429205 - DNA, 16 bp, M. musculus
tatgtatgtaatgtat

SEQ ID NO: 429206 - DNA, 16 bp, M. musculus
tatgtatgtacatata

SEQ ID NO: 429207 - DNA, 16 bp, M. musculus
tatgtatgtacgtata

SEQ ID NO: 429208 - DNA, 16 bp, M. musculus
tatgtatgtagtatgt

SEQ ID NO: 429209 - DNA, 16 bp, M. musculus
tatgtatgtatatata

SEQ ID NO: 429210 - DNA, 16 bp, M. musculus
tatgtatgtatgaata

SEQ ID NO: 429211 - DNA, 16 bp, M. musculus
tatgtatgtatgcatg

SEQ ID NO: 429212 - DNA, 16 bp, M. musculus
tatgtatgtatgtaca

SEQ ID NO: 429213 - DNA, 16 bp, M. musculus
tatgtatgtatgtatc

SEQ ID NO: 429214 - DNA, 16 bp, M. musculus
tatgtatgtgattaca

SEQ ID NO: 429215 - DNA, 16 bp, M. musculus
tatgtatgtggtgtat

SEQ ID NO: 429216 - DNA, 16 bp, M. musculus
tatgtatgtgtatgtg

SEQ ID NO: 429217 - DNA, 16 bp, M. musculus
tatgtatgtgtctatg

SEQ ID NO: 429218 - DNA, 16 bp, M. musculus
tatgtatgtgtgtaca

SEQ ID NO: 429219 - DNA, 16 bp, M. musculus
tatgtatgttatatgt

SEQ ID NO: 429220 - DNA, 16 bp, M. musculus
tatgtatgttttcagg

SEQ ID NO: 429221 - DNA, 16 bp, M. musculus
tatgtatttacacaca

SEQ ID NO: 429222 - DNA, 16 bp, M. musculus
tatgtatttatgtgaa

SEQ ID NO: 429223 - DNA, 16 bp, M. musculus
tatgtatttatgtgtg

SEQ ID NO: 429224 - DNA, 16 bp, M. musculus
tatgtatttatttact

SEQ ID NO: 429225 - DNA, 16 bp, M. musculus
tatgtatttctgtgta

SEQ ID NO: 429226 - DNA, 16 bp, M. musculus
tatgtatttgtatatg

SEQ ID NO: 429227 - DNA, 16 bp, M. musculus
tatgtattttacatat

SEQ ID NO: 429228 - DNA, 16 bp, M. musculus
tatgtattttcttcaa

SEQ ID NO: 429229 - DNA, 16 bp, M. musculus
tatgtcacccttttca

SEQ ID NO: 429230 - DNA, 16 bp, M. musculus
tatgtcaggctcctgt

SEQ ID NO: 429231 - DNA, 16 bp, M. musculus
tatgtcatttgcagga

SEQ ID NO: 429232 - DNA, 16 bp, M. musculus
tatgtccaatattctg

SEQ ID NO: 429233 - DNA, 52 bp, M. musculus
tatgtccccggtgtgggaagggccgccactgggcaaaagattgtaagcataa

SEQ ID NO: 429234 - DNA, 16 bp, M. musculus
tatgtccctgtgtgtg

SEQ ID NO: 429235 - DNA, 16 bp, M. musculus
tatgtccttatgattc

SEQ ID NO: 429236 - DNA, 16 bp, M. musculus
tatgtctatctatcta

SEQ ID NO: 429237 - DNA, 16 bp, M. musculus
tatgtctatgtatata

SEQ ID NO: 429238 - DNA, 16 bp, M. musculus
tatgtctcctttttaa

SEQ ID NO: 429239 - DNA, 16 bp, M. musculus
tatgtctctgtgtttg

SEQ ID NO: 429240 - DNA, 16 bp, M. musculus
tatgtctgaaaacagc

SEQ ID NO: 429241 - DNA, 16 bp, M. musculus
tatgtctgtatgagtg

SEQ ID NO: 429242 - DNA, 16 bp, M. musculus
tatgtctgtgtaccac

SEQ ID NO: 429243 - DNA, 16 bp, M. musculus
tatgtctgtgtctgtg

SEQ ID NO: 429244 - DNA, 16 bp, M. musculus
tatgtctgtttatgtg

SEQ ID NO: 429245 - DNA, 21 bp, M. musculus
tatgtgaacaaagataagccc

SEQ ID NO: 429246 - DNA, 16 bp, M. musculus
tatgtgaacatgcatg

SEQ ID NO: 429247 - DNA, 17 bp, M. musculus
tatgtgaagttctttga

SEQ ID NO: 429248 - DNA, 16 bp, M. musculus
tatgtgaatttttaaa

SEQ ID NO: 429249 - DNA, 16 bp, M. musculus
tatgtgagaaaaaaat

SEQ ID NO: 429250 - DNA, 16 bp, M. musculus
tatgtgagaagcatgg

SEQ ID NO: 429251 - DNA, 16 bp, M. musculus
tatgtgagattatgca

SEQ ID NO: 429252 - DNA, 16 bp, M. musculus
tatgtgagtacactgt

SEQ ID NO: 429253 - DNA, 16 bp, M. musculus
tatgtgagtacagtgt

SEQ ID NO: 429254 - DNA, 16 bp, M. musculus
tatgtgagtatactgt

SEQ ID NO: 429255 - DNA, 16 bp, M. musculus
tatgtgagtatgtata

SEQ ID NO: 429256 - DNA, 16 bp, M. musculus
tatgtgagtgctggga

SEQ ID NO: 429257 - DNA, 16 bp, M. musculus
tatgtgagtgttttgc

SEQ ID NO: 429258 - DNA, 16 bp, M. musculus
tatgtgatgtgtatgt

SEQ ID NO: 429259 - DNA, 16 bp, M. musculus
tatgtgattatatata

SEQ ID NO: 429260 - DNA, 16 bp, M. musculus
tatgtgcacacataca

SEQ ID NO: 429261 - DNA, 16 bp, M. musculus
tatgtgcacatgagtg

SEQ ID NO: 429262 - DNA, 16 bp, M. musculus
tatgtgcacatgtttg

SEQ ID NO: 429263 - DNA, 16 bp, M. musculus
tatgtgcaggcaaaac

SEQ ID NO: 429264 - DNA, 16 bp, M. musculus
tatgtgcatatatatt

SEQ ID NO: 429265 - DNA, 16 bp, M. musculus
tatgtgcatatatttt

SEQ ID NO: 429266 - DNA, 16 bp, M. musculus
tatgtgcatcacatgc

SEQ ID NO: 429267 - DNA, 16 bp, M. musculus
tatgtgcatgtatgtg

SEQ ID NO: 429268 - DNA, 16 bp, M. musculus
tatgtgcatgtgaatg

SEQ ID NO: 429269 - DNA, 16 bp, M. musculus
tatgtgcatgtgtgtt

SEQ ID NO: 429270 - DNA, 16 bp, M. musculus
tatgtgcatgttcata

SEQ ID NO: 429271 - DNA, 16 bp, M. musculus
tatgtgcctggtgcct

SEQ ID NO: 429272 - DNA, 16 bp, M. musculus
tatgtgcctgtgtctg

SEQ ID NO: 429273 - DNA, 16 bp, M. musculus
tatgtgctcatgtgtg

SEQ ID NO: 429274 - DNA, 16 bp, M. musculus
tatgtgctgtgtatgt

SEQ ID NO: 429275 - DNA, 17 bp, M. musculus
tatgtggaggtccttga

SEQ ID NO: 429276 - DNA, 16 bp, M. musculus
tatgtggagttcttta

SEQ ID NO: 429277 - DNA, 16 bp, M. musculus
tatgtggatttccttg

SEQ ID NO: 429278 - DNA, 16 bp, M. musculus
tatgtggctgctggga

SEQ ID NO: 429279 - DNA, 16 bp, M. musculus
tatgtgggcatgtgtg

SEQ ID NO: 429280 - DNA, 16 bp, M. musculus
tatgtgggtgtgtgca

SEQ ID NO: 429281 - DNA, 16 bp, M. musculus
tatgtggtgctgggga

SEQ ID NO: 429282 - DNA, 16 bp, M. musculus
tatgtggttaatgctg

SEQ ID NO: 429283 - DNA, 16 bp, M. musculus
tatgtgtacataaata

SEQ ID NO: 429284 - DNA, 16 bp, M. musculus
tatgtgtacatgagtg

SEQ ID NO: 429285 - DNA, 16 bp, M. musculus
tatgtgtacatgcata

SEQ ID NO: 429286 - DNA, 16 bp, M. musculus
tatgtgtatacatata

SEQ ID NO: 429287 - DNA, 16 bp, M. musculus
tatgtgtatagtgtat

SEQ ID NO: 429288 - DNA, 16 bp, M. musculus
tatgtgtatataaata

SEQ ID NO: 429289 - DNA, 16 bp, M. musculus
tatgtgtatatgggtg

SEQ ID NO: 429290 - DNA, 16 bp, M. musculus
tatgtgtatatgtgaa

SEQ ID NO: 429291 - DNA, 16 bp, M. musculus
tatgtgtatatgtgtg

SEQ ID NO: 429292 - DNA, 16 bp, M. musculus
tatgtgtatgtgcatg

SEQ ID NO: 429293 - DNA, 16 bp, M. musculus
tatgtgtatgtgtaca

SEQ ID NO: 429294 - DNA, 16 bp, M. musculus
tatgtgtatgtgtgct

SEQ ID NO: 429295 - DNA, 16 bp, M. musculus
tatgtgtatgtgtgtg

SEQ ID NO: 429296 - DNA, 16 bp, M. musculus
tatgtgtattatatgt

SEQ ID NO: 429297 - DNA, 16 bp, M. musculus
tatgtgtattatgtat

SEQ ID NO: 429298 - DNA, 16 bp, M. musculus
tatgtgtcgggaagaa

SEQ ID NO: 429299 - DNA, 16 bp, M. musculus
tatgtgtctggagcca

SEQ ID NO: 429300 - DNA, 17 bp, M. musculus
tatgtgtctggttccca

SEQ ID NO: 429301 - DNA, 16 bp, M. musculus
tatgtgtctgtctgtc

SEQ ID NO: 429302 - DNA, 16 bp, M. musculus
tatgtgtctgtgcatg

SEQ ID NO: 429303 - DNA, 16 bp, M. musculus
tatgtgtctgtgtgtc

SEQ ID NO: 429304 - DNA, 16 bp, M. musculus
tatgtgtgagcatgtg

SEQ ID NO: 429305 - DNA, 16 bp, M. musculus
tatgtgtgagtgtctg

SEQ ID NO: 429306 - DNA, 16 bp, M. musculus
tatgtgtgcacaagtg

SEQ ID NO: 429307 - DNA, 16 bp, M. musculus
tatgtgtgcatatgtg

SEQ ID NO: 429308 - DNA, 16 bp, M. musculus
tatgtgtgcatgagta

SEQ ID NO: 429309 - DNA, 16 bp, M. musculus
tatgtgtgcatttgta

SEQ ID NO: 429310 - DNA, 16 bp, M. musculus
tatgtgtgcctgtctg

SEQ ID NO: 429311 - DNA, 16 bp, M. musculus
tatgtgtgggtgtgca

SEQ ID NO: 429312 - DNA, 16 bp, M. musculus
tatgtgtggtatgtgt

SEQ ID NO: 429313 - DNA, 16 bp, M. musculus
tatgtgtggtgtgtgc

SEQ ID NO: 429314 - DNA, 16 bp, M. musculus
tatgtgtgtaaagact

SEQ ID NO: 429315 - DNA, 16 bp, M. musculus
tatgtgtgtaagagag

SEQ ID NO: 429316 - DNA, 16 bp, M. musculus
tatgtgtgtacatata

SEQ ID NO: 429317 - DNA, 16 bp, M. musculus
tatgtgtgtatatgcg

SEQ ID NO: 429318 - DNA, 16 bp, M. musculus
tatgtgtgtatattat

SEQ ID NO: 429319 - DNA, 16 bp, M. musculus
tatgtgtgtatgaaat

SEQ ID NO: 429320 - DNA, 16 bp, M. musculus
tatgtgtgtcaggggc

SEQ ID NO: 429321 - DNA, 16 bp, M. musculus
tatgtgtgtgatgtgt

SEQ ID NO: 429322 - DNA, 16 bp, M. musculus
tatgtgtgtgcacaag

SEQ ID NO: 429323 - DNA, 16 bp, M. musculus
tatgtgtgtgtatctg

SEQ ID NO: 429324 - DNA, 16 bp, M. musculus
tatgtgtgtgtgtatg

SEQ ID NO: 429325 - DNA, 16 bp, M. musculus
tatgtgtgtgtgtgca

SEQ ID NO: 429326 - DNA, 16 bp, M. musculus
tatgtgtgtgtgttca

SEQ ID NO: 429327 - DNA, 16 bp, M. musculus
tatgtgtgtgttctct

SEQ ID NO: 429328 - DNA, 16 bp, M. musculus
tatgtgttcatttctg

SEQ ID NO: 429329 - DNA, 16 bp, M. musculus
tatgtgttgtgtgcat

SEQ ID NO: 429330 - DNA, 16 bp, M. musculus
tatgtgtttctatgtg

SEQ ID NO: 429331 - DNA, 16 bp, M. musculus
tatgtgtttgaacact

SEQ ID NO: 429332 - DNA, 16 bp, M. musculus
tatgtgtttgaggcag

SEQ ID NO: 429333 - DNA, 16 bp, M. musculus
tatgtgtttgagtgtg

SEQ ID NO: 429334 - DNA, 16 bp, M. musculus
tatgtgtttgcacaca

SEQ ID NO: 429335 - DNA, 16 bp, M. musculus
tatgtgtttgcctgtg

SEQ ID NO: 429336 - DNA, 16 bp, M. musculus
tatgtgtttgtgtctc

SEQ ID NO: 429337 - DNA, 16 bp, M. musculus
tatgttaacattttaa

SEQ ID NO: 429338 - DNA, 16 bp, M. musculus
tatgttactcaaaata

SEQ ID NO: 429339 - DNA, 16 bp, M. musculus
tatgttagtgtgtgtg

SEQ ID NO: 429340 - DNA, 20 bp, M. musculus
tatgttatgtcaaatttgcc

SEQ ID NO: 429341 - DNA, 16 bp, M. musculus
tatgttcaatgagttg

SEQ ID NO: 429342 - DNA, 16 bp, M. musculus
tatgttcatttaaaaa

SEQ ID NO: 429343 - DNA, 16 bp, M. musculus
tatgttcatttagcag

SEQ ID NO: 429344 - DNA, 16 bp, M. musculus
tatgttctaaatattt

SEQ ID NO: 429345 - DNA, 16 bp, M. musculus
tatgttcttctacctg

SEQ ID NO: 429346 - DNA, 16 bp, M. musculus
tatgttcttgttcttg

SEQ ID NO: 429347 - DNA, 16 bp, M. musculus
tatgttgaagtctttg

SEQ ID NO: 429348 - DNA, 16 bp, M. musculus
tatgttgcctagagat

SEQ ID NO: 429349 - DNA, 16 bp, M. musculus
tatgttgccttggctg

SEQ ID NO: 429350 - DNA, 16 bp, M. musculus
tatgttgggattttga

SEQ ID NO: 429351 - DNA, 16 bp, M. musculus
tatgttgtgccttcat

SEQ ID NO: 429352 - DNA, 16 bp, M. musculus
tatgttgtgtttgcag

SEQ ID NO: 429353 - DNA, 16 bp, M. musculus
tatgtttatatacata

SEQ ID NO: 429354 - DNA, 16 bp, M. musculus
tatgtttatgagtaca

SEQ ID NO: 429355 - DNA, 16 bp, M. musculus
tatgtttatgtatgtg

SEQ ID NO: 429356 - DNA, 16 bp, M. musculus
tatgtttcttgtacct

SEQ ID NO: 429357 - DNA, 16 bp, M. musculus
tatgtttgcatgtgtg

SEQ ID NO: 429358 - DNA, 16 bp, M. musculus
tatgtttgctaggccc

SEQ ID NO: 429359 - DNA, 16 bp, M. musculus
tatgtttggccttgaa

SEQ ID NO: 429360 - DNA, 16 bp, M. musculus
tatgtttggcttcttt

SEQ ID NO: 429361 - DNA, 16 bp, M. musculus
tatgtttggtggaggt

SEQ ID NO: 429362 - DNA, 16 bp, M. musculus
tatgttttcattttaa

SEQ ID NO: 429363 - DNA, 16 bp, M. musculus
tatgttttgagaaatg

SEQ ID NO: 429364 - DNA, 16 bp, M. musculus
tatgtttttaaaactt

SEQ ID NO: 429365 - DNA, 16 bp, M. musculus
tatgtttttaaagaaa

SEQ ID NO: 429366 - DNA, 16 bp, M. musculus
tattaaaaaacaagga

SEQ ID NO: 429367 - DNA, 16 bp, M. musculus
tattaaaaacaaatga

SEQ ID NO: 429368 - DNA, 16 bp, M. musculus
tattaaaaacagtaag

SEQ ID NO: 429369 - DNA, 16 bp, M. musculus
tattaaaaatagattc

SEQ ID NO: 429370 - DNA, 16 bp, M. musculus
tattaaaacagaaagg

SEQ ID NO: 429371 - DNA, 16 bp, M. musculus
tattaaaaccagaaat

SEQ ID NO: 429372 - DNA, 16 bp, M. musculus
tattaaaagaagtaag

SEQ ID NO: 429373 - DNA, 16 bp, M. musculus
tattaaaaggtcacag

SEQ ID NO: 429374 - DNA, 16 bp, M. musculus
tattaaaagtcttgga

SEQ ID NO: 429375 - DNA, 16 bp, M. musculus
tattaaaattgaacct

SEQ ID NO: 429376 - DNA, 16 bp, M. musculus
tattaaacaaaaaagg

SEQ ID NO: 429377 - DNA, 16 bp, M. musculus
tattaaagggtcacaa

SEQ ID NO: 429378 - DNA, 16 bp, M. musculus
tattaaagggtcgcag

SEQ ID NO: 429379 - DNA, 16 bp, M. musculus
tattaaagggttgcag

SEQ ID NO: 429380 - DNA, 16 bp, M. musculus
tattaaatctaaatcc

SEQ ID NO: 429381 - DNA, 16 bp, M. musculus
tattaaatgttttctt

SEQ ID NO: 429382 - DNA, 16 bp, M. musculus
tattaaattctcaaaa

SEQ ID NO: 429383 - DNA, 18 bp, M. musculus
tattaaccccagaaatgg

SEQ ID NO: 429384 - DNA, 16 bp, M. musculus
tattaacctttccttt

SEQ ID NO: 429385 - DNA, 16 bp, M. musculus
tattaagaaaaaaatc

SEQ ID NO: 429386 - DNA, 16 bp, M. musculus
tattaagaaaaagtga

SEQ ID NO: 429387 - DNA, 16 bp, M. musculus
tattaagaaagttaat

SEQ ID NO: 429388 - DNA, 16 bp, M. musculus
tattaagaacaatgaa

SEQ ID NO: 429389 - DNA, 16 bp, M. musculus
tattaagaatgcatgt

SEQ ID NO: 429390 - DNA, 23 bp, M. musculus
tattaagacaactcttgatctct

SEQ ID NO: 429391 - DNA, 16 bp, M. musculus
tattaagagatattaa

SEQ ID NO: 429392 - DNA, 16 bp, M. musculus
tattaagcatcacctt

SEQ ID NO: 429393 - DNA, 16 bp, M. musculus
tattaaggaaaagtag

SEQ ID NO: 429394 - DNA, 16 bp, M. musculus
tattaatacccttctt

SEQ ID NO: 429395 - DNA, 16 bp, M. musculus
tattaatcaagaaaat

SEQ ID NO: 429396 - DNA, 16 bp, M. musculus
tattaatgatattctg

SEQ ID NO: 429397 - DNA, 16 bp, M. musculus
tattacaaaaggctat

SEQ ID NO: 429398 - DNA, 16 bp, M. musculus
tattacaagtatatca

SEQ ID NO: 429399 - DNA, 16 bp, M. musculus
tattacagagcaatgg

SEQ ID NO: 429400 - DNA, 16 bp, M. musculus
tattacatacatatat

SEQ ID NO: 429401 - DNA, 16 bp, M. musculus
tattacatgtttgagc

SEQ ID NO: 429402 - DNA, 16 bp, M. musculus
tattacattcacacac

SEQ ID NO: 429403 - DNA, 16 bp, M. musculus
tattacatttgtttgt

SEQ ID NO: 429404 - DNA, 16 bp, M. musculus
tattacccacaacaag

SEQ ID NO: 429405 - DNA, 16 bp, M. musculus
tattagaaacaatgac

SEQ ID NO: 429406 - DNA, 16 bp, M. musculus
tattagaaggaaaact

SEQ ID NO: 429407 - DNA, 18 bp, M. musculus
tattagaaggtttagcag

SEQ ID NO: 429408 - DNA, 17 bp, M. musculus
tattagccccaaagctc

SEQ ID NO: 429409 - DNA, 16 bp, M. musculus
tattagctgcctattt

SEQ ID NO: 429410 - DNA, 16 bp, M. musculus
tattaggagatgtggc

SEQ ID NO: 429411 - DNA, 16 bp, M. musculus
tattagttactttctt

SEQ ID NO: 429412 - DNA, 16 bp, M. musculus
tattagtttgctttct

SEQ ID NO: 429413 - DNA, 16 bp, M. musculus
tattagttttcaaaat

SEQ ID NO: 429414 - DNA, 17 bp, M. musculus
tattataaataaggctt

SEQ ID NO: 429415 - DNA, 16 bp, M. musculus
tattatagatttaaag

SEQ ID NO: 429416 - DNA, 16 bp, M. musculus
tattatatgatgggag

SEQ ID NO: 429417 - DNA, 16 bp, M. musculus
tattatatgcatatgt

SEQ ID NO: 429418 - DNA, 16 bp, M. musculus
tattatatgtaactac

SEQ ID NO: 429419 - DNA, 21 bp, M. musculus
tattatatgtaagtacactga

SEQ ID NO: 429420 - DNA, 16 bp, M. musculus
tattatatgtacatat

SEQ ID NO: 429421 - DNA, 16 bp, M. musculus
tattatatgtgagtat

SEQ ID NO: 429422 - DNA, 16 bp, M. musculus
tattatatgtgtgtat

SEQ ID NO: 429423 - DNA, 16 bp, M. musculus
tattatatgtgtgtgt

SEQ ID NO: 429424 - DNA, 16 bp, M. musculus
tattatctatgtatct

SEQ ID NO: 429425 - DNA, 16 bp, M. musculus
tattatctgtaagttt

SEQ ID NO: 429426 - DNA, 16 bp, M. musculus
tattatcttcacaaga

SEQ ID NO: 429427 - DNA, 17 bp, M. musculus
tattatgaaggaatagc

SEQ ID NO: 429428 - DNA, 16 bp, M. musculus
tattatgattcataac

SEQ ID NO: 429429 - DNA, 16 bp, M. musculus
tattatgtacacagtg

SEQ ID NO: 429430 - DNA, 16 bp, M. musculus
tattatgtagaagaat

SEQ ID NO: 429431 - DNA, 16 bp, M. musculus
tattatgtgtgtttga

SEQ ID NO: 429432 - DNA, 16 bp, M. musculus
tattattagtagtaat

SEQ ID NO: 429433 - DNA, 16 bp, M. musculus
tattattccaaatgat

SEQ ID NO: 429434 - DNA, 16 bp, M. musculus
tattatttaacatcta

SEQ ID NO: 429435 - DNA, 16 bp, M. musculus
tattcaaaccaccaca

SEQ ID NO: 429436 - DNA, 16 bp, M. musculus
tattcaaaccatcaca

SEQ ID NO: 429437 - DNA, 16 bp, M. musculus
tattcaaactaccaca

SEQ ID NO: 429438 - DNA, 16 bp, M. musculus
tattcaaagaaagaaa

SEQ ID NO: 429439 - DNA, 16 bp, M. musculus
tattcaaagaaataaa

SEQ ID NO: 429440 - DNA, 16 bp, M. musculus
tattcaaagcatcaca

SEQ ID NO: 429441 - DNA, 16 bp, M. musculus
tattcaaaggataaac

SEQ ID NO: 429442 - DNA, 16 bp, M. musculus
tattcaacaaaataga

SEQ ID NO: 429443 - DNA, 16 bp, M. musculus
tattcaagccaccaca

SEQ ID NO: 429444 - DNA, 16 bp, M. musculus
tattcaagccatcaca

SEQ ID NO: 429445 - DNA, 16 bp, M. musculus
tattcaccatggcagt

SEQ ID NO: 429446 - DNA, 16 bp, M. musculus
tattcactatagtact

SEQ ID NO: 429447 - DNA, 16 bp, M. musculus
tattcactttataccc

SEQ ID NO: 429448 - DNA, 16 bp, M. musculus
tattcagagaatcaac

SEQ ID NO: 429449 - DNA, 16 bp, M. musculus
tattcagctattaaaa

SEQ ID NO: 429450 - DNA, 16 bp, M. musculus
tattcagcttcattca

SEQ ID NO: 429451 - DNA, 16 bp, M. musculus
tattcagcttccacat

SEQ ID NO: 429452 - DNA, 16 bp, M. musculus
tattcagtgtgtgtgt

SEQ ID NO: 429453 - DNA, 16 bp, M. musculus
tattcagtttccacgt

SEQ ID NO: 429454 - DNA, 16 bp, M. musculus
tattcagtttttaaaa

SEQ ID NO: 429455 - DNA, 16 bp, M. musculus
tattcataaaggaaat

SEQ ID NO: 429456 - DNA, 16 bp, M. musculus
tattcataagaaaaat

SEQ ID NO: 429457 - DNA, 16 bp, M. musculus
tattcatatgtccttc

SEQ ID NO: 429458 - DNA, 16 bp, M. musculus
tattcatcaaagaaaa

SEQ ID NO: 429459 - DNA, 22 bp, M. musculus
tattcatgagtcagatgactta

SEQ ID NO: 429460 - DNA, 16 bp, M. musculus
tattcatgtacacaca

SEQ ID NO: 429461 - DNA, 16 bp, M. musculus
tattcatgtatatatt

SEQ ID NO: 429462 - DNA, 16 bp, M. musculus
tattcatgtatttatt

SEQ ID NO: 429463 - DNA, 16 bp, M. musculus
tattcatgtgtatgca

SEQ ID NO: 429464 - DNA, 16 bp, M. musculus
tattcattcaataaat

SEQ ID NO: 429465 - DNA, 16 bp, M. musculus
tattcattttcttcac

SEQ ID NO: 429466 - DNA, 16 bp, M. musculus
tattccaaaatatttt

SEQ ID NO: 429467 - DNA, 16 bp, M. musculus
tattccaacacagctg

SEQ ID NO: 429468 - DNA, 16 bp, M. musculus
tattccaacatataac

SEQ ID NO: 429469 - DNA, 16 bp, M. musculus
tattccacagacaggc

SEQ ID NO: 429470 - DNA, 16 bp, M. musculus
tattccactatataaa

SEQ ID NO: 429471 - DNA, 16 bp, M. musculus
tattccactgtgtaaa

SEQ ID NO: 429472 - DNA, 17 bp, M. musculus
tattccagatgaattta

SEQ ID NO: 429473 - DNA, 16 bp, M. musculus
tattccatatgaattt

SEQ ID NO: 429474 - DNA, 16 bp, M. musculus
tattccatcaaggcca

SEQ ID NO: 429475 - DNA, 16 bp, M. musculus
tattccattgtgtgaa

SEQ ID NO: 429476 - DNA, 16 bp, M. musculus
tattcccagactcttg

SEQ ID NO: 429477 - DNA, 16 bp, M. musculus
tattcccattattctt

SEQ ID NO: 429478 - DNA, 16 bp, M. musculus
tattccccagctatga

SEQ ID NO: 429479 - DNA, 16 bp, M. musculus
tattcccttgagacag

SEQ ID NO: 429480 - DNA, 16 bp, M. musculus
tattcccttgtttggg

SEQ ID NO: 429481 - DNA, 17 bp, M. musculus
tattcctacctgacctt

SEQ ID NO: 429482 - DNA, 16 bp, M. musculus
tattcctgagttaata

SEQ ID NO: 429483 - DNA, 16 bp, M. musculus
tattcgaaccaccaca

SEQ ID NO: 429484 - DNA, 16 bp, M. musculus
tattctaagtttttgg

SEQ ID NO: 429485 - DNA, 16 bp, M. musculus
tattctaatgctaaat

SEQ ID NO: 429486 - DNA, 16 bp, M. musculus
tattctacccctgaaa

SEQ ID NO: 429487 - DNA, 16 bp, M. musculus
tattctatattatttg

SEQ ID NO: 429488 - DNA, 16 bp, M. musculus
tattctattctatcct

SEQ ID NO: 429489 - DNA, 16 bp, M. musculus
tattctcaagagtggt

SEQ ID NO: 429490 - DNA, 16 bp, M. musculus
tattctcacatcaagg

SEQ ID NO: 429491 - DNA, 16 bp, M. musculus
tattctctgcaggaaa

SEQ ID NO: 429492 - DNA, 16 bp, M. musculus
tattctctttcctggt

SEQ ID NO: 429493 - DNA, 16 bp, M. musculus
tattctgagcttttgg

SEQ ID NO: 429494 - DNA, 16 bp, M. musculus
tattctgattattctt

SEQ ID NO: 429495 - DNA, 16 bp, M. musculus
tattctggaacttact

SEQ ID NO: 429496 - DNA, 16 bp, M. musculus
tattctgggctggcat

SEQ ID NO: 429497 - DNA, 16 bp, M. musculus
tattctgtacttttaa

SEQ ID NO: 429498 - DNA, 16 bp, M. musculus
tattctgtagatatct

SEQ ID NO: 429499 - DNA, 16 bp, M. musculus
tattctgtaggctgcc

SEQ ID NO: 429500 - DNA, 16 bp, M. musculus
tattctgtctgtctgt

SEQ ID NO: 429501 - DNA, 16 bp, M. musculus
tattctgtgagttcct

SEQ ID NO: 429502 - DNA, 16 bp, M. musculus
tattctgttgctgttg

SEQ ID NO: 429503 - DNA, 16 bp, M. musculus
tattctgtttcccctt

SEQ ID NO: 429504 - DNA, 16 bp, M. musculus
tattcttaaatgagtt

SEQ ID NO: 429505 - DNA, 16 bp, M. musculus
tattcttgtgggactc

SEQ ID NO: 429506 - DNA, 16 bp, M. musculus
tattctttctccacat

SEQ ID NO: 429507 - DNA, 16 bp, M. musculus
tattctttgacatttt

SEQ ID NO: 429508 - DNA, 16 bp, M. musculus
tattctttgagaattt

SEQ ID NO: 429509 - DNA, 16 bp, M. musculus
tattctttggcaattt

SEQ ID NO: 429510 - DNA, 16 bp, M. musculus
tattcttttaaaagtt

SEQ ID NO: 429511 - DNA, 16 bp, M. musculus
tattcttttgagtttc

SEQ ID NO: 429512 - DNA, 16 bp, M. musculus
tattgaaaaagatatt

SEQ ID NO: 429513 - DNA, 16 bp, M. musculus
tattgaaaacagattt

SEQ ID NO: 429514 - DNA, 16 bp, M. musculus
tattgaaaatgtcttt

SEQ ID NO: 429515 - DNA, 16 bp, M. musculus
tattgaacattttttc

SEQ ID NO: 429516 - DNA, 16 bp, M. musculus
tattgaatattttgag

SEQ ID NO: 429517 - DNA, 16 bp, M. musculus
tattgaatgcacaccc

SEQ ID NO: 429518 - DNA, 16 bp, M. musculus
tattgaccaatcagaa

SEQ ID NO: 429519 - DNA, 16 bp, M. musculus
tattgaccaggctggc

SEQ ID NO: 429520 - DNA, 16 bp, M. musculus
tattgacgatgtcttt

SEQ ID NO: 429521 - DNA, 23 bp, M. musculus
tattgactccccagatggacaca

SEQ ID NO: 429522 - DNA, 16 bp, M. musculus
tattgactgagaaaca

SEQ ID NO: 429523 - DNA, 16 bp, M. musculus
tattgactgtatcttt

SEQ ID NO: 429524 - DNA, 16 bp, M. musculus
tattgagaaaaatgta

SEQ ID NO: 429525 - DNA, 16 bp, M. musculus
tattgagaccctgtct

SEQ ID NO: 429526 - DNA, 16 bp, M. musculus
tattgatgacatctgt

SEQ ID NO: 429527 - DNA, 16 bp, M. musculus
tattgatgatgatgat

SEQ ID NO: 429528 - DNA, 16 bp, M. musculus
tattgatgtaaaaata

SEQ ID NO: 429529 - DNA, 16 bp, M. musculus
tattgcagatgccaac

SEQ ID NO: 429530 - DNA, 16 bp, M. musculus
tattgcatataccagc

SEQ ID NO: 429531 - DNA, 16 bp, M. musculus
tattgcatgaaaaaaa

SEQ ID NO: 429532 - DNA, 17 bp, M. musculus
tattgcattattcatga

SEQ ID NO: 429533 - DNA, 16 bp, M. musculus
tattgctaaagaagca

SEQ ID NO: 429534 - DNA, 16 bp, M. musculus
tattgctaaatgaatt

SEQ ID NO: 429535 - DNA, 16 bp, M. musculus
tattgctattgttatt

SEQ ID NO: 429536 - DNA, 16 bp, M. musculus
tattgctgaagacaac

SEQ ID NO: 429537 - DNA, 16 bp, M. musculus
tattgctgcatcctcc

SEQ ID NO: 429538 - DNA, 16 bp, M. musculus
tattgctggattttct

SEQ ID NO: 429539 - DNA, 16 bp, M. musculus
tattgctgtagacaaa

SEQ ID NO: 429540 - DNA, 16 bp, M. musculus
tattgctgtgaagaaa

SEQ ID NO: 429541 - DNA, 17 bp, M. musculus
tattgctgtgaagagat

SEQ ID NO: 429542 - DNA, 16 bp, M. musculus
tattgctttgattatg

SEQ ID NO: 429543 - DNA, 16 bp, M. musculus
tattgcttttatttcc

SEQ ID NO: 429544 - DNA, 16 bp, M. musculus
tattgcttttctggtg

SEQ ID NO: 429545 - DNA, 16 bp, M. musculus
tattgcttttgctatg

SEQ ID NO: 429546 - DNA, 16 bp, M. musculus
tattggagaatctttt

SEQ ID NO: 429547 - DNA, 16 bp, M. musculus
tattggattttctgga

SEQ ID NO: 429548 - DNA, 16 bp, M. musculus
tattggcaatgtttta

SEQ ID NO: 429549 - DNA, 16 bp, M. musculus
tattggcacaggggaa

SEQ ID NO: 429550 - DNA, 16 bp, M. musculus
tattggcagatgatat

SEQ ID NO: 429551 - DNA, 16 bp, M. musculus
tattggcatctgccta

SEQ ID NO: 429552 - DNA, 16 bp, M. musculus
tattgggaaattgaat

SEQ ID NO: 429553 - DNA, 16 bp, M. musculus
tattggtattttgcct

SEQ ID NO: 429554 - DNA, 16 bp, M. musculus
tattggttgccatttt

SEQ ID NO: 429555 - DNA, 16 bp, M. musculus
tattgtaaatatttct

SEQ ID NO: 429556 - DNA, 16 bp, M. musculus
tattgtaatgttaaat

SEQ ID NO: 429557 - DNA, 16 bp, M. musculus
tattgtagaaaatggc

SEQ ID NO: 429558 - DNA, 16 bp, M. musculus
tattgtatagtatagt

SEQ ID NO: 429559 - DNA, 16 bp, M. musculus
tattgtatgtatatga

SEQ ID NO: 429560 - DNA, 16 bp, M. musculus
tattgtattgtactgt

SEQ ID NO: 429561 - DNA, 16 bp, M. musculus
tattgtcaaatgcttt

SEQ ID NO: 429562 - DNA, 16 bp, M. musculus
tattgtcaagctgcta

SEQ ID NO: 429563 - DNA, 16 bp, M. musculus
tattgtcttcatttac

SEQ ID NO: 429564 - DNA, 16 bp, M. musculus
tattgtgaaactttaa

SEQ ID NO: 429565 - DNA, 16 bp, M. musculus
tattgtgaaaggtgct

SEQ ID NO: 429566 - DNA, 16 bp, M. musculus
tattgtgaacagacac

SEQ ID NO: 429567 - DNA, 16 bp, M. musculus
tattgtgaacatcatt

SEQ ID NO: 429568 - DNA, 16 bp, M. musculus
tattgtgctttaaaaa

SEQ ID NO: 429569 - DNA, 18 bp, M. musculus
tattgtgtaaatgtacca

SEQ ID NO: 429570 - DNA, 16 bp, M. musculus
tattgtgtgaaattgt

SEQ ID NO: 429571 - DNA, 16 bp, M. musculus
tattgttacaatattt

SEQ ID NO: 429572 - DNA, 16 bp, M. musculus
tattgttcctgtctga

SEQ ID NO: 429573 - DNA, 16 bp, M. musculus
tattgttcttccaatg

SEQ ID NO: 429574 - DNA, 16 bp, M. musculus
tattgttgaaaataat

SEQ ID NO: 429575 - DNA, 16 bp, M. musculus
tattgttgctgttttg

SEQ ID NO: 429576 - DNA, 16 bp, M. musculus
tattgttttgctaaat

SEQ ID NO: 429577 - DNA, 16 bp, M. musculus
tatttaaaaaagcaaa

SEQ ID NO: 429578 - DNA, 16 bp, M. musculus
tatttaaaaccatttt

SEQ ID NO: 429579 - DNA, 16 bp, M. musculus
tatttaaaaggcagtt

SEQ ID NO: 429580 - DNA, 16 bp, M. musculus
tatttaaaatgatgat

SEQ ID NO: 429581 - DNA, 16 bp, M. musculus
tatttaaagacatttt

SEQ ID NO: 429582 - DNA, 16 bp, M. musculus
tatttaaatatgcctt

SEQ ID NO: 429583 - DNA, 16 bp, M. musculus
tatttaaatgtttctt

SEQ ID NO: 429584 - DNA, 16 bp, M. musculus
tatttaaatgtttggt

SEQ ID NO: 429585 - DNA, 16 bp, M. musculus
tatttaacaagatttc

SEQ ID NO: 429586 - DNA, 16 bp, M. musculus
tatttaagaggcattt

SEQ ID NO: 429587 - DNA, 16 bp, M. musculus
tatttaagggattttt

SEQ ID NO: 429588 - DNA, 16 bp, M. musculus
tatttaatcatctatc

SEQ ID NO: 429589 - DNA, 16 bp, M. musculus
tatttacaggaaaatg

SEQ ID NO: 429590 - DNA, 16 bp, M. musculus
tatttacataacattt

SEQ ID NO: 429591 - DNA, 16 bp, M. musculus
tatttacatagcattt

SEQ ID NO: 429592 - DNA, 16 bp, M. musculus
tatttacatcaagatg

SEQ ID NO: 429593 - DNA, 16 bp, M. musculus
tatttacatcccaaat

SEQ ID NO: 429594 - DNA, 16 bp, M. musculus
tatttacatgtaaata

SEQ ID NO: 429595 - DNA, 16 bp, M. musculus
tatttacatgtctttt

SEQ ID NO: 429596 - DNA, 16 bp, M. musculus
tatttacatgtgtgtg

SEQ ID NO: 429597 - DNA, 16 bp, M. musculus
tatttacattacaatt

SEQ ID NO: 429598 - DNA, 16 bp, M. musculus
tatttacattaccatt

SEQ ID NO: 429599 - DNA, 16 bp, M. musculus
tatttacattatgatt

SEQ ID NO: 429600 - DNA, 16 bp, M. musculus
tatttacattctgatt

SEQ ID NO: 429601 - DNA, 16 bp, M. musculus
tatttacatttatttg

SEQ ID NO: 429602 - DNA, 16 bp, M. musculus
tatttacattttaagt

SEQ ID NO: 429603 - DNA, 16 bp, M. musculus
tatttaccaagaattt

SEQ ID NO: 429604 - DNA, 16 bp, M. musculus
tatttacttactcatt

SEQ ID NO: 429605 - DNA, 16 bp, M. musculus
tatttagaaatatgta

SEQ ID NO: 429606 - DNA, 16 bp, M. musculus
tatttagaaggtagtt

SEQ ID NO: 429607 - DNA, 16 bp, M. musculus
tatttagaatgtagct

SEQ ID NO: 429608 - DNA, 17 bp, M. musculus
tatttagggcatgggga

SEQ ID NO: 429609 - DNA, 17 bp, M. musculus
tatttagtgcacttgtt

SEQ ID NO: 429610 - DNA, 16 bp, M. musculus
tatttataaaactagt

SEQ ID NO: 429611 - DNA, 16 bp, M. musculus
tatttataactacctt

SEQ ID NO: 429612 - DNA, 17 bp, M. musculus
tatttataatagccagg

SEQ ID NO: 429613 - DNA, 16 bp, M. musculus
tatttatacaatgaaa

SEQ ID NO: 429614 - DNA, 16 bp, M. musculus
tatttatatttcaagt

SEQ ID NO: 429615 - DNA, 16 bp, M. musculus
tatttatccatctatc

SEQ ID NO: 429616 - DNA, 16 bp, M. musculus
tatttatctatctacc

SEQ ID NO: 429617 - DNA, 16 bp, M. musculus
tatttatgcatacata

SEQ ID NO: 429618 - DNA, 16 bp, M. musculus
tatttatgggcatctc

SEQ ID NO: 429619 - DNA, 16 bp, M. musculus
tatttatgtacacata

SEQ ID NO: 429620 - DNA, 16 bp, M. musculus
tatttatgtatatgca

SEQ ID NO: 429621 - DNA, 16 bp, M. musculus
tatttatgtatgtgca

SEQ ID NO: 429622 - DNA, 16 bp, M. musculus
tatttatgtattcatt

SEQ ID NO: 429623 - DNA, 16 bp, M. musculus
tatttatgtccttctt

SEQ ID NO: 429624 - DNA, 16 bp, M. musculus
tatttattaccttgca

SEQ ID NO: 429625 - DNA, 16 bp, M. musculus
tatttattagtgtgtg

SEQ ID NO: 429626 - DNA, 16 bp, M. musculus
tatttattatctgtaa

SEQ ID NO: 429627 - DNA, 16 bp, M. musculus
tatttattcatgtgtg

SEQ ID NO: 429628 - DNA, 16 bp, M. musculus
tatttattccatttac

SEQ ID NO: 429629 - DNA, 16 bp, M. musculus
tatttattctttggaa

SEQ ID NO: 429630 - DNA, 16 bp, M. musculus
tatttattgagcacct

SEQ ID NO: 429631 - DNA, 16 bp, M. musculus
tatttatttaaaactc

SEQ ID NO: 429632 - DNA, 16 bp, M. musculus
tatttatttacaaatg

SEQ ID NO: 429633 - DNA, 16 bp, M. musculus
tatttatttaggggat

SEQ ID NO: 429634 - DNA, 16 bp, M. musculus
tatttatttattagct

SEQ ID NO: 429635 - DNA, 16 bp, M. musculus
tatttatttcatgtat

SEQ ID NO: 429636 - DNA, 16 bp, M. musculus
tatttatttgagacat

SEQ ID NO: 429637 - DNA, 16 bp, M. musculus
tatttatttggaaaaa

SEQ ID NO: 429638 - DNA, 16 bp, M. musculus
tatttattttagaaag

SEQ ID NO: 429639 - DNA, 16 bp, M. musculus
tatttattttcaaaag

SEQ ID NO: 429640 - DNA, 16 bp, M. musculus
tatttattttgtgtgc

SEQ ID NO: 429641 - DNA, 16 bp, M. musculus
tatttatttttaacag

SEQ ID NO: 429642 - DNA, 16 bp, M. musculus
tatttcaaaaaagaaa

SEQ ID NO: 429643 - DNA, 16 bp, M. musculus
tatttcaaatgaattt

SEQ ID NO: 429644 - DNA, 16 bp, M. musculus
tatttcagaaaataaa

SEQ ID NO: 429645 - DNA, 16 bp, M. musculus
tatttcagaaataaaa

SEQ ID NO: 429646 - DNA, 16 bp, M. musculus
tatttcaggccttcat

SEQ ID NO: 429647 - DNA, 16 bp, M. musculus
tatttcagttttctta

SEQ ID NO: 429648 - DNA, 16 bp, M. musculus
tatttcatattttgaa

SEQ ID NO: 429649 - DNA, 16 bp, M. musculus
tatttcatgtatgtgg

SEQ ID NO: 429650 - DNA, 16 bp, M. musculus
tatttcattcctccct

SEQ ID NO: 429651 - DNA, 16 bp, M. musculus
tatttcatttctaaaa

SEQ ID NO: 429652 - DNA, 16 bp, M. musculus
tatttcattttgaaat

SEQ ID NO: 429653 - DNA, 16 bp, M. musculus
tatttccaaacaacat

SEQ ID NO: 429654 - DNA, 16 bp, M. musculus
tatttccattttaaca

SEQ ID NO: 429655 - DNA, 16 bp, M. musculus
tatttccctgatgatt

SEQ ID NO: 429656 - DNA, 16 bp, M. musculus
tatttccctttcctag

SEQ ID NO: 429657 - DNA, 16 bp, M. musculus
tatttcctaaacagaa

SEQ ID NO: 429658 - DNA, 16 bp, M. musculus
tatttcctaatatgac

SEQ ID NO: 429659 - DNA, 16 bp, M. musculus
tatttcctaattaaag

SEQ ID NO: 429660 - DNA, 16 bp, M. musculus
tatttcctatgttttc

SEQ ID NO: 429661 - DNA, 16 bp, M. musculus
tatttcctgccttcta

SEQ ID NO: 429662 - DNA, 16 bp, M. musculus
tatttccttaagggag

SEQ ID NO: 429663 - DNA, 16 bp, M. musculus
tatttctaaaagaaaa

SEQ ID NO: 429664 - DNA, 16 bp, M. musculus
tatttctacaaaggac

SEQ ID NO: 429665 - DNA, 16 bp, M. musculus
tatttctattttatgg

SEQ ID NO: 429666 - DNA, 16 bp, M. musculus
tatttctatttttaga

SEQ ID NO: 429667 - DNA, 16 bp, M. musculus
tatttctcaagacagt

SEQ ID NO: 429668 - DNA, 16 bp, M. musculus
tatttctcacttgctg

SEQ ID NO: 429669 - DNA, 16 bp, M. musculus
tatttctctctttagt

SEQ ID NO: 429670 - DNA, 16 bp, M. musculus
tatttctctgagaaca

SEQ ID NO: 429671 - DNA, 16 bp, M. musculus
tatttctctttgtcca

SEQ ID NO: 429672 - DNA, 16 bp, M. musculus
tatttctcttttggta

SEQ ID NO: 429673 - DNA, 16 bp, M. musculus
tatttctgaaaataaa

SEQ ID NO: 429674 - DNA, 16 bp, M. musculus
tatttctgcttcattt

SEQ ID NO: 429675 - DNA, 16 bp, M. musculus
tatttctgctttctct

SEQ ID NO: 429676 - DNA, 16 bp, M. musculus
tatttctggcttcttt

SEQ ID NO: 429677 - DNA, 16 bp, M. musculus
tatttctgggaacaaa

SEQ ID NO: 429678 - DNA, 16 bp, M. musculus
tatttctgggtgttca

SEQ ID NO: 429679 - DNA, 16 bp, M. musculus
tatttctgtctgtctc

SEQ ID NO: 429680 - DNA, 16 bp, M. musculus
tatttctgtgaaaaga

SEQ ID NO: 429681 - DNA, 16 bp, M. musculus
tatttctgtttctgtg

SEQ ID NO: 429682 - DNA, 16 bp, M. musculus
tatttcttaaagaaaa

SEQ ID NO: 429683 - DNA, 16 bp, M. musculus
tatttcttaaagattt

SEQ ID NO: 429684 - DNA, 16 bp, M. musculus
tatttcttcaagtgag

SEQ ID NO: 429685 - DNA, 16 bp, M. musculus
tatttcttgaaaaaaa

SEQ ID NO: 429686 - DNA, 16 bp, M. musculus
tatttcttggatgttt

SEQ ID NO: 429687 - DNA, 16 bp, M. musculus
tatttctttaaagaaa

SEQ ID NO: 429688 - DNA, 16 bp, M. musculus
tatttctttaagtgtg

SEQ ID NO: 429689 - DNA, 16 bp, M. musculus
tatttctttaggagtt

SEQ ID NO: 429690 - DNA, 16 bp, M. musculus
tatttctttagggtaa

SEQ ID NO: 429691 - DNA, 16 bp, M. musculus
tatttctttgaaaaat

SEQ ID NO: 429692 - DNA, 16 bp, M. musculus
tatttctttgaaattt

SEQ ID NO: 429693 - DNA, 16 bp, M. musculus
tatttctttgggattc

SEQ ID NO: 429694 - DNA, 16 bp, M. musculus
tatttctttgggggaa

SEQ ID NO: 429695 - DNA, 16 bp, M. musculus
tatttctttgtgtgtg

SEQ ID NO: 429696 - DNA, 16 bp, M. musculus
tatttcttttaaagat

SEQ ID NO: 429697 - DNA, 16 bp, M. musculus
tatttgaaaatgtaaa

SEQ ID NO: 429698 - DNA, 17 bp, M. musculus
tatttgaaagaatgtgg

SEQ ID NO: 429699 - DNA, 16 bp, M. musculus
tatttgaatgcttagt

SEQ ID NO: 429700 - DNA, 16 bp, M. musculus
tatttgagaaaatatt

SEQ ID NO: 429701 - DNA, 16 bp, M. musculus
tatttgagaagatagt

SEQ ID NO: 429702 - DNA, 16 bp, M. musculus
tatttgagtacactgt

SEQ ID NO: 429703 - DNA, 16 bp, M. musculus
tatttgatcatattca

SEQ ID NO: 429704 - DNA, 16 bp, M. musculus
tatttgatgttaattc

SEQ ID NO: 429705 - DNA, 16 bp, M. musculus
tatttgatttcctgga

SEQ ID NO: 429706 - DNA, 16 bp, M. musculus
tatttgcacccagcca

SEQ ID NO: 429707 - DNA, 16 bp, M. musculus
tatttgcagatgacaa

SEQ ID NO: 429708 - DNA, 16 bp, M. musculus
tatttgcattaaaatt

SEQ ID NO: 429709 - DNA, 16 bp, M. musculus
tatttgcattatttta

SEQ ID NO: 429710 - DNA, 16 bp, M. musculus
tatttgcatttttcta

SEQ ID NO: 429711 - DNA, 17 bp, M. musculus
tatttgccaggcactgc

SEQ ID NO: 429712 - DNA, 16 bp, M. musculus
tatttgcccagaaact

SEQ ID NO: 429713 - DNA, 16 bp, M. musculus
tatttgctccctgcct

SEQ ID NO: 429714 - DNA, 16 bp, M. musculus
tatttgctgaatgaat

SEQ ID NO: 429715 - DNA, 16 bp, M. musculus
tatttgctggccattt

SEQ ID NO: 429716 - DNA, 16 bp, M. musculus
tatttgcttatttact

SEQ ID NO: 429717 - DNA, 16 bp, M. musculus
tatttgcttcatttac

SEQ ID NO: 429718 - DNA, 16 bp, M. musculus
tatttggaaaaacaaa

SEQ ID NO: 429719 - DNA, 16 bp, M. musculus
tatttggaaatttcat

SEQ ID NO: 429720 - DNA, 16 bp, M. musculus
tatttggaggctgatt

SEQ ID NO: 429721 - DNA, 16 bp, M. musculus
tatttggctcatggtt

SEQ ID NO: 429722 - DNA, 16 bp, M. musculus
tatttggcttgttgat

SEQ ID NO: 429723 - DNA, 16 bp, M. musculus
tatttggtttattaca

SEQ ID NO: 429724 - DNA, 16 bp, M. musculus
tatttggttttcctct

SEQ ID NO: 429725 - DNA, 16 bp, M. musculus
tatttgtaaaattcat

SEQ ID NO: 429726 - DNA, 16 bp, M. musculus
tatttgtaagggaaat

SEQ ID NO: 429727 - DNA, 16 bp, M. musculus
tatttgtagacacttt

SEQ ID NO: 429728 - DNA, 16 bp, M. musculus
tatttgtatacataca

SEQ ID NO: 429729 - DNA, 16 bp, M. musculus
tatttgtatgtatatg

SEQ ID NO: 429730 - DNA, 16 bp, M. musculus
tatttgtatgtgtaca

SEQ ID NO: 429731 - DNA, 16 bp, M. musculus
tatttgtcagacactg

SEQ ID NO: 429732 - DNA, 16 bp, M. musculus
tatttgtcagactctg

SEQ ID NO: 429733 - DNA, 16 bp, M. musculus
tatttgtcatttgtat

SEQ ID NO: 429734 - DNA, 16 bp, M. musculus
tatttgtcattttaaa

SEQ ID NO: 429735 - DNA, 16 bp, M. musculus
tatttgtcctgaaaag

SEQ ID NO: 429736 - DNA, 16 bp, M. musculus
tatttgtctagaaaat

SEQ ID NO: 429737 - DNA, 16 bp, M. musculus
tatttgtctttttaaa

SEQ ID NO: 429738 - DNA, 16 bp, M. musculus
tatttgtgaaagaaaa

SEQ ID NO: 429739 - DNA, 16 bp, M. musculus
tatttgtgactattta

SEQ ID NO: 429740 - DNA, 16 bp, M. musculus
tatttgtgactgttga

SEQ ID NO: 429741 - DNA, 16 bp, M. musculus
tatttgtgtatctgtg

SEQ ID NO: 429742 - DNA, 16 bp, M. musculus
tatttgttctctctct

SEQ ID NO: 429743 - DNA, 17 bp, M. musculus
tatttgttgaaaatgct

SEQ ID NO: 429744 - DNA, 16 bp, M. musculus
tatttgttgaatgaat

SEQ ID NO: 429745 - DNA, 16 bp, M. musculus
tatttgttgttgctgt

SEQ ID NO: 429746 - DNA, 16 bp, M. musculus
tatttgtttaccagtt

SEQ ID NO: 429747 - DNA, 16 bp, M. musculus
tatttgttttctaaag

SEQ ID NO: 429748 - DNA, 16 bp, M. musculus
tattttaaaaaagact

SEQ ID NO: 429749 - DNA, 16 bp, M. musculus
tattttaaaaagcaaa

SEQ ID NO: 429750 - DNA, 16 bp, M. musculus
tattttaaaactgtat

SEQ ID NO: 429751 - DNA, 16 bp, M. musculus
tattttaaaagaacaa

SEQ ID NO: 429752 - DNA, 16 bp, M. musculus
tattttaaaagacaaa

SEQ ID NO: 429753 - DNA, 16 bp, M. musculus
tattttaaaagatttg

SEQ ID NO: 429754 - DNA, 16 bp, M. musculus
tattttaaaagctata

SEQ ID NO: 429755 - DNA, 16 bp, M. musculus
tattttaaaatacaca

SEQ ID NO: 429756 - DNA, 16 bp, M. musculus
tattttaaaatgtatc

SEQ ID NO: 429757 - DNA, 16 bp, M. musculus
tattttaaaatgtcat

SEQ ID NO: 429758 - DNA, 16 bp, M. musculus
tattttaaacagaaaa

SEQ ID NO: 429759 - DNA, 16 bp, M. musculus
tattttaaacatctga

SEQ ID NO: 429760 - DNA, 16 bp, M. musculus
tattttaaagaaacaa

SEQ ID NO: 429761 - DNA, 16 bp, M. musculus
tattttaaagagatta

SEQ ID NO: 429762 - DNA, 16 bp, M. musculus
tattttaaaggaaatt

SEQ ID NO: 429763 - DNA, 16 bp, M. musculus
tattttaagaaaatga

SEQ ID NO: 429764 - DNA, 16 bp, M. musculus
tattttaataagatcc

SEQ ID NO: 429765 - DNA, 16 bp, M. musculus
tattttaatatgcttt

SEQ ID NO: 429766 - DNA, 16 bp, M. musculus
tattttaatctcaaaa

SEQ ID NO: 429767 - DNA, 16 bp, M. musculus
tattttaatgagaatt

SEQ ID NO: 429768 - DNA, 16 bp, M. musculus
tattttaatgcttagt

SEQ ID NO: 429769 - DNA, 16 bp, M. musculus
tattttaatgtgtgtg

SEQ ID NO: 429770 - DNA, 16 bp, M. musculus
tattttaatgtgttct

SEQ ID NO: 429771 - DNA, 16 bp, M. musculus
tattttaattgctatt

SEQ ID NO: 429772 - DNA, 16 bp, M. musculus
tattttacaaaataga

SEQ ID NO: 429773 - DNA, 16 bp, M. musculus
tattttacacatcaaa

SEQ ID NO: 429774 - DNA, 16 bp, M. musculus
tattttaccaatttca

SEQ ID NO: 429775 - DNA, 16 bp, M. musculus
tattttactggatatt

SEQ ID NO: 429776 - DNA, 16 bp, M. musculus
tattttagaaaattga

SEQ ID NO: 429777 - DNA, 16 bp, M. musculus
tattttataggagaaa

SEQ ID NO: 429778 - DNA, 16 bp, M. musculus
tattttatatacactg

SEQ ID NO: 429779 - DNA, 16 bp, M. musculus
tattttatatcatttg

SEQ ID NO: 429780 - DNA, 16 bp, M. musculus
tattttatatgcatta

SEQ ID NO: 429781 - DNA, 16 bp, M. musculus
tattttatcacaacaa

SEQ ID NO: 429782 - DNA, 16 bp, M. musculus
tattttatctcagata

SEQ ID NO: 429783 - DNA, 16 bp, M. musculus
tattttatgaagaaaa

SEQ ID NO: 429784 - DNA, 16 bp, M. musculus
tattttatgcaaatat

SEQ ID NO: 429785 - DNA, 16 bp, M. musculus
tattttatgcatttta

SEQ ID NO: 429786 - DNA, 16 bp, M. musculus
tattttatgtatatgg

SEQ ID NO: 429787 - DNA, 16 bp, M. musculus
tattttatgtatgtgg

SEQ ID NO: 429788 - DNA, 16 bp, M. musculus
tattttattagcattt

SEQ ID NO: 429789 - DNA, 16 bp, M. musculus
tattttatttgcaatt

SEQ ID NO: 429790 - DNA, 16 bp, M. musculus
tattttattttctcag

SEQ ID NO: 429791 - DNA, 16 bp, M. musculus
tattttattttctgga

SEQ ID NO: 429792 - DNA, 16 bp, M. musculus
tattttcaaaacattt

SEQ ID NO: 429793 - DNA, 16 bp, M. musculus
tattttcaaagaaaca

SEQ ID NO: 429794 - DNA, 16 bp, M. musculus
tattttcaaggaaaat

SEQ ID NO: 429795 - DNA, 16 bp, M. musculus
tattttcaagttcaaa

SEQ ID NO: 429796 - DNA, 16 bp, M. musculus
tattttcaagttttat

SEQ ID NO: 429797 - DNA, 16 bp, M. musculus
tattttcacagaaaat

SEQ ID NO: 429798 - DNA, 16 bp, M. musculus
tattttcagcttctgg

SEQ ID NO: 429799 - DNA, 16 bp, M. musculus
tattttcagtaatggc

SEQ ID NO: 429800 - DNA, 16 bp, M. musculus
tattttcatgtatata

SEQ ID NO: 429801 - DNA, 16 bp, M. musculus
tattttcatgtatgtt

SEQ ID NO: 429802 - DNA, 16 bp, M. musculus
tattttcattttatgc

SEQ ID NO: 429803 - DNA, 16 bp, M. musculus
tattttcattttctga

SEQ ID NO: 429804 - DNA, 16 bp, M. musculus
tattttccagtttcat

SEQ ID NO: 429805 - DNA, 16 bp, M. musculus
tattttcctaacattt

SEQ ID NO: 429806 - DNA, 16 bp, M. musculus
tattttcctcaaatac

SEQ ID NO: 429807 - DNA, 16 bp, M. musculus
tattttcctgaatttc

SEQ ID NO: 429808 - DNA, 16 bp, M. musculus
tattttccttatccat

SEQ ID NO: 429809 - DNA, 16 bp, M. musculus
tattttccttggctgt

SEQ ID NO: 429810 - DNA, 16 bp, M. musculus
tattttcctttgtagg

SEQ ID NO: 429811 - DNA, 16 bp, M. musculus
tattttctaaatgaaa

SEQ ID NO: 429812 - DNA, 16 bp, M. musculus
tattttctagatctat

SEQ ID NO: 429813 - DNA, 16 bp, M. musculus
tattttctagttccat

SEQ ID NO: 429814 - DNA, 16 bp, M. musculus
tattttctatgtgtgt

SEQ ID NO: 429815 - DNA, 16 bp, M. musculus
tattttctatgttaaa

SEQ ID NO: 429816 - DNA, 18 bp, M. musculus
tattttctctttaggtaa

SEQ ID NO: 429817 - DNA, 16 bp, M. musculus
tattttctgaatttta

SEQ ID NO: 429818 - DNA, 16 bp, M. musculus
tattttctgagtttta

SEQ ID NO: 429819 - DNA, 16 bp, M. musculus
tattttctgtaaattt

SEQ ID NO: 429820 - DNA, 16 bp, M. musculus
tattttctgtactata

SEQ ID NO: 429821 - DNA, 16 bp, M. musculus
tattttctgtatttac

SEQ ID NO: 429822 - DNA, 16 bp, M. musculus
tattttctgtgacttt

SEQ ID NO: 429823 - DNA, 16 bp, M. musculus
tattttcttaagaaca

SEQ ID NO: 429824 - DNA, 16 bp, M. musculus
tattttcttacattgg

SEQ ID NO: 429825 - DNA, 16 bp, M. musculus
tattttcttagaattt

SEQ ID NO: 429826 - DNA, 16 bp, M. musculus
tattttcttcataaaa

SEQ ID NO: 429827 - DNA, 16 bp, M. musculus
tattttcttgaaaaat

SEQ ID NO: 429828 - DNA, 16 bp, M. musculus
tattttctttctgaaa

SEQ ID NO: 429829 - DNA, 16 bp, M. musculus
tattttcttttgagac

SEQ ID NO: 429830 - DNA, 16 bp, M. musculus
tattttctttttggag

SEQ ID NO: 429831 - DNA, 16 bp, M. musculus
tattttgaaaaacaaa

SEQ ID NO: 429832 - DNA, 16 bp, M. musculus
tattttgaaaatcaaa

SEQ ID NO: 429833 - DNA, 16 bp, M. musculus
tattttgaaattttca

SEQ ID NO: 429834 - DNA, 16 bp, M. musculus
tattttgaagaatatt

SEQ ID NO: 429835 - DNA, 17 bp, M. musculus
tattttgaatcatctga

SEQ ID NO: 429836 - DNA, 16 bp, M. musculus
tattttgagaaaataa

SEQ ID NO: 429837 - DNA, 16 bp, M. musculus
tattttgagacaagat

SEQ ID NO: 429838 - DNA, 16 bp, M. musculus
tattttgagatagggt

SEQ ID NO: 429839 - DNA, 16 bp, M. musculus
tattttgagttcttcc

SEQ ID NO: 429840 - DNA, 16 bp, M. musculus
tattttgatgaagaat

SEQ ID NO: 429841 - DNA, 16 bp, M. musculus
tattttgcatgttttg

SEQ ID NO: 429842 - DNA, 16 bp, M. musculus
tattttgcctgcatat

SEQ ID NO: 429843 - DNA, 16 bp, M. musculus
tattttgcctggatgt

SEQ ID NO: 429844 - DNA, 16 bp, M. musculus
tattttgctccctatt

SEQ ID NO: 429845 - DNA, 16 bp, M. musculus
tattttgcttatatgt

SEQ ID NO: 429846 - DNA, 16 bp, M. musculus
tattttgcttgtgtgt

SEQ ID NO: 429847 - DNA, 16 bp, M. musculus
tattttggaaaaaata

SEQ ID NO: 429848 - DNA, 16 bp, M. musculus
tattttggctcacagc

SEQ ID NO: 429849 - DNA, 16 bp, M. musculus
tattttggcttcttcc

SEQ ID NO: 429850 - DNA, 16 bp, M. musculus
tattttggctttttga

SEQ ID NO: 429851 - DNA, 16 bp, M. musculus
tattttgggttggaag

SEQ ID NO: 429852 - DNA, 16 bp, M. musculus
tattttggtcattatg

SEQ ID NO: 429853 - DNA, 16 bp, M. musculus
tattttgtacaattaa

SEQ ID NO: 429854 - DNA, 16 bp, M. musculus
tattttgtatatgtga

SEQ ID NO: 429855 - DNA, 16 bp, M. musculus
tattttgtatgtatga

SEQ ID NO: 429856 - DNA, 16 bp, M. musculus
tattttgtatgtgtga

SEQ ID NO: 429857 - DNA, 16 bp, M. musculus
tattttgtattttcaa

SEQ ID NO: 429858 - DNA, 16 bp, M. musculus
tattttgtcacagaga

SEQ ID NO: 429859 - DNA, 16 bp, M. musculus
tattttgtctctgtaa

SEQ ID NO: 429860 - DNA, 16 bp, M. musculus
tattttgtgcatgtgt

SEQ ID NO: 429861 - DNA, 16 bp, M. musculus
tattttgtggaaaaat

SEQ ID NO: 429862 - DNA, 16 bp, M. musculus
tattttgtgtgcatgc

SEQ ID NO: 429863 - DNA, 16 bp, M. musculus
tattttgttacctatt

SEQ ID NO: 429864 - DNA, 16 bp, M. musculus
tattttgttgctgatg

SEQ ID NO: 429865 - DNA, 16 bp, M. musculus
tattttgtttcccctt

SEQ ID NO: 429866 - DNA, 16 bp, M. musculus
tattttgtttgcatgt

SEQ ID NO: 429867 - DNA, 16 bp, M. musculus
tatttttaaaaaatgg

SEQ ID NO: 429868 - DNA, 16 bp, M. musculus
tatttttaaaaaccct

SEQ ID NO: 429869 - DNA, 16 bp, M. musculus
tatttttaaaaacctt

SEQ ID NO: 429870 - DNA, 16 bp, M. musculus
tatttttaaaaagtgt

SEQ ID NO: 429871 - DNA, 16 bp, M. musculus
tatttttaaaaatgca

SEQ ID NO: 429872 - DNA, 16 bp, M. musculus
tatttttaaaagaaag

SEQ ID NO: 429873 - DNA, 16 bp, M. musculus
tatttttaaaagtaac

SEQ ID NO: 429874 - DNA, 16 bp, M. musculus
tatttttaaaatgaag

SEQ ID NO: 429875 - DNA, 16 bp, M. musculus
tatttttaaaattcca

SEQ ID NO: 429876 - DNA, 16 bp, M. musculus
tatttttaaagaaact

SEQ ID NO: 429877 - DNA, 16 bp, M. musculus
tatttttaaagacaaa

SEQ ID NO: 429878 - DNA, 16 bp, M. musculus
tatttttaaagatgta

SEQ ID NO: 429879 - DNA, 16 bp, M. musculus
tatttttaaaggaaaa

SEQ ID NO: 429880 - DNA, 16 bp, M. musculus
tatttttaaagttcta

SEQ ID NO: 429881 - DNA, 16 bp, M. musculus
tatttttaagccaaaa

SEQ ID NO: 429882 - DNA, 16 bp, M. musculus
tatttttaagtgaaaa

SEQ ID NO: 429883 - DNA, 16 bp, M. musculus
tatttttagaaaatgt

SEQ ID NO: 429884 - DNA, 16 bp, M. musculus
tatttttagacaaaaa

SEQ ID NO: 429885 - DNA, 16 bp, M. musculus
tatttttatcatggaa

SEQ ID NO: 429886 - DNA, 16 bp, M. musculus
tatttttatctccttg

SEQ ID NO: 429887 - DNA, 16 bp, M. musculus
tatttttatgtgcata

SEQ ID NO: 429888 - DNA, 16 bp, M. musculus
tatttttattactgta

SEQ ID NO: 429889 - DNA, 16 bp, M. musculus
tatttttcaggctctg

SEQ ID NO: 429890 - DNA, 16 bp, M. musculus
tatttttcctcctttg

SEQ ID NO: 429891 - DNA, 16 bp, M. musculus
tatttttccttgctca

SEQ ID NO: 429892 - DNA, 16 bp, M. musculus
tatttttctcagaaaa

SEQ ID NO: 429893 - DNA, 16 bp, M. musculus
tatttttctgttggct

SEQ ID NO: 429894 - DNA, 16 bp, M. musculus
tatttttctttagaaa

SEQ ID NO: 429895 - DNA, 16 bp, M. musculus
tatttttgacatattt

SEQ ID NO: 429896 - DNA, 16 bp, M. musculus
tatttttgagaattgt

SEQ ID NO: 429897 - DNA, 16 bp, M. musculus
tatttttgagaatttc

SEQ ID NO: 429898 - DNA, 16 bp, M. musculus
tatttttgagacagag

SEQ ID NO: 429899 - DNA, 16 bp, M. musculus
tatttttgaggctttt

SEQ ID NO: 429900 - DNA, 16 bp, M. musculus
tatttttggaaaaaaa

SEQ ID NO: 429901 - DNA, 16 bp, M. musculus
tatttttgtagacttt

SEQ ID NO: 429902 - DNA, 16 bp, M. musculus
tatttttgtctctgtc

SEQ ID NO: 429903 - DNA, 16 bp, M. musculus
tattttttaaagaaag

SEQ ID NO: 429904 - DNA, 16 bp, M. musculus
tattttttgagacaaa

SEQ ID NO: 429905 - DNA, 16 bp, M. musculus
tattttttgagatggg

SEQ ID NO: 429906 - DNA, 16 bp, M. musculus
tatttttttaaagaca

SEQ ID NO: 429907 - DNA, 16 bp, M. musculus
tatttttttcaaaatg

SEQ ID NO: 429908 - DNA, 16 bp, M. musculus
tatttttttcaagaca

SEQ ID NO: 429909 - DNA, 16 bp, M. musculus
tatttttttcctgaaa

SEQ ID NO: 429910 - DNA, 16 bp, M. musculus
tatttttttctcagcc

SEQ ID NO: 429911 - DNA, 16 bp, M. musculus
tatttttttctgaaaa

SEQ ID NO: 429912 - DNA, 16 bp, M. musculus
tatttttttctgaaag

SEQ ID NO: 429913 - DNA, 16 bp, M. musculus
tatttttttcttaaag

SEQ ID NO: 429914 - DNA, 16 bp, M. musculus
tattttttttcaggaa

SEQ ID NO: 429915 - DNA, 16 bp, M. musculus
tattttttttccaaga

SEQ ID NO: 429916 - DNA, 16 bp, M. musculus
tattttttttctagaa

SEQ ID NO: 429917 - DNA, 16 bp, M. musculus
tcaaaaaaattagatc

SEQ ID NO: 429918 - DNA, 16 bp, M. musculus
tcaaaaaacctaaaag

SEQ ID NO: 429919 - DNA, 16 bp, M. musculus
tcaaaaaagtcaacaa

SEQ ID NO: 429920 - DNA, 16 bp, M. musculus
tcaaaaaatgcaaaat

SEQ ID NO: 429921 - DNA, 16 bp, M. musculus
tcaaaaaattggaaat

SEQ ID NO: 429922 - DNA, 16 bp, M. musculus
tcaaaaacaagatgga

SEQ ID NO: 429923 - DNA, 16 bp, M. musculus
tcaaaaacatcagaag

SEQ ID NO: 429924 - DNA, 16 bp, M. musculus
tcaaaaacatcatcta

SEQ ID NO: 429925 - DNA, 16 bp, M. musculus
tcaaaaacatttttta

SEQ ID NO: 429926 - DNA, 16 bp, M. musculus
tcaaaaagacaaatat

SEQ ID NO: 429927 - DNA, 16 bp, M. musculus
tcaaaaagccaaaaag

SEQ ID NO: 429928 - DNA, 16 bp, M. musculus
tcaaaaaggaaaagga

SEQ ID NO: 429929 - DNA, 16 bp, M. musculus
tcaaaaaggacaagga

SEQ ID NO: 429930 - DNA, 16 bp, M. musculus
tcaaaaaggataaaga

SEQ ID NO: 429931 - DNA, 16 bp, M. musculus
tcaaaaaggataagga

SEQ ID NO: 429932 - DNA, 17 bp, M. musculus
tcaaaaagggctccacc

SEQ ID NO: 429933 - DNA, 16 bp, M. musculus
tcaaaaagtacagaat

SEQ ID NO: 429934 - DNA, 17 bp, M. musculus
tcaaaaatattaatcca

SEQ ID NO: 429935 - DNA, 16 bp, M. musculus
tcaaaaatatttgttt

SEQ ID NO: 429936 - DNA, 16 bp, M. musculus
tcaaaaatcagctgct

SEQ ID NO: 429937 - DNA, 16 bp, M. musculus
tcaaaaatgagagaga

SEQ ID NO: 429938 - DNA, 16 bp, M. musculus
tcaaaaatgttttaaa

SEQ ID NO: 429939 - DNA, 16 bp, M. musculus
tcaaaaatgttttcta

SEQ ID NO: 429940 - DNA, 16 bp, M. musculus
tcaaaaattaagtgtc

SEQ ID NO: 429941 - DNA, 16 bp, M. musculus
tcaaaaattagaaatc

SEQ ID NO: 429942 - DNA, 16 bp, M. musculus
tcaaaaattcagatga

SEQ ID NO: 429943 - DNA, 16 bp, M. musculus
tcaaaaattcaggtca

SEQ ID NO: 429944 - DNA, 17 bp, M. musculus
tcaaaacaccaaatgca

SEQ ID NO: 429945 - DNA, 16 bp, M. musculus
tcaaaacagaagcaaa

SEQ ID NO: 429946 - DNA, 16 bp, M. musculus
tcaaaacagagacact

SEQ ID NO: 429947 - DNA, 17 bp, M. musculus
tcaaaacattggcagac

SEQ ID NO: 429948 - DNA, 16 bp, M. musculus
tcaaaaccacctgtaa

SEQ ID NO: 429949 - DNA, 16 bp, M. musculus
tcaaaaccagcaccac

SEQ ID NO: 429950 - DNA, 16 bp, M. musculus
tcaaaaccatctgtaa

SEQ ID NO: 429951 - DNA, 16 bp, M. musculus
tcaaaacctccaggaa

SEQ ID NO: 429952 - DNA, 16 bp, M. musculus
tcaaaacctctggaag

SEQ ID NO: 429953 - DNA, 16 bp, M. musculus
tcaaaactcaagtgtc

SEQ ID NO: 429954 - DNA, 16 bp, M. musculus
tcaaaactctagaggc

SEQ ID NO: 429955 - DNA, 16 bp, M. musculus
tcaaaactgtgcatac

SEQ ID NO: 429956 - DNA, 16 bp, M. musculus
tcaaaagaataaacat

SEQ ID NO: 429957 - DNA, 16 bp, M. musculus
tcaaaagaatgaattt

SEQ ID NO: 429958 - DNA, 16 bp, M. musculus
tcaaaagagagagaga

SEQ ID NO: 429959 - DNA, 16 bp, M. musculus
tcaaaagagcagtcag

SEQ ID NO: 429960 - DNA, 16 bp, M. musculus
tcaaaagatacaagaa

SEQ ID NO: 429961 - DNA, 17 bp, M. musculus
tcaaaagatggcctagc

SEQ ID NO: 429962 - DNA, 17 bp, M. musculus
tcaaaagatggcctagt

SEQ ID NO: 429963 - DNA, 16 bp, M. musculus
tcaaaagcttccaaga

SEQ ID NO: 429964 - DNA, 16 bp, M. musculus
tcaaaaggaaacctgg

SEQ ID NO: 429965 - DNA, 16 bp, M. musculus
tcaaaaggatcatcca

SEQ ID NO: 429966 - DNA, 16 bp, M. musculus
tcaaaaggatggacca

SEQ ID NO: 429967 - DNA, 16 bp, M. musculus
tcaaaagtgtgtgtca

SEQ ID NO: 429968 - DNA, 16 bp, M. musculus
tcaaaagttaagagca

SEQ ID NO: 429969 - DNA, 16 bp, M. musculus
tcaaaagttcccatag

SEQ ID NO: 429970 - DNA, 16 bp, M. musculus
tcaaaagttttgtagg

SEQ ID NO: 429971 - DNA, 16 bp, M. musculus
tcaaaataacaggaaa

SEQ ID NO: 429972 - DNA, 16 bp, M. musculus
tcaaaataatcattca

SEQ ID NO: 429973 - DNA, 16 bp, M. musculus
tcaaaatacattgttt

SEQ ID NO: 429974 - DNA, 16 bp, M. musculus
tcaaaatagagaaaat

SEQ ID NO: 429975 - DNA, 16 bp, M. musculus
tcaaaatatccagaaa

SEQ ID NO: 429976 - DNA, 16 bp, M. musculus
tcaaaatatccaggaa

SEQ ID NO: 429977 - DNA, 16 bp, M. musculus
tcaaaatcagtaccac

SEQ ID NO: 429978 - DNA, 16 bp, M. musculus
tcaaaatctcttttag

SEQ ID NO: 429979 - DNA, 16 bp, M. musculus
tcaaaatgaaaaatat

SEQ ID NO: 429980 - DNA, 16 bp, M. musculus
tcaaaattccaaaaca

SEQ ID NO: 429981 - DNA, 16 bp, M. musculus
tcaaacaaacaagcaa

SEQ ID NO: 429982 - DNA, 16 bp, M. musculus
tcaaacaaatcagaag

SEQ ID NO: 429983 - DNA, 16 bp, M. musculus
tcaaacaaatgaacaa

SEQ ID NO: 429984 - DNA, 16 bp, M. musculus
tcaaacaaggaatgag

SEQ ID NO: 429985 - DNA, 16 bp, M. musculus
tcaaacaatgaaacaa

SEQ ID NO: 429986 - DNA, 16 bp, M. musculus
tcaaacacacagagat

SEQ ID NO: 429987 - DNA, 16 bp, M. musculus
tcaaacagatgaagga

SEQ ID NO: 429988 - DNA, 16 bp, M. musculus
tcaaacagtatgtaaa

SEQ ID NO: 429989 - DNA, 16 bp, M. musculus
tcaaacatctgagcct

SEQ ID NO: 429990 - DNA, 16 bp, M. musculus
tcaaaccaccacagtg

SEQ ID NO: 429991 - DNA, 16 bp, M. musculus
tcaaaccaccacatac

SEQ ID NO: 429992 - DNA, 16 bp, M. musculus
tcaaaccagaccaatg

SEQ ID NO: 429993 - DNA, 16 bp, M. musculus
tcaaaccagaccagtg

SEQ ID NO: 429994 - DNA, 16 bp, M. musculus
tcaaaccatcacaata

SEQ ID NO: 429995 - DNA, 16 bp, M. musculus
tcaaacccaaggcttt

SEQ ID NO: 429996 - DNA, 16 bp, M. musculus
tcaaacccacagagat

SEQ ID NO: 429997 - DNA, 16 bp, M. musculus
tcaaacccagaacctt

SEQ ID NO: 429998 - DNA, 16 bp, M. musculus
tcaaacccagggcctg

SEQ ID NO: 429999 - DNA, 16 bp, M. musculus
tcaaaccctggcagca

SEQ ID NO: 430000 - DNA, 16 bp, M. musculus
tcaaactcaatggaga

SEQ ID NO: 430001 - DNA, 16 bp, M. musculus
tcaaactcacaagaga

SEQ ID NO: 430002 - DNA, 16 bp, M. musculus
tcaaactcacagagct

SEQ ID NO: 430003 - DNA, 16 bp, M. musculus
tcaaactcacagatat

SEQ ID NO: 430004 - DNA, 16 bp, M. musculus
tcaaactcagacatct

SEQ ID NO: 430005 - DNA, 17 bp, M. musculus
tcaaactcaggggggaa

SEQ ID NO: 430006 - DNA, 16 bp, M. musculus
tcaaactcaggtcctc

SEQ ID NO: 430007 - DNA, 16 bp, M. musculus
tcaaactcatgaagat

SEQ ID NO: 430008 - DNA, 16 bp, M. musculus
tcaaactccctatgta

SEQ ID NO: 430009 - DNA, 16 bp, M. musculus
tcaaactggcttttct

SEQ ID NO: 430010 - DNA, 16 bp, M. musculus
tcaaactgggcaggaa

SEQ ID NO: 430011 - DNA, 16 bp, M. musculus
tcaaactgttccataa

SEQ ID NO: 430012 - DNA, 16 bp, M. musculus
tcaaacttggactcca

SEQ ID NO: 430013 - DNA, 16 bp, M. musculus
tcaaacttgggttctc

SEQ ID NO: 430014 - DNA, 16 bp, M. musculus
tcaaacttgtgatctt

SEQ ID NO: 430015 - DNA, 16 bp, M. musculus
tcaaagaaaaattcaa

SEQ ID NO: 430016 - DNA, 16 bp, M. musculus
tcaaagaaaaggcaaa

SEQ ID NO: 430017 - DNA, 16 bp, M. musculus
tcaaagaaaatgtcaa

SEQ ID NO: 430018 - DNA, 16 bp, M. musculus
tcaaagaaaattcaaa

SEQ ID NO: 430019 - DNA, 16 bp, M. musculus
tcaaagaaacacatgg

SEQ ID NO: 430020 - DNA, 16 bp, M. musculus
tcaaagaaacagaaag

SEQ ID NO: 430021 - DNA, 16 bp, M. musculus
tcaaagaaagatttga

SEQ ID NO: 430022 - DNA, 16 bp, M. musculus
tcaaagaaatgcaaat

SEQ ID NO: 430023 - DNA, 16 bp, M. musculus
tcaaagaaccagaaaa

SEQ ID NO: 430024 - DNA, 16 bp, M. musculus
tcaaagaactacttct

SEQ ID NO: 430025 - DNA, 16 bp, M. musculus
tcaaagaagaaattga

SEQ ID NO: 430026 - DNA, 16 bp, M. musculus
tcaaagaagcttcatt

SEQ ID NO: 430027 - DNA, 16 bp, M. musculus
tcaaagaaggaaaaca

SEQ ID NO: 430028 - DNA, 16 bp, M. musculus
tcaaagaagtttcttt

SEQ ID NO: 430029 - DNA, 16 bp, M. musculus
tcaaagaatcaagcaa

SEQ ID NO: 430030 - DNA, 16 bp, M. musculus
tcaaagaatgaattgg

SEQ ID NO: 430031 - DNA, 16 bp, M. musculus
tcaaagaattaataaa

SEQ ID NO: 430032 - DNA, 16 bp, M. musculus
tcaaagacagccagag

SEQ ID NO: 430033 - DNA, 16 bp, M. musculus
tcaaagacagctgcat

SEQ ID NO: 430034 - DNA, 16 bp, M. musculus
tcaaagactcttctga

SEQ ID NO: 430035 - DNA, 16 bp, M. musculus
tcaaagagaaaaacca

SEQ ID NO: 430036 - DNA, 16 bp, M. musculus
tcaaagagatcctcct

SEQ ID NO: 430037 - DNA, 16 bp, M. musculus
tcaaagaggaaacaaa

SEQ ID NO: 430038 - DNA, 16 bp, M. musculus
tcaaagaggaaggagc

SEQ ID NO: 430039 - DNA, 16 bp, M. musculus
tcaaagataaaatctt

SEQ ID NO: 430040 - DNA, 16 bp, M. musculus
tcaaagatatgggcat

SEQ ID NO: 430041 - DNA, 16 bp, M. musculus
tcaaagatgttaaaga

SEQ ID NO: 430042 - DNA, 17 bp, M. musculus
tcaaagattctttcaaa

SEQ ID NO: 430043 - DNA, 16 bp, M. musculus
tcaaagcaaagctgcc

SEQ ID NO: 430044 - DNA, 16 bp, M. musculus
tcaaagcaagcatcag

SEQ ID NO: 430045 - DNA, 16 bp, M. musculus
tcaaagcacacatttc

SEQ ID NO: 430046 - DNA, 16 bp, M. musculus
tcaaagcagttttcag

SEQ ID NO: 430047 - DNA, 16 bp, M. musculus
tcaaagccagcctgga

SEQ ID NO: 430048 - DNA, 16 bp, M. musculus
tcaaagccatcctcag

SEQ ID NO: 430049 - DNA, 16 bp, M. musculus
tcaaagccatcttcag

SEQ ID NO: 430050 - DNA, 16 bp, M. musculus
tcaaagcccacaccca

SEQ ID NO: 430051 - DNA, 16 bp, M. musculus
tcaaagcccacccctg

SEQ ID NO: 430052 - DNA, 16 bp, M. musculus
tcaaagcccatgctgg

SEQ ID NO: 430053 - DNA, 16 bp, M. musculus
tcaaagccttgtcaca

SEQ ID NO: 430054 - DNA, 23 bp, M. musculus
tcaaagctatttgacttgagtga

SEQ ID NO: 430055 - DNA, 16 bp, M. musculus
tcaaagctcatatgaa

SEQ ID NO: 430056 - DNA, 16 bp, M. musculus
tcaaagcttttcccca

SEQ ID NO: 430057 - DNA, 16 bp, M. musculus
tcaaaggaaaaaaatg

SEQ ID NO: 430058 - DNA, 16 bp, M. musculus
tcaaaggaaaactcta

SEQ ID NO: 430059 - DNA, 16 bp, M. musculus
tcaaaggaaaagtcca

SEQ ID NO: 430060 - DNA, 16 bp, M. musculus
tcaaaggaaaattcca

SEQ ID NO: 430061 - DNA, 16 bp, M. musculus
tcaaaggaaatggtga

SEQ ID NO: 430062 - DNA, 16 bp, M. musculus
tcaaaggaagaggaga

SEQ ID NO: 430063 - DNA, 16 bp, M. musculus
tcaaaggaatagaatt

SEQ ID NO: 430064 - DNA, 16 bp, M. musculus
tcaaaggacaaccttg

SEQ ID NO: 430065 - DNA, 16 bp, M. musculus
tcaaaggacaacttgc

SEQ ID NO: 430066 - DNA, 16 bp, M. musculus
tcaaaggataataagg

SEQ ID NO: 430067 - DNA, 16 bp, M. musculus
tcaaaggcatgcacca

SEQ ID NO: 430068 - DNA, 16 bp, M. musculus
tcaaaggcatgtgcca

SEQ ID NO: 430069 - DNA, 16 bp, M. musculus
tcaaaggctgaggcag

SEQ ID NO: 430070 - DNA, 16 bp, M. musculus
tcaaaggctgctagtg

SEQ ID NO: 430071 - DNA, 16 bp, M. musculus
tcaaagggaaaatcta

SEQ ID NO: 430072 - DNA, 16 bp, M. musculus
tcaaaggggaaaccag

SEQ ID NO: 430073 - DNA, 16 bp, M. musculus
tcaaagtcacagagat

SEQ ID NO: 430074 - DNA, 16 bp, M. musculus
tcaaagtctttagtga

SEQ ID NO: 430075 - DNA, 16 bp, M. musculus
tcaaagttaaaatcta

SEQ ID NO: 430076 - DNA, 16 bp, M. musculus
tcaaagttagcatcag

SEQ ID NO: 430077 - DNA, 16 bp, M. musculus
tcaaagttgttttttt

SEQ ID NO: 430078 - DNA, 16 bp, M. musculus
tcaaagtttattttta

SEQ ID NO: 430079 - DNA, 16 bp, M. musculus
tcaaataaaaattgta

SEQ ID NO: 430080 - DNA, 16 bp, M. musculus
tcaaataaaatggaaa

SEQ ID NO: 430081 - DNA, 16 bp, M. musculus
tcaaatagctgagaag

SEQ ID NO: 430082 - DNA, 16 bp, M. musculus
tcaaatatgtgaacct

SEQ ID NO: 430083 - DNA, 16 bp, M. musculus
tcaaatattcagccaa

SEQ ID NO: 430084 - DNA, 16 bp, M. musculus
tcaaatcaggaattct

SEQ ID NO: 430085 - DNA, 16 bp, M. musculus
tcaaatccacctgcct

SEQ ID NO: 430086 - DNA, 16 bp, M. musculus
tcaaatccaggtcctc

SEQ ID NO: 430087 - DNA, 16 bp, M. musculus
tcaaatccatggcctc

SEQ ID NO: 430088 - DNA, 16 bp, M. musculus
tcaaatctttgaagaa

SEQ ID NO: 430089 - DNA, 16 bp, M. musculus
tcaaatgaatttgaga

SEQ ID NO: 430090 - DNA, 16 bp, M. musculus
tcaaatgagagagaga

SEQ ID NO: 430091 - DNA, 16 bp, M. musculus
tcaaatgatgaagaaa

SEQ ID NO: 430092 - DNA, 16 bp, M. musculus
tcaaatgccatcctga

SEQ ID NO: 430093 - DNA, 16 bp, M. musculus
tcaaatgctgatttct

SEQ ID NO: 430094 - DNA, 16 bp, M. musculus
tcaaatgtacacctaa

SEQ ID NO: 430095 - DNA, 16 bp, M. musculus
tcaaatgtatttattt

SEQ ID NO: 430096 - DNA, 16 bp, M. musculus
tcaaatgtatttttaa

SEQ ID NO: 430097 - DNA, 16 bp, M. musculus
tcaaatgttacctcct

SEQ ID NO: 430098 - DNA, 16 bp, M. musculus
tcaaatgtttctctga

SEQ ID NO: 430099 - DNA, 16 bp, M. musculus
tcaaatgtttgatttt

SEQ ID NO: 430100 - DNA, 16 bp, M. musculus
tcaaattcacagagat

SEQ ID NO: 430101 - DNA, 16 bp, M. musculus
tcaaattcaggtcatt

SEQ ID NO: 430102 - DNA, 16 bp, M. musculus
tcaaattcaggtcttc

SEQ ID NO: 430103 - DNA, 16 bp, M. musculus
tcaaattcaggttgtc

SEQ ID NO: 430104 - DNA, 16 bp, M. musculus
tcaaattcatttggaa

SEQ ID NO: 430105 - DNA, 17 bp, M. musculus
tcaaattcctggcccaa

SEQ ID NO: 430106 - DNA, 16 bp, M. musculus
tcaaattctatcccaa

SEQ ID NO: 430107 - DNA, 16 bp, M. musculus
tcaaattctttttcag

SEQ ID NO: 430108 - DNA, 16 bp, M. musculus
tcaaattgctgaacaa

SEQ ID NO: 430109 - DNA, 18 bp, M. musculus
tcaaattgtactacccat

SEQ ID NO: 430110 - DNA, 16 bp, M. musculus
tcaaatttgcctgtta

SEQ ID NO: 430111 - DNA, 16 bp, M. musculus
tcaacaaaacaggaaa

SEQ ID NO: 430112 - DNA, 16 bp, M. musculus
tcaacaaaaccagaaa

SEQ ID NO: 430113 - DNA, 16 bp, M. musculus
tcaacaaaatcacaga

SEQ ID NO: 430114 - DNA, 16 bp, M. musculus
tcaacaaactgaagtg

SEQ ID NO: 430115 - DNA, 16 bp, M. musculus
tcaacaaagaaatgga

SEQ ID NO: 430116 - DNA, 16 bp, M. musculus
tcaacaaagctgaaaa

SEQ ID NO: 430117 - DNA, 16 bp, M. musculus
tcaacaaatatttatt

SEQ ID NO: 430118 - DNA, 16 bp, M. musculus
tcaacaaatgagacct

SEQ ID NO: 430119 - DNA, 16 bp, M. musculus
tcaacaaatggttctg

SEQ ID NO: 430120 - DNA, 16 bp, M. musculus
tcaacaacacagactc

SEQ ID NO: 430121 - DNA, 16 bp, M. musculus
tcaacaacagggatca

SEQ ID NO: 430122 - DNA, 16 bp, M. musculus
tcaacaacattatgaa

SEQ ID NO: 430123 - DNA, 16 bp, M. musculus
tcaacaagaaggaaat

SEQ ID NO: 430124 - DNA, 16 bp, M. musculus
tcaacaagaaggaaga

SEQ ID NO: 430125 - DNA, 16 bp, M. musculus
tcaacaagataaacaa

SEQ ID NO: 430126 - DNA, 16 bp, M. musculus
tcaacaagcccagctg

SEQ ID NO: 430127 - DNA, 16 bp, M. musculus
tcaacaatgtaaaaat

SEQ ID NO: 430128 - DNA, 16 bp, M. musculus
tcaacaccagcctggt

SEQ ID NO: 430129 - DNA, 16 bp, M. musculus
tcaacaccatcatcca

SEQ ID NO: 430130 - DNA, 16 bp, M. musculus
tcaacacccactctca

SEQ ID NO: 430131 - DNA, 16 bp, M. musculus
tcaacagacacaagaa

SEQ ID NO: 430132 - DNA, 16 bp, M. musculus
tcaacagagactctaa

SEQ ID NO: 430133 - DNA, 16 bp, M. musculus
tcaacagaggaaggga

SEQ ID NO: 430134 - DNA, 19 bp, M. musculus
tcaacagaggaatggataa

SEQ ID NO: 430135 - DNA, 16 bp, M. musculus
tcaacagatgagtgga

SEQ ID NO: 430136 - DNA, 16 bp, M. musculus
tcaacagatgcaaaaa

SEQ ID NO: 430137 - DNA, 16 bp, M. musculus
tcaacagcagcagcaa

SEQ ID NO: 430138 - DNA, 16 bp, M. musculus
tcaacagcagcagcag

SEQ ID NO: 430139 - DNA, 16 bp, M. musculus
tcaacagccttagtca

SEQ ID NO: 430140 - DNA, 16 bp, M. musculus
tcaacaggagccagag

SEQ ID NO: 430141 - DNA, 16 bp, M. musculus
tcaacagtcttgggaa

SEQ ID NO: 430142 - DNA, 16 bp, M. musculus
tcaacataagagggca

SEQ ID NO: 430143 - DNA, 16 bp, M. musculus
tcaacatatggtgctg

SEQ ID NO: 430144 - DNA, 16 bp, M. musculus
tcaacatccttattca

SEQ ID NO: 430145 - DNA, 16 bp, M. musculus
tcaacatctacacaga

SEQ ID NO: 430146 - DNA, 16 bp, M. musculus
tcaacattttaaaaca

SEQ ID NO: 430147 - DNA, 16 bp, M. musculus
tcaaccaaaccaggaa

SEQ ID NO: 430148 - DNA, 16 bp, M. musculus
tcaaccaaagaacata

SEQ ID NO: 430149 - DNA, 16 bp, M. musculus
tcaaccaaatgaaact

SEQ ID NO: 430150 - DNA, 16 bp, M. musculus
tcaaccaatcagacac

SEQ ID NO: 430151 - DNA, 16 bp, M. musculus
tcaaccacaggggtct

SEQ ID NO: 430152 - DNA, 16 bp, M. musculus
tcaaccagatcaaggc

SEQ ID NO: 430153 - DNA, 16 bp, M. musculus
tcaaccaggctggcct

SEQ ID NO: 430154 - DNA, 16 bp, M. musculus
tcaaccataaaattat

SEQ ID NO: 430155 - DNA, 16 bp, M. musculus
tcaacccccaggaccc

SEQ ID NO: 430156 - DNA, 16 bp, M. musculus
tcaaccctcctgcctc

SEQ ID NO: 430157 - DNA, 16 bp, M. musculus
tcaacccttagttctt

SEQ ID NO: 430158 - DNA, 16 bp, M. musculus
tcaacctgtgggtcaa

SEQ ID NO: 430159 - DNA, 16 bp, M. musculus
tcaacctgtgggtcat

SEQ ID NO: 430160 - DNA, 16 bp, M. musculus
tcaacctgtgggtctc

SEQ ID NO: 430161 - DNA, 16 bp, M. musculus
tcaacctgtgggtggt

SEQ ID NO: 430162 - DNA, 16 bp, M. musculus
tcaactaacctgaacc

SEQ ID NO: 430163 - DNA, 16 bp, M. musculus
tcaactaacctggacc

SEQ ID NO: 430164 - DNA, 16 bp, M. musculus
tcaactatattcatag

SEQ ID NO: 430165 - DNA, 16 bp, M. musculus
tcaactcaactggaga

SEQ ID NO: 430166 - DNA, 16 bp, M. musculus
tcaactcacagagatc

SEQ ID NO: 430167 - DNA, 16 bp, M. musculus
tcaactcagctccaaa

SEQ ID NO: 430168 - DNA, 16 bp, M. musculus
tcaactccttcacctg

SEQ ID NO: 430169 - DNA, 16 bp, M. musculus
tcaactctctgaagaa

SEQ ID NO: 430170 - DNA, 16 bp, M. musculus
tcaactgaaaaataaa

SEQ ID NO: 430171 - DNA, 16 bp, M. musculus
tcaactgaagaatgga

SEQ ID NO: 430172 - DNA, 16 bp, M. musculus
tcaactgaccgaagag

SEQ ID NO: 430173 - DNA, 16 bp, M. musculus
tcaactgaggttctct

SEQ ID NO: 430174 - DNA, 18 bp, M. musculus
tcaactgggattatagga

SEQ ID NO: 430175 - DNA, 16 bp, M. musculus
tcaacttaatgggcca

SEQ ID NO: 430176 - DNA, 16 bp, M. musculus
tcaacttcacacaaac

SEQ ID NO: 430177 - DNA, 16 bp, M. musculus
tcaacttcccaataaa

SEQ ID NO: 430178 - DNA, 16 bp, M. musculus
tcaacttctctgtgtt

SEQ ID NO: 430179 - DNA, 16 bp, M. musculus
tcaacttcttccagcc

SEQ ID NO: 430180 - DNA, 16 bp, M. musculus
tcaacttgacacaact

SEQ ID NO: 430181 - DNA, 16 bp, M. musculus
tcaacttgatacaaac

SEQ ID NO: 430182 - DNA, 16 bp, M. musculus
tcaactttacttaggg

SEQ ID NO: 430183 - DNA, 17 bp, M. musculus
tcaagaaaaatgaagac

SEQ ID NO: 430184 - DNA, 16 bp, M. musculus
tcaagaaaactggaga

SEQ ID NO: 430185 - DNA, 16 bp, M. musculus
tcaagaaaatacccca

SEQ ID NO: 430186 - DNA, 16 bp, M. musculus
tcaagaaaatgaccca

SEQ ID NO: 430187 - DNA, 16 bp, M. musculus
tcaagaaaatgtacca

SEQ ID NO: 430188 - DNA, 16 bp, M. musculus
tcaagaaaatgtccca

SEQ ID NO: 430189 - DNA, 16 bp, M. musculus
tcaagaaaattcccca

SEQ ID NO: 430190 - DNA, 16 bp, M. musculus
tcaagaaacttgaggc

SEQ ID NO: 430191 - DNA, 16 bp, M. musculus
tcaagaaagaaagaga

SEQ ID NO: 430192 - DNA, 16 bp, M. musculus
tcaagaaagaaatcaa

SEQ ID NO: 430193 - DNA, 16 bp, M. musculus
tcaagaaattagatat

SEQ ID NO: 430194 - DNA, 16 bp, M. musculus
tcaagaacaaaatatg

SEQ ID NO: 430195 - DNA, 16 bp, M. musculus
tcaagaacaaggaaga

SEQ ID NO: 430196 - DNA, 16 bp, M. musculus
tcaagaacactcacca

SEQ ID NO: 430197 - DNA, 16 bp, M. musculus
tcaagaacagagagaa

SEQ ID NO: 430198 - DNA, 16 bp, M. musculus
tcaagaacagcaaaaa

SEQ ID NO: 430199 - DNA, 16 bp, M. musculus
tcaagaagaaagacca

SEQ ID NO: 430200 - DNA, 16 bp, M. musculus
tcaagaagaacgaaga

SEQ ID NO: 430201 - DNA, 16 bp, M. musculus
tcaagaagaaggaaga

SEQ ID NO: 430202 - DNA, 16 bp, M. musculus
tcaagaagaaggtaga

SEQ ID NO: 430203 - DNA, 16 bp, M. musculus
tcaagaagaatgaaga

SEQ ID NO: 430204 - DNA, 16 bp, M. musculus
tcaagaagaatgacga

SEQ ID NO: 430205 - DNA, 16 bp, M. musculus
tcaagaagaatgatga

SEQ ID NO: 430206 - DNA, 16 bp, M. musculus
tcaagaagagagaaga

SEQ ID NO: 430207 - DNA, 16 bp, M. musculus
tcaagaagaggaaaga

SEQ ID NO: 430208 - DNA, 16 bp, M. musculus
tcaagaagatggaaga

SEQ ID NO: 430209 - DNA, 16 bp, M. musculus
tcaagaagatggactt

SEQ ID NO: 430210 - DNA, 16 bp, M. musculus
tcaagaagcagagagt

SEQ ID NO: 430211 - DNA, 16 bp, M. musculus
tcaagaagctgaagca

SEQ ID NO: 430212 - DNA, 16 bp, M. musculus
tcaagaagctggactc

SEQ ID NO: 430213 - DNA, 16 bp, M. musculus
tcaagaaggaaaaaga

SEQ ID NO: 430214 - DNA, 16 bp, M. musculus
tcaagaaggaagaaca

SEQ ID NO: 430215 - DNA, 16 bp, M. musculus
tcaagaaggaagagca

SEQ ID NO: 430216 - DNA, 16 bp, M. musculus
tcaagaaggaggaaga

SEQ ID NO: 430217 - DNA, 17 bp, M. musculus
tcaagaaggtgggctcc

SEQ ID NO: 430218 - DNA, 16 bp, M. musculus
tcaagaatagccatca

SEQ ID NO: 430219 - DNA, 16 bp, M. musculus
tcaagaattctttgtt

SEQ ID NO: 430220 - DNA, 16 bp, M. musculus
tcaagacaatccctca

SEQ ID NO: 430221 - DNA, 16 bp, M. musculus
tcaagacagccaaggc

SEQ ID NO: 430222 - DNA, 16 bp, M. musculus
tcaagacagccaggac

SEQ ID NO: 430223 - DNA, 16 bp, M. musculus
tcaagacaggatttca

SEQ ID NO: 430224 - DNA, 16 bp, M. musculus
tcaagacagggattct

SEQ ID NO: 430225 - DNA, 16 bp, M. musculus
tcaagacagggcttct

SEQ ID NO: 430226 - DNA, 16 bp, M. musculus
tcaagacagggtctta

SEQ ID NO: 430227 - DNA, 16 bp, M. musculus
tcaagaccaacctggg

SEQ ID NO: 430228 - DNA, 16 bp, M. musculus
tcaagaccagcatggt

SEQ ID NO: 430229 - DNA, 16 bp, M. musculus
tcaagaccagcctcag

SEQ ID NO: 430230 - DNA, 16 bp, M. musculus
tcaagaccagcctgag

SEQ ID NO: 430231 - DNA, 16 bp, M. musculus
tcaagaccagcctgga

SEQ ID NO: 430232 - DNA, 16 bp, M. musculus
tcaagaccagcctggg

SEQ ID NO: 430233 - DNA, 16 bp, M. musculus
tcaagacctctggaaa

SEQ ID NO: 430234 - DNA, 16 bp, M. musculus
tcaagacttcacagga

SEQ ID NO: 430235 - DNA, 16 bp, M. musculus
tcaagagaaaggtaga

SEQ ID NO: 430236 - DNA, 16 bp, M. musculus
tcaagagaataaatat

SEQ ID NO: 430237 - DNA, 16 bp, M. musculus
tcaagagacaggaggc

SEQ ID NO: 430238 - DNA, 16 bp, M. musculus
tcaagagactggaggg

SEQ ID NO: 430239 - DNA, 16 bp, M. musculus
tcaagagagagagaga

SEQ ID NO: 430240 - DNA, 16 bp, M. musculus
tcaagagatacaaaaa

SEQ ID NO: 430241 - DNA, 16 bp, M. musculus
tcaagagcagagagaa

SEQ ID NO: 430242 - DNA, 30 bp, M. musculus
tcaagagctcaggggtactggttagttcat

SEQ ID NO: 430243 - DNA, 16 bp, M. musculus
tcaagagctccagggg

SEQ ID NO: 430244 - DNA, 16 bp, M. musculus
tcaagaggaaggaaaa

SEQ ID NO: 430245 - DNA, 16 bp, M. musculus
tcaagaggaggaggag

SEQ ID NO: 430246 - DNA, 16 bp, M. musculus
tcaagaggaggctcca

SEQ ID NO: 430247 - DNA, 16 bp, M. musculus
tcaagaggctggaggc

SEQ ID NO: 430248 - DNA, 16 bp, M. musculus
tcaagatccaggtcag

SEQ ID NO: 430249 - DNA, 16 bp, M. musculus
tcaagatcctcctgcc

SEQ ID NO: 430250 - DNA, 25 bp, M. musculus
tcaagatctccataccaagatccag

SEQ ID NO: 430251 - DNA, 18 bp, M. musculus
tcaagatctccatgtcaa

SEQ ID NO: 430252 - DNA, 16 bp, M. musculus
tcaagatgatgataga

SEQ ID NO: 430253 - DNA, 16 bp, M. musculus
tcaagatggagaactc

SEQ ID NO: 430254 - DNA, 16 bp, M. musculus
tcaagattcctctgct

SEQ ID NO: 430255 - DNA, 17 bp, M. musculus
tcaagcacagcaggaga

SEQ ID NO: 430256 - DNA, 16 bp, M. musculus
tcaagcagatcagaaa

SEQ ID NO: 430257 - DNA, 16 bp, M. musculus
tcaagcaggaacctgg

SEQ ID NO: 430258 - DNA, 16 bp, M. musculus
tcaagcagggcaagga

SEQ ID NO: 430259 - DNA, 16 bp, M. musculus
tcaagccaaattaaag

SEQ ID NO: 430260 - DNA, 16 bp, M. musculus
tcaagccaaggactct

SEQ ID NO: 430261 - DNA, 16 bp, M. musculus
tcaagccaggcatggt

SEQ ID NO: 430262 - DNA, 16 bp, M. musculus
tcaagccatcacagga

SEQ ID NO: 430263 - DNA, 16 bp, M. musculus
tcaagcccttggagga

SEQ ID NO: 430264 - DNA, 16 bp, M. musculus
tcaagcctgacaacct

SEQ ID NO: 430265 - DNA, 16 bp, M. musculus
tcaagccttcacagaa

SEQ ID NO: 430266 - DNA, 16 bp, M. musculus
tcaagctaaatggaga

SEQ ID NO: 430267 - DNA, 16 bp, M. musculus
tcaagctactgctgct

SEQ ID NO: 430268 - DNA, 16 bp, M. musculus
tcaagctcacagagac

SEQ ID NO: 430269 - DNA, 16 bp, M. musculus
tcaagctgcattacag

SEQ ID NO: 430270 - DNA, 16 bp, M. musculus
tcaagctgctgctgcc

SEQ ID NO: 430271 - DNA, 16 bp, M. musculus
tcaagctggcctggaa

SEQ ID NO: 430272 - DNA, 16 bp, M. musculus
tcaagctgggcggtgg

SEQ ID NO: 430273 - DNA, 16 bp, M. musculus
tcaagctggtctcaaa

SEQ ID NO: 430274 - DNA, 16 bp, M. musculus
tcaaggaaaaaagaac

SEQ ID NO: 430275 - DNA, 16 bp, M. musculus
tcaaggaaacaaataa

SEQ ID NO: 430276 - DNA, 16 bp, M. musculus
tcaaggaaatccagga

SEQ ID NO: 430277 - DNA, 16 bp, M. musculus
tcaaggaaatgaaaat

SEQ ID NO: 430278 - DNA, 16 bp, M. musculus
tcaaggaacaagcaag

SEQ ID NO: 430279 - DNA, 16 bp, M. musculus
tcaaggaagaaataga

SEQ ID NO: 430280 - DNA, 16 bp, M. musculus
tcaaggaagaattaaa

SEQ ID NO: 430281 - DNA, 16 bp, M. musculus
tcaaggacaattttat

SEQ ID NO: 430282 - DNA, 16 bp, M. musculus
tcaaggacaccacaga

SEQ ID NO: 430283 - DNA, 16 bp, M. musculus
tcaaggacacccatcc

SEQ ID NO: 430284 - DNA, 16 bp, M. musculus
tcaaggacagccttgt

SEQ ID NO: 430285 - DNA, 16 bp, M. musculus
tcaaggacagtctggg

SEQ ID NO: 430286 - DNA, 16 bp, M. musculus
tcaaggaccccaatgc

SEQ ID NO: 430287 - DNA, 16 bp, M. musculus
tcaaggacctgggtgt

SEQ ID NO: 430288 - DNA, 16 bp, M. musculus
tcaaggacttgaaaga

SEQ ID NO: 430289 - DNA, 16 bp, M. musculus
tcaaggagaaagaaga

SEQ ID NO: 430290 - DNA, 16 bp, M. musculus
tcaaggagaaggaaga

SEQ ID NO: 430291 - DNA, 16 bp, M. musculus
tcaaggagactttgac

SEQ ID NO: 430292 - DNA, 16 bp, M. musculus
tcaaggagataaaaag

SEQ ID NO: 430293 - DNA, 16 bp, M. musculus
tcaaggagcagaaggg

SEQ ID NO: 430294 - DNA, 16 bp, M. musculus
tcaaggaggaaaggcc

SEQ ID NO: 430295 - DNA, 16 bp, M. musculus
tcaaggatagacatta

SEQ ID NO: 430296 - DNA, 16 bp, M. musculus
tcaaggatgaccttga

SEQ ID NO: 430297 - DNA, 16 bp, M. musculus
tcaaggcacctgggac

SEQ ID NO: 430298 - DNA, 16 bp, M. musculus
tcaaggccaacctgaa

SEQ ID NO: 430299 - DNA, 16 bp, M. musculus
tcaaggccaacctgag

SEQ ID NO: 430300 - DNA, 16 bp, M. musculus
tcaaggccaacctgtt

SEQ ID NO: 430301 - DNA, 16 bp, M. musculus
tcaaggccagccagga

SEQ ID NO: 430302 - DNA, 16 bp, M. musculus
tcaaggccagcccagt

SEQ ID NO: 430303 - DNA, 16 bp, M. musculus
tcaaggccagcctaga

SEQ ID NO: 430304 - DNA, 16 bp, M. musculus
tcaaggccagcctcgg

SEQ ID NO: 430305 - DNA, 16 bp, M. musculus
tcaaggccagcctggc

SEQ ID NO: 430306 - DNA, 17 bp, M. musculus
tcaaggccagcctggtt

SEQ ID NO: 430307 - DNA, 16 bp, M. musculus
tcaaggccagctcagg

SEQ ID NO: 430308 - DNA, 16 bp, M. musculus
tcaaggccagctggtc

SEQ ID NO: 430309 - DNA, 16 bp, M. musculus
tcaaggccagtctgag

SEQ ID NO: 430310 - DNA, 17 bp, M. musculus
tcaaggccagtctggtt

SEQ ID NO: 430311 - DNA, 16 bp, M. musculus
tcaaggccagtctgtt

SEQ ID NO: 430312 - DNA, 16 bp, M. musculus
tcaaggccatcctgat

SEQ ID NO: 430313 - DNA, 16 bp, M. musculus
tcaaggccatcctgga

SEQ ID NO: 430314 - DNA, 16 bp, M. musculus
tcaaggccattctggg

SEQ ID NO: 430315 - DNA, 16 bp, M. musculus
tcaaggcccaccccca

SEQ ID NO: 430316 - DNA, 16 bp, M. musculus
tcaaggctatcctggt

SEQ ID NO: 430317 - DNA, 16 bp, M. musculus
tcaaggctattcccca

SEQ ID NO: 430318 - DNA, 16 bp, M. musculus
tcaaggctcttcccca

SEQ ID NO: 430319 - DNA, 16 bp, M. musculus
tcaaggctcttcccta

SEQ ID NO: 430320 - DNA, 16 bp, M. musculus
tcaaggctctttccca

SEQ ID NO: 430321 - DNA, 16 bp, M. musculus
tcaaggctggacaaag

SEQ ID NO: 430322 - DNA, 16 bp, M. musculus
tcaaggctggaggagg

SEQ ID NO: 430323 - DNA, 16 bp, M. musculus
tcaaggctggcctgga

SEQ ID NO: 430324 - DNA, 16 bp, M. musculus
tcaaggctggggaaag

SEQ ID NO: 430325 - DNA, 16 bp, M. musculus
tcaaggcttaacagtt

SEQ ID NO: 430326 - DNA, 16 bp, M. musculus
tcaaggcttttccaca

SEQ ID NO: 430327 - DNA, 16 bp, M. musculus
tcaagggagaaattcc

SEQ ID NO: 430328 - DNA, 16 bp, M. musculus
tcaagggcagcctggg

SEQ ID NO: 430329 - DNA, 16 bp, M. musculus
tcaagggctttgtgcc

SEQ ID NO: 430330 - DNA, 16 bp, M. musculus
tcaaggggaggtccca

SEQ ID NO: 430331 - DNA, 17 bp, M. musculus
tcaaggggattcaaatt

SEQ ID NO: 430332 - DNA, 16 bp, M. musculus
tcaaggggctggagag

SEQ ID NO: 430333 - DNA, 16 bp, M. musculus
tcaagggtatacaaat

SEQ ID NO: 430334 - DNA, 16 bp, M. musculus
tcaaggtcaaccttga

SEQ ID NO: 430335 - DNA, 16 bp, M. musculus
tcaaggtcagcctcaa

SEQ ID NO: 430336 - DNA, 16 bp, M. musculus
tcaaggtcagcctgct

SEQ ID NO: 430337 - DNA, 16 bp, M. musculus
tcaaggtcagtctgag

SEQ ID NO: 430338 - DNA, 16 bp, M. musculus
tcaaggtcatccatgg

SEQ ID NO: 430339 - DNA, 16 bp, M. musculus
tcaaggtcatccctgg

SEQ ID NO: 430340 - DNA, 16 bp, M. musculus
tcaaggtcatcctgga

SEQ ID NO: 430341 - DNA, 16 bp, M. musculus
tcaaggtcattctcaa

SEQ ID NO: 430342 - DNA, 16 bp, M. musculus
tcaaggtctggctcag

SEQ ID NO: 430343 - DNA, 16 bp, M. musculus
tcaaggttagcctgga

SEQ ID NO: 430344 - DNA, 16 bp, M. musculus
tcaaggttgtcctcag

SEQ ID NO: 430345 - DNA, 16 bp, M. musculus
tcaaggttgttttgat

SEQ ID NO: 430346 - DNA, 16 bp, M. musculus
tcaaggtttaattttt

SEQ ID NO: 430347 - DNA, 16 bp, M. musculus
tcaagtaacatataaa

SEQ ID NO: 430348 - DNA, 16 bp, M. musculus
tcaagtaacatatcaa

SEQ ID NO: 430349 - DNA, 16 bp, M. musculus
tcaagtactgagatta

SEQ ID NO: 430350 - DNA, 16 bp, M. musculus
tcaagtaggcttcatt

SEQ ID NO: 430351 - DNA, 16 bp, M. musculus
tcaagtcactgaagga

SEQ ID NO: 430352 - DNA, 16 bp, M. musculus
tcaagtccagctgcag

SEQ ID NO: 430353 - DNA, 16 bp, M. musculus
tcaagtcccagcactg

SEQ ID NO: 430354 - DNA, 16 bp, M. musculus
tcaagtccctggagaa

SEQ ID NO: 430355 - DNA, 16 bp, M. musculus
tcaagtctctgaaaaa

SEQ ID NO: 430356 - DNA, 16 bp, M. musculus
tcaagtctctgaagaa

SEQ ID NO: 430357 - DNA, 16 bp, M. musculus
tcaagtctctgcaaag

SEQ ID NO: 430358 - DNA, 16 bp, M. musculus
tcaagtctctgtagaa

SEQ ID NO: 430359 - DNA, 16 bp, M. musculus
tcaagtctcttcaggg

SEQ ID NO: 430360 - DNA, 16 bp, M. musculus
tcaagtctgtgaagaa

SEQ ID NO: 430361 - DNA, 16 bp, M. musculus
tcaagtcttgaacagt

SEQ ID NO: 430362 - DNA, 16 bp, M. musculus
tcaagtctttgaagaa

SEQ ID NO: 430363 - DNA, 16 bp, M. musculus
tcaagtgaccctttca

SEQ ID NO: 430364 - DNA, 16 bp, M. musculus
tcaagtgacttatttt

SEQ ID NO: 430365 - DNA, 16 bp, M. musculus
tcaagtggatcaagaa

SEQ ID NO: 430366 - DNA, 16 bp, M. musculus
tcaagtgtctgaagaa

SEQ ID NO: 430367 - DNA, 17 bp, M. musculus
tcaagtgtgtgtgtgtg

SEQ ID NO: 430368 - DNA, 16 bp, M. musculus
tcaagtgttatccctt

SEQ ID NO: 430369 - DNA, 16 bp, M. musculus
tcaagttcaagtagat

SEQ ID NO: 430370 - DNA, 16 bp, M. musculus
tcaagttcagcctggg

SEQ ID NO: 430371 - DNA, 16 bp, M. musculus
tcaagttccagaacag

SEQ ID NO: 430372 - DNA, 16 bp, M. musculus
tcaagttccaggccaa

SEQ ID NO: 430373 - DNA, 16 bp, M. musculus
tcaagttcctgctgcc

SEQ ID NO: 430374 - DNA, 16 bp, M. musculus
tcaagttctgggatta

SEQ ID NO: 430375 - DNA, 16 bp, M. musculus
tcaagttgaaaaaaaa

SEQ ID NO: 430376 - DNA, 16 bp, M. musculus
tcaagttgacaaaaac

SEQ ID NO: 430377 - DNA, 16 bp, M. musculus
tcaagttgacaaccaa

SEQ ID NO: 430378 - DNA, 16 bp, M. musculus
tcaagttgacaaggaa

SEQ ID NO: 430379 - DNA, 16 bp, M. musculus
tcaagttgacaaggag

SEQ ID NO: 430380 - DNA, 16 bp, M. musculus
tcaagttgacagccaa

SEQ ID NO: 430381 - DNA, 16 bp, M. musculus
tcaagtttctctgcat

SEQ ID NO: 430382 - DNA, 16 bp, M. musculus
tcaagtttctgtccat

SEQ ID NO: 430383 - DNA, 16 bp, M. musculus
tcaagttttaatattt

SEQ ID NO: 430384 - DNA, 16 bp, M. musculus
tcaagtttttaaaata

SEQ ID NO: 430385 - DNA, 16 bp, M. musculus
tcaataaaaatatgtt

SEQ ID NO: 430386 - DNA, 16 bp, M. musculus
tcaataaaagactggg

SEQ ID NO: 430387 - DNA, 16 bp, M. musculus
tcaataaaaggctaaa

SEQ ID NO: 430388 - DNA, 16 bp, M. musculus
tcaataaaatattatg

SEQ ID NO: 430389 - DNA, 16 bp, M. musculus
tcaataaaattctcaa

SEQ ID NO: 430390 - DNA, 16 bp, M. musculus
tcaataaagttctagc

SEQ ID NO: 430391 - DNA, 16 bp, M. musculus
tcaataaagttttatt

SEQ ID NO: 430392 - DNA, 16 bp, M. musculus
tcaataaatatgtatt

SEQ ID NO: 430393 - DNA, 16 bp, M. musculus
tcaataaatatttgtc

SEQ ID NO: 430394 - DNA, 16 bp, M. musculus
tcaataaatatttgtt

SEQ ID NO: 430395 - DNA, 16 bp, M. musculus
tcaataaatgttgctg

SEQ ID NO: 430396 - DNA, 16 bp, M. musculus
tcaataaatgtttgtt

SEQ ID NO: 430397 - DNA, 16 bp, M. musculus
tcaataaatttcttgc

SEQ ID NO: 430398 - DNA, 16 bp, M. musculus
tcaataagaaagcaag

SEQ ID NO: 430399 - DNA, 16 bp, M. musculus
tcaataagacaaaaag

SEQ ID NO: 430400 - DNA, 16 bp, M. musculus
tcaataagacagaaag

SEQ ID NO: 430401 - DNA, 16 bp, M. musculus
tcaataatcaagaaaa

SEQ ID NO: 430402 - DNA, 17 bp, M. musculus
tcaataattttgttgaa

SEQ ID NO: 430403 - DNA, 16 bp, M. musculus
tcaataccctcttctg

SEQ ID NO: 430404 - DNA, 16 bp, M. musculus
tcaatagacatgctaa

SEQ ID NO: 430405 - DNA, 16 bp, M. musculus
tcaatagatgcagaaa

SEQ ID NO: 430406 - DNA, 16 bp, M. musculus
tcaatataggaaaata

SEQ ID NO: 430407 - DNA, 16 bp, M. musculus
tcaatatgaattcaag

SEQ ID NO: 430408 - DNA, 16 bp, M. musculus
tcaatattagaaacat

SEQ ID NO: 430409 - DNA, 16 bp, M. musculus
tcaatattcatgaggg

SEQ ID NO: 430410 - DNA, 16 bp, M. musculus
tcaatattttctatgg

SEQ ID NO: 430411 - DNA, 16 bp, M. musculus
tcaatatttttgtgtc

SEQ ID NO: 430412 - DNA, 16 bp, M. musculus
tcaatcaaccaatcaa

SEQ ID NO: 430413 - DNA, 16 bp, M. musculus
tcaatcaatcaataaa

SEQ ID NO: 430414 - DNA, 16 bp, M. musculus
tcaatcactgagccat

SEQ ID NO: 430415 - DNA, 16 bp, M. musculus
tcaatcagccaatcaa

SEQ ID NO: 430416 - DNA, 16 bp, M. musculus
tcaatcagtcagtcag

SEQ ID NO: 430417 - DNA, 16 bp, M. musculus
tcaatccagaagaaac

SEQ ID NO: 430418 - DNA, 16 bp, M. musculus
tcaatcccagggaccc

SEQ ID NO: 430419 - DNA, 16 bp, M. musculus
tcaatccccagcactt

SEQ ID NO: 430420 - DNA, 16 bp, M. musculus
tcaatccctagaacct

SEQ ID NO: 430421 - DNA, 16 bp, M. musculus
tcaatctatgaagcca

SEQ ID NO: 430422 - DNA, 16 bp, M. musculus
tcaatctgacttctct

SEQ ID NO: 430423 - DNA, 16 bp, M. musculus
tcaatctgtaggttgc

SEQ ID NO: 430424 - DNA, 16 bp, M. musculus
tcaatgaaaaaatact

SEQ ID NO: 430425 - DNA, 16 bp, M. musculus
tcaatgaaaatgaaga

SEQ ID NO: 430426 - DNA, 16 bp, M. musculus
tcaatgaagaaaatgc

SEQ ID NO: 430427 - DNA, 16 bp, M. musculus
tcaatgaagaaaatgt

SEQ ID NO: 430428 - DNA, 16 bp, M. musculus
tcaatgaaggaataaa

SEQ ID NO: 430429 - DNA, 16 bp, M. musculus
tcaatgacaactttgt

SEQ ID NO: 430430 - DNA, 16 bp, M. musculus
tcaatgacacagactc

SEQ ID NO: 430431 - DNA, 16 bp, M. musculus
tcaatgacaggtaaga

SEQ ID NO: 430432 - DNA, 16 bp, M. musculus
tcaatgagaagctgag

SEQ ID NO: 430433 - DNA, 16 bp, M. musculus
tcaatgaggaaaaaaa

SEQ ID NO: 430434 - DNA, 16 bp, M. musculus
tcaatgaggctgtgga

SEQ ID NO: 430435 - DNA, 16 bp, M. musculus
tcaatgagttcaaggc

SEQ ID NO: 430436 - DNA, 16 bp, M. musculus
tcaatgataactttgt

SEQ ID NO: 430437 - DNA, 16 bp, M. musculus
tcaatgatacctcagt

SEQ ID NO: 430438 - DNA, 16 bp, M. musculus
tcaatgatgatgatga

SEQ ID NO: 430439 - DNA, 16 bp, M. musculus
tcaatgcaaaaagcaa

SEQ ID NO: 430440 - DNA, 16 bp, M. musculus
tcaatgcaggactgaa

SEQ ID NO: 430441 - DNA, 18 bp, M. musculus
tcaatgcagtaaatcttt

SEQ ID NO: 430442 - DNA, 16 bp, M. musculus
tcaatgcatctcttca

SEQ ID NO: 430443 - DNA, 16 bp, M. musculus
tcaatgccctcttctg

SEQ ID NO: 430444 - DNA, 17 bp, M. musculus
tcaatgccttcccaggc

SEQ ID NO: 430445 - DNA, 16 bp, M. musculus
tcaatgccttcttctg

SEQ ID NO: 430446 - DNA, 16 bp, M. musculus
tcaatgcttttaacca

SEQ ID NO: 430447 - DNA, 16 bp, M. musculus
tcaatggaataaaatt

SEQ ID NO: 430448 - DNA, 16 bp, M. musculus
tcaatggacagatgct

SEQ ID NO: 430449 - DNA, 16 bp, M. musculus
tcaatggatggatgga

SEQ ID NO: 430450 - DNA, 16 bp, M. musculus
tcaatggctgctgtgg

SEQ ID NO: 430451 - DNA, 17 bp, M. musculus
tcaatgggaaactacaa

SEQ ID NO: 430452 - DNA, 16 bp, M. musculus
tcaatgggggtgacct

SEQ ID NO: 430453 - DNA, 16 bp, M. musculus
tcaatggtatttttgg

SEQ ID NO: 430454 - DNA, 16 bp, M. musculus
tcaatgtattttatat

SEQ ID NO: 430455 - DNA, 16 bp, M. musculus
tcaatgtgtacatttt

SEQ ID NO: 430456 - DNA, 16 bp, M. musculus
tcaatgtgtctctctt

SEQ ID NO: 430457 - DNA, 16 bp, M. musculus
tcaattcccaacaatc

SEQ ID NO: 430458 - DNA, 16 bp, M. musculus
tcaattcccagcaaca

SEQ ID NO: 430459 - DNA, 16 bp, M. musculus
tcaattcccagcacac

SEQ ID NO: 430460 - DNA, 16 bp, M. musculus
tcaattcccagcatgc

SEQ ID NO: 430461 - DNA, 16 bp, M. musculus
tcaattcccagccacc

SEQ ID NO: 430462 - DNA, 16 bp, M. musculus
tcaattcccagctccc

SEQ ID NO: 430463 - DNA, 16 bp, M. musculus
tcaattcccaggactc

SEQ ID NO: 430464 - DNA, 17 bp, M. musculus
tcaattcctagcaccca

SEQ ID NO: 430465 - DNA, 16 bp, M. musculus
tcaattcctgatctta

SEQ ID NO: 430466 - DNA, 16 bp, M. musculus
tcaattcctggctctg

SEQ ID NO: 430467 - DNA, 16 bp, M. musculus
tcaattcctgggaccc

SEQ ID NO: 430468 - DNA, 16 bp, M. musculus
tcaattctataccatt

SEQ ID NO: 430469 - DNA, 16 bp, M. musculus
tcaattctattccttt

SEQ ID NO: 430470 - DNA, 16 bp, M. musculus
tcaattctgaacattt

SEQ ID NO: 430471 - DNA, 16 bp, M. musculus
tcaattctttactgag

SEQ ID NO: 430472 - DNA, 16 bp, M. musculus
tcaattctttgtggca

SEQ ID NO: 430473 - DNA, 16 bp, M. musculus
tcaattgaaacatgaa

SEQ ID NO: 430474 - DNA, 16 bp, M. musculus
tcaattgagaaaattc

SEQ ID NO: 430475 - DNA, 16 bp, M. musculus
tcaattgtgaacatct

SEQ ID NO: 430476 - DNA, 16 bp, M. musculus
tcaattgttaattctg

SEQ ID NO: 430477 - DNA, 16 bp, M. musculus
tcaatttaaatggaga

SEQ ID NO: 430478 - DNA, 82 bp, M. musculus
tcaatttaagtattatctctcaggttaagtctagagtgttttgtcctggtccccacggacacccggatcaggtcccatatat

SEQ ID NO: 430479 - DNA, 16 bp, M. musculus
tcaatttccagcagcc

SEQ ID NO: 430480 - DNA, 16 bp, M. musculus
tcaatttcctacagga

SEQ ID NO: 430481 - DNA, 16 bp, M. musculus
tcaatttcctgaccct

SEQ ID NO: 430482 - DNA, 16 bp, M. musculus
tcaatttctttattca

SEQ ID NO: 430483 - DNA, 16 bp, M. musculus
tcaatttgatttcatt

SEQ ID NO: 430484 - DNA, 16 bp, M. musculus
tcaatttgtatttaag

SEQ ID NO: 430485 - DNA, 16 bp, M. musculus
tcaattttaccaataa

SEQ ID NO: 430486 - DNA, 16 bp, M. musculus
tcaattttaccaatga

SEQ ID NO: 430487 - DNA, 16 bp, M. musculus
tcaattttactgttct

SEQ ID NO: 430488 - DNA, 16 bp, M. musculus
tcaattttattagttt

SEQ ID NO: 430489 - DNA, 16 bp, M. musculus
tcaattttcaataaaa

SEQ ID NO: 430490 - DNA, 16 bp, M. musculus
tcaattttgaaaatat

SEQ ID NO: 430491 - DNA, 16 bp, M. musculus
tcacaaaaatagaaag

SEQ ID NO: 430492 - DNA, 16 bp, M. musculus
tcacaaaacaggcttc

SEQ ID NO: 430493 - DNA, 16 bp, M. musculus
tcacaaaagaacacat

SEQ ID NO: 430494 - DNA, 16 bp, M. musculus
tcacaaaagaagccat

SEQ ID NO: 430495 - DNA, 23 bp, M. musculus
tcacaaaagaagtcattagatat

SEQ ID NO: 430496 - DNA, 16 bp, M. musculus
tcacaaaagaggcctc

SEQ ID NO: 430497 - DNA, 16 bp, M. musculus
tcacaaaatagaaaca

SEQ ID NO: 430498 - DNA, 16 bp, M. musculus
tcacaaacatctgtaa

SEQ ID NO: 430499 - DNA, 16 bp, M. musculus
tcacaaaccaaatcca

SEQ ID NO: 430500 - DNA, 16 bp, M. musculus
tcacaaacttccttct

SEQ ID NO: 430501 - DNA, 16 bp, M. musculus
tcacaaagacccacct

SEQ ID NO: 430502 - DNA, 16 bp, M. musculus
tcacaaagatccactt

SEQ ID NO: 430503 - DNA, 16 bp, M. musculus
tcacaaagcaggcctc

SEQ ID NO: 430504 - DNA, 16 bp, M. musculus
tcacaaaggaaatcac

SEQ ID NO: 430505 - DNA, 27 bp, M. musculus
tcacaaaggaactcacacaatatgtac

SEQ ID NO: 430506 - DNA, 16 bp, M. musculus
tcacaaaggaactcat

SEQ ID NO: 430507 - DNA, 19 bp, M. musculus
tcacaaaggaattcacaca

SEQ ID NO: 430508 - DNA, 16 bp, M. musculus
tcacaaaggcagagaa

SEQ ID NO: 430509 - DNA, 16 bp, M. musculus
tcacaaaggctttatt

SEQ ID NO: 430510 - DNA, 16 bp, M. musculus
tcacaaatacagaagt

SEQ ID NO: 430511 - DNA, 16 bp, M. musculus
tcacaaatcagcaaca

SEQ ID NO: 430512 - DNA, 16 bp, M. musculus
tcacaaatggacagat

SEQ ID NO: 430513 - DNA, 16 bp, M. musculus
tcacaacaaagccaaa

SEQ ID NO: 430514 - DNA, 16 bp, M. musculus
tcacaacagtaacaaa

SEQ ID NO: 430515 - DNA, 16 bp, M. musculus
tcacaacagtagtaaa

SEQ ID NO: 430516 - DNA, 16 bp, M. musculus
tcacaaccaaaaatat

SEQ ID NO: 430517 - DNA, 16 bp, M. musculus
tcacaaccatcagtaa

SEQ ID NO: 430518 - DNA, 17 bp, M. musculus
tcacaaccatctgtaac

SEQ ID NO: 430519 - DNA, 16 bp, M. musculus
tcacaaccatctgtac

SEQ ID NO: 430520 - DNA, 16 bp, M. musculus
tcacaaccctctgtaa

SEQ ID NO: 430521 - DNA, 16 bp, M. musculus
tcacaacctcctgtaa

SEQ ID NO: 430522 - DNA, 16 bp, M. musculus
tcacaactgcctataa

SEQ ID NO: 430523 - DNA, 16 bp, M. musculus
tcacaactgtatgtaa

SEQ ID NO: 430524 - DNA, 16 bp, M. musculus
tcacaactgtctgtga

SEQ ID NO: 430525 - DNA, 16 bp, M. musculus
tcacaagaacagcaca

SEQ ID NO: 430526 - DNA, 16 bp, M. musculus
tcacaagagggcacag

SEQ ID NO: 430527 - DNA, 16 bp, M. musculus
tcacaagccaggcctc

SEQ ID NO: 430528 - DNA, 16 bp, M. musculus
tcacaaggaccacaga

SEQ ID NO: 430529 - DNA, 16 bp, M. musculus
tcacaagttcaaagcc

SEQ ID NO: 430530 - DNA, 16 bp, M. musculus
tcacaagttcaaggtt

SEQ ID NO: 430531 - DNA, 16 bp, M. musculus
tcacaatcacctgtaa

SEQ ID NO: 430532 - DNA, 16 bp, M. musculus
tcacaatccatcattg

SEQ ID NO: 430533 - DNA, 16 bp, M. musculus
tcacaattatctgtaa

SEQ ID NO: 430534 - DNA, 16 bp, M. musculus
tcacaatttcattcta

SEQ ID NO: 430535 - DNA, 16 bp, M. musculus
tcacacaaaatctttc

SEQ ID NO: 430536 - DNA, 16 bp, M. musculus
tcacacaaagatattt

SEQ ID NO: 430537 - DNA, 16 bp, M. musculus
tcacacacaaaaagaa

SEQ ID NO: 430538 - DNA, 16 bp, M. musculus
tcacacacaaatgcac

SEQ ID NO: 430539 - DNA, 16 bp, M. musculus
tcacacacacacacag

SEQ ID NO: 430540 - DNA, 16 bp, M. musculus
tcacacacacacacat

SEQ ID NO: 430541 - DNA, 16 bp, M. musculus
tcacacacactctctc

SEQ ID NO: 430542 - DNA, 16 bp, M. musculus
tcacacacagacacac

SEQ ID NO: 430543 - DNA, 16 bp, M. musculus
tcacacacagacactc

SEQ ID NO: 430544 - DNA, 16 bp, M. musculus
tcacacacatgtatgt

SEQ ID NO: 430545 - DNA, 16 bp, M. musculus
tcacacacctttaatc

SEQ ID NO: 430546 - DNA, 16 bp, M. musculus
tcacacacgcacgcac

SEQ ID NO: 430547 - DNA, 16 bp, M. musculus
tcacacactcacacat

SEQ ID NO: 430548 - DNA, 16 bp, M. musculus
tcacacactccagcag

SEQ ID NO: 430549 - DNA, 16 bp, M. musculus
tcacacagacacacac

SEQ ID NO: 430550 - DNA, 16 bp, M. musculus
tcacacagacacacag

SEQ ID NO: 430551 - DNA, 16 bp, M. musculus
tcacacagcaagcagg

SEQ ID NO: 430552 - DNA, 16 bp, M. musculus
tcacacataccacaca

SEQ ID NO: 430553 - DNA, 16 bp, M. musculus
tcacacataccacata

SEQ ID NO: 430554 - DNA, 16 bp, M. musculus
tcacacatgcctttaa

SEQ ID NO: 430555 - DNA, 16 bp, M. musculus
tcacacatgctaggca

SEQ ID NO: 430556 - DNA, 16 bp, M. musculus
tcacacatgtgcacac

SEQ ID NO: 430557 - DNA, 16 bp, M. musculus
tcacaccaaggtattt

SEQ ID NO: 430558 - DNA, 16 bp, M. musculus
tcacacctgcacacac

SEQ ID NO: 430559 - DNA, 16 bp, M. musculus
tcacacctgtaatccc

SEQ ID NO: 430560 - DNA, 16 bp, M. musculus
tcacacggcaagcagg

SEQ ID NO: 430561 - DNA, 16 bp, M. musculus
tcacacgtgcacacac

SEQ ID NO: 430562 - DNA, 16 bp, M. musculus
tcacactcacacacac

SEQ ID NO: 430563 - DNA, 16 bp, M. musculus
tcacactcctcctcag

SEQ ID NO: 430564 - DNA, 16 bp, M. musculus
tcacacttccaaattt

SEQ ID NO: 430565 - DNA, 16 bp, M. musculus
tcacacttgcacagca

SEQ ID NO: 430566 - DNA, 16 bp, M. musculus
tcacagaaaaagaagc

SEQ ID NO: 430567 - DNA, 16 bp, M. musculus
tcacagaaaacaaaac

SEQ ID NO: 430568 - DNA, 16 bp, M. musculus
tcacagaaacagaaag

SEQ ID NO: 430569 - DNA, 16 bp, M. musculus
tcacagaaactgtggc

SEQ ID NO: 430570 - DNA, 16 bp, M. musculus
tcacagaaataggaaa

SEQ ID NO: 430571 - DNA, 16 bp, M. musculus
tcacagaaatctatct

SEQ ID NO: 430572 - DNA, 16 bp, M. musculus
tcacagaaatggaaaa

SEQ ID NO: 430573 - DNA, 16 bp, M. musculus
tcacagaaattgaaaa

SEQ ID NO: 430574 - DNA, 16 bp, M. musculus
tcacagaactcaggag

SEQ ID NO: 430575 - DNA, 16 bp, M. musculus
tcacagaacttatgga

SEQ ID NO: 430576 - DNA, 16 bp, M. musculus
tcacagaagaaaatat

SEQ ID NO: 430577 - DNA, 16 bp, M. musculus
tcacagaagagacctt

SEQ ID NO: 430578 - DNA, 16 bp, M. musculus
tcacagaagaggaaat

SEQ ID NO: 430579 - DNA, 16 bp, M. musculus
tcacagaagatggaaa

SEQ ID NO: 430580 - DNA, 16 bp, M. musculus
tcacagaaggaagtca

SEQ ID NO: 430581 - DNA, 16 bp, M. musculus
tcacagaagtagaaaa

SEQ ID NO: 430582 - DNA, 16 bp, M. musculus
tcacagaatttatgga

SEQ ID NO: 430583 - DNA, 16 bp, M. musculus
tcacagacatcaccaa

SEQ ID NO: 430584 - DNA, 16 bp, M. musculus
tcacagaccacatgaa

SEQ ID NO: 430585 - DNA, 16 bp, M. musculus
tcacagaccacatgag

SEQ ID NO: 430586 - DNA, 16 bp, M. musculus
tcacagaccatatgaa

SEQ ID NO: 430587 - DNA, 16 bp, M. musculus
tcacagactctagcct

SEQ ID NO: 430588 - DNA, 16 bp, M. musculus
tcacagacttggaaag

SEQ ID NO: 430589 - DNA, 16 bp, M. musculus
tcacagagaaaggaga

SEQ ID NO: 430590 - DNA, 16 bp, M. musculus
tcacagagaaagttgg

SEQ ID NO: 430591 - DNA, 16 bp, M. musculus
tcacagagacagaaag

SEQ ID NO: 430592 - DNA, 16 bp, M. musculus
tcacagagacccgcct

SEQ ID NO: 430593 - DNA, 16 bp, M. musculus
tcacagagaccctcct

SEQ ID NO: 430594 - DNA, 16 bp, M. musculus
tcacagagactgcagc

SEQ ID NO: 430595 - DNA, 16 bp, M. musculus
tcacagagacttgaag

SEQ ID NO: 430596 - DNA, 16 bp, M. musculus
tcacagagagaggagc

SEQ ID NO: 430597 - DNA, 16 bp, M. musculus
tcacagagagcctcct

SEQ ID NO: 430598 - DNA, 16 bp, M. musculus
tcacagagatcacctg

SEQ ID NO: 430599 - DNA, 16 bp, M. musculus
tcacagagatcctccc

SEQ ID NO: 430600 - DNA, 16 bp, M. musculus
tcacagagatctacct

SEQ ID NO: 430601 - DNA, 16 bp, M. musculus
tcacagagatctgctt

SEQ ID NO: 430602 - DNA, 16 bp, M. musculus
tcacagagatctggct

SEQ ID NO: 430603 - DNA, 16 bp, M. musculus
tcacagaggaaagaaa

SEQ ID NO: 430604 - DNA, 16 bp, M. musculus
tcacagaggaaggagc

SEQ ID NO: 430605 - DNA, 16 bp, M. musculus
tcacagaggcagagaa

SEQ ID NO: 430606 - DNA, 16 bp, M. musculus
tcacagaggcctgaga

SEQ ID NO: 430607 - DNA, 16 bp, M. musculus
tcacagaggtccactt

SEQ ID NO: 430608 - DNA, 16 bp, M. musculus
tcacagagttctacct

SEQ ID NO: 430609 - DNA, 16 bp, M. musculus
tcacagagttcttccc

SEQ ID NO: 430610 - DNA, 16 bp, M. musculus
tcacagataaggctgc

SEQ ID NO: 430611 - DNA, 18 bp, M. musculus
tcacagataggctgacag

SEQ ID NO: 430612 - DNA, 16 bp, M. musculus
tcacagatatctacct

SEQ ID NO: 430613 - DNA, 16 bp, M. musculus
tcacagatggctgtga

SEQ ID NO: 430614 - DNA, 16 bp, M. musculus
tcacagatgtgcccag

SEQ ID NO: 430615 - DNA, 16 bp, M. musculus
tcacagattggcagga

SEQ ID NO: 430616 - DNA, 16 bp, M. musculus
tcacagcaacaaaaaa

SEQ ID NO: 430617 - DNA, 16 bp, M. musculus
tcacagcaacaagaag

SEQ ID NO: 430618 - DNA, 16 bp, M. musculus
tcacagcaacaggaaa

SEQ ID NO: 430619 - DNA, 16 bp, M. musculus
tcacagcaacagggaa

SEQ ID NO: 430620 - DNA, 16 bp, M. musculus
tcacagcaatgaaaag

SEQ ID NO: 430621 - DNA, 16 bp, M. musculus
tcacagcaatgaaagc

SEQ ID NO: 430622 - DNA, 16 bp, M. musculus
tcacagcaatggaaat

SEQ ID NO: 430623 - DNA, 16 bp, M. musculus
tcacagcacccacatg

SEQ ID NO: 430624 - DNA, 16 bp, M. musculus
tcacagcacttggaag

SEQ ID NO: 430625 - DNA, 16 bp, M. musculus
tcacagcagatttcct

SEQ ID NO: 430626 - DNA, 16 bp, M. musculus
tcacagcagcagaaaa

SEQ ID NO: 430627 - DNA, 16 bp, M. musculus
tcacagcagcagaaac

SEQ ID NO: 430628 - DNA, 16 bp, M. musculus
tcacagcagtgagaaa

SEQ ID NO: 430629 - DNA, 16 bp, M. musculus
tcacagcattagggag

SEQ ID NO: 430630 - DNA, 16 bp, M. musculus
tcacagccacagagaa

SEQ ID NO: 430631 - DNA, 16 bp, M. musculus
tcacagccacctgtaa

SEQ ID NO: 430632 - DNA, 16 bp, M. musculus
tcacagccatccatgg

SEQ ID NO: 430633 - DNA, 24 bp, M. musculus
tcacagccatctgtaatgggatct

SEQ ID NO: 430634 - DNA, 16 bp, M. musculus
tcacagccatctgtac

SEQ ID NO: 430635 - DNA, 16 bp, M. musculus
tcacagctaaccattg

SEQ ID NO: 430636 - DNA, 16 bp, M. musculus
tcacagctaaggtcat

SEQ ID NO: 430637 - DNA, 16 bp, M. musculus
tcacagctctctgtaa

SEQ ID NO: 430638 - DNA, 16 bp, M. musculus
tcacagctgcctgtaa

SEQ ID NO: 430639 - DNA, 16 bp, M. musculus
tcacagctgggtagga

SEQ ID NO: 430640 - DNA, 16 bp, M. musculus
tcacagctgtctgtaa

SEQ ID NO: 430641 - DNA, 16 bp, M. musculus
tcacaggagcagaaat

SEQ ID NO: 430642 - DNA, 16 bp, M. musculus
tcacaggagggacagg

SEQ ID NO: 430643 - DNA, 16 bp, M. musculus
tcacaggcacacacta

SEQ ID NO: 430644 - DNA, 16 bp, M. musculus
tcacaggctcacagga

SEQ ID NO: 430645 - DNA, 16 bp, M. musculus
tcacagggaaggcaga

SEQ ID NO: 430646 - DNA, 16 bp, M. musculus
tcacagggatctgcct

SEQ ID NO: 430647 - DNA, 16 bp, M. musculus
tcacaggtatgtgcca

SEQ ID NO: 430648 - DNA, 16 bp, M. musculus
tcacaggtcagcagtg

SEQ ID NO: 430649 - DNA, 16 bp, M. musculus
tcacagtagctgtggt

SEQ ID NO: 430650 - DNA, 16 bp, M. musculus
tcacagtcacagtcac

SEQ ID NO: 430651 - DNA, 17 bp, M. musculus
tcacagtcagtgatcac

SEQ ID NO: 430652 - DNA, 16 bp, M. musculus
tcacagtcatctacag

SEQ ID NO: 430653 - DNA, 16 bp, M. musculus
tcacagtcatctatgg

SEQ ID NO: 430654 - DNA, 16 bp, M. musculus
tcacagtgaataaagg

SEQ ID NO: 430655 - DNA, 16 bp, M. musculus
tcacagtgacaagaaa

SEQ ID NO: 430656 - DNA, 16 bp, M. musculus
tcacagtgacacacct

SEQ ID NO: 430657 - DNA, 16 bp, M. musculus
tcacagtgacagaaaa

SEQ ID NO: 430658 - DNA, 16 bp, M. musculus
tcacagtggcaggagc

SEQ ID NO: 430659 - DNA, 16 bp, M. musculus
tcacagtggtaaaacc

SEQ ID NO: 430660 - DNA, 16 bp, M. musculus
tcacagtggtctccaa

SEQ ID NO: 430661 - DNA, 16 bp, M. musculus
tcacagtttaaaaaaa

SEQ ID NO: 430662 - DNA, 16 bp, M. musculus
tcacagtttgaaggga

SEQ ID NO: 430663 - DNA, 16 bp, M. musculus
tcacataaagagaaaa

SEQ ID NO: 430664 - DNA, 16 bp, M. musculus
tcacatacacacactc

SEQ ID NO: 430665 - DNA, 16 bp, M. musculus
tcacatacacatactc

SEQ ID NO: 430666 - DNA, 16 bp, M. musculus
tcacatagcagctcac

SEQ ID NO: 430667 - DNA, 16 bp, M. musculus
tcacatagtgtcactt

SEQ ID NO: 430668 - DNA, 16 bp, M. musculus
tcacatatacaaccac

SEQ ID NO: 430669 - DNA, 16 bp, M. musculus
tcacatatgcacatac

SEQ ID NO: 430670 - DNA, 16 bp, M. musculus
tcacatcatatccaca

SEQ ID NO: 430671 - DNA, 16 bp, M. musculus
tcacatcatgttgaat

SEQ ID NO: 430672 - DNA, 16 bp, M. musculus
tcacatccccaggccc

SEQ ID NO: 430673 - DNA, 18 bp, M. musculus
tcacatcctcgccagcat

SEQ ID NO: 430674 - DNA, 16 bp, M. musculus
tcacatctccccagga

SEQ ID NO: 430675 - DNA, 16 bp, M. musculus
tcacatctgtaatccc

SEQ ID NO: 430676 - DNA, 17 bp, M. musculus
tcacatgaaaattgtta

SEQ ID NO: 430677 - DNA, 16 bp, M. musculus
tcacatgaatttttta

SEQ ID NO: 430678 - DNA, 16 bp, M. musculus
tcacatgctcttctca

SEQ ID NO: 430679 - DNA, 16 bp, M. musculus
tcacatggaagctgaa

SEQ ID NO: 430680 - DNA, 16 bp, M. musculus
tcacatggaggctcac

SEQ ID NO: 430681 - DNA, 16 bp, M. musculus
tcacatggcatccaca

SEQ ID NO: 430682 - DNA, 17 bp, M. musculus
tcacatggtggctcaca

SEQ ID NO: 430683 - DNA, 19 bp, M. musculus
tcacatggtggctcataac

SEQ ID NO: 430684 - DNA, 16 bp, M. musculus
tcacatgtgtacacac

SEQ ID NO: 430685 - DNA, 16 bp, M. musculus
tcacattcataaaata

SEQ ID NO: 430686 - DNA, 16 bp, M. musculus
tcacattccactcctt

SEQ ID NO: 430687 - DNA, 16 bp, M. musculus
tcacattcttcttcat

SEQ ID NO: 430688 - DNA, 16 bp, M. musculus
tcacattcttttaaaa

SEQ ID NO: 430689 - DNA, 16 bp, M. musculus
tcacattgcagatggt

SEQ ID NO: 430690 - DNA, 16 bp, M. musculus
tcacatttaaaaatta

SEQ ID NO: 430691 - DNA, 16 bp, M. musculus
tcacatttaaaacaaa

SEQ ID NO: 430692 - DNA, 16 bp, M. musculus
tcacatttaaaatttt

SEQ ID NO: 430693 - DNA, 16 bp, M. musculus
tcacattttctgtgtc

SEQ ID NO: 430694 - DNA, 16 bp, M. musculus
tcaccaaaagcacatc

SEQ ID NO: 430695 - DNA, 16 bp, M. musculus
tcaccaaagaagcttc

SEQ ID NO: 430696 - DNA, 16 bp, M. musculus
tcaccaaagcccaccc

SEQ ID NO: 430697 - DNA, 16 bp, M. musculus
tcaccaaataggctag

SEQ ID NO: 430698 - DNA, 16 bp, M. musculus
tcaccaacagaataga

SEQ ID NO: 430699 - DNA, 16 bp, M. musculus
tcaccaacatgaccac

SEQ ID NO: 430700 - DNA, 16 bp, M. musculus
tcaccaaccaaagaaa

SEQ ID NO: 430701 - DNA, 16 bp, M. musculus
tcaccaacctctccag

SEQ ID NO: 430702 - DNA, 16 bp, M. musculus
tcaccaactggggacc

SEQ ID NO: 430703 - DNA, 16 bp, M. musculus
tcaccaagagcagcag

SEQ ID NO: 430704 - DNA, 16 bp, M. musculus
tcaccaagcctgccca

SEQ ID NO: 430705 - DNA, 16 bp, M. musculus
tcaccaagctagactt

SEQ ID NO: 430706 - DNA, 16 bp, M. musculus
tcaccaagctggactt

SEQ ID NO: 430707 - DNA, 17 bp, M. musculus
tcaccaaggacacccgg

SEQ ID NO: 430708 - DNA, 16 bp, M. musculus
tcaccaaggcccaccc

SEQ ID NO: 430709 - DNA, 16 bp, M. musculus
tcaccaatcttggcaa

SEQ ID NO: 430710 - DNA, 16 bp, M. musculus
tcaccaatgccttctc

SEQ ID NO: 430711 - DNA, 16 bp, M. musculus
tcaccaatggcctttc

SEQ ID NO: 430712 - DNA, 16 bp, M. musculus
tcaccaatggcttctc

SEQ ID NO: 430713 - DNA, 16 bp, M. musculus
tcaccacaacataaga

SEQ ID NO: 430714 - DNA, 16 bp, M. musculus
tcaccacaacgtgagg

SEQ ID NO: 430715 - DNA, 16 bp, M. musculus
tcaccaccagcagcag

SEQ ID NO: 430716 - DNA, 16 bp, M. musculus
tcaccacctgtggcag

SEQ ID NO: 430717 - DNA, 16 bp, M. musculus
tcaccagaggaagtca

SEQ ID NO: 430718 - DNA, 16 bp, M. musculus
tcaccagcatcttctg

SEQ ID NO: 430719 - DNA, 16 bp, M. musculus
tcaccagcatgaactg

SEQ ID NO: 430720 - DNA, 16 bp, M. musculus
tcaccagccccacaaa

SEQ ID NO: 430721 - DNA, 16 bp, M. musculus
tcaccagctgcagcac

SEQ ID NO: 430722 - DNA, 16 bp, M. musculus
tcaccagctttctgtt

SEQ ID NO: 430723 - DNA, 16 bp, M. musculus
tcaccagggactatga

SEQ ID NO: 430724 - DNA, 16 bp, M. musculus
tcaccagtgatctcaa

SEQ ID NO: 430725 - DNA, 16 bp, M. musculus
tcaccagtggagaaat

SEQ ID NO: 430726 - DNA, 16 bp, M. musculus
tcaccataatcagaac

SEQ ID NO: 430727 - DNA, 16 bp, M. musculus
tcaccatagatgctct

SEQ ID NO: 430728 - DNA, 16 bp, M. musculus
tcaccatcaccaacac

SEQ ID NO: 430729 - DNA, 16 bp, M. musculus
tcaccatcatcagaag

SEQ ID NO: 430730 - DNA, 16 bp, M. musculus
tcaccatcatcagagc

SEQ ID NO: 430731 - DNA, 16 bp, M. musculus
tcaccatcatcatcaa

SEQ ID NO: 430732 - DNA, 16 bp, M. musculus
tcaccatcatcttcat

SEQ ID NO: 430733 - DNA, 16 bp, M. musculus
tcaccatccatgacct

SEQ ID NO: 430734 - DNA, 16 bp, M. musculus
tcaccatctctgacct

SEQ ID NO: 430735 - DNA, 16 bp, M. musculus
tcaccatgtctgcctg

SEQ ID NO: 430736 - DNA, 16 bp, M. musculus
tcacccaagaggaata

SEQ ID NO: 430737 - DNA, 16 bp, M. musculus
tcacccagatcaacaa

SEQ ID NO: 430738 - DNA, 16 bp, M. musculus
tcacccaggctggcct

SEQ ID NO: 430739 - DNA, 17 bp, M. musculus
tcacccagtgattggct

SEQ ID NO: 430740 - DNA, 16 bp, M. musculus
tcacccatgctcctgt

SEQ ID NO: 430741 - DNA, 16 bp, M. musculus
tcaccccaccctggca

SEQ ID NO: 430742 - DNA, 16 bp, M. musculus
tcaccccagaaactcc

SEQ ID NO: 430743 - DNA, 41 bp, M. musculus
tcacccgtgcagcctgccctccgcggagtcccggagccaag

SEQ ID NO: 430744 - DNA, 16 bp, M. musculus
tcaccctctgcctctg

SEQ ID NO: 430745 - DNA, 16 bp, M. musculus
tcaccctgactggctg

SEQ ID NO: 430746 - DNA, 16 bp, M. musculus
tcaccctgagtgagat

SEQ ID NO: 430747 - DNA, 16 bp, M. musculus
tcaccctgcctgactc

SEQ ID NO: 430748 - DNA, 16 bp, M. musculus
tcacccttgcaacctc

SEQ ID NO: 430749 - DNA, 16 bp, M. musculus
tcacctacatgacatg

SEQ ID NO: 430750 - DNA, 16 bp, M. musculus
tcacctcccagatctc

SEQ ID NO: 430751 - DNA, 16 bp, M. musculus
tcacctcccaggcctc

SEQ ID NO: 430752 - DNA, 16 bp, M. musculus
tcacctcctcctgcac

SEQ ID NO: 430753 - DNA, 16 bp, M. musculus
tcacctcctgctgctg

SEQ ID NO: 430754 - DNA, 16 bp, M. musculus
tcacctctccctgcct

SEQ ID NO: 430755 - DNA, 16 bp, M. musculus
tcacctgagtcctggg

SEQ ID NO: 430756 - DNA, 16 bp, M. musculus
tcacctgccactgcct

SEQ ID NO: 430757 - DNA, 16 bp, M. musculus
tcacctgccagcttgt

SEQ ID NO: 430758 - DNA, 16 bp, M. musculus
tcacctgcccctgcct

SEQ ID NO: 430759 - DNA, 16 bp, M. musculus
tcacctgcttctgcct

SEQ ID NO: 430760 - DNA, 16 bp, M. musculus
tcacctgcttctgctt

SEQ ID NO: 430761 - DNA, 16 bp, M. musculus
tcacctgcttgccttg

SEQ ID NO: 430762 - DNA, 16 bp, M. musculus
tcacctgggaagggag

SEQ ID NO: 430763 - DNA, 16 bp, M. musculus
tcacctgtcaataaaa

SEQ ID NO: 430764 - DNA, 16 bp, M. musculus
tcacctgtctcttcct

SEQ ID NO: 430765 - DNA, 16 bp, M. musculus
tcacctgtgatcccag

SEQ ID NO: 430766 - DNA, 16 bp, M. musculus
tcacctgtgcagcctg

SEQ ID NO: 430767 - DNA, 16 bp, M. musculus
tcaccttaaaacaaaa

SEQ ID NO: 430768 - DNA, 16 bp, M. musculus
tcaccttacagaagct

SEQ ID NO: 430769 - DNA, 16 bp, M. musculus
tcaccttattttttga

SEQ ID NO: 430770 - DNA, 16 bp, M. musculus
tcaccttccaatcatg

SEQ ID NO: 430771 - DNA, 16 bp, M. musculus
tcaccttccaccttgt

SEQ ID NO: 430772 - DNA, 16 bp, M. musculus
tcaccttccaggtctc

SEQ ID NO: 430773 - DNA, 16 bp, M. musculus
tcaccttgtaaggttt

SEQ ID NO: 430774 - DNA, 16 bp, M. musculus
tcaccttgtcacattt

SEQ ID NO: 430775 - DNA, 16 bp, M. musculus
tcacctttaatctcag

SEQ ID NO: 430776 - DNA, 16 bp, M. musculus
tcacctttgtgtgtgt

SEQ ID NO: 430777 - DNA, 16 bp, M. musculus
tcacgaccaagaagca

SEQ ID NO: 430778 - DNA, 16 bp, M. musculus
tcacgacccacaggtt

SEQ ID NO: 430779 - DNA, 16 bp, M. musculus
tcacgcatgctaggca

SEQ ID NO: 430780 - DNA, 27 bp, M. musculus
tcacgctatgactcctggtgattggca

SEQ ID NO: 430781 - DNA, 16 bp, M. musculus
tcacgggaaagagagg

SEQ ID NO: 430782 - DNA, 21 bp, M. musculus
tcacggggaaggcagagcaca

SEQ ID NO: 430783 - DNA, 17 bp, M. musculus
tcacgtgtgtgtgtgtg

SEQ ID NO: 430784 - DNA, 16 bp, M. musculus
tcactaacaagtggat

SEQ ID NO: 430785 - DNA, 16 bp, M. musculus
tcactaacccactcac

SEQ ID NO: 430786 - DNA, 16 bp, M. musculus
tcactaaggccagacc

SEQ ID NO: 430787 - DNA, 16 bp, M. musculus
tcactaatagcctctc

SEQ ID NO: 430788 - DNA, 16 bp, M. musculus
tcactaatgaagaaaa

SEQ ID NO: 430789 - DNA, 16 bp, M. musculus
tcactaccacctgtaa

SEQ ID NO: 430790 - DNA, 16 bp, M. musculus
tcactactaacttcat

SEQ ID NO: 430791 - DNA, 16 bp, M. musculus
tcactagaaaattctg

SEQ ID NO: 430792 - DNA, 17 bp, M. musculus
tcactagcgggagcacc

SEQ ID NO: 430793 - DNA, 16 bp, M. musculus
tcactatagctctgta

SEQ ID NO: 430794 - DNA, 16 bp, M. musculus
tcactatgcagaccag

SEQ ID NO: 430795 - DNA, 16 bp, M. musculus
tcactatgtagactaa

SEQ ID NO: 430796 - DNA, 16 bp, M. musculus
tcactatgtagccaag

SEQ ID NO: 430797 - DNA, 16 bp, M. musculus
tcactatgtagcccag

SEQ ID NO: 430798 - DNA, 16 bp, M. musculus
tcactatgtagcccta

SEQ ID NO: 430799 - DNA, 16 bp, M. musculus
tcactatgtagctaag

SEQ ID NO: 430800 - DNA, 21 bp, M. musculus
tcactatgtagctctggctgt

SEQ ID NO: 430801 - DNA, 16 bp, M. musculus
tcactatgtagtcctg

SEQ ID NO: 430802 - DNA, 16 bp, M. musculus
tcactattctgttttt

SEQ ID NO: 430803 - DNA, 16 bp, M. musculus
tcactattgctctgta

SEQ ID NO: 430804 - DNA, 16 bp, M. musculus
tcactcaagatgattt

SEQ ID NO: 430805 - DNA, 16 bp, M. musculus
tcactcacaatgatat

SEQ ID NO: 430806 - DNA, 16 bp, M. musculus
tcactcacccactcac

SEQ ID NO: 430807 - DNA, 16 bp, M. musculus
tcactcagaataatgc

SEQ ID NO: 430808 - DNA, 16 bp, M. musculus
tcactcaggaagatat

SEQ ID NO: 430809 - DNA, 16 bp, M. musculus
tcactcaggaagatgc

SEQ ID NO: 430810 - DNA, 16 bp, M. musculus
tcactcaggatgaagc

SEQ ID NO: 430811 - DNA, 16 bp, M. musculus
tcactcaggctggcct

SEQ ID NO: 430812 - DNA, 16 bp, M. musculus
tcactcagggcttcct

SEQ ID NO: 430813 - DNA, 17 bp, M. musculus
tcactcaggtggtactg

SEQ ID NO: 430814 - DNA, 16 bp, M. musculus
tcactcagtagatcag

SEQ ID NO: 430815 - DNA, 16 bp, M. musculus
tcactccagctccagg

SEQ ID NO: 430816 - DNA, 16 bp, M. musculus
tcactccagttacttt

SEQ ID NO: 430817 - DNA, 16 bp, M. musculus
tcactcctgcactgaa

SEQ ID NO: 430818 - DNA, 16 bp, M. musculus
tcactccttctccctg

SEQ ID NO: 430819 - DNA, 17 bp, M. musculus
tcactcctttgttctct

SEQ ID NO: 430820 - DNA, 16 bp, M. musculus
tcactctccaccttgt

SEQ ID NO: 430821 - DNA, 16 bp, M. musculus
tcactctctctgtctc

SEQ ID NO: 430822 - DNA, 16 bp, M. musculus
tcactctgcagaccaa

SEQ ID NO: 430823 - DNA, 16 bp, M. musculus
tcactctgcagcccag

SEQ ID NO: 430824 - DNA, 16 bp, M. musculus
tcactctgccagtcag

SEQ ID NO: 430825 - DNA, 16 bp, M. musculus
tcactctgctcctgct

SEQ ID NO: 430826 - DNA, 16 bp, M. musculus
tcactctggactctcc

SEQ ID NO: 430827 - DNA, 17 bp, M. musculus
tcactctgtagaccaga

SEQ ID NO: 430828 - DNA, 20 bp, M. musculus
tcactctgtagaccaggcta

SEQ ID NO: 430829 - DNA, 16 bp, M. musculus
tcactctgtataccag

SEQ ID NO: 430830 - DNA, 16 bp, M. musculus
tcactctgtcactctg

SEQ ID NO: 430831 - DNA, 16 bp, M. musculus
tcactcttgcacttgc

SEQ ID NO: 430832 - DNA, 16 bp, M. musculus
tcactctttctacctt

SEQ ID NO: 430833 - DNA, 16 bp, M. musculus
tcactgaaacagaaac

SEQ ID NO: 430834 - DNA, 16 bp, M. musculus
tcactgaacctggagc

SEQ ID NO: 430835 - DNA, 16 bp, M. musculus
tcactgaaggaagtca

SEQ ID NO: 430836 - DNA, 16 bp, M. musculus
tcactgaattctagaa

SEQ ID NO: 430837 - DNA, 16 bp, M. musculus
tcactgacatgattgc

SEQ ID NO: 430838 - DNA, 16 bp, M. musculus
tcactgacctggaact

SEQ ID NO: 430839 - DNA, 16 bp, M. musculus
tcactgactgctcttc

SEQ ID NO: 430840 - DNA, 16 bp, M. musculus
tcactgagaaaatgcc

SEQ ID NO: 430841 - DNA, 16 bp, M. musculus
tcactgagactcctct

SEQ ID NO: 430842 - DNA, 16 bp, M. musculus
tcactgagatccacct

SEQ ID NO: 430843 - DNA, 16 bp, M. musculus
tcactgagccatcact

SEQ ID NO: 430844 - DNA, 16 bp, M. musculus
tcactgagccatctca

SEQ ID NO: 430845 - DNA, 16 bp, M. musculus
tcactgagccatctct

SEQ ID NO: 430846 - DNA, 16 bp, M. musculus
tcactgagctatctca

SEQ ID NO: 430847 - DNA, 16 bp, M. musculus
tcactgagctccaggt

SEQ ID NO: 430848 - DNA, 16 bp, M. musculus
tcactgaggaaaatca

SEQ ID NO: 430849 - DNA, 16 bp, M. musculus
tcactgaggactttga

SEQ ID NO: 430850 - DNA, 16 bp, M. musculus
tcactgaggagagtca

SEQ ID NO: 430851 - DNA, 16 bp, M. musculus
tcactgaggagggcag

SEQ ID NO: 430852 - DNA, 16 bp, M. musculus
tcactgaggatgatgc

SEQ ID NO: 430853 - DNA, 16 bp, M. musculus
tcactgaggcatctct

SEQ ID NO: 430854 - DNA, 16 bp, M. musculus
tcactgaggtgaaata

SEQ ID NO: 430855 - DNA, 16 bp, M. musculus
tcactgagtgaagtca

SEQ ID NO: 430856 - DNA, 20 bp, M. musculus
tcactgataagtggatatca

SEQ ID NO: 430857 - DNA, 20 bp, M. musculus
tcactgataagtggatatta

SEQ ID NO: 430858 - DNA, 20 bp, M. musculus
tcactgataagtggctatta

SEQ ID NO: 430859 - DNA, 20 bp, M. musculus
tcactgataagtgggtatta

SEQ ID NO: 430860 - DNA, 16 bp, M. musculus
tcactgatataatttt

SEQ ID NO: 430861 - DNA, 16 bp, M. musculus
tcactgatcaagctgt

SEQ ID NO: 430862 - DNA, 16 bp, M. musculus
tcactgatgctgggaa

SEQ ID NO: 430863 - DNA, 18 bp, M. musculus
tcactgatttagaaaaat

SEQ ID NO: 430864 - DNA, 16 bp, M. musculus
tcactgcctctccttc

SEQ ID NO: 430865 - DNA, 16 bp, M. musculus
tcactgcctttgcatt

SEQ ID NO: 430866 - DNA, 16 bp, M. musculus
tcactgctgcttgagg

SEQ ID NO: 430867 - DNA, 16 bp, M. musculus
tcactggacttccttt

SEQ ID NO: 430868 - DNA, 16 bp, M. musculus
tcactggaggtggact

SEQ ID NO: 430869 - DNA, 16 bp, M. musculus
tcactggagtggatgt

SEQ ID NO: 430870 - DNA, 16 bp, M. musculus
tcactggcatggcctg

SEQ ID NO: 430871 - DNA, 16 bp, M. musculus
tcactggccagccagt

SEQ ID NO: 430872 - DNA, 16 bp, M. musculus
tcactggccccaagga

SEQ ID NO: 430873 - DNA, 16 bp, M. musculus
tcactggcctggaact

SEQ ID NO: 430874 - DNA, 16 bp, M. musculus
tcactggctgctcttc

SEQ ID NO: 430875 - DNA, 16 bp, M. musculus
tcactgggaagagagt

SEQ ID NO: 430876 - DNA, 16 bp, M. musculus
tcactgggactcctcc

SEQ ID NO: 430877 - DNA, 16 bp, M. musculus
tcactgggcagccagc

SEQ ID NO: 430878 - DNA, 16 bp, M. musculus
tcactggggtgggctt

SEQ ID NO: 430879 - DNA, 16 bp, M. musculus
tcactggtaagtgaat

SEQ ID NO: 430880 - DNA, 16 bp, M. musculus
tcactgtaattttgct

SEQ ID NO: 430881 - DNA, 16 bp, M. musculus
tcactgtcactgtcac

SEQ ID NO: 430882 - DNA, 16 bp, M. musculus
tcactgtccattgagt

SEQ ID NO: 430883 - DNA, 16 bp, M. musculus
tcactgtcctcagaca

SEQ ID NO: 430884 - DNA, 16 bp, M. musculus
tcactgtcctggcatt

SEQ ID NO: 430885 - DNA, 16 bp, M. musculus
tcactgtctggatttt

SEQ ID NO: 430886 - DNA, 16 bp, M. musculus
tcactgtgaagaccag

SEQ ID NO: 430887 - DNA, 16 bp, M. musculus
tcactgtgaagccctg

SEQ ID NO: 430888 - DNA, 16 bp, M. musculus
tcactgtgaaggtggg

SEQ ID NO: 430889 - DNA, 16 bp, M. musculus
tcactgtgacaaaata

SEQ ID NO: 430890 - DNA, 16 bp, M. musculus
tcactgtgcagctgag

SEQ ID NO: 430891 - DNA, 16 bp, M. musculus
tcactgtggatgtggg

SEQ ID NO: 430892 - DNA, 16 bp, M. musculus
tcactgtgggtgggct

SEQ ID NO: 430893 - DNA, 16 bp, M. musculus
tcactgtgggtggtgt

SEQ ID NO: 430894 - DNA, 16 bp, M. musculus
tcactgtgggtgtggg

SEQ ID NO: 430895 - DNA, 16 bp, M. musculus
tcactgtgggtttggg

SEQ ID NO: 430896 - DNA, 16 bp, M. musculus
tcactgtgtagaacag

SEQ ID NO: 430897 - DNA, 16 bp, M. musculus
tcactgtgtagcacag

SEQ ID NO: 430898 - DNA, 16 bp, M. musculus
tcactgtgtagccctg

SEQ ID NO: 430899 - DNA, 16 bp, M. musculus
tcactgtgtagccttg

SEQ ID NO: 430900 - DNA, 16 bp, M. musculus
tcactgtgtagctctg

SEQ ID NO: 430901 - DNA, 16 bp, M. musculus
tcactgtgtagtcctg

SEQ ID NO: 430902 - DNA, 16 bp, M. musculus
tcactgtgtatccctg

SEQ ID NO: 430903 - DNA, 16 bp, M. musculus
tcactgtgtccctgta

SEQ ID NO: 430904 - DNA, 16 bp, M. musculus
tcactgtgtccctgtg

SEQ ID NO: 430905 - DNA, 16 bp, M. musculus
tcactgtgtctctgtt

SEQ ID NO: 430906 - DNA, 16 bp, M. musculus
tcactgtgtttctgtt

SEQ ID NO: 430907 - DNA, 16 bp, M. musculus
tcacttaaactttcct

SEQ ID NO: 430908 - DNA, 16 bp, M. musculus
tcacttatcactgagt

SEQ ID NO: 430909 - DNA, 16 bp, M. musculus
tcacttcacagccaga

SEQ ID NO: 430910 - DNA, 16 bp, M. musculus
tcacttcccagtcctc

SEQ ID NO: 430911 - DNA, 16 bp, M. musculus
tcacttcccagtcctt

SEQ ID NO: 430912 - DNA, 16 bp, M. musculus
tcacttcctgcttcct

SEQ ID NO: 430913 - DNA, 16 bp, M. musculus
tcacttctcatgataa

SEQ ID NO: 430914 - DNA, 16 bp, M. musculus
tcacttctccaactcc

SEQ ID NO: 430915 - DNA, 16 bp, M. musculus
tcacttctgctgcctg

SEQ ID NO: 430916 - DNA, 16 bp, M. musculus
tcacttgagctttgac

SEQ ID NO: 430917 - DNA, 16 bp, M. musculus
tcacttgggcacttta

SEQ ID NO: 430918 - DNA, 16 bp, M. musculus
tcactttactaaacca

SEQ ID NO: 430919 - DNA, 16 bp, M. musculus
tcactttcaaacatgg

SEQ ID NO: 430920 - DNA, 16 bp, M. musculus
tcactttcttttctgt

SEQ ID NO: 430921 - DNA, 16 bp, M. musculus
tcactttgagaaatta

SEQ ID NO: 430922 - DNA, 16 bp, M. musculus
tcactttggagaccag

SEQ ID NO: 430923 - DNA, 16 bp, M. musculus
tcactttgtggtttat

SEQ ID NO: 430924 - DNA, 16 bp, M. musculus
tcactttgtgttttct

SEQ ID NO: 430925 - DNA, 16 bp, M. musculus
tcacttttactttgtg

SEQ ID NO: 430926 - DNA, 16 bp, M. musculus
tcacttttgtagacca

SEQ ID NO: 430927 - DNA, 16 bp, M. musculus
tcactttttaaaaaat

SEQ ID NO: 430928 - DNA, 16 bp, M. musculus
tcactttttaaaaact

SEQ ID NO: 430929 - DNA, 16 bp, M. musculus
tcacttttttaaaaaa

SEQ ID NO: 430930 - DNA, 16 bp, M. musculus
tcagaaaaaaagcagg

SEQ ID NO: 430931 - DNA, 16 bp, M. musculus
tcagaaaacaactttt

SEQ ID NO: 430932 - DNA, 16 bp, M. musculus
tcagaaaacacagatt

SEQ ID NO: 430933 - DNA, 16 bp, M. musculus
tcagaaaacagagaaa

SEQ ID NO: 430934 - DNA, 16 bp, M. musculus
tcagaaaactggacac

SEQ ID NO: 430935 - DNA, 16 bp, M. musculus
tcagaaaagaaaagga

SEQ ID NO: 430936 - DNA, 16 bp, M. musculus
tcagaaaagaaattcc

SEQ ID NO: 430937 - DNA, 16 bp, M. musculus
tcagaaaagaacaggc

SEQ ID NO: 430938 - DNA, 16 bp, M. musculus
tcagaaaagcaaacaa

SEQ ID NO: 430939 - DNA, 16 bp, M. musculus
tcagaaaagcagtcag

SEQ ID NO: 430940 - DNA, 16 bp, M. musculus
tcagaaaagctgctat

SEQ ID NO: 430941 - DNA, 16 bp, M. musculus
tcagaaaataggaaat

SEQ ID NO: 430942 - DNA, 16 bp, M. musculus
tcagaaaatcaaatca

SEQ ID NO: 430943 - DNA, 18 bp, M. musculus
tcagaaaatcactcactg

SEQ ID NO: 430944 - DNA, 16 bp, M. musculus
tcagaaaatgaaaaga

SEQ ID NO: 430945 - DNA, 16 bp, M. musculus
tcagaaaatggagaca

SEQ ID NO: 430946 - DNA, 16 bp, M. musculus
tcagaaaattgaacat

SEQ ID NO: 430947 - DNA, 16 bp, M. musculus
tcagaaaattgtctcc

SEQ ID NO: 430948 - DNA, 16 bp, M. musculus
tcagaaaattgttttc

SEQ ID NO: 430949 - DNA, 16 bp, M. musculus
tcagaaacaagacaaa

SEQ ID NO: 430950 - DNA, 20 bp, M. musculus
tcagaaacaatggtaactca

SEQ ID NO: 430951 - DNA, 16 bp, M. musculus
tcagaaacacacacac

SEQ ID NO: 430952 - DNA, 16 bp, M. musculus
tcagaaaccccctatc

SEQ ID NO: 430953 - DNA, 17 bp, M. musculus
tcagaaacttctatctc

SEQ ID NO: 430954 - DNA, 16 bp, M. musculus
tcagaaacttgaaatt

SEQ ID NO: 430955 - DNA, 16 bp, M. musculus
tcagaaagaaccagaa

SEQ ID NO: 430956 - DNA, 16 bp, M. musculus
tcagaaagaacttgaa

SEQ ID NO: 430957 - DNA, 16 bp, M. musculus
tcagaaagacaaaaca

SEQ ID NO: 430958 - DNA, 16 bp, M. musculus
tcagaaagagaaagaa

SEQ ID NO: 430959 - DNA, 16 bp, M. musculus
tcagaaagcaagtaga

SEQ ID NO: 430960 - DNA, 16 bp, M. musculus
tcagaaagcagcactc

SEQ ID NO: 430961 - DNA, 16 bp, M. musculus
tcagaaagcaggagct

SEQ ID NO: 430962 - DNA, 16 bp, M. musculus
tcagaaaggaaaagga

SEQ ID NO: 430963 - DNA, 16 bp, M. musculus
tcagaaatatgagtat

SEQ ID NO: 430964 - DNA, 16 bp, M. musculus
tcagaaatctgcccac

SEQ ID NO: 430965 - DNA, 16 bp, M. musculus
tcagaaatctgcttgt

SEQ ID NO: 430966 - DNA, 16 bp, M. musculus
tcagaaatctttaaac

SEQ ID NO: 430967 - DNA, 16 bp, M. musculus
tcagaaatgaaaagga

SEQ ID NO: 430968 - DNA, 16 bp, M. musculus
tcagaaattaaaaagg

SEQ ID NO: 430969 - DNA, 16 bp, M. musculus
tcagaacaacaaattc

SEQ ID NO: 430970 - DNA, 16 bp, M. musculus
tcagaacacttacctc

SEQ ID NO: 430971 - DNA, 16 bp, M. musculus
tcagaacagaacaaaa

SEQ ID NO: 430972 - DNA, 16 bp, M. musculus
tcagaacaggggaatg

SEQ ID NO: 430973 - DNA, 16 bp, M. musculus
tcagaaccaactggga

SEQ ID NO: 430974 - DNA, 16 bp, M. musculus
tcagaaccagaactgc

SEQ ID NO: 430975 - DNA, 16 bp, M. musculus
tcagaacccaacaaaa

SEQ ID NO: 430976 - DNA, 16 bp, M. musculus
tcagaacccaattctt

SEQ ID NO: 430977 - DNA, 16 bp, M. musculus
tcagaacccacatggc

SEQ ID NO: 430978 - DNA, 16 bp, M. musculus
tcagaacctgcccagc

SEQ ID NO: 430979 - DNA, 16 bp, M. musculus
tcagaacgcagcactt

SEQ ID NO: 430980 - DNA, 16 bp, M. musculus
tcagaactatctgtaa

SEQ ID NO: 430981 - DNA, 16 bp, M. musculus
tcagaactatgagttt

SEQ ID NO: 430982 - DNA, 16 bp, M. musculus
tcagaactattaaaaa

SEQ ID NO: 430983 - DNA, 16 bp, M. musculus
tcagaactcctcaaag

SEQ ID NO: 430984 - DNA, 16 bp, M. musculus
tcagaactgaaaagga

SEQ ID NO: 430985 - DNA, 16 bp, M. musculus
tcagaactttgtctct

SEQ ID NO: 430986 - DNA, 16 bp, M. musculus
tcagaagaaactttga

SEQ ID NO: 430987 - DNA, 16 bp, M. musculus
tcagaagaagaaacaa

SEQ ID NO: 430988 - DNA, 16 bp, M. musculus
tcagaagaagaagaag

SEQ ID NO: 430989 - DNA, 16 bp, M. musculus
tcagaagacaattttc

SEQ ID NO: 430990 - DNA, 16 bp, M. musculus
tcagaagacagccatg

SEQ ID NO: 430991 - DNA, 16 bp, M. musculus
tcagaagacagcttgc

SEQ ID NO: 430992 - DNA, 16 bp, M. musculus
tcagaagacagtcatg

SEQ ID NO: 430993 - DNA, 16 bp, M. musculus
tcagaagactgaagca

SEQ ID NO: 430994 - DNA, 16 bp, M. musculus
tcagaagagcagtcat

SEQ ID NO: 430995 - DNA, 16 bp, M. musculus
tcagaagagcagtcgg

SEQ ID NO: 430996 - DNA, 16 bp, M. musculus
tcagaagagcagtctg

SEQ ID NO: 430997 - DNA, 16 bp, M. musculus
tcagaagaggaaaaag

SEQ ID NO: 430998 - DNA, 16 bp, M. musculus
tcagaagaggaagcag

SEQ ID NO: 430999 - DNA, 16 bp, M. musculus
tcagaagaggagaagg

SEQ ID NO: 431000 - DNA, 16 bp, M. musculus
tcagaagaggcatcag

SEQ ID NO: 431001 - DNA, 16 bp, M. musculus
tcagaagaggccatca

SEQ ID NO: 431002 - DNA, 16 bp, M. musculus
tcagaagagggcaaca

SEQ ID NO: 431003 - DNA, 16 bp, M. musculus
tcagaagagggcttca

SEQ ID NO: 431004 - DNA, 16 bp, M. musculus
tcagaagagtttttgc

SEQ ID NO: 431005 - DNA, 16 bp, M. musculus
tcagaagatctcttcc

SEQ ID NO: 431006 - DNA, 16 bp, M. musculus
tcagaagatggaaagc

SEQ ID NO: 431007 - DNA, 16 bp, M. musculus
tcagaagatggaacga

SEQ ID NO: 431008 - DNA, 16 bp, M. musculus
tcagaagatggcatca

SEQ ID NO: 431009 - DNA, 16 bp, M. musculus
tcagaagcaaagggga

SEQ ID NO: 431010 - DNA, 16 bp, M. musculus
tcagaagcagagacag

SEQ ID NO: 431011 - DNA, 16 bp, M. musculus
tcagaagccaaaagaa

SEQ ID NO: 431012 - DNA, 16 bp, M. musculus
tcagaagccagaagag

SEQ ID NO: 431013 - DNA, 16 bp, M. musculus
tcagaagcctgtgtct

SEQ ID NO: 431014 - DNA, 16 bp, M. musculus
tcagaagctctgtgac

SEQ ID NO: 431015 - DNA, 18 bp, M. musculus
tcagaagctgtcctctag

SEQ ID NO: 431016 - DNA, 16 bp, M. musculus
tcagaagctgttctct

SEQ ID NO: 431017 - DNA, 16 bp, M. musculus
tcagaaggaactgctg

SEQ ID NO: 431018 - DNA, 16 bp, M. musculus
tcagaaggaagatggc

SEQ ID NO: 431019 - DNA, 16 bp, M. musculus
tcagaaggatcctgtc

SEQ ID NO: 431020 - DNA, 16 bp, M. musculus
tcagaaggcagagaca

SEQ ID NO: 431021 - DNA, 16 bp, M. musculus
tcagaaggcagaggtg

SEQ ID NO: 431022 - DNA, 16 bp, M. musculus
tcagaaggcagccatg

SEQ ID NO: 431023 - DNA, 16 bp, M. musculus
tcagaaggccttcctg

SEQ ID NO: 431024 - DNA, 16 bp, M. musculus
tcagaaggggaaaaaa

SEQ ID NO: 431025 - DNA, 16 bp, M. musculus
tcagaaggggaaacaa

SEQ ID NO: 431026 - DNA, 16 bp, M. musculus
tcagaagggggcatca

SEQ ID NO: 431027 - DNA, 16 bp, M. musculus
tcagaaggtggaaaga

SEQ ID NO: 431028 - DNA, 16 bp, M. musculus
tcagaagttaagagca

SEQ ID NO: 431029 - DNA, 16 bp, M. musculus
tcagaagtttgaggcc

SEQ ID NO: 431030 - DNA, 16 bp, M. musculus
tcagaataaactcaga

SEQ ID NO: 431031 - DNA, 24 bp, M. musculus
tcagaataagagtaacttataaag

SEQ ID NO: 431032 - DNA, 16 bp, M. musculus
tcagaataatgtgaag

SEQ ID NO: 431033 - DNA, 16 bp, M. musculus
tcagaatatattttat

SEQ ID NO: 431034 - DNA, 16 bp, M. musculus
tcagaatatttttctt

SEQ ID NO: 431035 - DNA, 16 bp, M. musculus
tcagaatcagataaac

SEQ ID NO: 431036 - DNA, 16 bp, M. musculus
tcagaatcagatgaag

SEQ ID NO: 431037 - DNA, 16 bp, M. musculus
tcagaatccagttctc

SEQ ID NO: 431038 - DNA, 16 bp, M. musculus
tcagaatctgaagatt

SEQ ID NO: 431039 - DNA, 17 bp, M. musculus
tcagaatctgtgttcat

SEQ ID NO: 431040 - DNA, 24 bp, M. musculus
tcagaatgatgccctccaggtcca

SEQ ID NO: 431041 - DNA, 16 bp, M. musculus
tcagaatgcattatat

SEQ ID NO: 431042 - DNA, 16 bp, M. musculus
tcagaatggctgtcat

SEQ ID NO: 431043 - DNA, 16 bp, M. musculus
tcagaattgagagttc

SEQ ID NO: 431044 - DNA, 16 bp, M. musculus
tcagaattggaaggct

SEQ ID NO: 431045 - DNA, 16 bp, M. musculus
tcagaatttgaagatt

SEQ ID NO: 431046 - DNA, 16 bp, M. musculus
tcagacaaagcagcag

SEQ ID NO: 431047 - DNA, 16 bp, M. musculus
tcagacaacccagaag

SEQ ID NO: 431048 - DNA, 16 bp, M. musculus
tcagacaagacaagct

SEQ ID NO: 431049 - DNA, 16 bp, M. musculus
tcagacaaggtttctc

SEQ ID NO: 431050 - DNA, 16 bp, M. musculus
tcagacacaccagaaa

SEQ ID NO: 431051 - DNA, 18 bp, M. musculus
tcagacacaccagaagaa

SEQ ID NO: 431052 - DNA, 19 bp, M. musculus
tcagacacaccagaagaga

SEQ ID NO: 431053 - DNA, 16 bp, M. musculus
tcagacacaccaggaa

SEQ ID NO: 431054 - DNA, 16 bp, M. musculus
tcagacacaccagtca

SEQ ID NO: 431055 - DNA, 18 bp, M. musculus
tcagacacacccgaagag

SEQ ID NO: 431056 - DNA, 16 bp, M. musculus
tcagacacagaagagg

SEQ ID NO: 431057 - DNA, 16 bp, M. musculus
tcagacactggaccac

SEQ ID NO: 431058 - DNA, 16 bp, M. musculus
tcagacactggatcac

SEQ ID NO: 431059 - DNA, 16 bp, M. musculus
tcagacagaaacaatt

SEQ ID NO: 431060 - DNA, 16 bp, M. musculus
tcagacaggccttgaa

SEQ ID NO: 431061 - DNA, 16 bp, M. musculus
tcagacagggtctcat

SEQ ID NO: 431062 - DNA, 16 bp, M. musculus
tcagacagggtttctc

SEQ ID NO: 431063 - DNA, 16 bp, M. musculus
tcagacataccagagg

SEQ ID NO: 431064 - DNA, 16 bp, M. musculus
tcagacatcaacatgg

SEQ ID NO: 431065 - DNA, 16 bp, M. musculus
tcagacatggtgattc

SEQ ID NO: 431066 - DNA, 16 bp, M. musculus
tcagaccaaggcagga

SEQ ID NO: 431067 - DNA, 16 bp, M. musculus
tcagaccaccacagat

SEQ ID NO: 431068 - DNA, 16 bp, M. musculus
tcagaccagaaggaat

SEQ ID NO: 431069 - DNA, 16 bp, M. musculus
tcagacccaaaggaca

SEQ ID NO: 431070 - DNA, 16 bp, M. musculus
tcagacccagaaagat

SEQ ID NO: 431071 - DNA, 16 bp, M. musculus
tcagacctcagcttga

SEQ ID NO: 431072 - DNA, 16 bp, M. musculus
tcagacctctctctct

SEQ ID NO: 431073 - DNA, 16 bp, M. musculus
tcagacctctgtgcac

SEQ ID NO: 431074 - DNA, 16 bp, M. musculus
tcagacctgcctcctg

SEQ ID NO: 431075 - DNA, 16 bp, M. musculus
tcagactccagaagtt

SEQ ID NO: 431076 - DNA, 16 bp, M. musculus
tcagactccctggaac

SEQ ID NO: 431077 - DNA, 16 bp, M. musculus
tcagactctgaaagcc

SEQ ID NO: 431078 - DNA, 16 bp, M. musculus
tcagactctgagagcc

SEQ ID NO: 431079 - DNA, 16 bp, M. musculus
tcagactggcctcaaa

SEQ ID NO: 431080 - DNA, 16 bp, M. musculus
tcagactgtcaggatc

SEQ ID NO: 431081 - DNA, 16 bp, M. musculus
tcagactgtttattct

SEQ ID NO: 431082 - DNA, 16 bp, M. musculus
tcagacttggtggcaa

SEQ ID NO: 431083 - DNA, 16 bp, M. musculus
tcagacttggtggcag

SEQ ID NO: 431084 - DNA, 16 bp, M. musculus
tcagactttatttttt

SEQ ID NO: 431085 - DNA, 16 bp, M. musculus
tcagagaaaaagatag

SEQ ID NO: 431086 - DNA, 16 bp, M. musculus
tcagagaaaatacaaa

SEQ ID NO: 431087 - DNA, 16 bp, M. musculus
tcagagaaaatgcaaa

SEQ ID NO: 431088 - DNA, 17 bp, M. musculus
tcagagaaactctgtct

SEQ ID NO: 431089 - DNA, 16 bp, M. musculus
tcagagaaagaactga

SEQ ID NO: 431090 - DNA, 16 bp, M. musculus
tcagagaaagatttca

SEQ ID NO: 431091 - DNA, 16 bp, M. musculus
tcagagaacaacttgg

SEQ ID NO: 431092 - DNA, 16 bp, M. musculus
tcagagaacagctttg

SEQ ID NO: 431093 - DNA, 16 bp, M. musculus
tcagagaacccctctg

SEQ ID NO: 431094 - DNA, 16 bp, M. musculus
tcagagaactctctgc

SEQ ID NO: 431095 - DNA, 16 bp, M. musculus
tcagagaagaacaaaa

SEQ ID NO: 431096 - DNA, 16 bp, M. musculus
tcagagaagcttcttt

SEQ ID NO: 431097 - DNA, 16 bp, M. musculus
tcagagaaggagaagc

SEQ ID NO: 431098 - DNA, 16 bp, M. musculus
tcagagaaggggaagc

SEQ ID NO: 431099 - DNA, 16 bp, M. musculus
tcagagaattggacat

SEQ ID NO: 431100 - DNA, 16 bp, M. musculus
tcagagacaactataa

SEQ ID NO: 431101 - DNA, 16 bp, M. musculus
tcagagacactgaaat

SEQ ID NO: 431102 - DNA, 16 bp, M. musculus
tcagagacagacagag

SEQ ID NO: 431103 - DNA, 16 bp, M. musculus
tcagagacaggccctg

SEQ ID NO: 431104 - DNA, 16 bp, M. musculus
tcagagacttcaagtt

SEQ ID NO: 431105 - DNA, 16 bp, M. musculus
tcagagagacacagag

SEQ ID NO: 431106 - DNA, 16 bp, M. musculus
tcagagagaggaagag

SEQ ID NO: 431107 - DNA, 16 bp, M. musculus
tcagagagctgcttca

SEQ ID NO: 431108 - DNA, 16 bp, M. musculus
tcagagaggaaaaaaa

SEQ ID NO: 431109 - DNA, 16 bp, M. musculus
tcagagaggaaaccag

SEQ ID NO: 431110 - DNA, 16 bp, M. musculus
tcagagagtttgctgt

SEQ ID NO: 431111 - DNA, 16 bp, M. musculus
tcagagatcaagagtt

SEQ ID NO: 431112 - DNA, 16 bp, M. musculus
tcagagatcagcttgc

SEQ ID NO: 431113 - DNA, 16 bp, M. musculus
tcagagatctacctgc

SEQ ID NO: 431114 - DNA, 16 bp, M. musculus
tcagagatctatctgc

SEQ ID NO: 431115 - DNA, 16 bp, M. musculus
tcagagatggagccac

SEQ ID NO: 431116 - DNA, 16 bp, M. musculus
tcagagatggcaaaca

SEQ ID NO: 431117 - DNA, 16 bp, M. musculus
tcagagatgtgactgt

SEQ ID NO: 431118 - DNA, 32 bp, M. musculus
tcagagcaagccgcgcctctggtagaacagct

SEQ ID NO: 431119 - DNA, 20 bp, M. musculus
tcagagcaagctgcgcctct

SEQ ID NO: 431120 - DNA, 16 bp, M. musculus
tcagagcaatggaaac

SEQ ID NO: 431121 - DNA, 16 bp, M. musculus
tcagagcactctgcag

SEQ ID NO: 431122 - DNA, 16 bp, M. musculus
tcagagcctcctcctg

SEQ ID NO: 431123 - DNA, 16 bp, M. musculus
tcagagcctggcagtt

SEQ ID NO: 431124 - DNA, 16 bp, M. musculus
tcagagctatgaattt

SEQ ID NO: 431125 - DNA, 16 bp, M. musculus
tcagagctcagaaaga

SEQ ID NO: 431126 - DNA, 16 bp, M. musculus
tcagagctcctcagag

SEQ ID NO: 431127 - DNA, 16 bp, M. musculus
tcagagctctctctgc

SEQ ID NO: 431128 - DNA, 16 bp, M. musculus
tcagagctcttaacca

SEQ ID NO: 431129 - DNA, 16 bp, M. musculus
tcagagctgaggacca

SEQ ID NO: 431130 - DNA, 16 bp, M. musculus
tcagagctgtgtggtt

SEQ ID NO: 431131 - DNA, 16 bp, M. musculus
tcagaggaaaactttg

SEQ ID NO: 431132 - DNA, 16 bp, M. musculus
tcagaggacaacatgg

SEQ ID NO: 431133 - DNA, 16 bp, M. musculus
tcagaggacaacctct

SEQ ID NO: 431134 - DNA, 16 bp, M. musculus
tcagaggacaacctgc

SEQ ID NO: 431135 - DNA, 16 bp, M. musculus
tcagaggacaactatg

SEQ ID NO: 431136 - DNA, 16 bp, M. musculus
tcagaggacaactgtc

SEQ ID NO: 431137 - DNA, 16 bp, M. musculus
tcagaggacaacttgg

SEQ ID NO: 431138 - DNA, 16 bp, M. musculus
tcagaggacaacttgt

SEQ ID NO: 431139 - DNA, 16 bp, M. musculus
tcagaggacagcatgt

SEQ ID NO: 431140 - DNA, 16 bp, M. musculus
tcagaggacagcttgt

SEQ ID NO: 431141 - DNA, 16 bp, M. musculus
tcagaggacagcttta

SEQ ID NO: 431142 - DNA, 16 bp, M. musculus
tcagaggacagtgatg

SEQ ID NO: 431143 - DNA, 16 bp, M. musculus
tcagaggactctctgc

SEQ ID NO: 431144 - DNA, 16 bp, M. musculus
tcagaggactggagtt

SEQ ID NO: 431145 - DNA, 16 bp, M. musculus
tcagaggagaagaatg

SEQ ID NO: 431146 - DNA, 16 bp, M. musculus
tcagaggatacaaatc

SEQ ID NO: 431147 - DNA, 16 bp, M. musculus
tcagaggatgaccttg

SEQ ID NO: 431148 - DNA, 16 bp, M. musculus
tcagaggatggaaaga

SEQ ID NO: 431149 - DNA, 16 bp, M. musculus
tcagaggcaaagagga

SEQ ID NO: 431150 - DNA, 16 bp, M. musculus
tcagaggcaaaggcag

SEQ ID NO: 431151 - DNA, 16 bp, M. musculus
tcagaggcaaggggga

SEQ ID NO: 431152 - DNA, 17 bp, M. musculus
tcagaggcagaggcaga

SEQ ID NO: 431153 - DNA, 16 bp, M. musculus
tcagaggcaggtggat

SEQ ID NO: 431154 - DNA, 16 bp, M. musculus
tcagaggccagaggag

SEQ ID NO: 431155 - DNA, 16 bp, M. musculus
tcagaggccagcctga

SEQ ID NO: 431156 - DNA, 16 bp, M. musculus
tcagaggctctgccaa

SEQ ID NO: 431157 - DNA, 16 bp, M. musculus
tcagaggctggggaga

SEQ ID NO: 431158 - DNA, 16 bp, M. musculus
tcagagggccaggaga

SEQ ID NO: 431159 - DNA, 16 bp, M. musculus
tcagagggtaagagca

SEQ ID NO: 431160 - DNA, 16 bp, M. musculus
tcagaggtcaaggtca

SEQ ID NO: 431161 - DNA, 16 bp, M. musculus
tcagaggtgaagggga

SEQ ID NO: 431162 - DNA, 16 bp, M. musculus
tcagaggttaaaaaca

SEQ ID NO: 431163 - DNA, 16 bp, M. musculus
tcagaggttagtccat

SEQ ID NO: 431164 - DNA, 16 bp, M. musculus
tcagaggttcagttca

SEQ ID NO: 431165 - DNA, 20 bp, M. musculus
tcagaggttccgtccattat

SEQ ID NO: 431166 - DNA, 16 bp, M. musculus
tcagagtatgcctggg

SEQ ID NO: 431167 - DNA, 16 bp, M. musculus
tcagagtcagctgctg

SEQ ID NO: 431168 - DNA, 16 bp, M. musculus
tcagagtctctcactg

SEQ ID NO: 431169 - DNA, 16 bp, M. musculus
tcagagtctttgacat

SEQ ID NO: 431170 - DNA, 16 bp, M. musculus
tcagagtgaaaggcag

SEQ ID NO: 431171 - DNA, 16 bp, M. musculus
tcagagtgcagtcatg

SEQ ID NO: 431172 - DNA, 16 bp, M. musculus
tcagagtgggtcttcc

SEQ ID NO: 431173 - DNA, 16 bp, M. musculus
tcagagtggttttgat

SEQ ID NO: 431174 - DNA, 16 bp, M. musculus
tcagagttattttgat

SEQ ID NO: 431175 - DNA, 16 bp, M. musculus
tcagagttcaattccc

SEQ ID NO: 431176 - DNA, 16 bp, M. musculus
tcagagttcagatccc

SEQ ID NO: 431177 - DNA, 16 bp, M. musculus
tcagagttctctggtg

SEQ ID NO: 431178 - DNA, 16 bp, M. musculus
tcagagttctgcctgc

SEQ ID NO: 431179 - DNA, 16 bp, M. musculus
tcagagttctgggatt

SEQ ID NO: 431180 - DNA, 17 bp, M. musculus
tcagagttcttggcagt

SEQ ID NO: 431181 - DNA, 16 bp, M. musculus
tcagagttgttatttt

SEQ ID NO: 431182 - DNA, 16 bp, M. musculus
tcagataaacaattta

SEQ ID NO: 431183 - DNA, 16 bp, M. musculus
tcagataaactattta

SEQ ID NO: 431184 - DNA, 16 bp, M. musculus
tcagataaggctagag

SEQ ID NO: 431185 - DNA, 16 bp, M. musculus
tcagatacatttgttt

SEQ ID NO: 431186 - DNA, 16 bp, M. musculus
tcagatagcatctgag

SEQ ID NO: 431187 - DNA, 16 bp, M. musculus
tcagatagctcacaac

SEQ ID NO: 431188 - DNA, 16 bp, M. musculus
tcagatatactgaggg

SEQ ID NO: 431189 - DNA, 16 bp, M. musculus
tcagatatcaatggga

SEQ ID NO: 431190 - DNA, 16 bp, M. musculus
tcagatatccacctgc

SEQ ID NO: 431191 - DNA, 16 bp, M. musculus
tcagatattggatgga

SEQ ID NO: 431192 - DNA, 16 bp, M. musculus
tcagatcaagatggag

SEQ ID NO: 431193 - DNA, 16 bp, M. musculus
tcagatcaccacaaac

SEQ ID NO: 431194 - DNA, 16 bp, M. musculus
tcagatcaccactgac

SEQ ID NO: 431195 - DNA, 16 bp, M. musculus
tcagatcaccattgac

SEQ ID NO: 431196 - DNA, 16 bp, M. musculus
tcagatcagatcagat

SEQ ID NO: 431197 - DNA, 16 bp, M. musculus
tcagatcatcagactt

SEQ ID NO: 431198 - DNA, 16 bp, M. musculus
tcagatcccaaagaat

SEQ ID NO: 431199 - DNA, 16 bp, M. musculus
tcagatcccagcacca

SEQ ID NO: 431200 - DNA, 16 bp, M. musculus
tcagatcccagcatcc

SEQ ID NO: 431201 - DNA, 16 bp, M. musculus
tcagatcccttgggac

SEQ ID NO: 431202 - DNA, 16 bp, M. musculus
tcagatcctcatgctt

SEQ ID NO: 431203 - DNA, 16 bp, M. musculus
tcagatcctctggaac

SEQ ID NO: 431204 - DNA, 17 bp, M. musculus
tcagatcctgttgcttt

SEQ ID NO: 431205 - DNA, 16 bp, M. musculus
tcagatctcatcacgg

SEQ ID NO: 431206 - DNA, 18 bp, M. musculus
tcagatctcattacaggt

SEQ ID NO: 431207 - DNA, 16 bp, M. musculus
tcagatctcattacga

SEQ ID NO: 431208 - DNA, 16 bp, M. musculus
tcagatctcattgtgg

SEQ ID NO: 431209 - DNA, 16 bp, M. musculus
tcagatctcctagaac

SEQ ID NO: 431210 - DNA, 16 bp, M. musculus
tcagatctccttacgg

SEQ ID NO: 431211 - DNA, 16 bp, M. musculus
tcagatctctggaagg

SEQ ID NO: 431212 - DNA, 16 bp, M. musculus
tcagatctctgttaca

SEQ ID NO: 431213 - DNA, 16 bp, M. musculus
tcagatcttcaggctt

SEQ ID NO: 431214 - DNA, 16 bp, M. musculus
tcagatcttggagtta

SEQ ID NO: 431215 - DNA, 16 bp, M. musculus
tcagatctttctacaa

SEQ ID NO: 431216 - DNA, 16 bp, M. musculus
tcagatgaagatgaag

SEQ ID NO: 431217 - DNA, 23 bp, M. musculus
tcagatgacttactgaagttttg

SEQ ID NO: 431218 - DNA, 16 bp, M. musculus
tcagatgagcaaggtc

SEQ ID NO: 431219 - DNA, 16 bp, M. musculus
tcagatgatgaattct

SEQ ID NO: 431220 - DNA, 16 bp, M. musculus
tcagatgattttagct

SEQ ID NO: 431221 - DNA, 16 bp, M. musculus
tcagatgcccctcaac

SEQ ID NO: 431222 - DNA, 16 bp, M. musculus
tcagatgccctctcct

SEQ ID NO: 431223 - DNA, 16 bp, M. musculus
tcagatgctgaaaaag

SEQ ID NO: 431224 - DNA, 16 bp, M. musculus
tcagatggatgcagag

SEQ ID NO: 431225 - DNA, 16 bp, M. musculus
tcagatggcagaaggc

SEQ ID NO: 431226 - DNA, 16 bp, M. musculus
tcagatggcagaggcc

SEQ ID NO: 431227 - DNA, 16 bp, M. musculus
tcagatggcgggaggc

SEQ ID NO: 431228 - DNA, 16 bp, M. musculus
tcagatggctccacag

SEQ ID NO: 431229 - DNA, 16 bp, M. musculus
tcagatgggggtgggg

SEQ ID NO: 431230 - DNA, 16 bp, M. musculus
tcagatggggtggagg

SEQ ID NO: 431231 - DNA, 16 bp, M. musculus
tcagattaaaggcatg

SEQ ID NO: 431232 - DNA, 16 bp, M. musculus
tcagattaaaggtgtg

SEQ ID NO: 431233 - DNA, 16 bp, M. musculus
tcagattcacagagat

SEQ ID NO: 431234 - DNA, 16 bp, M. musculus
tcagattccatctcac

SEQ ID NO: 431235 - DNA, 16 bp, M. musculus
tcagattgattttcct

SEQ ID NO: 431236 - DNA, 16 bp, M. musculus
tcagatttagagctgc

SEQ ID NO: 431237 - DNA, 16 bp, M. musculus
tcagatttaggattga

SEQ ID NO: 431238 - DNA, 16 bp, M. musculus
tcagatttgcctcctg

SEQ ID NO: 431239 - DNA, 16 bp, M. musculus
tcagatttggtggcaa

SEQ ID NO: 431240 - DNA, 16 bp, M. musculus
tcagcaaaacctggaa

SEQ ID NO: 431241 - DNA, 16 bp, M. musculus
tcagcaaaatcttgct

SEQ ID NO: 431242 - DNA, 17 bp, M. musculus
tcagcaaaatcttgctg

SEQ ID NO: 431243 - DNA, 16 bp, M. musculus
tcagcaaaatctttct

SEQ ID NO: 431244 - DNA, 16 bp, M. musculus
tcagcaaaatggcaaa

SEQ ID NO: 431245 - DNA, 16 bp, M. musculus
tcagcaaaatgtttct

SEQ ID NO: 431246 - DNA, 16 bp, M. musculus
tcagcaaacacttcct

SEQ ID NO: 431247 - DNA, 16 bp, M. musculus
tcagcaaagaccagtg

SEQ ID NO: 431248 - DNA, 16 bp, M. musculus
tcagcaaagtggatgg

SEQ ID NO: 431249 - DNA, 17 bp, M. musculus
tcagcaaagtggctgaa

SEQ ID NO: 431250 - DNA, 16 bp, M. musculus
tcagcaaatggtgctg

SEQ ID NO: 431251 - DNA, 16 bp, M. musculus
tcagcaacacacacac

SEQ ID NO: 431252 - DNA, 16 bp, M. musculus
tcagcaacagtttcta

SEQ ID NO: 431253 - DNA, 20 bp, M. musculus
tcagcaaccacatggtggct

SEQ ID NO: 431254 - DNA, 16 bp, M. musculus
tcagcaacccacccac

SEQ ID NO: 431255 - DNA, 16 bp, M. musculus
tcagcaactcaaacag

SEQ ID NO: 431256 - DNA, 16 bp, M. musculus
tcagcaactgactgag

SEQ ID NO: 431257 - DNA, 16 bp, M. musculus
tcagcaagatggtcat

SEQ ID NO: 431258 - DNA, 16 bp, M. musculus
tcagcaagcacttccc

SEQ ID NO: 431259 - DNA, 16 bp, M. musculus
tcagcaagctcttgct

SEQ ID NO: 431260 - DNA, 16 bp, M. musculus
tcagcaataaggtctt

SEQ ID NO: 431261 - DNA, 16 bp, M. musculus
tcagcaatagggtttt

SEQ ID NO: 431262 - DNA, 16 bp, M. musculus
tcagcaatggacagat

SEQ ID NO: 431263 - DNA, 16 bp, M. musculus
tcagcaatggcacatg

SEQ ID NO: 431264 - DNA, 16 bp, M. musculus
tcagcaattttttttt

SEQ ID NO: 431265 - DNA, 16 bp, M. musculus
tcagcacagccagggc

SEQ ID NO: 431266 - DNA, 16 bp, M. musculus
tcagcaccaaggacag

SEQ ID NO: 431267 - DNA, 16 bp, M. musculus
tcagcaccacggacag

SEQ ID NO: 431268 - DNA, 16 bp, M. musculus
tcagcaccagcactgg

SEQ ID NO: 431269 - DNA, 16 bp, M. musculus
tcagcaccatggacag

SEQ ID NO: 431270 - DNA, 16 bp, M. musculus
tcagcacctgcctcca

SEQ ID NO: 431271 - DNA, 16 bp, M. musculus
tcagcaccttcagtcc

SEQ ID NO: 431272 - DNA, 16 bp, M. musculus
tcagcactcaggaagc

SEQ ID NO: 431273 - DNA, 16 bp, M. musculus
tcagcactcctgagaa

SEQ ID NO: 431274 - DNA, 16 bp, M. musculus
tcagcactgaaaacat

SEQ ID NO: 431275 - DNA, 16 bp, M. musculus
tcagcacttcatggaa

SEQ ID NO: 431276 - DNA, 16 bp, M. musculus
tcagcacttggcaggc

SEQ ID NO: 431277 - DNA, 16 bp, M. musculus
tcagcacttttttttt

SEQ ID NO: 431278 - DNA, 16 bp, M. musculus
tcagcagacaccaaac

SEQ ID NO: 431279 - DNA, 16 bp, M. musculus
tcagcagacctgggag

SEQ ID NO: 431280 - DNA, 16 bp, M. musculus
tcagcagaccttggag

SEQ ID NO: 431281 - DNA, 16 bp, M. musculus
tcagcagaggcagagg

SEQ ID NO: 431282 - DNA, 16 bp, M. musculus
tcagcagatgaatgga

SEQ ID NO: 431283 - DNA, 16 bp, M. musculus
tcagcagcagcaacaa

SEQ ID NO: 431284 - DNA, 16 bp, M. musculus
tcagcagcagcagcca

SEQ ID NO: 431285 - DNA, 17 bp, M. musculus
tcagcagcagcagctca

SEQ ID NO: 431286 - DNA, 16 bp, M. musculus
tcagcagcctgagaga

SEQ ID NO: 431287 - DNA, 16 bp, M. musculus
tcagcagctgccagga

SEQ ID NO: 431288 - DNA, 16 bp, M. musculus
tcagcagctggtcctg

SEQ ID NO: 431289 - DNA, 16 bp, M. musculus
tcagcagcttcagcca

SEQ ID NO: 431290 - DNA, 16 bp, M. musculus
tcagcagcttcagtcc

SEQ ID NO: 431291 - DNA, 16 bp, M. musculus
tcagcaggaagtagtc

SEQ ID NO: 431292 - DNA, 16 bp, M. musculus
tcagcaggacacctgg

SEQ ID NO: 431293 - DNA, 16 bp, M. musculus
tcagcaggagcagcag

SEQ ID NO: 431294 - DNA, 16 bp, M. musculus
tcagcaggaggaacca

SEQ ID NO: 431295 - DNA, 16 bp, M. musculus
tcagcaggaggaatgg

SEQ ID NO: 431296 - DNA, 16 bp, M. musculus
tcagcaggagggacca

SEQ ID NO: 431297 - DNA, 16 bp, M. musculus
tcagcaggagttagtg

SEQ ID NO: 431298 - DNA, 16 bp, M. musculus
tcagcaggcctgggag

SEQ ID NO: 431299 - DNA, 17 bp, M. musculus
tcagcagggctttttca

SEQ ID NO: 431300 - DNA, 16 bp, M. musculus
tcagcaggtaaagttt

SEQ ID NO: 431301 - DNA, 16 bp, M. musculus
tcagcagtccagtcca

SEQ ID NO: 431302 - DNA, 16 bp, M. musculus
tcagcagtgaaaactt

SEQ ID NO: 431303 - DNA, 16 bp, M. musculus
tcagcagtgaaaagca

SEQ ID NO: 431304 - DNA, 16 bp, M. musculus
tcagcagtgaagaaca

SEQ ID NO: 431305 - DNA, 16 bp, M. musculus
tcagcagtgagaagca

SEQ ID NO: 431306 - DNA, 16 bp, M. musculus
tcagcagtggcagctc

SEQ ID NO: 431307 - DNA, 16 bp, M. musculus
tcagcagttccagtgg

SEQ ID NO: 431308 - DNA, 16 bp, M. musculus
tcagcagtttctccag

SEQ ID NO: 431309 - DNA, 16 bp, M. musculus
tcagcatcactctgtg

SEQ ID NO: 431310 - DNA, 16 bp, M. musculus
tcagcatcactgaggt

SEQ ID NO: 431311 - DNA, 17 bp, M. musculus
tcagcatcattaatcat

SEQ ID NO: 431312 - DNA, 16 bp, M. musculus
tcagcatccaaaccct

SEQ ID NO: 431313 - DNA, 16 bp, M. musculus
tcagcatctgccccag

SEQ ID NO: 431314 - DNA, 16 bp, M. musculus
tcagcatgagctgtca

SEQ ID NO: 431315 - DNA, 16 bp, M. musculus
tcagcatgtaaaagaa

SEQ ID NO: 431316 - DNA, 16 bp, M. musculus
tcagcatgtacttctt

SEQ ID NO: 431317 - DNA, 19 bp, M. musculus
tcagcatgtctgacaatga

SEQ ID NO: 431318 - DNA, 16 bp, M. musculus
tcagcatttggaagca

SEQ ID NO: 431319 - DNA, 16 bp, M. musculus
tcagcatttggaagtt

SEQ ID NO: 431320 - DNA, 16 bp, M. musculus
tcagcatttggagact

SEQ ID NO: 431321 - DNA, 16 bp, M. musculus
tcagccaagaggcaga

SEQ ID NO: 431322 - DNA, 16 bp, M. musculus
tcagccaatgactgag

SEQ ID NO: 431323 - DNA, 16 bp, M. musculus
tcagccaatgagcttc

SEQ ID NO: 431324 - DNA, 16 bp, M. musculus
tcagccagagacagct

SEQ ID NO: 431325 - DNA, 16 bp, M. musculus
tcagccagagttcaga

SEQ ID NO: 431326 - DNA, 16 bp, M. musculus
tcagccagccagtcag

SEQ ID NO: 431327 - DNA, 16 bp, M. musculus
tcagccagccattgga

SEQ ID NO: 431328 - DNA, 22 bp, M. musculus
tcagccaggactacacagagaa

SEQ ID NO: 431329 - DNA, 16 bp, M. musculus
tcagccaggagacaga

SEQ ID NO: 431330 - DNA, 16 bp, M. musculus
tcagccaggaggtgga

SEQ ID NO: 431331 - DNA, 16 bp, M. musculus
tcagccagggctacat

SEQ ID NO: 431332 - DNA, 17 bp, M. musculus
tcagccagtcctgggca

SEQ ID NO: 431333 - DNA, 16 bp, M. musculus
tcagccagtgcagctg

SEQ ID NO: 431334 - DNA, 16 bp, M. musculus
tcagccatcacaacac

SEQ ID NO: 431335 - DNA, 16 bp, M. musculus
tcagccattaaaggct

SEQ ID NO: 431336 - DNA, 16 bp, M. musculus
tcagccattcagtgtt

SEQ ID NO: 431337 - DNA, 16 bp, M. musculus
tcagcccctcttcccc

SEQ ID NO: 431338 - DNA, 16 bp, M. musculus
tcagcccctgcttcct

SEQ ID NO: 431339 - DNA, 16 bp, M. musculus
tcagccccttcagtcc

SEQ ID NO: 431340 - DNA, 16 bp, M. musculus
tcagccctggagagac

SEQ ID NO: 431341 - DNA, 16 bp, M. musculus
tcagccctttggtatt

SEQ ID NO: 431342 - DNA, 16 bp, M. musculus
tcagcctcagaactgg

SEQ ID NO: 431343 - DNA, 16 bp, M. musculus
tcagcctcagaagcag

SEQ ID NO: 431344 - DNA, 16 bp, M. musculus
tcagcctcagcactgg

SEQ ID NO: 431345 - DNA, 16 bp, M. musculus
tcagcctcaggaggaa

SEQ ID NO: 431346 - DNA, 16 bp, M. musculus
tcagcctccaaacaat

SEQ ID NO: 431347 - DNA, 16 bp, M. musculus
tcagcctccagagagg

SEQ ID NO: 431348 - DNA, 16 bp, M. musculus
tcagcctccagagtgt

SEQ ID NO: 431349 - DNA, 16 bp, M. musculus
tcagcctccagggagg

SEQ ID NO: 431350 - DNA, 16 bp, M. musculus
tcagcctcccaggcac

SEQ ID NO: 431351 - DNA, 16 bp, M. musculus
tcagcctcctgagtac

SEQ ID NO: 431352 - DNA, 16 bp, M. musculus
tcagcctcctttctta

SEQ ID NO: 431353 - DNA, 57 bp, M. musculus
tcagcctctctccccagccatccctgtcattgctcaatgggcacatgaacaaagtgg

SEQ ID NO: 431354 - DNA, 16 bp, M. musculus
tcagcctctgcctcct

SEQ ID NO: 431355 - DNA, 16 bp, M. musculus
tcagcctctgtcactg

SEQ ID NO: 431356 - DNA, 16 bp, M. musculus
tcagcctcttgagtgc

SEQ ID NO: 431357 - DNA, 16 bp, M. musculus
tcagcctgcttcaagg

SEQ ID NO: 431358 - DNA, 16 bp, M. musculus
tcagcctgcttcctta

SEQ ID NO: 431359 - DNA, 16 bp, M. musculus
tcagcctgctttctaa

SEQ ID NO: 431360 - DNA, 16 bp, M. musculus
tcagcctgctttctcc

SEQ ID NO: 431361 - DNA, 16 bp, M. musculus
tcagcctggactcttc

SEQ ID NO: 431362 - DNA, 16 bp, M. musculus
tcagcctgggaaagag

SEQ ID NO: 431363 - DNA, 16 bp, M. musculus
tcagcctgggacagag

SEQ ID NO: 431364 - DNA, 16 bp, M. musculus
tcagcctgggctacaa

SEQ ID NO: 431365 - DNA, 16 bp, M. musculus
tcagcctggtcaacag

SEQ ID NO: 431366 - DNA, 16 bp, M. musculus
tcagcctggtccacag

SEQ ID NO: 431367 - DNA, 16 bp, M. musculus
tcagcctgtcccagaa

SEQ ID NO: 431368 - DNA, 16 bp, M. musculus
tcagcctgtttatccc

SEQ ID NO: 431369 - DNA, 16 bp, M. musculus
tcagccttcagccttc

SEQ ID NO: 431370 - DNA, 16 bp, M. musculus
tcagccttcctcatgc

SEQ ID NO: 431371 - DNA, 16 bp, M. musculus
tcagccttctgagtag

SEQ ID NO: 431372 - DNA, 16 bp, M. musculus
tcagcctttgtccatg

SEQ ID NO: 431373 - DNA, 16 bp, M. musculus
tcagcgggcccatgcc

SEQ ID NO: 431374 - DNA, 16 bp, M. musculus
tcagctaaactggctg

SEQ ID NO: 431375 - DNA, 16 bp, M. musculus
tcagctacctccccag

SEQ ID NO: 431376 - DNA, 16 bp, M. musculus
tcagctacctcttcag

SEQ ID NO: 431377 - DNA, 16 bp, M. musculus
tcagctactgccccag

SEQ ID NO: 431378 - DNA, 16 bp, M. musculus
tcagctactgggtaga

SEQ ID NO: 431379 - DNA, 19 bp, M. musculus
tcagctagctgacaataaa

SEQ ID NO: 431380 - DNA, 16 bp, M. musculus
tcagctataccacttc

SEQ ID NO: 431381 - DNA, 16 bp, M. musculus
tcagctcacaactgtc

SEQ ID NO: 431382 - DNA, 16 bp, M. musculus
tcagctcagcctcctg

SEQ ID NO: 431383 - DNA, 16 bp, M. musculus
tcagctcagctcagct

SEQ ID NO: 431384 - DNA, 16 bp, M. musculus
tcagctccaactttgt

SEQ ID NO: 431385 - DNA, 16 bp, M. musculus
tcagctccagaggatc

SEQ ID NO: 431386 - DNA, 16 bp, M. musculus
tcagctccagctcagg

SEQ ID NO: 431387 - DNA, 16 bp, M. musculus
tcagctccagggcaca

SEQ ID NO: 431388 - DNA, 16 bp, M. musculus
tcagctccaggtgcag

SEQ ID NO: 431389 - DNA, 16 bp, M. musculus
tcagctcccaagtctg

SEQ ID NO: 431390 - DNA, 16 bp, M. musculus
tcagctcccagaaccc

SEQ ID NO: 431391 - DNA, 16 bp, M. musculus
tcagctcccagcaacc

SEQ ID NO: 431392 - DNA, 16 bp, M. musculus
tcagctcccagcacct

SEQ ID NO: 431393 - DNA, 16 bp, M. musculus
tcagctcctccagagc

SEQ ID NO: 431394 - DNA, 16 bp, M. musculus
tcagctcctctgctgt

SEQ ID NO: 431395 - DNA, 16 bp, M. musculus
tcagctcctgcctcca

SEQ ID NO: 431396 - DNA, 16 bp, M. musculus
tcagctcctgccttcc

SEQ ID NO: 431397 - DNA, 16 bp, M. musculus
tcagctcctggcagca

SEQ ID NO: 431398 - DNA, 16 bp, M. musculus
tcagctcctgttacag

SEQ ID NO: 431399 - DNA, 16 bp, M. musculus
tcagctccttgtgtcc

SEQ ID NO: 431400 - DNA, 16 bp, M. musculus
tcagctctaaagaaaa

SEQ ID NO: 431401 - DNA, 16 bp, M. musculus
tcagctctaagcccca

SEQ ID NO: 431402 - DNA, 16 bp, M. musculus
tcagctctcaggaggc

SEQ ID NO: 431403 - DNA, 16 bp, M. musculus
tcagctctgaaaaaaa

SEQ ID NO: 431404 - DNA, 16 bp, M. musculus
tcagctctgctctgag

SEQ ID NO: 431405 - DNA, 16 bp, M. musculus
tcagctctgggtgctg

SEQ ID NO: 431406 - DNA, 16 bp, M. musculus
tcagctcttcagtcct

SEQ ID NO: 431407 - DNA, 16 bp, M. musculus
tcagctcttccgtggt

SEQ ID NO: 431408 - DNA, 16 bp, M. musculus
tcagctcttctgagac

SEQ ID NO: 431409 - DNA, 16 bp, M. musculus
tcagctcttctgaggc

SEQ ID NO: 431410 - DNA, 16 bp, M. musculus
tcagctcttctgcagt

SEQ ID NO: 431411 - DNA, 16 bp, M. musculus
tcagctcttctgtggt

SEQ ID NO: 431412 - DNA, 16 bp, M. musculus
tcagctgaagagttct

SEQ ID NO: 431413 - DNA, 17 bp, M. musculus
tcagctgacatcactct

SEQ ID NO: 431414 - DNA, 16 bp, M. musculus
tcagctgagtttttga

SEQ ID NO: 431415 - DNA, 16 bp, M. musculus
tcagctgcaagaagca

SEQ ID NO: 431416 - DNA, 16 bp, M. musculus
tcagctgccctgactc

SEQ ID NO: 431417 - DNA, 16 bp, M. musculus
tcagctgctctccatg

SEQ ID NO: 431418 - DNA, 16 bp, M. musculus
tcagctgctctgcatg

SEQ ID NO: 431419 - DNA, 16 bp, M. musculus
tcagctgctgcctcca

SEQ ID NO: 431420 - DNA, 16 bp, M. musculus
tcagctgcttctccag

SEQ ID NO: 431421 - DNA, 16 bp, M. musculus
tcagctgcttgttgag

SEQ ID NO: 431422 - DNA, 16 bp, M. musculus
tcagctggagctgaag

SEQ ID NO: 431423 - DNA, 16 bp, M. musculus
tcagctggtaaagatg

SEQ ID NO: 431424 - DNA, 16 bp, M. musculus
tcagctggtaaaggca

SEQ ID NO: 431425 - DNA, 16 bp, M. musculus
tcagctggtgtatggt

SEQ ID NO: 431426 - DNA, 16 bp, M. musculus
tcagctgtgtctctct

SEQ ID NO: 431427 - DNA, 16 bp, M. musculus
tcagctgtgtgtgtgt

SEQ ID NO: 431428 - DNA, 16 bp, M. musculus
tcagctgttcagagca

SEQ ID NO: 431429 - DNA, 16 bp, M. musculus
tcagcttattggccat

SEQ ID NO: 431430 - DNA, 16 bp, M. musculus
tcagcttcaggagagg

SEQ ID NO: 431431 - DNA, 16 bp, M. musculus
tcagcttcccaagtag

SEQ ID NO: 431432 - DNA, 16 bp, M. musculus
tcagcttcctgagtac

SEQ ID NO: 431433 - DNA, 16 bp, M. musculus
tcagcttcctgctcca

SEQ ID NO: 431434 - DNA, 16 bp, M. musculus
tcagcttcctgctccc

SEQ ID NO: 431435 - DNA, 16 bp, M. musculus
tcagcttcctgctctg

SEQ ID NO: 431436 - DNA, 16 bp, M. musculus
tcagcttctcactgaa

SEQ ID NO: 431437 - DNA, 16 bp, M. musculus
tcagcttctgcctcca

SEQ ID NO: 431438 - DNA, 16 bp, M. musculus
tcagcttctggctatt

SEQ ID NO: 431439 - DNA, 16 bp, M. musculus
tcagcttctgtccatt

SEQ ID NO: 431440 - DNA, 16 bp, M. musculus
tcagcttcttccagac

SEQ ID NO: 431441 - DNA, 16 bp, M. musculus
tcagcttcttgctatt

SEQ ID NO: 431442 - DNA, 16 bp, M. musculus
tcagcttgaagaggag

SEQ ID NO: 431443 - DNA, 16 bp, M. musculus
tcagcttgagtcagca

SEQ ID NO: 431444 - DNA, 25 bp, M. musculus
tcagctttcagttacaattgagtac

SEQ ID NO: 431445 - DNA, 16 bp, M. musculus
tcagctttcctcagca

SEQ ID NO: 431446 - DNA, 16 bp, M. musculus
tcagctttctgttact

SEQ ID NO: 431447 - DNA, 16 bp, M. musculus
tcagctttgagcccca

SEQ ID NO: 431448 - DNA, 16 bp, M. musculus
tcagcttttttgcctt

SEQ ID NO: 431449 - DNA, 16 bp, M. musculus
tcaggaaaaaaaatat

SEQ ID NO: 431450 - DNA, 16 bp, M. musculus
tcaggaaaacaaacaa

SEQ ID NO: 431451 - DNA, 16 bp, M. musculus
tcaggaaaaggtaaaa

SEQ ID NO: 431452 - DNA, 16 bp, M. musculus
tcaggaaaatggatgg

SEQ ID NO: 431453 - DNA, 16 bp, M. musculus
tcaggaaacacagata

SEQ ID NO: 431454 - DNA, 16 bp, M. musculus
tcaggaaagctgccca

SEQ ID NO: 431455 - DNA, 16 bp, M. musculus
tcaggaaagctgtctg

SEQ ID NO: 431456 - DNA, 16 bp, M. musculus
tcaggaaataatcaaa

SEQ ID NO: 431457 - DNA, 16 bp, M. musculus
tcaggaaccataaatg

SEQ ID NO: 431458 - DNA, 16 bp, M. musculus
tcaggaactgccagac

SEQ ID NO: 431459 - DNA, 16 bp, M. musculus
tcaggaacttcggaag

SEQ ID NO: 431460 - DNA, 16 bp, M. musculus
tcaggaagaaagaaga

SEQ ID NO: 431461 - DNA, 16 bp, M. musculus
tcaggaagaacaaaga

SEQ ID NO: 431462 - DNA, 16 bp, M. musculus
tcaggaagaagagaga

SEQ ID NO: 431463 - DNA, 16 bp, M. musculus
tcaggaagaccaacag

SEQ ID NO: 431464 - DNA, 16 bp, M. musculus
tcaggaagagaccctg

SEQ ID NO: 431465 - DNA, 16 bp, M. musculus
tcaggaagcacttgtt

SEQ ID NO: 431466 - DNA, 16 bp, M. musculus
tcaggaagcagaagca

SEQ ID NO: 431467 - DNA, 16 bp, M. musculus
tcaggaagcagagatg

SEQ ID NO: 431468 - DNA, 16 bp, M. musculus
tcaggaagcagaggaa

SEQ ID NO: 431469 - DNA, 16 bp, M. musculus
tcaggaagcagaggca

SEQ ID NO: 431470 - DNA, 16 bp, M. musculus
tcaggaagcagaggta

SEQ ID NO: 431471 - DNA, 16 bp, M. musculus
tcaggaagcaggagat

SEQ ID NO: 431472 - DNA, 16 bp, M. musculus
tcaggaagccctgggt

SEQ ID NO: 431473 - DNA, 16 bp, M. musculus
tcaggaagctgaagca

SEQ ID NO: 431474 - DNA, 16 bp, M. musculus
tcaggaaggagaggca

SEQ ID NO: 431475 - DNA, 16 bp, M. musculus
tcaggaagttcctgaa

SEQ ID NO: 431476 - DNA, 16 bp, M. musculus
tcaggaatcaatggga

SEQ ID NO: 431477 - DNA, 16 bp, M. musculus
tcaggaatctgtgtgt

SEQ ID NO: 431478 - DNA, 16 bp, M. musculus
tcaggaattcaaggtc

SEQ ID NO: 431479 - DNA, 16 bp, M. musculus
tcaggaatttttccct

SEQ ID NO: 431480 - DNA, 16 bp, M. musculus
tcaggacaaattcagc

SEQ ID NO: 431481 - DNA, 16 bp, M. musculus
tcaggacaaggtttct

SEQ ID NO: 431482 - DNA, 16 bp, M. musculus
tcaggacacagaggca

SEQ ID NO: 431483 - DNA, 16 bp, M. musculus
tcaggacagacagaca

SEQ ID NO: 431484 - DNA, 20 bp, M. musculus
tcaggacagccaaggctaca

SEQ ID NO: 431485 - DNA, 16 bp, M. musculus
tcaggacagccagtgc

SEQ ID NO: 431486 - DNA, 16 bp, M. musculus
tcaggacaggaactca

SEQ ID NO: 431487 - DNA, 16 bp, M. musculus
tcaggaccaccagtcc

SEQ ID NO: 431488 - DNA, 16 bp, M. musculus
tcaggaccagaggaca

SEQ ID NO: 431489 - DNA, 16 bp, M. musculus
tcaggaccaggaagca

SEQ ID NO: 431490 - DNA, 16 bp, M. musculus
tcaggaccaggaatgg

SEQ ID NO: 431491 - DNA, 17 bp, M. musculus
tcaggacctctggaaga

SEQ ID NO: 431492 - DNA, 16 bp, M. musculus
tcaggactggacctca

SEQ ID NO: 431493 - DNA, 16 bp, M. musculus
tcaggacttctggaaa

SEQ ID NO: 431494 - DNA, 16 bp, M. musculus
tcaggagaaagaaaga

SEQ ID NO: 431495 - DNA, 16 bp, M. musculus
tcaggagacaaagaca

SEQ ID NO: 431496 - DNA, 16 bp, M. musculus
tcaggagacagtttta

SEQ ID NO: 431497 - DNA, 16 bp, M. musculus
tcaggagacatagatg

SEQ ID NO: 431498 - DNA, 16 bp, M. musculus
tcaggagactgaagca

SEQ ID NO: 431499 - DNA, 16 bp, M. musculus
tcaggagagccagggc

SEQ ID NO: 431500 - DNA, 18 bp, M. musculus
tcaggagaggagacccag

SEQ ID NO: 431501 - DNA, 16 bp, M. musculus
tcaggagcagaggcag

SEQ ID NO: 431502 - DNA, 16 bp, M. musculus
tcaggagccagaggca

SEQ ID NO: 431503 - DNA, 16 bp, M. musculus
tcaggagccagatgct

SEQ ID NO: 431504 - DNA, 16 bp, M. musculus
tcaggagctacagatg

SEQ ID NO: 431505 - DNA, 16 bp, M. musculus
tcaggagctcatgaat

SEQ ID NO: 431506 - DNA, 16 bp, M. musculus
tcaggagctccaggcc

SEQ ID NO: 431507 - DNA, 16 bp, M. musculus
tcaggagctgacacac

SEQ ID NO: 431508 - DNA, 16 bp, M. musculus
tcaggagctgaggcag

SEQ ID NO: 431509 - DNA, 16 bp, M. musculus
tcaggagctggagaga

SEQ ID NO: 431510 - DNA, 16 bp, M. musculus
tcaggaggacctggct

SEQ ID NO: 431511 - DNA, 16 bp, M. musculus
tcaggaggagagagag

SEQ ID NO: 431512 - DNA, 16 bp, M. musculus
tcaggaggagctgaga

SEQ ID NO: 431513 - DNA, 16 bp, M. musculus
tcaggaggaggaagag

SEQ ID NO: 431514 - DNA, 16 bp, M. musculus
tcaggaggcagaagca

SEQ ID NO: 431515 - DNA, 16 bp, M. musculus
tcaggaggcagaatca

SEQ ID NO: 431516 - DNA, 16 bp, M. musculus
tcaggaggcagacaca

SEQ ID NO: 431517 - DNA, 16 bp, M. musculus
tcaggaggcagagaca

SEQ ID NO: 431518 - DNA, 16 bp, M. musculus
tcaggaggcagaggag

SEQ ID NO: 431519 - DNA, 16 bp, M. musculus
tcaggaggccaaggca

SEQ ID NO: 431520 - DNA, 16 bp, M. musculus
tcaggaggctgaggaa

SEQ ID NO: 431521 - DNA, 17 bp, M. musculus
tcaggaggctgaggcaa

SEQ ID NO: 431522 - DNA, 16 bp, M. musculus
tcaggaggctgaggga

SEQ ID NO: 431523 - DNA, 16 bp, M. musculus
tcaggagggagggagg

SEQ ID NO: 431524 - DNA, 16 bp, M. musculus
tcaggaggtcctgagt

SEQ ID NO: 431525 - DNA, 16 bp, M. musculus
tcaggagtgtgtgtgt

SEQ ID NO: 431526 - DNA, 16 bp, M. musculus
tcaggagttcaaatcc

SEQ ID NO: 431527 - DNA, 16 bp, M. musculus
tcaggagttcaagcag

SEQ ID NO: 431528 - DNA, 16 bp, M. musculus
tcaggagttggaggca

SEQ ID NO: 431529 - DNA, 16 bp, M. musculus
tcaggatagaaactca

SEQ ID NO: 431530 - DNA, 16 bp, M. musculus
tcaggatcaaatagac

SEQ ID NO: 431531 - DNA, 16 bp, M. musculus
tcaggatcacaggatc

SEQ ID NO: 431532 - DNA, 16 bp, M. musculus
tcaggatcccagtgta

SEQ ID NO: 431533 - DNA, 17 bp, M. musculus
tcaggatcttcggaaga

SEQ ID NO: 431534 - DNA, 16 bp, M. musculus
tcaggatgaagatgct

SEQ ID NO: 431535 - DNA, 16 bp, M. musculus
tcaggatgaccttgaa

SEQ ID NO: 431536 - DNA, 16 bp, M. musculus
tcaggatgatatttgc

SEQ ID NO: 431537 - DNA, 18 bp, M. musculus
tcaggatgatcacctgct

SEQ ID NO: 431538 - DNA, 16 bp, M. musculus
tcaggatgatgcccac

SEQ ID NO: 431539 - DNA, 16 bp, M. musculus
tcaggatgcaaaggaa

SEQ ID NO: 431540 - DNA, 30 bp, M. musculus
tcaggatggagagacagtgggaagcagtgc

SEQ ID NO: 431541 - DNA, 16 bp, M. musculus
tcaggatggctttgaa

SEQ ID NO: 431542 - DNA, 16 bp, M. musculus
tcaggattggcagcaa

SEQ ID NO: 431543 - DNA, 16 bp, M. musculus
tcaggattgttttgat

SEQ ID NO: 431544 - DNA, 16 bp, M. musculus
tcaggcaaaatgctcc

SEQ ID NO: 431545 - DNA, 16 bp, M. musculus
tcaggcacacacatgg

SEQ ID NO: 431546 - DNA, 16 bp, M. musculus
tcaggcacctgactct

SEQ ID NO: 431547 - DNA, 16 bp, M. musculus
tcaggcactccagaag

SEQ ID NO: 431548 - DNA, 16 bp, M. musculus
tcaggcactgaagaca

SEQ ID NO: 431549 - DNA, 16 bp, M. musculus
tcaggcactggaagag

SEQ ID NO: 431550 - DNA, 16 bp, M. musculus
tcaggcactggcaggg

SEQ ID NO: 431551 - DNA, 16 bp, M. musculus
tcaggcatggtgattc

SEQ ID NO: 431552 - DNA, 16 bp, M. musculus
tcaggcattggttggt

SEQ ID NO: 431553 - DNA, 16 bp, M. musculus
tcaggcattttgtcac

SEQ ID NO: 431554 - DNA, 16 bp, M. musculus
tcaggccagccaggga

SEQ ID NO: 431555 - DNA, 16 bp, M. musculus
tcaggccagccagggt

SEQ ID NO: 431556 - DNA, 16 bp, M. musculus
tcaggccctgggacct

SEQ ID NO: 431557 - DNA, 16 bp, M. musculus
tcaggcctccacaggc

SEQ ID NO: 431558 - DNA, 16 bp, M. musculus
tcaggccttcattttc

SEQ ID NO: 431559 - DNA, 16 bp, M. musculus
tcaggccttggggcct

SEQ ID NO: 431560 - DNA, 16 bp, M. musculus
tcaggcgccaggcagc

SEQ ID NO: 431561 - DNA, 16 bp, M. musculus
tcaggctcaggctcag

SEQ ID NO: 431562 - DNA, 16 bp, M. musculus
tcaggctcagttccca

SEQ ID NO: 431563 - DNA, 16 bp, M. musculus
tcaggctctgacagca

SEQ ID NO: 431564 - DNA, 16 bp, M. musculus
tcaggctctgtgagcc

SEQ ID NO: 431565 - DNA, 16 bp, M. musculus
tcaggctgaccttgaa

SEQ ID NO: 431566 - DNA, 17 bp, M. musculus
tcaggctggagaaatgg

SEQ ID NO: 431567 - DNA, 20 bp, M. musculus
tcaggctggcctcaaactca

SEQ ID NO: 431568 - DNA, 16 bp, M. musculus
tcaggctggcctggag

SEQ ID NO: 431569 - DNA, 16 bp, M. musculus
tcaggctggccttaaa

SEQ ID NO: 431570 - DNA, 16 bp, M. musculus
tcaggctggccttgaa

SEQ ID NO: 431571 - DNA, 21 bp, M. musculus
tcaggctggccttgaactcac

SEQ ID NO: 431572 - DNA, 16 bp, M. musculus
tcaggctggccttgag

SEQ ID NO: 431573 - DNA, 16 bp, M. musculus
tcaggctggctttgaa

SEQ ID NO: 431574 - DNA, 16 bp, M. musculus
tcaggctggggagggg

SEQ ID NO: 431575 - DNA, 16 bp, M. musculus
tcaggctgtggcagag

SEQ ID NO: 431576 - DNA, 16 bp, M. musculus
tcaggcttagcagcaa

SEQ ID NO: 431577 - DNA, 16 bp, M. musculus
tcaggcttggcagaaa

SEQ ID NO: 431578 - DNA, 16 bp, M. musculus
tcaggcttggcagcag

SEQ ID NO: 431579 - DNA, 16 bp, M. musculus
tcagggaaaagcaaat

SEQ ID NO: 431580 - DNA, 16 bp, M. musculus
tcagggaaactgaggc

SEQ ID NO: 431581 - DNA, 16 bp, M. musculus
tcagggaaaggcaaat

SEQ ID NO: 431582 - DNA, 16 bp, M. musculus
tcagggaaatacaagt

SEQ ID NO: 431583 - DNA, 16 bp, M. musculus
tcagggaacaggagct

SEQ ID NO: 431584 - DNA, 16 bp, M. musculus
tcagggaagaaacaaa

SEQ ID NO: 431585 - DNA, 16 bp, M. musculus
tcagggaagatgagcg

SEQ ID NO: 431586 - DNA, 16 bp, M. musculus
tcagggaatcctgcag

SEQ ID NO: 431587 - DNA, 16 bp, M. musculus
tcagggacaaagatag

SEQ ID NO: 431588 - DNA, 16 bp, M. musculus
tcagggacaggccctg

SEQ ID NO: 431589 - DNA, 16 bp, M. musculus
tcagggactggccatc

SEQ ID NO: 431590 - DNA, 16 bp, M. musculus
tcagggacttcctgag

SEQ ID NO: 431591 - DNA, 16 bp, M. musculus
tcagggagaaaaaaaa

SEQ ID NO: 431592 - DNA, 16 bp, M. musculus
tcagggagtggcacca

SEQ ID NO: 431593 - DNA, 16 bp, M. musculus
tcagggattcaagaac

SEQ ID NO: 431594 - DNA, 16 bp, M. musculus
tcagggcaatgcaaat

SEQ ID NO: 431595 - DNA, 16 bp, M. musculus
tcagggcacagccaca

SEQ ID NO: 431596 - DNA, 16 bp, M. musculus
tcagggcagcaggagc

SEQ ID NO: 431597 - DNA, 16 bp, M. musculus
tcagggcagctgacaa

SEQ ID NO: 431598 - DNA, 17 bp, M. musculus
tcagggcaggaactcag

SEQ ID NO: 431599 - DNA, 16 bp, M. musculus
tcagggcaggcctgag

SEQ ID NO: 431600 - DNA, 16 bp, M. musculus
tcagggcagggacctg

SEQ ID NO: 431601 - DNA, 16 bp, M. musculus
tcagggcagggtccca

SEQ ID NO: 431602 - DNA, 16 bp, M. musculus
tcagggccaggaagtg

SEQ ID NO: 431603 - DNA, 16 bp, M. musculus
tcagggcccccaatgg

SEQ ID NO: 431604 - DNA, 17 bp, M. musculus
tcagggctacacagaga

SEQ ID NO: 431605 - DNA, 16 bp, M. musculus
tcagggctctctagag

SEQ ID NO: 431606 - DNA, 16 bp, M. musculus
tcagggctgaaagcaa

SEQ ID NO: 431607 - DNA, 16 bp, M. musculus
tcagggctggcaagat

SEQ ID NO: 431608 - DNA, 16 bp, M. musculus
tcagggcttcagaaat

SEQ ID NO: 431609 - DNA, 16 bp, M. musculus
tcagggcttcctctgc

SEQ ID NO: 431610 - DNA, 16 bp, M. musculus
tcaggggaacagttgg

SEQ ID NO: 431611 - DNA, 16 bp, M. musculus
tcaggggaaggactga

SEQ ID NO: 431612 - DNA, 16 bp, M. musculus
tcaggggatccagtgc

SEQ ID NO: 431613 - DNA, 16 bp, M. musculus
tcaggggctgaggcag

SEQ ID NO: 431614 - DNA, 16 bp, M. musculus
tcagggggcagaggca

SEQ ID NO: 431615 - DNA, 16 bp, M. musculus
tcaggggtagagtgct

SEQ ID NO: 431616 - DNA, 16 bp, M. musculus
tcaggggttaagaaca

SEQ ID NO: 431617 - DNA, 16 bp, M. musculus
tcagggtcagcacaca

SEQ ID NO: 431618 - DNA, 16 bp, M. musculus
tcagggtcatcttcag

SEQ ID NO: 431619 - DNA, 16 bp, M. musculus
tcagggtcctttgagc

SEQ ID NO: 431620 - DNA, 16 bp, M. musculus
tcagggtcttccctcc

SEQ ID NO: 431621 - DNA, 16 bp, M. musculus
tcagggttagggttag

SEQ ID NO: 431622 - DNA, 16 bp, M. musculus
tcagggttcagggaac

SEQ ID NO: 431623 - DNA, 16 bp, M. musculus
tcagggttggggacag

SEQ ID NO: 431624 - DNA, 16 bp, M. musculus
tcagggtttcattgct

SEQ ID NO: 431625 - DNA, 16 bp, M. musculus
tcaggtacagaagatt

SEQ ID NO: 431626 - DNA, 16 bp, M. musculus
tcaggtactttattca

SEQ ID NO: 431627 - DNA, 16 bp, M. musculus
tcaggtagaccacatc

SEQ ID NO: 431628 - DNA, 16 bp, M. musculus
tcaggtagtactatgt

SEQ ID NO: 431629 - DNA, 16 bp, M. musculus
tcaggtatggtggcac

SEQ ID NO: 431630 - DNA, 16 bp, M. musculus
tcaggtcatcaagctt

SEQ ID NO: 431631 - DNA, 16 bp, M. musculus
tcaggtcatcagactt

SEQ ID NO: 431632 - DNA, 16 bp, M. musculus
tcaggtcatcccttct

SEQ ID NO: 431633 - DNA, 16 bp, M. musculus
tcaggtccaaaagaaa

SEQ ID NO: 431634 - DNA, 16 bp, M. musculus
tcaggtcccaaagaaa

SEQ ID NO: 431635 - DNA, 16 bp, M. musculus
tcaggtcccagcacct

SEQ ID NO: 431636 - DNA, 16 bp, M. musculus
tcaggtcctcaagctt

SEQ ID NO: 431637 - DNA, 16 bp, M. musculus
tcaggtctcctggaag

SEQ ID NO: 431638 - DNA, 16 bp, M. musculus
tcaggtctgcatgctt

SEQ ID NO: 431639 - DNA, 16 bp, M. musculus
tcaggtcttcaggctt

SEQ ID NO: 431640 - DNA, 16 bp, M. musculus
tcaggtcttcagtcct

SEQ ID NO: 431641 - DNA, 16 bp, M. musculus
tcaggtcttcatgctt

SEQ ID NO: 431642 - DNA, 16 bp, M. musculus
tcaggtgaaagcagat

SEQ ID NO: 431643 - DNA, 16 bp, M. musculus
tcaggtgacagaagat

SEQ ID NO: 431644 - DNA, 20 bp, M. musculus
tcaggtgacagcagatgctg

SEQ ID NO: 431645 - DNA, 16 bp, M. musculus
tcaggtgactctgctg

SEQ ID NO: 431646 - DNA, 16 bp, M. musculus
tcaggtgagagcacca

SEQ ID NO: 431647 - DNA, 16 bp, M. musculus
tcaggtgctggtagaa

SEQ ID NO: 431648 - DNA, 16 bp, M. musculus
tcaggtggaaactgaa

SEQ ID NO: 431649 - DNA, 16 bp, M. musculus
tcaggtggagaagata

SEQ ID NO: 431650 - DNA, 17 bp, M. musculus
tcaggtggatttctgag

SEQ ID NO: 431651 - DNA, 16 bp, M. musculus
tcaggtggcagtgcag

SEQ ID NO: 431652 - DNA, 16 bp, M. musculus
tcaggtggctcacagt

SEQ ID NO: 431653 - DNA, 16 bp, M. musculus
tcaggtggctgaggca

SEQ ID NO: 431654 - DNA, 16 bp, M. musculus
tcaggtgtaattctga

SEQ ID NO: 431655 - DNA, 16 bp, M. musculus
tcaggtgtcagcagat

SEQ ID NO: 431656 - DNA, 16 bp, M. musculus
tcaggtgtccataggt

SEQ ID NO: 431657 - DNA, 16 bp, M. musculus
tcaggtgtctttctca

SEQ ID NO: 431658 - DNA, 16 bp, M. musculus
tcaggtgtggtggcac

SEQ ID NO: 431659 - DNA, 16 bp, M. musculus
tcaggtgtttctcagc

SEQ ID NO: 431660 - DNA, 16 bp, M. musculus
tcaggttcctctccat

SEQ ID NO: 431661 - DNA, 16 bp, M. musculus
tcaggttctctaaaat

SEQ ID NO: 431662 - DNA, 16 bp, M. musculus
tcaggttggcctcaaa

SEQ ID NO: 431663 - DNA, 16 bp, M. musculus
tcaggttggccttgaa

SEQ ID NO: 431664 - DNA, 16 bp, M. musculus
tcaggtttccaggctt

SEQ ID NO: 431665 - DNA, 16 bp, M. musculus
tcaggtttgacagcaa

SEQ ID NO: 431666 - DNA, 16 bp, M. musculus
tcaggtttggtggcaa

SEQ ID NO: 431667 - DNA, 16 bp, M. musculus
tcaggttttctttgaa

SEQ ID NO: 431668 - DNA, 16 bp, M. musculus
tcagtaaagtctattt

SEQ ID NO: 431669 - DNA, 16 bp, M. musculus
tcagtaaagtgcttgt

SEQ ID NO: 431670 - DNA, 16 bp, M. musculus
tcagtaaatatttgtt

SEQ ID NO: 431671 - DNA, 16 bp, M. musculus
tcagtaacaacaaaaa

SEQ ID NO: 431672 - DNA, 16 bp, M. musculus
tcagtaacattcagaa

SEQ ID NO: 431673 - DNA, 16 bp, M. musculus
tcagtaagagactctg

SEQ ID NO: 431674 - DNA, 16 bp, M. musculus
tcagtaaggccaagat

SEQ ID NO: 431675 - DNA, 16 bp, M. musculus
tcagtaattaagagca

SEQ ID NO: 431676 - DNA, 16 bp, M. musculus
tcagtacctgtggctc

SEQ ID NO: 431677 - DNA, 16 bp, M. musculus
tcagtagaagaagatg

SEQ ID NO: 431678 - DNA, 16 bp, M. musculus
tcagtagcttttctat

SEQ ID NO: 431679 - DNA, 16 bp, M. musculus
tcagtattattttatt

SEQ ID NO: 431680 - DNA, 16 bp, M. musculus
tcagtatttccatctt

SEQ ID NO: 431681 - DNA, 16 bp, M. musculus
tcagtcaaagaaaatg

SEQ ID NO: 431682 - DNA, 16 bp, M. musculus
tcagtcaaagaagatg

SEQ ID NO: 431683 - DNA, 16 bp, M. musculus
tcagtcaagagcagag

SEQ ID NO: 431684 - DNA, 16 bp, M. musculus
tcagtcacaaaacaga

SEQ ID NO: 431685 - DNA, 16 bp, M. musculus
tcagtcacaaagcaaa

SEQ ID NO: 431686 - DNA, 16 bp, M. musculus
tcagtcacacagataa

SEQ ID NO: 431687 - DNA, 16 bp, M. musculus
tcagtcactccatacc

SEQ ID NO: 431688 - DNA, 16 bp, M. musculus
tcagtcagctgcttgt

SEQ ID NO: 431689 - DNA, 16 bp, M. musculus
tcagtcagctgggaga

SEQ ID NO: 431690 - DNA, 16 bp, M. musculus
tcagtcaggggcagag

SEQ ID NO: 431691 - DNA, 16 bp, M. musculus
tcagtcagtctctctc

SEQ ID NO: 431692 - DNA, 16 bp, M. musculus
tcagtcatttttttct

SEQ ID NO: 431693 - DNA, 16 bp, M. musculus
tcagtccaatggttgg

SEQ ID NO: 431694 - DNA, 17 bp, M. musculus
tcagtccattatcacca

SEQ ID NO: 431695 - DNA, 16 bp, M. musculus
tcagtccattatcatt

SEQ ID NO: 431696 - DNA, 16 bp, M. musculus
tcagtccccagcaccc

SEQ ID NO: 431697 - DNA, 16 bp, M. musculus
tcagtcccccaaaact

SEQ ID NO: 431698 - DNA, 16 bp, M. musculus
tcagtccctgcttgct

SEQ ID NO: 431699 - DNA, 16 bp, M. musculus
tcagtccctgtttgct

SEQ ID NO: 431700 - DNA, 16 bp, M. musculus
tcagtcccttgtcctg

SEQ ID NO: 431701 - DNA, 16 bp, M. musculus
tcagtccttcccctaa

SEQ ID NO: 431702 - DNA, 16 bp, M. musculus
tcagtccttcctctaa

SEQ ID NO: 431703 - DNA, 16 bp, M. musculus
tcagtcgtctggacct

SEQ ID NO: 431704 - DNA, 16 bp, M. musculus
tcagtctaatggttgg

SEQ ID NO: 431705 - DNA, 16 bp, M. musculus
tcagtctatgctccac

SEQ ID NO: 431706 - DNA, 17 bp, M. musculus
tcagtctctctctctct

SEQ ID NO: 431707 - DNA, 16 bp, M. musculus
tcagtctctgctctat

SEQ ID NO: 431708 - DNA, 16 bp, M. musculus
tcagtctctgcttcct

SEQ ID NO: 431709 - DNA, 16 bp, M. musculus
tcagtctgcagcagat

SEQ ID NO: 431710 - DNA, 16 bp, M. musculus
tcagtctgctttctca

SEQ ID NO: 431711 - DNA, 16 bp, M. musculus
tcagtctgggacccca

SEQ ID NO: 431712 - DNA, 16 bp, M. musculus
tcagtcttcctgcctc

SEQ ID NO: 431713 - DNA, 16 bp, M. musculus
tcagtcttctcctgtt

SEQ ID NO: 431714 - DNA, 16 bp, M. musculus
tcagtcttgcagttcc

SEQ ID NO: 431715 - DNA, 16 bp, M. musculus
tcagtgaagaaagcaa

SEQ ID NO: 431716 - DNA, 16 bp, M. musculus
tcagtgaagtcagttt

SEQ ID NO: 431717 - DNA, 16 bp, M. musculus
tcagtgactagtctgc

SEQ ID NO: 431718 - DNA, 16 bp, M. musculus
tcagtgactctggttt

SEQ ID NO: 431719 - DNA, 16 bp, M. musculus
tcagtgagagaccctg

SEQ ID NO: 431720 - DNA, 16 bp, M. musculus
tcagtgagccccaggg

SEQ ID NO: 431721 - DNA, 16 bp, M. musculus
tcagtgatcacatctg

SEQ ID NO: 431722 - DNA, 16 bp, M. musculus
tcagtgatcctaagat

SEQ ID NO: 431723 - DNA, 16 bp, M. musculus
tcagtgatgaacaatg

SEQ ID NO: 431724 - DNA, 16 bp, M. musculus
tcagtgatgggctgtg

SEQ ID NO: 431725 - DNA, 16 bp, M. musculus
tcagtgcaggaactca

SEQ ID NO: 431726 - DNA, 16 bp, M. musculus
tcagtgcagggtggca

SEQ ID NO: 431727 - DNA, 16 bp, M. musculus
tcagtgcagtagctga

SEQ ID NO: 431728 - DNA, 16 bp, M. musculus
tcagtgccagcactgg

SEQ ID NO: 431729 - DNA, 16 bp, M. musculus
tcagtgccctgactga

SEQ ID NO: 431730 - DNA, 16 bp, M. musculus
tcagtgctctccttcc

SEQ ID NO: 431731 - DNA, 16 bp, M. musculus
tcagtgctgttaactg

SEQ ID NO: 431732 - DNA, 16 bp, M. musculus
tcagtgcttttaatca

SEQ ID NO: 431733 - DNA, 16 bp, M. musculus
tcagtggaaagaaagg

SEQ ID NO: 431734 - DNA, 16 bp, M. musculus
tcagtggacagtccca

SEQ ID NO: 431735 - DNA, 16 bp, M. musculus
tcagtggagaagaact

SEQ ID NO: 431736 - DNA, 16 bp, M. musculus
tcagtggattcaattc

SEQ ID NO: 431737 - DNA, 16 bp, M. musculus
tcagtggcaaagcact

SEQ ID NO: 431738 - DNA, 16 bp, M. musculus
tcagtggcagagtgct

SEQ ID NO: 431739 - DNA, 16 bp, M. musculus
tcagtggccattctct

SEQ ID NO: 431740 - DNA, 16 bp, M. musculus
tcagtggcctttcttt

SEQ ID NO: 431741 - DNA, 16 bp, M. musculus
tcagtgggaaagaatg

SEQ ID NO: 431742 - DNA, 16 bp, M. musculus
tcagtgggagaggaca

SEQ ID NO: 431743 - DNA, 16 bp, M. musculus
tcagtgggaggagatg

SEQ ID NO: 431744 - DNA, 16 bp, M. musculus
tcagtgggaggagcag

SEQ ID NO: 431745 - DNA, 16 bp, M. musculus
tcagtgggaggggagg

SEQ ID NO: 431746 - DNA, 16 bp, M. musculus
tcagtgggcagagtgc

SEQ ID NO: 431747 - DNA, 16 bp, M. musculus
tcagtgggctagaagg

SEQ ID NO: 431748 - DNA, 16 bp, M. musculus
tcagtgggggagggcc

SEQ ID NO: 431749 - DNA, 16 bp, M. musculus
tcagtgggtaaaagtg

SEQ ID NO: 431750 - DNA, 16 bp, M. musculus
tcagtgggtaaagatg

SEQ ID NO: 431751 - DNA, 16 bp, M. musculus
tcagtgggtacaggca

SEQ ID NO: 431752 - DNA, 16 bp, M. musculus
tcagtgggtagagtgt

SEQ ID NO: 431753 - DNA, 16 bp, M. musculus
tcagtggtagagaatt

SEQ ID NO: 431754 - DNA, 16 bp, M. musculus
tcagtggtcaagaaca

SEQ ID NO: 431755 - DNA, 16 bp, M. musculus
tcagtggtcaggagca

SEQ ID NO: 431756 - DNA, 16 bp, M. musculus
tcagtggtgaagagtg

SEQ ID NO: 431757 - DNA, 16 bp, M. musculus
tcagtggttaaaagtg

SEQ ID NO: 431758 - DNA, 16 bp, M. musculus
tcagtggttaaaggtg

SEQ ID NO: 431759 - DNA, 16 bp, M. musculus
tcagtggttaaagtgc

SEQ ID NO: 431760 - DNA, 16 bp, M. musculus
tcagtggttaagagag

SEQ ID NO: 431761 - DNA, 16 bp, M. musculus
tcagtggttaaggaca

SEQ ID NO: 431762 - DNA, 16 bp, M. musculus
tcagtggttaggaaca

SEQ ID NO: 431763 - DNA, 16 bp, M. musculus
tcagtgtctgagaaat

SEQ ID NO: 431764 - DNA, 16 bp, M. musculus
tcagtgtgtgacatat

SEQ ID NO: 431765 - DNA, 16 bp, M. musculus
tcagtgttccaacagt

SEQ ID NO: 431766 - DNA, 16 bp, M. musculus
tcagtgttctttccca

SEQ ID NO: 431767 - DNA, 16 bp, M. musculus
tcagtgttggtttctg

SEQ ID NO: 431768 - DNA, 16 bp, M. musculus
tcagtgtttaagagtg

SEQ ID NO: 431769 - DNA, 16 bp, M. musculus
tcagtgtttctgattt

SEQ ID NO: 431770 - DNA, 16 bp, M. musculus
tcagtgtttggaagct

SEQ ID NO: 431771 - DNA, 16 bp, M. musculus
tcagtgttttattaca

SEQ ID NO: 431772 - DNA, 16 bp, M. musculus
tcagttagcgagaatt

SEQ ID NO: 431773 - DNA, 18 bp, M. musculus
tcagttcagcatgtctga

SEQ ID NO: 431774 - DNA, 16 bp, M. musculus
tcagttcccaacactc

SEQ ID NO: 431775 - DNA, 16 bp, M. musculus
tcagttcccagaactc

SEQ ID NO: 431776 - DNA, 16 bp, M. musculus
tcagttcccagcagct

SEQ ID NO: 431777 - DNA, 16 bp, M. musculus
tcagttcccaggacct

SEQ ID NO: 431778 - DNA, 16 bp, M. musculus
tcagttcccatccatg

SEQ ID NO: 431779 - DNA, 16 bp, M. musculus
tcagttccctggtgac

SEQ ID NO: 431780 - DNA, 16 bp, M. musculus
tcagttcctagcacct

SEQ ID NO: 431781 - DNA, 16 bp, M. musculus
tcagttcctgctttct

SEQ ID NO: 431782 - DNA, 16 bp, M. musculus
tcagttctctcttcca

SEQ ID NO: 431783 - DNA, 16 bp, M. musculus
tcagttctctgcttcc

SEQ ID NO: 431784 - DNA, 16 bp, M. musculus
tcagttctctgcttct

SEQ ID NO: 431785 - DNA, 16 bp, M. musculus
tcagttctgttcctct

SEQ ID NO: 431786 - DNA, 16 bp, M. musculus
tcagttctgtttctct

SEQ ID NO: 431787 - DNA, 16 bp, M. musculus
tcagttcttcacagga

SEQ ID NO: 431788 - DNA, 16 bp, M. musculus
tcagttctttccttct

SEQ ID NO: 431789 - DNA, 16 bp, M. musculus
tcagttgagatttcct

SEQ ID NO: 431790 - DNA, 16 bp, M. musculus
tcagttgaggaaaggc

SEQ ID NO: 431791 - DNA, 16 bp, M. musculus
tcagttgtcaaaaaca

SEQ ID NO: 431792 - DNA, 16 bp, M. musculus
tcagttgtcaacttga

SEQ ID NO: 431793 - DNA, 16 bp, M. musculus
tcagttgtttaaaaaa

SEQ ID NO: 431794 - DNA, 16 bp, M. musculus
tcagttgtttgtttgt

SEQ ID NO: 431795 - DNA, 16 bp, M. musculus
tcagtttaaaaaaaaa

SEQ ID NO: 431796 - DNA, 16 bp, M. musculus
tcagtttagttctata

SEQ ID NO: 431797 - DNA, 16 bp, M. musculus
tcagtttagttctgta

SEQ ID NO: 431798 - DNA, 16 bp, M. musculus
tcagtttatatatata

SEQ ID NO: 431799 - DNA, 16 bp, M. musculus
tcagtttccaagtgaa

SEQ ID NO: 431800 - DNA, 16 bp, M. musculus
tcagtttccatcagtt

SEQ ID NO: 431801 - DNA, 16 bp, M. musculus
tcagtttcccaaatgc

SEQ ID NO: 431802 - DNA, 16 bp, M. musculus
tcagtttcccctctgt

SEQ ID NO: 431803 - DNA, 16 bp, M. musculus
tcagtttcctccttcc

SEQ ID NO: 431804 - DNA, 16 bp, M. musculus
tcagtttctagcacct

SEQ ID NO: 431805 - DNA, 16 bp, M. musculus
tcagtttctcagaaaa

SEQ ID NO: 431806 - DNA, 16 bp, M. musculus
tcagtttctgctccat

SEQ ID NO: 431807 - DNA, 16 bp, M. musculus
tcagtttctgctctga

SEQ ID NO: 431808 - DNA, 16 bp, M. musculus
tcagtttcttcctctg

SEQ ID NO: 431809 - DNA, 16 bp, M. musculus
tcagtttcttctttga

SEQ ID NO: 431810 - DNA, 16 bp, M. musculus
tcagtttgcaaggatt

SEQ ID NO: 431811 - DNA, 16 bp, M. musculus
tcagtttgcagagagc

SEQ ID NO: 431812 - DNA, 16 bp, M. musculus
tcagtttgtattttct

SEQ ID NO: 431813 - DNA, 16 bp, M. musculus
tcagttttcccatctg

SEQ ID NO: 431814 - DNA, 16 bp, M. musculus
tcagttttctccagtg

SEQ ID NO: 431815 - DNA, 16 bp, M. musculus
tcagttttctcctttc

SEQ ID NO: 431816 - DNA, 16 bp, M. musculus
tcagttttctgaggaa

SEQ ID NO: 431817 - DNA, 16 bp, M. musculus
tcagttttctgttgct

SEQ ID NO: 431818 - DNA, 16 bp, M. musculus
tcagttttggttttgt

SEQ ID NO: 431819 - DNA, 16 bp, M. musculus
tcagttttgttttggt

SEQ ID NO: 431820 - DNA, 16 bp, M. musculus
tcagtttttaaaatct

SEQ ID NO: 431821 - DNA, 16 bp, M. musculus
tcagtttttacatttt

SEQ ID NO: 431822 - DNA, 16 bp, M. musculus
tcagtttttcaagaca

SEQ ID NO: 431823 - DNA, 16 bp, M. musculus
tcagttttttccttcc

SEQ ID NO: 431824 - DNA, 16 bp, M. musculus
tcataaaaaggaaact

SEQ ID NO: 431825 - DNA, 16 bp, M. musculus
tcataaaagaaaacat

SEQ ID NO: 431826 - DNA, 16 bp, M. musculus
tcataaaagaaacatt

SEQ ID NO: 431827 - DNA, 16 bp, M. musculus
tcataaaataagtaaa

SEQ ID NO: 431828 - DNA, 16 bp, M. musculus
tcataaaatgaatttg

SEQ ID NO: 431829 - DNA, 16 bp, M. musculus
tcataaaattatttct

SEQ ID NO: 431830 - DNA, 16 bp, M. musculus
tcataaagatgataga

SEQ ID NO: 431831 - DNA, 16 bp, M. musculus
tcataaatgaaataaa

SEQ ID NO: 431832 - DNA, 16 bp, M. musculus
tcataacactagcaaa

SEQ ID NO: 431833 - DNA, 16 bp, M. musculus
tcataacagcagcaaa

SEQ ID NO: 431834 - DNA, 16 bp, M. musculus
tcataacagtagcaat

SEQ ID NO: 431835 - DNA, 16 bp, M. musculus
tcataacggtagcaaa

SEQ ID NO: 431836 - DNA, 16 bp, M. musculus
tcataactatctgtaa

SEQ ID NO: 431837 - DNA, 16 bp, M. musculus
tcataagagatttttt

SEQ ID NO: 431838 - DNA, 17 bp, M. musculus
tcataatagccagaaat

SEQ ID NO: 431839 - DNA, 16 bp, M. musculus
tcataatcataataat

SEQ ID NO: 431840 - DNA, 16 bp, M. musculus
tcataatgataatgga

SEQ ID NO: 431841 - DNA, 16 bp, M. musculus
tcataatgatgatgga

SEQ ID NO: 431842 - DNA, 16 bp, M. musculus
tcataatgctttgtct

SEQ ID NO: 431843 - DNA, 16 bp, M. musculus
tcataatgtaaatact

SEQ ID NO: 431844 - DNA, 16 bp, M. musculus
tcataatgtaaatatt

SEQ ID NO: 431845 - DNA, 24 bp, M. musculus
tcataatgttgttccacctatagg

SEQ ID NO: 431846 - DNA, 16 bp, M. musculus
tcatacaaggagataa

SEQ ID NO: 431847 - DNA, 16 bp, M. musculus
tcatacacagacacac

SEQ ID NO: 431848 - DNA, 16 bp, M. musculus
tcatacacataaaata

SEQ ID NO: 431849 - DNA, 16 bp, M. musculus
tcatacacctgaaaat

SEQ ID NO: 431850 - DNA, 16 bp, M. musculus
tcatacacgtaaaata

SEQ ID NO: 431851 - DNA, 16 bp, M. musculus
tcatacagaagagaaa

SEQ ID NO: 431852 - DNA, 16 bp, M. musculus
tcatacagatttttca

SEQ ID NO: 431853 - DNA, 16 bp, M. musculus
tcatacagttctttca

SEQ ID NO: 431854 - DNA, 16 bp, M. musculus
tcatacatataaagta

SEQ ID NO: 431855 - DNA, 16 bp, M. musculus
tcatactaaatggaga

SEQ ID NO: 431856 - DNA, 16 bp, M. musculus
tcatagaactctgcac

SEQ ID NO: 431857 - DNA, 16 bp, M. musculus
tcatagaagaaaaatt

SEQ ID NO: 431858 - DNA, 16 bp, M. musculus
tcatagaagcagaagg

SEQ ID NO: 431859 - DNA, 16 bp, M. musculus
tcatagaagcagaggg

SEQ ID NO: 431860 - DNA, 16 bp, M. musculus
tcatagaaggaattgg

SEQ ID NO: 431861 - DNA, 16 bp, M. musculus
tcatagaggagaaagt

SEQ ID NO: 431862 - DNA, 16 bp, M. musculus
tcatagagttagaaaa

SEQ ID NO: 431863 - DNA, 16 bp, M. musculus
tcatagatgaaaactt

SEQ ID NO: 431864 - DNA, 16 bp, M. musculus
tcatagatgcaaacat

SEQ ID NO: 431865 - DNA, 16 bp, M. musculus
tcatagatggagaaga

SEQ ID NO: 431866 - DNA, 16 bp, M. musculus
tcatagcagcagcaaa

SEQ ID NO: 431867 - DNA, 16 bp, M. musculus
tcatagcaggtgatta

SEQ ID NO: 431868 - DNA, 16 bp, M. musculus
tcatagccctgagtgt

SEQ ID NO: 431869 - DNA, 16 bp, M. musculus
tcatagctcctcccag

SEQ ID NO: 431870 - DNA, 16 bp, M. musculus
tcatagctctgagtac

SEQ ID NO: 431871 - DNA, 16 bp, M. musculus
tcatagctctgagttc

SEQ ID NO: 431872 - DNA, 16 bp, M. musculus
tcataggagaagggga

SEQ ID NO: 431873 - DNA, 16 bp, M. musculus
tcatagttttgttttg

SEQ ID NO: 431874 - DNA, 16 bp, M. musculus
tcatatacccagaaga

SEQ ID NO: 431875 - DNA, 16 bp, M. musculus
tcatatataatataca

SEQ ID NO: 431876 - DNA, 16 bp, M. musculus
tcatatatgcatgtgt

SEQ ID NO: 431877 - DNA, 16 bp, M. musculus
tcatatatgtgtatgt

SEQ ID NO: 431878 - DNA, 16 bp, M. musculus
tcatatattttggata

SEQ ID NO: 431879 - DNA, 16 bp, M. musculus
tcatatcacctgcaaa

SEQ ID NO: 431880 - DNA, 16 bp, M. musculus
tcatatctacaataaa

SEQ ID NO: 431881 - DNA, 16 bp, M. musculus
tcatatctataataaa

SEQ ID NO: 431882 - DNA, 16 bp, M. musculus
tcatatgcaaaagcaa

SEQ ID NO: 431883 - DNA, 16 bp, M. musculus
tcatatgcacacacac

SEQ ID NO: 431884 - DNA, 16 bp, M. musculus
tcatatgccagcaaga

SEQ ID NO: 431885 - DNA, 16 bp, M. musculus
tcatattccattgtgt

SEQ ID NO: 431886 - DNA, 16 bp, M. musculus
tcatattgatttccat

SEQ ID NO: 431887 - DNA, 16 bp, M. musculus
tcatattgctctggct

SEQ ID NO: 431888 - DNA, 16 bp, M. musculus
tcatcaaaagagacaa

SEQ ID NO: 431889 - DNA, 16 bp, M. musculus
tcatcaaaatcttgtt

SEQ ID NO: 431890 - DNA, 16 bp, M. musculus
tcatcaaagaaaaaat

SEQ ID NO: 431891 - DNA, 16 bp, M. musculus
tcatcaaagaaatgca

SEQ ID NO: 431892 - DNA, 16 bp, M. musculus
tcatcaaaggaaaaaa

SEQ ID NO: 431893 - DNA, 16 bp, M. musculus
tcatcaaaggacagat

SEQ ID NO: 431894 - DNA, 16 bp, M. musculus
tcatcaagaaaacaaa

SEQ ID NO: 431895 - DNA, 16 bp, M. musculus
tcatcaagaaaataaa

SEQ ID NO: 431896 - DNA, 16 bp, M. musculus
tcatcaagcacttctt

SEQ ID NO: 431897 - DNA, 16 bp, M. musculus
tcatcaaggcagaaac

SEQ ID NO: 431898 - DNA, 16 bp, M. musculus
tcatcaaggcaggacc

SEQ ID NO: 431899 - DNA, 17 bp, M. musculus
tcatcaaggctggagca

SEQ ID NO: 431900 - DNA, 16 bp, M. musculus
tcatcaaggctgtgct

SEQ ID NO: 431901 - DNA, 16 bp, M. musculus
tcatcaatgaaggaag

SEQ ID NO: 431902 - DNA, 16 bp, M. musculus
tcatcaatggaaaaat

SEQ ID NO: 431903 - DNA, 16 bp, M. musculus
tcatcaccaaaggcag

SEQ ID NO: 431904 - DNA, 16 bp, M. musculus
tcatcaccaagaaagt

SEQ ID NO: 431905 - DNA, 16 bp, M. musculus
tcatcaccaaggaaat

SEQ ID NO: 431906 - DNA, 16 bp, M. musculus
tcatcaccaccaccat

SEQ ID NO: 431907 - DNA, 16 bp, M. musculus
tcatcaccaccatcat

SEQ ID NO: 431908 - DNA, 16 bp, M. musculus
tcatcaccatcaccat

SEQ ID NO: 431909 - DNA, 16 bp, M. musculus
tcatcaccatcatcac

SEQ ID NO: 431910 - DNA, 16 bp, M. musculus
tcatcactgaaggaaa

SEQ ID NO: 431911 - DNA, 16 bp, M. musculus
tcatcactgagggaag

SEQ ID NO: 431912 - DNA, 16 bp, M. musculus
tcatcagaatccagca

SEQ ID NO: 431913 - DNA, 16 bp, M. musculus
tcatcagagaagattc

SEQ ID NO: 431914 - DNA, 16 bp, M. musculus
tcatcagagaagcttc

SEQ ID NO: 431915 - DNA, 16 bp, M. musculus
tcatcagcatcagcat

SEQ ID NO: 431916 - DNA, 17 bp, M. musculus
tcatcagctttatcatg

SEQ ID NO: 431917 - DNA, 16 bp, M. musculus
tcatcaggagcaagag

SEQ ID NO: 431918 - DNA, 16 bp, M. musculus
tcatcaggagcaggag

SEQ ID NO: 431919 - DNA, 16 bp, M. musculus
tcatcaggctgggcag

SEQ ID NO: 431920 - DNA, 16 bp, M. musculus
tcatcaggcttggcag

SEQ ID NO: 431921 - DNA, 16 bp, M. musculus
tcatcaggggaaatgc

SEQ ID NO: 431922 - DNA, 16 bp, M. musculus
tcatcagtcaagaaaa

SEQ ID NO: 431923 - DNA, 16 bp, M. musculus
tcatcagtgaagacca

SEQ ID NO: 431924 - DNA, 16 bp, M. musculus
tcatcagtgtgtgtgt

SEQ ID NO: 431925 - DNA, 16 bp, M. musculus
tcatcatagcaggaag

SEQ ID NO: 431926 - DNA, 16 bp, M. musculus
tcatcatcaccattat

SEQ ID NO: 431927 - DNA, 16 bp, M. musculus
tcatcatcatcatctc

SEQ ID NO: 431928 - DNA, 16 bp, M. musculus
tcatcatcatcatgat

SEQ ID NO: 431929 - DNA, 16 bp, M. musculus
tcatcatcatcattct

SEQ ID NO: 431930 - DNA, 16 bp, M. musculus
tcatcatcatctcctc

SEQ ID NO: 431931 - DNA, 16 bp, M. musculus
tcatcatcatcttctt

SEQ ID NO: 431932 - DNA, 16 bp, M. musculus
tcatcatcatgaaaaa

SEQ ID NO: 431933 - DNA, 16 bp, M. musculus
tcatcatcattattgt

SEQ ID NO: 431934 - DNA, 16 bp, M. musculus
tcatcatctcagatct

SEQ ID NO: 431935 - DNA, 16 bp, M. musculus
tcatcatcttcctcct

SEQ ID NO: 431936 - DNA, 21 bp, M. musculus
tcatcatgaaaataatcatac

SEQ ID NO: 431937 - DNA, 26 bp, M. musculus
tcatcatgagatatgcttttaaatca

SEQ ID NO: 431938 - DNA, 16 bp, M. musculus
tcatcatgatcatcat

SEQ ID NO: 431939 - DNA, 16 bp, M. musculus
tcatcatggaaaatgg

SEQ ID NO: 431940 - DNA, 16 bp, M. musculus
tcatcattatcatcat

SEQ ID NO: 431941 - DNA, 16 bp, M. musculus
tcatcattgaagacag

SEQ ID NO: 431942 - DNA, 16 bp, M. musculus
tcatccaagctgcctg

SEQ ID NO: 431943 - DNA, 16 bp, M. musculus
tcatccacatactgta

SEQ ID NO: 431944 - DNA, 16 bp, M. musculus
tcatccacccatccat

SEQ ID NO: 431945 - DNA, 16 bp, M. musculus
tcatccagacaaaaac

SEQ ID NO: 431946 - DNA, 16 bp, M. musculus
tcatccagagaagtca

SEQ ID NO: 431947 - DNA, 16 bp, M. musculus
tcatccaggctggcct

SEQ ID NO: 431948 - DNA, 16 bp, M. musculus
tcatccagggaagcca

SEQ ID NO: 431949 - DNA, 16 bp, M. musculus
tcatccagttgttttt

SEQ ID NO: 431950 - DNA, 17 bp, M. musculus
tcatccatactgaccaa

SEQ ID NO: 431951 - DNA, 16 bp, M. musculus
tcatccatcctggcca

SEQ ID NO: 431952 - DNA, 16 bp, M. musculus
tcatccatgctgccac

SEQ ID NO: 431953 - DNA, 16 bp, M. musculus
tcatccatggcttttt

SEQ ID NO: 431954 - DNA, 16 bp, M. musculus
tcatccatttgcctac

SEQ ID NO: 431955 - DNA, 16 bp, M. musculus
tcatcccagagatgaa

SEQ ID NO: 431956 - DNA, 16 bp, M. musculus
tcatcccagagattca

SEQ ID NO: 431957 - DNA, 16 bp, M. musculus
tcatcccagcaatagt

SEQ ID NO: 431958 - DNA, 16 bp, M. musculus
tcatcccagccctggg

SEQ ID NO: 431959 - DNA, 16 bp, M. musculus
tcatcccaggaatgca

SEQ ID NO: 431960 - DNA, 16 bp, M. musculus
tcatcccaggatttct

SEQ ID NO: 431961 - DNA, 16 bp, M. musculus
tcatcccatgggctgg

SEQ ID NO: 431962 - DNA, 16 bp, M. musculus
tcatccccagcaccca

SEQ ID NO: 431963 - DNA, 16 bp, M. musculus
tcatccctcagatgct

SEQ ID NO: 431964 - DNA, 16 bp, M. musculus
tcatcctcatcctcct

SEQ ID NO: 431965 - DNA, 16 bp, M. musculus
tcatcctcctcgtcct

SEQ ID NO: 431966 - DNA, 16 bp, M. musculus
tcatcctcctgcctca

SEQ ID NO: 431967 - DNA, 16 bp, M. musculus
tcatcctctgctacat

SEQ ID NO: 431968 - DNA, 16 bp, M. musculus
tcatcctctgcttcat

SEQ ID NO: 431969 - DNA, 16 bp, M. musculus
tcatcctgaatgaagt

SEQ ID NO: 431970 - DNA, 16 bp, M. musculus
tcatcctgggctacag

SEQ ID NO: 431971 - DNA, 16 bp, M. musculus
tcatcctggtctacag

SEQ ID NO: 431972 - DNA, 16 bp, M. musculus
tcatccttggccacat

SEQ ID NO: 431973 - DNA, 16 bp, M. musculus
tcatcgtcatcatcat

SEQ ID NO: 431974 - DNA, 16 bp, M. musculus
tcatcgttgtcatcat

SEQ ID NO: 431975 - DNA, 16 bp, M. musculus
tcatcgttgttgttgt

SEQ ID NO: 431976 - DNA, 16 bp, M. musculus
tcatctacctgtctgt

SEQ ID NO: 431977 - DNA, 16 bp, M. musculus
tcatctataagatgaa

SEQ ID NO: 431978 - DNA, 16 bp, M. musculus
tcatctataattttgt

SEQ ID NO: 431979 - DNA, 16 bp, M. musculus
tcatctatgggaggag

SEQ ID NO: 431980 - DNA, 16 bp, M. musculus
tcatctatttatctac

SEQ ID NO: 431981 - DNA, 16 bp, M. musculus
tcatctcaatcctttc

SEQ ID NO: 431982 - DNA, 16 bp, M. musculus
tcatctcaccaatccc

SEQ ID NO: 431983 - DNA, 17 bp, M. musculus
tcatctcagctccaaac

SEQ ID NO: 431984 - DNA, 16 bp, M. musculus
tcatctcatgtttaaa

SEQ ID NO: 431985 - DNA, 16 bp, M. musculus
tcatctccccctgccc

SEQ ID NO: 431986 - DNA, 16 bp, M. musculus
tcatctccctgtccct

SEQ ID NO: 431987 - DNA, 16 bp, M. musculus
tcatctcctgcttcct

SEQ ID NO: 431988 - DNA, 16 bp, M. musculus
tcatctctaagatgga

SEQ ID NO: 431989 - DNA, 16 bp, M. musculus
tcatctctccctccat

SEQ ID NO: 431990 - DNA, 16 bp, M. musculus
tcatctctccctgctt

SEQ ID NO: 431991 - DNA, 16 bp, M. musculus
tcatctctctctgctt

SEQ ID NO: 431992 - DNA, 16 bp, M. musculus
tcatctctctgcctcc

SEQ ID NO: 431993 - DNA, 16 bp, M. musculus
tcatctctcttgcttc

SEQ ID NO: 431994 - DNA, 16 bp, M. musculus
tcatctgaaggccgct

SEQ ID NO: 431995 - DNA, 16 bp, M. musculus
tcatctgaaggtcact

SEQ ID NO: 431996 - DNA, 16 bp, M. musculus
tcatctgacctccaca

SEQ ID NO: 431997 - DNA, 16 bp, M. musculus
tcatctgagagaaaag

SEQ ID NO: 431998 - DNA, 16 bp, M. musculus
tcatctgagaggaaag

SEQ ID NO: 431999 - DNA, 17 bp, M. musculus
tcatctgcaaaaagtga

SEQ ID NO: 432000 - DNA, 16 bp, M. musculus
tcatctgcaaaatggg

SEQ ID NO: 432001 - DNA, 16 bp, M. musculus
tcatctgcaagaagtg

SEQ ID NO: 432002 - DNA, 16 bp, M. musculus
tcatctgcaagagcag

SEQ ID NO: 432003 - DNA, 16 bp, M. musculus
tcatctgcactgctct

SEQ ID NO: 432004 - DNA, 16 bp, M. musculus
tcatctgcaggctgct

SEQ ID NO: 432005 - DNA, 16 bp, M. musculus
tcatctgctatatatg

SEQ ID NO: 432006 - DNA, 16 bp, M. musculus
tcatctgctgggtgga

SEQ ID NO: 432007 - DNA, 16 bp, M. musculus
tcatctggaaaggaaa

SEQ ID NO: 432008 - DNA, 16 bp, M. musculus
tcatctggaataccaa

SEQ ID NO: 432009 - DNA, 16 bp, M. musculus
tcatctggactctgtt

SEQ ID NO: 432010 - DNA, 16 bp, M. musculus
tcatctggcctcctca

SEQ ID NO: 432011 - DNA, 16 bp, M. musculus
tcatctggtgtatgct

SEQ ID NO: 432012 - DNA, 16 bp, M. musculus
tcatctgtaaaatggg

SEQ ID NO: 432013 - DNA, 16 bp, M. musculus
tcatctgtaaagtggg

SEQ ID NO: 432014 - DNA, 16 bp, M. musculus
tcatctgtgaaatggg

SEQ ID NO: 432015 - DNA, 16 bp, M. musculus
tcatcttcagccagga

SEQ ID NO: 432016 - DNA, 16 bp, M. musculus
tcatcttcatcatcat

SEQ ID NO: 432017 - DNA, 16 bp, M. musculus
tcatcttcatccagga

SEQ ID NO: 432018 - DNA, 16 bp, M. musculus
tcatcttcatcctctt

SEQ ID NO: 432019 - DNA, 16 bp, M. musculus
tcatcttcatcttcct

SEQ ID NO: 432020 - DNA, 16 bp, M. musculus
tcatcttcctgcttct

SEQ ID NO: 432021 - DNA, 16 bp, M. musculus
tcatcttctgccagaa

SEQ ID NO: 432022 - DNA, 16 bp, M. musculus
tcatcttctgctacat

SEQ ID NO: 432023 - DNA, 16 bp, M. musculus
tcatcttctgctagga

SEQ ID NO: 432024 - DNA, 16 bp, M. musculus
tcatcttcttgcctct

SEQ ID NO: 432025 - DNA, 16 bp, M. musculus
tcatcttggaaaattt

SEQ ID NO: 432026 - DNA, 16 bp, M. musculus
tcatctttattatcca

SEQ ID NO: 432027 - DNA, 16 bp, M. musculus
tcatctttgaatgaac

SEQ ID NO: 432028 - DNA, 16 bp, M. musculus
tcatctttggctacat

SEQ ID NO: 432029 - DNA, 16 bp, M. musculus
tcatcttttaaaaaca

SEQ ID NO: 432030 - DNA, 16 bp, M. musculus
tcatcttttgctacat

SEQ ID NO: 432031 - DNA, 16 bp, M. musculus
tcatgaaaccaaaaag

SEQ ID NO: 432032 - DNA, 16 bp, M. musculus
tcatgaaccacagagt

SEQ ID NO: 432033 - DNA, 16 bp, M. musculus
tcatgaagatcctgca

SEQ ID NO: 432034 - DNA, 16 bp, M. musculus
tcatgaaggagctttg

SEQ ID NO: 432035 - DNA, 17 bp, M. musculus
tcatgaagtttgtgcag

SEQ ID NO: 432036 - DNA, 16 bp, M. musculus
tcatgaatccagccct

SEQ ID NO: 432037 - DNA, 16 bp, M. musculus
tcatgaatttgagaag

SEQ ID NO: 432038 - DNA, 16 bp, M. musculus
tcatgacagatggttg

SEQ ID NO: 432039 - DNA, 16 bp, M. musculus
tcatgacagtagcaaa

SEQ ID NO: 432040 - DNA, 16 bp, M. musculus
tcatgacccacaggtt

SEQ ID NO: 432041 - DNA, 16 bp, M. musculus
tcatgactccagctgc

SEQ ID NO: 432042 - DNA, 16 bp, M. musculus
tcatgactcctttggg

SEQ ID NO: 432043 - DNA, 16 bp, M. musculus
tcatgactgccctctg

SEQ ID NO: 432044 - DNA, 16 bp, M. musculus
tcatgacttcttcaag

SEQ ID NO: 432045 - DNA, 16 bp, M. musculus
tcatgagcccctcccc

SEQ ID NO: 432046 - DNA, 16 bp, M. musculus
tcatgagctctccctc

SEQ ID NO: 432047 - DNA, 16 bp, M. musculus
tcatgaggttcctgtg

SEQ ID NO: 432048 - DNA, 16 bp, M. musculus
tcatgagtcaccatgt

SEQ ID NO: 432049 - DNA, 16 bp, M. musculus
tcatgagttctaggcc

SEQ ID NO: 432050 - DNA, 16 bp, M. musculus
tcatgagtttgaggcc

SEQ ID NO: 432051 - DNA, 16 bp, M. musculus
tcatgataaaattctt

SEQ ID NO: 432052 - DNA, 30 bp, M. musculus
tcatgataacaaaatttgtgaatgcaatca

SEQ ID NO: 432053 - DNA, 16 bp, M. musculus
tcatgataatggactg

SEQ ID NO: 432054 - DNA, 16 bp, M. musculus
tcatgatcacatttgg

SEQ ID NO: 432055 - DNA, 16 bp, M. musculus
tcatgatgataatttc

SEQ ID NO: 432056 - DNA, 16 bp, M. musculus
tcatgatgatgggaga

SEQ ID NO: 432057 - DNA, 16 bp, M. musculus
tcatgatgatgttaga

SEQ ID NO: 432058 - DNA, 16 bp, M. musculus
tcatgatggtggtaga

SEQ ID NO: 432059 - DNA, 16 bp, M. musculus
tcatgatgtctttgtt

SEQ ID NO: 432060 - DNA, 16 bp, M. musculus
tcatgatgttattgtt

SEQ ID NO: 432061 - DNA, 16 bp, M. musculus
tcatgatgttctcatt

SEQ ID NO: 432062 - DNA, 16 bp, M. musculus
tcatgatgtttgttca

SEQ ID NO: 432063 - DNA, 16 bp, M. musculus
tcatgatttctggttg

SEQ ID NO: 432064 - DNA, 16 bp, M. musculus
tcatgcaaatcaagag

SEQ ID NO: 432065 - DNA, 16 bp, M. musculus
tcatgcaatatattct

SEQ ID NO: 432066 - DNA, 16 bp, M. musculus
tcatgcacacacatac

SEQ ID NO: 432067 - DNA, 18 bp, M. musculus
tcatgcagtgttttggag

SEQ ID NO: 432068 - DNA, 16 bp, M. musculus
tcatgcatgctaggca

SEQ ID NO: 432069 - DNA, 16 bp, M. musculus
tcatgccaagccactc

SEQ ID NO: 432070 - DNA, 16 bp, M. musculus
tcatgccaggccatta

SEQ ID NO: 432071 - DNA, 16 bp, M. musculus
tcatgcccagcttttt

SEQ ID NO: 432072 - DNA, 16 bp, M. musculus
tcatgccctagaaaaa

SEQ ID NO: 432073 - DNA, 16 bp, M. musculus
tcatgcctaaaaatgt

SEQ ID NO: 432074 - DNA, 16 bp, M. musculus
tcatgcctgaagatgt

SEQ ID NO: 432075 - DNA, 16 bp, M. musculus
tcatgctaaataccaa

SEQ ID NO: 432076 - DNA, 16 bp, M. musculus
tcatgctctagcagag

SEQ ID NO: 432077 - DNA, 16 bp, M. musculus
tcatgctgcagctgga

SEQ ID NO: 432078 - DNA, 16 bp, M. musculus
tcatgctggtgaagat

SEQ ID NO: 432079 - DNA, 16 bp, M. musculus
tcatgctggtgaggat

SEQ ID NO: 432080 - DNA, 16 bp, M. musculus
tcatgctgtactacag

SEQ ID NO: 432081 - DNA, 16 bp, M. musculus
tcatgcttgcaaagca

SEQ ID NO: 432082 - DNA, 16 bp, M. musculus
tcatggaaaaagaaac

SEQ ID NO: 432083 - DNA, 16 bp, M. musculus
tcatggaaactgaaca

SEQ ID NO: 432084 - DNA, 16 bp, M. musculus
tcatggaagctgtagt

SEQ ID NO: 432085 - DNA, 16 bp, M. musculus
tcatggacactgtggt

SEQ ID NO: 432086 - DNA, 16 bp, M. musculus
tcatggactaaacctc

SEQ ID NO: 432087 - DNA, 16 bp, M. musculus
tcatggacttccacat

SEQ ID NO: 432088 - DNA, 16 bp, M. musculus
tcatggagaaacagga

SEQ ID NO: 432089 - DNA, 16 bp, M. musculus
tcatggagagcagctg

SEQ ID NO: 432090 - DNA, 16 bp, M. musculus
tcatggagtatcttgg

SEQ ID NO: 432091 - DNA, 16 bp, M. musculus
tcatggagtggcagga

SEQ ID NO: 432092 - DNA, 16 bp, M. musculus
tcatggagttattaac

SEQ ID NO: 432093 - DNA, 16 bp, M. musculus
tcatggagttctgtct

SEQ ID NO: 432094 - DNA, 16 bp, M. musculus
tcatggataagtggat

SEQ ID NO: 432095 - DNA, 17 bp, M. musculus
tcatggattggcatgat

SEQ ID NO: 432096 - DNA, 16 bp, M. musculus
tcatggcacatgtgtg

SEQ ID NO: 432097 - DNA, 22 bp, M. musculus
tcatggcagttgctagtgacat

SEQ ID NO: 432098 - DNA, 16 bp, M. musculus
tcatggccactattcc

SEQ ID NO: 432099 - DNA, 16 bp, M. musculus
tcatggcctctgtatc

SEQ ID NO: 432100 - DNA, 16 bp, M. musculus
tcatggctctgctccc

SEQ ID NO: 432101 - DNA, 16 bp, M. musculus
tcatgggaacaaatat

SEQ ID NO: 432102 - DNA, 16 bp, M. musculus
tcatgggaatttcttt

SEQ ID NO: 432103 - DNA, 16 bp, M. musculus
tcatgggactttgttt

SEQ ID NO: 432104 - DNA, 16 bp, M. musculus
tcatgggagagagcac

SEQ ID NO: 432105 - DNA, 16 bp, M. musculus
tcatgggataatcaaa

SEQ ID NO: 432106 - DNA, 16 bp, M. musculus
tcatgggatatgcttt

SEQ ID NO: 432107 - DNA, 16 bp, M. musculus
tcatgggatggatctc

SEQ ID NO: 432108 - DNA, 16 bp, M. musculus
tcatgggcatcccttt

SEQ ID NO: 432109 - DNA, 16 bp, M. musculus
tcatgggcatctctgt

SEQ ID NO: 432110 - DNA, 16 bp, M. musculus
tcatgggcatctcttt

SEQ ID NO: 432111 - DNA, 16 bp, M. musculus
tcatgggctgcagcca

SEQ ID NO: 432112 - DNA, 16 bp, M. musculus
tcatgggtccaagctg

SEQ ID NO: 432113 - DNA, 16 bp, M. musculus
tcatgggtccttccat

SEQ ID NO: 432114 - DNA, 16 bp, M. musculus
tcatgggttcctccat

SEQ ID NO: 432115 - DNA, 16 bp, M. musculus
tcatggtaccttctac

SEQ ID NO: 432116 - DNA, 16 bp, M. musculus
tcatggtatctcttca

SEQ ID NO: 432117 - DNA, 16 bp, M. musculus
tcatggtgatgatgga

SEQ ID NO: 432118 - DNA, 16 bp, M. musculus
tcatggtgattctcct

SEQ ID NO: 432119 - DNA, 16 bp, M. musculus
tcatggtggatgatca

SEQ ID NO: 432120 - DNA, 16 bp, M. musculus
tcatggtggggaacat

SEQ ID NO: 432121 - DNA, 16 bp, M. musculus
tcatggtgtcctggat

SEQ ID NO: 432122 - DNA, 16 bp, M. musculus
tcatggtgtctcttca

SEQ ID NO: 432123 - DNA, 16 bp, M. musculus
tcatggtgtctcttcc

SEQ ID NO: 432124 - DNA, 16 bp, M. musculus
tcatggtgtttgtcat

SEQ ID NO: 432125 - DNA, 16 bp, M. musculus
tcatggtttcagagat

SEQ ID NO: 432126 - DNA, 16 bp, M. musculus
tcatggtttcagagtt

SEQ ID NO: 432127 - DNA, 16 bp, M. musculus
tcatggtttcattttt

SEQ ID NO: 432128 - DNA, 16 bp, M. musculus
tcatgtagaaaaatga

SEQ ID NO: 432129 - DNA, 16 bp, M. musculus
tcatgtagaagactgt

SEQ ID NO: 432130 - DNA, 16 bp, M. musculus
tcatgtagcccaagct

SEQ ID NO: 432131 - DNA, 16 bp, M. musculus
tcatgtagcccagact

SEQ ID NO: 432132 - DNA, 16 bp, M. musculus
tcatgtagccctggct

SEQ ID NO: 432133 - DNA, 16 bp, M. musculus
tcatgtagcctaagct

SEQ ID NO: 432134 - DNA, 16 bp, M. musculus
tcatgtaggagaatgc

SEQ ID NO: 432135 - DNA, 16 bp, M. musculus
tcatgtaggctcaaga

SEQ ID NO: 432136 - DNA, 16 bp, M. musculus
tcatgtagtccaggct

SEQ ID NO: 432137 - DNA, 16 bp, M. musculus
tcatgtatatatgtat

SEQ ID NO: 432138 - DNA, 16 bp, M. musculus
tcatgtatttgaacaa

SEQ ID NO: 432139 - DNA, 16 bp, M. musculus
tcatgtattttatgta

SEQ ID NO: 432140 - DNA, 16 bp, M. musculus
tcatgtcagctccaaa

SEQ ID NO: 432141 - DNA, 16 bp, M. musculus
tcatgtctctgtgtgt

SEQ ID NO: 432142 - DNA, 16 bp, M. musculus
tcatgtctcttcacag

SEQ ID NO: 432143 - DNA, 16 bp, M. musculus
tcatgtgacttttttc

SEQ ID NO: 432144 - DNA, 16 bp, M. musculus
tcatgtgagtgctggg

SEQ ID NO: 432145 - DNA, 16 bp, M. musculus
tcatgtgatttttgtt

SEQ ID NO: 432146 - DNA, 16 bp, M. musculus
tcatgtgcattctttt

SEQ ID NO: 432147 - DNA, 16 bp, M. musculus
tcatgtggaagaatgt

SEQ ID NO: 432148 - DNA, 16 bp, M. musculus
tcatgtggacatgaga

SEQ ID NO: 432149 - DNA, 16 bp, M. musculus
tcatgtggcagctcac

SEQ ID NO: 432150 - DNA, 16 bp, M. musculus
tcatgtggctcaggct

SEQ ID NO: 432151 - DNA, 16 bp, M. musculus
tcatgtggtctgggaa

SEQ ID NO: 432152 - DNA, 16 bp, M. musculus
tcatgtggtggtgacc

SEQ ID NO: 432153 - DNA, 19 bp, M. musculus
tcatgtggttgctgggaac

SEQ ID NO: 432154 - DNA, 16 bp, M. musculus
tcatgtggtttttctt

SEQ ID NO: 432155 - DNA, 16 bp, M. musculus
tcatgtgtcctccaca

SEQ ID NO: 432156 - DNA, 16 bp, M. musculus
tcatgtgtggaagtca

SEQ ID NO: 432157 - DNA, 16 bp, M. musculus
tcatgtgtgttatttt

SEQ ID NO: 432158 - DNA, 16 bp, M. musculus
tcatgtgttatgcaaa

SEQ ID NO: 432159 - DNA, 16 bp, M. musculus
tcatgtgttttgtgaa

SEQ ID NO: 432160 - DNA, 16 bp, M. musculus
tcatgttcatgtgtgt

SEQ ID NO: 432161 - DNA, 16 bp, M. musculus
tcatgttcccctttcc

SEQ ID NO: 432162 - DNA, 16 bp, M. musculus
tcatgttgatctgcag

SEQ ID NO: 432163 - DNA, 16 bp, M. musculus
tcatgttggtgagact

SEQ ID NO: 432164 - DNA, 16 bp, M. musculus
tcatgttgtggtgacc

SEQ ID NO: 432165 - DNA, 16 bp, M. musculus
tcatgttttcagagtt

SEQ ID NO: 432166 - DNA, 16 bp, M. musculus
tcatgtttttgaacaa

SEQ ID NO: 432167 - DNA, 16 bp, M. musculus
tcattaaaaacaatga

SEQ ID NO: 432168 - DNA, 16 bp, M. musculus
tcattaaaaggaaaaa

SEQ ID NO: 432169 - DNA, 16 bp, M. musculus
tcattaaaatggaaat

SEQ ID NO: 432170 - DNA, 16 bp, M. musculus
tcattaaactctgaaa

SEQ ID NO: 432171 - DNA, 16 bp, M. musculus
tcattaaaggaacttt

SEQ ID NO: 432172 - DNA, 16 bp, M. musculus
tcattaaggaaaaaaa

SEQ ID NO: 432173 - DNA, 16 bp, M. musculus
tcattaagtcccattt

SEQ ID NO: 432174 - DNA, 17 bp, M. musculus
tcattaccctctgccag

SEQ ID NO: 432175 - DNA, 16 bp, M. musculus
tcattactaaaggaag

SEQ ID NO: 432176 - DNA, 16 bp, M. musculus
tcattagcatggagaa

SEQ ID NO: 432177 - DNA, 16 bp, M. musculus
tcattataaacttagg

SEQ ID NO: 432178 - DNA, 16 bp, M. musculus
tcattatcttgctttt

SEQ ID NO: 432179 - DNA, 16 bp, M. musculus
tcattatggaaatgca

SEQ ID NO: 432180 - DNA, 17 bp, M. musculus
tcattatggatggttgt

SEQ ID NO: 432181 - DNA, 19 bp, M. musculus
tcattatgggtggttgtga

SEQ ID NO: 432182 - DNA, 16 bp, M. musculus
tcattatgtagctcag

SEQ ID NO: 432183 - DNA, 16 bp, M. musculus
tcattattgtagctca

SEQ ID NO: 432184 - DNA, 16 bp, M. musculus
tcattcaaacattaac

SEQ ID NO: 432185 - DNA, 16 bp, M. musculus
tcattcaaaccaacac

SEQ ID NO: 432186 - DNA, 16 bp, M. musculus
tcattcattaaaaata

SEQ ID NO: 432187 - DNA, 16 bp, M. musculus
tcattcattcaaaaat

SEQ ID NO: 432188 - DNA, 16 bp, M. musculus
tcattcattcacttac

SEQ ID NO: 432189 - DNA, 16 bp, M. musculus
tcattcattcatttgt

SEQ ID NO: 432190 - DNA, 16 bp, M. musculus
tcattcatttactcat

SEQ ID NO: 432191 - DNA, 16 bp, M. musculus
tcattcatttcattta

SEQ ID NO: 432192 - DNA, 16 bp, M. musculus
tcattcattttctaaa

SEQ ID NO: 432193 - DNA, 16 bp, M. musculus
tcattccaaacattgt

SEQ ID NO: 432194 - DNA, 16 bp, M. musculus
tcattccaaggatgca

SEQ ID NO: 432195 - DNA, 16 bp, M. musculus
tcattccagggacccc

SEQ ID NO: 432196 - DNA, 16 bp, M. musculus
tcattccatcttctga

SEQ ID NO: 432197 - DNA, 16 bp, M. musculus
tcattcccagcaacca

SEQ ID NO: 432198 - DNA, 16 bp, M. musculus
tcattccccacttctt

SEQ ID NO: 432199 - DNA, 16 bp, M. musculus
tcattccttcagcctc

SEQ ID NO: 432200 - DNA, 16 bp, M. musculus
tcattctaagaaggaa

SEQ ID NO: 432201 - DNA, 16 bp, M. musculus
tcattctaatcaaggg

SEQ ID NO: 432202 - DNA, 16 bp, M. musculus
tcattctaggtcagat

SEQ ID NO: 432203 - DNA, 16 bp, M. musculus
tcattctatgaaacca

SEQ ID NO: 432204 - DNA, 16 bp, M. musculus
tcattctcatccactt

SEQ ID NO: 432205 - DNA, 16 bp, M. musculus
tcattctcatctattc

SEQ ID NO: 432206 - DNA, 16 bp, M. musculus
tcattctcctgaccct

SEQ ID NO: 432207 - DNA, 16 bp, M. musculus
tcattctcctgcctct

SEQ ID NO: 432208 - DNA, 16 bp, M. musculus
tcattctctctgtctc

SEQ ID NO: 432209 - DNA, 16 bp, M. musculus
tcattctgagtgaggt

SEQ ID NO: 432210 - DNA, 16 bp, M. musculus
tcattctgatgggtgt

SEQ ID NO: 432211 - DNA, 16 bp, M. musculus
tcattctgttttccag

SEQ ID NO: 432212 - DNA, 16 bp, M. musculus
tcattcttcacagaaa

SEQ ID NO: 432213 - DNA, 17 bp, M. musculus
tcattcttcatgagttt

SEQ ID NO: 432214 - DNA, 16 bp, M. musculus
tcattcttccactgga

SEQ ID NO: 432215 - DNA, 16 bp, M. musculus
tcattcttttaaaaat

SEQ ID NO: 432216 - DNA, 16 bp, M. musculus
tcattgaacatggaaa

SEQ ID NO: 432217 - DNA, 16 bp, M. musculus
tcattgactctgtgcc

SEQ ID NO: 432218 - DNA, 16 bp, M. musculus
tcattgagaacagtgt

SEQ ID NO: 432219 - DNA, 16 bp, M. musculus
tcattgagaagaatgt

SEQ ID NO: 432220 - DNA, 16 bp, M. musculus
tcattgagaagaattt

SEQ ID NO: 432221 - DNA, 16 bp, M. musculus
tcattgagcagatggt

SEQ ID NO: 432222 - DNA, 16 bp, M. musculus
tcattgatatctactt

SEQ ID NO: 432223 - DNA, 16 bp, M. musculus
tcattgattggtggtt

SEQ ID NO: 432224 - DNA, 16 bp, M. musculus
tcattgatttttttaa

SEQ ID NO: 432225 - DNA, 16 bp, M. musculus
tcattgcaatgaacat

SEQ ID NO: 432226 - DNA, 16 bp, M. musculus
tcattgctgtgacaaa

SEQ ID NO: 432227 - DNA, 16 bp, M. musculus
tcattgctttctttgt

SEQ ID NO: 432228 - DNA, 16 bp, M. musculus
tcattgggaaccctgt

SEQ ID NO: 432229 - DNA, 16 bp, M. musculus
tcattgggaagaaagg

SEQ ID NO: 432230 - DNA, 16 bp, M. musculus
tcattggggactctgt

SEQ ID NO: 432231 - DNA, 16 bp, M. musculus
tcattgggggccctgt

SEQ ID NO: 432232 - DNA, 16 bp, M. musculus
tcattggtacaggaga

SEQ ID NO: 432233 - DNA, 16 bp, M. musculus
tcattggttaagagca

SEQ ID NO: 432234 - DNA, 16 bp, M. musculus
tcattggttattttat

SEQ ID NO: 432235 - DNA, 16 bp, M. musculus
tcattggtttggtttg

SEQ ID NO: 432236 - DNA, 16 bp, M. musculus
tcattgtcattgtcat

SEQ ID NO: 432237 - DNA, 16 bp, M. musculus
tcattgtctgttggag

SEQ ID NO: 432238 - DNA, 16 bp, M. musculus
tcattgtgacattttt

SEQ ID NO: 432239 - DNA, 16 bp, M. musculus
tcattgtgggaagcat

SEQ ID NO: 432240 - DNA, 16 bp, M. musculus
tcattgtgtcccaaag

SEQ ID NO: 432241 - DNA, 16 bp, M. musculus
tcattgtgtcccttaa

SEQ ID NO: 432242 - DNA, 16 bp, M. musculus
tcattgtgttccataa

SEQ ID NO: 432243 - DNA, 16 bp, M. musculus
tcattgttcagttctg

SEQ ID NO: 432244 - DNA, 16 bp, M. musculus
tcattgtttctacttt

SEQ ID NO: 432245 - DNA, 16 bp, M. musculus
tcattgtttttaatag

SEQ ID NO: 432246 - DNA, 16 bp, M. musculus
tcatttaaaacatttt

SEQ ID NO: 432247 - DNA, 16 bp, M. musculus
tcatttaaggtgtgta

SEQ ID NO: 432248 - DNA, 16 bp, M. musculus
tcatttacacaatgga

SEQ ID NO: 432249 - DNA, 16 bp, M. musculus
tcatttacatttcaga

SEQ ID NO: 432250 - DNA, 22 bp, M. musculus
tcatttacatttccagtgctat

SEQ ID NO: 432251 - DNA, 144 bp, M. musculus
tcatttactcagtcccaaattgatagattggctcacaatgccatgactccttttgactggatgagtgtggtaaaggcatgtcttacgatgggacagtatctagattggaagtctatatggcatgatctgtgtttgagtcaggcc

SEQ ID NO: 432252 - DNA, 17 bp, M. musculus
tcatttagataatgtga

SEQ ID NO: 432253 - DNA, 16 bp, M. musculus
tcatttaggaagaggg

SEQ ID NO: 432254 - DNA, 16 bp, M. musculus
tcatttataagatgga

SEQ ID NO: 432255 - DNA, 16 bp, M. musculus
tcatttatcaagaaaa

SEQ ID NO: 432256 - DNA, 16 bp, M. musculus
tcatttatgtgtgtat

SEQ ID NO: 432257 - DNA, 16 bp, M. musculus
tcatttatttggtgtt

SEQ ID NO: 432258 - DNA, 16 bp, M. musculus
tcatttattttgatgt

SEQ ID NO: 432259 - DNA, 16 bp, M. musculus
tcatttcaaattgaat

SEQ ID NO: 432260 - DNA, 16 bp, M. musculus
tcatttcagggatgca

SEQ ID NO: 432261 - DNA, 16 bp, M. musculus
tcatttccatttccat

SEQ ID NO: 432262 - DNA, 16 bp, M. musculus
tcatttcctgctgtct

SEQ ID NO: 432263 - DNA, 16 bp, M. musculus
tcatttcctgctttct

SEQ ID NO: 432264 - DNA, 24 bp, M. musculus
tcatttcctggtatgacaatgaat

SEQ ID NO: 432265 - DNA, 16 bp, M. musculus
tcatttctatggccca

SEQ ID NO: 432266 - DNA, 16 bp, M. musculus
tcatttctcatttcat

SEQ ID NO: 432267 - DNA, 16 bp, M. musculus
tcatttctctaatttc

SEQ ID NO: 432268 - DNA, 16 bp, M. musculus
tcatttctgatttatt

SEQ ID NO: 432269 - DNA, 16 bp, M. musculus
tcatttctgattttaa

SEQ ID NO: 432270 - DNA, 16 bp, M. musculus
tcatttctgctcctgt

SEQ ID NO: 432271 - DNA, 16 bp, M. musculus
tcatttctgctgctgt

SEQ ID NO: 432272 - DNA, 16 bp, M. musculus
tcatttctgggtctcc

SEQ ID NO: 432273 - DNA, 16 bp, M. musculus
tcatttctgttccttt

SEQ ID NO: 432274 - DNA, 16 bp, M. musculus
tcatttctgttgttat

SEQ ID NO: 432275 - DNA, 16 bp, M. musculus
tcatttctgtttctgt

SEQ ID NO: 432276 - DNA, 16 bp, M. musculus
tcatttcttcagtctc

SEQ ID NO: 432277 - DNA, 16 bp, M. musculus
tcatttctttctcagc

SEQ ID NO: 432278 - DNA, 16 bp, M. musculus
tcatttcttttgaaat

SEQ ID NO: 432279 - DNA, 16 bp, M. musculus
tcatttgaaatggaaa

SEQ ID NO: 432280 - DNA, 16 bp, M. musculus
tcatttgaagaaaaaa

SEQ ID NO: 432281 - DNA, 16 bp, M. musculus
tcatttgaagtaggaa

SEQ ID NO: 432282 - DNA, 16 bp, M. musculus
tcatttgagatctttt

SEQ ID NO: 432283 - DNA, 16 bp, M. musculus
tcatttgagatgtaaa

SEQ ID NO: 432284 - DNA, 16 bp, M. musculus
tcatttgcatataaaa

SEQ ID NO: 432285 - DNA, 16 bp, M. musculus
tcatttgcatttccct

SEQ ID NO: 432286 - DNA, 16 bp, M. musculus
tcatttgctgctgttt

SEQ ID NO: 432287 - DNA, 16 bp, M. musculus
tcatttggaaaaacaa

SEQ ID NO: 432288 - DNA, 16 bp, M. musculus
tcatttggacaaagtg

SEQ ID NO: 432289 - DNA, 16 bp, M. musculus
tcatttgtaccttgcc

SEQ ID NO: 432290 - DNA, 16 bp, M. musculus
tcatttgtataatgga

SEQ ID NO: 432291 - DNA, 16 bp, M. musculus
tcatttgtgtgtgtgt

SEQ ID NO: 432292 - DNA, 16 bp, M. musculus
tcatttgtttttgaga

SEQ ID NO: 432293 - DNA, 16 bp, M. musculus
tcattttaaaagaaat

SEQ ID NO: 432294 - DNA, 16 bp, M. musculus
tcattttaaaagtcaa

SEQ ID NO: 432295 - DNA, 16 bp, M. musculus
tcattttaaaagtttt

SEQ ID NO: 432296 - DNA, 16 bp, M. musculus
tcattttaaaatgttt

SEQ ID NO: 432297 - DNA, 16 bp, M. musculus
tcattttaaagaaaga

SEQ ID NO: 432298 - DNA, 16 bp, M. musculus
tcattttaaatatgaa

SEQ ID NO: 432299 - DNA, 16 bp, M. musculus
tcattttaaatgtatt

SEQ ID NO: 432300 - DNA, 16 bp, M. musculus
tcattttaaccccagg

SEQ ID NO: 432301 - DNA, 16 bp, M. musculus
tcattttaataaaaca

SEQ ID NO: 432302 - DNA, 16 bp, M. musculus
tcattttaatgtgttc

SEQ ID NO: 432303 - DNA, 16 bp, M. musculus
tcattttaatttgtat

SEQ ID NO: 432304 - DNA, 16 bp, M. musculus
tcattttaattttagt

SEQ ID NO: 432305 - DNA, 16 bp, M. musculus
tcattttatgaagcaa

SEQ ID NO: 432306 - DNA, 16 bp, M. musculus
tcattttattactatg

SEQ ID NO: 432307 - DNA, 16 bp, M. musculus
tcattttattgctatt

SEQ ID NO: 432308 - DNA, 16 bp, M. musculus
tcattttcaaaatgaa

SEQ ID NO: 432309 - DNA, 16 bp, M. musculus
tcattttcaatatgtt

SEQ ID NO: 432310 - DNA, 16 bp, M. musculus
tcattttcataaaaat

SEQ ID NO: 432311 - DNA, 16 bp, M. musculus
tcattttcctcatctg

SEQ ID NO: 432312 - DNA, 16 bp, M. musculus
tcattttcttcatctg

SEQ ID NO: 432313 - DNA, 16 bp, M. musculus
tcattttcttgtttaa

SEQ ID NO: 432314 - DNA, 16 bp, M. musculus
tcattttctttttaag

SEQ ID NO: 432315 - DNA, 16 bp, M. musculus
tcattttgccttttgc

SEQ ID NO: 432316 - DNA, 16 bp, M. musculus
tcattttgttttgcat

SEQ ID NO: 432317 - DNA, 16 bp, M. musculus
tcatttttaaaattca

SEQ ID NO: 432318 - DNA, 16 bp, M. musculus
tcatttttaaattgtt

SEQ ID NO: 432319 - DNA, 16 bp, M. musculus
tcatttttaatagggt

SEQ ID NO: 432320 - DNA, 16 bp, M. musculus
tcatttttaatatctg

SEQ ID NO: 432321 - DNA, 16 bp, M. musculus
tcatttttactgtatt

SEQ ID NO: 432322 - DNA, 16 bp, M. musculus
tcatttttctgcaaat

SEQ ID NO: 432323 - DNA, 16 bp, M. musculus
tcatttttcttctctg

SEQ ID NO: 432324 - DNA, 16 bp, M. musculus
tcatttttgtccctgc

SEQ ID NO: 432325 - DNA, 16 bp, M. musculus
tcattttttaaaaaga

SEQ ID NO: 432326 - DNA, 16 bp, M. musculus
tcattttttaaaatgt

SEQ ID NO: 432327 - DNA, 16 bp, M. musculus
tcattttttaaagatt

SEQ ID NO: 432328 - DNA, 16 bp, M. musculus
tcatttttttccctaa

SEQ ID NO: 432329 - DNA, 16 bp, M. musculus
tcatttttttctgaaa

SEQ ID NO: 432330 - DNA, 16 bp, M. musculus
tcattttttttaaagt

SEQ ID NO: 432331 - DNA, 16 bp, M. musculus
tcattttttttggccc

SEQ ID NO: 432332 - DNA, 16 bp, M. musculus
tccaaaaaagaaagag

SEQ ID NO: 432333 - DNA, 16 bp, M. musculus
tccaaaacactgcatg

SEQ ID NO: 432334 - DNA, 16 bp, M. musculus
tccaaaacactttctt

SEQ ID NO: 432335 - DNA, 16 bp, M. musculus
tccaaaacagccagga

SEQ ID NO: 432336 - DNA, 16 bp, M. musculus
tccaaaagaaagagag

SEQ ID NO: 432337 - DNA, 16 bp, M. musculus
tccaaaagatccaaca

SEQ ID NO: 432338 - DNA, 16 bp, M. musculus
tccaaaattcaggtga

SEQ ID NO: 432339 - DNA, 16 bp, M. musculus
tccaaacatcacgtgt

SEQ ID NO: 432340 - DNA, 17 bp, M. musculus
tccaaacattgtactaa

SEQ ID NO: 432341 - DNA, 16 bp, M. musculus
tccaaacgctgactcc

SEQ ID NO: 432342 - DNA, 16 bp, M. musculus
tccaaactctgaatct

SEQ ID NO: 432343 - DNA, 16 bp, M. musculus
tccaaacttctgggct

SEQ ID NO: 432344 - DNA, 16 bp, M. musculus
tccaaactttggctct

SEQ ID NO: 432345 - DNA, 16 bp, M. musculus
tccaaagaaaccaaaa

SEQ ID NO: 432346 - DNA, 16 bp, M. musculus
tccaaagaccacagtc

SEQ ID NO: 432347 - DNA, 16 bp, M. musculus
tccaaagagttcctgg

SEQ ID NO: 432348 - DNA, 16 bp, M. musculus
tccaaagccagcctgg

SEQ ID NO: 432349 - DNA, 16 bp, M. musculus
tccaaaggaaaaaaat

SEQ ID NO: 432350 - DNA, 16 bp, M. musculus
tccaaaggaccagagt

SEQ ID NO: 432351 - DNA, 16 bp, M. musculus
tccaaaggacccagat

SEQ ID NO: 432352 - DNA, 16 bp, M. musculus
tccaaaggcagcagaa

SEQ ID NO: 432353 - DNA, 16 bp, M. musculus
tccaaagtcctagaaa

SEQ ID NO: 432354 - DNA, 16 bp, M. musculus
tccaaataatatcaat

SEQ ID NO: 432355 - DNA, 16 bp, M. musculus
tccaaatacagtcaca

SEQ ID NO: 432356 - DNA, 16 bp, M. musculus
tccaaatagacaggac

SEQ ID NO: 432357 - DNA, 16 bp, M. musculus
tccaaatccatccatt

SEQ ID NO: 432358 - DNA, 16 bp, M. musculus
tccaaatgccagataa

SEQ ID NO: 432359 - DNA, 16 bp, M. musculus
tccaaatggaggagct

SEQ ID NO: 432360 - DNA, 16 bp, M. musculus
tccaaattaatcctaa

SEQ ID NO: 432361 - DNA, 16 bp, M. musculus
tccaaattctaagaag

SEQ ID NO: 432362 - DNA, 26 bp, M. musculus
tccaaattgctaacctggagagatgg

SEQ ID NO: 432363 - DNA, 16 bp, M. musculus
tccaaatttcctggat

SEQ ID NO: 432364 - DNA, 16 bp, M. musculus
tccaacaaaaccagaa

SEQ ID NO: 432365 - DNA, 16 bp, M. musculus
tccaacaaagccacac

SEQ ID NO: 432366 - DNA, 16 bp, M. musculus
tccaacaagaccacac

SEQ ID NO: 432367 - DNA, 16 bp, M. musculus
tccaacaagatcacac

SEQ ID NO: 432368 - DNA, 16 bp, M. musculus
tccaacaaggccacaa

SEQ ID NO: 432369 - DNA, 16 bp, M. musculus
tccaacaaggccacac

SEQ ID NO: 432370 - DNA, 16 bp, M. musculus
tccaacaaggccattc

SEQ ID NO: 432371 - DNA, 16 bp, M. musculus
tccaacacaactgact

SEQ ID NO: 432372 - DNA, 16 bp, M. musculus
tccaacacacatacag

SEQ ID NO: 432373 - DNA, 16 bp, M. musculus
tccaacacccatccat

SEQ ID NO: 432374 - DNA, 16 bp, M. musculus
tccaacaccctcctct

SEQ ID NO: 432375 - DNA, 16 bp, M. musculus
tccaacaccctctctg

SEQ ID NO: 432376 - DNA, 16 bp, M. musculus
tccaacacccttttct

SEQ ID NO: 432377 - DNA, 16 bp, M. musculus
tccaacagaaggtgtg

SEQ ID NO: 432378 - DNA, 16 bp, M. musculus
tccaacagggccagaa

SEQ ID NO: 432379 - DNA, 16 bp, M. musculus
tccaacatataacagg

SEQ ID NO: 432380 - DNA, 16 bp, M. musculus
tccaacatcctcttct

SEQ ID NO: 432381 - DNA, 16 bp, M. musculus
tccaacatcttcttct

SEQ ID NO: 432382 - DNA, 16 bp, M. musculus
tccaacatgtcttcat

SEQ ID NO: 432383 - DNA, 63 bp, M. musculus
tccaaccatacctctgccccagctaactgctccgtggcctcccaacacaagctgaccctgtcc

SEQ ID NO: 432384 - DNA, 16 bp, M. musculus
tccaaccatgtgtttt

SEQ ID NO: 432385 - DNA, 16 bp, M. musculus
tccaactactgcactg

SEQ ID NO: 432386 - DNA, 16 bp, M. musculus
tccaactcatgatcct

SEQ ID NO: 432387 - DNA, 16 bp, M. musculus
tccaactcccttttca

SEQ ID NO: 432388 - DNA, 16 bp, M. musculus
tccaactcttcactct

SEQ ID NO: 432389 - DNA, 16 bp, M. musculus
tccaactgcctctgcc

SEQ ID NO: 432390 - DNA, 16 bp, M. musculus
tccaacttcatgttct

SEQ ID NO: 432391 - DNA, 16 bp, M. musculus
tccaacttctcaccat

SEQ ID NO: 432392 - DNA, 16 bp, M. musculus
tccaacttgtaataag

SEQ ID NO: 432393 - DNA, 16 bp, M. musculus
tccaactttaatccat

SEQ ID NO: 432394 - DNA, 16 bp, M. musculus
tccaagaaaacataca

SEQ ID NO: 432395 - DNA, 16 bp, M. musculus
tccaagaaccacacca

SEQ ID NO: 432396 - DNA, 16 bp, M. musculus
tccaagaactacaact

SEQ ID NO: 432397 - DNA, 16 bp, M. musculus
tccaagaagaaatggg

SEQ ID NO: 432398 - DNA, 16 bp, M. musculus
tccaagaaggccacac

SEQ ID NO: 432399 - DNA, 16 bp, M. musculus
tccaagaatatataaa

SEQ ID NO: 432400 - DNA, 16 bp, M. musculus
tccaagacagccagga

SEQ ID NO: 432401 - DNA, 16 bp, M. musculus
tccaagagcaagtgga

SEQ ID NO: 432402 - DNA, 16 bp, M. musculus
tccaagagctgactgt

SEQ ID NO: 432403 - DNA, 16 bp, M. musculus
tccaagagctggatcc

SEQ ID NO: 432404 - DNA, 16 bp, M. musculus
tccaagaggaaccctc

SEQ ID NO: 432405 - DNA, 31 bp, M. musculus
tccaagaggaactctcaattctgaatatcta

SEQ ID NO: 432406 - DNA, 16 bp, M. musculus
tccaagatcttctgga

SEQ ID NO: 432407 - DNA, 16 bp, M. musculus
tccaagcaaatggaat

SEQ ID NO: 432408 - DNA, 16 bp, M. musculus
tccaagcactcagaag

SEQ ID NO: 432409 - DNA, 16 bp, M. musculus
tccaagcagaaccatt

SEQ ID NO: 432410 - DNA, 16 bp, M. musculus
tccaagccagcctggt

SEQ ID NO: 432411 - DNA, 17 bp, M. musculus
tccaagcctctgaccca

SEQ ID NO: 432412 - DNA, 16 bp, M. musculus
tccaagctgacctcaa

SEQ ID NO: 432413 - DNA, 16 bp, M. musculus
tccaaggaccagaaaa

SEQ ID NO: 432414 - DNA, 16 bp, M. musculus
tccaaggagctctggg

SEQ ID NO: 432415 - DNA, 16 bp, M. musculus
tccaaggatgagaaga

SEQ ID NO: 432416 - DNA, 16 bp, M. musculus
tccaaggatgaggcca

SEQ ID NO: 432417 - DNA, 16 bp, M. musculus
tccaaggccagccttg

SEQ ID NO: 432418 - DNA, 16 bp, M. musculus
tccaaggctggaatta

SEQ ID NO: 432419 - DNA, 16 bp, M. musculus
tccaagggatccaatg

SEQ ID NO: 432420 - DNA, 16 bp, M. musculus
tccaagggatccagtg

SEQ ID NO: 432421 - DNA, 16 bp, M. musculus
tccaagggcatctgca

SEQ ID NO: 432422 - DNA, 16 bp, M. musculus
tccaaggtccctccct

SEQ ID NO: 432423 - DNA, 16 bp, M. musculus
tccaagtacccacatg

SEQ ID NO: 432424 - DNA, 16 bp, M. musculus
tccaagtacttgggag

SEQ ID NO: 432425 - DNA, 16 bp, M. musculus
tccaagtgctgaaatt

SEQ ID NO: 432426 - DNA, 16 bp, M. musculus
tccaagtggtaagaag

SEQ ID NO: 432427 - DNA, 16 bp, M. musculus
tccaagttcaagacca

SEQ ID NO: 432428 - DNA, 16 bp, M. musculus
tccaagttccctaagc

SEQ ID NO: 432429 - DNA, 16 bp, M. musculus
tccaataaggccacac

SEQ ID NO: 432430 - DNA, 16 bp, M. musculus
tccaatacaaggacag

SEQ ID NO: 432431 - DNA, 16 bp, M. musculus
tccaatcccccagtct

SEQ ID NO: 432432 - DNA, 16 bp, M. musculus
tccaatctatttggag

SEQ ID NO: 432433 - DNA, 16 bp, M. musculus
tccaatgaaatgtttt

SEQ ID NO: 432434 - DNA, 16 bp, M. musculus
tccaatgatgaccaac

SEQ ID NO: 432435 - DNA, 16 bp, M. musculus
tccaatgcactcttct

SEQ ID NO: 432436 - DNA, 16 bp, M. musculus
tccaatggttggctgc

SEQ ID NO: 432437 - DNA, 16 bp, M. musculus
tccaatgtggaagcag

SEQ ID NO: 432438 - DNA, 16 bp, M. musculus
tccaattaaatgtctt

SEQ ID NO: 432439 - DNA, 16 bp, M. musculus
tccaattataaaacca

SEQ ID NO: 432440 - DNA, 17 bp, M. musculus
tccaattctattccatt

SEQ ID NO: 432441 - DNA, 48 bp, M. musculus
tccaattctgtaacatatactgaaaaagactttttgacaaattagctg

SEQ ID NO: 432442 - DNA, 16 bp, M. musculus
tccaattgaaggcaat

SEQ ID NO: 432443 - DNA, 16 bp, M. musculus
tccaattttaagaaat

SEQ ID NO: 432444 - DNA, 16 bp, M. musculus
tccaatttttcattag

SEQ ID NO: 432445 - DNA, 17 bp, M. musculus
tccaatttttctgagga

SEQ ID NO: 432446 - DNA, 16 bp, M. musculus
tccaatttttgaggaa

SEQ ID NO: 432447 - DNA, 16 bp, M. musculus
tccacaaaactcaaga

SEQ ID NO: 432448 - DNA, 16 bp, M. musculus
tccacaaaattagaaa

SEQ ID NO: 432449 - DNA, 16 bp, M. musculus
tccacaaactattcca

SEQ ID NO: 432450 - DNA, 16 bp, M. musculus
tccacaacttgaagtt

SEQ ID NO: 432451 - DNA, 16 bp, M. musculus
tccacaagcaggaggc

SEQ ID NO: 432452 - DNA, 16 bp, M. musculus
tccacaagcatgaggc

SEQ ID NO: 432453 - DNA, 17 bp, M. musculus
tccacaatctgtccatt

SEQ ID NO: 432454 - DNA, 16 bp, M. musculus
tccacaatgtttcctg

SEQ ID NO: 432455 - DNA, 16 bp, M. musculus
tccacacacatgccat

SEQ ID NO: 432456 - DNA, 16 bp, M. musculus
tccacacagccctggg

SEQ ID NO: 432457 - DNA, 16 bp, M. musculus
tccacacagctatggt

SEQ ID NO: 432458 - DNA, 16 bp, M. musculus
tccacacagtggctca

SEQ ID NO: 432459 - DNA, 16 bp, M. musculus
tccacacatacaaaca

SEQ ID NO: 432460 - DNA, 16 bp, M. musculus
tccacacatgcacaca

SEQ ID NO: 432461 - DNA, 16 bp, M. musculus
tccacacatgcaccat

SEQ ID NO: 432462 - DNA, 16 bp, M. musculus
tccacaccacagtcca

SEQ ID NO: 432463 - DNA, 16 bp, M. musculus
tccacaccctggtctt

SEQ ID NO: 432464 - DNA, 16 bp, M. musculus
tccacactcaggaagg

SEQ ID NO: 432465 - DNA, 16 bp, M. musculus
tccacactctgactgt

SEQ ID NO: 432466 - DNA, 16 bp, M. musculus
tccacactgctgctca

SEQ ID NO: 432467 - DNA, 16 bp, M. musculus
tccacactttggtctt

SEQ ID NO: 432468 - DNA, 16 bp, M. musculus
tccacagaactgaaaa

SEQ ID NO: 432469 - DNA, 16 bp, M. musculus
tccacagacagcagaa

SEQ ID NO: 432470 - DNA, 16 bp, M. musculus
tccacagagaaaaagc

SEQ ID NO: 432471 - DNA, 16 bp, M. musculus
tccacagagaaaccct

SEQ ID NO: 432472 - DNA, 16 bp, M. musculus
tccacagagtgagttt

SEQ ID NO: 432473 - DNA, 16 bp, M. musculus
tccacagcagctgact

SEQ ID NO: 432474 - DNA, 16 bp, M. musculus
tccacagccctctgta

SEQ ID NO: 432475 - DNA, 16 bp, M. musculus
tccacagcctgaggaa

SEQ ID NO: 432476 - DNA, 16 bp, M. musculus
tccacagccttcccaa

SEQ ID NO: 432477 - DNA, 16 bp, M. musculus
tccacaggaccaaagg

SEQ ID NO: 432478 - DNA, 16 bp, M. musculus
tccacaggaccaaggc

SEQ ID NO: 432479 - DNA, 16 bp, M. musculus
tccacaggagccatct

SEQ ID NO: 432480 - DNA, 16 bp, M. musculus
tccacaggcaccagga

SEQ ID NO: 432481 - DNA, 16 bp, M. musculus
tccacaggctcatgtg

SEQ ID NO: 432482 - DNA, 16 bp, M. musculus
tccacagtcctcccaa

SEQ ID NO: 432483 - DNA, 16 bp, M. musculus
tccacagtcctccccc

SEQ ID NO: 432484 - DNA, 16 bp, M. musculus
tccacagtgctgggat

SEQ ID NO: 432485 - DNA, 16 bp, M. musculus
tccacagttaagagca

SEQ ID NO: 432486 - DNA, 17 bp, M. musculus
tccacagttacctggca

SEQ ID NO: 432487 - DNA, 16 bp, M. musculus
tccacatacaaccaga

SEQ ID NO: 432488 - DNA, 16 bp, M. musculus
tccacatagcaagttc

SEQ ID NO: 432489 - DNA, 16 bp, M. musculus
tccacatcaaaccaga

SEQ ID NO: 432490 - DNA, 16 bp, M. musculus
tccacatcattgccag

SEQ ID NO: 432491 - DNA, 16 bp, M. musculus
tccacatcctcagcag

SEQ ID NO: 432492 - DNA, 16 bp, M. musculus
tccacatcctctccaa

SEQ ID NO: 432493 - DNA, 16 bp, M. musculus
tccacatcctgtacct

SEQ ID NO: 432494 - DNA, 16 bp, M. musculus
tccacatctgatagag

SEQ ID NO: 432495 - DNA, 16 bp, M. musculus
tccacatcttctgaga

SEQ ID NO: 432496 - DNA, 16 bp, M. musculus
tccacatgacagctca

SEQ ID NO: 432497 - DNA, 16 bp, M. musculus
tccacatgcagaagaa

SEQ ID NO: 432498 - DNA, 16 bp, M. musculus
tccacatggctgttca

SEQ ID NO: 432499 - DNA, 16 bp, M. musculus
tccacatggctttctg

SEQ ID NO: 432500 - DNA, 16 bp, M. musculus
tccacatgtgtgcatg

SEQ ID NO: 432501 - DNA, 16 bp, M. musculus
tccacattatttcagg

SEQ ID NO: 432502 - DNA, 16 bp, M. musculus
tccacattctcaccag

SEQ ID NO: 432503 - DNA, 16 bp, M. musculus
tccacattgatgttca

SEQ ID NO: 432504 - DNA, 16 bp, M. musculus
tccacattttattaca

SEQ ID NO: 432505 - DNA, 16 bp, M. musculus
tccaccaaggccacac

SEQ ID NO: 432506 - DNA, 17 bp, M. musculus
tccaccagaaaactcct

SEQ ID NO: 432507 - DNA, 16 bp, M. musculus
tccaccagagaaatcc

SEQ ID NO: 432508 - DNA, 16 bp, M. musculus
tccaccagagaactaa

SEQ ID NO: 432509 - DNA, 16 bp, M. musculus
tccaccagagaactca

SEQ ID NO: 432510 - DNA, 16 bp, M. musculus
tccaccagagaagact

SEQ ID NO: 432511 - DNA, 16 bp, M. musculus
tccaccaggcctcccc

SEQ ID NO: 432512 - DNA, 16 bp, M. musculus
tccaccatacctagga

SEQ ID NO: 432513 - DNA, 16 bp, M. musculus
tccaccatgcctgcct

SEQ ID NO: 432514 - DNA, 16 bp, M. musculus
tccaccatgtgggtct

SEQ ID NO: 432515 - DNA, 16 bp, M. musculus
tccacccacttctgct

SEQ ID NO: 432516 - DNA, 16 bp, M. musculus
tccacccagcagctga

SEQ ID NO: 432517 - DNA, 16 bp, M. musculus
tccaccccatgtgctc

SEQ ID NO: 432518 - DNA, 16 bp, M. musculus
tccacccccagtgaca

SEQ ID NO: 432519 - DNA, 17 bp, M. musculus
tccaccccttgtcaact

SEQ ID NO: 432520 - DNA, 16 bp, M. musculus
tccaccctccatctgc

SEQ ID NO: 432521 - DNA, 16 bp, M. musculus
tccaccctttggtctt

SEQ ID NO: 432522 - DNA, 16 bp, M. musculus
tccacctaagatccac

SEQ ID NO: 432523 - DNA, 16 bp, M. musculus
tccacctatctctgcc

SEQ ID NO: 432524 - DNA, 16 bp, M. musculus
tccacctcaccccagt

SEQ ID NO: 432525 - DNA, 16 bp, M. musculus
tccacctcagggacaa

SEQ ID NO: 432526 - DNA, 16 bp, M. musculus
tccacctcatgccagt

SEQ ID NO: 432527 - DNA, 16 bp, M. musculus
tccacctccaacaaca

SEQ ID NO: 432528 - DNA, 16 bp, M. musculus
tccacctccagcagaa

SEQ ID NO: 432529 - DNA, 16 bp, M. musculus
tccacctccagcagga

SEQ ID NO: 432530 - DNA, 16 bp, M. musculus
tccacctccagtgaca

SEQ ID NO: 432531 - DNA, 16 bp, M. musculus
tccacctcccatctca

SEQ ID NO: 432532 - DNA, 16 bp, M. musculus
tccacctcccatcttg

SEQ ID NO: 432533 - DNA, 16 bp, M. musculus
tccacctcctcttctg

SEQ ID NO: 432534 - DNA, 16 bp, M. musculus
tccacctcttgtgtct

SEQ ID NO: 432535 - DNA, 16 bp, M. musculus
tccacctgcctctgca

SEQ ID NO: 432536 - DNA, 16 bp, M. musculus
tccacctggcttggga

SEQ ID NO: 432537 - DNA, 16 bp, M. musculus
tccaccttatattttg

SEQ ID NO: 432538 - DNA, 16 bp, M. musculus
tccaccttcttgagtc

SEQ ID NO: 432539 - DNA, 16 bp, M. musculus
tccaccttgatgataa

SEQ ID NO: 432540 - DNA, 16 bp, M. musculus
tccactatatgatcca

SEQ ID NO: 432541 - DNA, 16 bp, M. musculus
tccactatgttcacag

SEQ ID NO: 432542 - DNA, 17 bp, M. musculus
tccactatgttcataga

SEQ ID NO: 432543 - DNA, 20 bp, M. musculus
tccactcaccagaggtctta

SEQ ID NO: 432544 - DNA, 16 bp, M. musculus
tccactcaggagagca

SEQ ID NO: 432545 - DNA, 16 bp, M. musculus
tccactcatctatcca

SEQ ID NO: 432546 - DNA, 16 bp, M. musculus
tccactccactgccac

SEQ ID NO: 432547 - DNA, 16 bp, M. musculus
tccactccactgctgc

SEQ ID NO: 432548 - DNA, 16 bp, M. musculus
tccactccagcaccag

SEQ ID NO: 432549 - DNA, 16 bp, M. musculus
tccactcctgcctcca

SEQ ID NO: 432550 - DNA, 16 bp, M. musculus
tccactgatggtggga

SEQ ID NO: 432551 - DNA, 16 bp, M. musculus
tccactgcacaaagaa

SEQ ID NO: 432552 - DNA, 16 bp, M. musculus
tccactgcctctgcct

SEQ ID NO: 432553 - DNA, 16 bp, M. musculus
tccactgctggtggaa

SEQ ID NO: 432554 - DNA, 16 bp, M. musculus
tccactggacagagca

SEQ ID NO: 432555 - DNA, 16 bp, M. musculus
tccactgggattcctg

SEQ ID NO: 432556 - DNA, 16 bp, M. musculus
tccactggggtcccca

SEQ ID NO: 432557 - DNA, 16 bp, M. musculus
tccactgtatatatga

SEQ ID NO: 432558 - DNA, 16 bp, M. musculus
tccacttatatgtttg

SEQ ID NO: 432559 - DNA, 16 bp, M. musculus
tccacttcaagaaaac

SEQ ID NO: 432560 - DNA, 16 bp, M. musculus
tccacttcctgcccag

SEQ ID NO: 432561 - DNA, 16 bp, M. musculus
tccacttctgtatttg

SEQ ID NO: 432562 - DNA, 16 bp, M. musculus
tccacttctgtatttt

SEQ ID NO: 432563 - DNA, 16 bp, M. musculus
tccacttgatgctctg

SEQ ID NO: 432564 - DNA, 16 bp, M. musculus
tccagaaaaacaccat

SEQ ID NO: 432565 - DNA, 16 bp, M. musculus
tccagaaaagattcaa

SEQ ID NO: 432566 - DNA, 16 bp, M. musculus
tccagaaaatcagata

SEQ ID NO: 432567 - DNA, 16 bp, M. musculus
tccagaaaatccagaa

SEQ ID NO: 432568 - DNA, 16 bp, M. musculus
tccagaaaattttaac

SEQ ID NO: 432569 - DNA, 16 bp, M. musculus
tccagaaacacacaca

SEQ ID NO: 432570 - DNA, 16 bp, M. musculus
tccagaaaccccttat

SEQ ID NO: 432571 - DNA, 16 bp, M. musculus
tccagaaagtcccaga

SEQ ID NO: 432572 - DNA, 16 bp, M. musculus
tccagaacagccagga

SEQ ID NO: 432573 - DNA, 16 bp, M. musculus
tccagaacattttatc

SEQ ID NO: 432574 - DNA, 16 bp, M. musculus
tccagaactggaaggc

SEQ ID NO: 432575 - DNA, 16 bp, M. musculus
tccagaagaaacctca

SEQ ID NO: 432576 - DNA, 16 bp, M. musculus
tccagaagaaactgca

SEQ ID NO: 432577 - DNA, 16 bp, M. musculus
tccagaagaagttcca

SEQ ID NO: 432578 - DNA, 16 bp, M. musculus
tccagaagacccaaca

SEQ ID NO: 432579 - DNA, 16 bp, M. musculus
tccagaagacccagat

SEQ ID NO: 432580 - DNA, 16 bp, M. musculus
tccagaagagggcgcc

SEQ ID NO: 432581 - DNA, 16 bp, M. musculus
tccagaagatcaaata

SEQ ID NO: 432582 - DNA, 16 bp, M. musculus
tccagaagatccagca

SEQ ID NO: 432583 - DNA, 16 bp, M. musculus
tccagaagatgaccca

SEQ ID NO: 432584 - DNA, 16 bp, M. musculus
tccagaagatggccca

SEQ ID NO: 432585 - DNA, 16 bp, M. musculus
tccagaagatgttcaa

SEQ ID NO: 432586 - DNA, 20 bp, M. musculus
tccagaagccaataccagct

SEQ ID NO: 432587 - DNA, 16 bp, M. musculus
tccagaagctgaggca

SEQ ID NO: 432588 - DNA, 16 bp, M. musculus
tccagaagtctggagc

SEQ ID NO: 432589 - DNA, 16 bp, M. musculus
tccagaatagaacagc

SEQ ID NO: 432590 - DNA, 16 bp, M. musculus
tccagaatcttctggc

SEQ ID NO: 432591 - DNA, 16 bp, M. musculus
tccagaatgctgagat

SEQ ID NO: 432592 - DNA, 16 bp, M. musculus
tccagacaaccgacca

SEQ ID NO: 432593 - DNA, 16 bp, M. musculus
tccagacacctgcaag

SEQ ID NO: 432594 - DNA, 16 bp, M. musculus
tccagacagagacacc

SEQ ID NO: 432595 - DNA, 16 bp, M. musculus
tccagacagataccag

SEQ ID NO: 432596 - DNA, 16 bp, M. musculus
tccagaccagccaggg

SEQ ID NO: 432597 - DNA, 16 bp, M. musculus
tccagacggtggctgg

SEQ ID NO: 432598 - DNA, 16 bp, M. musculus
tccagacttctcacca

SEQ ID NO: 432599 - DNA, 16 bp, M. musculus
tccagagaaaccctgt

SEQ ID NO: 432600 - DNA, 16 bp, M. musculus
tccagagaatacaaga

SEQ ID NO: 432601 - DNA, 16 bp, M. musculus
tccagagacccagtag

SEQ ID NO: 432602 - DNA, 16 bp, M. musculus
tccagagactgaggca

SEQ ID NO: 432603 - DNA, 16 bp, M. musculus
tccagagactgcccac

SEQ ID NO: 432604 - DNA, 16 bp, M. musculus
tccagagactgctcca

SEQ ID NO: 432605 - DNA, 16 bp, M. musculus
tccagagactgttcca

SEQ ID NO: 432606 - DNA, 16 bp, M. musculus
tccagagaggaaacag

SEQ ID NO: 432607 - DNA, 16 bp, M. musculus
tccagagatggtccca

SEQ ID NO: 432608 - DNA, 16 bp, M. musculus
tccagagattacaaga

SEQ ID NO: 432609 - DNA, 16 bp, M. musculus
tccagagcactgggat

SEQ ID NO: 432610 - DNA, 16 bp, M. musculus
tccagagccatgcctg

SEQ ID NO: 432611 - DNA, 16 bp, M. musculus
tccagagcctgcccca

SEQ ID NO: 432612 - DNA, 16 bp, M. musculus
tccagagcgctgggat

SEQ ID NO: 432613 - DNA, 16 bp, M. musculus
tccagagctccctgga

SEQ ID NO: 432614 - DNA, 16 bp, M. musculus
tccagaggacagcatt

SEQ ID NO: 432615 - DNA, 16 bp, M. musculus
tccagaggacatgggt

SEQ ID NO: 432616 - DNA, 16 bp, M. musculus
tccagaggaccagagt

SEQ ID NO: 432617 - DNA, 16 bp, M. musculus
tccagaggaccaggag

SEQ ID NO: 432618 - DNA, 16 bp, M. musculus
tccagaggacccacat

SEQ ID NO: 432619 - DNA, 16 bp, M. musculus
tccagaggacccaggc

SEQ ID NO: 432620 - DNA, 16 bp, M. musculus
tccagaggacccaggt

SEQ ID NO: 432621 - DNA, 16 bp, M. musculus
tccagaggacccagtt

SEQ ID NO: 432622 - DNA, 16 bp, M. musculus
tccagaggagccaggt

SEQ ID NO: 432623 - DNA, 16 bp, M. musculus
tccagaggccagaaga

SEQ ID NO: 432624 - DNA, 16 bp, M. musculus
tccagaggctctgaca

SEQ ID NO: 432625 - DNA, 16 bp, M. musculus
tccagaggctctgatg

SEQ ID NO: 432626 - DNA, 16 bp, M. musculus
tccagaggctgcccca

SEQ ID NO: 432627 - DNA, 16 bp, M. musculus
tccagagggttccaga

SEQ ID NO: 432628 - DNA, 16 bp, M. musculus
tccagaggtcccaggt

SEQ ID NO: 432629 - DNA, 16 bp, M. musculus
tccagagtactgggat

SEQ ID NO: 432630 - DNA, 16 bp, M. musculus
tccagagtctacccca

SEQ ID NO: 432631 - DNA, 16 bp, M. musculus
tccagagtctgcccca

SEQ ID NO: 432632 - DNA, 16 bp, M. musculus
tccagagtgctctcca

SEQ ID NO: 432633 - DNA, 16 bp, M. musculus
tccagagtgctgcagc

SEQ ID NO: 432634 - DNA, 16 bp, M. musculus
tccagagttatatgga

SEQ ID NO: 432635 - DNA, 16 bp, M. musculus
tccagagttccctggg

SEQ ID NO: 432636 - DNA, 16 bp, M. musculus
tccagatacttaaaag

SEQ ID NO: 432637 - DNA, 16 bp, M. musculus
tccagatagctcagct

SEQ ID NO: 432638 - DNA, 16 bp, M. musculus
tccagatcagcctggg

SEQ ID NO: 432639 - DNA, 16 bp, M. musculus
tccagatccagggcat

SEQ ID NO: 432640 - DNA, 16 bp, M. musculus
tccagatcctcctgcc

SEQ ID NO: 432641 - DNA, 16 bp, M. musculus
tccagatcctgtcaag

SEQ ID NO: 432642 - DNA, 16 bp, M. musculus
tccagatctgtcagcc

SEQ ID NO: 432643 - DNA, 16 bp, M. musculus
tccagatgaaaatcca

SEQ ID NO: 432644 - DNA, 16 bp, M. musculus
tccagatgaatttgaa

SEQ ID NO: 432645 - DNA, 16 bp, M. musculus
tccagatgcagtcaag

SEQ ID NO: 432646 - DNA, 16 bp, M. musculus
tccagatgtagtcagg

SEQ ID NO: 432647 - DNA, 16 bp, M. musculus
tccagatgttgttcta

SEQ ID NO: 432648 - DNA, 16 bp, M. musculus
tccagattcctgccct

SEQ ID NO: 432649 - DNA, 16 bp, M. musculus
tccagatttcttccct

SEQ ID NO: 432650 - DNA, 16 bp, M. musculus
tccagcaacaagccca

SEQ ID NO: 432651 - DNA, 16 bp, M. musculus
tccagcaagcagcaga

SEQ ID NO: 432652 - DNA, 16 bp, M. musculus
tccagcaagccccagg

SEQ ID NO: 432653 - DNA, 16 bp, M. musculus
tccagcaaggccacac

SEQ ID NO: 432654 - DNA, 16 bp, M. musculus
tccagcaaggccacag

SEQ ID NO: 432655 - DNA, 16 bp, M. musculus
tccagcaaggctccac

SEQ ID NO: 432656 - DNA, 23 bp, M. musculus
tccagcacaaagtcaggatgttg

SEQ ID NO: 432657 - DNA, 16 bp, M. musculus
tccagcaccctcttct

SEQ ID NO: 432658 - DNA, 16 bp, M. musculus
tccagcacctgcctgc

SEQ ID NO: 432659 - DNA, 16 bp, M. musculus
tccagcaccttgtctg

SEQ ID NO: 432660 - DNA, 16 bp, M. musculus
tccagcactcaggagg

SEQ ID NO: 432661 - DNA, 17 bp, M. musculus
tccagcactcaggaggt

SEQ ID NO: 432662 - DNA, 17 bp, M. musculus
tccagcacttgggagac

SEQ ID NO: 432663 - DNA, 16 bp, M. musculus
tccagcagaacataga

SEQ ID NO: 432664 - DNA, 17 bp, M. musculus
tccagcagaaggtggag

SEQ ID NO: 432665 - DNA, 16 bp, M. musculus
tccagcagcacctgga

SEQ ID NO: 432666 - DNA, 16 bp, M. musculus
tccagcagccacagag

SEQ ID NO: 432667 - DNA, 16 bp, M. musculus
tccagcagccatggca

SEQ ID NO: 432668 - DNA, 19 bp, M. musculus
tccagcaggtccagttatt

SEQ ID NO: 432669 - DNA, 16 bp, M. musculus
tccagcagtcctcctg

SEQ ID NO: 432670 - DNA, 16 bp, M. musculus
tccagcagtctggagc

SEQ ID NO: 432671 - DNA, 16 bp, M. musculus
tccagcagtgggcatg

SEQ ID NO: 432672 - DNA, 16 bp, M. musculus
tccagcatcccatctc

SEQ ID NO: 432673 - DNA, 16 bp, M. musculus
tccagcattaattaat

SEQ ID NO: 432674 - DNA, 16 bp, M. musculus
tccagccaacaccagg

SEQ ID NO: 432675 - DNA, 16 bp, M. musculus
tccagccaatagctga

SEQ ID NO: 432676 - DNA, 16 bp, M. musculus
tccagccacaggccca

SEQ ID NO: 432677 - DNA, 16 bp, M. musculus
tccagccagccagcca

SEQ ID NO: 432678 - DNA, 16 bp, M. musculus
tccagcccattgtgag

SEQ ID NO: 432679 - DNA, 16 bp, M. musculus
tccagccccatggtca

SEQ ID NO: 432680 - DNA, 16 bp, M. musculus
tccagcccctttgctg

SEQ ID NO: 432681 - DNA, 16 bp, M. musculus
tccagccctacagagg

SEQ ID NO: 432682 - DNA, 16 bp, M. musculus
tccagccctccagccc

SEQ ID NO: 432683 - DNA, 16 bp, M. musculus
tccagccctgcccttt

SEQ ID NO: 432684 - DNA, 16 bp, M. musculus
tccagcccttgggagg

SEQ ID NO: 432685 - DNA, 16 bp, M. musculus
tccagcctcagtgaga

SEQ ID NO: 432686 - DNA, 16 bp, M. musculus
tccagcctcagtggga

SEQ ID NO: 432687 - DNA, 16 bp, M. musculus
tccagcctcattttat

SEQ ID NO: 432688 - DNA, 16 bp, M. musculus
tccagcctccctgccc

SEQ ID NO: 432689 - DNA, 16 bp, M. musculus
tccagcctcctcctcc

SEQ ID NO: 432690 - DNA, 16 bp, M. musculus
tccagcctctgcctcc

SEQ ID NO: 432691 - DNA, 16 bp, M. musculus
tccagcctctgctgcc

SEQ ID NO: 432692 - DNA, 16 bp, M. musculus
tccagcctgggctaca

SEQ ID NO: 432693 - DNA, 16 bp, M. musculus
tccagccttcatcttc

SEQ ID NO: 432694 - DNA, 16 bp, M. musculus
tccagcctttccccaa

SEQ ID NO: 432695 - DNA, 16 bp, M. musculus
tccagcgccatgcctg

SEQ ID NO: 432696 - DNA, 16 bp, M. musculus
tccagcgcctcttcct

SEQ ID NO: 432697 - DNA, 16 bp, M. musculus
tccagctaaggcccag

SEQ ID NO: 432698 - DNA, 16 bp, M. musculus
tccagctacatcactg

SEQ ID NO: 432699 - DNA, 16 bp, M. musculus
tccagctactccactg

SEQ ID NO: 432700 - DNA, 16 bp, M. musculus
tccagctccagaggga

SEQ ID NO: 432701 - DNA, 16 bp, M. musculus
tccagctccaggacat

SEQ ID NO: 432702 - DNA, 16 bp, M. musculus
tccagctccaggagaa

SEQ ID NO: 432703 - DNA, 16 bp, M. musculus
tccagctccaggagac

SEQ ID NO: 432704 - DNA, 16 bp, M. musculus
tccagctccagggaag

SEQ ID NO: 432705 - DNA, 16 bp, M. musculus
tccagctccagggaat

SEQ ID NO: 432706 - DNA, 16 bp, M. musculus
tccagctccaggtgat

SEQ ID NO: 432707 - DNA, 16 bp, M. musculus
tccagctccatgtctg

SEQ ID NO: 432708 - DNA, 16 bp, M. musculus
tccagctcctgtctcc

SEQ ID NO: 432709 - DNA, 16 bp, M. musculus
tccagctcctgtgacc

SEQ ID NO: 432710 - DNA, 16 bp, M. musculus
tccagctctagggcat

SEQ ID NO: 432711 - DNA, 16 bp, M. musculus
tccagctctaggggat

SEQ ID NO: 432712 - DNA, 16 bp, M. musculus
tccagctctgcactct

SEQ ID NO: 432713 - DNA, 16 bp, M. musculus
tccagctctgccctct

SEQ ID NO: 432714 - DNA, 16 bp, M. musculus
tccagctcttcaaagg

SEQ ID NO: 432715 - DNA, 16 bp, M. musculus
tccagctgatgccatc

SEQ ID NO: 432716 - DNA, 16 bp, M. musculus
tccagctgcatatgca

SEQ ID NO: 432717 - DNA, 17 bp, M. musculus
tccagctgcatatgtaa

SEQ ID NO: 432718 - DNA, 16 bp, M. musculus
tccagctgggtgtggt

SEQ ID NO: 432719 - DNA, 16 bp, M. musculus
tccagctgtgtctggg

SEQ ID NO: 432720 - DNA, 16 bp, M. musculus
tccagcttagtgtttt

SEQ ID NO: 432721 - DNA, 16 bp, M. musculus
tccagcttcagggaat

SEQ ID NO: 432722 - DNA, 16 bp, M. musculus
tccagcttctccattg

SEQ ID NO: 432723 - DNA, 16 bp, M. musculus
tccagcttctctccat

SEQ ID NO: 432724 - DNA, 16 bp, M. musculus
tccagcttctggaaat

SEQ ID NO: 432725 - DNA, 16 bp, M. musculus
tccagcttgtggctat

SEQ ID NO: 432726 - DNA, 16 bp, M. musculus
tccagcttttacatgg

SEQ ID NO: 432727 - DNA, 16 bp, M. musculus
tccagcttttcattct

SEQ ID NO: 432728 - DNA, 17 bp, M. musculus
tccagctttttcctaat

SEQ ID NO: 432729 - DNA, 16 bp, M. musculus
tccaggaaatcaagga

SEQ ID NO: 432730 - DNA, 16 bp, M. musculus
tccaggaaatccaaga

SEQ ID NO: 432731 - DNA, 16 bp, M. musculus
tccaggaaatccagaa

SEQ ID NO: 432732 - DNA, 16 bp, M. musculus
tccaggaaatcctgga

SEQ ID NO: 432733 - DNA, 16 bp, M. musculus
tccaggaaatctgaga

SEQ ID NO: 432734 - DNA, 16 bp, M. musculus
tccaggaacacatcaa

SEQ ID NO: 432735 - DNA, 16 bp, M. musculus
tccaggaagccttcct

SEQ ID NO: 432736 - DNA, 17 bp, M. musculus
tccaggaagtgggagtg

SEQ ID NO: 432737 - DNA, 16 bp, M. musculus
tccaggaatctgcctg

SEQ ID NO: 432738 - DNA, 17 bp, M. musculus
tccaggaatgcagggat

SEQ ID NO: 432739 - DNA, 16 bp, M. musculus
tccaggaatggaactc

SEQ ID NO: 432740 - DNA, 16 bp, M. musculus
tccaggaattccagga

SEQ ID NO: 432741 - DNA, 16 bp, M. musculus
tccaggacaaaatcaa

SEQ ID NO: 432742 - DNA, 16 bp, M. musculus
tccaggacacaatgga

SEQ ID NO: 432743 - DNA, 16 bp, M. musculus
tccaggacactcaggg

SEQ ID NO: 432744 - DNA, 17 bp, M. musculus
tccaggacagcaagggc

SEQ ID NO: 432745 - DNA, 16 bp, M. musculus
tccaggacagcagggg

SEQ ID NO: 432746 - DNA, 17 bp, M. musculus
tccaggacagccaagga

SEQ ID NO: 432747 - DNA, 16 bp, M. musculus
tccaggacagccagac

SEQ ID NO: 432748 - DNA, 16 bp, M. musculus
tccaggacagccagct

SEQ ID NO: 432749 - DNA, 16 bp, M. musculus
tccaggacagccagga

SEQ ID NO: 432750 - DNA, 16 bp, M. musculus
tccaggacagccaggc

SEQ ID NO: 432751 - DNA, 16 bp, M. musculus
tccaggacagccaggt

SEQ ID NO: 432752 - DNA, 16 bp, M. musculus
tccaggacagccagtg

SEQ ID NO: 432753 - DNA, 16 bp, M. musculus
tccaggacagcctgga

SEQ ID NO: 432754 - DNA, 16 bp, M. musculus
tccaggacagcctgtg

SEQ ID NO: 432755 - DNA, 16 bp, M. musculus
tccaggacagtcgggg

SEQ ID NO: 432756 - DNA, 16 bp, M. musculus
tccaggacatccagga

SEQ ID NO: 432757 - DNA, 16 bp, M. musculus
tccaggacatctctgt

SEQ ID NO: 432758 - DNA, 16 bp, M. musculus
tccaggaccaagaagt

SEQ ID NO: 432759 - DNA, 16 bp, M. musculus
tccaggacggccagag

SEQ ID NO: 432760 - DNA, 16 bp, M. musculus
tccaggactccacaga

SEQ ID NO: 432761 - DNA, 16 bp, M. musculus
tccaggacttttatca

SEQ ID NO: 432762 - DNA, 16 bp, M. musculus
tccaggagacatgatt

SEQ ID NO: 432763 - DNA, 16 bp, M. musculus
tccaggagacctgaca

SEQ ID NO: 432764 - DNA, 16 bp, M. musculus
tccaggagacctgatg

SEQ ID NO: 432765 - DNA, 16 bp, M. musculus
tccaggagactgagtt

SEQ ID NO: 432766 - DNA, 16 bp, M. musculus
tccaggagagccagaa

SEQ ID NO: 432767 - DNA, 16 bp, M. musculus
tccaggagagccagag

SEQ ID NO: 432768 - DNA, 16 bp, M. musculus
tccaggagatctgatg

SEQ ID NO: 432769 - DNA, 16 bp, M. musculus
tccaggagattcaaca

SEQ ID NO: 432770 - DNA, 16 bp, M. musculus
tccaggagccagagag

SEQ ID NO: 432771 - DNA, 16 bp, M. musculus
tccaggagctcagaca

SEQ ID NO: 432772 - DNA, 16 bp, M. musculus
tccaggagctggaaag

SEQ ID NO: 432773 - DNA, 16 bp, M. musculus
tccaggagctggagag

SEQ ID NO: 432774 - DNA, 17 bp, M. musculus
tccaggaggtgagtttc

SEQ ID NO: 432775 - DNA, 16 bp, M. musculus
tccaggagtcagttct

SEQ ID NO: 432776 - DNA, 17 bp, M. musculus
tccaggagtcctgagtt

SEQ ID NO: 432777 - DNA, 16 bp, M. musculus
tccaggagtttgtcct

SEQ ID NO: 432778 - DNA, 16 bp, M. musculus
tccaggatacaatgag

SEQ ID NO: 432779 - DNA, 16 bp, M. musculus
tccaggatatccagga

SEQ ID NO: 432780 - DNA, 16 bp, M. musculus
tccaggatttagagga

SEQ ID NO: 432781 - DNA, 16 bp, M. musculus
tccaggcacagatgga

SEQ ID NO: 432782 - DNA, 16 bp, M. musculus
tccaggcagacacagt

SEQ ID NO: 432783 - DNA, 16 bp, M. musculus
tccaggcagggatggt

SEQ ID NO: 432784 - DNA, 16 bp, M. musculus
tccaggcatggtggta

SEQ ID NO: 432785 - DNA, 16 bp, M. musculus
tccaggccactgagag

SEQ ID NO: 432786 - DNA, 16 bp, M. musculus
tccaggccagacagag

SEQ ID NO: 432787 - DNA, 16 bp, M. musculus
tccaggccagccaaag

SEQ ID NO: 432788 - DNA, 16 bp, M. musculus
tccaggccagcccagg

SEQ ID NO: 432789 - DNA, 16 bp, M. musculus
tccaggccagcctggt

SEQ ID NO: 432790 - DNA, 16 bp, M. musculus
tccaggccagctaagg

SEQ ID NO: 432791 - DNA, 16 bp, M. musculus
tccaggccagcttggg

SEQ ID NO: 432792 - DNA, 16 bp, M. musculus
tccaggccaggctggg

SEQ ID NO: 432793 - DNA, 16 bp, M. musculus
tccaggccaggctggt

SEQ ID NO: 432794 - DNA, 16 bp, M. musculus
tccaggccatccagag

SEQ ID NO: 432795 - DNA, 16 bp, M. musculus
tccaggccatccttag

SEQ ID NO: 432796 - DNA, 16 bp, M. musculus
tccaggcccagatcca

SEQ ID NO: 432797 - DNA, 16 bp, M. musculus
tccaggccccacacaa

SEQ ID NO: 432798 - DNA, 16 bp, M. musculus
tccaggccttcaaagg

SEQ ID NO: 432799 - DNA, 16 bp, M. musculus
tccaggctagccagga

SEQ ID NO: 432800 - DNA, 16 bp, M. musculus
tccaggctagccaggg

SEQ ID NO: 432801 - DNA, 16 bp, M. musculus
tccaggctccatggct

SEQ ID NO: 432802 - DNA, 16 bp, M. musculus
tccaggctgacctgaa

SEQ ID NO: 432803 - DNA, 16 bp, M. musculus
tccaggctgccctgga

SEQ ID NO: 432804 - DNA, 16 bp, M. musculus
tccaggctgcttccag

SEQ ID NO: 432805 - DNA, 16 bp, M. musculus
tccaggctggagagat

SEQ ID NO: 432806 - DNA, 16 bp, M. musculus
tccaggctggccagga

SEQ ID NO: 432807 - DNA, 16 bp, M. musculus
tccaggctggcctcaa

SEQ ID NO: 432808 - DNA, 16 bp, M. musculus
tccaggctggcctgga

SEQ ID NO: 432809 - DNA, 16 bp, M. musculus
tccaggctggctggcc

SEQ ID NO: 432810 - DNA, 16 bp, M. musculus
tccaggcttttcccta

SEQ ID NO: 432811 - DNA, 16 bp, M. musculus
tccagggaatctgata

SEQ ID NO: 432812 - DNA, 16 bp, M. musculus
tccagggaatctgatg

SEQ ID NO: 432813 - DNA, 16 bp, M. musculus
tccagggaccaaaacc

SEQ ID NO: 432814 - DNA, 16 bp, M. musculus
tccagggacctcagga

SEQ ID NO: 432815 - DNA, 16 bp, M. musculus
tccagggagaaacgct

SEQ ID NO: 432816 - DNA, 16 bp, M. musculus
tccagggagtcttacc

SEQ ID NO: 432817 - DNA, 16 bp, M. musculus
tccagggatgtaggga

SEQ ID NO: 432818 - DNA, 16 bp, M. musculus
tccagggcaggcccca

SEQ ID NO: 432819 - DNA, 16 bp, M. musculus
tccagggcatccaaca

SEQ ID NO: 432820 - DNA, 16 bp, M. musculus
tccagggcatccaatg

SEQ ID NO: 432821 - DNA, 16 bp, M. musculus
tccagggcatctggca

SEQ ID NO: 432822 - DNA, 16 bp, M. musculus
tccagggccacacaga

SEQ ID NO: 432823 - DNA, 16 bp, M. musculus
tccagggccactgact

SEQ ID NO: 432824 - DNA, 16 bp, M. musculus
tccagggccagctctc

SEQ ID NO: 432825 - DNA, 16 bp, M. musculus
tccagggctctgaatt

SEQ ID NO: 432826 - DNA, 16 bp, M. musculus
tccagggctctgagtt

SEQ ID NO: 432827 - DNA, 16 bp, M. musculus
tccagggcttcctgca

SEQ ID NO: 432828 - DNA, 16 bp, M. musculus
tccagggcttctgaca

SEQ ID NO: 432829 - DNA, 16 bp, M. musculus
tccagggctttgagct

SEQ ID NO: 432830 - DNA, 16 bp, M. musculus
tccaggggaatccaac

SEQ ID NO: 432831 - DNA, 16 bp, M. musculus
tccaggggaatccaat

SEQ ID NO: 432832 - DNA, 16 bp, M. musculus
tccaggggacccaatg

SEQ ID NO: 432833 - DNA, 16 bp, M. musculus
tccaggggatccaatg

SEQ ID NO: 432834 - DNA, 16 bp, M. musculus
tccaggggatccagtg

SEQ ID NO: 432835 - DNA, 16 bp, M. musculus
tccaggggatctgaga

SEQ ID NO: 432836 - DNA, 16 bp, M. musculus
tccagggtgcagacag

SEQ ID NO: 432837 - DNA, 16 bp, M. musculus
tccaggtaaaggcaaa

SEQ ID NO: 432838 - DNA, 16 bp, M. musculus
tccaggtacactcctt

SEQ ID NO: 432839 - DNA, 16 bp, M. musculus
tccaggtcagaaattt

SEQ ID NO: 432840 - DNA, 16 bp, M. musculus
tccaggtcagaagcct

SEQ ID NO: 432841 - DNA, 16 bp, M. musculus
tccaggtcagccaaag

SEQ ID NO: 432842 - DNA, 16 bp, M. musculus
tccaggtcagcctggt

SEQ ID NO: 432843 - DNA, 16 bp, M. musculus
tccaggtccagtgaga

SEQ ID NO: 432844 - DNA, 16 bp, M. musculus
tccaggtccctggagg

SEQ ID NO: 432845 - DNA, 16 bp, M. musculus
tccaggtgtcagagcc

SEQ ID NO: 432846 - DNA, 16 bp, M. musculus
tccaggtgtggtggta

SEQ ID NO: 432847 - DNA, 16 bp, M. musculus
tccaggttcagtttcc

SEQ ID NO: 432848 - DNA, 16 bp, M. musculus
tccaggttcctgccca

SEQ ID NO: 432849 - DNA, 16 bp, M. musculus
tccaggttcctgcccc

SEQ ID NO: 432850 - DNA, 16 bp, M. musculus
tccaggttccttccct

SEQ ID NO: 432851 - DNA, 16 bp, M. musculus
tccaggtttctttcct

SEQ ID NO: 432852 - DNA, 16 bp, M. musculus
tccaggtttgccagga

SEQ ID NO: 432853 - DNA, 16 bp, M. musculus
tccagtaccatgcagt

SEQ ID NO: 432854 - DNA, 16 bp, M. musculus
tccagtagataggcag

SEQ ID NO: 432855 - DNA, 16 bp, M. musculus
tccagtcaaccctgct

SEQ ID NO: 432856 - DNA, 16 bp, M. musculus
tccagtcagcaggagg

SEQ ID NO: 432857 - DNA, 16 bp, M. musculus
tccagtccacaccagc

SEQ ID NO: 432858 - DNA, 16 bp, M. musculus
tccagtcctgtatctg

SEQ ID NO: 432859 - DNA, 16 bp, M. musculus
tccagtccttccccta

SEQ ID NO: 432860 - DNA, 16 bp, M. musculus
tccagtcctttgcaag

SEQ ID NO: 432861 - DNA, 16 bp, M. musculus
tccagtctctggatgg

SEQ ID NO: 432862 - DNA, 16 bp, M. musculus
tccagtctttaaaaaa

SEQ ID NO: 432863 - DNA, 16 bp, M. musculus
tccagtgaagtctgtt

SEQ ID NO: 432864 - DNA, 16 bp, M. musculus
tccagtgcacctcaga

SEQ ID NO: 432865 - DNA, 16 bp, M. musculus
tccagtgccaggagat

SEQ ID NO: 432866 - DNA, 16 bp, M. musculus
tccagtgccatcttct

SEQ ID NO: 432867 - DNA, 16 bp, M. musculus
tccagtggacaaaaga

SEQ ID NO: 432868 - DNA, 16 bp, M. musculus
tccagtggaggagtta

SEQ ID NO: 432869 - DNA, 16 bp, M. musculus
tccagtggaggcttga

SEQ ID NO: 432870 - DNA, 16 bp, M. musculus
tccagtggatctgaca

SEQ ID NO: 432871 - DNA, 16 bp, M. musculus
tccagtgtgggtgctg

SEQ ID NO: 432872 - DNA, 16 bp, M. musculus
tccagtgtttcagaga

SEQ ID NO: 432873 - DNA, 16 bp, M. musculus
tccagtgtttgacaga

SEQ ID NO: 432874 - DNA, 16 bp, M. musculus
tccagtgttttcttct

SEQ ID NO: 432875 - DNA, 16 bp, M. musculus
tccagttagtgctgcc

SEQ ID NO: 432876 - DNA, 16 bp, M. musculus
tccagttccaggggac

SEQ ID NO: 432877 - DNA, 16 bp, M. musculus
tccagttccagggtat

SEQ ID NO: 432878 - DNA, 16 bp, M. musculus
tccagttcctggagat

SEQ ID NO: 432879 - DNA, 16 bp, M. musculus
tccagttctggggatc

SEQ ID NO: 432880 - DNA, 16 bp, M. musculus
tccagttgcagaggat

SEQ ID NO: 432881 - DNA, 16 bp, M. musculus
tccagttgcaggggat

SEQ ID NO: 432882 - DNA, 16 bp, M. musculus
tccagttgttgggaga

SEQ ID NO: 432883 - DNA, 16 bp, M. musculus
tccagtttcagaggat

SEQ ID NO: 432884 - DNA, 16 bp, M. musculus
tccagtttcaggaaat

SEQ ID NO: 432885 - DNA, 16 bp, M. musculus
tccagtttcatgaggc

SEQ ID NO: 432886 - DNA, 16 bp, M. musculus
tccagtttcattttgg

SEQ ID NO: 432887 - DNA, 16 bp, M. musculus
tccagtttcttgagtt

SEQ ID NO: 432888 - DNA, 16 bp, M. musculus
tccagttttatgaggt

SEQ ID NO: 432889 - DNA, 16 bp, M. musculus
tccagttttccattgg

SEQ ID NO: 432890 - DNA, 16 bp, M. musculus
tccagttttctgaaga

SEQ ID NO: 432891 - DNA, 16 bp, M. musculus
tccagttttcttgagt

SEQ ID NO: 432892 - DNA, 16 bp, M. musculus
tccagttttgtccctg

SEQ ID NO: 432893 - DNA, 16 bp, M. musculus
tccagttttgttgaga

SEQ ID NO: 432894 - DNA, 16 bp, M. musculus
tccagttttgtttttg

SEQ ID NO: 432895 - DNA, 16 bp, M. musculus
tccataaaaatactaa

SEQ ID NO: 432896 - DNA, 16 bp, M. musculus
tccataaatccagtcc

SEQ ID NO: 432897 - DNA, 16 bp, M. musculus
tccataagactgggct

SEQ ID NO: 432898 - DNA, 16 bp, M. musculus
tccataagatcaagct

SEQ ID NO: 432899 - DNA, 16 bp, M. musculus
tccataagattaggct

SEQ ID NO: 432900 - DNA, 16 bp, M. musculus
tccataattctgtgac

SEQ ID NO: 432901 - DNA, 16 bp, M. musculus
tccatacacatatgta

SEQ ID NO: 432902 - DNA, 16 bp, M. musculus
tccatacagtctatac

SEQ ID NO: 432903 - DNA, 16 bp, M. musculus
tccatacatgtgctgt

SEQ ID NO: 432904 - DNA, 16 bp, M. musculus
tccataccccattttt

SEQ ID NO: 432905 - DNA, 16 bp, M. musculus
tccatacttacatatg

SEQ ID NO: 432906 - DNA, 16 bp, M. musculus
tccatagatgtgtgga

SEQ ID NO: 432907 - DNA, 16 bp, M. musculus
tccatagtctatagca

SEQ ID NO: 432908 - DNA, 16 bp, M. musculus
tccatagttctgggaa

SEQ ID NO: 432909 - DNA, 16 bp, M. musculus
tccatatccatccatc

SEQ ID NO: 432910 - DNA, 16 bp, M. musculus
tccatatccattcttc

SEQ ID NO: 432911 - DNA, 16 bp, M. musculus
tccatatgtgtatgtg

SEQ ID NO: 432912 - DNA, 16 bp, M. musculus
tccatattttctcaaa

SEQ ID NO: 432913 - DNA, 16 bp, M. musculus
tccatcaacacaatcc

SEQ ID NO: 432914 - DNA, 16 bp, M. musculus
tccatcaaggagatca

SEQ ID NO: 432915 - DNA, 16 bp, M. musculus
tccatcagaatggcct

SEQ ID NO: 432916 - DNA, 16 bp, M. musculus
tccatcagcaagcact

SEQ ID NO: 432917 - DNA, 16 bp, M. musculus
tccatcagctgctgga

SEQ ID NO: 432918 - DNA, 16 bp, M. musculus
tccatcatcaatggga

SEQ ID NO: 432919 - DNA, 16 bp, M. musculus
tccatcatggaggaaa

SEQ ID NO: 432920 - DNA, 16 bp, M. musculus
tccatcattgagagaa

SEQ ID NO: 432921 - DNA, 16 bp, M. musculus
tccatcatttttgtca

SEQ ID NO: 432922 - DNA, 16 bp, M. musculus
tccatccaacagctga

SEQ ID NO: 432923 - DNA, 16 bp, M. musculus
tccatccatccacctc

SEQ ID NO: 432924 - DNA, 16 bp, M. musculus
tccatccatccatccg

SEQ ID NO: 432925 - DNA, 16 bp, M. musculus
tccatccatccatctg

SEQ ID NO: 432926 - DNA, 16 bp, M. musculus
tccatccatctgttca

SEQ ID NO: 432927 - DNA, 16 bp, M. musculus
tccatccattcattca

SEQ ID NO: 432928 - DNA, 16 bp, M. musculus
tccatccatttgccaa

SEQ ID NO: 432929 - DNA, 17 bp, M. musculus
tccatcccataatcagc

SEQ ID NO: 432930 - DNA, 16 bp, M. musculus
tccatcccatatacag

SEQ ID NO: 432931 - DNA, 16 bp, M. musculus
tccatcccatctgtag

SEQ ID NO: 432932 - DNA, 16 bp, M. musculus
tccatccccacagtta

SEQ ID NO: 432933 - DNA, 16 bp, M. musculus
tccatccccagcacct

SEQ ID NO: 432934 - DNA, 16 bp, M. musculus
tccatccccagcatcc

SEQ ID NO: 432935 - DNA, 16 bp, M. musculus
tccatccccagctttc

SEQ ID NO: 432936 - DNA, 16 bp, M. musculus
tccatcccttcactgg

SEQ ID NO: 432937 - DNA, 16 bp, M. musculus
tccatccgtctgtctg

SEQ ID NO: 432938 - DNA, 16 bp, M. musculus
tccatcctactcagtg

SEQ ID NO: 432939 - DNA, 16 bp, M. musculus
tccatcgtgtaaatgt

SEQ ID NO: 432940 - DNA, 16 bp, M. musculus
tccatctacctctgcc

SEQ ID NO: 432941 - DNA, 16 bp, M. musculus
tccatctactcatcca

SEQ ID NO: 432942 - DNA, 16 bp, M. musculus
tccatctactgagatc

SEQ ID NO: 432943 - DNA, 16 bp, M. musculus
tccatctatccattca

SEQ ID NO: 432944 - DNA, 16 bp, M. musculus
tccatctcacagcagt

SEQ ID NO: 432945 - DNA, 18 bp, M. musculus
tccatctccactggggat

SEQ ID NO: 432946 - DNA, 16 bp, M. musculus
tccatctccagcacca

SEQ ID NO: 432947 - DNA, 16 bp, M. musculus
tccatctccccactgt

SEQ ID NO: 432948 - DNA, 16 bp, M. musculus
tccatctctctgcctt

SEQ ID NO: 432949 - DNA, 16 bp, M. musculus
tccatctctgcatctc

SEQ ID NO: 432950 - DNA, 16 bp, M. musculus
tccatctctgcctccc

SEQ ID NO: 432951 - DNA, 16 bp, M. musculus
tccatctctgctgtgc

SEQ ID NO: 432952 - DNA, 16 bp, M. musculus
tccatctctgcttcct

SEQ ID NO: 432953 - DNA, 16 bp, M. musculus
tccatctctgtctctc

SEQ ID NO: 432954 - DNA, 16 bp, M. musculus
tccatctctgtcttcc

SEQ ID NO: 432955 - DNA, 16 bp, M. musculus
tccatctgcccctgcc

SEQ ID NO: 432956 - DNA, 16 bp, M. musculus
tccatctgcctctgac

SEQ ID NO: 432957 - DNA, 16 bp, M. musculus
tccatctgctgcagga

SEQ ID NO: 432958 - DNA, 16 bp, M. musculus
tccatctgcttctgcc

SEQ ID NO: 432959 - DNA, 16 bp, M. musculus
tccatctgggctgctc

SEQ ID NO: 432960 - DNA, 16 bp, M. musculus
tccatctgtcaggtgg

SEQ ID NO: 432961 - DNA, 16 bp, M. musculus
tccatctgtctgtctg

SEQ ID NO: 432962 - DNA, 16 bp, M. musculus
tccatcttacagatga

SEQ ID NO: 432963 - DNA, 16 bp, M. musculus
tccatcttcaaagcca

SEQ ID NO: 432964 - DNA, 16 bp, M. musculus
tccatcttcccactgt

SEQ ID NO: 432965 - DNA, 16 bp, M. musculus
tccatcttcctcctgt

SEQ ID NO: 432966 - DNA, 16 bp, M. musculus
tccatctttatccctg

SEQ ID NO: 432967 - DNA, 16 bp, M. musculus
tccatgaaaggacaca

SEQ ID NO: 432968 - DNA, 16 bp, M. musculus
tccatgaacccagccc

SEQ ID NO: 432969 - DNA, 16 bp, M. musculus
tccatgaagtgtttgc

SEQ ID NO: 432970 - DNA, 16 bp, M. musculus
tccatgaatccagccc

SEQ ID NO: 432971 - DNA, 16 bp, M. musculus
tccatgacaaagggca

SEQ ID NO: 432972 - DNA, 16 bp, M. musculus
tccatgacctctacat

SEQ ID NO: 432973 - DNA, 16 bp, M. musculus
tccatgacctctgctt

SEQ ID NO: 432974 - DNA, 16 bp, M. musculus
tccatgagaaccagct

SEQ ID NO: 432975 - DNA, 17 bp, M. musculus
tccatgagataaaaaca

SEQ ID NO: 432976 - DNA, 16 bp, M. musculus
tccatgagatccagat

SEQ ID NO: 432977 - DNA, 16 bp, M. musculus
tccatgagcaccaggc

SEQ ID NO: 432978 - DNA, 16 bp, M. musculus
tccatgagcagaaata

SEQ ID NO: 432979 - DNA, 16 bp, M. musculus
tccatgaggatgcccc

SEQ ID NO: 432980 - DNA, 16 bp, M. musculus
tccatgaggtgctgag

SEQ ID NO: 432981 - DNA, 16 bp, M. musculus
tccatgatggaagtac

SEQ ID NO: 432982 - DNA, 16 bp, M. musculus
tccatgatggcagagt

SEQ ID NO: 432983 - DNA, 16 bp, M. musculus
tccatgattttagtgg

SEQ ID NO: 432984 - DNA, 16 bp, M. musculus
tccatgccacaggcac

SEQ ID NO: 432985 - DNA, 16 bp, M. musculus
tccatgcccaaggtgc

SEQ ID NO: 432986 - DNA, 16 bp, M. musculus
tccatgcctgcctgga

SEQ ID NO: 432987 - DNA, 16 bp, M. musculus
tccatgctcctcaaag

SEQ ID NO: 432988 - DNA, 16 bp, M. musculus
tccatgcttcccacca

SEQ ID NO: 432989 - DNA, 16 bp, M. musculus
tccatggaactggagt

SEQ ID NO: 432990 - DNA, 16 bp, M. musculus
tccatggagtgtgtgt

SEQ ID NO: 432991 - DNA, 16 bp, M. musculus
tccatggcacagggca

SEQ ID NO: 432992 - DNA, 16 bp, M. musculus
tccatggcctttgcat

SEQ ID NO: 432993 - DNA, 16 bp, M. musculus
tccatggcttcagata

SEQ ID NO: 432994 - DNA, 16 bp, M. musculus
tccatggcttgctcag

SEQ ID NO: 432995 - DNA, 16 bp, M. musculus
tccatgggcaagaacc

SEQ ID NO: 432996 - DNA, 16 bp, M. musculus
tccatgggcaccaggc

SEQ ID NO: 432997 - DNA, 17 bp, M. musculus
tccatgggcagaaatga

SEQ ID NO: 432998 - DNA, 16 bp, M. musculus
tccatggggattttgt

SEQ ID NO: 432999 - DNA, 16 bp, M. musculus
tccatggggctgcaaa

SEQ ID NO: 433000 - DNA, 16 bp, M. musculus
tccatggggggccctg

SEQ ID NO: 433001 - DNA, 16 bp, M. musculus
tccatgggtgtttggt

SEQ ID NO: 433002 - DNA, 16 bp, M. musculus
tccatggttggctgtg

SEQ ID NO: 433003 - DNA, 16 bp, M. musculus
tccatgtacacacaca

SEQ ID NO: 433004 - DNA, 16 bp, M. musculus
tccatgtccatgtcca

SEQ ID NO: 433005 - DNA, 16 bp, M. musculus
tccatgtctgatgtcc

SEQ ID NO: 433006 - DNA, 16 bp, M. musculus
tccatgtgcacacaca

SEQ ID NO: 433007 - DNA, 16 bp, M. musculus
tccatgtggagactgg

SEQ ID NO: 433008 - DNA, 16 bp, M. musculus
tccatgtgtactcttt

SEQ ID NO: 433009 - DNA, 16 bp, M. musculus
tccatgttctctgctt

SEQ ID NO: 433010 - DNA, 16 bp, M. musculus
tccattaatttctctc

SEQ ID NO: 433011 - DNA, 20 bp, M. musculus
tccattacagatggttgtga

SEQ ID NO: 433012 - DNA, 16 bp, M. musculus
tccattatatatatat

SEQ ID NO: 433013 - DNA, 16 bp, M. musculus
tccattatccatccat

SEQ ID NO: 433014 - DNA, 17 bp, M. musculus
tccattatttatgctgt

SEQ ID NO: 433015 - DNA, 16 bp, M. musculus
tccattcattctcatg

SEQ ID NO: 433016 - DNA, 16 bp, M. musculus
tccattcatttgtctg

SEQ ID NO: 433017 - DNA, 16 bp, M. musculus
tccattccatctattt

SEQ ID NO: 433018 - DNA, 16 bp, M. musculus
tccattcccagaaccc

SEQ ID NO: 433019 - DNA, 16 bp, M. musculus
tccattcccagcacct

SEQ ID NO: 433020 - DNA, 16 bp, M. musculus
tccattcccagtacca

SEQ ID NO: 433021 - DNA, 19 bp, M. musculus
tccattcctatatccttgt

SEQ ID NO: 433022 - DNA, 16 bp, M. musculus
tccattcctatctccc

SEQ ID NO: 433023 - DNA, 16 bp, M. musculus
tccattcttcagtgga

SEQ ID NO: 433024 - DNA, 16 bp, M. musculus
tccattctttctgctg

SEQ ID NO: 433025 - DNA, 16 bp, M. musculus
tccattgagaaaatgt

SEQ ID NO: 433026 - DNA, 16 bp, M. musculus
tccattgataataaga

SEQ ID NO: 433027 - DNA, 16 bp, M. musculus
tccattgatcaatctg

SEQ ID NO: 433028 - DNA, 16 bp, M. musculus
tccattgatctagctg

SEQ ID NO: 433029 - DNA, 16 bp, M. musculus
tccattgatgaaaatg

SEQ ID NO: 433030 - DNA, 16 bp, M. musculus
tccattgatgactgac

SEQ ID NO: 433031 - DNA, 16 bp, M. musculus
tccattgctggtgaga

SEQ ID NO: 433032 - DNA, 16 bp, M. musculus
tccattgctgtaacaa

SEQ ID NO: 433033 - DNA, 17 bp, M. musculus
tccattggacatgcaaa

SEQ ID NO: 433034 - DNA, 16 bp, M. musculus
tccattgtggtctgat

SEQ ID NO: 433035 - DNA, 16 bp, M. musculus
tccatttattttcctg

SEQ ID NO: 433036 - DNA, 16 bp, M. musculus
tccatttcaaatgtta

SEQ ID NO: 433037 - DNA, 16 bp, M. musculus
tccatttccagcaccc

SEQ ID NO: 433038 - DNA, 16 bp, M. musculus
tccatttctctaccac

SEQ ID NO: 433039 - DNA, 16 bp, M. musculus
tccatttctgtgtttt

SEQ ID NO: 433040 - DNA, 16 bp, M. musculus
tccatttctgttttct

SEQ ID NO: 433041 - DNA, 16 bp, M. musculus
tccatttcttttaaaa

SEQ ID NO: 433042 - DNA, 16 bp, M. musculus
tccatttgcaatcagc

SEQ ID NO: 433043 - DNA, 16 bp, M. musculus
tccatttgcctgtgaa

SEQ ID NO: 433044 - DNA, 16 bp, M. musculus
tccatttgccttcaaa

SEQ ID NO: 433045 - DNA, 16 bp, M. musculus
tccatttgcttggaat

SEQ ID NO: 433046 - DNA, 16 bp, M. musculus
tccatttgtctgtgaa

SEQ ID NO: 433047 - DNA, 16 bp, M. musculus
tccatttgttgattct

SEQ ID NO: 433048 - DNA, 16 bp, M. musculus
tccatttgtttaagaa

SEQ ID NO: 433049 - DNA, 16 bp, M. musculus
tccatttgtttgcaaa

SEQ ID NO: 433050 - DNA, 16 bp, M. musculus
tccattttacaagcag

SEQ ID NO: 433051 - DNA, 16 bp, M. musculus
tccattttattgattt

SEQ ID NO: 433052 - DNA, 16 bp, M. musculus
tccatttttaaaagat

SEQ ID NO: 433053 - DNA, 16 bp, M. musculus
tccatttttatgtctt

SEQ ID NO: 433054 - DNA, 16 bp, M. musculus
tccatttttctaagaa

SEQ ID NO: 433055 - DNA, 16 bp, M. musculus
tccatttttctctcca

SEQ ID NO: 433056 - DNA, 16 bp, M. musculus
tccatttttgtatttg

SEQ ID NO: 433057 - DNA, 16 bp, M. musculus
tccatttttgtcccta

SEQ ID NO: 433058 - DNA, 16 bp, M. musculus
tccatttttgtccctg

SEQ ID NO: 433059 - DNA, 16 bp, M. musculus
tccatttttttaaaaa

SEQ ID NO: 433060 - DNA, 16 bp, M. musculus
tcccaaaacaaaagaa

SEQ ID NO: 433061 - DNA, 16 bp, M. musculus
tcccaaaagcaggcaa

SEQ ID NO: 433062 - DNA, 16 bp, M. musculus
tcccaaaagtccctcc

SEQ ID NO: 433063 - DNA, 16 bp, M. musculus
tcccaaacagttccac

SEQ ID NO: 433064 - DNA, 16 bp, M. musculus
tcccaaacctcaggaa

SEQ ID NO: 433065 - DNA, 21 bp, M. musculus
tcccaaaggtcttttctgtga

SEQ ID NO: 433066 - DNA, 16 bp, M. musculus
tcccaaagttcctaag

SEQ ID NO: 433067 - DNA, 16 bp, M. musculus
tcccaaatagttccac

SEQ ID NO: 433068 - DNA, 16 bp, M. musculus
tcccaaatgctgggat

SEQ ID NO: 433069 - DNA, 16 bp, M. musculus
tcccaaatgttgcctc

SEQ ID NO: 433070 - DNA, 16 bp, M. musculus
tcccaacaaccacatg

SEQ ID NO: 433071 - DNA, 16 bp, M. musculus
tcccaacaaccacatt

SEQ ID NO: 433072 - DNA, 16 bp, M. musculus
tcccaacaaccatatg

SEQ ID NO: 433073 - DNA, 16 bp, M. musculus
tcccaacactccagag

SEQ ID NO: 433074 - DNA, 16 bp, M. musculus
tcccaacagtggtcag

SEQ ID NO: 433075 - DNA, 16 bp, M. musculus
tcccaacctgcttctt

SEQ ID NO: 433076 - DNA, 16 bp, M. musculus
tcccaactcctcccaa

SEQ ID NO: 433077 - DNA, 16 bp, M. musculus
tcccaagaacccacat

SEQ ID NO: 433078 - DNA, 16 bp, M. musculus
tcccaagacagccagg

SEQ ID NO: 433079 - DNA, 16 bp, M. musculus
tcccaagagacagcta

SEQ ID NO: 433080 - DNA, 16 bp, M. musculus
tcccaagagcagacaa

SEQ ID NO: 433081 - DNA, 16 bp, M. musculus
tcccaagagctaggat

SEQ ID NO: 433082 - DNA, 16 bp, M. musculus
tcccaagattcttcca

SEQ ID NO: 433083 - DNA, 16 bp, M. musculus
tcccaaggaagtgcaa

SEQ ID NO: 433084 - DNA, 16 bp, M. musculus
tcccaaggtttcctgt

SEQ ID NO: 433085 - DNA, 16 bp, M. musculus
tcccaagtacagggat

SEQ ID NO: 433086 - DNA, 16 bp, M. musculus
tcccaagtactaggat

SEQ ID NO: 433087 - DNA, 16 bp, M. musculus
tcccaagtcaaagggc

SEQ ID NO: 433088 - DNA, 16 bp, M. musculus
tcccaagtgattctag

SEQ ID NO: 433089 - DNA, 16 bp, M. musculus
tcccaagtgcagagat

SEQ ID NO: 433090 - DNA, 16 bp, M. musculus
tcccaagtgctgagat

SEQ ID NO: 433091 - DNA, 16 bp, M. musculus
tcccaagtgctgcagc

SEQ ID NO: 433092 - DNA, 16 bp, M. musculus
tcccaagttccattac

SEQ ID NO: 433093 - DNA, 16 bp, M. musculus
tcccaagttgctttgg

SEQ ID NO: 433094 - DNA, 16 bp, M. musculus
tcccaatcttctgaga

SEQ ID NO: 433095 - DNA, 16 bp, M. musculus
tcccaatttgggcctg

SEQ ID NO: 433096 - DNA, 16 bp, M. musculus
tcccacaacatccaga

SEQ ID NO: 433097 - DNA, 16 bp, M. musculus
tcccacaaccacaggg

SEQ ID NO: 433098 - DNA, 16 bp, M. musculus
tcccacaagcacaaac

SEQ ID NO: 433099 - DNA, 31 bp, M. musculus
tcccacaagcacaaaggatggagccgagatg

SEQ ID NO: 433100 - DNA, 16 bp, M. musculus
tcccacaagcctgaag

SEQ ID NO: 433101 - DNA, 16 bp, M. musculus
tcccacaagttgttct

SEQ ID NO: 433102 - DNA, 16 bp, M. musculus
tcccacaatgcatctg

SEQ ID NO: 433103 - DNA, 16 bp, M. musculus
tcccacacaggtccct

SEQ ID NO: 433104 - DNA, 16 bp, M. musculus
tcccacacaggtgaga

SEQ ID NO: 433105 - DNA, 16 bp, M. musculus
tcccacacccctgtca

SEQ ID NO: 433106 - DNA, 16 bp, M. musculus
tcccacagattgaggg

SEQ ID NO: 433107 - DNA, 16 bp, M. musculus
tcccacagccccctgc

SEQ ID NO: 433108 - DNA, 16 bp, M. musculus
tcccacagcctgagga

SEQ ID NO: 433109 - DNA, 17 bp, M. musculus
tcccacagtaggcccag

SEQ ID NO: 433110 - DNA, 16 bp, M. musculus
tcccacagtccccaga

SEQ ID NO: 433111 - DNA, 16 bp, M. musculus
tcccaccaaggccaga

SEQ ID NO: 433112 - DNA, 16 bp, M. musculus
tcccaccacacccagc

SEQ ID NO: 433113 - DNA, 16 bp, M. musculus
tcccaccaccaatgga

SEQ ID NO: 433114 - DNA, 16 bp, M. musculus
tcccaccactcaggag

SEQ ID NO: 433115 - DNA, 16 bp, M. musculus
tcccaccagagaactc

SEQ ID NO: 433116 - DNA, 16 bp, M. musculus
tcccaccagcaaagga

SEQ ID NO: 433117 - DNA, 16 bp, M. musculus
tcccaccagcactgga

SEQ ID NO: 433118 - DNA, 16 bp, M. musculus
tcccacctcacccagt

SEQ ID NO: 433119 - DNA, 16 bp, M. musculus
tcccacctcagccaga

SEQ ID NO: 433120 - DNA, 16 bp, M. musculus
tcccacctcagtgaac

SEQ ID NO: 433121 - DNA, 16 bp, M. musculus
tcccacctccacagtg

SEQ ID NO: 433122 - DNA, 16 bp, M. musculus
tcccacctctgcctct

SEQ ID NO: 433123 - DNA, 16 bp, M. musculus
tcccacctgcctctgc

SEQ ID NO: 433124 - DNA, 16 bp, M. musculus
tcccacctgtcccttc

SEQ ID NO: 433125 - DNA, 16 bp, M. musculus
tcccaccttgatgata

SEQ ID NO: 433126 - DNA, 16 bp, M. musculus
tcccacctttgatcac

SEQ ID NO: 433127 - DNA, 16 bp, M. musculus
tcccacgtgctgggat

SEQ ID NO: 433128 - DNA, 16 bp, M. musculus
tcccactcagttccct

SEQ ID NO: 433129 - DNA, 16 bp, M. musculus
tcccactcctgcttcc

SEQ ID NO: 433130 - DNA, 16 bp, M. musculus
tcccactctcatgacc

SEQ ID NO: 433131 - DNA, 16 bp, M. musculus
tcccactctgtcctct

SEQ ID NO: 433132 - DNA, 16 bp, M. musculus
tcccactgagaccaga

SEQ ID NO: 433133 - DNA, 16 bp, M. musculus
tcccactgaggccaga

SEQ ID NO: 433134 - DNA, 16 bp, M. musculus
tcccactgatgcatga

SEQ ID NO: 433135 - DNA, 16 bp, M. musculus
tcccactgatggccta

SEQ ID NO: 433136 - DNA, 17 bp, M. musculus
tcccactgcagcaggag

SEQ ID NO: 433137 - DNA, 16 bp, M. musculus
tcccacttcctgaccc

SEQ ID NO: 433138 - DNA, 16 bp, M. musculus
tcccacttcctgggcc

SEQ ID NO: 433139 - DNA, 19 bp, M. musculus
tcccacttcttggccctgt

SEQ ID NO: 433140 - DNA, 17 bp, M. musculus
tcccactttgggtctgt

SEQ ID NO: 433141 - DNA, 16 bp, M. musculus
tcccagaaaatccttg

SEQ ID NO: 433142 - DNA, 16 bp, M. musculus
tcccagaaacacccta

SEQ ID NO: 433143 - DNA, 16 bp, M. musculus
tcccagaaaccacata

SEQ ID NO: 433144 - DNA, 16 bp, M. musculus
tcccagaaaccacatg

SEQ ID NO: 433145 - DNA, 16 bp, M. musculus
tcccagaacatgggag

SEQ ID NO: 433146 - DNA, 16 bp, M. musculus
tcccagaaccacatgg

SEQ ID NO: 433147 - DNA, 16 bp, M. musculus
tcccagaacccaacag

SEQ ID NO: 433148 - DNA, 16 bp, M. musculus
tcccagaactcaggaa

SEQ ID NO: 433149 - DNA, 16 bp, M. musculus
tcccagaactctctct

SEQ ID NO: 433150 - DNA, 16 bp, M. musculus
tcccagaactgaggag

SEQ ID NO: 433151 - DNA, 16 bp, M. musculus
tcccagaagcagagag

SEQ ID NO: 433152 - DNA, 16 bp, M. musculus
tcccagaagctcttag

SEQ ID NO: 433153 - DNA, 21 bp, M. musculus
tcccagaagctgtcagcttct

SEQ ID NO: 433154 - DNA, 16 bp, M. musculus
tcccagaagctgtgag

SEQ ID NO: 433155 - DNA, 16 bp, M. musculus
tcccagacaccagaga

SEQ ID NO: 433156 - DNA, 16 bp, M. musculus
tcccagacactccttc

SEQ ID NO: 433157 - DNA, 16 bp, M. musculus
tcccagacctcaagct

SEQ ID NO: 433158 - DNA, 16 bp, M. musculus
tcccagactggcctca

SEQ ID NO: 433159 - DNA, 16 bp, M. musculus
tcccagactggcttca

SEQ ID NO: 433160 - DNA, 16 bp, M. musculus
tcccagagaagctgca

SEQ ID NO: 433161 - DNA, 16 bp, M. musculus
tcccagagactaagtc

SEQ ID NO: 433162 - DNA, 16 bp, M. musculus
tcccagagagctctgg

SEQ ID NO: 433163 - DNA, 16 bp, M. musculus
tcccagagatctggga

SEQ ID NO: 433164 - DNA, 16 bp, M. musculus
tcccagagatgcagag

SEQ ID NO: 433165 - DNA, 16 bp, M. musculus
tcccagagcaagaggt

SEQ ID NO: 433166 - DNA, 16 bp, M. musculus
tcccagagcacccagg

SEQ ID NO: 433167 - DNA, 16 bp, M. musculus
tcccagagctgggatt

SEQ ID NO: 433168 - DNA, 16 bp, M. musculus
tcccagagctgtgtct

SEQ ID NO: 433169 - DNA, 16 bp, M. musculus
tcccagaggaataata

SEQ ID NO: 433170 - DNA, 16 bp, M. musculus
tcccagaggacccagg

SEQ ID NO: 433171 - DNA, 16 bp, M. musculus
tcccagaggcagagaa

SEQ ID NO: 433172 - DNA, 16 bp, M. musculus
tcccagaggcagagag

SEQ ID NO: 433173 - DNA, 16 bp, M. musculus
tcccagaggcaggtgg

SEQ ID NO: 433174 - DNA, 16 bp, M. musculus
tcccagagtggttgta

SEQ ID NO: 433175 - DNA, 16 bp, M. musculus
tcccagagttcccagg

SEQ ID NO: 433176 - DNA, 16 bp, M. musculus
tcccagatccactgct

SEQ ID NO: 433177 - DNA, 16 bp, M. musculus
tcccagatccaggcat

SEQ ID NO: 433178 - DNA, 16 bp, M. musculus
tcccagatccctctct

SEQ ID NO: 433179 - DNA, 16 bp, M. musculus
tcccagatccctctga

SEQ ID NO: 433180 - DNA, 16 bp, M. musculus
tcccagatgccaagaa

SEQ ID NO: 433181 - DNA, 16 bp, M. musculus
tcccagatgtccctca

SEQ ID NO: 433182 - DNA, 16 bp, M. musculus
tcccagattgaaaact

SEQ ID NO: 433183 - DNA, 16 bp, M. musculus
tcccagcaacatggtg

SEQ ID NO: 433184 - DNA, 16 bp, M. musculus
tcccagcaaccacact

SEQ ID NO: 433185 - DNA, 16 bp, M. musculus
tcccagcaaccacagg

SEQ ID NO: 433186 - DNA, 16 bp, M. musculus
tcccagcaaccacata

SEQ ID NO: 433187 - DNA, 18 bp, M. musculus
tcccagcaaccacatgga

SEQ ID NO: 433188 - DNA, 30 bp, M. musculus
tcccagcaaccacatggtggctcacaacca

SEQ ID NO: 433189 - DNA, 20 bp, M. musculus
tcccagcaaccacatggtgt

SEQ ID NO: 433190 - DNA, 17 bp, M. musculus
tcccagcaaccacatgt

SEQ ID NO: 433191 - DNA, 16 bp, M. musculus
tcccagcaaccgcatg

SEQ ID NO: 433192 - DNA, 16 bp, M. musculus
tcccagcaatcacacg

SEQ ID NO: 433193 - DNA, 16 bp, M. musculus
tcccagcaatggaaac

SEQ ID NO: 433194 - DNA, 16 bp, M. musculus
tcccagcacagaggag

SEQ ID NO: 433195 - DNA, 16 bp, M. musculus
tcccagcaccaacatc

SEQ ID NO: 433196 - DNA, 16 bp, M. musculus
tcccagcaccacacag

SEQ ID NO: 433197 - DNA, 16 bp, M. musculus
tcccagcaccaggagg

SEQ ID NO: 433198 - DNA, 16 bp, M. musculus
tcccagcaccagggag

SEQ ID NO: 433199 - DNA, 16 bp, M. musculus
tcccagcacccaagag

SEQ ID NO: 433200 - DNA, 16 bp, M. musculus
tcccagcacccacaga

SEQ ID NO: 433201 - DNA, 16 bp, M. musculus
tcccagcacccagatg

SEQ ID NO: 433202 - DNA, 16 bp, M. musculus
tcccagcacccatgtt

SEQ ID NO: 433203 - DNA, 16 bp, M. musculus
tcccagcacctacaag

SEQ ID NO: 433204 - DNA, 16 bp, M. musculus
tcccagcacctacatc

SEQ ID NO: 433205 - DNA, 16 bp, M. musculus
tcccagcacctacatg

SEQ ID NO: 433206 - DNA, 16 bp, M. musculus
tcccagcacctatgta

SEQ ID NO: 433207 - DNA, 16 bp, M. musculus
tcccagcactagaaag

SEQ ID NO: 433208 - DNA, 16 bp, M. musculus
tcccagcactagagaa

SEQ ID NO: 433209 - DNA, 16 bp, M. musculus
tcccagcactaggaag

SEQ ID NO: 433210 - DNA, 16 bp, M. musculus
tcccagcactcaggtg

SEQ ID NO: 433211 - DNA, 16 bp, M. musculus
tcccagcactcggaag

SEQ ID NO: 433212 - DNA, 16 bp, M. musculus
tcccagcactgagaaa

SEQ ID NO: 433213 - DNA, 16 bp, M. musculus
tcccagcactggagag

SEQ ID NO: 433214 - DNA, 16 bp, M. musculus
tcccagcactggggaa

SEQ ID NO: 433215 - DNA, 16 bp, M. musculus
tcccagcactggggga

SEQ ID NO: 433216 - DNA, 16 bp, M. musculus
tcccagcactggggtt

SEQ ID NO: 433217 - DNA, 16 bp, M. musculus
tcccagcactgtggag

SEQ ID NO: 433218 - DNA, 16 bp, M. musculus
tcccagcacttgcagg

SEQ ID NO: 433219 - DNA, 16 bp, M. musculus
tcccagcacttggaaa

SEQ ID NO: 433220 - DNA, 16 bp, M. musculus
tcccagcacttggagg

SEQ ID NO: 433221 - DNA, 16 bp, M. musculus
tcccagcagcacccag

SEQ ID NO: 433222 - DNA, 16 bp, M. musculus
tcccagcagccacatg

SEQ ID NO: 433223 - DNA, 17 bp, M. musculus
tcccagcagccacatgg

SEQ ID NO: 433224 - DNA, 16 bp, M. musculus
tcccagcagccacgtg

SEQ ID NO: 433225 - DNA, 16 bp, M. musculus
tcccagcagccttcag

SEQ ID NO: 433226 - DNA, 16 bp, M. musculus
tcccagcagggcatag

SEQ ID NO: 433227 - DNA, 16 bp, M. musculus
tcccagcaggtagcag

SEQ ID NO: 433228 - DNA, 16 bp, M. musculus
tcccagcatccatgtc

SEQ ID NO: 433229 - DNA, 16 bp, M. musculus
tcccagcatccctcag

SEQ ID NO: 433230 - DNA, 16 bp, M. musculus
tcccagcatctctcag

SEQ ID NO: 433231 - DNA, 16 bp, M. musculus
tcccagcatctgggaa

SEQ ID NO: 433232 - DNA, 16 bp, M. musculus
tcccagcatgcactgg

SEQ ID NO: 433233 - DNA, 16 bp, M. musculus
tcccagcatgcatctg

SEQ ID NO: 433234 - DNA, 16 bp, M. musculus
tcccagcatgccctgc

SEQ ID NO: 433235 - DNA, 16 bp, M. musculus
tcccagcatgctttgc

SEQ ID NO: 433236 - DNA, 16 bp, M. musculus
tcccagcatggagagg

SEQ ID NO: 433237 - DNA, 16 bp, M. musculus
tcccagcattccagag

SEQ ID NO: 433238 - DNA, 16 bp, M. musculus
tcccagcattcctcag

SEQ ID NO: 433239 - DNA, 16 bp, M. musculus
tcccagcatttagaag

SEQ ID NO: 433240 - DNA, 16 bp, M. musculus
tcccagcatttgggaa

SEQ ID NO: 433241 - DNA, 18 bp, M. musculus
tcccagccaaaaaaagcc

SEQ ID NO: 433242 - DNA, 16 bp, M. musculus
tcccagccaaaaagag

SEQ ID NO: 433243 - DNA, 16 bp, M. musculus
tcccagccacaactgc

SEQ ID NO: 433244 - DNA, 16 bp, M. musculus
tcccagccatctgtaa

SEQ ID NO: 433245 - DNA, 16 bp, M. musculus
tcccagccccagctcc

SEQ ID NO: 433246 - DNA, 16 bp, M. musculus
tcccagcccctcactg

SEQ ID NO: 433247 - DNA, 16 bp, M. musculus
tcccagcccctgggag

SEQ ID NO: 433248 - DNA, 16 bp, M. musculus
tcccagcctcttgttg

SEQ ID NO: 433249 - DNA, 16 bp, M. musculus
tcccagcctgagctgc

SEQ ID NO: 433250 - DNA, 16 bp, M. musculus
tcccagccttgagcag

SEQ ID NO: 433251 - DNA, 16 bp, M. musculus
tcccagcgcttgggag

SEQ ID NO: 433252 - DNA, 16 bp, M. musculus
tcccagctacttggga

SEQ ID NO: 433253 - DNA, 16 bp, M. musculus
tcccagctcaaagaac

SEQ ID NO: 433254 - DNA, 16 bp, M. musculus
tcccagctcttgggaa

SEQ ID NO: 433255 - DNA, 16 bp, M. musculus
tcccagctgctctgcc

SEQ ID NO: 433256 - DNA, 16 bp, M. musculus
tcccagcttccagaac

SEQ ID NO: 433257 - DNA, 16 bp, M. musculus
tcccaggaacccacag

SEQ ID NO: 433258 - DNA, 16 bp, M. musculus
tcccaggaagctctgg

SEQ ID NO: 433259 - DNA, 16 bp, M. musculus
tcccaggacagcctgg

SEQ ID NO: 433260 - DNA, 16 bp, M. musculus
tcccaggaccaaatgg

SEQ ID NO: 433261 - DNA, 16 bp, M. musculus
tcccaggacccaaagg

SEQ ID NO: 433262 - DNA, 16 bp, M. musculus
tcccaggacccagcag

SEQ ID NO: 433263 - DNA, 16 bp, M. musculus
tcccaggacccaggag

SEQ ID NO: 433264 - DNA, 16 bp, M. musculus
tcccaggactcaagag

SEQ ID NO: 433265 - DNA, 16 bp, M. musculus
tcccaggactctggag

SEQ ID NO: 433266 - DNA, 18 bp, M. musculus
tcccaggactgttgaatt

SEQ ID NO: 433267 - DNA, 16 bp, M. musculus
tcccaggacttgagcg

SEQ ID NO: 433268 - DNA, 16 bp, M. musculus
tcccaggagacagagg

SEQ ID NO: 433269 - DNA, 16 bp, M. musculus
tcccaggaggaagaga

SEQ ID NO: 433270 - DNA, 16 bp, M. musculus
tcccaggaggcagagg

SEQ ID NO: 433271 - DNA, 16 bp, M. musculus
tcccaggatagccagg

SEQ ID NO: 433272 - DNA, 16 bp, M. musculus
tcccaggatccacatg

SEQ ID NO: 433273 - DNA, 16 bp, M. musculus
tcccaggatgaccttg

SEQ ID NO: 433274 - DNA, 16 bp, M. musculus
tcccaggcagggcaga

SEQ ID NO: 433275 - DNA, 16 bp, M. musculus
tcccaggccaccctgg

SEQ ID NO: 433276 - DNA, 16 bp, M. musculus
tcccaggccagccaag

SEQ ID NO: 433277 - DNA, 16 bp, M. musculus
tcccaggccagcctgg

SEQ ID NO: 433278 - DNA, 16 bp, M. musculus
tcccaggccagtgaga

SEQ ID NO: 433279 - DNA, 16 bp, M. musculus
tcccaggccttgggaa

SEQ ID NO: 433280 - DNA, 16 bp, M. musculus
tcccaggctagacaca

SEQ ID NO: 433281 - DNA, 16 bp, M. musculus
tcccaggctgacctta

SEQ ID NO: 433282 - DNA, 16 bp, M. musculus
tcccaggctgatcctg

SEQ ID NO: 433283 - DNA, 16 bp, M. musculus
tcccaggctggcctca

SEQ ID NO: 433284 - DNA, 16 bp, M. musculus
tcccaggctggctggc

SEQ ID NO: 433285 - DNA, 16 bp, M. musculus
tcccagggacctagca

SEQ ID NO: 433286 - DNA, 16 bp, M. musculus
tcccagggagccctgg

SEQ ID NO: 433287 - DNA, 16 bp, M. musculus
tcccagggatccagct

SEQ ID NO: 433288 - DNA, 16 bp, M. musculus
tcccagggatgcagga

SEQ ID NO: 433289 - DNA, 16 bp, M. musculus
tcccagggatggttca

SEQ ID NO: 433290 - DNA, 16 bp, M. musculus
tcccagggtggcagcc

SEQ ID NO: 433291 - DNA, 16 bp, M. musculus
tcccaggtccctgtgg

SEQ ID NO: 433292 - DNA, 16 bp, M. musculus
tcccaggtgaccctag

SEQ ID NO: 433293 - DNA, 16 bp, M. musculus
tcccaggtgactccag

SEQ ID NO: 433294 - DNA, 16 bp, M. musculus
tcccaggtgctgggat

SEQ ID NO: 433295 - DNA, 16 bp, M. musculus
tcccaggtgggctgat

SEQ ID NO: 433296 - DNA, 16 bp, M. musculus
tcccaggtgtacccag

SEQ ID NO: 433297 - DNA, 16 bp, M. musculus
tcccagtactcaggaa

SEQ ID NO: 433298 - DNA, 16 bp, M. musculus
tcccagtcctgacttc

SEQ ID NO: 433299 - DNA, 16 bp, M. musculus
tcccagtcttccctcc

SEQ ID NO: 433300 - DNA, 16 bp, M. musculus
tcccagtgaagatcca

SEQ ID NO: 433301 - DNA, 16 bp, M. musculus
tcccagtgaagcaagt

SEQ ID NO: 433302 - DNA, 16 bp, M. musculus
tcccagtgccagggag

SEQ ID NO: 433303 - DNA, 16 bp, M. musculus
tcccagtgctgggagg

SEQ ID NO: 433304 - DNA, 16 bp, M. musculus
tcccagttgagtcaga

SEQ ID NO: 433305 - DNA, 16 bp, M. musculus
tcccagtttcccatcc

SEQ ID NO: 433306 - DNA, 16 bp, M. musculus
tcccagtttcttcagc

SEQ ID NO: 433307 - DNA, 16 bp, M. musculus
tcccagtttgctttct

SEQ ID NO: 433308 - DNA, 16 bp, M. musculus
tcccataacagatggt

SEQ ID NO: 433309 - DNA, 16 bp, M. musculus
tcccataatccttccc

SEQ ID NO: 433310 - DNA, 16 bp, M. musculus
tcccatcaaccacatg

SEQ ID NO: 433311 - DNA, 16 bp, M. musculus
tcccatcacttaggag

SEQ ID NO: 433312 - DNA, 16 bp, M. musculus
tcccatccatccatcc

SEQ ID NO: 433313 - DNA, 16 bp, M. musculus
tcccatccttgatcac

SEQ ID NO: 433314 - DNA, 16 bp, M. musculus
tcccatctctgccttc

SEQ ID NO: 433315 - DNA, 16 bp, M. musculus
tcccatctgccaaaag

SEQ ID NO: 433316 - DNA, 16 bp, M. musculus
tcccatctggaaaaca

SEQ ID NO: 433317 - DNA, 16 bp, M. musculus
tcccatcttccactga

SEQ ID NO: 433318 - DNA, 16 bp, M. musculus
tcccatgcatcctctc

SEQ ID NO: 433319 - DNA, 16 bp, M. musculus
tcccatgccctcctct

SEQ ID NO: 433320 - DNA, 16 bp, M. musculus
tcccatggagctggag

SEQ ID NO: 433321 - DNA, 16 bp, M. musculus
tcccatggcggatcct

SEQ ID NO: 433322 - DNA, 16 bp, M. musculus
tcccatgtctgcctgt

SEQ ID NO: 433323 - DNA, 16 bp, M. musculus
tcccatgtgctgggat

SEQ ID NO: 433324 - DNA, 16 bp, M. musculus
tcccatgtgtcaccag

SEQ ID NO: 433325 - DNA, 16 bp, M. musculus
tcccattaatgaccaa

SEQ ID NO: 433326 - DNA, 16 bp, M. musculus
tcccattgatgccaca

SEQ ID NO: 433327 - DNA, 16 bp, M. musculus
tcccattgatgccaga

SEQ ID NO: 433328 - DNA, 16 bp, M. musculus
tcccattgggtcctgg

SEQ ID NO: 433329 - DNA, 16 bp, M. musculus
tcccatttgtcaatgc

SEQ ID NO: 433330 - DNA, 16 bp, M. musculus
tcccattttacagatg

SEQ ID NO: 433331 - DNA, 16 bp, M. musculus
tcccattttttaaaaa

SEQ ID NO: 433332 - DNA, 16 bp, M. musculus
tccccaaagaagcttt

SEQ ID NO: 433333 - DNA, 16 bp, M. musculus
tccccaaagaaggagc

SEQ ID NO: 433334 - DNA, 16 bp, M. musculus
tccccaaagctcccag

SEQ ID NO: 433335 - DNA, 16 bp, M. musculus
tccccaaaggacatgc

SEQ ID NO: 433336 - DNA, 17 bp, M. musculus
tccccaactgaagctcc

SEQ ID NO: 433337 - DNA, 16 bp, M. musculus
tccccaagacccacct

SEQ ID NO: 433338 - DNA, 16 bp, M. musculus
tccccaagctctatcc

SEQ ID NO: 433339 - DNA, 16 bp, M. musculus
tccccaagctctgcct

SEQ ID NO: 433340 - DNA, 16 bp, M. musculus
tccccaaggaagagca

SEQ ID NO: 433341 - DNA, 16 bp, M. musculus
tccccaataaaaggac

SEQ ID NO: 433342 - DNA, 16 bp, M. musculus
tccccaatgctgggat

SEQ ID NO: 433343 - DNA, 16 bp, M. musculus
tccccacagacatgcc

SEQ ID NO: 433344 - DNA, 16 bp, M. musculus
tccccacagctaccct

SEQ ID NO: 433345 - DNA, 16 bp, M. musculus
tccccacaggctgcac

SEQ ID NO: 433346 - DNA, 16 bp, M. musculus
tccccaccacaccctg

SEQ ID NO: 433347 - DNA, 16 bp, M. musculus
tccccactcccactgc

SEQ ID NO: 433348 - DNA, 16 bp, M. musculus
tccccactccctgagg

SEQ ID NO: 433349 - DNA, 16 bp, M. musculus
tccccactccctgggg

SEQ ID NO: 433350 - DNA, 16 bp, M. musculus
tccccactgagccacc

SEQ ID NO: 433351 - DNA, 16 bp, M. musculus
tccccactgcagctgt

SEQ ID NO: 433352 - DNA, 16 bp, M. musculus
tccccactttttggcc

SEQ ID NO: 433353 - DNA, 16 bp, M. musculus
tccccagaacccacag

SEQ ID NO: 433354 - DNA, 16 bp, M. musculus
tccccagaagccatca

SEQ ID NO: 433355 - DNA, 16 bp, M. musculus
tccccagaatccacat

SEQ ID NO: 433356 - DNA, 16 bp, M. musculus
tccccagaattctaaa

SEQ ID NO: 433357 - DNA, 16 bp, M. musculus
tccccagagaactctc

SEQ ID NO: 433358 - DNA, 16 bp, M. musculus
tccccagagaagagca

SEQ ID NO: 433359 - DNA, 16 bp, M. musculus
tccccagagcccacag

SEQ ID NO: 433360 - DNA, 16 bp, M. musculus
tccccagagctctcag

SEQ ID NO: 433361 - DNA, 22 bp, M. musculus
tccccagagctctggctttccc

SEQ ID NO: 433362 - DNA, 16 bp, M. musculus
tccccagagttcccag

SEQ ID NO: 433363 - DNA, 16 bp, M. musculus
tccccagcacagggat

SEQ ID NO: 433364 - DNA, 16 bp, M. musculus
tccccagcacccaggt

SEQ ID NO: 433365 - DNA, 16 bp, M. musculus
tccccagcacctgcat

SEQ ID NO: 433366 - DNA, 16 bp, M. musculus
tccccagcactgcaga

SEQ ID NO: 433367 - DNA, 16 bp, M. musculus
tccccagcagccatca

SEQ ID NO: 433368 - DNA, 16 bp, M. musculus
tccccagcccccacat

SEQ ID NO: 433369 - DNA, 16 bp, M. musculus
tccccagcccctgcct

SEQ ID NO: 433370 - DNA, 16 bp, M. musculus
tccccagcctcagcct

SEQ ID NO: 433371 - DNA, 16 bp, M. musculus
tccccagcctctgcct

SEQ ID NO: 433372 - DNA, 16 bp, M. musculus
tccccagctcctcacc

SEQ ID NO: 433373 - DNA, 16 bp, M. musculus
tccccaggaactagag

SEQ ID NO: 433374 - DNA, 16 bp, M. musculus
tccccaggacccacac

SEQ ID NO: 433375 - DNA, 16 bp, M. musculus
tccccaggacccacag

SEQ ID NO: 433376 - DNA, 16 bp, M. musculus
tccccaggactcacag

SEQ ID NO: 433377 - DNA, 16 bp, M. musculus
tccccaggagctcctg

SEQ ID NO: 433378 - DNA, 16 bp, M. musculus
tccccaggagctggag

SEQ ID NO: 433379 - DNA, 16 bp, M. musculus
tccccagggcccccct

SEQ ID NO: 433380 - DNA, 16 bp, M. musculus
tccccagtgacacact

SEQ ID NO: 433381 - DNA, 16 bp, M. musculus
tccccagtgctagaat

SEQ ID NO: 433382 - DNA, 16 bp, M. musculus
tccccatcaaaatcac

SEQ ID NO: 433383 - DNA, 16 bp, M. musculus
tccccatggtgacttc

SEQ ID NO: 433384 - DNA, 16 bp, M. musculus
tccccatgtgggacag

SEQ ID NO: 433385 - DNA, 16 bp, M. musculus
tccccattccctctgc

SEQ ID NO: 433386 - DNA, 16 bp, M. musculus
tccccatttactttga

SEQ ID NO: 433387 - DNA, 16 bp, M. musculus
tccccattttaaggag

SEQ ID NO: 433388 - DNA, 16 bp, M. musculus
tcccccaaagctccca

SEQ ID NO: 433389 - DNA, 16 bp, M. musculus
tcccccaacccctgct

SEQ ID NO: 433390 - DNA, 16 bp, M. musculus
tcccccacacccacag

SEQ ID NO: 433391 - DNA, 16 bp, M. musculus
tcccccacagtgacac

SEQ ID NO: 433392 - DNA, 16 bp, M. musculus
tcccccagagcttcca

SEQ ID NO: 433393 - DNA, 16 bp, M. musculus
tcccccagccccagac

SEQ ID NO: 433394 - DNA, 16 bp, M. musculus
tcccccagcctcagcc

SEQ ID NO: 433395 - DNA, 16 bp, M. musculus
tcccccagctcttcca

SEQ ID NO: 433396 - DNA, 16 bp, M. musculus
tcccccaggtgctcct

SEQ ID NO: 433397 - DNA, 16 bp, M. musculus
tcccccagtgaggagc

SEQ ID NO: 433398 - DNA, 18 bp, M. musculus
tcccccagtgaggggctg

SEQ ID NO: 433399 - DNA, 16 bp, M. musculus
tcccccatctccctgc

SEQ ID NO: 433400 - DNA, 16 bp, M. musculus
tcccccatgcccactg

SEQ ID NO: 433401 - DNA, 16 bp, M. musculus
tccccccagccatggt

SEQ ID NO: 433402 - DNA, 16 bp, M. musculus
tcccccctgctcacca

SEQ ID NO: 433403 - DNA, 16 bp, M. musculus
tccccccttgatcact

SEQ ID NO: 433404 - DNA, 16 bp, M. musculus
tcccccggaactggag

SEQ ID NO: 433405 - DNA, 16 bp, M. musculus
tccccctcctccatgt

SEQ ID NO: 433406 - DNA, 16 bp, M. musculus
tccccctcctggtcca

SEQ ID NO: 433407 - DNA, 16 bp, M. musculus
tccccctctctctgca

SEQ ID NO: 433408 - DNA, 16 bp, M. musculus
tccccctgcctcagcc

SEQ ID NO: 433409 - DNA, 16 bp, M. musculus
tccccctgcctctgtg

SEQ ID NO: 433410 - DNA, 16 bp, M. musculus
tccccctgcctttatg

SEQ ID NO: 433411 - DNA, 16 bp, M. musculus
tccccctgctcctcaa

SEQ ID NO: 433412 - DNA, 16 bp, M. musculus
tccccctgcttcccaa

SEQ ID NO: 433413 - DNA, 16 bp, M. musculus
tccccctggaactgga

SEQ ID NO: 433414 - DNA, 16 bp, M. musculus
tccccctggagctgga

SEQ ID NO: 433415 - DNA, 16 bp, M. musculus
tccccctttccagttt

SEQ ID NO: 433416 - DNA, 16 bp, M. musculus
tccccctttctaagaa

SEQ ID NO: 433417 - DNA, 16 bp, M. musculus
tccccgtgtgtgtgtg

SEQ ID NO: 433418 - DNA, 16 bp, M. musculus
tccccgttttccatgg

SEQ ID NO: 433419 - DNA, 16 bp, M. musculus
tcccctaaatcttcca

SEQ ID NO: 433420 - DNA, 17 bp, M. musculus
tcccctaaccactcact

SEQ ID NO: 433421 - DNA, 16 bp, M. musculus
tcccctaactaggctg

SEQ ID NO: 433422 - DNA, 16 bp, M. musculus
tcccctacactggggt

SEQ ID NO: 433423 - DNA, 16 bp, M. musculus
tcccctacccctgctc

SEQ ID NO: 433424 - DNA, 17 bp, M. musculus
tcccctatactggggca

SEQ ID NO: 433425 - DNA, 16 bp, M. musculus
tcccctccaaaatccc

SEQ ID NO: 433426 - DNA, 16 bp, M. musculus
tcccctccagaaggga

SEQ ID NO: 433427 - DNA, 16 bp, M. musculus
tcccctccatggcctc

SEQ ID NO: 433428 - DNA, 16 bp, M. musculus
tcccctccatttccat

SEQ ID NO: 433429 - DNA, 16 bp, M. musculus
tcccctccccatgctc

SEQ ID NO: 433430 - DNA, 16 bp, M. musculus
tcccctcccttcttga

SEQ ID NO: 433431 - DNA, 16 bp, M. musculus
tcccctctacacacac

SEQ ID NO: 433432 - DNA, 17 bp, M. musculus
tcccctctactgaggca

SEQ ID NO: 433433 - DNA, 16 bp, M. musculus
tcccctctaggagcct

SEQ ID NO: 433434 - DNA, 16 bp, M. musculus
tcccctctcccccaga

SEQ ID NO: 433435 - DNA, 16 bp, M. musculus
tcccctctcctctgag

SEQ ID NO: 433436 - DNA, 16 bp, M. musculus
tcccctctgcaaacac

SEQ ID NO: 433437 - DNA, 16 bp, M. musculus
tcccctgaaatttggc

SEQ ID NO: 433438 - DNA, 16 bp, M. musculus
tcccctgaagacacca

SEQ ID NO: 433439 - DNA, 16 bp, M. musculus
tcccctgaccaacaac

SEQ ID NO: 433440 - DNA, 16 bp, M. musculus
tcccctgagatgctct

SEQ ID NO: 433441 - DNA, 16 bp, M. musculus
tcccctgcaagaacaa

SEQ ID NO: 433442 - DNA, 16 bp, M. musculus
tcccctgcagctggag

SEQ ID NO: 433443 - DNA, 16 bp, M. musculus
tcccctgcccccaact

SEQ ID NO: 433444 - DNA, 16 bp, M. musculus
tcccctgcctcagcct

SEQ ID NO: 433445 - DNA, 16 bp, M. musculus
tcccctggaactggac

SEQ ID NO: 433446 - DNA, 16 bp, M. musculus
tcccctggaactggag

SEQ ID NO: 433447 - DNA, 16 bp, M. musculus
tcccctggaacttgag

SEQ ID NO: 433448 - DNA, 16 bp, M. musculus
tcccctggaagagcag

SEQ ID NO: 433449 - DNA, 17 bp, M. musculus
tcccctggagatagaat

SEQ ID NO: 433450 - DNA, 16 bp, M. musculus
tcccctggagatggag

SEQ ID NO: 433451 - DNA, 16 bp, M. musculus
tcccctggagctggaa

SEQ ID NO: 433452 - DNA, 16 bp, M. musculus
tcccctggcttactca

SEQ ID NO: 433453 - DNA, 16 bp, M. musculus
tcccctggcttgccca

SEQ ID NO: 433454 - DNA, 16 bp, M. musculus
tcccctggcttgctca

SEQ ID NO: 433455 - DNA, 16 bp, M. musculus
tcccctggcttgctta

SEQ ID NO: 433456 - DNA, 16 bp, M. musculus
tcccctggctttctca

SEQ ID NO: 433457 - DNA, 16 bp, M. musculus
tcccctgggactggaa

SEQ ID NO: 433458 - DNA, 16 bp, M. musculus
tcccctgggagctgca

SEQ ID NO: 433459 - DNA, 16 bp, M. musculus
tcccctgggattaaag

SEQ ID NO: 433460 - DNA, 16 bp, M. musculus
tcccctgggcctggag

SEQ ID NO: 433461 - DNA, 16 bp, M. musculus
tcccctgtccctgcat

SEQ ID NO: 433462 - DNA, 16 bp, M. musculus
tcccctgtctccacat

SEQ ID NO: 433463 - DNA, 16 bp, M. musculus
tcccctgtgcccatgt

SEQ ID NO: 433464 - DNA, 16 bp, M. musculus
tccccttcagggccct

SEQ ID NO: 433465 - DNA, 16 bp, M. musculus
tccccttcagggcctg

SEQ ID NO: 433466 - DNA, 16 bp, M. musculus
tccccttcccatgtcc

SEQ ID NO: 433467 - DNA, 16 bp, M. musculus
tccccttctctgagga

SEQ ID NO: 433468 - DNA, 16 bp, M. musculus
tccccttcttctcaga

SEQ ID NO: 433469 - DNA, 16 bp, M. musculus
tccccttgagctgaat

SEQ ID NO: 433470 - DNA, 16 bp, M. musculus
tccccttgagctggat

SEQ ID NO: 433471 - DNA, 16 bp, M. musculus
tcccctttcctggttg

SEQ ID NO: 433472 - DNA, 16 bp, M. musculus
tccccttttcctcaga

SEQ ID NO: 433473 - DNA, 16 bp, M. musculus
tccccttttctgtgaa

SEQ ID NO: 433474 - DNA, 16 bp, M. musculus
tcccgacctcaagctg

SEQ ID NO: 433475 - DNA, 16 bp, M. musculus
tcccgattcagcgtgc

SEQ ID NO: 433476 - DNA, 16 bp, M. musculus
tcccgcctcagcctcc

SEQ ID NO: 433477 - DNA, 16 bp, M. musculus
tcccgcctgcctctgc

SEQ ID NO: 433478 - DNA, 16 bp, M. musculus
tcccggaaccaggatg

SEQ ID NO: 433479 - DNA, 16 bp, M. musculus
tcccggaaccgagatg

SEQ ID NO: 433480 - DNA, 16 bp, M. musculus
tcccggacagccaggg

SEQ ID NO: 433481 - DNA, 16 bp, M. musculus
tcccgggatcccagga

SEQ ID NO: 433482 - DNA, 17 bp, M. musculus
tcccgggatgagctggc

SEQ ID NO: 433483 - DNA, 16 bp, M. musculus
tcccgggtgccatctt

SEQ ID NO: 433484 - DNA, 19 bp, M. musculus
tcccgggtttccggcacca

SEQ ID NO: 433485 - DNA, 22 bp, M. musculus
tcccgtggggagtcccgtgtgg

SEQ ID NO: 433486 - DNA, 16 bp, M. musculus
tcccgtttctttttgg

SEQ ID NO: 433487 - DNA, 16 bp, M. musculus
tccctaaagcaaggga

SEQ ID NO: 433488 - DNA, 17 bp, M. musculus
tccctaacctaaagaaa

SEQ ID NO: 433489 - DNA, 16 bp, M. musculus
tccctacccactcact

SEQ ID NO: 433490 - DNA, 16 bp, M. musculus
tccctacctacccact

SEQ ID NO: 433491 - DNA, 16 bp, M. musculus
tccctagagctggagt

SEQ ID NO: 433492 - DNA, 16 bp, M. musculus
tccctagggcttgctg

SEQ ID NO: 433493 - DNA, 16 bp, M. musculus
tccctatataatccaa

SEQ ID NO: 433494 - DNA, 16 bp, M. musculus
tccctatataatccag

SEQ ID NO: 433495 - DNA, 16 bp, M. musculus
tccctatctctgtctc

SEQ ID NO: 433496 - DNA, 16 bp, M. musculus
tccctattcccaggcc

SEQ ID NO: 433497 - DNA, 17 bp, M. musculus
tccctcaacagaagaat

SEQ ID NO: 433498 - DNA, 16 bp, M. musculus
tccctcaactggaggc

SEQ ID NO: 433499 - DNA, 16 bp, M. musculus
tccctcaagagactgg

SEQ ID NO: 433500 - DNA, 16 bp, M. musculus
tccctcaagagaggaa

SEQ ID NO: 433501 - DNA, 16 bp, M. musculus
tccctcaccctgcttc

SEQ ID NO: 433502 - DNA, 16 bp, M. musculus
tccctcacctgctcca

SEQ ID NO: 433503 - DNA, 16 bp, M. musculus
tccctcaccttacaag

SEQ ID NO: 433504 - DNA, 99 bp, M. musculus
tccctcacttgggtgtgttacttaggcctatttaccaagtgactcggaaagctgctagctttgtgtggggcctggaacaggagaaggcccttcaacagg

SEQ ID NO: 433505 - DNA, 16 bp, M. musculus
tccctcagagggaagg

SEQ ID NO: 433506 - DNA, 16 bp, M. musculus
tccctcagcctcctga

SEQ ID NO: 433507 - DNA, 16 bp, M. musculus
tccctcagctgaagaa

SEQ ID NO: 433508 - DNA, 16 bp, M. musculus
tccctccagcctcctc

SEQ ID NO: 433509 - DNA, 16 bp, M. musculus
tccctccagggcctct

SEQ ID NO: 433510 - DNA, 16 bp, M. musculus
tccctccagtccctcc

SEQ ID NO: 433511 - DNA, 16 bp, M. musculus
tccctccatggagctg

SEQ ID NO: 433512 - DNA, 16 bp, M. musculus
tccctccatggcatct

SEQ ID NO: 433513 - DNA, 16 bp, M. musculus
tccctccatggtttct

SEQ ID NO: 433514 - DNA, 16 bp, M. musculus
tccctccatgtttact

SEQ ID NO: 433515 - DNA, 16 bp, M. musculus
tccctcccaagtccct

SEQ ID NO: 433516 - DNA, 16 bp, M. musculus
tccctcccaagtggaa

SEQ ID NO: 433517 - DNA, 16 bp, M. musculus
tccctcccaagtggga

SEQ ID NO: 433518 - DNA, 16 bp, M. musculus
tccctccctcagcagc

SEQ ID NO: 433519 - DNA, 16 bp, M. musculus
tccctccctccacctg

SEQ ID NO: 433520 - DNA, 16 bp, M. musculus
tccctccctgtacact

SEQ ID NO: 433521 - DNA, 16 bp, M. musculus
tccctcccttccccag

SEQ ID NO: 433522 - DNA, 16 bp, M. musculus
tccctcctccctccag

SEQ ID NO: 433523 - DNA, 16 bp, M. musculus
tccctcctccctgtgg

SEQ ID NO: 433524 - DNA, 16 bp, M. musculus
tccctcctcctgctca

SEQ ID NO: 433525 - DNA, 16 bp, M. musculus
tccctcctctcagatg

SEQ ID NO: 433526 - DNA, 16 bp, M. musculus
tccctcctctccagtg

SEQ ID NO: 433527 - DNA, 16 bp, M. musculus
tccctcctctgtgtgt

SEQ ID NO: 433528 - DNA, 16 bp, M. musculus
tccctcctgttgagca

SEQ ID NO: 433529 - DNA, 16 bp, M. musculus
tccctccttgatcact

SEQ ID NO: 433530 - DNA, 16 bp, M. musculus
tccctctaccctgctc

SEQ ID NO: 433531 - DNA, 16 bp, M. musculus
tccctctcaaattcat

SEQ ID NO: 433532 - DNA, 16 bp, M. musculus
tccctctcactgcccc

SEQ ID NO: 433533 - DNA, 16 bp, M. musculus
tccctctccttactgt

SEQ ID NO: 433534 - DNA, 16 bp, M. musculus
tccctctctccattca

SEQ ID NO: 433535 - DNA, 16 bp, M. musculus
tccctctctctactgt

SEQ ID NO: 433536 - DNA, 16 bp, M. musculus
tccctctgaaaatccc

SEQ ID NO: 433537 - DNA, 16 bp, M. musculus
tccctctgactggaat

SEQ ID NO: 433538 - DNA, 16 bp, M. musculus
tccctctgcattggtg

SEQ ID NO: 433539 - DNA, 16 bp, M. musculus
tccctctgcctcctgg

SEQ ID NO: 433540 - DNA, 16 bp, M. musculus
tccctctgccttccat

SEQ ID NO: 433541 - DNA, 16 bp, M. musculus
tccctctgcttctatg

SEQ ID NO: 433542 - DNA, 16 bp, M. musculus
tccctctggaactgta

SEQ ID NO: 433543 - DNA, 16 bp, M. musculus
tccctctggggaagaa

SEQ ID NO: 433544 - DNA, 16 bp, M. musculus
tccctctgtccctctg

SEQ ID NO: 433545 - DNA, 16 bp, M. musculus
tccctctgtctcctga

SEQ ID NO: 433546 - DNA, 16 bp, M. musculus
tccctctgtctgtctg

SEQ ID NO: 433547 - DNA, 16 bp, M. musculus
tccctcttaatctaag

SEQ ID NO: 433548 - DNA, 16 bp, M. musculus
tccctcttctgagatg

SEQ ID NO: 433549 - DNA, 16 bp, M. musculus
tccctctttctccaca

SEQ ID NO: 433550 - DNA, 17 bp, M. musculus
tccctctttgatgataa

SEQ ID NO: 433551 - DNA, 16 bp, M. musculus
tccctgaacagggagt

SEQ ID NO: 433552 - DNA, 16 bp, M. musculus
tccctgaactctgcct

SEQ ID NO: 433553 - DNA, 16 bp, M. musculus
tccctgaagaaagaaa

SEQ ID NO: 433554 - DNA, 16 bp, M. musculus
tccctgaagctgtgtt

SEQ ID NO: 433555 - DNA, 16 bp, M. musculus
tccctgacagaggaga

SEQ ID NO: 433556 - DNA, 16 bp, M. musculus
tccctgaccccaagct

SEQ ID NO: 433557 - DNA, 16 bp, M. musculus
tccctgacctcaggct

SEQ ID NO: 433558 - DNA, 16 bp, M. musculus
tccctgactcctttct

SEQ ID NO: 433559 - DNA, 16 bp, M. musculus
tccctgactgggcctg

SEQ ID NO: 433560 - DNA, 16 bp, M. musculus
tccctgacttccctca

SEQ ID NO: 433561 - DNA, 16 bp, M. musculus
tccctgagagacacac

SEQ ID NO: 433562 - DNA, 16 bp, M. musculus
tccctgagagttctgg

SEQ ID NO: 433563 - DNA, 16 bp, M. musculus
tccctgagccatctct

SEQ ID NO: 433564 - DNA, 16 bp, M. musculus
tccctgagcccagcac

SEQ ID NO: 433565 - DNA, 16 bp, M. musculus
tccctgagcctgttgc

SEQ ID NO: 433566 - DNA, 16 bp, M. musculus
tccctgagctctgtct

SEQ ID NO: 433567 - DNA, 16 bp, M. musculus
tccctgagctgagcat

SEQ ID NO: 433568 - DNA, 16 bp, M. musculus
tccctgaggctcactg

SEQ ID NO: 433569 - DNA, 16 bp, M. musculus
tccctgaggtagaaca

SEQ ID NO: 433570 - DNA, 16 bp, M. musculus
tccctgagtcctgagg

SEQ ID NO: 433571 - DNA, 16 bp, M. musculus
tccctgagttcagtct

SEQ ID NO: 433572 - DNA, 16 bp, M. musculus
tccctgattttagggg

SEQ ID NO: 433573 - DNA, 16 bp, M. musculus
tccctgcaccctgctc

SEQ ID NO: 433574 - DNA, 16 bp, M. musculus
tccctgcagctcactg

SEQ ID NO: 433575 - DNA, 16 bp, M. musculus
tccctgcaggctgaga

SEQ ID NO: 433576 - DNA, 16 bp, M. musculus
tccctgcagttctgaa

SEQ ID NO: 433577 - DNA, 16 bp, M. musculus
tccctgcatccctgca

SEQ ID NO: 433578 - DNA, 16 bp, M. musculus
tccctgcatctccttt

SEQ ID NO: 433579 - DNA, 16 bp, M. musculus
tccctgccagaggaga

SEQ ID NO: 433580 - DNA, 16 bp, M. musculus
tccctgcccccacctt

SEQ ID NO: 433581 - DNA, 16 bp, M. musculus
tccctgcccccagctg

SEQ ID NO: 433582 - DNA, 16 bp, M. musculus
tccctgcccctcacca

SEQ ID NO: 433583 - DNA, 16 bp, M. musculus
tccctgccctggcatt

SEQ ID NO: 433584 - DNA, 16 bp, M. musculus
tccctgcctcccaagt

SEQ ID NO: 433585 - DNA, 16 bp, M. musculus
tccctgcctccctggg

SEQ ID NO: 433586 - DNA, 16 bp, M. musculus
tccctgcctctctctg

SEQ ID NO: 433587 - DNA, 16 bp, M. musculus
tccctgcctctggctc

SEQ ID NO: 433588 - DNA, 16 bp, M. musculus
tccctgctcaccaacc

SEQ ID NO: 433589 - DNA, 16 bp, M. musculus
tccctgctcatcttcc

SEQ ID NO: 433590 - DNA, 16 bp, M. musculus
tccctgctccatcttt

SEQ ID NO: 433591 - DNA, 16 bp, M. musculus
tccctgctccccagcc

SEQ ID NO: 433592 - DNA, 16 bp, M. musculus
tccctgctcctgctgg

SEQ ID NO: 433593 - DNA, 16 bp, M. musculus
tccctgctgctggctc

SEQ ID NO: 433594 - DNA, 16 bp, M. musculus
tccctgctggtcctgg

SEQ ID NO: 433595 - DNA, 16 bp, M. musculus
tccctgcttcagttcc

SEQ ID NO: 433596 - DNA, 16 bp, M. musculus
tccctgcttccctgga

SEQ ID NO: 433597 - DNA, 16 bp, M. musculus
tccctgcttgctgctt

SEQ ID NO: 433598 - DNA, 16 bp, M. musculus
tccctgcttttagtgg

SEQ ID NO: 433599 - DNA, 16 bp, M. musculus
tccctggaacccacat

SEQ ID NO: 433600 - DNA, 16 bp, M. musculus
tccctggaagtggagt

SEQ ID NO: 433601 - DNA, 16 bp, M. musculus
tccctggaataaaacc

SEQ ID NO: 433602 - DNA, 16 bp, M. musculus
tccctggactagagtg

SEQ ID NO: 433603 - DNA, 16 bp, M. musculus
tccctggagctgcagt

SEQ ID NO: 433604 - DNA, 16 bp, M. musculus
tccctggagctggtgt

SEQ ID NO: 433605 - DNA, 16 bp, M. musculus
tccctggaggcaagct

SEQ ID NO: 433606 - DNA, 16 bp, M. musculus
tccctggataggattt

SEQ ID NO: 433607 - DNA, 16 bp, M. musculus
tccctggatatgccag

SEQ ID NO: 433608 - DNA, 16 bp, M. musculus
tccctggatatggcaa

SEQ ID NO: 433609 - DNA, 16 bp, M. musculus
tccctggatcccactg

SEQ ID NO: 433610 - DNA, 16 bp, M. musculus
tccctggatccctgga

SEQ ID NO: 433611 - DNA, 16 bp, M. musculus
tccctggatgatggac

SEQ ID NO: 433612 - DNA, 16 bp, M. musculus
tccctggcatctggaa

SEQ ID NO: 433613 - DNA, 16 bp, M. musculus
tccctggccagcccgg

SEQ ID NO: 433614 - DNA, 16 bp, M. musculus
tccctggccctcatag

SEQ ID NO: 433615 - DNA, 16 bp, M. musculus
tccctggctatggcag

SEQ ID NO: 433616 - DNA, 16 bp, M. musculus
tccctggctgcttctc

SEQ ID NO: 433617 - DNA, 16 bp, M. musculus
tccctggctggtctgg

SEQ ID NO: 433618 - DNA, 16 bp, M. musculus
tccctggcttgctcag

SEQ ID NO: 433619 - DNA, 16 bp, M. musculus
tccctgggaattctgg

SEQ ID NO: 433620 - DNA, 16 bp, M. musculus
tccctgggacaagcat

SEQ ID NO: 433621 - DNA, 16 bp, M. musculus
tccctgggacctctag

SEQ ID NO: 433622 - DNA, 16 bp, M. musculus
tccctgggactcacag

SEQ ID NO: 433623 - DNA, 16 bp, M. musculus
tccctgggactcactg

SEQ ID NO: 433624 - DNA, 16 bp, M. musculus
tccctgggagccctgg

SEQ ID NO: 433625 - DNA, 16 bp, M. musculus
tccctgggagctccag

SEQ ID NO: 433626 - DNA, 16 bp, M. musculus
tccctgggagctgtgg

SEQ ID NO: 433627 - DNA, 16 bp, M. musculus
tccctgggatggagcc

SEQ ID NO: 433628 - DNA, 16 bp, M. musculus
tccctgggccaagcat

SEQ ID NO: 433629 - DNA, 16 bp, M. musculus
tccctgggctctgcct

SEQ ID NO: 433630 - DNA, 16 bp, M. musculus
tccctgggctggaggt

SEQ ID NO: 433631 - DNA, 16 bp, M. musculus
tccctgggctgggagt

SEQ ID NO: 433632 - DNA, 16 bp, M. musculus
tccctggggcctcagg

SEQ ID NO: 433633 - DNA, 16 bp, M. musculus
tccctggggcctcctg

SEQ ID NO: 433634 - DNA, 16 bp, M. musculus
tccctggggctcactg

SEQ ID NO: 433635 - DNA, 16 bp, M. musculus
tccctggggctggaga

SEQ ID NO: 433636 - DNA, 16 bp, M. musculus
tccctgggtccctggg

SEQ ID NO: 433637 - DNA, 16 bp, M. musculus
tccctgggtggggcag

SEQ ID NO: 433638 - DNA, 16 bp, M. musculus
tccctgggttcccagg

SEQ ID NO: 433639 - DNA, 16 bp, M. musculus
tccctggtccctggtt

SEQ ID NO: 433640 - DNA, 16 bp, M. musculus
tccctggtcctggcat

SEQ ID NO: 433641 - DNA, 16 bp, M. musculus
tccctggtcttccctg

SEQ ID NO: 433642 - DNA, 16 bp, M. musculus
tccctggtgctgggat

SEQ ID NO: 433643 - DNA, 16 bp, M. musculus
tccctggtggtcctgg

SEQ ID NO: 433644 - DNA, 16 bp, M. musculus
tccctgtatttctttt

SEQ ID NO: 433645 - DNA, 16 bp, M. musculus
tccctgtcatgatgat

SEQ ID NO: 433646 - DNA, 16 bp, M. musculus
tccctgtcctggcatt

SEQ ID NO: 433647 - DNA, 16 bp, M. musculus
tccctgtctctgcctc

SEQ ID NO: 433648 - DNA, 16 bp, M. musculus
tccctgtctctgtccc

SEQ ID NO: 433649 - DNA, 16 bp, M. musculus
tccctgtctgtcctgg

SEQ ID NO: 433650 - DNA, 16 bp, M. musculus
tccctgtcttagtcag

SEQ ID NO: 433651 - DNA, 16 bp, M. musculus
tccctgtctttctgct

SEQ ID NO: 433652 - DNA, 16 bp, M. musculus
tccctgtgagcctatg

SEQ ID NO: 433653 - DNA, 16 bp, M. musculus
tccctgtgctcagtct

SEQ ID NO: 433654 - DNA, 16 bp, M. musculus
tccctgtgctccctgt

SEQ ID NO: 433655 - DNA, 16 bp, M. musculus
tccctgtgctggtggt

SEQ ID NO: 433656 - DNA, 16 bp, M. musculus
tccctgtggtggtttg

SEQ ID NO: 433657 - DNA, 16 bp, M. musculus
tccctgtgtagaccag

SEQ ID NO: 433658 - DNA, 16 bp, M. musculus
tccctgtgtcttctgt

SEQ ID NO: 433659 - DNA, 17 bp, M. musculus
tccctgttcgggcgcca

SEQ ID NO: 433660 - DNA, 16 bp, M. musculus
tccctgtttagattct

SEQ ID NO: 433661 - DNA, 16 bp, M. musculus
tcccttaaagaattgc

SEQ ID NO: 433662 - DNA, 16 bp, M. musculus
tcccttactgctttta

SEQ ID NO: 433663 - DNA, 16 bp, M. musculus
tcccttagagctggag

SEQ ID NO: 433664 - DNA, 16 bp, M. musculus
tcccttatctgcacca

SEQ ID NO: 433665 - DNA, 16 bp, M. musculus
tcccttcacctctgag

SEQ ID NO: 433666 - DNA, 16 bp, M. musculus
tcccttcagttccttg

SEQ ID NO: 433667 - DNA, 16 bp, M. musculus
tcccttcagtttcttt

SEQ ID NO: 433668 - DNA, 16 bp, M. musculus
tcccttccaagtgctg

SEQ ID NO: 433669 - DNA, 16 bp, M. musculus
tcccttcccccagcct

SEQ ID NO: 433670 - DNA, 16 bp, M. musculus
tcccttcctcccagtc

SEQ ID NO: 433671 - DNA, 16 bp, M. musculus
tcccttcctcctgagg

SEQ ID NO: 433672 - DNA, 16 bp, M. musculus
tcccttcctggtttcc

SEQ ID NO: 433673 - DNA, 16 bp, M. musculus
tcccttctcactgagc

SEQ ID NO: 433674 - DNA, 16 bp, M. musculus
tcccttctctcagatg

SEQ ID NO: 433675 - DNA, 16 bp, M. musculus
tcccttctctgagaag

SEQ ID NO: 433676 - DNA, 16 bp, M. musculus
tcccttctggtcagtg

SEQ ID NO: 433677 - DNA, 16 bp, M. musculus
tcccttgagacaggat

SEQ ID NO: 433678 - DNA, 16 bp, M. musculus
tcccttgcagcctctg

SEQ ID NO: 433679 - DNA, 16 bp, M. musculus
tcccttggaactggag

SEQ ID NO: 433680 - DNA, 16 bp, M. musculus
tcccttggagatggaa

SEQ ID NO: 433681 - DNA, 16 bp, M. musculus
tcccttggagctgaag

SEQ ID NO: 433682 - DNA, 16 bp, M. musculus
tcccttggaggaaact

SEQ ID NO: 433683 - DNA, 16 bp, M. musculus
tcccttgtcccagggt

SEQ ID NO: 433684 - DNA, 16 bp, M. musculus
tcccttgtctgaaggt

SEQ ID NO: 433685 - DNA, 16 bp, M. musculus
tcccttgtgtccatat

SEQ ID NO: 433686 - DNA, 16 bp, M. musculus
tccctttaaaaattac

SEQ ID NO: 433687 - DNA, 16 bp, M. musculus
tccctttaaaaattat

SEQ ID NO: 433688 - DNA, 16 bp, M. musculus
tccctttccatttctg

SEQ ID NO: 433689 - DNA, 16 bp, M. musculus
tccctttccccactta

SEQ ID NO: 433690 - DNA, 16 bp, M. musculus
tccctttcctgatttc

SEQ ID NO: 433691 - DNA, 16 bp, M. musculus
tccctttgtcctttca

SEQ ID NO: 433692 - DNA, 16 bp, M. musculus
tccctttgtgacttct

SEQ ID NO: 433693 - DNA, 16 bp, M. musculus
tccctttgttgtctaa

SEQ ID NO: 433694 - DNA, 16 bp, M. musculus
tcccttttctttacag

SEQ ID NO: 433695 - DNA, 75 bp, M. musculus
tccgaagacccctcgacaactaagggagttcctagggacggcaggcttctgtcgcctctggatccctgggtttgc

SEQ ID NO: 433696 - DNA, 16 bp, M. musculus
tccgactctgaccctg

SEQ ID NO: 433697 - DNA, 16 bp, M. musculus
tccgagttcaaatccc

SEQ ID NO: 433698 - DNA, 16 bp, M. musculus
tccgatgcactcttct

SEQ ID NO: 433699 - DNA, 16 bp, M. musculus
tccgatgccttcttct

SEQ ID NO: 433700 - DNA, 16 bp, M. musculus
tccgcccacctctgcc

SEQ ID NO: 433701 - DNA, 16 bp, M. musculus
tccgcctggcttggga

SEQ ID NO: 433702 - DNA, 16 bp, M. musculus
tccgctgcacactctg

SEQ ID NO: 433703 - DNA, 16 bp, M. musculus
tccgctgctgtgtgtg

SEQ ID NO: 433704 - DNA, 17 bp, M. musculus
tccggacggtggctggc

SEQ ID NO: 433705 - DNA, 16 bp, M. musculus
tccggaggacccaggt

SEQ ID NO: 433706 - DNA, 19 bp, M. musculus
tccggcccaaagatttatt

SEQ ID NO: 433707 - DNA, 16 bp, M. musculus
tccgggccagccaggg

SEQ ID NO: 433708 - DNA, 16 bp, M. musculus
tccggtcaaccctgct

SEQ ID NO: 433709 - DNA, 16 bp, M. musculus
tccgtccatccatcca

SEQ ID NO: 433710 - DNA, 16 bp, M. musculus
tccgtccgtccgtcca

SEQ ID NO: 433711 - DNA, 16 bp, M. musculus
tccgtgaagtgtttgc

SEQ ID NO: 433712 - DNA, 40 bp, M. musculus
tccgttgccttgacgtgggaatcctctgaagggcagcaag

SEQ ID NO: 433713 - DNA, 16 bp, M. musculus
tcctaaaacaaaaaga

SEQ ID NO: 433714 - DNA, 16 bp, M. musculus
tcctaaaagcaaataa

SEQ ID NO: 433715 - DNA, 16 bp, M. musculus
tcctaaacctaaagaa

SEQ ID NO: 433716 - DNA, 16 bp, M. musculus
tcctaacaaggtggat

SEQ ID NO: 433717 - DNA, 16 bp, M. musculus
tcctaacagcttccca

SEQ ID NO: 433718 - DNA, 16 bp, M. musculus
tcctaaccactgagcc

SEQ ID NO: 433719 - DNA, 16 bp, M. musculus
tcctaacttaaaagac

SEQ ID NO: 433720 - DNA, 16 bp, M. musculus
tcctaagacctccctg

SEQ ID NO: 433721 - DNA, 16 bp, M. musculus
tcctaagaggctctgc

SEQ ID NO: 433722 - DNA, 16 bp, M. musculus
tcctaagattctgggt

SEQ ID NO: 433723 - DNA, 16 bp, M. musculus
tcctaagctttgccca

SEQ ID NO: 433724 - DNA, 16 bp, M. musculus
tcctaagggagataac

SEQ ID NO: 433725 - DNA, 16 bp, M. musculus
tcctaagggctgggat

SEQ ID NO: 433726 - DNA, 16 bp, M. musculus
tcctaagtctgtggct

SEQ ID NO: 433727 - DNA, 16 bp, M. musculus
tcctaagtgctgggat

SEQ ID NO: 433728 - DNA, 16 bp, M. musculus
tcctaagtgttggaat

SEQ ID NO: 433729 - DNA, 16 bp, M. musculus
tcctaatccaaaatat

SEQ ID NO: 433730 - DNA, 16 bp, M. musculus
tcctaatcctcctgcc

SEQ ID NO: 433731 - DNA, 16 bp, M. musculus
tcctaatccttctaaa

SEQ ID NO: 433732 - DNA, 16 bp, M. musculus
tcctaatcctttcaaa

SEQ ID NO: 433733 - DNA, 17 bp, M. musculus
tcctaatgaggcagtga

SEQ ID NO: 433734 - DNA, 16 bp, M. musculus
tcctaatgttgtgacc

SEQ ID NO: 433735 - DNA, 16 bp, M. musculus
tcctaattaacacaat

SEQ ID NO: 433736 - DNA, 16 bp, M. musculus
tcctaattacaaaata

SEQ ID NO: 433737 - DNA, 16 bp, M. musculus
tcctacagctgacaaa

SEQ ID NO: 433738 - DNA, 17 bp, M. musculus
tcctacagggtctccct

SEQ ID NO: 433739 - DNA, 16 bp, M. musculus
tcctacatctgacaga

SEQ ID NO: 433740 - DNA, 16 bp, M. musculus
tcctacctcagcctcc

SEQ ID NO: 433741 - DNA, 16 bp, M. musculus
tcctacctcagttaac

SEQ ID NO: 433742 - DNA, 16 bp, M. musculus
tcctacctccctgccc

SEQ ID NO: 433743 - DNA, 16 bp, M. musculus
tcctaccttcctacct

SEQ ID NO: 433744 - DNA, 16 bp, M. musculus
tcctactcatctccct

SEQ ID NO: 433745 - DNA, 16 bp, M. musculus
tcctactggaggtggt

SEQ ID NO: 433746 - DNA, 16 bp, M. musculus
tcctacttcctgaggt

SEQ ID NO: 433747 - DNA, 16 bp, M. musculus
tcctactttcatgtct

SEQ ID NO: 433748 - DNA, 16 bp, M. musculus
tcctagaatagagttg

SEQ ID NO: 433749 - DNA, 16 bp, M. musculus
tcctagagatgccccc

SEQ ID NO: 433750 - DNA, 16 bp, M. musculus
tcctagagattgcccc

SEQ ID NO: 433751 - DNA, 16 bp, M. musculus
tcctagcaacaacatg

SEQ ID NO: 433752 - DNA, 16 bp, M. musculus
tcctagcaaccacatg

SEQ ID NO: 433753 - DNA, 16 bp, M. musculus
tcctagcaaccttcag

SEQ ID NO: 433754 - DNA, 16 bp, M. musculus
tcctagcaatcacatg

SEQ ID NO: 433755 - DNA, 16 bp, M. musculus
tcctagcacttagaag

SEQ ID NO: 433756 - DNA, 16 bp, M. musculus
tcctagcattcaagag

SEQ ID NO: 433757 - DNA, 16 bp, M. musculus
tcctagcatttgagag

SEQ ID NO: 433758 - DNA, 16 bp, M. musculus
tcctagctattgatgg

SEQ ID NO: 433759 - DNA, 16 bp, M. musculus
tcctagctattgtgaa

SEQ ID NO: 433760 - DNA, 16 bp, M. musculus
tcctagctgcagtgtg

SEQ ID NO: 433761 - DNA, 16 bp, M. musculus
tcctaggatcccagga

SEQ ID NO: 433762 - DNA, 16 bp, M. musculus
tcctaggctggccttg

SEQ ID NO: 433763 - DNA, 16 bp, M. musculus
tcctagggtttctacc

SEQ ID NO: 433764 - DNA, 16 bp, M. musculus
tcctaggtgattctgg

SEQ ID NO: 433765 - DNA, 16 bp, M. musculus
tcctagtgctcaagct

SEQ ID NO: 433766 - DNA, 16 bp, M. musculus
tcctataatcccagca

SEQ ID NO: 433767 - DNA, 16 bp, M. musculus
tcctataattctttaa

SEQ ID NO: 433768 - DNA, 16 bp, M. musculus
tcctatagggctgcaa

SEQ ID NO: 433769 - DNA, 16 bp, M. musculus
tcctatcagaccaaca

SEQ ID NO: 433770 - DNA, 16 bp, M. musculus
tcctatcagcaatgga

SEQ ID NO: 433771 - DNA, 16 bp, M. musculus
tcctatcatttttgtt

SEQ ID NO: 433772 - DNA, 16 bp, M. musculus
tcctatctcttcccat

SEQ ID NO: 433773 - DNA, 16 bp, M. musculus
tcctatgaagctgcaa

SEQ ID NO: 433774 - DNA, 16 bp, M. musculus
tcctatgatcctggga

SEQ ID NO: 433775 - DNA, 16 bp, M. musculus
tcctatggagttccta

SEQ ID NO: 433776 - DNA, 16 bp, M. musculus
tcctattaaccatctt

SEQ ID NO: 433777 - DNA, 16 bp, M. musculus
tcctcaaactattcca

SEQ ID NO: 433778 - DNA, 16 bp, M. musculus
tcctcaaagaaaaaca

SEQ ID NO: 433779 - DNA, 16 bp, M. musculus
tcctcaacagaagctc

SEQ ID NO: 433780 - DNA, 23 bp, M. musculus
tcctcaacagaggaatggataca

SEQ ID NO: 433781 - DNA, 16 bp, M. musculus
tcctcaaccttcctaa

SEQ ID NO: 433782 - DNA, 16 bp, M. musculus
tcctcaaggccaagga

SEQ ID NO: 433783 - DNA, 16 bp, M. musculus
tcctcaataaagtttt

SEQ ID NO: 433784 - DNA, 16 bp, M. musculus
tcctcacacttgcaca

SEQ ID NO: 433785 - DNA, 16 bp, M. musculus
tcctcacagacacacc

SEQ ID NO: 433786 - DNA, 16 bp, M. musculus
tcctcacagcaataga

SEQ ID NO: 433787 - DNA, 16 bp, M. musculus
tcctcacaggaccctc

SEQ ID NO: 433788 - DNA, 16 bp, M. musculus
tcctcacagttaccta

SEQ ID NO: 433789 - DNA, 16 bp, M. musculus
tcctcacatcttcctg

SEQ ID NO: 433790 - DNA, 16 bp, M. musculus
tcctcaccaagttgct

SEQ ID NO: 433791 - DNA, 16 bp, M. musculus
tcctcaccctgctccc

SEQ ID NO: 433792 - DNA, 16 bp, M. musculus
tcctcaccttcttcca

SEQ ID NO: 433793 - DNA, 16 bp, M. musculus
tcctcactgataagtg

SEQ ID NO: 433794 - DNA, 16 bp, M. musculus
tcctcacttgggtact

SEQ ID NO: 433795 - DNA, 16 bp, M. musculus
tcctcagaaaagggaa

SEQ ID NO: 433796 - DNA, 16 bp, M. musculus
tcctcagacacagcag

SEQ ID NO: 433797 - DNA, 16 bp, M. musculus
tcctcagacctctgtg

SEQ ID NO: 433798 - DNA, 16 bp, M. musculus
tcctcagagaagcagg

SEQ ID NO: 433799 - DNA, 16 bp, M. musculus
tcctcagagaagcttc

SEQ ID NO: 433800 - DNA, 16 bp, M. musculus
tcctcagagaggctct

SEQ ID NO: 433801 - DNA, 16 bp, M. musculus
tcctcagcaagaacag

SEQ ID NO: 433802 - DNA, 16 bp, M. musculus
tcctcagcaccacaga

SEQ ID NO: 433803 - DNA, 16 bp, M. musculus
tcctcagcctcttcca

SEQ ID NO: 433804 - DNA, 16 bp, M. musculus
tcctcagctacataat

SEQ ID NO: 433805 - DNA, 22 bp, M. musculus
tcctcagctagctgttaaaagc

SEQ ID NO: 433806 - DNA, 16 bp, M. musculus
tcctcagctccttcca

SEQ ID NO: 433807 - DNA, 16 bp, M. musculus
tcctcagctctggggg

SEQ ID NO: 433808 - DNA, 16 bp, M. musculus
tcctcagctgaggctc

SEQ ID NO: 433809 - DNA, 16 bp, M. musculus
tcctcagcttctccca

SEQ ID NO: 433810 - DNA, 16 bp, M. musculus
tcctcaggaaattgga

SEQ ID NO: 433811 - DNA, 16 bp, M. musculus
tcctcaggcaccaggc

SEQ ID NO: 433812 - DNA, 16 bp, M. musculus
tcctcaggctgtggaa

SEQ ID NO: 433813 - DNA, 16 bp, M. musculus
tcctcagggccagggc

SEQ ID NO: 433814 - DNA, 16 bp, M. musculus
tcctcaggggaacctg

SEQ ID NO: 433815 - DNA, 16 bp, M. musculus
tcctcaggttgctttt

SEQ ID NO: 433816 - DNA, 16 bp, M. musculus
tcctcagtgctaggat

SEQ ID NO: 433817 - DNA, 16 bp, M. musculus
tcctcagtgctggggt

SEQ ID NO: 433818 - DNA, 16 bp, M. musculus
tcctcagtggttttca

SEQ ID NO: 433819 - DNA, 16 bp, M. musculus
tcctcagttcctacct

SEQ ID NO: 433820 - DNA, 16 bp, M. musculus
tcctcagttctgggat

SEQ ID NO: 433821 - DNA, 16 bp, M. musculus
tcctcatcaaaggaaa

SEQ ID NO: 433822 - DNA, 16 bp, M. musculus
tcctcatcaggactcc

SEQ ID NO: 433823 - DNA, 16 bp, M. musculus
tcctcatcatcatcct

SEQ ID NO: 433824 - DNA, 16 bp, M. musculus
tcctcatcatcttcct

SEQ ID NO: 433825 - DNA, 16 bp, M. musculus
tcctcatcccattctc

SEQ ID NO: 433826 - DNA, 16 bp, M. musculus
tcctcatcctcaccag

SEQ ID NO: 433827 - DNA, 16 bp, M. musculus
tcctcatcctcatcct

SEQ ID NO: 433828 - DNA, 16 bp, M. musculus
tcctcatctgtgaagt

SEQ ID NO: 433829 - DNA, 16 bp, M. musculus
tcctcatgctgtggtg

SEQ ID NO: 433830 - DNA, 16 bp, M. musculus
tcctcatgcttgcata

SEQ ID NO: 433831 - DNA, 16 bp, M. musculus
tcctcatggagacaag

SEQ ID NO: 433832 - DNA, 16 bp, M. musculus
tcctcatggtggctca

SEQ ID NO: 433833 - DNA, 16 bp, M. musculus
tcctcatgttgtgctg

SEQ ID NO: 433834 - DNA, 16 bp, M. musculus
tcctcatgttgtggtg

SEQ ID NO: 433835 - DNA, 16 bp, M. musculus
tcctcattggcttcct

SEQ ID NO: 433836 - DNA, 16 bp, M. musculus
tcctcattgggtcctg

SEQ ID NO: 433837 - DNA, 16 bp, M. musculus
tcctccaacaagaaca

SEQ ID NO: 433838 - DNA, 16 bp, M. musculus
tcctccaacaaggcca

SEQ ID NO: 433839 - DNA, 16 bp, M. musculus
tcctccaacaaggtca

SEQ ID NO: 433840 - DNA, 16 bp, M. musculus
tcctccaacagggcca

SEQ ID NO: 433841 - DNA, 16 bp, M. musculus
tcctccaacctccaca

SEQ ID NO: 433842 - DNA, 16 bp, M. musculus
tcctccaagaggaaat

SEQ ID NO: 433843 - DNA, 16 bp, M. musculus
tcctccaagatgaact

SEQ ID NO: 433844 - DNA, 16 bp, M. musculus
tcctccaagcacagtg

SEQ ID NO: 433845 - DNA, 16 bp, M. musculus
tcctccaaggcctctg

SEQ ID NO: 433846 - DNA, 16 bp, M. musculus
tcctccaagggttcac

SEQ ID NO: 433847 - DNA, 16 bp, M. musculus
tcctccaatgtcacag

SEQ ID NO: 433848 - DNA, 16 bp, M. musculus
tcctccaatgttggtg

SEQ ID NO: 433849 - DNA, 16 bp, M. musculus
tcctccacagacatgc

SEQ ID NO: 433850 - DNA, 16 bp, M. musculus
tcctccaccataccta

SEQ ID NO: 433851 - DNA, 16 bp, M. musculus
tcctccacctactcac

SEQ ID NO: 433852 - DNA, 16 bp, M. musculus
tcctccacctccccag

SEQ ID NO: 433853 - DNA, 16 bp, M. musculus
tcctccagaagagcag

SEQ ID NO: 433854 - DNA, 16 bp, M. musculus
tcctccagacacatcc

SEQ ID NO: 433855 - DNA, 16 bp, M. musculus
tcctccagatacatgc

SEQ ID NO: 433856 - DNA, 16 bp, M. musculus
tcctccagcaaagcca

SEQ ID NO: 433857 - DNA, 16 bp, M. musculus
tcctccagcaagactc

SEQ ID NO: 433858 - DNA, 16 bp, M. musculus
tcctccagcaaggctc

SEQ ID NO: 433859 - DNA, 16 bp, M. musculus
tcctccagcacagcct

SEQ ID NO: 433860 - DNA, 16 bp, M. musculus
tcctccagcactccct

SEQ ID NO: 433861 - DNA, 16 bp, M. musculus
tcctccagcagcagat

SEQ ID NO: 433862 - DNA, 16 bp, M. musculus
tcctccagcctccaca

SEQ ID NO: 433863 - DNA, 16 bp, M. musculus
tcctccagctccatgc

SEQ ID NO: 433864 - DNA, 16 bp, M. musculus
tcctccagctcctcca

SEQ ID NO: 433865 - DNA, 16 bp, M. musculus
tcctccagctcttcca

SEQ ID NO: 433866 - DNA, 16 bp, M. musculus
tcctccaggaagcctt

SEQ ID NO: 433867 - DNA, 16 bp, M. musculus
tcctccagtaaggcca

SEQ ID NO: 433868 - DNA, 16 bp, M. musculus
tcctccatcaacctgt

SEQ ID NO: 433869 - DNA, 16 bp, M. musculus
tcctccatcaaggcca

SEQ ID NO: 433870 - DNA, 16 bp, M. musculus
tcctccatctcctctg

SEQ ID NO: 433871 - DNA, 16 bp, M. musculus
tcctccatggcctgtg

SEQ ID NO: 433872 - DNA, 16 bp, M. musculus
tcctccatgggctctg

SEQ ID NO: 433873 - DNA, 16 bp, M. musculus
tcctccatggtccctg

SEQ ID NO: 433874 - DNA, 16 bp, M. musculus
tcctccattgctggta

SEQ ID NO: 433875 - DNA, 16 bp, M. musculus
tcctccattggggacc

SEQ ID NO: 433876 - DNA, 16 bp, M. musculus
tcctcccaaggctcag

SEQ ID NO: 433877 - DNA, 16 bp, M. musculus
tcctcccaagtgctga

SEQ ID NO: 433878 - DNA, 16 bp, M. musculus
tcctcccacaaggcca

SEQ ID NO: 433879 - DNA, 16 bp, M. musculus
tcctcccacaggtctt

SEQ ID NO: 433880 - DNA, 16 bp, M. musculus
tcctcccagaaagaac

SEQ ID NO: 433881 - DNA, 16 bp, M. musculus
tcctcccaggaggcct

SEQ ID NO: 433882 - DNA, 16 bp, M. musculus
tcctcccagtgctggg

SEQ ID NO: 433883 - DNA, 16 bp, M. musculus
tcctcccagttccttc

SEQ ID NO: 433884 - DNA, 16 bp, M. musculus
tcctcccatgtcccct

SEQ ID NO: 433885 - DNA, 16 bp, M. musculus
tcctcccattgatggg

SEQ ID NO: 433886 - DNA, 16 bp, M. musculus
tcctccccaaattgct

SEQ ID NO: 433887 - DNA, 16 bp, M. musculus
tcctccccagcatctg

SEQ ID NO: 433888 - DNA, 16 bp, M. musculus
tcctccccagctgctt

SEQ ID NO: 433889 - DNA, 16 bp, M. musculus
tcctccccatgcccca

SEQ ID NO: 433890 - DNA, 16 bp, M. musculus
tcctcccccagaagct

SEQ ID NO: 433891 - DNA, 16 bp, M. musculus
tcctcccccagcttct

SEQ ID NO: 433892 - DNA, 16 bp, M. musculus
tcctcccctgtctcca

SEQ ID NO: 433893 - DNA, 16 bp, M. musculus
tcctccctcatgatgc

SEQ ID NO: 433894 - DNA, 16 bp, M. musculus
tcctccctccaccctg

SEQ ID NO: 433895 - DNA, 16 bp, M. musculus
tcctccctccagccct

SEQ ID NO: 433896 - DNA, 16 bp, M. musculus
tcctccctccagcttc

SEQ ID NO: 433897 - DNA, 16 bp, M. musculus
tcctccctcctgtgga

SEQ ID NO: 433898 - DNA, 16 bp, M. musculus
tcctccctgcatcctc

SEQ ID NO: 433899 - DNA, 16 bp, M. musculus
tcctccctgctgatgt

SEQ ID NO: 433900 - DNA, 16 bp, M. musculus
tcctccctgggatcct

SEQ ID NO: 433901 - DNA, 16 bp, M. musculus
tcctccctggggaaga

SEQ ID NO: 433902 - DNA, 16 bp, M. musculus
tcctccctgtcttctg

SEQ ID NO: 433903 - DNA, 16 bp, M. musculus
tcctcctagctgcctg

SEQ ID NO: 433904 - DNA, 16 bp, M. musculus
tcctcctatagggttg

SEQ ID NO: 433905 - DNA, 16 bp, M. musculus
tcctcctcagcatctt

SEQ ID NO: 433906 - DNA, 16 bp, M. musculus
tcctcctcagcttctt

SEQ ID NO: 433907 - DNA, 16 bp, M. musculus
tcctcctcatcatcat

SEQ ID NO: 433908 - DNA, 16 bp, M. musculus
tcctcctcatcatctt

SEQ ID NO: 433909 - DNA, 16 bp, M. musculus
tcctcctccctcagct

SEQ ID NO: 433910 - DNA, 16 bp, M. musculus
tcctcctcctccacag

SEQ ID NO: 433911 - DNA, 16 bp, M. musculus
tcctcctcctcccagc

SEQ ID NO: 433912 - DNA, 16 bp, M. musculus
tcctcctcctcctgat

SEQ ID NO: 433913 - DNA, 16 bp, M. musculus
tcctcctcctccttaa

SEQ ID NO: 433914 - DNA, 16 bp, M. musculus
tcctcctcctctacat

SEQ ID NO: 433915 - DNA, 16 bp, M. musculus
tcctcctcctctgtgt

SEQ ID NO: 433916 - DNA, 16 bp, M. musculus
tcctcctccttcagct

SEQ ID NO: 433917 - DNA, 16 bp, M. musculus
tcctcctctgacctct

SEQ ID NO: 433918 - DNA, 16 bp, M. musculus
tcctcctctgcatcct

SEQ ID NO: 433919 - DNA, 16 bp, M. musculus
tcctcctctgcctgct

SEQ ID NO: 433920 - DNA, 16 bp, M. musculus
tcctcctctggcttcc

SEQ ID NO: 433921 - DNA, 16 bp, M. musculus
tcctcctgaggctgac

SEQ ID NO: 433922 - DNA, 16 bp, M. musculus
tcctcctgcagcagac

SEQ ID NO: 433923 - DNA, 16 bp, M. musculus
tcctcctgcaggagat

SEQ ID NO: 433924 - DNA, 16 bp, M. musculus
tcctcctgcccctacc

SEQ ID NO: 433925 - DNA, 16 bp, M. musculus
tcctcctgcctcaacc

SEQ ID NO: 433926 - DNA, 16 bp, M. musculus
tcctcctgcctcagac

SEQ ID NO: 433927 - DNA, 16 bp, M. musculus
tcctcctgcctcctga

SEQ ID NO: 433928 - DNA, 16 bp, M. musculus
tcctcctgcctcggct

SEQ ID NO: 433929 - DNA, 16 bp, M. musculus
tcctcctgcctgcctt

SEQ ID NO: 433930 - DNA, 16 bp, M. musculus
tcctcctgcctgtgcc

SEQ ID NO: 433931 - DNA, 16 bp, M. musculus
tcctcctgccttctgc

SEQ ID NO: 433932 - DNA, 16 bp, M. musculus
tcctcctgctgaactt

SEQ ID NO: 433933 - DNA, 16 bp, M. musculus
tcctcctgctgagaag

SEQ ID NO: 433934 - DNA, 16 bp, M. musculus
tcctcctgctgctgct

SEQ ID NO: 433935 - DNA, 16 bp, M. musculus
tcctcctgcttccacc

SEQ ID NO: 433936 - DNA, 16 bp, M. musculus
tcctcctgcttctgct

SEQ ID NO: 433937 - DNA, 16 bp, M. musculus
tcctcctggagagaac

SEQ ID NO: 433938 - DNA, 16 bp, M. musculus
tcctcctggcagaaga

SEQ ID NO: 433939 - DNA, 16 bp, M. musculus
tcctcctggctgcctg

SEQ ID NO: 433940 - DNA, 16 bp, M. musculus
tcctcctggctgtctt

SEQ ID NO: 433941 - DNA, 16 bp, M. musculus
tcctcctgggttgcct

SEQ ID NO: 433942 - DNA, 16 bp, M. musculus
tcctcctggtcctcct

SEQ ID NO: 433943 - DNA, 16 bp, M. musculus
tcctcctgtccatcct

SEQ ID NO: 433944 - DNA, 16 bp, M. musculus
tcctcctgtctccatt

SEQ ID NO: 433945 - DNA, 16 bp, M. musculus
tcctcctgtctcccca

SEQ ID NO: 433946 - DNA, 16 bp, M. musculus
tcctcctgtctctgcc

SEQ ID NO: 433947 - DNA, 16 bp, M. musculus
tcctcctgtctctgct

SEQ ID NO: 433948 - DNA, 16 bp, M. musculus
tcctcctgtggaaaaa

SEQ ID NO: 433949 - DNA, 16 bp, M. musculus
tcctccttgcctctga

SEQ ID NO: 433950 - DNA, 16 bp, M. musculus
tcctcctttaaaaaaa

SEQ ID NO: 433951 - DNA, 16 bp, M. musculus
tcctcctttttggccc

SEQ ID NO: 433952 - DNA, 16 bp, M. musculus
tcctctaacaaggcca

SEQ ID NO: 433953 - DNA, 16 bp, M. musculus
tcctctacaagagcag

SEQ ID NO: 433954 - DNA, 43 bp, M. musculus
tcctctaccatcatcatgagatatgcttttaaatccaggtcta

SEQ ID NO: 433955 - DNA, 18 bp, M. musculus
tcctctacccctgcgtgg

SEQ ID NO: 433956 - DNA, 16 bp, M. musculus
tcctctacctcctgtg

SEQ ID NO: 433957 - DNA, 16 bp, M. musculus
tcctctactttctgtt

SEQ ID NO: 433958 - DNA, 16 bp, M. musculus
tcctctagaagaggag

SEQ ID NO: 433959 - DNA, 16 bp, M. musculus
tcctctaggcaccttg

SEQ ID NO: 433960 - DNA, 16 bp, M. musculus
tcctctagggactttg

SEQ ID NO: 433961 - DNA, 16 bp, M. musculus
tcctctattagtttca

SEQ ID NO: 433962 - DNA, 16 bp, M. musculus
tcctctcagacatcct

SEQ ID NO: 433963 - DNA, 16 bp, M. musculus
tcctctcagcacctca

SEQ ID NO: 433964 - DNA, 16 bp, M. musculus
tcctctcagcatcctg

SEQ ID NO: 433965 - DNA, 16 bp, M. musculus
tcctctcaggagacag

SEQ ID NO: 433966 - DNA, 16 bp, M. musculus
tcctctcagtggggtg

SEQ ID NO: 433967 - DNA, 16 bp, M. musculus
tcctctccaacttgtt

SEQ ID NO: 433968 - DNA, 16 bp, M. musculus
tcctctccaagctgct

SEQ ID NO: 433969 - DNA, 16 bp, M. musculus
tcctctccagcatgtg

SEQ ID NO: 433970 - DNA, 16 bp, M. musculus
tcctctcccacagagg

SEQ ID NO: 433971 - DNA, 16 bp, M. musculus
tcctctctcattctta

SEQ ID NO: 433972 - DNA, 16 bp, M. musculus
tcctctctgcttccca

SEQ ID NO: 433973 - DNA, 16 bp, M. musculus
tcctctctggcctcct

SEQ ID NO: 433974 - DNA, 16 bp, M. musculus
tcctctctgtctctgt

SEQ ID NO: 433975 - DNA, 16 bp, M. musculus
tcctctcttacctgat

SEQ ID NO: 433976 - DNA, 16 bp, M. musculus
tcctctgaaactgtgt

SEQ ID NO: 433977 - DNA, 16 bp, M. musculus
tcctctgaaagaacaa

SEQ ID NO: 433978 - DNA, 16 bp, M. musculus
tcctctgaaagagaag

SEQ ID NO: 433979 - DNA, 16 bp, M. musculus
tcctctgaaagagctg

SEQ ID NO: 433980 - DNA, 16 bp, M. musculus
tcctctgacctcagca

SEQ ID NO: 433981 - DNA, 16 bp, M. musculus
tcctctgacctccata

SEQ ID NO: 433982 - DNA, 16 bp, M. musculus
tcctctgacctctcta

SEQ ID NO: 433983 - DNA, 16 bp, M. musculus
tcctctgacctgtaca

SEQ ID NO: 433984 - DNA, 16 bp, M. musculus
tcctctgaccttcaaa

SEQ ID NO: 433985 - DNA, 16 bp, M. musculus
tcctctgactaccaca

SEQ ID NO: 433986 - DNA, 16 bp, M. musculus
tcctctgactcccaca

SEQ ID NO: 433987 - DNA, 16 bp, M. musculus
tcctctgacttctact

SEQ ID NO: 433988 - DNA, 16 bp, M. musculus
tcctctgactttcaca

SEQ ID NO: 433989 - DNA, 16 bp, M. musculus
tcctctgagaagggga

SEQ ID NO: 433990 - DNA, 16 bp, M. musculus
tcctctgagaccctga

SEQ ID NO: 433991 - DNA, 16 bp, M. musculus
tcctctgagctagaca

SEQ ID NO: 433992 - DNA, 16 bp, M. musculus
tcctctgcaaagagca

SEQ ID NO: 433993 - DNA, 16 bp, M. musculus
tcctctgcaaaggcag

SEQ ID NO: 433994 - DNA, 16 bp, M. musculus
tcctctgcaagaatag

SEQ ID NO: 433995 - DNA, 16 bp, M. musculus
tcctctgcactttctt

SEQ ID NO: 433996 - DNA, 16 bp, M. musculus
tcctctgcattctctc

SEQ ID NO: 433997 - DNA, 16 bp, M. musculus
tcctctgccaaagcag

SEQ ID NO: 433998 - DNA, 16 bp, M. musculus
tcctctgcctcagttt

SEQ ID NO: 433999 - DNA, 20 bp, M. musculus
tcctctgcctcccaagtgct

SEQ ID NO: 434000 - DNA, 16 bp, M. musculus
tcctctgcctggccct

SEQ ID NO: 434001 - DNA, 16 bp, M. musculus
tcctctgcctttccca

SEQ ID NO: 434002 - DNA, 17 bp, M. musculus
tcctctgctgtatgtgt

SEQ ID NO: 434003 - DNA, 16 bp, M. musculus
tcctctggaacagcag

SEQ ID NO: 434004 - DNA, 17 bp, M. musculus
tcctctggaagagcagt

SEQ ID NO: 434005 - DNA, 16 bp, M. musculus
tcctctggaagagcca

SEQ ID NO: 434006 - DNA, 16 bp, M. musculus
tcctctggaagagctg

SEQ ID NO: 434007 - DNA, 16 bp, M. musculus
tcctctggaagaggag

SEQ ID NO: 434008 - DNA, 16 bp, M. musculus
tcctctggaagtgcag

SEQ ID NO: 434009 - DNA, 16 bp, M. musculus
tcctctggaagtgctc

SEQ ID NO: 434010 - DNA, 16 bp, M. musculus
tcctctggacgagcag

SEQ ID NO: 434011 - DNA, 16 bp, M. musculus
tcctctggagaccatg

SEQ ID NO: 434012 - DNA, 16 bp, M. musculus
tcctctggagtgtctg

SEQ ID NO: 434013 - DNA, 16 bp, M. musculus
tcctctggagttacag

SEQ ID NO: 434014 - DNA, 16 bp, M. musculus
tcctctggcagggaag

SEQ ID NO: 434015 - DNA, 16 bp, M. musculus
tcctctggcccccaca

SEQ ID NO: 434016 - DNA, 16 bp, M. musculus
tcctctggcctccaaa

SEQ ID NO: 434017 - DNA, 16 bp, M. musculus
tcctctggcctctgtg

SEQ ID NO: 434018 - DNA, 16 bp, M. musculus
tcctctggctcttcca

SEQ ID NO: 434019 - DNA, 16 bp, M. musculus
tcctctggctttcaca

SEQ ID NO: 434020 - DNA, 16 bp, M. musculus
tcctctgggacagagg

SEQ ID NO: 434021 - DNA, 16 bp, M. musculus
tcctctggggacagtg

SEQ ID NO: 434022 - DNA, 16 bp, M. musculus
tcctctggggaccgtg

SEQ ID NO: 434023 - DNA, 16 bp, M. musculus
tcctctggggactttg

SEQ ID NO: 434024 - DNA, 16 bp, M. musculus
tcctctggggtgaatt

SEQ ID NO: 434025 - DNA, 16 bp, M. musculus
tcctctggtctccaca

SEQ ID NO: 434026 - DNA, 16 bp, M. musculus
tcctctgtaaaatggg

SEQ ID NO: 434027 - DNA, 16 bp, M. musculus
tcctctgtctccctgc

SEQ ID NO: 434028 - DNA, 16 bp, M. musculus
tcctctgtctcctgag

SEQ ID NO: 434029 - DNA, 16 bp, M. musculus
tcctctgtcttccaca

SEQ ID NO: 434030 - DNA, 16 bp, M. musculus
tcctctgtcttctgag

SEQ ID NO: 434031 - DNA, 19 bp, M. musculus
tcctctgtgataactccag

SEQ ID NO: 434032 - DNA, 16 bp, M. musculus
tcctctgtggacagca

SEQ ID NO: 434033 - DNA, 16 bp, M. musculus
tcctctgtgtagctct

SEQ ID NO: 434034 - DNA, 16 bp, M. musculus
tcctctgtgtgcagtg

SEQ ID NO: 434035 - DNA, 16 bp, M. musculus
tcctctgttgggggcc

SEQ ID NO: 434036 - DNA, 16 bp, M. musculus
tcctctgttgtaaatt

SEQ ID NO: 434037 - DNA, 16 bp, M. musculus
tcctcttcaagttgct

SEQ ID NO: 434038 - DNA, 16 bp, M. musculus
tcctcttcagaaaagg

SEQ ID NO: 434039 - DNA, 16 bp, M. musculus
tcctcttcagcatctg

SEQ ID NO: 434040 - DNA, 16 bp, M. musculus
tcctcttcatttccat

SEQ ID NO: 434041 - DNA, 16 bp, M. musculus
tcctcttccaaaatga

SEQ ID NO: 434042 - DNA, 16 bp, M. musculus
tcctcttccactgagg

SEQ ID NO: 434043 - DNA, 16 bp, M. musculus
tcctcttcctcaggct

SEQ ID NO: 434044 - DNA, 16 bp, M. musculus
tcctcttcctccacat

SEQ ID NO: 434045 - DNA, 16 bp, M. musculus
tcctcttcctcctgag

SEQ ID NO: 434046 - DNA, 16 bp, M. musculus
tcctcttcctcctggg

SEQ ID NO: 434047 - DNA, 16 bp, M. musculus
tcctcttcctgctgct

SEQ ID NO: 434048 - DNA, 16 bp, M. musculus
tcctcttctcagatga

SEQ ID NO: 434049 - DNA, 16 bp, M. musculus
tcctcttctctctgtg

SEQ ID NO: 434050 - DNA, 16 bp, M. musculus
tcctcttctctgatga

SEQ ID NO: 434051 - DNA, 16 bp, M. musculus
tcctcttctgacctcc

SEQ ID NO: 434052 - DNA, 16 bp, M. musculus
tcctcttctgctgtgt

SEQ ID NO: 434053 - DNA, 16 bp, M. musculus
tcctcttctggcctct

SEQ ID NO: 434054 - DNA, 16 bp, M. musculus
tcctcttctggccttc

SEQ ID NO: 434055 - DNA, 16 bp, M. musculus
tcctcttgattttctt

SEQ ID NO: 434056 - DNA, 16 bp, M. musculus
tcctcttgcagaggac

SEQ ID NO: 434057 - DNA, 16 bp, M. musculus
tcctcttgcagtttgc

SEQ ID NO: 434058 - DNA, 16 bp, M. musculus
tcctcttgcctcagtc

SEQ ID NO: 434059 - DNA, 16 bp, M. musculus
tcctcttgcctttgcc

SEQ ID NO: 434060 - DNA, 16 bp, M. musculus
tcctcttgctcctgct

SEQ ID NO: 434061 - DNA, 16 bp, M. musculus
tcctcttgcttcagcc

SEQ ID NO: 434062 - DNA, 16 bp, M. musculus
tcctcttggagacaga

SEQ ID NO: 434063 - DNA, 16 bp, M. musculus
tcctcttggccatggc

SEQ ID NO: 434064 - DNA, 16 bp, M. musculus
tcctcttggctgcctt

SEQ ID NO: 434065 - DNA, 17 bp, M. musculus
tcctcttgggtgaattt

SEQ ID NO: 434066 - DNA, 16 bp, M. musculus
tcctctttcccagttt

SEQ ID NO: 434067 - DNA, 16 bp, M. musculus
tcctctttcctgattt

SEQ ID NO: 434068 - DNA, 16 bp, M. musculus
tcctctttgcttcctg

SEQ ID NO: 434069 - DNA, 16 bp, M. musculus
tcctcttttgtgaatt

SEQ ID NO: 434070 - DNA, 16 bp, M. musculus
tcctgaaactctctgt

SEQ ID NO: 434071 - DNA, 16 bp, M. musculus
tcctgaaactgaaaag

SEQ ID NO: 434072 - DNA, 16 bp, M. musculus
tcctgaaacttgctat

SEQ ID NO: 434073 - DNA, 16 bp, M. musculus
tcctgaaattcttctc

SEQ ID NO: 434074 - DNA, 16 bp, M. musculus
tcctgaacaaaacaca

SEQ ID NO: 434075 - DNA, 16 bp, M. musculus
tcctgaacaaaatacc

SEQ ID NO: 434076 - DNA, 16 bp, M. musculus
tcctgaagaaattcaa

SEQ ID NO: 434077 - DNA, 16 bp, M. musculus
tcctgaagacccagct

SEQ ID NO: 434078 - DNA, 17 bp, M. musculus
tcctgaagcagctgggc

SEQ ID NO: 434079 - DNA, 16 bp, M. musculus
tcctgaagttgctttt

SEQ ID NO: 434080 - DNA, 16 bp, M. musculus
tcctgaatgaggtgac

SEQ ID NO: 434081 - DNA, 16 bp, M. musculus
tcctgaatgctgagat

SEQ ID NO: 434082 - DNA, 16 bp, M. musculus
tcctgaatgctgggac

SEQ ID NO: 434083 - DNA, 16 bp, M. musculus
tcctgaatgttgggat

SEQ ID NO: 434084 - DNA, 17 bp, M. musculus
tcctgaatttcctggat

SEQ ID NO: 434085 - DNA, 16 bp, M. musculus
tcctgacactggacaa

SEQ ID NO: 434086 - DNA, 16 bp, M. musculus
tcctgacagtgaagat

SEQ ID NO: 434087 - DNA, 16 bp, M. musculus
tcctgaccaagaagca

SEQ ID NO: 434088 - DNA, 16 bp, M. musculus
tcctgaccacaagatg

SEQ ID NO: 434089 - DNA, 16 bp, M. musculus
tcctgaccctctggac

SEQ ID NO: 434090 - DNA, 16 bp, M. musculus
tcctgacctcaagcta

SEQ ID NO: 434091 - DNA, 16 bp, M. musculus
tcctgacctctgtggg

SEQ ID NO: 434092 - DNA, 16 bp, M. musculus
tcctgaccttcctgct

SEQ ID NO: 434093 - DNA, 16 bp, M. musculus
tcctgacggcgatccc

SEQ ID NO: 434094 - DNA, 16 bp, M. musculus
tcctgactcagcctcc

SEQ ID NO: 434095 - DNA, 16 bp, M. musculus
tcctgacttccctcag

SEQ ID NO: 434096 - DNA, 16 bp, M. musculus
tcctgacttccttgat

SEQ ID NO: 434097 - DNA, 16 bp, M. musculus
tcctgagaaatgacac

SEQ ID NO: 434098 - DNA, 16 bp, M. musculus
tcctgagaaccttagt

SEQ ID NO: 434099 - DNA, 16 bp, M. musculus
tcctgagagctgagat

SEQ ID NO: 434100 - DNA, 16 bp, M. musculus
tcctgagatcctgtga

SEQ ID NO: 434101 - DNA, 16 bp, M. musculus
tcctgagcgctggaat

SEQ ID NO: 434102 - DNA, 16 bp, M. musculus
tcctgagctctgagga

SEQ ID NO: 434103 - DNA, 16 bp, M. musculus
tcctgaggaccagcag

SEQ ID NO: 434104 - DNA, 16 bp, M. musculus
tcctgaggcaaaggcc

SEQ ID NO: 434105 - DNA, 16 bp, M. musculus
tcctgagggctctggg

SEQ ID NO: 434106 - DNA, 16 bp, M. musculus
tcctgaggtcctgggt

SEQ ID NO: 434107 - DNA, 16 bp, M. musculus
tcctgagtactgaaat

SEQ ID NO: 434108 - DNA, 16 bp, M. musculus
tcctgagtgatggggt

SEQ ID NO: 434109 - DNA, 16 bp, M. musculus
tcctgagtgccaggat

SEQ ID NO: 434110 - DNA, 16 bp, M. musculus
tcctgagtgctggaac

SEQ ID NO: 434111 - DNA, 16 bp, M. musculus
tcctgagtgctggcat

SEQ ID NO: 434112 - DNA, 16 bp, M. musculus
tcctgagtgtggggat

SEQ ID NO: 434113 - DNA, 16 bp, M. musculus
tcctgagttctgggat

SEQ ID NO: 434114 - DNA, 16 bp, M. musculus
tcctgagttctgggtt

SEQ ID NO: 434115 - DNA, 16 bp, M. musculus
tcctgatagccctggc

SEQ ID NO: 434116 - DNA, 16 bp, M. musculus
tcctgatcctcttgtc

SEQ ID NO: 434117 - DNA, 16 bp, M. musculus
tcctgatccttctgct

SEQ ID NO: 434118 - DNA, 16 bp, M. musculus
tcctgatggatctgcc

SEQ ID NO: 434119 - DNA, 16 bp, M. musculus
tcctgatgtagaactc

SEQ ID NO: 434120 - DNA, 16 bp, M. musculus
tcctgattctcctgcc

SEQ ID NO: 434121 - DNA, 16 bp, M. musculus
tcctgattctcctgtc

SEQ ID NO: 434122 - DNA, 17 bp, M. musculus
tcctgatttctttccta

SEQ ID NO: 434123 - DNA, 16 bp, M. musculus
tcctgcaaatttcatg

SEQ ID NO: 434124 - DNA, 17 bp, M. musculus
tcctgcaagatacaaag

SEQ ID NO: 434125 - DNA, 16 bp, M. musculus
tcctgcaagctgtcct

SEQ ID NO: 434126 - DNA, 16 bp, M. musculus
tcctgcaagctgtctt

SEQ ID NO: 434127 - DNA, 16 bp, M. musculus
tcctgcaaggtggtct

SEQ ID NO: 434128 - DNA, 16 bp, M. musculus
tcctgcaagttttcct

SEQ ID NO: 434129 - DNA, 16 bp, M. musculus
tcctgcaatctggcaa

SEQ ID NO: 434130 - DNA, 16 bp, M. musculus
tcctgcaatgacttga

SEQ ID NO: 434131 - DNA, 16 bp, M. musculus
tcctgcacaaaaatca

SEQ ID NO: 434132 - DNA, 16 bp, M. musculus
tcctgcaccatgactg

SEQ ID NO: 434133 - DNA, 17 bp, M. musculus
tcctgcagaaacatcat

SEQ ID NO: 434134 - DNA, 16 bp, M. musculus
tcctgcagaggactca

SEQ ID NO: 434135 - DNA, 16 bp, M. musculus
tcctgcagaggacttg

SEQ ID NO: 434136 - DNA, 16 bp, M. musculus
tcctgcagagtggaga

SEQ ID NO: 434137 - DNA, 16 bp, M. musculus
tcctgcagcatgcctg

SEQ ID NO: 434138 - DNA, 16 bp, M. musculus
tcctgcagcccaggct

SEQ ID NO: 434139 - DNA, 16 bp, M. musculus
tcctgcagctttgaat

SEQ ID NO: 434140 - DNA, 16 bp, M. musculus
tcctgcaggaggacct

SEQ ID NO: 434141 - DNA, 16 bp, M. musculus
tcctgcaggttgtcct

SEQ ID NO: 434142 - DNA, 16 bp, M. musculus
tcctgcatcagcctcc

SEQ ID NO: 434143 - DNA, 16 bp, M. musculus
tcctgcatccctctga

SEQ ID NO: 434144 - DNA, 16 bp, M. musculus
tcctgcatctgcctgc

SEQ ID NO: 434145 - DNA, 16 bp, M. musculus
tcctgcattccttccc

SEQ ID NO: 434146 - DNA, 16 bp, M. musculus
tcctgccaagccatga

SEQ ID NO: 434147 - DNA, 16 bp, M. musculus
tcctgccaagtggcac

SEQ ID NO: 434148 - DNA, 17 bp, M. musculus
tcctgccaatccatgag

SEQ ID NO: 434149 - DNA, 16 bp, M. musculus
tcctgccaccatgtct

SEQ ID NO: 434150 - DNA, 16 bp, M. musculus
tcctgccaggagagag

SEQ ID NO: 434151 - DNA, 16 bp, M. musculus
tcctgccagtccttct

SEQ ID NO: 434152 - DNA, 16 bp, M. musculus
tcctgccatctgctcc

SEQ ID NO: 434153 - DNA, 16 bp, M. musculus
tcctgccccagcctcc

SEQ ID NO: 434154 - DNA, 16 bp, M. musculus
tcctgccccagcctct

SEQ ID NO: 434155 - DNA, 16 bp, M. musculus
tcctgccctcactgct

SEQ ID NO: 434156 - DNA, 16 bp, M. musculus
tcctgccctggcattc

SEQ ID NO: 434157 - DNA, 16 bp, M. musculus
tcctgcctaagcctcc

SEQ ID NO: 434158 - DNA, 16 bp, M. musculus
tcctgcctagctacag

SEQ ID NO: 434159 - DNA, 16 bp, M. musculus
tcctgcctcaacctcc

SEQ ID NO: 434160 - DNA, 16 bp, M. musculus
tcctgcctcaccacct

SEQ ID NO: 434161 - DNA, 16 bp, M. musculus
tcctgcctcaccactc

SEQ ID NO: 434162 - DNA, 16 bp, M. musculus
tcctgcctcaccctct

SEQ ID NO: 434163 - DNA, 16 bp, M. musculus
tcctgcctcagccacc

SEQ ID NO: 434164 - DNA, 16 bp, M. musculus
tcctgcctcagccatc

SEQ ID NO: 434165 - DNA, 16 bp, M. musculus
tcctgcctcagccccc

SEQ ID NO: 434166 - DNA, 16 bp, M. musculus
tcctgcctcagcctgc

SEQ ID NO: 434167 - DNA, 16 bp, M. musculus
tcctgcctcagccttt

SEQ ID NO: 434168 - DNA, 16 bp, M. musculus
tcctgcctcagctgcc

SEQ ID NO: 434169 - DNA, 16 bp, M. musculus
tcctgcctcagctttc

SEQ ID NO: 434170 - DNA, 16 bp, M. musculus
tcctgcctcaggctcc

SEQ ID NO: 434171 - DNA, 16 bp, M. musculus
tcctgcctcaggttcc

SEQ ID NO: 434172 - DNA, 16 bp, M. musculus
tcctgcctcagtctct

SEQ ID NO: 434173 - DNA, 16 bp, M. musculus
tcctgcctcagttcct

SEQ ID NO: 434174 - DNA, 16 bp, M. musculus
tcctgcctcagtttct

SEQ ID NO: 434175 - DNA, 16 bp, M. musculus
tcctgcctccacaccc

SEQ ID NO: 434176 - DNA, 16 bp, M. musculus
tcctgcctccacctct

SEQ ID NO: 434177 - DNA, 16 bp, M. musculus
tcctgcctccactccc

SEQ ID NO: 434178 - DNA, 16 bp, M. musculus
tcctgcctccacttcc

SEQ ID NO: 434179 - DNA, 16 bp, M. musculus
tcctgcctccactttc

SEQ ID NO: 434180 - DNA, 16 bp, M. musculus
tcctgcctccaggttt

SEQ ID NO: 434181 - DNA, 16 bp, M. musculus
tcctgcctccatctcc

SEQ ID NO: 434182 - DNA, 16 bp, M. musculus
tcctgcctccgggttc

SEQ ID NO: 434183 - DNA, 16 bp, M. musculus
tcctgcctcggtttcc

SEQ ID NO: 434184 - DNA, 16 bp, M. musculus
tcctgcctctacctca

SEQ ID NO: 434185 - DNA, 16 bp, M. musculus
tcctgcctctacctcc

SEQ ID NO: 434186 - DNA, 16 bp, M. musculus
tcctgcctctaggttc

SEQ ID NO: 434187 - DNA, 16 bp, M. musculus
tcctgcctctagtttc

SEQ ID NO: 434188 - DNA, 16 bp, M. musculus
tcctgcctctatgagg

SEQ ID NO: 434189 - DNA, 16 bp, M. musculus
tcctgcctctgactct

SEQ ID NO: 434190 - DNA, 16 bp, M. musculus
tcctgcctctgggttc

SEQ ID NO: 434191 - DNA, 16 bp, M. musculus
tcctgcctgcagagtg

SEQ ID NO: 434192 - DNA, 16 bp, M. musculus
tcctgcctgctgccat

SEQ ID NO: 434193 - DNA, 16 bp, M. musculus
tcctgcctggatgctg

SEQ ID NO: 434194 - DNA, 16 bp, M. musculus
tcctgcctggccacag

SEQ ID NO: 434195 - DNA, 16 bp, M. musculus
tcctgcctggctgcag

SEQ ID NO: 434196 - DNA, 16 bp, M. musculus
tcctgccttccagccc

SEQ ID NO: 434197 - DNA, 16 bp, M. musculus
tcctgccttcctgcct

SEQ ID NO: 434198 - DNA, 16 bp, M. musculus
tcctgccttcctttgg

SEQ ID NO: 434199 - DNA, 16 bp, M. musculus
tcctgccttggcctcc

SEQ ID NO: 434200 - DNA, 16 bp, M. musculus
tcctgccttggtttcc

SEQ ID NO: 434201 - DNA, 16 bp, M. musculus
tcctgctactcttcct

SEQ ID NO: 434202 - DNA, 16 bp, M. musculus
tcctgctatggggctg

SEQ ID NO: 434203 - DNA, 16 bp, M. musculus
tcctgctcactgtgct

SEQ ID NO: 434204 - DNA, 16 bp, M. musculus
tcctgctcatctccct

SEQ ID NO: 434205 - DNA, 16 bp, M. musculus
tcctgctccagcctcc

SEQ ID NO: 434206 - DNA, 16 bp, M. musculus
tcctgctccagttgtt

SEQ ID NO: 434207 - DNA, 16 bp, M. musculus
tcctgctccccaaccc

SEQ ID NO: 434208 - DNA, 16 bp, M. musculus
tcctgctcctcctgtt

SEQ ID NO: 434209 - DNA, 16 bp, M. musculus
tcctgctcctgatgat

SEQ ID NO: 434210 - DNA, 16 bp, M. musculus
tcctgctcctgctgcc

SEQ ID NO: 434211 - DNA, 16 bp, M. musculus
tcctgctcctgctgtt

SEQ ID NO: 434212 - DNA, 16 bp, M. musculus
tcctgctcctgttcct

SEQ ID NO: 434213 - DNA, 16 bp, M. musculus
tcctgctctcatgcct

SEQ ID NO: 434214 - DNA, 16 bp, M. musculus
tcctgctctcctaccc

SEQ ID NO: 434215 - DNA, 16 bp, M. musculus
tcctgctctcctgctc

SEQ ID NO: 434216 - DNA, 16 bp, M. musculus
tcctgctctgatgtca

SEQ ID NO: 434217 - DNA, 16 bp, M. musculus
tcctgctctggctcct

SEQ ID NO: 434218 - DNA, 16 bp, M. musculus
tcctgctctggcttct

SEQ ID NO: 434219 - DNA, 16 bp, M. musculus
tcctgctctgtcccct

SEQ ID NO: 434220 - DNA, 16 bp, M. musculus
tcctgctctgtgtgag

SEQ ID NO: 434221 - DNA, 16 bp, M. musculus
tcctgctgcagctggg

SEQ ID NO: 434222 - DNA, 16 bp, M. musculus
tcctgctgccctaatg

SEQ ID NO: 434223 - DNA, 16 bp, M. musculus
tcctgctgcctcagcc

SEQ ID NO: 434224 - DNA, 16 bp, M. musculus
tcctgctgcctctcct

SEQ ID NO: 434225 - DNA, 16 bp, M. musculus
tcctgctgcctctgct

SEQ ID NO: 434226 - DNA, 16 bp, M. musculus
tcctgctgcctgcaga

SEQ ID NO: 434227 - DNA, 16 bp, M. musculus
tcctgctgcctgcctg

SEQ ID NO: 434228 - DNA, 16 bp, M. musculus
tcctgctgccttcaga

SEQ ID NO: 434229 - DNA, 16 bp, M. musculus
tcctgctgctgaggca

SEQ ID NO: 434230 - DNA, 16 bp, M. musculus
tcctgctgctgcctcc

SEQ ID NO: 434231 - DNA, 16 bp, M. musculus
tcctgctgctgctgcc

SEQ ID NO: 434232 - DNA, 16 bp, M. musculus
tcctgctgctgtgcct

SEQ ID NO: 434233 - DNA, 16 bp, M. musculus
tcctgctgcttctgct

SEQ ID NO: 434234 - DNA, 16 bp, M. musculus
tcctgctggagatggg

SEQ ID NO: 434235 - DNA, 16 bp, M. musculus
tcctgctggaggtgga

SEQ ID NO: 434236 - DNA, 16 bp, M. musculus
tcctgctggtccctcc

SEQ ID NO: 434237 - DNA, 16 bp, M. musculus
tcctgctgtcctgctg

SEQ ID NO: 434238 - DNA, 16 bp, M. musculus
tcctgctgtctactac

SEQ ID NO: 434239 - DNA, 16 bp, M. musculus
tcctgctgtctccacc

SEQ ID NO: 434240 - DNA, 16 bp, M. musculus
tcctgctgtctctgcc

SEQ ID NO: 434241 - DNA, 16 bp, M. musculus
tcctgctgtgtcaggg

SEQ ID NO: 434242 - DNA, 16 bp, M. musculus
tcctgctgttgccctg

SEQ ID NO: 434243 - DNA, 16 bp, M. musculus
tcctgcttatcagata

SEQ ID NO: 434244 - DNA, 16 bp, M. musculus
tcctgcttcacttaag

SEQ ID NO: 434245 - DNA, 16 bp, M. musculus
tcctgcttcagcctct

SEQ ID NO: 434246 - DNA, 16 bp, M. musculus
tcctgcttcagccttc

SEQ ID NO: 434247 - DNA, 16 bp, M. musculus
tcctgcttcagcttcc

SEQ ID NO: 434248 - DNA, 16 bp, M. musculus
tcctgcttcagcttct

SEQ ID NO: 434249 - DNA, 16 bp, M. musculus
tcctgcttcagtcttc

SEQ ID NO: 434250 - DNA, 16 bp, M. musculus
tcctgcttcatcctcc

SEQ ID NO: 434251 - DNA, 16 bp, M. musculus
tcctgcttccacctcc

SEQ ID NO: 434252 - DNA, 16 bp, M. musculus
tcctgcttccatctcc

SEQ ID NO: 434253 - DNA, 16 bp, M. musculus
tcctgcttccatgtcc

SEQ ID NO: 434254 - DNA, 16 bp, M. musculus
tcctgcttcctgctcc

SEQ ID NO: 434255 - DNA, 16 bp, M. musculus
tcctgcttcctggcca

SEQ ID NO: 434256 - DNA, 16 bp, M. musculus
tcctgcttctgcttct

SEQ ID NO: 434257 - DNA, 16 bp, M. musculus
tcctgcttgagttcct

SEQ ID NO: 434258 - DNA, 16 bp, M. musculus
tcctgctttctctgtg

SEQ ID NO: 434259 - DNA, 16 bp, M. musculus
tcctgctttctgccct

SEQ ID NO: 434260 - DNA, 16 bp, M. musculus
tcctggaaccaaggtg

SEQ ID NO: 434261 - DNA, 16 bp, M. musculus
tcctggaacccacaga

SEQ ID NO: 434262 - DNA, 16 bp, M. musculus
tcctggaaccctggct

SEQ ID NO: 434263 - DNA, 16 bp, M. musculus
tcctggaactcagtct

SEQ ID NO: 434264 - DNA, 16 bp, M. musculus
tcctggaactcgatct

SEQ ID NO: 434265 - DNA, 16 bp, M. musculus
tcctggaactctatct

SEQ ID NO: 434266 - DNA, 16 bp, M. musculus
tcctggaactgaaatt

SEQ ID NO: 434267 - DNA, 16 bp, M. musculus
tcctggaactggaatt

SEQ ID NO: 434268 - DNA, 16 bp, M. musculus
tcctggaagcagcaga

SEQ ID NO: 434269 - DNA, 16 bp, M. musculus
tcctggaataaaacct

SEQ ID NO: 434270 - DNA, 16 bp, M. musculus
tcctggaatactttgg

SEQ ID NO: 434271 - DNA, 16 bp, M. musculus
tcctggaattcctgga

SEQ ID NO: 434272 - DNA, 16 bp, M. musculus
tcctggacagccagag

SEQ ID NO: 434273 - DNA, 16 bp, M. musculus
tcctggacagccagga

SEQ ID NO: 434274 - DNA, 16 bp, M. musculus
tcctggacattcaccc

SEQ ID NO: 434275 - DNA, 16 bp, M. musculus
tcctggacctcaagct

SEQ ID NO: 434276 - DNA, 16 bp, M. musculus
tcctggacctggagtt

SEQ ID NO: 434277 - DNA, 16 bp, M. musculus
tcctggacctttagct

SEQ ID NO: 434278 - DNA, 16 bp, M. musculus
tcctggacttcctgga

SEQ ID NO: 434279 - DNA, 16 bp, M. musculus
tcctggagactgaact

SEQ ID NO: 434280 - DNA, 16 bp, M. musculus
tcctggagatgaaaaa

SEQ ID NO: 434281 - DNA, 16 bp, M. musculus
tcctggagatgccctc

SEQ ID NO: 434282 - DNA, 16 bp, M. musculus
tcctggagccaagaag

SEQ ID NO: 434283 - DNA, 16 bp, M. musculus
tcctggagctcacact

SEQ ID NO: 434284 - DNA, 16 bp, M. musculus
tcctggagctcactat

SEQ ID NO: 434285 - DNA, 16 bp, M. musculus
tcctggagctgaagtt

SEQ ID NO: 434286 - DNA, 16 bp, M. musculus
tcctggagctgctgct

SEQ ID NO: 434287 - DNA, 16 bp, M. musculus
tcctggagctggagag

SEQ ID NO: 434288 - DNA, 16 bp, M. musculus
tcctggaggaggagaa

SEQ ID NO: 434289 - DNA, 16 bp, M. musculus
tcctggaggccagaag

SEQ ID NO: 434290 - DNA, 16 bp, M. musculus
tcctggaggctagtgt

SEQ ID NO: 434291 - DNA, 16 bp, M. musculus
tcctggagttcactct

SEQ ID NO: 434292 - DNA, 16 bp, M. musculus
tcctggagttcctgga

SEQ ID NO: 434293 - DNA, 16 bp, M. musculus
tcctggataaaagaca

SEQ ID NO: 434294 - DNA, 16 bp, M. musculus
tcctggatacccaaac

SEQ ID NO: 434295 - DNA, 16 bp, M. musculus
tcctggatctcctgga

SEQ ID NO: 434296 - DNA, 16 bp, M. musculus
tcctggatctctcaga

SEQ ID NO: 434297 - DNA, 16 bp, M. musculus
tcctggatgctataag

SEQ ID NO: 434298 - DNA, 16 bp, M. musculus
tcctggatggcctgga

SEQ ID NO: 434299 - DNA, 16 bp, M. musculus
tcctggatggttttct

SEQ ID NO: 434300 - DNA, 16 bp, M. musculus
tcctggattccctgga

SEQ ID NO: 434301 - DNA, 16 bp, M. musculus
tcctggattcctccct

SEQ ID NO: 434302 - DNA, 16 bp, M. musculus
tcctggatttcctgca

SEQ ID NO: 434303 - DNA, 17 bp, M. musculus
tcctggatttcctggac

SEQ ID NO: 434304 - DNA, 17 bp, M. musculus
tcctggatttcctggat

SEQ ID NO: 434305 - DNA, 17 bp, M. musculus
tcctggatttcttggat

SEQ ID NO: 434306 - DNA, 16 bp, M. musculus
tcctggatttgctgga

SEQ ID NO: 434307 - DNA, 16 bp, M. musculus
tcctggcacccacaca

SEQ ID NO: 434308 - DNA, 16 bp, M. musculus
tcctggcactggggag

SEQ ID NO: 434309 - DNA, 16 bp, M. musculus
tcctggcagcagccag

SEQ ID NO: 434310 - DNA, 16 bp, M. musculus
tcctggcagccttcag

SEQ ID NO: 434311 - DNA, 16 bp, M. musculus
tcctggccagaggaca

SEQ ID NO: 434312 - DNA, 16 bp, M. musculus
tcctggcccagacatt

SEQ ID NO: 434313 - DNA, 16 bp, M. musculus
tcctggccctggcagt

SEQ ID NO: 434314 - DNA, 16 bp, M. musculus
tcctggccctggcctt

SEQ ID NO: 434315 - DNA, 16 bp, M. musculus
tcctggccctgggatt

SEQ ID NO: 434316 - DNA, 16 bp, M. musculus
tcctggccctggtgtt

SEQ ID NO: 434317 - DNA, 16 bp, M. musculus
tcctggcctctgtgag

SEQ ID NO: 434318 - DNA, 16 bp, M. musculus
tcctggccttcaccaa

SEQ ID NO: 434319 - DNA, 16 bp, M. musculus
tcctggccttctgatg

SEQ ID NO: 434320 - DNA, 16 bp, M. musculus
tcctggctattgtgaa

SEQ ID NO: 434321 - DNA, 16 bp, M. musculus
tcctggctcagcctcc

SEQ ID NO: 434322 - DNA, 16 bp, M. musculus
tcctggctccttctca

SEQ ID NO: 434323 - DNA, 16 bp, M. musculus
tcctggctgaaaatga

SEQ ID NO: 434324 - DNA, 16 bp, M. musculus
tcctggctgaagataa

SEQ ID NO: 434325 - DNA, 16 bp, M. musculus
tcctggctgacctgga

SEQ ID NO: 434326 - DNA, 16 bp, M. musculus
tcctggctgaggaaga

SEQ ID NO: 434327 - DNA, 16 bp, M. musculus
tcctggctgccttgga

SEQ ID NO: 434328 - DNA, 16 bp, M. musculus
tcctggctgcctttag

SEQ ID NO: 434329 - DNA, 16 bp, M. musculus
tcctggctgcttttgg

SEQ ID NO: 434330 - DNA, 16 bp, M. musculus
tcctggctggtcctgc

SEQ ID NO: 434331 - DNA, 16 bp, M. musculus
tcctggctgtcatgga

SEQ ID NO: 434332 - DNA, 16 bp, M. musculus
tcctggctgtcctaga

SEQ ID NO: 434333 - DNA, 16 bp, M. musculus
tcctggctgtcctgaa

SEQ ID NO: 434334 - DNA, 17 bp, M. musculus
tcctggctgtcctggaa

SEQ ID NO: 434335 - DNA, 16 bp, M. musculus
tcctggctgtcttgga

SEQ ID NO: 434336 - DNA, 16 bp, M. musculus
tcctggctgtgttaga

SEQ ID NO: 434337 - DNA, 16 bp, M. musculus
tcctggcttcctttga

SEQ ID NO: 434338 - DNA, 16 bp, M. musculus
tcctggcttgctcagt

SEQ ID NO: 434339 - DNA, 16 bp, M. musculus
tcctgggaactggagt

SEQ ID NO: 434340 - DNA, 16 bp, M. musculus
tcctgggactcacttt

SEQ ID NO: 434341 - DNA, 16 bp, M. musculus
tcctgggagacaagtt

SEQ ID NO: 434342 - DNA, 16 bp, M. musculus
tcctgggagaccagat

SEQ ID NO: 434343 - DNA, 16 bp, M. musculus
tcctgggagaccagtt

SEQ ID NO: 434344 - DNA, 16 bp, M. musculus
tcctgggagctctgag

SEQ ID NO: 434345 - DNA, 16 bp, M. musculus
tcctgggaggccttca

SEQ ID NO: 434346 - DNA, 16 bp, M. musculus
tcctgggagtctcttg

SEQ ID NO: 434347 - DNA, 16 bp, M. musculus
tcctgggatcctgaga

SEQ ID NO: 434348 - DNA, 16 bp, M. musculus
tcctgggatcctggct

SEQ ID NO: 434349 - DNA, 16 bp, M. musculus
tcctgggatctgcctg

SEQ ID NO: 434350 - DNA, 16 bp, M. musculus
tcctgggatgccttca

SEQ ID NO: 434351 - DNA, 16 bp, M. musculus
tcctgggattaaagac

SEQ ID NO: 434352 - DNA, 16 bp, M. musculus
tcctgggattaaaggc

SEQ ID NO: 434353 - DNA, 16 bp, M. musculus
tcctgggattaaaggt

SEQ ID NO: 434354 - DNA, 16 bp, M. musculus
tcctgggattacaggt

SEQ ID NO: 434355 - DNA, 16 bp, M. musculus
tcctgggatttttttt

SEQ ID NO: 434356 - DNA, 16 bp, M. musculus
tcctgggcacctggct

SEQ ID NO: 434357 - DNA, 16 bp, M. musculus
tcctgggcagaagtca

SEQ ID NO: 434358 - DNA, 16 bp, M. musculus
tcctgggcagagttgg

SEQ ID NO: 434359 - DNA, 16 bp, M. musculus
tcctgggcagccaggg

SEQ ID NO: 434360 - DNA, 17 bp, M. musculus
tcctgggcatataccca

SEQ ID NO: 434361 - DNA, 22 bp, M. musculus
tcctgggcatatatccagaagg

SEQ ID NO: 434362 - DNA, 16 bp, M. musculus
tcctgggcatcaaact

SEQ ID NO: 434363 - DNA, 16 bp, M. musculus
tcctgggctcctgggc

SEQ ID NO: 434364 - DNA, 16 bp, M. musculus
tcctgggctttctttt

SEQ ID NO: 434365 - DNA, 16 bp, M. musculus
tcctgggctttgtttt

SEQ ID NO: 434366 - DNA, 16 bp, M. musculus
tcctgggcttttcttt

SEQ ID NO: 434367 - DNA, 16 bp, M. musculus
tcctgggcttttttat

SEQ ID NO: 434368 - DNA, 16 bp, M. musculus
tcctggggctggtgag

SEQ ID NO: 434369 - DNA, 16 bp, M. musculus
tcctggggtcagagcc

SEQ ID NO: 434370 - DNA, 16 bp, M. musculus
tcctggggtgtgtgtg

SEQ ID NO: 434371 - DNA, 16 bp, M. musculus
tcctgggtcctctgca

SEQ ID NO: 434372 - DNA, 16 bp, M. musculus
tcctgggtcttgctct

SEQ ID NO: 434373 - DNA, 16 bp, M. musculus
tcctgggttactttgt

SEQ ID NO: 434374 - DNA, 16 bp, M. musculus
tcctgggttcagtcct

SEQ ID NO: 434375 - DNA, 16 bp, M. musculus
tcctgggtttcctgga

SEQ ID NO: 434376 - DNA, 16 bp, M. musculus
tcctgggtttgatcct

SEQ ID NO: 434377 - DNA, 19 bp, M. musculus
tcctggtactcctacaaag

SEQ ID NO: 434378 - DNA, 16 bp, M. musculus
tcctggtactccttta

SEQ ID NO: 434379 - DNA, 16 bp, M. musculus
tcctggtatttttgtt

SEQ ID NO: 434380 - DNA, 16 bp, M. musculus
tcctggtcaccccttc

SEQ ID NO: 434381 - DNA, 16 bp, M. musculus
tcctggtcctcctgct

SEQ ID NO: 434382 - DNA, 17 bp, M. musculus
tcctggtctacatagtg

SEQ ID NO: 434383 - DNA, 16 bp, M. musculus
tcctggtcttcctgcc

SEQ ID NO: 434384 - DNA, 16 bp, M. musculus
tcctggtgcccacaga

SEQ ID NO: 434385 - DNA, 16 bp, M. musculus
tcctggtgctggtatt

SEQ ID NO: 434386 - DNA, 16 bp, M. musculus
tcctggtgtgaccaag

SEQ ID NO: 434387 - DNA, 16 bp, M. musculus
tcctggtgttcctgct

SEQ ID NO: 434388 - DNA, 16 bp, M. musculus
tcctggtttcccatct

SEQ ID NO: 434389 - DNA, 16 bp, M. musculus
tcctggtttccctgga

SEQ ID NO: 434390 - DNA, 16 bp, M. musculus
tcctggtttggatgat

SEQ ID NO: 434391 - DNA, 16 bp, M. musculus
tcctgtaagtaacccc

SEQ ID NO: 434392 - DNA, 16 bp, M. musculus
tcctgtaccaatgagt

SEQ ID NO: 434393 - DNA, 16 bp, M. musculus
tcctgtagagttccta

SEQ ID NO: 434394 - DNA, 16 bp, M. musculus
tcctgtagctctttaa

SEQ ID NO: 434395 - DNA, 16 bp, M. musculus
tcctgtaggcagcaga

SEQ ID NO: 434396 - DNA, 16 bp, M. musculus
tcctgtatgaaagaat

SEQ ID NO: 434397 - DNA, 16 bp, M. musculus
tcctgtatgtgtgtgt

SEQ ID NO: 434398 - DNA, 16 bp, M. musculus
tcctgtcaaggtctca

SEQ ID NO: 434399 - DNA, 16 bp, M. musculus
tcctgtcactgtgaca

SEQ ID NO: 434400 - DNA, 16 bp, M. musculus
tcctgtcagcaggctc

SEQ ID NO: 434401 - DNA, 16 bp, M. musculus
tcctgtccaatcacag

SEQ ID NO: 434402 - DNA, 16 bp, M. musculus
tcctgtccacaagcac

SEQ ID NO: 434403 - DNA, 16 bp, M. musculus
tcctgtccccacccca

SEQ ID NO: 434404 - DNA, 16 bp, M. musculus
tcctgtccccacctcc

SEQ ID NO: 434405 - DNA, 16 bp, M. musculus
tcctgtcctgactttc

SEQ ID NO: 434406 - DNA, 16 bp, M. musculus
tcctgtcctgcttgag

SEQ ID NO: 434407 - DNA, 16 bp, M. musculus
tcctgtcctgtcctgt

SEQ ID NO: 434408 - DNA, 16 bp, M. musculus
tcctgtcctgtccttt

SEQ ID NO: 434409 - DNA, 16 bp, M. musculus
tcctgtccttcctgtg

SEQ ID NO: 434410 - DNA, 16 bp, M. musculus
tcctgtctaaaggaaa

SEQ ID NO: 434411 - DNA, 16 bp, M. musculus
tcctgtctacaagaaa

SEQ ID NO: 434412 - DNA, 16 bp, M. musculus
tcctgtctcagagaga

SEQ ID NO: 434413 - DNA, 16 bp, M. musculus
tcctgtctcagcctcc

SEQ ID NO: 434414 - DNA, 16 bp, M. musculus
tcctgtctcaggctcc

SEQ ID NO: 434415 - DNA, 16 bp, M. musculus
tcctgtctccactccc

SEQ ID NO: 434416 - DNA, 16 bp, M. musculus
tcctgtctccatctcc

SEQ ID NO: 434417 - DNA, 16 bp, M. musculus
tcctgtctcctgtctt

SEQ ID NO: 434418 - DNA, 16 bp, M. musculus
tcctgtctcgaaaaac

SEQ ID NO: 434419 - DNA, 16 bp, M. musculus
tcctgtctctccccat

SEQ ID NO: 434420 - DNA, 16 bp, M. musculus
tcctgtctctgcatct

SEQ ID NO: 434421 - DNA, 17 bp, M. musculus
tcctgtctgaaagaact

SEQ ID NO: 434422 - DNA, 16 bp, M. musculus
tcctgtctgaaagcat

SEQ ID NO: 434423 - DNA, 16 bp, M. musculus
tcctgtctgaaggaac

SEQ ID NO: 434424 - DNA, 16 bp, M. musculus
tcctgtctggctacag

SEQ ID NO: 434425 - DNA, 16 bp, M. musculus
tcctgtcttcattttc

SEQ ID NO: 434426 - DNA, 16 bp, M. musculus
tcctgtcttgatgata

SEQ ID NO: 434427 - DNA, 16 bp, M. musculus
tcctgtcttggcttct

SEQ ID NO: 434428 - DNA, 16 bp, M. musculus
tcctgtctttaaaaaa

SEQ ID NO: 434429 - DNA, 16 bp, M. musculus
tcctgtctttaaaaat

SEQ ID NO: 434430 - DNA, 16 bp, M. musculus
tcctgtctttgcctct

SEQ ID NO: 434431 - DNA, 16 bp, M. musculus
tcctgtgaagggctgg

SEQ ID NO: 434432 - DNA, 16 bp, M. musculus
tcctgtgacctctaca

SEQ ID NO: 434433 - DNA, 16 bp, M. musculus
tcctgtgaccttcaca

SEQ ID NO: 434434 - DNA, 16 bp, M. musculus
tcctgtgatcctgggt

SEQ ID NO: 434435 - DNA, 16 bp, M. musculus
tcctgtgatttttgtt

SEQ ID NO: 434436 - DNA, 16 bp, M. musculus
tcctgtgccacagagc

SEQ ID NO: 434437 - DNA, 16 bp, M. musculus
tcctgtgccctgtgtg

SEQ ID NO: 434438 - DNA, 16 bp, M. musculus
tcctgtgctccagtca

SEQ ID NO: 434439 - DNA, 16 bp, M. musculus
tcctgtgctgaggaca

SEQ ID NO: 434440 - DNA, 16 bp, M. musculus
tcctgtgctgtgctgt

SEQ ID NO: 434441 - DNA, 16 bp, M. musculus
tcctgtggagcaggcc

SEQ ID NO: 434442 - DNA, 16 bp, M. musculus
tcctgtggagctggag

SEQ ID NO: 434443 - DNA, 16 bp, M. musculus
tcctgtggaggaggaa

SEQ ID NO: 434444 - DNA, 16 bp, M. musculus
tcctgtggaggctcca

SEQ ID NO: 434445 - DNA, 16 bp, M. musculus
tcctgtggaggctgga

SEQ ID NO: 434446 - DNA, 16 bp, M. musculus
tcctgtggaggctgtg

SEQ ID NO: 434447 - DNA, 16 bp, M. musculus
tcctgtggctggtccc

SEQ ID NO: 434448 - DNA, 16 bp, M. musculus
tcctgtggcttcttgc

SEQ ID NO: 434449 - DNA, 16 bp, M. musculus
tcctgtgggctctggg

SEQ ID NO: 434450 - DNA, 16 bp, M. musculus
tcctgtgggtgctggg

SEQ ID NO: 434451 - DNA, 16 bp, M. musculus
tcctgtggtcctgggt

SEQ ID NO: 434452 - DNA, 16 bp, M. musculus
tcctgtggtgatttcc

SEQ ID NO: 434453 - DNA, 16 bp, M. musculus
tcctgtgtagcttgtt

SEQ ID NO: 434454 - DNA, 16 bp, M. musculus
tcctgtgtctgcctcc

SEQ ID NO: 434455 - DNA, 16 bp, M. musculus
tcctgtgtctgtgtgt

SEQ ID NO: 434456 - DNA, 16 bp, M. musculus
tcctgtgtggaccctt

SEQ ID NO: 434457 - DNA, 17 bp, M. musculus
tcctgtgtgggtccttg

SEQ ID NO: 434458 - DNA, 16 bp, M. musculus
tcctgtgttttcttga

SEQ ID NO: 434459 - DNA, 16 bp, M. musculus
tcctgttatctttgtt

SEQ ID NO: 434460 - DNA, 16 bp, M. musculus
tcctgttatttctgtt

SEQ ID NO: 434461 - DNA, 16 bp, M. musculus
tcctgttcccatcccc

SEQ ID NO: 434462 - DNA, 16 bp, M. musculus
tcctgttcctgctgcc

SEQ ID NO: 434463 - DNA, 16 bp, M. musculus
tcctgttcctgctgct

SEQ ID NO: 434464 - DNA, 16 bp, M. musculus
tcctgttcctgctggc

SEQ ID NO: 434465 - DNA, 16 bp, M. musculus
tcctgttcctgttcct

SEQ ID NO: 434466 - DNA, 16 bp, M. musculus
tcctgttccttcccca

SEQ ID NO: 434467 - DNA, 16 bp, M. musculus
tcctgttgcagctaca

SEQ ID NO: 434468 - DNA, 16 bp, M. musculus
tcctgttgctgctgct

SEQ ID NO: 434469 - DNA, 116 bp, M. musculus
tcctgtttatattactcatgttagagcccattcaggcctacctggccccatggctctgggaaatgatttggcagataaggccactaaagtggtggctgctgccctatcatccccgg

SEQ ID NO: 434470 - DNA, 16 bp, M. musculus
tcctgtttatgattaa

SEQ ID NO: 434471 - DNA, 16 bp, M. musculus
tcctgtttcaaaaaag

SEQ ID NO: 434472 - DNA, 16 bp, M. musculus
tcctgtttcagcctcc

SEQ ID NO: 434473 - DNA, 16 bp, M. musculus
tcctgtttcagcctct

SEQ ID NO: 434474 - DNA, 16 bp, M. musculus
tcctgtttgtgcagcc

SEQ ID NO: 434475 - DNA, 16 bp, M. musculus
tcctgttttagaacca

SEQ ID NO: 434476 - DNA, 16 bp, M. musculus
tccttaaatagaccac

SEQ ID NO: 434477 - DNA, 16 bp, M. musculus
tccttaaccactgagc

SEQ ID NO: 434478 - DNA, 16 bp, M. musculus
tccttaactcaccttc

SEQ ID NO: 434479 - DNA, 16 bp, M. musculus
tccttaatcaagaaaa

SEQ ID NO: 434480 - DNA, 16 bp, M. musculus
tccttacagagcaaca

SEQ ID NO: 434481 - DNA, 16 bp, M. musculus
tccttacagcacacag

SEQ ID NO: 434482 - DNA, 16 bp, M. musculus
tccttacccactgctg

SEQ ID NO: 434483 - DNA, 16 bp, M. musculus
tccttagaagtgagaa

SEQ ID NO: 434484 - DNA, 16 bp, M. musculus
tccttagaatggagaa

SEQ ID NO: 434485 - DNA, 16 bp, M. musculus
tccttaggcaaatgga

SEQ ID NO: 434486 - DNA, 16 bp, M. musculus
tccttaggtggggcag

SEQ ID NO: 434487 - DNA, 16 bp, M. musculus
tccttagtcctatgaa

SEQ ID NO: 434488 - DNA, 16 bp, M. musculus
tccttataagacttgc

SEQ ID NO: 434489 - DNA, 16 bp, M. musculus
tccttatcaggaattc

SEQ ID NO: 434490 - DNA, 16 bp, M. musculus
tccttatgggatatgg

SEQ ID NO: 434491 - DNA, 16 bp, M. musculus
tccttatgttttttga

SEQ ID NO: 434492 - DNA, 16 bp, M. musculus
tccttattaacaaaat

SEQ ID NO: 434493 - DNA, 16 bp, M. musculus
tccttcaagaaggaaa

SEQ ID NO: 434494 - DNA, 16 bp, M. musculus
tccttcaatctttcct

SEQ ID NO: 434495 - DNA, 16 bp, M. musculus
tccttcacaagtctgc

SEQ ID NO: 434496 - DNA, 16 bp, M. musculus
tccttcacatgtttgc

SEQ ID NO: 434497 - DNA, 16 bp, M. musculus
tccttcacctgtgtct

SEQ ID NO: 434498 - DNA, 16 bp, M. musculus
tccttcaccttacaga

SEQ ID NO: 434499 - DNA, 16 bp, M. musculus
tccttcagcaaggctc

SEQ ID NO: 434500 - DNA, 16 bp, M. musculus
tccttcagcctctgct

SEQ ID NO: 434501 - DNA, 16 bp, M. musculus
tccttcagtccttctt

SEQ ID NO: 434502 - DNA, 16 bp, M. musculus
tccttcagtccttttc

SEQ ID NO: 434503 - DNA, 16 bp, M. musculus
tccttcagtctctgct

SEQ ID NO: 434504 - DNA, 16 bp, M. musculus
tccttcagtctctgtt

SEQ ID NO: 434505 - DNA, 16 bp, M. musculus
tccttcagtgtcttct

SEQ ID NO: 434506 - DNA, 16 bp, M. musculus
tccttcagttcttctc

SEQ ID NO: 434507 - DNA, 16 bp, M. musculus
tccttcatcccctctg

SEQ ID NO: 434508 - DNA, 16 bp, M. musculus
tccttcattctcttgg

SEQ ID NO: 434509 - DNA, 16 bp, M. musculus
tccttcattcttgtct

SEQ ID NO: 434510 - DNA, 16 bp, M. musculus
tccttcattgctggta

SEQ ID NO: 434511 - DNA, 16 bp, M. musculus
tccttcattgtggacc

SEQ ID NO: 434512 - DNA, 16 bp, M. musculus
tccttcattgttggtg

SEQ ID NO: 434513 - DNA, 16 bp, M. musculus
tccttccaaactctcc

SEQ ID NO: 434514 - DNA, 16 bp, M. musculus
tccttccacaaaaggc

SEQ ID NO: 434515 - DNA, 16 bp, M. musculus
tccttccaccatgtgg

SEQ ID NO: 434516 - DNA, 16 bp, M. musculus
tccttccagctcctcc

SEQ ID NO: 434517 - DNA, 16 bp, M. musculus
tccttccatccatcct

SEQ ID NO: 434518 - DNA, 16 bp, M. musculus
tccttccatggatgtt

SEQ ID NO: 434519 - DNA, 17 bp, M. musculus
tccttccatggctattt

SEQ ID NO: 434520 - DNA, 16 bp, M. musculus
tccttccatggttgtt

SEQ ID NO: 434521 - DNA, 16 bp, M. musculus
tccttcccaacttgtt

SEQ ID NO: 434522 - DNA, 16 bp, M. musculus
tccttcccaagctgct

SEQ ID NO: 434523 - DNA, 16 bp, M. musculus
tccttcccaccccctg

SEQ ID NO: 434524 - DNA, 16 bp, M. musculus
tccttcccagaattcc

SEQ ID NO: 434525 - DNA, 16 bp, M. musculus
tccttccccagcacca

SEQ ID NO: 434526 - DNA, 16 bp, M. musculus
tccttccccagcccca

SEQ ID NO: 434527 - DNA, 16 bp, M. musculus
tccttcccccagctct

SEQ ID NO: 434528 - DNA, 16 bp, M. musculus
tccttcccctagctct

SEQ ID NO: 434529 - DNA, 16 bp, M. musculus
tccttccctaattcaa

SEQ ID NO: 434530 - DNA, 16 bp, M. musculus
tccttcctcagtccct

SEQ ID NO: 434531 - DNA, 16 bp, M. musculus
tccttcctgcctgcct

SEQ ID NO: 434532 - DNA, 16 bp, M. musculus
tccttcctggctacag

SEQ ID NO: 434533 - DNA, 16 bp, M. musculus
tccttcctgtcctcca

SEQ ID NO: 434534 - DNA, 16 bp, M. musculus
tccttcctgtctgtct

SEQ ID NO: 434535 - DNA, 16 bp, M. musculus
tccttcctgttgctgt

SEQ ID NO: 434536 - DNA, 16 bp, M. musculus
tccttcctgtttccat

SEQ ID NO: 434537 - DNA, 16 bp, M. musculus
tccttccttcagtttc

SEQ ID NO: 434538 - DNA, 16 bp, M. musculus
tccttccttgcctgcc

SEQ ID NO: 434539 - DNA, 17 bp, M. musculus
tccttccttgggtgttt

SEQ ID NO: 434540 - DNA, 16 bp, M. musculus
tccttcggtcctttct

SEQ ID NO: 434541 - DNA, 16 bp, M. musculus
tccttctacaaaaggc

SEQ ID NO: 434542 - DNA, 16 bp, M. musculus
tccttctacaaactaa

SEQ ID NO: 434543 - DNA, 16 bp, M. musculus
tccttctacctcagcc

SEQ ID NO: 434544 - DNA, 16 bp, M. musculus
tccttctagctccacc

SEQ ID NO: 434545 - DNA, 16 bp, M. musculus
tccttctcaagttgct

SEQ ID NO: 434546 - DNA, 16 bp, M. musculus
tccttctccaccacca

SEQ ID NO: 434547 - DNA, 16 bp, M. musculus
tccttctccagcagca

SEQ ID NO: 434548 - DNA, 16 bp, M. musculus
tccttctctctaccaa

SEQ ID NO: 434549 - DNA, 16 bp, M. musculus
tccttctgccatgtgg

SEQ ID NO: 434550 - DNA, 16 bp, M. musculus
tccttctgcctcagcc

SEQ ID NO: 434551 - DNA, 16 bp, M. musculus
tccttctgcctcagct

SEQ ID NO: 434552 - DNA, 16 bp, M. musculus
tccttctgcctccact

SEQ ID NO: 434553 - DNA, 16 bp, M. musculus
tccttctgccttccat

SEQ ID NO: 434554 - DNA, 16 bp, M. musculus
tccttctgctctctgc

SEQ ID NO: 434555 - DNA, 16 bp, M. musculus
tccttctgctgctgct

SEQ ID NO: 434556 - DNA, 16 bp, M. musculus
tccttctgtctcagct

SEQ ID NO: 434557 - DNA, 16 bp, M. musculus
tccttctgtctctgct

SEQ ID NO: 434558 - DNA, 16 bp, M. musculus
tccttctgtgtgtgtg

SEQ ID NO: 434559 - DNA, 16 bp, M. musculus
tccttctgttcccagg

SEQ ID NO: 434560 - DNA, 16 bp, M. musculus
tccttcttaaagtcct

SEQ ID NO: 434561 - DNA, 16 bp, M. musculus
tccttcttaaagttct

SEQ ID NO: 434562 - DNA, 16 bp, M. musculus
tccttcttcagcctcc

SEQ ID NO: 434563 - DNA, 16 bp, M. musculus
tccttcttcatcatgc

SEQ ID NO: 434564 - DNA, 16 bp, M. musculus
tccttcttcatgtcct

SEQ ID NO: 434565 - DNA, 16 bp, M. musculus
tccttcttccaatgcc

SEQ ID NO: 434566 - DNA, 16 bp, M. musculus
tccttcttcccagata

SEQ ID NO: 434567 - DNA, 16 bp, M. musculus
tccttcttcctagatg

SEQ ID NO: 434568 - DNA, 16 bp, M. musculus
tccttcttgatgtcct

SEQ ID NO: 434569 - DNA, 17 bp, M. musculus
tccttcttgccagttgg

SEQ ID NO: 434570 - DNA, 16 bp, M. musculus
tccttcttgtctatac

SEQ ID NO: 434571 - DNA, 16 bp, M. musculus
tccttcttgttaagct

SEQ ID NO: 434572 - DNA, 16 bp, M. musculus
tccttctttgttgggt

SEQ ID NO: 434573 - DNA, 16 bp, M. musculus
tccttgacagcatctg

SEQ ID NO: 434574 - DNA, 16 bp, M. musculus
tccttgagaagagatt

SEQ ID NO: 434575 - DNA, 16 bp, M. musculus
tccttgagaggagggt

SEQ ID NO: 434576 - DNA, 16 bp, M. musculus
tccttgatgaaggaga

SEQ ID NO: 434577 - DNA, 16 bp, M. musculus
tccttgatggataaga

SEQ ID NO: 434578 - DNA, 16 bp, M. musculus
tccttgcagcttttaa

SEQ ID NO: 434579 - DNA, 16 bp, M. musculus
tccttgcaggtgtccg

SEQ ID NO: 434580 - DNA, 16 bp, M. musculus
tccttgccagcatcag

SEQ ID NO: 434581 - DNA, 16 bp, M. musculus
tccttgccagcatctc

SEQ ID NO: 434582 - DNA, 16 bp, M. musculus
tccttgccagcatttg

SEQ ID NO: 434583 - DNA, 16 bp, M. musculus
tccttgcctcaggcca

SEQ ID NO: 434584 - DNA, 16 bp, M. musculus
tccttgcctgcacacc

SEQ ID NO: 434585 - DNA, 16 bp, M. musculus
tccttgccttccacct

SEQ ID NO: 434586 - DNA, 16 bp, M. musculus
tccttgccttccatct

SEQ ID NO: 434587 - DNA, 16 bp, M. musculus
tccttgccttctacct

SEQ ID NO: 434588 - DNA, 22 bp, M. musculus
tccttgcgccagtcccgagttt

SEQ ID NO: 434589 - DNA, 16 bp, M. musculus
tccttggagcctggaa

SEQ ID NO: 434590 - DNA, 16 bp, M. musculus
tccttggagtccagtt

SEQ ID NO: 434591 - DNA, 16 bp, M. musculus
tccttgggaagagttt

SEQ ID NO: 434592 - DNA, 16 bp, M. musculus
tccttgggaggttctg

SEQ ID NO: 434593 - DNA, 16 bp, M. musculus
tccttgggcctgggga

SEQ ID NO: 434594 - DNA, 16 bp, M. musculus
tccttggggccagtga

SEQ ID NO: 434595 - DNA, 16 bp, M. musculus
tccttggggtaatgat

SEQ ID NO: 434596 - DNA, 16 bp, M. musculus
tccttgggtaccaggc

SEQ ID NO: 434597 - DNA, 16 bp, M. musculus
tccttggtctctcagg

SEQ ID NO: 434598 - DNA, 16 bp, M. musculus
tccttggtctggtcca

SEQ ID NO: 434599 - DNA, 16 bp, M. musculus
tccttggtgtgctagg

SEQ ID NO: 434600 - DNA, 16 bp, M. musculus
tccttggttattttct

SEQ ID NO: 434601 - DNA, 16 bp, M. musculus
tccttgtatcttatca

SEQ ID NO: 434602 - DNA, 16 bp, M. musculus
tccttgtccaatcaca

SEQ ID NO: 434603 - DNA, 16 bp, M. musculus
tccttgtccttggcca

SEQ ID NO: 434604 - DNA, 16 bp, M. musculus
tccttgtctctgcctc

SEQ ID NO: 434605 - DNA, 20 bp, M. musculus
tccttgtgggtgggaccatc

SEQ ID NO: 434606 - DNA, 16 bp, M. musculus
tccttgtgggtggtgc

SEQ ID NO: 434607 - DNA, 16 bp, M. musculus
tccttgtggtgtggtg

SEQ ID NO: 434608 - DNA, 16 bp, M. musculus
tccttgtgtgtgtgtg

SEQ ID NO: 434609 - DNA, 16 bp, M. musculus
tccttgtgttgatgtt

SEQ ID NO: 434610 - DNA, 16 bp, M. musculus
tccttgttcctgctgt

SEQ ID NO: 434611 - DNA, 16 bp, M. musculus
tccttgttggaggaag

SEQ ID NO: 434612 - DNA, 16 bp, M. musculus
tccttgtttccacttg

SEQ ID NO: 434613 - DNA, 16 bp, M. musculus
tccttgttttatgttg

SEQ ID NO: 434614 - DNA, 16 bp, M. musculus
tcctttaaaaaaacaa

SEQ ID NO: 434615 - DNA, 16 bp, M. musculus
tcctttaaaaatattt

SEQ ID NO: 434616 - DNA, 16 bp, M. musculus
tcctttaaaaattatt

SEQ ID NO: 434617 - DNA, 17 bp, M. musculus
tcctttaaccggagaaa

SEQ ID NO: 434618 - DNA, 16 bp, M. musculus
tcctttaatctcagca

SEQ ID NO: 434619 - DNA, 16 bp, M. musculus
tcctttaatctctgct

SEQ ID NO: 434620 - DNA, 16 bp, M. musculus
tcctttactgtatgtg

SEQ ID NO: 434621 - DNA, 16 bp, M. musculus
tcctttagaagagttt

SEQ ID NO: 434622 - DNA, 16 bp, M. musculus
tcctttagctccttgg

SEQ ID NO: 434623 - DNA, 16 bp, M. musculus
tcctttagtctttgct

SEQ ID NO: 434624 - DNA, 16 bp, M. musculus
tcctttataagacttg

SEQ ID NO: 434625 - DNA, 16 bp, M. musculus
tcctttatatattttg

SEQ ID NO: 434626 - DNA, 16 bp, M. musculus
tcctttatcagagttg

SEQ ID NO: 434627 - DNA, 16 bp, M. musculus
tcctttattaaaaaaa

SEQ ID NO: 434628 - DNA, 16 bp, M. musculus
tcctttcaaaatctgt

SEQ ID NO: 434629 - DNA, 16 bp, M. musculus
tcctttcaaagcagaa

SEQ ID NO: 434630 - DNA, 17 bp, M. musculus
tcctttcaacaaaatct

SEQ ID NO: 434631 - DNA, 16 bp, M. musculus
tcctttcaagggtgtt

SEQ ID NO: 434632 - DNA, 16 bp, M. musculus
tcctttcacaatctgt

SEQ ID NO: 434633 - DNA, 16 bp, M. musculus
tcctttcactcacaca

SEQ ID NO: 434634 - DNA, 16 bp, M. musculus
tcctttcagaaaaaaa

SEQ ID NO: 434635 - DNA, 16 bp, M. musculus
tcctttcagccaaatc

SEQ ID NO: 434636 - DNA, 23 bp, M. musculus
tcctttcatggaagggagttgaa

SEQ ID NO: 434637 - DNA, 16 bp, M. musculus
tcctttccaaaggaaa

SEQ ID NO: 434638 - DNA, 16 bp, M. musculus
tcctttccctttccaa

SEQ ID NO: 434639 - DNA, 16 bp, M. musculus
tcctttccttccacca

SEQ ID NO: 434640 - DNA, 16 bp, M. musculus
tcctttcctttttaaa

SEQ ID NO: 434641 - DNA, 16 bp, M. musculus
tcctttctcaaaacaa

SEQ ID NO: 434642 - DNA, 23 bp, M. musculus
tcctttctctgtgataactccag

SEQ ID NO: 434643 - DNA, 16 bp, M. musculus
tcctttctgatgactc

SEQ ID NO: 434644 - DNA, 16 bp, M. musculus
tcctttctgtaactcc

SEQ ID NO: 434645 - DNA, 16 bp, M. musculus
tcctttcttcagtctc

SEQ ID NO: 434646 - DNA, 17 bp, M. musculus
tcctttctttgaactgt

SEQ ID NO: 434647 - DNA, 17 bp, M. musculus
tcctttctttgtgataa

SEQ ID NO: 434648 - DNA, 16 bp, M. musculus
tcctttgaaagaaaag

SEQ ID NO: 434649 - DNA, 17 bp, M. musculus
tcctttgaagggctgaa

SEQ ID NO: 434650 - DNA, 16 bp, M. musculus
tcctttgaaggtctgg

SEQ ID NO: 434651 - DNA, 16 bp, M. musculus
tcctttgacttacaga

SEQ ID NO: 434652 - DNA, 16 bp, M. musculus
tcctttgaggagagaa

SEQ ID NO: 434653 - DNA, 16 bp, M. musculus
tcctttgagtatatac

SEQ ID NO: 434654 - DNA, 16 bp, M. musculus
tcctttgatatttgtt

SEQ ID NO: 434655 - DNA, 16 bp, M. musculus
tcctttgcttctgaga

SEQ ID NO: 434656 - DNA, 16 bp, M. musculus
tcctttggaagatcag

SEQ ID NO: 434657 - DNA, 16 bp, M. musculus
tcctttggcttacaga

SEQ ID NO: 434658 - DNA, 16 bp, M. musculus
tcctttggcttccaca

SEQ ID NO: 434659 - DNA, 16 bp, M. musculus
tcctttgggtatgtgc

SEQ ID NO: 434660 - DNA, 16 bp, M. musculus
tcctttgtacaaatga

SEQ ID NO: 434661 - DNA, 16 bp, M. musculus
tcctttgtgactgagt

SEQ ID NO: 434662 - DNA, 16 bp, M. musculus
tccttttaaaagataa

SEQ ID NO: 434663 - DNA, 16 bp, M. musculus
tccttttcatttctaa

SEQ ID NO: 434664 - DNA, 16 bp, M. musculus
tccttttcctctggct

SEQ ID NO: 434665 - DNA, 16 bp, M. musculus
tccttttccttcctgg

SEQ ID NO: 434666 - DNA, 16 bp, M. musculus
tccttttctctcagct

SEQ ID NO: 434667 - DNA, 16 bp, M. musculus
tccttttctctgagat

SEQ ID NO: 434668 - DNA, 16 bp, M. musculus
tccttttctctttaaa

SEQ ID NO: 434669 - DNA, 16 bp, M. musculus
tccttttctgaagaga

SEQ ID NO: 434670 - DNA, 16 bp, M. musculus
tccttttcttctagag

SEQ ID NO: 434671 - DNA, 16 bp, M. musculus
tccttttctttcataa

SEQ ID NO: 434672 - DNA, 16 bp, M. musculus
tccttttggatctggg

SEQ ID NO: 434673 - DNA, 16 bp, M. musculus
tccttttgggattggg

SEQ ID NO: 434674 - DNA, 16 bp, M. musculus
tccttttgggtgtatt

SEQ ID NO: 434675 - DNA, 16 bp, M. musculus
tcctttttaaaaaaat

SEQ ID NO: 434676 - DNA, 16 bp, M. musculus
tcctttttaaaatcct

SEQ ID NO: 434677 - DNA, 16 bp, M. musculus
tcctttttctggacag

SEQ ID NO: 434678 - DNA, 16 bp, M. musculus
tcctttttctgtggta

SEQ ID NO: 434679 - DNA, 16 bp, M. musculus
tccttttttaaaaaat

SEQ ID NO: 434680 - DNA, 16 bp, M. musculus
tccttttttccattgt

SEQ ID NO: 434681 - DNA, 16 bp, M. musculus
tccttttttgtctaat

SEQ ID NO: 434682 - DNA, 16 bp, M. musculus
tcctttttttaaaaaa

SEQ ID NO: 434683 - DNA, 16 bp, M. musculus
tcctttttttctagat

SEQ ID NO: 434684 - DNA, 16 bp, M. musculus
tcgaaagaacccagat

SEQ ID NO: 434685 - DNA, 16 bp, M. musculus
tcgaacccacagagat

SEQ ID NO: 434686 - DNA, 17 bp, M. musculus
tcgaactcagagatcct

SEQ ID NO: 434687 - DNA, 16 bp, M. musculus
tcgaactcagagatct

SEQ ID NO: 434688 - DNA, 16 bp, M. musculus
tcgacagaggaatgga

SEQ ID NO: 434689 - DNA, 16 bp, M. musculus
tcgacccagagctccg

SEQ ID NO: 434690 - DNA, 16 bp, M. musculus
tcgagaccagcctggg

SEQ ID NO: 434691 - DNA, 16 bp, M. musculus
tcgagcccagcctggt

SEQ ID NO: 434692 - DNA, 16 bp, M. musculus
tcgagccccgggcttc

SEQ ID NO: 434693 - DNA, 16 bp, M. musculus
tcgagctgccgctgct

SEQ ID NO: 434694 - DNA, 16 bp, M. musculus
tcgagcttctgggcta

SEQ ID NO: 434695 - DNA, 16 bp, M. musculus
tcgaggagctggttct

SEQ ID NO: 434696 - DNA, 16 bp, M. musculus
tcgaggaggaggagga

SEQ ID NO: 434697 - DNA, 16 bp, M. musculus
tcgaggcaggaacctg

SEQ ID NO: 434698 - DNA, 16 bp, M. musculus
tcgattttgtggaata

SEQ ID NO: 434699 - DNA, 16 bp, M. musculus
tcgcagcattgggaag

SEQ ID NO: 434700 - DNA, 17 bp, M. musculus
tcgcattcttctccatg

SEQ ID NO: 434701 - DNA, 16 bp, M. musculus
tcgcccaacacctgca

SEQ ID NO: 434702 - DNA, 17 bp, M. musculus
tcgcccgtcccagaaac

SEQ ID NO: 434703 - DNA, 16 bp, M. musculus
tcgcctgtcccagaaa

SEQ ID NO: 434704 - DNA, 18 bp, M. musculus
tcgctatgtagaccaggc

SEQ ID NO: 434705 - DNA, 16 bp, M. musculus
tcgctccagcccaaag

SEQ ID NO: 434706 - DNA, 16 bp, M. musculus
tcgctgtcctggaact

SEQ ID NO: 434707 - DNA, 16 bp, M. musculus
tcgctgtggtgggaga

SEQ ID NO: 434708 - DNA, 16 bp, M. musculus
tcggagctcttgtctc

SEQ ID NO: 434709 - DNA, 26 bp, M. musculus
tcggaggactggcgcgccgagtgtgg

SEQ ID NO: 434710 - DNA, 16 bp, M. musculus
tcggccaccttcctgg

SEQ ID NO: 434711 - DNA, 17 bp, M. musculus
tcggccgatgggctgca

SEQ ID NO: 434712 - DNA, 16 bp, M. musculus
tcggctcttttatttt

SEQ ID NO: 434713 - DNA, 16 bp, M. musculus
tcgggagactctgctg

SEQ ID NO: 434714 - DNA, 16 bp, M. musculus
tcgggaggctgaggca

SEQ ID NO: 434715 - DNA, 16 bp, M. musculus
tcgggggaaaaaaaaa

SEQ ID NO: 434716 - DNA, 16 bp, M. musculus
tcgggggagaggccca

SEQ ID NO: 434717 - DNA, 16 bp, M. musculus
tcggtcctgaggcagc

SEQ ID NO: 434718 - DNA, 20 bp, M. musculus
tcggtgctcttaaccgctga

SEQ ID NO: 434719 - DNA, 16 bp, M. musculus
tcggtgctcttaactg

SEQ ID NO: 434720 - DNA, 16 bp, M. musculus
tcggtttgcaagaatt

SEQ ID NO: 434721 - DNA, 16 bp, M. musculus
tcgtcatcatcatcat

SEQ ID NO: 434722 - DNA, 16 bp, M. musculus
tcgtcatcgtcgtcat

SEQ ID NO: 434723 - DNA, 16 bp, M. musculus
tcgtcctttctgttca

SEQ ID NO: 434724 - DNA, 16 bp, M. musculus
tcgtcgtcatcatcat

SEQ ID NO: 434725 - DNA, 16 bp, M. musculus
tcgtcgtcgtcgtcat

SEQ ID NO: 434726 - DNA, 16 bp, M. musculus
tcgtcgtcgtcgtcgt

SEQ ID NO: 434727 - DNA, 16 bp, M. musculus
tcgtctcagctccaat

SEQ ID NO: 434728 - DNA, 16 bp, M. musculus
tcgtgacccctttggg

SEQ ID NO: 434729 - DNA, 16 bp, M. musculus
tcgtgctgcagctgga

SEQ ID NO: 434730 - DNA, 16 bp, M. musculus
tcgtggggctggagag

SEQ ID NO: 434731 - DNA, 16 bp, M. musculus
tcgttccatcttctga

SEQ ID NO: 434732 - DNA, 16 bp, M. musculus
tctaaaaaccctaaaa

SEQ ID NO: 434733 - DNA, 16 bp, M. musculus
tctaaaaagatgtttt

SEQ ID NO: 434734 - DNA, 16 bp, M. musculus
tctaaaaatatgtttt

SEQ ID NO: 434735 - DNA, 16 bp, M. musculus
tctaaaaatggaagca

SEQ ID NO: 434736 - DNA, 16 bp, M. musculus
tctaaaacaaaaggat

SEQ ID NO: 434737 - DNA, 16 bp, M. musculus
tctaaaactgaccaca

SEQ ID NO: 434738 - DNA, 16 bp, M. musculus
tctaaaagaaatggaa

SEQ ID NO: 434739 - DNA, 16 bp, M. musculus
tctaaaagctctaaaa

SEQ ID NO: 434740 - DNA, 16 bp, M. musculus
tctaaaagctctctgg

SEQ ID NO: 434741 - DNA, 16 bp, M. musculus
tctaaaagtaattctt

SEQ ID NO: 434742 - DNA, 16 bp, M. musculus
tctaaacaaggtcata

SEQ ID NO: 434743 - DNA, 16 bp, M. musculus
tctaaaccccattttt

SEQ ID NO: 434744 - DNA, 18 bp, M. musculus
tctaaagaatgagatgca

SEQ ID NO: 434745 - DNA, 16 bp, M. musculus
tctaaagacagctaca

SEQ ID NO: 434746 - DNA, 16 bp, M. musculus
tctaaagagaaaagaa

SEQ ID NO: 434747 - DNA, 16 bp, M. musculus
tctaaagagcaagttc

SEQ ID NO: 434748 - DNA, 16 bp, M. musculus
tctaaagccctcttct

SEQ ID NO: 434749 - DNA, 16 bp, M. musculus
tctaaatagtctttaa

SEQ ID NO: 434750 - DNA, 16 bp, M. musculus
tctaaatccagtcaag

SEQ ID NO: 434751 - DNA, 16 bp, M. musculus
tctaaattttccagtt

SEQ ID NO: 434752 - DNA, 16 bp, M. musculus
tctaacacacctgaaa

SEQ ID NO: 434753 - DNA, 16 bp, M. musculus
tctaacacatccagga

SEQ ID NO: 434754 - DNA, 16 bp, M. musculus
tctaacacttattttt

SEQ ID NO: 434755 - DNA, 16 bp, M. musculus
tctaactcctcaattg

SEQ ID NO: 434756 - DNA, 16 bp, M. musculus
tctaactccttgagtt

SEQ ID NO: 434757 - DNA, 16 bp, M. musculus
tctaactgctgagcca

SEQ ID NO: 434758 - DNA, 16 bp, M. musculus
tctaagaaaagaaaag

SEQ ID NO: 434759 - DNA, 16 bp, M. musculus
tctaagaaagaaagaa

SEQ ID NO: 434760 - DNA, 16 bp, M. musculus
tctaagaaagcaggct

SEQ ID NO: 434761 - DNA, 16 bp, M. musculus
tctaagaaataaaaat

SEQ ID NO: 434762 - DNA, 16 bp, M. musculus
tctaagaagaatcaaa

SEQ ID NO: 434763 - DNA, 16 bp, M. musculus
tctaagaaggactgaa

SEQ ID NO: 434764 - DNA, 16 bp, M. musculus
tctaagaaggggcaaa

SEQ ID NO: 434765 - DNA, 16 bp, M. musculus
tctaagaaggggcaag

SEQ ID NO: 434766 - DNA, 16 bp, M. musculus
tctaagaataataggt

SEQ ID NO: 434767 - DNA, 16 bp, M. musculus
tctaagaatctcctgt

SEQ ID NO: 434768 - DNA, 16 bp, M. musculus
tctaagcagagaattc

SEQ ID NO: 434769 - DNA, 16 bp, M. musculus
tctaaggcaaaggaca

SEQ ID NO: 434770 - DNA, 16 bp, M. musculus
tctaagggcagtgtga

SEQ ID NO: 434771 - DNA, 16 bp, M. musculus
tctaaggggaaaaaaa

SEQ ID NO: 434772 - DNA, 16 bp, M. musculus
tctaagtctttttcag

SEQ ID NO: 434773 - DNA, 16 bp, M. musculus
tctaagttggaggcca

SEQ ID NO: 434774 - DNA, 16 bp, M. musculus
tctaataaaaaaagac

SEQ ID NO: 434775 - DNA, 16 bp, M. musculus
tctaataaaaagaaat

SEQ ID NO: 434776 - DNA, 16 bp, M. musculus
tctaataaaaataatg

SEQ ID NO: 434777 - DNA, 16 bp, M. musculus
tctaataaaaatattc

SEQ ID NO: 434778 - DNA, 16 bp, M. musculus
tctaataaaaatgaaa

SEQ ID NO: 434779 - DNA, 16 bp, M. musculus
tctaataaaaattttg

SEQ ID NO: 434780 - DNA, 16 bp, M. musculus
tctaataaaattgttt

SEQ ID NO: 434781 - DNA, 16 bp, M. musculus
tctaataaagcagaag

SEQ ID NO: 434782 - DNA, 16 bp, M. musculus
tctaatatcagataaa

SEQ ID NO: 434783 - DNA, 16 bp, M. musculus
tctaatatgatgtttg

SEQ ID NO: 434784 - DNA, 16 bp, M. musculus
tctaatattggactta

SEQ ID NO: 434785 - DNA, 16 bp, M. musculus
tctaatcccagcactc

SEQ ID NO: 434786 - DNA, 16 bp, M. musculus
tctaatgaaaaagaaa

SEQ ID NO: 434787 - DNA, 16 bp, M. musculus
tctaatgctctcttct

SEQ ID NO: 434788 - DNA, 16 bp, M. musculus
tctaatgctgtcttct

SEQ ID NO: 434789 - DNA, 16 bp, M. musculus
tctaatgctttgaatt

SEQ ID NO: 434790 - DNA, 16 bp, M. musculus
tctaatggagacattt

SEQ ID NO: 434791 - DNA, 16 bp, M. musculus
tctaatttcttgagtt

SEQ ID NO: 434792 - DNA, 16 bp, M. musculus
tctaatttgtgtgtgt

SEQ ID NO: 434793 - DNA, 16 bp, M. musculus
tctacaaaagcaacaa

SEQ ID NO: 434794 - DNA, 16 bp, M. musculus
tctacaaaaggctaaa

SEQ ID NO: 434795 - DNA, 16 bp, M. musculus
tctacaaaatgagttt

SEQ ID NO: 434796 - DNA, 16 bp, M. musculus
tctacaaagagagttc

SEQ ID NO: 434797 - DNA, 16 bp, M. musculus
tctacaaagcaagttg

SEQ ID NO: 434798 - DNA, 16 bp, M. musculus
tctacaaagggagttc

SEQ ID NO: 434799 - DNA, 16 bp, M. musculus
tctacaaatatctgtt

SEQ ID NO: 434800 - DNA, 16 bp, M. musculus
tctacaagaacaagtg

SEQ ID NO: 434801 - DNA, 16 bp, M. musculus
tctacaagagaaacaa

SEQ ID NO: 434802 - DNA, 16 bp, M. musculus
tctacaagagcaacaa

SEQ ID NO: 434803 - DNA, 16 bp, M. musculus
tctacaataaaaatct

SEQ ID NO: 434804 - DNA, 16 bp, M. musculus
tctacacagcaagctc

SEQ ID NO: 434805 - DNA, 16 bp, M. musculus
tctacacatgatcttc

SEQ ID NO: 434806 - DNA, 16 bp, M. musculus
tctacactggggtatc

SEQ ID NO: 434807 - DNA, 16 bp, M. musculus
tctacagaacaagttc

SEQ ID NO: 434808 - DNA, 16 bp, M. musculus
tctacagaatattcca

SEQ ID NO: 434809 - DNA, 16 bp, M. musculus
tctacagaatgggttc

SEQ ID NO: 434810 - DNA, 16 bp, M. musculus
tctacagactgagttc

SEQ ID NO: 434811 - DNA, 16 bp, M. musculus
tctacagagaaagttc

SEQ ID NO: 434812 - DNA, 16 bp, M. musculus
tctacagagagagtcc

SEQ ID NO: 434813 - DNA, 16 bp, M. musculus
tctacagagcaagtcc

SEQ ID NO: 434814 - DNA, 16 bp, M. musculus
tctacagaggaagttc

SEQ ID NO: 434815 - DNA, 16 bp, M. musculus
tctacagagtaagatc

SEQ ID NO: 434816 - DNA, 16 bp, M. musculus
tctacagattgagttc

SEQ ID NO: 434817 - DNA, 16 bp, M. musculus
tctacagcccaggctg

SEQ ID NO: 434818 - DNA, 16 bp, M. musculus
tctacagcctgatctt

SEQ ID NO: 434819 - DNA, 16 bp, M. musculus
tctacaggtctgacaa

SEQ ID NO: 434820 - DNA, 16 bp, M. musculus
tctacaggttctattt

SEQ ID NO: 434821 - DNA, 16 bp, M. musculus
tctacaggttttctct

SEQ ID NO: 434822 - DNA, 16 bp, M. musculus
tctacagtgatgctcc

SEQ ID NO: 434823 - DNA, 16 bp, M. musculus
tctacagtggggaggg

SEQ ID NO: 434824 - DNA, 16 bp, M. musculus
tctacatagcaaattc

SEQ ID NO: 434825 - DNA, 16 bp, M. musculus
tctacatagccctggc

SEQ ID NO: 434826 - DNA, 16 bp, M. musculus
tctacataggcctggc

SEQ ID NO: 434827 - DNA, 16 bp, M. musculus
tctacatagtaagctc

SEQ ID NO: 434828 - DNA, 16 bp, M. musculus
tctacatctatggtaa

SEQ ID NO: 434829 - DNA, 16 bp, M. musculus
tctacatctccatgtc

SEQ ID NO: 434830 - DNA, 16 bp, M. musculus
tctacatgcagaagaa

SEQ ID NO: 434831 - DNA, 17 bp, M. musculus
tctacatgctgacctcc

SEQ ID NO: 434832 - DNA, 16 bp, M. musculus
tctacattttgagtac

SEQ ID NO: 434833 - DNA, 16 bp, M. musculus
tctaccaacaatggag

SEQ ID NO: 434834 - DNA, 16 bp, M. musculus
tctaccaactgagcta

SEQ ID NO: 434835 - DNA, 16 bp, M. musculus
tctaccacaagatcca

SEQ ID NO: 434836 - DNA, 16 bp, M. musculus
tctaccactgaactaa

SEQ ID NO: 434837 - DNA, 18 bp, M. musculus
tctaccactgagccacat

SEQ ID NO: 434838 - DNA, 16 bp, M. musculus
tctaccactgagttat

SEQ ID NO: 434839 - DNA, 17 bp, M. musculus
tctaccagtgtctgaca

SEQ ID NO: 434840 - DNA, 29 bp, M. musculus
tctaccatcatcatgagatatgcctttaa

SEQ ID NO: 434841 - DNA, 16 bp, M. musculus
tctaccatcatcatgg

SEQ ID NO: 434842 - DNA, 16 bp, M. musculus
tctacccatccatcca

SEQ ID NO: 434843 - DNA, 16 bp, M. musculus
tctaccccattgatga

SEQ ID NO: 434844 - DNA, 16 bp, M. musculus
tctaccctctttctat

SEQ ID NO: 434845 - DNA, 16 bp, M. musculus
tctaccctgctgccca

SEQ ID NO: 434846 - DNA, 16 bp, M. musculus
tctaccctgtgcaaag

SEQ ID NO: 434847 - DNA, 16 bp, M. musculus
tctacctatctatcta

SEQ ID NO: 434848 - DNA, 16 bp, M. musculus
tctacctcccaagagc

SEQ ID NO: 434849 - DNA, 16 bp, M. musculus
tctacctcccaagtgt

SEQ ID NO: 434850 - DNA, 16 bp, M. musculus
tctacctcctgagtga

SEQ ID NO: 434851 - DNA, 16 bp, M. musculus
tctacctctgccttcc

SEQ ID NO: 434852 - DNA, 16 bp, M. musculus
tctacctgaagacaca

SEQ ID NO: 434853 - DNA, 16 bp, M. musculus
tctacctgaagaccaa

SEQ ID NO: 434854 - DNA, 16 bp, M. musculus
tctacctgaagaccca

SEQ ID NO: 434855 - DNA, 16 bp, M. musculus
tctacctgcatgctgc

SEQ ID NO: 434856 - DNA, 16 bp, M. musculus
tctacctgccctgagc

SEQ ID NO: 434857 - DNA, 16 bp, M. musculus
tctacctgcctctgct

SEQ ID NO: 434858 - DNA, 16 bp, M. musculus
tctacctgcctctggc

SEQ ID NO: 434859 - DNA, 16 bp, M. musculus
tctacctgcctctgtt

SEQ ID NO: 434860 - DNA, 16 bp, M. musculus
tctacctgcctgtcat

SEQ ID NO: 434861 - DNA, 16 bp, M. musculus
tctacctgcctgtctc

SEQ ID NO: 434862 - DNA, 16 bp, M. musculus
tctacctgcctgttac

SEQ ID NO: 434863 - DNA, 16 bp, M. musculus
tctacctgcttttgga

SEQ ID NO: 434864 - DNA, 16 bp, M. musculus
tctacctgtcctggaa

SEQ ID NO: 434865 - DNA, 17 bp, M. musculus
tctacctgtctgtcgct

SEQ ID NO: 434866 - DNA, 16 bp, M. musculus
tctacctgttccacat

SEQ ID NO: 434867 - DNA, 16 bp, M. musculus
tctacctgtttagtag

SEQ ID NO: 434868 - DNA, 16 bp, M. musculus
tctacctgtttgactg

SEQ ID NO: 434869 - DNA, 23 bp, M. musculus
tctaccttcacccatgaggcttg

SEQ ID NO: 434870 - DNA, 16 bp, M. musculus
tctaccttgtcttcaa

SEQ ID NO: 434871 - DNA, 16 bp, M. musculus
tctaccttgtttgaga

SEQ ID NO: 434872 - DNA, 28 bp, M. musculus
tctacgtaactaaggggtcatgtcctat

SEQ ID NO: 434873 - DNA, 16 bp, M. musculus
tctactaagatgaact

SEQ ID NO: 434874 - DNA, 16 bp, M. musculus
tctactcaccagaggt

SEQ ID NO: 434875 - DNA, 16 bp, M. musculus
tctactccctcaactc

SEQ ID NO: 434876 - DNA, 17 bp, M. musculus
tctactcctcttgggtg

SEQ ID NO: 434877 - DNA, 16 bp, M. musculus
tctactctaaatattt

SEQ ID NO: 434878 - DNA, 16 bp, M. musculus
tctactgtatatatgt

SEQ ID NO: 434879 - DNA, 16 bp, M. musculus
tctactgtgctgccca

SEQ ID NO: 434880 - DNA, 16 bp, M. musculus
tctacttcaatttctt

SEQ ID NO: 434881 - DNA, 16 bp, M. musculus
tctacttcagtttctg

SEQ ID NO: 434882 - DNA, 16 bp, M. musculus
tctacttctattttgt

SEQ ID NO: 434883 - DNA, 16 bp, M. musculus
tctacttctgtgaaga

SEQ ID NO: 434884 - DNA, 16 bp, M. musculus
tctacttctgttttgt

SEQ ID NO: 434885 - DNA, 16 bp, M. musculus
tctacttgcctctgct

SEQ ID NO: 434886 - DNA, 16 bp, M. musculus
tctacttgcttgattt

SEQ ID NO: 434887 - DNA, 16 bp, M. musculus
tctactttaaatcctc

SEQ ID NO: 434888 - DNA, 16 bp, M. musculus
tctactttatatgtct

SEQ ID NO: 434889 - DNA, 16 bp, M. musculus
tctactttccaccatg

SEQ ID NO: 434890 - DNA, 16 bp, M. musculus
tctactttgttgattt

SEQ ID NO: 434891 - DNA, 16 bp, M. musculus
tctagaaaaaaaagga

SEQ ID NO: 434892 - DNA, 16 bp, M. musculus
tctagaaaaagcaaga

SEQ ID NO: 434893 - DNA, 16 bp, M. musculus
tctagaaaatgaagaa

SEQ ID NO: 434894 - DNA, 16 bp, M. musculus
tctagaaagtgccaga

SEQ ID NO: 434895 - DNA, 16 bp, M. musculus
tctagaacaaaaagaa

SEQ ID NO: 434896 - DNA, 16 bp, M. musculus
tctagaacaaaggaag

SEQ ID NO: 434897 - DNA, 16 bp, M. musculus
tctagaacagatgcaa

SEQ ID NO: 434898 - DNA, 16 bp, M. musculus
tctagaactttttttt

SEQ ID NO: 434899 - DNA, 16 bp, M. musculus
tctagaagaaatggat

SEQ ID NO: 434900 - DNA, 16 bp, M. musculus
tctagaagaacagaaa

SEQ ID NO: 434901 - DNA, 16 bp, M. musculus
tctagaagagaagcca

SEQ ID NO: 434902 - DNA, 16 bp, M. musculus
tctagaagagcaagca

SEQ ID NO: 434903 - DNA, 16 bp, M. musculus
tctagaagatgtccca

SEQ ID NO: 434904 - DNA, 16 bp, M. musculus
tctagaaggattaggt

SEQ ID NO: 434905 - DNA, 16 bp, M. musculus
tctagaataaaaagaa

SEQ ID NO: 434906 - DNA, 16 bp, M. musculus
tctagaatcccccagt

SEQ ID NO: 434907 - DNA, 16 bp, M. musculus
tctagaatgagatctg

SEQ ID NO: 434908 - DNA, 16 bp, M. musculus
tctagacctgtaacca

SEQ ID NO: 434909 - DNA, 16 bp, M. musculus
tctagactcccaggtc

SEQ ID NO: 434910 - DNA, 16 bp, M. musculus
tctagactgttctctg

SEQ ID NO: 434911 - DNA, 16 bp, M. musculus
tctagaggagcagaag

SEQ ID NO: 434912 - DNA, 16 bp, M. musculus
tctagagtgctgggat

SEQ ID NO: 434913 - DNA, 16 bp, M. musculus
tctagagtgttgggat

SEQ ID NO: 434914 - DNA, 16 bp, M. musculus
tctagatagataccaa

SEQ ID NO: 434915 - DNA, 16 bp, M. musculus
tctagatccttcattg

SEQ ID NO: 434916 - DNA, 16 bp, M. musculus
tctagatctttctgaa

SEQ ID NO: 434917 - DNA, 16 bp, M. musculus
tctagatttttcagtt

SEQ ID NO: 434918 - DNA, 16 bp, M. musculus
tctagcaccacatctg

SEQ ID NO: 434919 - DNA, 16 bp, M. musculus
tctagcatcagtggga

SEQ ID NO: 434920 - DNA, 16 bp, M. musculus
tctagctatcctggaa

SEQ ID NO: 434921 - DNA, 16 bp, M. musculus
tctagctccttcactg

SEQ ID NO: 434922 - DNA, 16 bp, M. musculus
tctagctctatatgta

SEQ ID NO: 434923 - DNA, 16 bp, M. musculus
tctagctctgttcttt

SEQ ID NO: 434924 - DNA, 16 bp, M. musculus
tctagctgtatttgta

SEQ ID NO: 434925 - DNA, 16 bp, M. musculus
tctagctgtattttta

SEQ ID NO: 434926 - DNA, 16 bp, M. musculus
tctagcttgtgtcaag

SEQ ID NO: 434927 - DNA, 16 bp, M. musculus
tctagcttgtgtgaag

SEQ ID NO: 434928 - DNA, 16 bp, M. musculus
tctaggaaaaaaaaat

SEQ ID NO: 434929 - DNA, 16 bp, M. musculus
tctaggacagacaggg

SEQ ID NO: 434930 - DNA, 31 bp, M. musculus
tctaggagaaggagcctatactcatcactag

SEQ ID NO: 434931 - DNA, 16 bp, M. musculus
tctaggagaatgaatt

SEQ ID NO: 434932 - DNA, 16 bp, M. musculus
tctaggagagactgtt

SEQ ID NO: 434933 - DNA, 16 bp, M. musculus
tctaggagatccaatg

SEQ ID NO: 434934 - DNA, 16 bp, M. musculus
tctaggagctggttct

SEQ ID NO: 434935 - DNA, 16 bp, M. musculus
tctaggcatggtggca

SEQ ID NO: 434936 - DNA, 17 bp, M. musculus
tctaggccagccaggac

SEQ ID NO: 434937 - DNA, 16 bp, M. musculus
tctaggccatcctggt

SEQ ID NO: 434938 - DNA, 18 bp, M. musculus
tctaggctccagatgcct

SEQ ID NO: 434939 - DNA, 16 bp, M. musculus
tctaggctggctttga

SEQ ID NO: 434940 - DNA, 16 bp, M. musculus
tctaggctggtctcaa

SEQ ID NO: 434941 - DNA, 16 bp, M. musculus
tctaggtgggcagctt

SEQ ID NO: 434942 - DNA, 16 bp, M. musculus
tctaggtgtagtggga

SEQ ID NO: 434943 - DNA, 16 bp, M. musculus
tctaggttatttctag

SEQ ID NO: 434944 - DNA, 16 bp, M. musculus
tctaggttcagtgaga

SEQ ID NO: 434945 - DNA, 16 bp, M. musculus
tctagtatggttttct

SEQ ID NO: 434946 - DNA, 36 bp, M. musculus
tctagtatggttttgttcatttccatcacctgtttg

SEQ ID NO: 434947 - DNA, 16 bp, M. musculus
tctagtcaagttgaca

SEQ ID NO: 434948 - DNA, 16 bp, M. musculus
tctagtcagtctggct

SEQ ID NO: 434949 - DNA, 16 bp, M. musculus
tctagtctccaaggtc

SEQ ID NO: 434950 - DNA, 16 bp, M. musculus
tctagtgccatgtctg

SEQ ID NO: 434951 - DNA, 16 bp, M. musculus
tctagttcaatccatt

SEQ ID NO: 434952 - DNA, 16 bp, M. musculus
tctagttccagaggac

SEQ ID NO: 434953 - DNA, 16 bp, M. musculus
tctagttccaggggac

SEQ ID NO: 434954 - DNA, 16 bp, M. musculus
tctagttgacataaaa

SEQ ID NO: 434955 - DNA, 17 bp, M. musculus
tctagttttgttgagta

SEQ ID NO: 434956 - DNA, 16 bp, M. musculus
tctataaaaagacata

SEQ ID NO: 434957 - DNA, 16 bp, M. musculus
tctataaatttcagtc

SEQ ID NO: 434958 - DNA, 16 bp, M. musculus
tctataactccagcac

SEQ ID NO: 434959 - DNA, 16 bp, M. musculus
tctataagaaaacaag

SEQ ID NO: 434960 - DNA, 17 bp, M. musculus
tctataagtcccctctc

SEQ ID NO: 434961 - DNA, 16 bp, M. musculus
tctataataactttat

SEQ ID NO: 434962 - DNA, 16 bp, M. musculus
tctataattccagcac

SEQ ID NO: 434963 - DNA, 16 bp, M. musculus
tctataatttgtaaaa

SEQ ID NO: 434964 - DNA, 16 bp, M. musculus
tctataccctccccca

SEQ ID NO: 434965 - DNA, 16 bp, M. musculus
tctatacctattatcc

SEQ ID NO: 434966 - DNA, 16 bp, M. musculus
tctatactctccaaat

SEQ ID NO: 434967 - DNA, 16 bp, M. musculus
tctatagaccagtctg

SEQ ID NO: 434968 - DNA, 16 bp, M. musculus
tctatagctcaggctg

SEQ ID NO: 434969 - DNA, 16 bp, M. musculus
tctatagtttgtaaag

SEQ ID NO: 434970 - DNA, 16 bp, M. musculus
tctatataatgagttt

SEQ ID NO: 434971 - DNA, 16 bp, M. musculus
tctatatagcccaggc

SEQ ID NO: 434972 - DNA, 16 bp, M. musculus
tctatatcatctatat

SEQ ID NO: 434973 - DNA, 16 bp, M. musculus
tctatatctatatata

SEQ ID NO: 434974 - DNA, 16 bp, M. musculus
tctatatgtctgtctg

SEQ ID NO: 434975 - DNA, 16 bp, M. musculus
tctatcaatcaatcta

SEQ ID NO: 434976 - DNA, 16 bp, M. musculus
tctatcaatcatctat

SEQ ID NO: 434977 - DNA, 16 bp, M. musculus
tctatcactctctacc

SEQ ID NO: 434978 - DNA, 16 bp, M. musculus
tctatcagaaaaaaaa

SEQ ID NO: 434979 - DNA, 16 bp, M. musculus
tctatcagaagtaaag

SEQ ID NO: 434980 - DNA, 16 bp, M. musculus
tctatcagattttcaa

SEQ ID NO: 434981 - DNA, 16 bp, M. musculus
tctatcatcttcatga

SEQ ID NO: 434982 - DNA, 16 bp, M. musculus
tctatcattatttagt

SEQ ID NO: 434983 - DNA, 17 bp, M. musculus
tctatcatttaaagata

SEQ ID NO: 434984 - DNA, 16 bp, M. musculus
tctatccacccaccca

SEQ ID NO: 434985 - DNA, 16 bp, M. musculus
tctatccatccatctg

SEQ ID NO: 434986 - DNA, 16 bp, M. musculus
tctatccatttattta

SEQ ID NO: 434987 - DNA, 17 bp, M. musculus
tctatcccattggtcta

SEQ ID NO: 434988 - DNA, 16 bp, M. musculus
tctatccccagcactg

SEQ ID NO: 434989 - DNA, 16 bp, M. musculus
tctatccctctctttg

SEQ ID NO: 434990 - DNA, 16 bp, M. musculus
tctatccctgctattc

SEQ ID NO: 434991 - DNA, 16 bp, M. musculus
tctatctatcatctct

SEQ ID NO: 434992 - DNA, 25 bp, M. musculus
tctatctatctatctatctatctat

SEQ ID NO: 434993 - DNA, 22 bp, M. musculus
tctatctatctatctatctatg

SEQ ID NO: 434994 - DNA, 16 bp, M. musculus
tctatctatctatgct

SEQ ID NO: 434995 - DNA, 16 bp, M. musculus
tctatctatctctata

SEQ ID NO: 434996 - DNA, 16 bp, M. musculus
tctatctatctctctg

SEQ ID NO: 434997 - DNA, 16 bp, M. musculus
tctatctatctgtctg

SEQ ID NO: 434998 - DNA, 16 bp, M. musculus
tctatctatctgtgtg

SEQ ID NO: 434999 - DNA, 16 bp, M. musculus
tctatctcaagatcca

SEQ ID NO: 435000 - DNA, 16 bp, M. musculus
tctatctcagaaggaa

SEQ ID NO: 435001 - DNA, 16 bp, M. musculus
tctatctccaggggaa

SEQ ID NO: 435002 - DNA, 16 bp, M. musculus
tctatctccatctcca

SEQ ID NO: 435003 - DNA, 16 bp, M. musculus
tctatctctcctttgt

SEQ ID NO: 435004 - DNA, 16 bp, M. musculus
tctatctctgtctctg

SEQ ID NO: 435005 - DNA, 16 bp, M. musculus
tctatctgcatgtaca

SEQ ID NO: 435006 - DNA, 16 bp, M. musculus
tctatctgtctgtcca

SEQ ID NO: 435007 - DNA, 16 bp, M. musculus
tctatctgtctgtctg

SEQ ID NO: 435008 - DNA, 16 bp, M. musculus
tctatctgtttgtctg

SEQ ID NO: 435009 - DNA, 16 bp, M. musculus
tctatcttctgtctgt

SEQ ID NO: 435010 - DNA, 16 bp, M. musculus
tctatcttgaaaaaca

SEQ ID NO: 435011 - DNA, 16 bp, M. musculus
tctatgaacatagtga

SEQ ID NO: 435012 - DNA, 16 bp, M. musculus
tctatgaaggtgttct

SEQ ID NO: 435013 - DNA, 16 bp, M. musculus
tctatgaatatagcag

SEQ ID NO: 435014 - DNA, 16 bp, M. musculus
tctatgaccaagacat

SEQ ID NO: 435015 - DNA, 16 bp, M. musculus
tctatgacccagtata

SEQ ID NO: 435016 - DNA, 16 bp, M. musculus
tctatgactcctgact

SEQ ID NO: 435017 - DNA, 16 bp, M. musculus
tctatgactccttatc

SEQ ID NO: 435018 - DNA, 16 bp, M. musculus
tctatgactttttatt

SEQ ID NO: 435019 - DNA, 16 bp, M. musculus
tctatgagctcaaggc

SEQ ID NO: 435020 - DNA, 16 bp, M. musculus
tctatgagggtactcc

SEQ ID NO: 435021 - DNA, 16 bp, M. musculus
tctatgagtttgaagc

SEQ ID NO: 435022 - DNA, 16 bp, M. musculus
tctatgatgaagacat

SEQ ID NO: 435023 - DNA, 16 bp, M. musculus
tctatgattttgttga

SEQ ID NO: 435024 - DNA, 16 bp, M. musculus
tctatgccccagtgta

SEQ ID NO: 435025 - DNA, 16 bp, M. musculus
tctatgccttttatca

SEQ ID NO: 435026 - DNA, 16 bp, M. musculus
tctatggaaacttctg

SEQ ID NO: 435027 - DNA, 29 bp, M. musculus
tctatggaatcttctgcacctgagattct

SEQ ID NO: 435028 - DNA, 17 bp, M. musculus
tctatggagtcccgaca

SEQ ID NO: 435029 - DNA, 16 bp, M. musculus
tctatggtaatttaga

SEQ ID NO: 435030 - DNA, 16 bp, M. musculus
tctatggttccagatc

SEQ ID NO: 435031 - DNA, 16 bp, M. musculus
tctatgtctctttctg

SEQ ID NO: 435032 - DNA, 16 bp, M. musculus
tctatgtcttcattca

SEQ ID NO: 435033 - DNA, 16 bp, M. musculus
tctatgtggccctggc

SEQ ID NO: 435034 - DNA, 16 bp, M. musculus
tctatgtgtactcctt

SEQ ID NO: 435035 - DNA, 16 bp, M. musculus
tctatgtgtatatgtg

SEQ ID NO: 435036 - DNA, 16 bp, M. musculus
tctatgtgtgtatgca

SEQ ID NO: 435037 - DNA, 16 bp, M. musculus
tctatgttcattcaga

SEQ ID NO: 435038 - DNA, 17 bp, M. musculus
tctattagtttcactgt

SEQ ID NO: 435039 - DNA, 16 bp, M. musculus
tctattagtttctgtg

SEQ ID NO: 435040 - DNA, 16 bp, M. musculus
tctattatctatccat

SEQ ID NO: 435041 - DNA, 16 bp, M. musculus
tctattatcttctgta

SEQ ID NO: 435042 - DNA, 16 bp, M. musculus
tctattcatgaatttt

SEQ ID NO: 435043 - DNA, 16 bp, M. musculus
tctattcctcttggat

SEQ ID NO: 435044 - DNA, 22 bp, M. musculus
tctattcctgcacaaacatcac

SEQ ID NO: 435045 - DNA, 16 bp, M. musculus
tctattcgtgattctt

SEQ ID NO: 435046 - DNA, 16 bp, M. musculus
tctattcttctaagtt

SEQ ID NO: 435047 - DNA, 16 bp, M. musculus
tctattcttgtggctg

SEQ ID NO: 435048 - DNA, 16 bp, M. musculus
tctattgccatgaaga

SEQ ID NO: 435049 - DNA, 16 bp, M. musculus
tctattgcttttatta

SEQ ID NO: 435050 - DNA, 16 bp, M. musculus
tctattgtgtaaatat

SEQ ID NO: 435051 - DNA, 16 bp, M. musculus
tctatttcttctttga

SEQ ID NO: 435052 - DNA, 16 bp, M. musculus
tctatttctttccacc

SEQ ID NO: 435053 - DNA, 16 bp, M. musculus
tctatttctttgggga

SEQ ID NO: 435054 - DNA, 16 bp, M. musculus
tctatttgcattcttt

SEQ ID NO: 435055 - DNA, 17 bp, M. musculus
tctatttggggttctgt

SEQ ID NO: 435056 - DNA, 16 bp, M. musculus
tctattttcaataaaa

SEQ ID NO: 435057 - DNA, 16 bp, M. musculus
tctattttcaattaaa

SEQ ID NO: 435058 - DNA, 16 bp, M. musculus
tctattttcctacaaa

SEQ ID NO: 435059 - DNA, 16 bp, M. musculus
tctattttggagaagg

SEQ ID NO: 435060 - DNA, 16 bp, M. musculus
tctatttttaaatgtt

SEQ ID NO: 435061 - DNA, 16 bp, M. musculus
tctatttttgtctctg

SEQ ID NO: 435062 - DNA, 16 bp, M. musculus
tctatttttgtgaaga

SEQ ID NO: 435063 - DNA, 16 bp, M. musculus
tctcaaaaaaaggaag

SEQ ID NO: 435064 - DNA, 16 bp, M. musculus
tctcaaaaaacaagat

SEQ ID NO: 435065 - DNA, 16 bp, M. musculus
tctcaaaaaagaaaag

SEQ ID NO: 435066 - DNA, 16 bp, M. musculus
tctcaaaaaagcaaaa

SEQ ID NO: 435067 - DNA, 16 bp, M. musculus
tctcaaaaagaaagga

SEQ ID NO: 435068 - DNA, 16 bp, M. musculus
tctcaaaaatattaat

SEQ ID NO: 435069 - DNA, 16 bp, M. musculus
tctcaaaaatcccaaa

SEQ ID NO: 435070 - DNA, 16 bp, M. musculus
tctcaaaaattaagat

SEQ ID NO: 435071 - DNA, 16 bp, M. musculus
tctcaaaacaaatcaa

SEQ ID NO: 435072 - DNA, 16 bp, M. musculus
tctcaaaacagaaaca

SEQ ID NO: 435073 - DNA, 16 bp, M. musculus
tctcaaaaccaaaacc

SEQ ID NO: 435074 - DNA, 22 bp, M. musculus
tctcaaaacctcatcttggcaa

SEQ ID NO: 435075 - DNA, 16 bp, M. musculus
tctcaaaagacaaaag

SEQ ID NO: 435076 - DNA, 16 bp, M. musculus
tctcaaaagagagaga

SEQ ID NO: 435077 - DNA, 16 bp, M. musculus
tctcaaaagcaaaaac

SEQ ID NO: 435078 - DNA, 16 bp, M. musculus
tctcaaaagcaggcaa

SEQ ID NO: 435079 - DNA, 16 bp, M. musculus
tctcaaaaggaaaaaa

SEQ ID NO: 435080 - DNA, 16 bp, M. musculus
tctcaaaataaacaca

SEQ ID NO: 435081 - DNA, 16 bp, M. musculus
tctcaaacaaaagaaa

SEQ ID NO: 435082 - DNA, 16 bp, M. musculus
tctcaaacaaacagaa

SEQ ID NO: 435083 - DNA, 16 bp, M. musculus
tctcaaacaaccagct

SEQ ID NO: 435084 - DNA, 16 bp, M. musculus
tctcaaacagttccac

SEQ ID NO: 435085 - DNA, 16 bp, M. musculus
tctcaaactagagaga

SEQ ID NO: 435086 - DNA, 16 bp, M. musculus
tctcaaactatttcac

SEQ ID NO: 435087 - DNA, 16 bp, M. musculus
tctcaaacttccttct

SEQ ID NO: 435088 - DNA, 16 bp, M. musculus
tctcaaagaaacaact

SEQ ID NO: 435089 - DNA, 16 bp, M. musculus
tctcaaagaagaaaag

SEQ ID NO: 435090 - DNA, 16 bp, M. musculus
tctcaaagatctgcct

SEQ ID NO: 435091 - DNA, 16 bp, M. musculus
tctcaaagccacctcc

SEQ ID NO: 435092 - DNA, 16 bp, M. musculus
tctcaaagcctgcctc

SEQ ID NO: 435093 - DNA, 16 bp, M. musculus
tctcaaaggctgaaaa

SEQ ID NO: 435094 - DNA, 16 bp, M. musculus
tctcaaagggacacag

SEQ ID NO: 435095 - DNA, 16 bp, M. musculus
tctcaaagtaagtacc

SEQ ID NO: 435096 - DNA, 16 bp, M. musculus
tctcaaagtgaaagca

SEQ ID NO: 435097 - DNA, 16 bp, M. musculus
tctcaaatgctgggat

SEQ ID NO: 435098 - DNA, 16 bp, M. musculus
tctcaaattcatctga

SEQ ID NO: 435099 - DNA, 16 bp, M. musculus
tctcaacactcaggaa

SEQ ID NO: 435100 - DNA, 16 bp, M. musculus
tctcaacagcaatgga

SEQ ID NO: 435101 - DNA, 16 bp, M. musculus
tctcaacattattttc

SEQ ID NO: 435102 - DNA, 16 bp, M. musculus
tctcaaccactaagcc

SEQ ID NO: 435103 - DNA, 16 bp, M. musculus
tctcaaccattcggta

SEQ ID NO: 435104 - DNA, 16 bp, M. musculus
tctcaacctgtggggt

SEQ ID NO: 435105 - DNA, 17 bp, M. musculus
tctcaacctgtgggtct

SEQ ID NO: 435106 - DNA, 16 bp, M. musculus
tctcaacctgtgggtt

SEQ ID NO: 435107 - DNA, 21 bp, M. musculus
tctcaaccttcctaatgctgt

SEQ ID NO: 435108 - DNA, 16 bp, M. musculus
tctcaacctttctaat

SEQ ID NO: 435109 - DNA, 16 bp, M. musculus
tctcaactccaaactt

SEQ ID NO: 435110 - DNA, 16 bp, M. musculus
tctcaactgaagaatg

SEQ ID NO: 435111 - DNA, 16 bp, M. musculus
tctcaactgaggttcc

SEQ ID NO: 435112 - DNA, 16 bp, M. musculus
tctcaactttgttttt

SEQ ID NO: 435113 - DNA, 16 bp, M. musculus
tctcaagaaacaaaac

SEQ ID NO: 435114 - DNA, 16 bp, M. musculus
tctcaagaataaaaaa

SEQ ID NO: 435115 - DNA, 16 bp, M. musculus
tctcaagagagtgtgg

SEQ ID NO: 435116 - DNA, 16 bp, M. musculus
tctcaagatctccatg

SEQ ID NO: 435117 - DNA, 16 bp, M. musculus
tctcaagcaaaacaaa

SEQ ID NO: 435118 - DNA, 16 bp, M. musculus
tctcaaggaaaaagac

SEQ ID NO: 435119 - DNA, 16 bp, M. musculus
tctcaagggaaaaaaa

SEQ ID NO: 435120 - DNA, 16 bp, M. musculus
tctcaaggtcctgagt

SEQ ID NO: 435121 - DNA, 17 bp, M. musculus
tctcaatcctcctgcct

SEQ ID NO: 435122 - DNA, 16 bp, M. musculus
tctcaatcttcctaat

SEQ ID NO: 435123 - DNA, 16 bp, M. musculus
tctcaatgaacctgga

SEQ ID NO: 435124 - DNA, 16 bp, M. musculus
tctcaatggaggaata

SEQ ID NO: 435125 - DNA, 16 bp, M. musculus
tctcaattctgagatt

SEQ ID NO: 435126 - DNA, 16 bp, M. musculus
tctcaattgaggttcc

SEQ ID NO: 435127 - DNA, 16 bp, M. musculus
tctcacaaaagacagc

SEQ ID NO: 435128 - DNA, 16 bp, M. musculus
tctcacaagaggctaa

SEQ ID NO: 435129 - DNA, 17 bp, M. musculus
tctcacacacacacact

SEQ ID NO: 435130 - DNA, 16 bp, M. musculus
tctcacacattttttt

SEQ ID NO: 435131 - DNA, 16 bp, M. musculus
tctcacaccacagcaa

SEQ ID NO: 435132 - DNA, 16 bp, M. musculus
tctcacagacacagac

SEQ ID NO: 435133 - DNA, 16 bp, M. musculus
tctcacagaggccaga

SEQ ID NO: 435134 - DNA, 16 bp, M. musculus
tctcacaggagaaggg

SEQ ID NO: 435135 - DNA, 16 bp, M. musculus
tctcaccaacctctcc

SEQ ID NO: 435136 - DNA, 16 bp, M. musculus
tctcaccaatgggcag

SEQ ID NO: 435137 - DNA, 16 bp, M. musculus
tctcaccacagcaagc

SEQ ID NO: 435138 - DNA, 16 bp, M. musculus
tctcaccagaaactat

SEQ ID NO: 435139 - DNA, 16 bp, M. musculus
tctcaccagaggaata

SEQ ID NO: 435140 - DNA, 16 bp, M. musculus
tctcaccagcccatct

SEQ ID NO: 435141 - DNA, 16 bp, M. musculus
tctcaccagccccagc

SEQ ID NO: 435142 - DNA, 16 bp, M. musculus
tctcaccagcccccag

SEQ ID NO: 435143 - DNA, 16 bp, M. musculus
tctcaccagcccttca

SEQ ID NO: 435144 - DNA, 16 bp, M. musculus
tctcaccagttccagc

SEQ ID NO: 435145 - DNA, 16 bp, M. musculus
tctcaccatctcagag

SEQ ID NO: 435146 - DNA, 16 bp, M. musculus
tctcaccctgaagatc

SEQ ID NO: 435147 - DNA, 16 bp, M. musculus
tctcacctctgacacc

SEQ ID NO: 435148 - DNA, 16 bp, M. musculus
tctcacctgggcagac

SEQ ID NO: 435149 - DNA, 17 bp, M. musculus
tctcacctgtgcagact

SEQ ID NO: 435150 - DNA, 16 bp, M. musculus
tctcaccttccacctt

SEQ ID NO: 435151 - DNA, 16 bp, M. musculus
tctcactaaatctgga

SEQ ID NO: 435152 - DNA, 16 bp, M. musculus
tctcactacacagccc

SEQ ID NO: 435153 - DNA, 16 bp, M. musculus
tctcactactgcctga

SEQ ID NO: 435154 - DNA, 16 bp, M. musculus
tctcactagaaaacaa

SEQ ID NO: 435155 - DNA, 16 bp, M. musculus
tctcactctttgctct

SEQ ID NO: 435156 - DNA, 17 bp, M. musculus
tctcactcttttatact

SEQ ID NO: 435157 - DNA, 16 bp, M. musculus
tctcactgaacctgga

SEQ ID NO: 435158 - DNA, 16 bp, M. musculus
tctcactgaactcaga

SEQ ID NO: 435159 - DNA, 16 bp, M. musculus
tctcactgaggcctga

SEQ ID NO: 435160 - DNA, 16 bp, M. musculus
tctcactgaggctgga

SEQ ID NO: 435161 - DNA, 16 bp, M. musculus
tctcactgtgtggccc

SEQ ID NO: 435162 - DNA, 16 bp, M. musculus
tctcactgttccaggc

SEQ ID NO: 435163 - DNA, 16 bp, M. musculus
tctcacttctctcact

SEQ ID NO: 435164 - DNA, 16 bp, M. musculus
tctcactttggatttt

SEQ ID NO: 435165 - DNA, 16 bp, M. musculus
tctcactttgtagccc

SEQ ID NO: 435166 - DNA, 16 bp, M. musculus
tctcagaaaaaaaaat

SEQ ID NO: 435167 - DNA, 16 bp, M. musculus
tctcagaaaaaacaaa

SEQ ID NO: 435168 - DNA, 16 bp, M. musculus
tctcagaaaaatgaaa

SEQ ID NO: 435169 - DNA, 16 bp, M. musculus
tctcagaaaacacttc

SEQ ID NO: 435170 - DNA, 16 bp, M. musculus
tctcagaaaacacttt

SEQ ID NO: 435171 - DNA, 16 bp, M. musculus
tctcagaaaaccaaac

SEQ ID NO: 435172 - DNA, 18 bp, M. musculus
tctcagaaaagcaaggaa

SEQ ID NO: 435173 - DNA, 16 bp, M. musculus
tctcagaaaagtaaaa

SEQ ID NO: 435174 - DNA, 16 bp, M. musculus
tctcagaaaattggat

SEQ ID NO: 435175 - DNA, 16 bp, M. musculus
tctcagaaacaaaaac

SEQ ID NO: 435176 - DNA, 16 bp, M. musculus
tctcagaaatgctttc

SEQ ID NO: 435177 - DNA, 16 bp, M. musculus
tctcagaacaacaaca

SEQ ID NO: 435178 - DNA, 16 bp, M. musculus
tctcagaagaaaaaca

SEQ ID NO: 435179 - DNA, 16 bp, M. musculus
tctcagaagaaagaaa

SEQ ID NO: 435180 - DNA, 16 bp, M. musculus
tctcagaagacagaaa

SEQ ID NO: 435181 - DNA, 16 bp, M. musculus
tctcagaagacagcta

SEQ ID NO: 435182 - DNA, 16 bp, M. musculus
tctcagaagagaaagg

SEQ ID NO: 435183 - DNA, 16 bp, M. musculus
tctcagaagagaagag

SEQ ID NO: 435184 - DNA, 16 bp, M. musculus
tctcagaagatgaaag

SEQ ID NO: 435185 - DNA, 16 bp, M. musculus
tctcagaagctctgtg

SEQ ID NO: 435186 - DNA, 16 bp, M. musculus
tctcagacaaccattg

SEQ ID NO: 435187 - DNA, 16 bp, M. musculus
tctcagactggcctca

SEQ ID NO: 435188 - DNA, 16 bp, M. musculus
tctcagagatcaaact

SEQ ID NO: 435189 - DNA, 16 bp, M. musculus
tctcagagcagagctg

SEQ ID NO: 435190 - DNA, 16 bp, M. musculus
tctcagagctggagag

SEQ ID NO: 435191 - DNA, 16 bp, M. musculus
tctcagagctgtgtgg

SEQ ID NO: 435192 - DNA, 16 bp, M. musculus
tctcagaggcaaggag

SEQ ID NO: 435193 - DNA, 16 bp, M. musculus
tctcagaggcagaaga

SEQ ID NO: 435194 - DNA, 16 bp, M. musculus
tctcagaggcagcttg

SEQ ID NO: 435195 - DNA, 16 bp, M. musculus
tctcagaggctgagaa

SEQ ID NO: 435196 - DNA, 16 bp, M. musculus
tctcagagtctcagag

SEQ ID NO: 435197 - DNA, 16 bp, M. musculus
tctcagagtctgagcc

SEQ ID NO: 435198 - DNA, 16 bp, M. musculus
tctcagagttgctttg

SEQ ID NO: 435199 - DNA, 16 bp, M. musculus
tctcagagttgttttt

SEQ ID NO: 435200 - DNA, 16 bp, M. musculus
tctcagatgactttag

SEQ ID NO: 435201 - DNA, 16 bp, M. musculus
tctcagatgattttag

SEQ ID NO: 435202 - DNA, 16 bp, M. musculus
tctcagcaaagcaaag

SEQ ID NO: 435203 - DNA, 16 bp, M. musculus
tctcagcaaagtgaag

SEQ ID NO: 435204 - DNA, 16 bp, M. musculus
tctcagcacccacgtg

SEQ ID NO: 435205 - DNA, 16 bp, M. musculus
tctcagcactagggaa

SEQ ID NO: 435206 - DNA, 16 bp, M. musculus
tctcagcactcaggac

SEQ ID NO: 435207 - DNA, 16 bp, M. musculus
tctcagcactcaggag

SEQ ID NO: 435208 - DNA, 16 bp, M. musculus
tctcagcactccagag

SEQ ID NO: 435209 - DNA, 16 bp, M. musculus
tctcagcactgaggag

SEQ ID NO: 435210 - DNA, 16 bp, M. musculus
tctcagcacttggcag

SEQ ID NO: 435211 - DNA, 16 bp, M. musculus
tctcagcacttgggaa

SEQ ID NO: 435212 - DNA, 16 bp, M. musculus
tctcagcacttgggtg

SEQ ID NO: 435213 - DNA, 16 bp, M. musculus
tctcagcactttggag

SEQ ID NO: 435214 - DNA, 16 bp, M. musculus
tctcagcagagactct

SEQ ID NO: 435215 - DNA, 16 bp, M. musculus
tctcagcagcagcagc

SEQ ID NO: 435216 - DNA, 16 bp, M. musculus
tctcagcagccattga

SEQ ID NO: 435217 - DNA, 16 bp, M. musculus
tctcagcaggaggggt

SEQ ID NO: 435218 - DNA, 16 bp, M. musculus
tctcagcatcctcatg

SEQ ID NO: 435219 - DNA, 16 bp, M. musculus
tctcagcatcttctct

SEQ ID NO: 435220 - DNA, 16 bp, M. musculus
tctcagcattccttgg

SEQ ID NO: 435221 - DNA, 16 bp, M. musculus
tctcagccacttgagt

SEQ ID NO: 435222 - DNA, 16 bp, M. musculus
tctcagccattcagca

SEQ ID NO: 435223 - DNA, 16 bp, M. musculus
tctcagccatttggaa

SEQ ID NO: 435224 - DNA, 16 bp, M. musculus
tctcagcccctcctgc

SEQ ID NO: 435225 - DNA, 16 bp, M. musculus
tctcagccctcaggag

SEQ ID NO: 435226 - DNA, 16 bp, M. musculus
tctcagcccttttatc

SEQ ID NO: 435227 - DNA, 16 bp, M. musculus
tctcagcctcagcctc

SEQ ID NO: 435228 - DNA, 16 bp, M. musculus
tctcagcctcctcagt

SEQ ID NO: 435229 - DNA, 16 bp, M. musculus
tctcagcctctcagcc

SEQ ID NO: 435230 - DNA, 16 bp, M. musculus
tctcagcctgtgggtt

SEQ ID NO: 435231 - DNA, 16 bp, M. musculus
tctcagcctgtttctc

SEQ ID NO: 435232 - DNA, 16 bp, M. musculus
tctcagcctttctgta

SEQ ID NO: 435233 - DNA, 16 bp, M. musculus
tctcagcgctcaggag

SEQ ID NO: 435234 - DNA, 16 bp, M. musculus
tctcagctacttggga

SEQ ID NO: 435235 - DNA, 19 bp, M. musculus
tctcagctccaaactttgt

SEQ ID NO: 435236 - DNA, 16 bp, M. musculus
tctcagctccaagctt

SEQ ID NO: 435237 - DNA, 16 bp, M. musculus
tctcagctcctccagc

SEQ ID NO: 435238 - DNA, 16 bp, M. musculus
tctcagctcctcctcc

SEQ ID NO: 435239 - DNA, 16 bp, M. musculus
tctcagctcctctcca

SEQ ID NO: 435240 - DNA, 16 bp, M. musculus
tctcagctctgcctac

SEQ ID NO: 435241 - DNA, 16 bp, M. musculus
tctcagctgcagaaga

SEQ ID NO: 435242 - DNA, 16 bp, M. musculus
tctcagctgttcttca

SEQ ID NO: 435243 - DNA, 16 bp, M. musculus
tctcagcttcccctct

SEQ ID NO: 435244 - DNA, 16 bp, M. musculus
tctcagcttctgactg

SEQ ID NO: 435245 - DNA, 16 bp, M. musculus
tctcagcttctttctg

SEQ ID NO: 435246 - DNA, 16 bp, M. musculus
tctcaggaaaaagaca

SEQ ID NO: 435247 - DNA, 16 bp, M. musculus
tctcaggaacccctct

SEQ ID NO: 435248 - DNA, 16 bp, M. musculus
tctcaggaactgccag

SEQ ID NO: 435249 - DNA, 17 bp, M. musculus
tctcaggaagaccccga

SEQ ID NO: 435250 - DNA, 16 bp, M. musculus
tctcaggaatgctttc

SEQ ID NO: 435251 - DNA, 16 bp, M. musculus
tctcaggagaagagag

SEQ ID NO: 435252 - DNA, 16 bp, M. musculus
tctcaggagacaagaa

SEQ ID NO: 435253 - DNA, 16 bp, M. musculus
tctcaggagacaggca

SEQ ID NO: 435254 - DNA, 16 bp, M. musculus
tctcaggaggcagagg

SEQ ID NO: 435255 - DNA, 16 bp, M. musculus
tctcaggatcccagga

SEQ ID NO: 435256 - DNA, 16 bp, M. musculus
tctcaggatgagcttt

SEQ ID NO: 435257 - DNA, 16 bp, M. musculus
tctcaggcccaccctg

SEQ ID NO: 435258 - DNA, 16 bp, M. musculus
tctcaggctggcctca

SEQ ID NO: 435259 - DNA, 16 bp, M. musculus
tctcaggctggcctgg

SEQ ID NO: 435260 - DNA, 16 bp, M. musculus
tctcaggctggctttg

SEQ ID NO: 435261 - DNA, 16 bp, M. musculus
tctcaggctgggcaga

SEQ ID NO: 435262 - DNA, 16 bp, M. musculus
tctcagggaggaggct

SEQ ID NO: 435263 - DNA, 16 bp, M. musculus
tctcagggcctactgt

SEQ ID NO: 435264 - DNA, 16 bp, M. musculus
tctcaggggacagtca

SEQ ID NO: 435265 - DNA, 16 bp, M. musculus
tctcaggggacagtta

SEQ ID NO: 435266 - DNA, 16 bp, M. musculus
tctcagggtctcagaa

SEQ ID NO: 435267 - DNA, 17 bp, M. musculus
tctcaggtacagaagat

SEQ ID NO: 435268 - DNA, 16 bp, M. musculus
tctcaggtcctgcaga

SEQ ID NO: 435269 - DNA, 16 bp, M. musculus
tctcaggtgcagagga

SEQ ID NO: 435270 - DNA, 16 bp, M. musculus
tctcagtaacatgggt

SEQ ID NO: 435271 - DNA, 16 bp, M. musculus
tctcagtatatgccca

SEQ ID NO: 435272 - DNA, 16 bp, M. musculus
tctcagtatctaatga

SEQ ID NO: 435273 - DNA, 16 bp, M. musculus
tctcagtatgtagctc

SEQ ID NO: 435274 - DNA, 16 bp, M. musculus
tctcagtcctcctgcc

SEQ ID NO: 435275 - DNA, 16 bp, M. musculus
tctcagtctcctgagt

SEQ ID NO: 435276 - DNA, 16 bp, M. musculus
tctcagtctctgctcc

SEQ ID NO: 435277 - DNA, 16 bp, M. musculus
tctcagtctctgtctc

SEQ ID NO: 435278 - DNA, 16 bp, M. musculus
tctcagtctctgtgag

SEQ ID NO: 435279 - DNA, 16 bp, M. musculus
tctcagtctgtctctg

SEQ ID NO: 435280 - DNA, 16 bp, M. musculus
tctcagtctgtctgtc

SEQ ID NO: 435281 - DNA, 16 bp, M. musculus
tctcagtgctcaggag

SEQ ID NO: 435282 - DNA, 16 bp, M. musculus
tctcagtgctgagatt

SEQ ID NO: 435283 - DNA, 16 bp, M. musculus
tctcagtgctggggag

SEQ ID NO: 435284 - DNA, 16 bp, M. musculus
tctcagtgctggggtt

SEQ ID NO: 435285 - DNA, 16 bp, M. musculus
tctcagtggaagaaga

SEQ ID NO: 435286 - DNA, 16 bp, M. musculus
tctcagtggatcaagg

SEQ ID NO: 435287 - DNA, 17 bp, M. musculus
tctcagtgggattccct

SEQ ID NO: 435288 - DNA, 16 bp, M. musculus
tctcagtggtccaggt

SEQ ID NO: 435289 - DNA, 16 bp, M. musculus
tctcagtggttaagag

SEQ ID NO: 435290 - DNA, 16 bp, M. musculus
tctcagtgttgttttt

SEQ ID NO: 435291 - DNA, 16 bp, M. musculus
tctcagttctctctct

SEQ ID NO: 435292 - DNA, 16 bp, M. musculus
tctcagttctgaacat

SEQ ID NO: 435293 - DNA, 16 bp, M. musculus
tctcagttctgcctgc

SEQ ID NO: 435294 - DNA, 16 bp, M. musculus
tctcagtttcctcatc

SEQ ID NO: 435295 - DNA, 16 bp, M. musculus
tctcagtttctccatc

SEQ ID NO: 435296 - DNA, 16 bp, M. musculus
tctcataaaaacacta

SEQ ID NO: 435297 - DNA, 16 bp, M. musculus
tctcataaaaccaaaa

SEQ ID NO: 435298 - DNA, 16 bp, M. musculus
tctcataaaattgaaa

SEQ ID NO: 435299 - DNA, 16 bp, M. musculus
tctcataagaattaag

SEQ ID NO: 435300 - DNA, 16 bp, M. musculus
tctcatacaatatatc

SEQ ID NO: 435301 - DNA, 16 bp, M. musculus
tctcatagcccaggct

SEQ ID NO: 435302 - DNA, 16 bp, M. musculus
tctcatcagcaatgga

SEQ ID NO: 435303 - DNA, 16 bp, M. musculus
tctcatcgtggaagct

SEQ ID NO: 435304 - DNA, 16 bp, M. musculus
tctcatctacccctat

SEQ ID NO: 435305 - DNA, 16 bp, M. musculus
tctcatctataagttt

SEQ ID NO: 435306 - DNA, 16 bp, M. musculus
tctcatctctagccct

SEQ ID NO: 435307 - DNA, 16 bp, M. musculus
tctcatctctatctct

SEQ ID NO: 435308 - DNA, 16 bp, M. musculus
tctcatctctctctgt

SEQ ID NO: 435309 - DNA, 16 bp, M. musculus
tctcatctgtaaagtg

SEQ ID NO: 435310 - DNA, 19 bp, M. musculus
tctcatgatgatgatagag

SEQ ID NO: 435311 - DNA, 16 bp, M. musculus
tctcatgatgatgatt

SEQ ID NO: 435312 - DNA, 33 bp, M. musculus
tctcatgatgatggtagaggacataaagaagga

SEQ ID NO: 435313 - DNA, 16 bp, M. musculus
tctcatgcccaagttg

SEQ ID NO: 435314 - DNA, 16 bp, M. musculus
tctcatgctggttaat

SEQ ID NO: 435315 - DNA, 16 bp, M. musculus
tctcatggaagcattt

SEQ ID NO: 435316 - DNA, 16 bp, M. musculus
tctcatggagagtcct

SEQ ID NO: 435317 - DNA, 16 bp, M. musculus
tctcatggcctgctca

SEQ ID NO: 435318 - DNA, 16 bp, M. musculus
tctcatggtattccag

SEQ ID NO: 435319 - DNA, 16 bp, M. musculus
tctcatgtagaccagg

SEQ ID NO: 435320 - DNA, 16 bp, M. musculus
tctcatgtagcctagg

SEQ ID NO: 435321 - DNA, 16 bp, M. musculus
tctcatgtatcctagg

SEQ ID NO: 435322 - DNA, 17 bp, M. musculus
tctcatgtcatttgtat

SEQ ID NO: 435323 - DNA, 16 bp, M. musculus
tctcatgtggcccagg

SEQ ID NO: 435324 - DNA, 16 bp, M. musculus
tctcatgtgtcccagg

SEQ ID NO: 435325 - DNA, 16 bp, M. musculus
tctcatgttgtggtga

SEQ ID NO: 435326 - DNA, 16 bp, M. musculus
tctcattaaaaacaaa

SEQ ID NO: 435327 - DNA, 16 bp, M. musculus
tctcattacgggtggc

SEQ ID NO: 435328 - DNA, 17 bp, M. musculus
tctcattacgggtggtt

SEQ ID NO: 435329 - DNA, 16 bp, M. musculus
tctcattatgttgccc

SEQ ID NO: 435330 - DNA, 16 bp, M. musculus
tctcattctctggctt

SEQ ID NO: 435331 - DNA, 16 bp, M. musculus
tctcattctgtgtgtg

SEQ ID NO: 435332 - DNA, 16 bp, M. musculus
tctcattgaacctgga

SEQ ID NO: 435333 - DNA, 16 bp, M. musculus
tctcattgaggcattt

SEQ ID NO: 435334 - DNA, 16 bp, M. musculus
tctcattggcctgaag

SEQ ID NO: 435335 - DNA, 16 bp, M. musculus
tctcattggcctggaa

SEQ ID NO: 435336 - DNA, 16 bp, M. musculus
tctcatttaaaaacaa

SEQ ID NO: 435337 - DNA, 16 bp, M. musculus
tctcatttaatcctta

SEQ ID NO: 435338 - DNA, 16 bp, M. musculus
tctcatttatttgtaa

SEQ ID NO: 435339 - DNA, 16 bp, M. musculus
tctcatttctctcact

SEQ ID NO: 435340 - DNA, 16 bp, M. musculus
tctcatttcttggccc

SEQ ID NO: 435341 - DNA, 16 bp, M. musculus
tctcattttcttctgt

SEQ ID NO: 435342 - DNA, 16 bp, M. musculus
tctcattttgctttgt

SEQ ID NO: 435343 - DNA, 16 bp, M. musculus
tctcattttttaaaaa

SEQ ID NO: 435344 - DNA, 16 bp, M. musculus
tctccaaaaatacgct

SEQ ID NO: 435345 - DNA, 16 bp, M. musculus
tctccaaaagtgacca

SEQ ID NO: 435346 - DNA, 16 bp, M. musculus
tctccaaaggaaaaaa

SEQ ID NO: 435347 - DNA, 16 bp, M. musculus
tctccaaatacataaa

SEQ ID NO: 435348 - DNA, 16 bp, M. musculus
tctccaacaaggacac

SEQ ID NO: 435349 - DNA, 16 bp, M. musculus
tctccaacatcttgga

SEQ ID NO: 435350 - DNA, 16 bp, M. musculus
tctccaacccaaatat

SEQ ID NO: 435351 - DNA, 16 bp, M. musculus
tctccaactccttcac

SEQ ID NO: 435352 - DNA, 16 bp, M. musculus
tctccaacttctccat

SEQ ID NO: 435353 - DNA, 16 bp, M. musculus
tctccaagacttttaa

SEQ ID NO: 435354 - DNA, 16 bp, M. musculus
tctccaagagaatgtc

SEQ ID NO: 435355 - DNA, 16 bp, M. musculus
tctccaagaggatgtc

SEQ ID NO: 435356 - DNA, 16 bp, M. musculus
tctccaagatccatga

SEQ ID NO: 435357 - DNA, 16 bp, M. musculus
tctccaagccatgtgc

SEQ ID NO: 435358 - DNA, 16 bp, M. musculus
tctccaagcctcaaga

SEQ ID NO: 435359 - DNA, 16 bp, M. musculus
tctccaagctccatct

SEQ ID NO: 435360 - DNA, 16 bp, M. musculus
tctccaagctgactga

SEQ ID NO: 435361 - DNA, 16 bp, M. musculus
tctccaatacttttaa

SEQ ID NO: 435362 - DNA, 16 bp, M. musculus
tctccaatctctctcc

SEQ ID NO: 435363 - DNA, 16 bp, M. musculus
tctccacaaccttgcc

SEQ ID NO: 435364 - DNA, 16 bp, M. musculus
tctccacacacacaca

SEQ ID NO: 435365 - DNA, 16 bp, M. musculus
tctccacactgcagga

SEQ ID NO: 435366 - DNA, 16 bp, M. musculus
tctccacatatcccaa

SEQ ID NO: 435367 - DNA, 16 bp, M. musculus
tctccacatccctgcc

SEQ ID NO: 435368 - DNA, 16 bp, M. musculus
tctccacatcctaacc

SEQ ID NO: 435369 - DNA, 16 bp, M. musculus
tctccacatccttgct

SEQ ID NO: 435370 - DNA, 16 bp, M. musculus
tctccacatgcacaca

SEQ ID NO: 435371 - DNA, 16 bp, M. musculus
tctccacatggatgct

SEQ ID NO: 435372 - DNA, 16 bp, M. musculus
tctccacctctctgtc

SEQ ID NO: 435373 - DNA, 16 bp, M. musculus
tctccacctgcctctg

SEQ ID NO: 435374 - DNA, 16 bp, M. musculus
tctccaccttcctagt

SEQ ID NO: 435375 - DNA, 16 bp, M. musculus
tctccacggcctctgc

SEQ ID NO: 435376 - DNA, 16 bp, M. musculus
tctccactggaagtcc

SEQ ID NO: 435377 - DNA, 16 bp, M. musculus
tctccacttatcagtg

SEQ ID NO: 435378 - DNA, 16 bp, M. musculus
tctccacttccttgtc

SEQ ID NO: 435379 - DNA, 16 bp, M. musculus
tctccactttagtttt

SEQ ID NO: 435380 - DNA, 16 bp, M. musculus
tctccagaaaaaaaaa

SEQ ID NO: 435381 - DNA, 16 bp, M. musculus
tctccagagatctcca

SEQ ID NO: 435382 - DNA, 16 bp, M. musculus
tctccagagctcccag

SEQ ID NO: 435383 - DNA, 16 bp, M. musculus
tctccagagctccctg

SEQ ID NO: 435384 - DNA, 16 bp, M. musculus
tctccagaggactctc

SEQ ID NO: 435385 - DNA, 16 bp, M. musculus
tctccagagttgtctc

SEQ ID NO: 435386 - DNA, 16 bp, M. musculus
tctccagatacatcca

SEQ ID NO: 435387 - DNA, 16 bp, M. musculus
tctccagatggggcag

SEQ ID NO: 435388 - DNA, 16 bp, M. musculus
tctccagcaccacaca

SEQ ID NO: 435389 - DNA, 16 bp, M. musculus
tctccagcaccacaga

SEQ ID NO: 435390 - DNA, 16 bp, M. musculus
tctccagcacccacat

SEQ ID NO: 435391 - DNA, 16 bp, M. musculus
tctccagcacccatat

SEQ ID NO: 435392 - DNA, 16 bp, M. musculus
tctccagcactgccca

SEQ ID NO: 435393 - DNA, 16 bp, M. musculus
tctccagcagaaggtg

SEQ ID NO: 435394 - DNA, 16 bp, M. musculus
tctccagcatccatgt

SEQ ID NO: 435395 - DNA, 16 bp, M. musculus
tctccagccagaactt

SEQ ID NO: 435396 - DNA, 16 bp, M. musculus
tctccagcccacttct

SEQ ID NO: 435397 - DNA, 16 bp, M. musculus
tctccagcccatcttt

SEQ ID NO: 435398 - DNA, 16 bp, M. musculus
tctccagccccaacct

SEQ ID NO: 435399 - DNA, 16 bp, M. musculus
tctccagccccaatct

SEQ ID NO: 435400 - DNA, 16 bp, M. musculus
tctccagccccacaaa

SEQ ID NO: 435401 - DNA, 16 bp, M. musculus
tctccagccccaccag

SEQ ID NO: 435402 - DNA, 16 bp, M. musculus
tctccagccccagaag

SEQ ID NO: 435403 - DNA, 16 bp, M. musculus
tctccagccccagagt

SEQ ID NO: 435404 - DNA, 16 bp, M. musculus
tctccagccccagcat

SEQ ID NO: 435405 - DNA, 16 bp, M. musculus
tctccagccccaggac

SEQ ID NO: 435406 - DNA, 16 bp, M. musculus
tctccagccccaggat

SEQ ID NO: 435407 - DNA, 16 bp, M. musculus
tctccagccccaggcc

SEQ ID NO: 435408 - DNA, 16 bp, M. musculus
tctccagccccagtga

SEQ ID NO: 435409 - DNA, 16 bp, M. musculus
tctccagccccatcat

SEQ ID NO: 435410 - DNA, 16 bp, M. musculus
tctccagccccatcca

SEQ ID NO: 435411 - DNA, 16 bp, M. musculus
tctccagccccatctc

SEQ ID NO: 435412 - DNA, 16 bp, M. musculus
tctccagccccatggc

SEQ ID NO: 435413 - DNA, 16 bp, M. musculus
tctccagcccccaaac

SEQ ID NO: 435414 - DNA, 16 bp, M. musculus
tctccagcccccacag

SEQ ID NO: 435415 - DNA, 16 bp, M. musculus
tctccagcccccagcc

SEQ ID NO: 435416 - DNA, 16 bp, M. musculus
tctccagcccccattt

SEQ ID NO: 435417 - DNA, 16 bp, M. musculus
tctccagccccctaga

SEQ ID NO: 435418 - DNA, 16 bp, M. musculus
tctccagccccctcca

SEQ ID NO: 435419 - DNA, 16 bp, M. musculus
tctccagccccctctg

SEQ ID NO: 435420 - DNA, 16 bp, M. musculus
tctccagcccctcaca

SEQ ID NO: 435421 - DNA, 16 bp, M. musculus
tctccagcccctcatt

SEQ ID NO: 435422 - DNA, 16 bp, M. musculus
tctccagcccctccct

SEQ ID NO: 435423 - DNA, 16 bp, M. musculus
tctccagcccctgccc

SEQ ID NO: 435424 - DNA, 16 bp, M. musculus
tctccagcccctggga

SEQ ID NO: 435425 - DNA, 16 bp, M. musculus
tctccagcccctggtc

SEQ ID NO: 435426 - DNA, 16 bp, M. musculus
tctccagcccctgtct

SEQ ID NO: 435427 - DNA, 16 bp, M. musculus
tctccagcccctgtgc

SEQ ID NO: 435428 - DNA, 16 bp, M. musculus
tctccagcccctttct

SEQ ID NO: 435429 - DNA, 16 bp, M. musculus
tctccagccccttttc

SEQ ID NO: 435430 - DNA, 16 bp, M. musculus
tctccagccctccagt

SEQ ID NO: 435431 - DNA, 16 bp, M. musculus
tctccagccctctgct

SEQ ID NO: 435432 - DNA, 16 bp, M. musculus
tctccagccctgaaaa

SEQ ID NO: 435433 - DNA, 16 bp, M. musculus
tctccagccctgacat

SEQ ID NO: 435434 - DNA, 16 bp, M. musculus
tctccagccctgcccc

SEQ ID NO: 435435 - DNA, 16 bp, M. musculus
tctccagccctgcctg

SEQ ID NO: 435436 - DNA, 16 bp, M. musculus
tctccagcccttcccc

SEQ ID NO: 435437 - DNA, 16 bp, M. musculus
tctccagcccttgctt

SEQ ID NO: 435438 - DNA, 16 bp, M. musculus
tctccagcccttgtct

SEQ ID NO: 435439 - DNA, 16 bp, M. musculus
tctccagcccttgttt

SEQ ID NO: 435440 - DNA, 16 bp, M. musculus
tctccagcctccacac

SEQ ID NO: 435441 - DNA, 16 bp, M. musculus
tctccagcctccagaa

SEQ ID NO: 435442 - DNA, 16 bp, M. musculus
tctccagcctgttttc

SEQ ID NO: 435443 - DNA, 16 bp, M. musculus
tctccagctactctct

SEQ ID NO: 435444 - DNA, 16 bp, M. musculus
tctccagctccctccc

SEQ ID NO: 435445 - DNA, 16 bp, M. musculus
tctccagctccttcat

SEQ ID NO: 435446 - DNA, 16 bp, M. musculus
tctccagcttctggct

SEQ ID NO: 435447 - DNA, 16 bp, M. musculus
tctccaggaatccagc

SEQ ID NO: 435448 - DNA, 16 bp, M. musculus
tctccaggaatcttcc

SEQ ID NO: 435449 - DNA, 16 bp, M. musculus
tctccaggattgcctc

SEQ ID NO: 435450 - DNA, 16 bp, M. musculus
tctccaggccatgtgg

SEQ ID NO: 435451 - DNA, 16 bp, M. musculus
tctccaggttctccca

SEQ ID NO: 435452 - DNA, 16 bp, M. musculus
tctccagtctctctct

SEQ ID NO: 435453 - DNA, 24 bp, M. musculus
tctccagtgatactgccaagtaac

SEQ ID NO: 435454 - DNA, 16 bp, M. musculus
tctccagtttcatctc

SEQ ID NO: 435455 - DNA, 16 bp, M. musculus
tctccagttttgcctc

SEQ ID NO: 435456 - DNA, 16 bp, M. musculus
tctccatagcaagttc

SEQ ID NO: 435457 - DNA, 16 bp, M. musculus
tctccatatagccctg

SEQ ID NO: 435458 - DNA, 16 bp, M. musculus
tctccatcaaattcct

SEQ ID NO: 435459 - DNA, 16 bp, M. musculus
tctccatcaccttctg

SEQ ID NO: 435460 - DNA, 16 bp, M. musculus
tctccatccatccatc

SEQ ID NO: 435461 - DNA, 16 bp, M. musculus
tctccatccctgacct

SEQ ID NO: 435462 - DNA, 16 bp, M. musculus
tctccatctctgccct

SEQ ID NO: 435463 - DNA, 16 bp, M. musculus
tctccatctctgcctt

SEQ ID NO: 435464 - DNA, 16 bp, M. musculus
tctccatcttcccaga

SEQ ID NO: 435465 - DNA, 16 bp, M. musculus
tctccatgaggatgtc

SEQ ID NO: 435466 - DNA, 16 bp, M. musculus
tctccatgcaatgctg

SEQ ID NO: 435467 - DNA, 16 bp, M. musculus
tctccatggcctctgc

SEQ ID NO: 435468 - DNA, 16 bp, M. musculus
tctccatggtaatctg

SEQ ID NO: 435469 - DNA, 16 bp, M. musculus
tctccatgtagaccag

SEQ ID NO: 435470 - DNA, 16 bp, M. musculus
tctccatgttcaatga

SEQ ID NO: 435471 - DNA, 16 bp, M. musculus
tctccatgttcagtga

SEQ ID NO: 435472 - DNA, 16 bp, M. musculus
tctccatttctgtttt

SEQ ID NO: 435473 - DNA, 16 bp, M. musculus
tctccattttatatat

SEQ ID NO: 435474 - DNA, 16 bp, M. musculus
tctccattttcattcc

SEQ ID NO: 435475 - DNA, 16 bp, M. musculus
tctcccaaacaacaac

SEQ ID NO: 435476 - DNA, 16 bp, M. musculus
tctcccaaatcagcat

SEQ ID NO: 435477 - DNA, 16 bp, M. musculus
tctcccaaatgctgga

SEQ ID NO: 435478 - DNA, 16 bp, M. musculus
tctcccaagtactgag

SEQ ID NO: 435479 - DNA, 16 bp, M. musculus
tctcccaagtgctgag

SEQ ID NO: 435480 - DNA, 16 bp, M. musculus
tctcccaagttctggg

SEQ ID NO: 435481 - DNA, 16 bp, M. musculus
tctcccacagaggcca

SEQ ID NO: 435482 - DNA, 16 bp, M. musculus
tctcccaccagcaatg

SEQ ID NO: 435483 - DNA, 17 bp, M. musculus
tctcccacctggaactg

SEQ ID NO: 435484 - DNA, 16 bp, M. musculus
tctcccactctgtagt

SEQ ID NO: 435485 - DNA, 16 bp, M. musculus
tctcccagaagtactg

SEQ ID NO: 435486 - DNA, 16 bp, M. musculus
tctcccagaggccctg

SEQ ID NO: 435487 - DNA, 16 bp, M. musculus
tctcccagatgcctct

SEQ ID NO: 435488 - DNA, 16 bp, M. musculus
tctcccagcagccatc

SEQ ID NO: 435489 - DNA, 16 bp, M. musculus
tctcccagcctctgcc

SEQ ID NO: 435490 - DNA, 16 bp, M. musculus
tctcccagcctgaaac

SEQ ID NO: 435491 - DNA, 16 bp, M. musculus
tctcccaggaggtctg

SEQ ID NO: 435492 - DNA, 16 bp, M. musculus
tctcccaggagtgctg

SEQ ID NO: 435493 - DNA, 16 bp, M. musculus
tctcccaggtctgttg

SEQ ID NO: 435494 - DNA, 16 bp, M. musculus
tctcccagttccttcc

SEQ ID NO: 435495 - DNA, 16 bp, M. musculus
tctcccatcccaggtc

SEQ ID NO: 435496 - DNA, 16 bp, M. musculus
tctcccattaccaaga

SEQ ID NO: 435497 - DNA, 16 bp, M. musculus
tctcccattgatgtcc

SEQ ID NO: 435498 - DNA, 16 bp, M. musculus
tctccccacagccctg

SEQ ID NO: 435499 - DNA, 16 bp, M. musculus
tctccccaccctggca

SEQ ID NO: 435500 - DNA, 16 bp, M. musculus
tctccccactgtaggg

SEQ ID NO: 435501 - DNA, 16 bp, M. musculus
tctccccagccatccc

SEQ ID NO: 435502 - DNA, 16 bp, M. musculus
tctccccagcccacag

SEQ ID NO: 435503 - DNA, 16 bp, M. musculus
tctccccagccctctc

SEQ ID NO: 435504 - DNA, 16 bp, M. musculus
tctccccagccctgca

SEQ ID NO: 435505 - DNA, 16 bp, M. musculus
tctccccagcctcctc

SEQ ID NO: 435506 - DNA, 16 bp, M. musculus
tctccccagctcctcc

SEQ ID NO: 435507 - DNA, 16 bp, M. musculus
tctccccagctctgag

SEQ ID NO: 435508 - DNA, 16 bp, M. musculus
tctccccagtctcctc

SEQ ID NO: 435509 - DNA, 16 bp, M. musculus
tctccccagtttcttt

SEQ ID NO: 435510 - DNA, 16 bp, M. musculus
tctccccattgtaggg

SEQ ID NO: 435511 - DNA, 16 bp, M. musculus
tctcccccaagttgct

SEQ ID NO: 435512 - DNA, 16 bp, M. musculus
tctcccccaccctgct

SEQ ID NO: 435513 - DNA, 16 bp, M. musculus
tctcccctattatttg

SEQ ID NO: 435514 - DNA, 16 bp, M. musculus
tctcccctgcccccat

SEQ ID NO: 435515 - DNA, 16 bp, M. musculus
tctcccctgtgcccat

SEQ ID NO: 435516 - DNA, 16 bp, M. musculus
tctcccctttattggg

SEQ ID NO: 435517 - DNA, 16 bp, M. musculus
tctcccctttggaaac

SEQ ID NO: 435518 - DNA, 16 bp, M. musculus
tctccctactgtctgg

SEQ ID NO: 435519 - DNA, 16 bp, M. musculus
tctccctcagcctcct

SEQ ID NO: 435520 - DNA, 16 bp, M. musculus
tctccctcagcctctc

SEQ ID NO: 435521 - DNA, 16 bp, M. musculus
tctccctctaccaaat

SEQ ID NO: 435522 - DNA, 16 bp, M. musculus
tctccctctcccagca

SEQ ID NO: 435523 - DNA, 16 bp, M. musculus
tctccctctctctgac

SEQ ID NO: 435524 - DNA, 16 bp, M. musculus
tctccctctctctgtg

SEQ ID NO: 435525 - DNA, 16 bp, M. musculus
tctccctctggaacca

SEQ ID NO: 435526 - DNA, 16 bp, M. musculus
tctccctctgtgtctc

SEQ ID NO: 435527 - DNA, 16 bp, M. musculus
tctccctctgtgtgtg

SEQ ID NO: 435528 - DNA, 16 bp, M. musculus
tctccctgacaagaaa

SEQ ID NO: 435529 - DNA, 16 bp, M. musculus
tctccctgcccagtca

SEQ ID NO: 435530 - DNA, 16 bp, M. musculus
tctccctgcccccatc

SEQ ID NO: 435531 - DNA, 16 bp, M. musculus
tctccctgcctcagcc

SEQ ID NO: 435532 - DNA, 16 bp, M. musculus
tctccctgcctctacc

SEQ ID NO: 435533 - DNA, 16 bp, M. musculus
tctccctgctccccaa

SEQ ID NO: 435534 - DNA, 16 bp, M. musculus
tctccctggcctggag

SEQ ID NO: 435535 - DNA, 17 bp, M. musculus
tctccctgtcttaatct

SEQ ID NO: 435536 - DNA, 16 bp, M. musculus
tctcccttaaaaaaaa

SEQ ID NO: 435537 - DNA, 16 bp, M. musculus
tctccctttcagcttc

SEQ ID NO: 435538 - DNA, 16 bp, M. musculus
tctccctttctcagca

SEQ ID NO: 435539 - DNA, 16 bp, M. musculus
tctccgtctccgtctc

SEQ ID NO: 435540 - DNA, 20 bp, M. musculus
tctccgttaaccggagaaaa

SEQ ID NO: 435541 - DNA, 16 bp, M. musculus
tctcctaaacataata

SEQ ID NO: 435542 - DNA, 16 bp, M. musculus
tctcctacagggttgc

SEQ ID NO: 435543 - DNA, 16 bp, M. musculus
tctcctacctcctgag

SEQ ID NO: 435544 - DNA, 16 bp, M. musculus
tctcctactgaggcta

SEQ ID NO: 435545 - DNA, 16 bp, M. musculus
tctcctagaaatggct

SEQ ID NO: 435546 - DNA, 16 bp, M. musculus
tctcctagctcttcca

SEQ ID NO: 435547 - DNA, 16 bp, M. musculus
tctcctagtgctcaag

SEQ ID NO: 435548 - DNA, 16 bp, M. musculus
tctcctcacagcaatg

SEQ ID NO: 435549 - DNA, 16 bp, M. musculus
tctcctcactgttggg

SEQ ID NO: 435550 - DNA, 16 bp, M. musculus
tctcctcagaaaagag

SEQ ID NO: 435551 - DNA, 16 bp, M. musculus
tctcctcagaccccaa

SEQ ID NO: 435552 - DNA, 16 bp, M. musculus
tctcctcagagaagtg

SEQ ID NO: 435553 - DNA, 16 bp, M. musculus
tctcctcagagctcag

SEQ ID NO: 435554 - DNA, 16 bp, M. musculus
tctcctcagctcagtt

SEQ ID NO: 435555 - DNA, 16 bp, M. musculus
tctcctcagcttcttc

SEQ ID NO: 435556 - DNA, 16 bp, M. musculus
tctcctcagcttcttt

SEQ ID NO: 435557 - DNA, 16 bp, M. musculus
tctcctcagtgctggg

SEQ ID NO: 435558 - DNA, 16 bp, M. musculus
tctcctcagtttcatg

SEQ ID NO: 435559 - DNA, 16 bp, M. musculus
tctcctcatgaaagtg

SEQ ID NO: 435560 - DNA, 16 bp, M. musculus
tctcctccaaaaatcc

SEQ ID NO: 435561 - DNA, 16 bp, M. musculus
tctcctccatggcctc

SEQ ID NO: 435562 - DNA, 16 bp, M. musculus
tctcctcccaatgatg

SEQ ID NO: 435563 - DNA, 16 bp, M. musculus
tctcctcccagcccca

SEQ ID NO: 435564 - DNA, 16 bp, M. musculus
tctcctcccagtcctg

SEQ ID NO: 435565 - DNA, 16 bp, M. musculus
tctcctcccattgata

SEQ ID NO: 435566 - DNA, 16 bp, M. musculus
tctcctcccattgatg

SEQ ID NO: 435567 - DNA, 16 bp, M. musculus
tctcctccccagctct

SEQ ID NO: 435568 - DNA, 16 bp, M. musculus
tctcctcccctagggc

SEQ ID NO: 435569 - DNA, 16 bp, M. musculus
tctcctccctcccaag

SEQ ID NO: 435570 - DNA, 16 bp, M. musculus
tctcctcctcagacct

SEQ ID NO: 435571 - DNA, 16 bp, M. musculus
tctcctcctgcaggga

SEQ ID NO: 435572 - DNA, 16 bp, M. musculus
tctcctcctgctgcct

SEQ ID NO: 435573 - DNA, 16 bp, M. musculus
tctcctcctgcttcta

SEQ ID NO: 435574 - DNA, 16 bp, M. musculus
tctcctcctggctgcc

SEQ ID NO: 435575 - DNA, 16 bp, M. musculus
tctcctcctggctgtc

SEQ ID NO: 435576 - DNA, 16 bp, M. musculus
tctcctctcctcacat

SEQ ID NO: 435577 - DNA, 16 bp, M. musculus
tctcctctgacctctg

SEQ ID NO: 435578 - DNA, 16 bp, M. musculus
tctcctctgccctcca

SEQ ID NO: 435579 - DNA, 17 bp, M. musculus
tctcctctggcaaggaa

SEQ ID NO: 435580 - DNA, 16 bp, M. musculus
tctcctctggcctcca

SEQ ID NO: 435581 - DNA, 16 bp, M. musculus
tctcctctggtgggaa

SEQ ID NO: 435582 - DNA, 16 bp, M. musculus
tctcctctgtcacatt

SEQ ID NO: 435583 - DNA, 16 bp, M. musculus
tctcctctgtgtctct

SEQ ID NO: 435584 - DNA, 16 bp, M. musculus
tctcctcttgctcctg

SEQ ID NO: 435585 - DNA, 16 bp, M. musculus
tctcctctttggtggc

SEQ ID NO: 435586 - DNA, 16 bp, M. musculus
tctcctgaattgctct

SEQ ID NO: 435587 - DNA, 16 bp, M. musculus
tctcctgacctctgtg

SEQ ID NO: 435588 - DNA, 16 bp, M. musculus
tctcctgacttcctca

SEQ ID NO: 435589 - DNA, 17 bp, M. musculus
tctcctgagaggctcta

SEQ ID NO: 435590 - DNA, 16 bp, M. musculus
tctcctgagaggttct

SEQ ID NO: 435591 - DNA, 16 bp, M. musculus
tctcctgagagtcttt

SEQ ID NO: 435592 - DNA, 16 bp, M. musculus
tctcctgagagtttct

SEQ ID NO: 435593 - DNA, 16 bp, M. musculus
tctcctgagcagactg

SEQ ID NO: 435594 - DNA, 16 bp, M. musculus
tctcctgagtactgca

SEQ ID NO: 435595 - DNA, 16 bp, M. musculus
tctcctgagtgccagg

SEQ ID NO: 435596 - DNA, 16 bp, M. musculus
tctcctgagtgctgag

SEQ ID NO: 435597 - DNA, 16 bp, M. musculus
tctcctgcagaacaca

SEQ ID NO: 435598 - DNA, 16 bp, M. musculus
tctcctgccccagcct

SEQ ID NO: 435599 - DNA, 16 bp, M. musculus
tctcctgccctgtgtc

SEQ ID NO: 435600 - DNA, 16 bp, M. musculus
tctcctgcctcagtct

SEQ ID NO: 435601 - DNA, 16 bp, M. musculus
tctcctgcctcagttt

SEQ ID NO: 435602 - DNA, 16 bp, M. musculus
tctcctgcctccaccc

SEQ ID NO: 435603 - DNA, 16 bp, M. musculus
tctcctgcctccacct

SEQ ID NO: 435604 - DNA, 16 bp, M. musculus
tctcctgcctcctgtc

SEQ ID NO: 435605 - DNA, 16 bp, M. musculus
tctcctgcctctgtgt

SEQ ID NO: 435606 - DNA, 16 bp, M. musculus
tctcctgcctgctgca

SEQ ID NO: 435607 - DNA, 16 bp, M. musculus
tctcctgctctgatga

SEQ ID NO: 435608 - DNA, 16 bp, M. musculus
tctcctgctgctgcct

SEQ ID NO: 435609 - DNA, 16 bp, M. musculus
tctcctgctgcttcct

SEQ ID NO: 435610 - DNA, 16 bp, M. musculus
tctcctggaattgtgg

SEQ ID NO: 435611 - DNA, 16 bp, M. musculus
tctcctggacctctgg

SEQ ID NO: 435612 - DNA, 16 bp, M. musculus
tctcctggagtgtctg

SEQ ID NO: 435613 - DNA, 16 bp, M. musculus
tctcctggccagtcag

SEQ ID NO: 435614 - DNA, 16 bp, M. musculus
tctcctggcctccatg

SEQ ID NO: 435615 - DNA, 16 bp, M. musculus
tctcctggctcccaaa

SEQ ID NO: 435616 - DNA, 16 bp, M. musculus
tctcctggcttccttc

SEQ ID NO: 435617 - DNA, 16 bp, M. musculus
tctcctgggactggag

SEQ ID NO: 435618 - DNA, 16 bp, M. musculus
tctcctgggaggctct

SEQ ID NO: 435619 - DNA, 16 bp, M. musculus
tctcctgggcctctgg

SEQ ID NO: 435620 - DNA, 16 bp, M. musculus
tctcctgggctgtttc

SEQ ID NO: 435621 - DNA, 16 bp, M. musculus
tctcctggtaggcctg

SEQ ID NO: 435622 - DNA, 16 bp, M. musculus
tctcctggtgtccctc

SEQ ID NO: 435623 - DNA, 16 bp, M. musculus
tctcctggtgtccttc

SEQ ID NO: 435624 - DNA, 17 bp, M. musculus
tctcctgtagtaagctt

SEQ ID NO: 435625 - DNA, 16 bp, M. musculus
tctcctgtatgtgttt

SEQ ID NO: 435626 - DNA, 27 bp, M. musculus
tctcctgtatttctttaagtgagttat

SEQ ID NO: 435627 - DNA, 16 bp, M. musculus
tctcctgtctcctgtc

SEQ ID NO: 435628 - DNA, 16 bp, M. musculus
tctcctgtctctgcct

SEQ ID NO: 435629 - DNA, 16 bp, M. musculus
tctcctgtgcccatgt

SEQ ID NO: 435630 - DNA, 16 bp, M. musculus
tctcctgtggggactg

SEQ ID NO: 435631 - DNA, 16 bp, M. musculus
tctcctgtgtatgtgt

SEQ ID NO: 435632 - DNA, 16 bp, M. musculus
tctcctgtgtctgctt

SEQ ID NO: 435633 - DNA, 16 bp, M. musculus
tctcctgtgtgagata

SEQ ID NO: 435634 - DNA, 16 bp, M. musculus
tctcctgtgtgctctc

SEQ ID NO: 435635 - DNA, 16 bp, M. musculus
tctcctgtgtgtgtct

SEQ ID NO: 435636 - DNA, 16 bp, M. musculus
tctcctgtttctgcct

SEQ ID NO: 435637 - DNA, 24 bp, M. musculus
tctccttaaacaggcagaagaggg

SEQ ID NO: 435638 - DNA, 16 bp, M. musculus
tctccttacagatggt

SEQ ID NO: 435639 - DNA, 16 bp, M. musculus
tctccttagtggcagc

SEQ ID NO: 435640 - DNA, 16 bp, M. musculus
tctccttatttgctcc

SEQ ID NO: 435641 - DNA, 16 bp, M. musculus
tctccttcaaattcac

SEQ ID NO: 435642 - DNA, 16 bp, M. musculus
tctccttcaggtctgg

SEQ ID NO: 435643 - DNA, 16 bp, M. musculus
tctccttcagtccttt

SEQ ID NO: 435644 - DNA, 16 bp, M. musculus
tctccttcatctctat

SEQ ID NO: 435645 - DNA, 16 bp, M. musculus
tctccttccaccttgg

SEQ ID NO: 435646 - DNA, 16 bp, M. musculus
tctccttccactgtgt

SEQ ID NO: 435647 - DNA, 16 bp, M. musculus
tctccttcccagccac

SEQ ID NO: 435648 - DNA, 18 bp, M. musculus
tctccttcgggtctggga

SEQ ID NO: 435649 - DNA, 16 bp, M. musculus
tctccttctacaatgt

SEQ ID NO: 435650 - DNA, 16 bp, M. musculus
tctccttctaccacgt

SEQ ID NO: 435651 - DNA, 16 bp, M. musculus
tctccttctcccatgt

SEQ ID NO: 435652 - DNA, 16 bp, M. musculus
tctccttctctgacct

SEQ ID NO: 435653 - DNA, 16 bp, M. musculus
tctccttctctgagga

SEQ ID NO: 435654 - DNA, 16 bp, M. musculus
tctccttctgccttta

SEQ ID NO: 435655 - DNA, 16 bp, M. musculus
tctccttctgttgcct

SEQ ID NO: 435656 - DNA, 16 bp, M. musculus
tctccttcttctctga

SEQ ID NO: 435657 - DNA, 16 bp, M. musculus
tctccttgcctctgtc

SEQ ID NO: 435658 - DNA, 16 bp, M. musculus
tctccttgccttctga

SEQ ID NO: 435659 - DNA, 16 bp, M. musculus
tctccttgctgcctgc

SEQ ID NO: 435660 - DNA, 16 bp, M. musculus
tctccttggctcacta

SEQ ID NO: 435661 - DNA, 16 bp, M. musculus
tctcctttgaggactg

SEQ ID NO: 435662 - DNA, 16 bp, M. musculus
tctcctttgcctctga

SEQ ID NO: 435663 - DNA, 16 bp, M. musculus
tctcctttgtgctgag

SEQ ID NO: 435664 - DNA, 16 bp, M. musculus
tctcctttgttctgag

SEQ ID NO: 435665 - DNA, 16 bp, M. musculus
tctccttttcattcag

SEQ ID NO: 435666 - DNA, 16 bp, M. musculus
tctccttttgggtttg

SEQ ID NO: 435667 - DNA, 16 bp, M. musculus
tctcctttttttaaaa

SEQ ID NO: 435668 - DNA, 18 bp, M. musculus
tctcgcctttcccagaaa

SEQ ID NO: 435669 - DNA, 16 bp, M. musculus
tctcggaaaaccaaaa

SEQ ID NO: 435670 - DNA, 16 bp, M. musculus
tctcgggcatcccaga

SEQ ID NO: 435671 - DNA, 16 bp, M. musculus
tctcggggggaaaaaa

SEQ ID NO: 435672 - DNA, 16 bp, M. musculus
tctcggtaaagagaca

SEQ ID NO: 435673 - DNA, 16 bp, M. musculus
tctctaaaaaaagaaa

SEQ ID NO: 435674 - DNA, 16 bp, M. musculus
tctctaaaggaacaga

SEQ ID NO: 435675 - DNA, 16 bp, M. musculus
tctctaacacctccat

SEQ ID NO: 435676 - DNA, 16 bp, M. musculus
tctctaactacatccc

SEQ ID NO: 435677 - DNA, 16 bp, M. musculus
tctctaactcctccaa

SEQ ID NO: 435678 - DNA, 16 bp, M. musculus
tctctaagtaaataaa

SEQ ID NO: 435679 - DNA, 16 bp, M. musculus
tctctaattttgttaa

SEQ ID NO: 435680 - DNA, 16 bp, M. musculus
tctctaattttgttga

SEQ ID NO: 435681 - DNA, 16 bp, M. musculus
tctctacaaagatgtg

SEQ ID NO: 435682 - DNA, 19 bp, M. musculus
tctctacaaagatgtgatg

SEQ ID NO: 435683 - DNA, 16 bp, M. musculus
tctctacacacacaca

SEQ ID NO: 435684 - DNA, 16 bp, M. musculus
tctctacatagccctg

SEQ ID NO: 435685 - DNA, 16 bp, M. musculus
tctctacatagccttg

SEQ ID NO: 435686 - DNA, 16 bp, M. musculus
tctctaccactgagct

SEQ ID NO: 435687 - DNA, 16 bp, M. musculus
tctctaccctctttgt

SEQ ID NO: 435688 - DNA, 16 bp, M. musculus
tctctaccttaatttt

SEQ ID NO: 435689 - DNA, 16 bp, M. musculus
tctctaccttagtttt

SEQ ID NO: 435690 - DNA, 16 bp, M. musculus
tctctacttcctgtct

SEQ ID NO: 435691 - DNA, 16 bp, M. musculus
tctctagagcagcatc

SEQ ID NO: 435692 - DNA, 16 bp, M. musculus
tctctagaggaacaga

SEQ ID NO: 435693 - DNA, 16 bp, M. musculus
tctctagccctccttt

SEQ ID NO: 435694 - DNA, 16 bp, M. musculus
tctctagccctggctg

SEQ ID NO: 435695 - DNA, 16 bp, M. musculus
tctctagctctttctt

SEQ ID NO: 435696 - DNA, 16 bp, M. musculus
tctctagtttctcttt

SEQ ID NO: 435697 - DNA, 16 bp, M. musculus
tctctataggttctct

SEQ ID NO: 435698 - DNA, 16 bp, M. musculus
tctctatatatgtata

SEQ ID NO: 435699 - DNA, 16 bp, M. musculus
tctctatcatctatat

SEQ ID NO: 435700 - DNA, 16 bp, M. musculus
tctctatgactttgag

SEQ ID NO: 435701 - DNA, 16 bp, M. musculus
tctctatgagtttaag

SEQ ID NO: 435702 - DNA, 16 bp, M. musculus
tctctatgtagccaag

SEQ ID NO: 435703 - DNA, 16 bp, M. musculus
tctctatgtatccctg

SEQ ID NO: 435704 - DNA, 16 bp, M. musculus
tctctatgtgtctgtc

SEQ ID NO: 435705 - DNA, 16 bp, M. musculus
tctctatttccatccc

SEQ ID NO: 435706 - DNA, 16 bp, M. musculus
tctctcaaaaaataaa

SEQ ID NO: 435707 - DNA, 16 bp, M. musculus
tctctcaaagcccacc

SEQ ID NO: 435708 - DNA, 16 bp, M. musculus
tctctcaagtgctggg

SEQ ID NO: 435709 - DNA, 16 bp, M. musculus
tctctcaatgaagtga

SEQ ID NO: 435710 - DNA, 16 bp, M. musculus
tctctcacacacacaa

SEQ ID NO: 435711 - DNA, 16 bp, M. musculus
tctctcacacacataa

SEQ ID NO: 435712 - DNA, 16 bp, M. musculus
tctctcactaagcctg

SEQ ID NO: 435713 - DNA, 16 bp, M. musculus
tctctcactcctccat

SEQ ID NO: 435714 - DNA, 16 bp, M. musculus
tctctcactctcagca

SEQ ID NO: 435715 - DNA, 16 bp, M. musculus
tctctcactgaaccca

SEQ ID NO: 435716 - DNA, 16 bp, M. musculus
tctctcactgaacctg

SEQ ID NO: 435717 - DNA, 16 bp, M. musculus
tctctcactgagcctg

SEQ ID NO: 435718 - DNA, 16 bp, M. musculus
tctctcactggccttg

SEQ ID NO: 435719 - DNA, 16 bp, M. musculus
tctctcagacaccgag

SEQ ID NO: 435720 - DNA, 16 bp, M. musculus
tctctcagagactagt

SEQ ID NO: 435721 - DNA, 16 bp, M. musculus
tctctcagaggacagc

SEQ ID NO: 435722 - DNA, 16 bp, M. musculus
tctctcagcagccatt

SEQ ID NO: 435723 - DNA, 16 bp, M. musculus
tctctcagcattcctt

SEQ ID NO: 435724 - DNA, 16 bp, M. musculus
tctctcagcctctcag

SEQ ID NO: 435725 - DNA, 16 bp, M. musculus
tctctcagctacttct

SEQ ID NO: 435726 - DNA, 16 bp, M. musculus
tctctcagctcccagg

SEQ ID NO: 435727 - DNA, 16 bp, M. musculus
tctctcagcttcttgc

SEQ ID NO: 435728 - DNA, 16 bp, M. musculus
tctctcagggaagtga

SEQ ID NO: 435729 - DNA, 16 bp, M. musculus
tctctcagtccctgct

SEQ ID NO: 435730 - DNA, 16 bp, M. musculus
tctctcatatattaca

SEQ ID NO: 435731 - DNA, 16 bp, M. musculus
tctctcatcccagtgc

SEQ ID NO: 435732 - DNA, 16 bp, M. musculus
tctctcatctctctgt

SEQ ID NO: 435733 - DNA, 16 bp, M. musculus
tctctcatctctggga

SEQ ID NO: 435734 - DNA, 16 bp, M. musculus
tctctcatctctgggg

SEQ ID NO: 435735 - DNA, 19 bp, M. musculus
tctctcatctgattggtta

SEQ ID NO: 435736 - DNA, 16 bp, M. musculus
tctctcatgtgtgtat

SEQ ID NO: 435737 - DNA, 16 bp, M. musculus
tctctcattctcagtt

SEQ ID NO: 435738 - DNA, 16 bp, M. musculus
tctctcattgacctgg

SEQ ID NO: 435739 - DNA, 16 bp, M. musculus
tctctcattggcttgg

SEQ ID NO: 435740 - DNA, 16 bp, M. musculus
tctctccaaaactttt

SEQ ID NO: 435741 - DNA, 16 bp, M. musculus
tctctccaaccccagt

SEQ ID NO: 435742 - DNA, 16 bp, M. musculus
tctctccaacccctgt

SEQ ID NO: 435743 - DNA, 16 bp, M. musculus
tctctccacttaattt

SEQ ID NO: 435744 - DNA, 16 bp, M. musculus
tctctccagaaatcaa

SEQ ID NO: 435745 - DNA, 16 bp, M. musculus
tctctccagacccctg

SEQ ID NO: 435746 - DNA, 16 bp, M. musculus
tctctccagacccttg

SEQ ID NO: 435747 - DNA, 16 bp, M. musculus
tctctccagcacccct

SEQ ID NO: 435748 - DNA, 16 bp, M. musculus
tctctccagcacctca

SEQ ID NO: 435749 - DNA, 16 bp, M. musculus
tctctccagcagccat

SEQ ID NO: 435750 - DNA, 16 bp, M. musculus
tctctccagcatctct

SEQ ID NO: 435751 - DNA, 16 bp, M. musculus
tctctccagccacaac

SEQ ID NO: 435752 - DNA, 16 bp, M. musculus
tctctccagcccaaga

SEQ ID NO: 435753 - DNA, 16 bp, M. musculus
tctctccagcccagaa

SEQ ID NO: 435754 - DNA, 16 bp, M. musculus
tctctccagcccagcc

SEQ ID NO: 435755 - DNA, 16 bp, M. musculus
tctctccagcccagct

SEQ ID NO: 435756 - DNA, 16 bp, M. musculus
tctctccagcccaggg

SEQ ID NO: 435757 - DNA, 16 bp, M. musculus
tctctccagccccaat

SEQ ID NO: 435758 - DNA, 16 bp, M. musculus
tctctccagccccagg

SEQ ID NO: 435759 - DNA, 16 bp, M. musculus
tctctccagccccata

SEQ ID NO: 435760 - DNA, 16 bp, M. musculus
tctctccagcccccaa

SEQ ID NO: 435761 - DNA, 16 bp, M. musculus
tctctccagcccccag

SEQ ID NO: 435762 - DNA, 16 bp, M. musculus
tctctccagcccccat

SEQ ID NO: 435763 - DNA, 16 bp, M. musculus
tctctccagcccctgc

SEQ ID NO: 435764 - DNA, 16 bp, M. musculus
tctctccagcccctgt

SEQ ID NO: 435765 - DNA, 16 bp, M. musculus
tctctccagccctcaa

SEQ ID NO: 435766 - DNA, 16 bp, M. musculus
tctctccagccctggc

SEQ ID NO: 435767 - DNA, 16 bp, M. musculus
tctctccagcccttgg

SEQ ID NO: 435768 - DNA, 16 bp, M. musculus
tctctccagccctttc

SEQ ID NO: 435769 - DNA, 16 bp, M. musculus
tctctccagcctcctc

SEQ ID NO: 435770 - DNA, 16 bp, M. musculus
tctctccagcctctac

SEQ ID NO: 435771 - DNA, 16 bp, M. musculus
tctctccagcctctgt

SEQ ID NO: 435772 - DNA, 16 bp, M. musculus
tctctccagcctgaca

SEQ ID NO: 435773 - DNA, 16 bp, M. musculus
tctctccagcctgctt

SEQ ID NO: 435774 - DNA, 16 bp, M. musculus
tctctccagcctgtgt

SEQ ID NO: 435775 - DNA, 16 bp, M. musculus
tctctccagccttatt

SEQ ID NO: 435776 - DNA, 16 bp, M. musculus
tctctccagctccagt

SEQ ID NO: 435777 - DNA, 16 bp, M. musculus
tctctccagctcccta

SEQ ID NO: 435778 - DNA, 16 bp, M. musculus
tctctccagctctgag

SEQ ID NO: 435779 - DNA, 16 bp, M. musculus
tctctccagctctggg

SEQ ID NO: 435780 - DNA, 16 bp, M. musculus
tctctccagcttcctc

SEQ ID NO: 435781 - DNA, 16 bp, M. musculus
tctctccaggcaagct

SEQ ID NO: 435782 - DNA, 16 bp, M. musculus
tctctccaggcccaga

SEQ ID NO: 435783 - DNA, 16 bp, M. musculus
tctctccaggcccagg

SEQ ID NO: 435784 - DNA, 16 bp, M. musculus
tctctccagtcccaga

SEQ ID NO: 435785 - DNA, 16 bp, M. musculus
tctctccagtcccatg

SEQ ID NO: 435786 - DNA, 16 bp, M. musculus
tctctccagtccccaa

SEQ ID NO: 435787 - DNA, 16 bp, M. musculus
tctctccagtcccctc

SEQ ID NO: 435788 - DNA, 16 bp, M. musculus
tctctccagtcccctt

SEQ ID NO: 435789 - DNA, 16 bp, M. musculus
tctctccagtccctcc

SEQ ID NO: 435790 - DNA, 16 bp, M. musculus
tctctccagtcccttg

SEQ ID NO: 435791 - DNA, 16 bp, M. musculus
tctctccagtcctcct

SEQ ID NO: 435792 - DNA, 16 bp, M. musculus
tctctccagttccctc

SEQ ID NO: 435793 - DNA, 16 bp, M. musculus
tctctccatagccctg

SEQ ID NO: 435794 - DNA, 16 bp, M. musculus
tctctccatctctgtg

SEQ ID NO: 435795 - DNA, 16 bp, M. musculus
tctctccatgtatact

SEQ ID NO: 435796 - DNA, 16 bp, M. musculus
tctctcccaagtggaa

SEQ ID NO: 435797 - DNA, 16 bp, M. musculus
tctctccctctgtgtg

SEQ ID NO: 435798 - DNA, 16 bp, M. musculus
tctctccctgccccca

SEQ ID NO: 435799 - DNA, 16 bp, M. musculus
tctctcctcccattga

SEQ ID NO: 435800 - DNA, 16 bp, M. musculus
tctctcctctcacctg

SEQ ID NO: 435801 - DNA, 16 bp, M. musculus
tctctcctctccagga

SEQ ID NO: 435802 - DNA, 16 bp, M. musculus
tctctcctctctgcca

SEQ ID NO: 435803 - DNA, 16 bp, M. musculus
tctctcctgagtttta

SEQ ID NO: 435804 - DNA, 16 bp, M. musculus
tctctcctgccatgtg

SEQ ID NO: 435805 - DNA, 16 bp, M. musculus
tctctcctgctgctct

SEQ ID NO: 435806 - DNA, 16 bp, M. musculus
tctctcctggcctcca

SEQ ID NO: 435807 - DNA, 16 bp, M. musculus
tctctcctgtctgtct

SEQ ID NO: 435808 - DNA, 16 bp, M. musculus
tctctcctgtgcagac

SEQ ID NO: 435809 - DNA, 16 bp, M. musculus
tctctccttctaccat

SEQ ID NO: 435810 - DNA, 16 bp, M. musculus
tctctccttctatcat

SEQ ID NO: 435811 - DNA, 16 bp, M. musculus
tctctccttctgccat

SEQ ID NO: 435812 - DNA, 16 bp, M. musculus
tctctccttctgtcac

SEQ ID NO: 435813 - DNA, 16 bp, M. musculus
tctctccttcttctag

SEQ ID NO: 435814 - DNA, 16 bp, M. musculus
tctctcctttaaaaaa

SEQ ID NO: 435815 - DNA, 16 bp, M. musculus
tctctctacatagtcc

SEQ ID NO: 435816 - DNA, 16 bp, M. musculus
tctctctagccccatg

SEQ ID NO: 435817 - DNA, 16 bp, M. musculus
tctctctagcccctgg

SEQ ID NO: 435818 - DNA, 16 bp, M. musculus
tctctctagcccttct

SEQ ID NO: 435819 - DNA, 16 bp, M. musculus
tctctctagtttattt

SEQ ID NO: 435820 - DNA, 16 bp, M. musculus
tctctctatctctctg

SEQ ID NO: 435821 - DNA, 16 bp, M. musculus
tctctctatgtagctc

SEQ ID NO: 435822 - DNA, 16 bp, M. musculus
tctctctatgtgtgtc

SEQ ID NO: 435823 - DNA, 16 bp, M. musculus
tctctctcacacgcac

SEQ ID NO: 435824 - DNA, 16 bp, M. musculus
tctctctcagtacctc

SEQ ID NO: 435825 - DNA, 16 bp, M. musculus
tctctctcatctcaga

SEQ ID NO: 435826 - DNA, 16 bp, M. musculus
tctctctcatctgtct

SEQ ID NO: 435827 - DNA, 16 bp, M. musculus
tctctctcatgttcag

SEQ ID NO: 435828 - DNA, 16 bp, M. musculus
tctctctccacatggc

SEQ ID NO: 435829 - DNA, 16 bp, M. musculus
tctctctccagctcct

SEQ ID NO: 435830 - DNA, 16 bp, M. musculus
tctctctccctgtgtg

SEQ ID NO: 435831 - DNA, 16 bp, M. musculus
tctctctcctcactgc

SEQ ID NO: 435832 - DNA, 16 bp, M. musculus
tctctctcctcctcag

SEQ ID NO: 435833 - DNA, 16 bp, M. musculus
tctctctcctctgtgt

SEQ ID NO: 435834 - DNA, 16 bp, M. musculus
tctctctccttcatgt

SEQ ID NO: 435835 - DNA, 16 bp, M. musculus
tctctctctcagatgt

SEQ ID NO: 435836 - DNA, 16 bp, M. musculus
tctctctctcagtctc

SEQ ID NO: 435837 - DNA, 16 bp, M. musculus
tctctctctcagtgtt

SEQ ID NO: 435838 - DNA, 16 bp, M. musculus
tctctctctcatcaga

SEQ ID NO: 435839 - DNA, 16 bp, M. musculus
tctctctctcattcat

SEQ ID NO: 435840 - DNA, 16 bp, M. musculus
tctctctctccagcat

SEQ ID NO: 435841 - DNA, 16 bp, M. musculus
tctctctctccagcca

SEQ ID NO: 435842 - DNA, 16 bp, M. musculus
tctctctctccagcct

SEQ ID NO: 435843 - DNA, 16 bp, M. musculus
tctctctctccatctg

SEQ ID NO: 435844 - DNA, 16 bp, M. musculus
tctctctctccatgcc

SEQ ID NO: 435845 - DNA, 16 bp, M. musculus
tctctctctcctgctg

SEQ ID NO: 435846 - DNA, 16 bp, M. musculus
tctctctctctcctaa

SEQ ID NO: 435847 - DNA, 16 bp, M. musculus
tctctctctctctagc

SEQ ID NO: 435848 - DNA, 16 bp, M. musculus
tctctctctctctgaa

SEQ ID NO: 435849 - DNA, 16 bp, M. musculus
tctctctctctctgac

SEQ ID NO: 435850 - DNA, 16 bp, M. musculus
tctctctctctctggg

SEQ ID NO: 435851 - DNA, 16 bp, M. musculus
tctctctctctctggt

SEQ ID NO: 435852 - DNA, 16 bp, M. musculus
tctctctctctcttag

SEQ ID NO: 435853 - DNA, 16 bp, M. musculus
tctctctctctcttga

SEQ ID NO: 435854 - DNA, 16 bp, M. musculus
tctctctctctgagtc

SEQ ID NO: 435855 - DNA, 16 bp, M. musculus
tctctctctctgtcaa

SEQ ID NO: 435856 - DNA, 16 bp, M. musculus
tctctctctcttgaaa

SEQ ID NO: 435857 - DNA, 16 bp, M. musculus
tctctctctcttggtc

SEQ ID NO: 435858 - DNA, 16 bp, M. musculus
tctctctctctttaca

SEQ ID NO: 435859 - DNA, 16 bp, M. musculus
tctctctctctttagg

SEQ ID NO: 435860 - DNA, 16 bp, M. musculus
tctctctctgattcat

SEQ ID NO: 435861 - DNA, 16 bp, M. musculus
tctctctctgcctgct

SEQ ID NO: 435862 - DNA, 16 bp, M. musculus
tctctctctgtatata

SEQ ID NO: 435863 - DNA, 16 bp, M. musculus
tctctctctgtgcatg

SEQ ID NO: 435864 - DNA, 16 bp, M. musculus
tctctctctgtgtgta

SEQ ID NO: 435865 - DNA, 16 bp, M. musculus
tctctctctttcaaga

SEQ ID NO: 435866 - DNA, 16 bp, M. musculus
tctctctctttgcctg

SEQ ID NO: 435867 - DNA, 16 bp, M. musculus
tctctctcttttaaaa

SEQ ID NO: 435868 - DNA, 16 bp, M. musculus
tctctctcttttacac

SEQ ID NO: 435869 - DNA, 16 bp, M. musculus
tctctctgagtctctc

SEQ ID NO: 435870 - DNA, 16 bp, M. musculus
tctctctgatctgctt

SEQ ID NO: 435871 - DNA, 16 bp, M. musculus
tctctctgcaacctgt

SEQ ID NO: 435872 - DNA, 16 bp, M. musculus
tctctctgcagccctg

SEQ ID NO: 435873 - DNA, 16 bp, M. musculus
tctctctgcagcctgt

SEQ ID NO: 435874 - DNA, 16 bp, M. musculus
tctctctgcatagccc

SEQ ID NO: 435875 - DNA, 16 bp, M. musculus
tctctctgcccttgac

SEQ ID NO: 435876 - DNA, 16 bp, M. musculus
tctctctgcctccaga

SEQ ID NO: 435877 - DNA, 16 bp, M. musculus
tctctctgcctctggg

SEQ ID NO: 435878 - DNA, 16 bp, M. musculus
tctctctggccttctt

SEQ ID NO: 435879 - DNA, 16 bp, M. musculus
tctctctgggaagaat

SEQ ID NO: 435880 - DNA, 16 bp, M. musculus
tctctctggtctctct

SEQ ID NO: 435881 - DNA, 16 bp, M. musculus
tctctctgtagctctg

SEQ ID NO: 435882 - DNA, 16 bp, M. musculus
tctctctgtagtcctg

SEQ ID NO: 435883 - DNA, 16 bp, M. musculus
tctctctgtatacaca

SEQ ID NO: 435884 - DNA, 16 bp, M. musculus
tctctctgtatagccc

SEQ ID NO: 435885 - DNA, 16 bp, M. musculus
tctctctgtatctctc

SEQ ID NO: 435886 - DNA, 16 bp, M. musculus
tctctctgtatgtgta

SEQ ID NO: 435887 - DNA, 16 bp, M. musculus
tctctctgtcactctg

SEQ ID NO: 435888 - DNA, 16 bp, M. musculus
tctctctgtccaccat

SEQ ID NO: 435889 - DNA, 16 bp, M. musculus
tctctctgtccatcct

SEQ ID NO: 435890 - DNA, 16 bp, M. musculus
tctctctgtctctctg

SEQ ID NO: 435891 - DNA, 16 bp, M. musculus
tctctctgtctctgac

SEQ ID NO: 435892 - DNA, 16 bp, M. musculus
tctctctgtcttctgc

SEQ ID NO: 435893 - DNA, 16 bp, M. musculus
tctctctgtgcttctg

SEQ ID NO: 435894 - DNA, 16 bp, M. musculus
tctctctgtggccctg

SEQ ID NO: 435895 - DNA, 16 bp, M. musculus
tctctctgtgtccctc

SEQ ID NO: 435896 - DNA, 17 bp, M. musculus
tctctctgtgtctctct

SEQ ID NO: 435897 - DNA, 16 bp, M. musculus
tctctctgtgtgtatg

SEQ ID NO: 435898 - DNA, 16 bp, M. musculus
tctctctgtgtgtctg

SEQ ID NO: 435899 - DNA, 16 bp, M. musculus
tctctctgtgtgtgta

SEQ ID NO: 435900 - DNA, 16 bp, M. musculus
tctctctgtgtgtgtc

SEQ ID NO: 435901 - DNA, 16 bp, M. musculus
tctctcttcaactccc

SEQ ID NO: 435902 - DNA, 16 bp, M. musculus
tctctcttccatgtct

SEQ ID NO: 435903 - DNA, 16 bp, M. musculus
tctctcttcccaatga

SEQ ID NO: 435904 - DNA, 16 bp, M. musculus
tctctcttcccagatg

SEQ ID NO: 435905 - DNA, 16 bp, M. musculus
tctctcttcccagtga

SEQ ID NO: 435906 - DNA, 16 bp, M. musculus
tctctcttcccattga

SEQ ID NO: 435907 - DNA, 16 bp, M. musculus
tctctcttctagctct

SEQ ID NO: 435908 - DNA, 16 bp, M. musculus
tctctcttctatcact

SEQ ID NO: 435909 - DNA, 16 bp, M. musculus
tctctcttggtctctg

SEQ ID NO: 435910 - DNA, 16 bp, M. musculus
tctctctttaaaaaaa

SEQ ID NO: 435911 - DNA, 16 bp, M. musculus
tctctctttctgtgtg

SEQ ID NO: 435912 - DNA, 16 bp, M. musculus
tctctctttctttaga

SEQ ID NO: 435913 - DNA, 16 bp, M. musculus
tctctctttgtgtgtg

SEQ ID NO: 435914 - DNA, 16 bp, M. musculus
tctctctttttaaagt

SEQ ID NO: 435915 - DNA, 16 bp, M. musculus
tctctctttttataaa

SEQ ID NO: 435916 - DNA, 16 bp, M. musculus
tctctgaaacactgga

SEQ ID NO: 435917 - DNA, 16 bp, M. musculus
tctctgaaaccataag

SEQ ID NO: 435918 - DNA, 16 bp, M. musculus
tctctgaaacctcttg

SEQ ID NO: 435919 - DNA, 16 bp, M. musculus
tctctgaaactctttg

SEQ ID NO: 435920 - DNA, 16 bp, M. musculus
tctctgaactctggct

SEQ ID NO: 435921 - DNA, 16 bp, M. musculus
tctctgaagaaacaaa

SEQ ID NO: 435922 - DNA, 16 bp, M. musculus
tctctgaagacagcaa

SEQ ID NO: 435923 - DNA, 16 bp, M. musculus
tctctgaataaacaca

SEQ ID NO: 435924 - DNA, 16 bp, M. musculus
tctctgacaaaagaaa

SEQ ID NO: 435925 - DNA, 16 bp, M. musculus
tctctgacactgagcc

SEQ ID NO: 435926 - DNA, 16 bp, M. musculus
tctctgacctctgacc

SEQ ID NO: 435927 - DNA, 16 bp, M. musculus
tctctgactattttgc

SEQ ID NO: 435928 - DNA, 16 bp, M. musculus
tctctgactcatcctg

SEQ ID NO: 435929 - DNA, 16 bp, M. musculus
tctctgactctatctc

SEQ ID NO: 435930 - DNA, 16 bp, M. musculus
tctctgactctcttct

SEQ ID NO: 435931 - DNA, 16 bp, M. musculus
tctctgacttctgtga

SEQ ID NO: 435932 - DNA, 16 bp, M. musculus
tctctgactttggctt

SEQ ID NO: 435933 - DNA, 16 bp, M. musculus
tctctgactttgtctg

SEQ ID NO: 435934 - DNA, 16 bp, M. musculus
tctctgagaaaatcaa

SEQ ID NO: 435935 - DNA, 16 bp, M. musculus
tctctgagactttcta

SEQ ID NO: 435936 - DNA, 16 bp, M. musculus
tctctgagagaccctg

SEQ ID NO: 435937 - DNA, 16 bp, M. musculus
tctctgagccctgagg

SEQ ID NO: 435938 - DNA, 16 bp, M. musculus
tctctgagcctctgtt

SEQ ID NO: 435939 - DNA, 16 bp, M. musculus
tctctgagctcaaggt

SEQ ID NO: 435940 - DNA, 16 bp, M. musculus
tctctgaggaactgcc

SEQ ID NO: 435941 - DNA, 16 bp, M. musculus
tctctgaggagaaggg

SEQ ID NO: 435942 - DNA, 16 bp, M. musculus
tctctgaggcttgctg

SEQ ID NO: 435943 - DNA, 16 bp, M. musculus
tctctgagtggccttt

SEQ ID NO: 435944 - DNA, 16 bp, M. musculus
tctctgagttcaaaga

SEQ ID NO: 435945 - DNA, 16 bp, M. musculus
tctctgatctttgctt

SEQ ID NO: 435946 - DNA, 16 bp, M. musculus
tctctgatgaaatttt

SEQ ID NO: 435947 - DNA, 16 bp, M. musculus
tctctgatgaagactg

SEQ ID NO: 435948 - DNA, 16 bp, M. musculus
tctctgatgatgacta

SEQ ID NO: 435949 - DNA, 16 bp, M. musculus
tctctgatgatgactg

SEQ ID NO: 435950 - DNA, 16 bp, M. musculus
tctctgatgtctgtgt

SEQ ID NO: 435951 - DNA, 16 bp, M. musculus
tctctgcaacctgtct

SEQ ID NO: 435952 - DNA, 16 bp, M. musculus
tctctgcactcccagc

SEQ ID NO: 435953 - DNA, 16 bp, M. musculus
tctctgcactgttctc

SEQ ID NO: 435954 - DNA, 16 bp, M. musculus
tctctgcagcagtaca

SEQ ID NO: 435955 - DNA, 16 bp, M. musculus
tctctgcagcccctga

SEQ ID NO: 435956 - DNA, 16 bp, M. musculus
tctctgcaggatgtct

SEQ ID NO: 435957 - DNA, 16 bp, M. musculus
tctctgcaggcaagct

SEQ ID NO: 435958 - DNA, 19 bp, M. musculus
tctctgcaggcaagctctc

SEQ ID NO: 435959 - DNA, 16 bp, M. musculus
tctctgcagttctttt

SEQ ID NO: 435960 - DNA, 16 bp, M. musculus
tctctgcatctctggg

SEQ ID NO: 435961 - DNA, 16 bp, M. musculus
tctctgcatctgtttc

SEQ ID NO: 435962 - DNA, 16 bp, M. musculus
tctctgcatgtgtttc

SEQ ID NO: 435963 - DNA, 16 bp, M. musculus
tctctgcattcccttc

SEQ ID NO: 435964 - DNA, 16 bp, M. musculus
tctctgcatttccttt

SEQ ID NO: 435965 - DNA, 16 bp, M. musculus
tctctgccacctactg

SEQ ID NO: 435966 - DNA, 16 bp, M. musculus
tctctgccctcttctg

SEQ ID NO: 435967 - DNA, 16 bp, M. musculus
tctctgccctgcctct

SEQ ID NO: 435968 - DNA, 16 bp, M. musculus
tctctgcctcagaccc

SEQ ID NO: 435969 - DNA, 16 bp, M. musculus
tctctgcctcagtttc

SEQ ID NO: 435970 - DNA, 16 bp, M. musculus
tctctgcctccagagt

SEQ ID NO: 435971 - DNA, 16 bp, M. musculus
tctctgcctccatctt

SEQ ID NO: 435972 - DNA, 16 bp, M. musculus
tctctgcctcccaaat

SEQ ID NO: 435973 - DNA, 17 bp, M. musculus
tctctgcctcccaagta

SEQ ID NO: 435974 - DNA, 16 bp, M. musculus
tctctgcctcccacct

SEQ ID NO: 435975 - DNA, 16 bp, M. musculus
tctctgcctcccagtt

SEQ ID NO: 435976 - DNA, 20 bp, M. musculus
tctctgcctcccgagtgctg

SEQ ID NO: 435977 - DNA, 16 bp, M. musculus
tctctgcctcctaaat

SEQ ID NO: 435978 - DNA, 16 bp, M. musculus
tctctgcctctcagtg

SEQ ID NO: 435979 - DNA, 16 bp, M. musculus
tctctgcctctctgag

SEQ ID NO: 435980 - DNA, 16 bp, M. musculus
tctctgcctctctggt

SEQ ID NO: 435981 - DNA, 16 bp, M. musculus
tctctgcctctgctac

SEQ ID NO: 435982 - DNA, 16 bp, M. musculus
tctctgcctctgtccc

SEQ ID NO: 435983 - DNA, 16 bp, M. musculus
tctctgcctctgtctc

SEQ ID NO: 435984 - DNA, 16 bp, M. musculus
tctctgcctctgtttc

SEQ ID NO: 435985 - DNA, 16 bp, M. musculus
tctctgcctcttctgc

SEQ ID NO: 435986 - DNA, 17 bp, M. musculus
tctctgcctcttgagtg

SEQ ID NO: 435987 - DNA, 16 bp, M. musculus
tctctgcctgcagatc

SEQ ID NO: 435988 - DNA, 16 bp, M. musculus
tctctgcctgcctcct

SEQ ID NO: 435989 - DNA, 16 bp, M. musculus
tctctgcctgctgcct

SEQ ID NO: 435990 - DNA, 16 bp, M. musculus
tctctgcctgcttgct

SEQ ID NO: 435991 - DNA, 16 bp, M. musculus
tctctgccttctgagc

SEQ ID NO: 435992 - DNA, 16 bp, M. musculus
tctctgcctttctctg

SEQ ID NO: 435993 - DNA, 16 bp, M. musculus
tctctgctacacatgt

SEQ ID NO: 435994 - DNA, 16 bp, M. musculus
tctctgctccaacttt

SEQ ID NO: 435995 - DNA, 16 bp, M. musculus
tctctgctccaggtgt

SEQ ID NO: 435996 - DNA, 16 bp, M. musculus
tctctgctcctctgcc

SEQ ID NO: 435997 - DNA, 16 bp, M. musculus
tctctgctctatattt

SEQ ID NO: 435998 - DNA, 16 bp, M. musculus
tctctgctctcactga

SEQ ID NO: 435999 - DNA, 16 bp, M. musculus
tctctgctctgctctc

SEQ ID NO: 436000 - DNA, 16 bp, M. musculus
tctctgctctggactc

SEQ ID NO: 436001 - DNA, 16 bp, M. musculus
tctctgctctgtactt

SEQ ID NO: 436002 - DNA, 16 bp, M. musculus
tctctgctcttctgca

SEQ ID NO: 436003 - DNA, 16 bp, M. musculus
tctctgctcttctgtg

SEQ ID NO: 436004 - DNA, 16 bp, M. musculus
tctctgctcttggctg

SEQ ID NO: 436005 - DNA, 16 bp, M. musculus
tctctgctgagaagtc

SEQ ID NO: 436006 - DNA, 16 bp, M. musculus
tctctgctgctgctgc

SEQ ID NO: 436007 - DNA, 16 bp, M. musculus
tctctgctgtcctcca

SEQ ID NO: 436008 - DNA, 16 bp, M. musculus
tctctgctgtgtgtgt

SEQ ID NO: 436009 - DNA, 16 bp, M. musculus
tctctgcttcaggtcc

SEQ ID NO: 436010 - DNA, 16 bp, M. musculus
tctctgcttcattttt

SEQ ID NO: 436011 - DNA, 16 bp, M. musculus
tctctgcttcccatct

SEQ ID NO: 436012 - DNA, 16 bp, M. musculus
tctctgcttcctctgt

SEQ ID NO: 436013 - DNA, 16 bp, M. musculus
tctctgcttcctgagt

SEQ ID NO: 436014 - DNA, 16 bp, M. musculus
tctctgcttcctgcct

SEQ ID NO: 436015 - DNA, 16 bp, M. musculus
tctctgcttcctggtc

SEQ ID NO: 436016 - DNA, 16 bp, M. musculus
tctctgcttcctggtt

SEQ ID NO: 436017 - DNA, 16 bp, M. musculus
tctctgcttcctgtgt

SEQ ID NO: 436018 - DNA, 16 bp, M. musculus
tctctgcttctgctgt

SEQ ID NO: 436019 - DNA, 16 bp, M. musculus
tctctgcttcttcctg

SEQ ID NO: 436020 - DNA, 16 bp, M. musculus
tctctgctttctgatt

SEQ ID NO: 436021 - DNA, 16 bp, M. musculus
tctctgctttctggtt

SEQ ID NO: 436022 - DNA, 16 bp, M. musculus
tctctgcttttgactt

SEQ ID NO: 436023 - DNA, 16 bp, M. musculus
tctctgctttttaaaa

SEQ ID NO: 436024 - DNA, 16 bp, M. musculus
tctctggaaatgccct

SEQ ID NO: 436025 - DNA, 17 bp, M. musculus
tctctggaacacagcct

SEQ ID NO: 436026 - DNA, 16 bp, M. musculus
tctctggaacccagct

SEQ ID NO: 436027 - DNA, 16 bp, M. musculus
tctctggaactttcta

SEQ ID NO: 436028 - DNA, 16 bp, M. musculus
tctctggaagaatttt

SEQ ID NO: 436029 - DNA, 17 bp, M. musculus
tctctggaagagcagct

SEQ ID NO: 436030 - DNA, 16 bp, M. musculus
tctctggaagctctga

SEQ ID NO: 436031 - DNA, 16 bp, M. musculus
tctctggagagaagtc

SEQ ID NO: 436032 - DNA, 16 bp, M. musculus
tctctggagcttgctg

SEQ ID NO: 436033 - DNA, 16 bp, M. musculus
tctctggaggctgagg

SEQ ID NO: 436034 - DNA, 16 bp, M. musculus
tctctggagtcagttg

SEQ ID NO: 436035 - DNA, 16 bp, M. musculus
tctctggagtccacct

SEQ ID NO: 436036 - DNA, 16 bp, M. musculus
tctctggatagccctg

SEQ ID NO: 436037 - DNA, 16 bp, M. musculus
tctctggatgcccttt

SEQ ID NO: 436038 - DNA, 16 bp, M. musculus
tctctggatggtccct

SEQ ID NO: 436039 - DNA, 16 bp, M. musculus
tctctggccaggcctg

SEQ ID NO: 436040 - DNA, 16 bp, M. musculus
tctctggcctctctgg

SEQ ID NO: 436041 - DNA, 16 bp, M. musculus
tctctggcctttctgc

SEQ ID NO: 436042 - DNA, 16 bp, M. musculus
tctctggctctctctc

SEQ ID NO: 436043 - DNA, 16 bp, M. musculus
tctctggctggagctt

SEQ ID NO: 436044 - DNA, 16 bp, M. musculus
tctctgggaactccct

SEQ ID NO: 436045 - DNA, 16 bp, M. musculus
tctctgggacatcaag

SEQ ID NO: 436046 - DNA, 16 bp, M. musculus
tctctgggacattcta

SEQ ID NO: 436047 - DNA, 16 bp, M. musculus
tctctgggactcactg

SEQ ID NO: 436048 - DNA, 16 bp, M. musculus
tctctgggagttctga

SEQ ID NO: 436049 - DNA, 16 bp, M. musculus
tctctgggcatgcctg

SEQ ID NO: 436050 - DNA, 16 bp, M. musculus
tctctgggctggaagt

SEQ ID NO: 436051 - DNA, 16 bp, M. musculus
tctctgggctggctgt

SEQ ID NO: 436052 - DNA, 16 bp, M. musculus
tctctggggaaaaaaa

SEQ ID NO: 436053 - DNA, 16 bp, M. musculus
tctctggggcaaccag

SEQ ID NO: 436054 - DNA, 16 bp, M. musculus
tctctggggcttgctg

SEQ ID NO: 436055 - DNA, 16 bp, M. musculus
tctctggggtttgctg

SEQ ID NO: 436056 - DNA, 16 bp, M. musculus
tctctgggtcagggaa

SEQ ID NO: 436057 - DNA, 16 bp, M. musculus
tctctgggtctctctg

SEQ ID NO: 436058 - DNA, 16 bp, M. musculus
tctctgggtctgtgga

SEQ ID NO: 436059 - DNA, 16 bp, M. musculus
tctctgggtggccttt

SEQ ID NO: 436060 - DNA, 16 bp, M. musculus
tctctgggtggctttt

SEQ ID NO: 436061 - DNA, 16 bp, M. musculus
tctctggtagaaattt

SEQ ID NO: 436062 - DNA, 16 bp, M. musculus
tctctggtagactttt

SEQ ID NO: 436063 - DNA, 16 bp, M. musculus
tctctggtgactctag

SEQ ID NO: 436064 - DNA, 16 bp, M. musculus
tctctggtgagactat

SEQ ID NO: 436065 - DNA, 16 bp, M. musculus
tctctggtgctgggat

SEQ ID NO: 436066 - DNA, 16 bp, M. musculus
tctctggtggactttt

SEQ ID NO: 436067 - DNA, 16 bp, M. musculus
tctctggtggcaggag

SEQ ID NO: 436068 - DNA, 16 bp, M. musculus
tctctggtgtcattaa

SEQ ID NO: 436069 - DNA, 16 bp, M. musculus
tctctggttcattctg

SEQ ID NO: 436070 - DNA, 16 bp, M. musculus
tctctgtaaatacttc

SEQ ID NO: 436071 - DNA, 16 bp, M. musculus
tctctgtaactctgtc

SEQ ID NO: 436072 - DNA, 16 bp, M. musculus
tctctgtagagctctg

SEQ ID NO: 436073 - DNA, 17 bp, M. musculus
tctctgtagccctggct

SEQ ID NO: 436074 - DNA, 16 bp, M. musculus
tctctgtattgtcctg

SEQ ID NO: 436075 - DNA, 16 bp, M. musculus
tctctgtatttattta

SEQ ID NO: 436076 - DNA, 16 bp, M. musculus
tctctgtattttcaat

SEQ ID NO: 436077 - DNA, 16 bp, M. musculus
tctctgtcatctatct

SEQ ID NO: 436078 - DNA, 16 bp, M. musculus
tctctgtccacacatc

SEQ ID NO: 436079 - DNA, 16 bp, M. musculus
tctctgtccccacccc

SEQ ID NO: 436080 - DNA, 16 bp, M. musculus
tctctgtcctgaaact

SEQ ID NO: 436081 - DNA, 16 bp, M. musculus
tctctgtctcccagtg

SEQ ID NO: 436082 - DNA, 16 bp, M. musculus
tctctgtctccccacc

SEQ ID NO: 436083 - DNA, 16 bp, M. musculus
tctctgtctccctctg

SEQ ID NO: 436084 - DNA, 16 bp, M. musculus
tctctgtctccctgtc

SEQ ID NO: 436085 - DNA, 16 bp, M. musculus
tctctgtctcctgctt

SEQ ID NO: 436086 - DNA, 16 bp, M. musculus
tctctgtctcgtgtgt

SEQ ID NO: 436087 - DNA, 16 bp, M. musculus
tctctgtctctacctc

SEQ ID NO: 436088 - DNA, 16 bp, M. musculus
tctctgtctctctcca

SEQ ID NO: 436089 - DNA, 16 bp, M. musculus
tctctgtctctgagtg

SEQ ID NO: 436090 - DNA, 16 bp, M. musculus
tctctgtctctgtcac

SEQ ID NO: 436091 - DNA, 17 bp, M. musculus
tctctgtctctgtctct

SEQ ID NO: 436092 - DNA, 18 bp, M. musculus
tctctgtctctgtctctg

SEQ ID NO: 436093 - DNA, 16 bp, M. musculus
tctctgtctttccctg

SEQ ID NO: 436094 - DNA, 16 bp, M. musculus
tctctgtgacttcata

SEQ ID NO: 436095 - DNA, 16 bp, M. musculus
tctctgtgactttgag

SEQ ID NO: 436096 - DNA, 16 bp, M. musculus
tctctgtgagcccatg

SEQ ID NO: 436097 - DNA, 16 bp, M. musculus
tctctgtgagctcaca

SEQ ID NO: 436098 - DNA, 16 bp, M. musculus
tctctgtgagtctaag

SEQ ID NO: 436099 - DNA, 16 bp, M. musculus
tctctgtgagtctggg

SEQ ID NO: 436100 - DNA, 16 bp, M. musculus
tctctgtgagttagag

SEQ ID NO: 436101 - DNA, 16 bp, M. musculus
tctctgtgagtttaca

SEQ ID NO: 436102 - DNA, 16 bp, M. musculus
tctctgtgatttcata

SEQ ID NO: 436103 - DNA, 16 bp, M. musculus
tctctgtgcctgtctg

SEQ ID NO: 436104 - DNA, 16 bp, M. musculus
tctctgtgctctctct

SEQ ID NO: 436105 - DNA, 16 bp, M. musculus
tctctgtgcttgtgat

SEQ ID NO: 436106 - DNA, 16 bp, M. musculus
tctctgtggaaaacct

SEQ ID NO: 436107 - DNA, 16 bp, M. musculus
tctctgtggagctctg

SEQ ID NO: 436108 - DNA, 16 bp, M. musculus
tctctgtggaggtagt

SEQ ID NO: 436109 - DNA, 16 bp, M. musculus
tctctgtggccctggc

SEQ ID NO: 436110 - DNA, 16 bp, M. musculus
tctctgtggtctttgt

SEQ ID NO: 436111 - DNA, 16 bp, M. musculus
tctctgtgtaatagcc

SEQ ID NO: 436112 - DNA, 16 bp, M. musculus
tctctgtgtaatcttg

SEQ ID NO: 436113 - DNA, 16 bp, M. musculus
tctctgtgtagcccca

SEQ ID NO: 436114 - DNA, 16 bp, M. musculus
tctctgtgtagtttct

SEQ ID NO: 436115 - DNA, 16 bp, M. musculus
tctctgtgtatacatg

SEQ ID NO: 436116 - DNA, 16 bp, M. musculus
tctctgtgtcaccttg

SEQ ID NO: 436117 - DNA, 16 bp, M. musculus
tctctgtgtcactctg

SEQ ID NO: 436118 - DNA, 16 bp, M. musculus
tctctgtgtcattatt

SEQ ID NO: 436119 - DNA, 16 bp, M. musculus
tctctgtgtcctcagc

SEQ ID NO: 436120 - DNA, 16 bp, M. musculus
tctctgtgtccttggc

SEQ ID NO: 436121 - DNA, 16 bp, M. musculus
tctctgtgtctgcctc

SEQ ID NO: 436122 - DNA, 16 bp, M. musculus
tctctgtgtctgtcta

SEQ ID NO: 436123 - DNA, 16 bp, M. musculus
tctctgtgtcttctgt

SEQ ID NO: 436124 - DNA, 16 bp, M. musculus
tctctgtgtggcccta

SEQ ID NO: 436125 - DNA, 16 bp, M. musculus
tctctgtgtggccttg

SEQ ID NO: 436126 - DNA, 16 bp, M. musculus
tctctgtgtggctctg

SEQ ID NO: 436127 - DNA, 16 bp, M. musculus
tctctgtgtggtcagc

SEQ ID NO: 436128 - DNA, 16 bp, M. musculus
tctctgtgtggtcctg

SEQ ID NO: 436129 - DNA, 16 bp, M. musculus
tctctgtgtgtctgct

SEQ ID NO: 436130 - DNA, 16 bp, M. musculus
tctctgtgtgtctgtg

SEQ ID NO: 436131 - DNA, 16 bp, M. musculus
tctctgtgtgtctttc

SEQ ID NO: 436132 - DNA, 16 bp, M. musculus
tctctgtgtgtgaatg

SEQ ID NO: 436133 - DNA, 16 bp, M. musculus
tctctgtgtgtgagtg

SEQ ID NO: 436134 - DNA, 16 bp, M. musculus
tctctgtgtgtgcctg

SEQ ID NO: 436135 - DNA, 16 bp, M. musculus
tctctgtgtgtgctgc

SEQ ID NO: 436136 - DNA, 16 bp, M. musculus
tctctgtgtgtggtgt

SEQ ID NO: 436137 - DNA, 16 bp, M. musculus
tctctgtgtgtgtgca

SEQ ID NO: 436138 - DNA, 16 bp, M. musculus
tctctgtgtgttcctg

SEQ ID NO: 436139 - DNA, 16 bp, M. musculus
tctctgtgtgtttctg

SEQ ID NO: 436140 - DNA, 16 bp, M. musculus
tctctgtgtgtttgaa

SEQ ID NO: 436141 - DNA, 16 bp, M. musculus
tctctgtgttcctgtg

SEQ ID NO: 436142 - DNA, 16 bp, M. musculus
tctctgtgtttgtatg

SEQ ID NO: 436143 - DNA, 16 bp, M. musculus
tctctgttccactttt

SEQ ID NO: 436144 - DNA, 16 bp, M. musculus
tctctgttgtgaattc

SEQ ID NO: 436145 - DNA, 16 bp, M. musculus
tctctgtttctctatc

SEQ ID NO: 436146 - DNA, 16 bp, M. musculus
tctctgtttcttgtgc

SEQ ID NO: 436147 - DNA, 16 bp, M. musculus
tctctgtttgaggcca

SEQ ID NO: 436148 - DNA, 16 bp, M. musculus
tctctgttttcatttc

SEQ ID NO: 436149 - DNA, 16 bp, M. musculus
tctcttaaaaataaat

SEQ ID NO: 436150 - DNA, 16 bp, M. musculus
tctcttaaccactgag

SEQ ID NO: 436151 - DNA, 16 bp, M. musculus
tctcttacccacccac

SEQ ID NO: 436152 - DNA, 17 bp, M. musculus
tctcttagcatcaatgg

SEQ ID NO: 436153 - DNA, 16 bp, M. musculus
tctcttagcatccctc

SEQ ID NO: 436154 - DNA, 16 bp, M. musculus
tctcttagccatgaaa

SEQ ID NO: 436155 - DNA, 16 bp, M. musculus
tctcttaggaaaaaaa

SEQ ID NO: 436156 - DNA, 16 bp, M. musculus
tctcttagtaaacttg

SEQ ID NO: 436157 - DNA, 16 bp, M. musculus
tctcttatagaaacca

SEQ ID NO: 436158 - DNA, 16 bp, M. musculus
tctcttatgttggggt

SEQ ID NO: 436159 - DNA, 16 bp, M. musculus
tctcttattctctgca

SEQ ID NO: 436160 - DNA, 16 bp, M. musculus
tctcttcaacaaaatt

SEQ ID NO: 436161 - DNA, 16 bp, M. musculus
tctcttcaatctgtct

SEQ ID NO: 436162 - DNA, 16 bp, M. musculus
tctcttcacagccata

SEQ ID NO: 436163 - DNA, 16 bp, M. musculus
tctcttcacccagctc

SEQ ID NO: 436164 - DNA, 16 bp, M. musculus
tctcttcagacactcc

SEQ ID NO: 436165 - DNA, 16 bp, M. musculus
tctcttcagagccatc

SEQ ID NO: 436166 - DNA, 16 bp, M. musculus
tctcttcagggttagg

SEQ ID NO: 436167 - DNA, 16 bp, M. musculus
tctcttcatagcaata

SEQ ID NO: 436168 - DNA, 16 bp, M. musculus
tctcttccacactggg

SEQ ID NO: 436169 - DNA, 16 bp, M. musculus
tctcttccagctgcct

SEQ ID NO: 436170 - DNA, 26 bp, M. musculus
tctcttccatctcttgtattctgttg

SEQ ID NO: 436171 - DNA, 16 bp, M. musculus
tctcttccatttcttg

SEQ ID NO: 436172 - DNA, 16 bp, M. musculus
tctcttcccaaatgac

SEQ ID NO: 436173 - DNA, 16 bp, M. musculus
tctcttcccagcaccc

SEQ ID NO: 436174 - DNA, 16 bp, M. musculus
tctcttcccattgatg

SEQ ID NO: 436175 - DNA, 16 bp, M. musculus
tctcttcctactgcct

SEQ ID NO: 436176 - DNA, 16 bp, M. musculus
tctcttcctcagcttc

SEQ ID NO: 436177 - DNA, 16 bp, M. musculus
tctcttcctgctgcct

SEQ ID NO: 436178 - DNA, 16 bp, M. musculus
tctcttcctggagatg

SEQ ID NO: 436179 - DNA, 16 bp, M. musculus
tctcttcctggccctg

SEQ ID NO: 436180 - DNA, 16 bp, M. musculus
tctcttcctttaggtt

SEQ ID NO: 436181 - DNA, 19 bp, M. musculus
tctcttctagtgtgtctga

SEQ ID NO: 436182 - DNA, 18 bp, M. musculus
tctcttctatacccatta

SEQ ID NO: 436183 - DNA, 16 bp, M. musculus
tctcttctattagatt

SEQ ID NO: 436184 - DNA, 16 bp, M. musculus
tctcttctcaaatgac

SEQ ID NO: 436185 - DNA, 16 bp, M. musculus
tctcttctcagcatcc

SEQ ID NO: 436186 - DNA, 16 bp, M. musculus
tctcttctcccaccat

SEQ ID NO: 436187 - DNA, 16 bp, M. musculus
tctcttctgcacctct

SEQ ID NO: 436188 - DNA, 16 bp, M. musculus
tctcttctgcactggg

SEQ ID NO: 436189 - DNA, 16 bp, M. musculus
tctcttctgccagtat

SEQ ID NO: 436190 - DNA, 16 bp, M. musculus
tctcttctgctcagct

SEQ ID NO: 436191 - DNA, 16 bp, M. musculus
tctcttctgcttcctg

SEQ ID NO: 436192 - DNA, 17 bp, M. musculus
tctcttctggcctctgc

SEQ ID NO: 436193 - DNA, 21 bp, M. musculus
tctcttctggtgtgtctgaaa

SEQ ID NO: 436194 - DNA, 16 bp, M. musculus
tctcttctgtaaaatg

SEQ ID NO: 436195 - DNA, 16 bp, M. musculus
tctcttcttccactat

SEQ ID NO: 436196 - DNA, 16 bp, M. musculus
tctcttcttcccaagt

SEQ ID NO: 436197 - DNA, 16 bp, M. musculus
tctcttcttgcagcag

SEQ ID NO: 436198 - DNA, 16 bp, M. musculus
tctcttctttgaaagt

SEQ ID NO: 436199 - DNA, 16 bp, M. musculus
tctcttgagagcatca

SEQ ID NO: 436200 - DNA, 16 bp, M. musculus
tctcttgagtgctgag

SEQ ID NO: 436201 - DNA, 16 bp, M. musculus
tctcttgctctcctgc

SEQ ID NO: 436202 - DNA, 16 bp, M. musculus
tctcttgctctctctg

SEQ ID NO: 436203 - DNA, 16 bp, M. musculus
tctcttgctcttcagt

SEQ ID NO: 436204 - DNA, 16 bp, M. musculus
tctcttgctgctgcct

SEQ ID NO: 436205 - DNA, 16 bp, M. musculus
tctcttgggactggag

SEQ ID NO: 436206 - DNA, 16 bp, M. musculus
tctcttggtggccttt

SEQ ID NO: 436207 - DNA, 16 bp, M. musculus
tctcttggttgctgtt

SEQ ID NO: 436208 - DNA, 16 bp, M. musculus
tctcttgtcaccaaac

SEQ ID NO: 436209 - DNA, 18 bp, M. musculus
tctcttgtgagactatgt

SEQ ID NO: 436210 - DNA, 16 bp, M. musculus
tctcttgttgctctgt

SEQ ID NO: 436211 - DNA, 16 bp, M. musculus
tctctttagaaagcaa

SEQ ID NO: 436212 - DNA, 16 bp, M. musculus
tctctttagatgtgga

SEQ ID NO: 436213 - DNA, 16 bp, M. musculus
tctctttagttccttg

SEQ ID NO: 436214 - DNA, 16 bp, M. musculus
tctctttatttaaaaa

SEQ ID NO: 436215 - DNA, 16 bp, M. musculus
tctctttcaaatgatg

SEQ ID NO: 436216 - DNA, 16 bp, M. musculus
tctctttcaaattaat

SEQ ID NO: 436217 - DNA, 16 bp, M. musculus
tctctttcaagtgatg

SEQ ID NO: 436218 - DNA, 16 bp, M. musculus
tctctttccaccatgt

SEQ ID NO: 436219 - DNA, 18 bp, M. musculus
tctctttccactgatggc

SEQ ID NO: 436220 - DNA, 16 bp, M. musculus
tctctttccagagatg

SEQ ID NO: 436221 - DNA, 16 bp, M. musculus
tctctttccagggatg

SEQ ID NO: 436222 - DNA, 16 bp, M. musculus
tctctttccatagcct

SEQ ID NO: 436223 - DNA, 16 bp, M. musculus
tctctttctgtgtgtg

SEQ ID NO: 436224 - DNA, 16 bp, M. musculus
tctctttctttgatgg

SEQ ID NO: 436225 - DNA, 16 bp, M. musculus
tctctttgtatctctg

SEQ ID NO: 436226 - DNA, 16 bp, M. musculus
tctctttgtgatatag

SEQ ID NO: 436227 - DNA, 16 bp, M. musculus
tctctttgtgtatgtg

SEQ ID NO: 436228 - DNA, 16 bp, M. musculus
tctctttgtgtctgtc

SEQ ID NO: 436229 - DNA, 16 bp, M. musculus
tctctttgttggatct

SEQ ID NO: 436230 - DNA, 16 bp, M. musculus
tctcttttataagttg

SEQ ID NO: 436231 - DNA, 16 bp, M. musculus
tctcttttatctcttg

SEQ ID NO: 436232 - DNA, 16 bp, M. musculus
tctcttttccagttgc

SEQ ID NO: 436233 - DNA, 16 bp, M. musculus
tctcttttcctgctgc

SEQ ID NO: 436234 - DNA, 16 bp, M. musculus
tctcttttcttaaagg

SEQ ID NO: 436235 - DNA, 16 bp, M. musculus
tctcttttgccaaaga

SEQ ID NO: 436236 - DNA, 16 bp, M. musculus
tctcttttggtgtgtc

SEQ ID NO: 436237 - DNA, 16 bp, M. musculus
tctctttttaaaaaag

SEQ ID NO: 436238 - DNA, 16 bp, M. musculus
tctctttttaaaaaga

SEQ ID NO: 436239 - DNA, 16 bp, M. musculus
tctctttttaaaagaa

SEQ ID NO: 436240 - DNA, 16 bp, M. musculus
tctctttttaaagatt

SEQ ID NO: 436241 - DNA, 16 bp, M. musculus
tctctttttattagat

SEQ ID NO: 436242 - DNA, 16 bp, M. musculus
tctctttttgtaaact

SEQ ID NO: 436243 - DNA, 16 bp, M. musculus
tctcttttttaaaaaa

SEQ ID NO: 436244 - DNA, 16 bp, M. musculus
tctgaaaaaaaataat

SEQ ID NO: 436245 - DNA, 16 bp, M. musculus
tctgaaaaaaatattt

SEQ ID NO: 436246 - DNA, 16 bp, M. musculus
tctgaaaaaaattaaa

SEQ ID NO: 436247 - DNA, 16 bp, M. musculus
tctgaaaaataaaata

SEQ ID NO: 436248 - DNA, 16 bp, M. musculus
tctgaaaaatgtgtca

SEQ ID NO: 436249 - DNA, 16 bp, M. musculus
tctgaaaaattagaag

SEQ ID NO: 436250 - DNA, 16 bp, M. musculus
tctgaaaacaaacaaa

SEQ ID NO: 436251 - DNA, 16 bp, M. musculus
tctgaaaacaccctat

SEQ ID NO: 436252 - DNA, 16 bp, M. musculus
tctgaaaactccctcc

SEQ ID NO: 436253 - DNA, 16 bp, M. musculus
tctgaaaagagcaatg

SEQ ID NO: 436254 - DNA, 16 bp, M. musculus
tctgaaaaggactctg

SEQ ID NO: 436255 - DNA, 16 bp, M. musculus
tctgaaaataaagatc

SEQ ID NO: 436256 - DNA, 16 bp, M. musculus
tctgaaaatcaatttg

SEQ ID NO: 436257 - DNA, 16 bp, M. musculus
tctgaaaatcccctcc

SEQ ID NO: 436258 - DNA, 16 bp, M. musculus
tctgaaacagccccat

SEQ ID NO: 436259 - DNA, 16 bp, M. musculus
tctgaaaccccatagg

SEQ ID NO: 436260 - DNA, 16 bp, M. musculus
tctgaaacctcagagc

SEQ ID NO: 436261 - DNA, 16 bp, M. musculus
tctgaaacctgtgaca

SEQ ID NO: 436262 - DNA, 16 bp, M. musculus
tctgaaactcactttg

SEQ ID NO: 436263 - DNA, 16 bp, M. musculus
tctgaaactgcaagca

SEQ ID NO: 436264 - DNA, 16 bp, M. musculus
tctgaaactgttagcc

SEQ ID NO: 436265 - DNA, 16 bp, M. musculus
tctgaaacttcaaagc

SEQ ID NO: 436266 - DNA, 16 bp, M. musculus
tctgaaagaaaaataa

SEQ ID NO: 436267 - DNA, 16 bp, M. musculus
tctgaaagaaaagaaa

SEQ ID NO: 436268 - DNA, 16 bp, M. musculus
tctgaaagaactgcag

SEQ ID NO: 436269 - DNA, 16 bp, M. musculus
tctgaaagaagctgag

SEQ ID NO: 436270 - DNA, 16 bp, M. musculus
tctgaaagagcagtga

SEQ ID NO: 436271 - DNA, 16 bp, M. musculus
tctgaaagagcagtta

SEQ ID NO: 436272 - DNA, 16 bp, M. musculus
tctgaaagattttttt

SEQ ID NO: 436273 - DNA, 16 bp, M. musculus
tctgaaaggaaggaag

SEQ ID NO: 436274 - DNA, 16 bp, M. musculus
tctgaaaggaccctga

SEQ ID NO: 436275 - DNA, 16 bp, M. musculus
tctgaaatccaccttc

SEQ ID NO: 436276 - DNA, 16 bp, M. musculus
tctgaaatctcttgag

SEQ ID NO: 436277 - DNA, 16 bp, M. musculus
tctgaaatggccctaa

SEQ ID NO: 436278 - DNA, 16 bp, M. musculus
tctgaaattattgtat

SEQ ID NO: 436279 - DNA, 16 bp, M. musculus
tctgaaattctttttc

SEQ ID NO: 436280 - DNA, 16 bp, M. musculus
tctgaaatttctgtct

SEQ ID NO: 436281 - DNA, 16 bp, M. musculus
tctgaaattttgagga

SEQ ID NO: 436282 - DNA, 16 bp, M. musculus
tctgaacatctgtgct

SEQ ID NO: 436283 - DNA, 16 bp, M. musculus
tctgaaccattgagcc

SEQ ID NO: 436284 - DNA, 16 bp, M. musculus
tctgaacccaagatct

SEQ ID NO: 436285 - DNA, 16 bp, M. musculus
tctgaactaaaaccat

SEQ ID NO: 436286 - DNA, 16 bp, M. musculus
tctgaactataagcca

SEQ ID NO: 436287 - DNA, 16 bp, M. musculus
tctgaactcagggcct

SEQ ID NO: 436288 - DNA, 16 bp, M. musculus
tctgaactccacacat

SEQ ID NO: 436289 - DNA, 16 bp, M. musculus
tctgaactcttccaga

SEQ ID NO: 436290 - DNA, 16 bp, M. musculus
tctgaacttcaaattg

SEQ ID NO: 436291 - DNA, 16 bp, M. musculus
tctgaacttttgggct

SEQ ID NO: 436292 - DNA, 16 bp, M. musculus
tctgaactttttggct

SEQ ID NO: 436293 - DNA, 16 bp, M. musculus
tctgaagaaaaatgga

SEQ ID NO: 436294 - DNA, 16 bp, M. musculus
tctgaagaaagaaaat

SEQ ID NO: 436295 - DNA, 16 bp, M. musculus
tctgaagaaagaaatg

SEQ ID NO: 436296 - DNA, 16 bp, M. musculus
tctgaagaaagaaatt

SEQ ID NO: 436297 - DNA, 16 bp, M. musculus
tctgaagaaagaagct

SEQ ID NO: 436298 - DNA, 16 bp, M. musculus
tctgaagaaagaagtc

SEQ ID NO: 436299 - DNA, 16 bp, M. musculus
tctgaagaaaggaatt

SEQ ID NO: 436300 - DNA, 16 bp, M. musculus
tctgaagaaccaccag

SEQ ID NO: 436301 - DNA, 16 bp, M. musculus
tctgaagaaccgccag

SEQ ID NO: 436302 - DNA, 21 bp, M. musculus
tctgaagacaactacagtgta

SEQ ID NO: 436303 - DNA, 16 bp, M. musculus
tctgaagacagaaaca

SEQ ID NO: 436304 - DNA, 16 bp, M. musculus
tctgaagacagaggca

SEQ ID NO: 436305 - DNA, 16 bp, M. musculus
tctgaagacagcaaca

SEQ ID NO: 436306 - DNA, 16 bp, M. musculus
tctgaagacagcacag

SEQ ID NO: 436307 - DNA, 22 bp, M. musculus
tctgaagacagcgacagtgtat

SEQ ID NO: 436308 - DNA, 23 bp, M. musculus
tctgaagacagctacaatgtact

SEQ ID NO: 436309 - DNA, 20 bp, M. musculus
tctgaagacagctacagtgc

SEQ ID NO: 436310 - DNA, 21 bp, M. musculus
tctgaagacagctacagtgta

SEQ ID NO: 436311 - DNA, 21 bp, M. musculus
tctgaagacagctacagtgtc

SEQ ID NO: 436312 - DNA, 16 bp, M. musculus
tctgaagacagctata

SEQ ID NO: 436313 - DNA, 16 bp, M. musculus
tctgaagacagtggca

SEQ ID NO: 436314 - DNA, 16 bp, M. musculus
tctgaagactgctttg

SEQ ID NO: 436315 - DNA, 16 bp, M. musculus
tctgaagagaaacaga

SEQ ID NO: 436316 - DNA, 16 bp, M. musculus
tctgaagagaaagaga

SEQ ID NO: 436317 - DNA, 16 bp, M. musculus
tctgaagagaacaatg

SEQ ID NO: 436318 - DNA, 16 bp, M. musculus
tctgaagagaagggga

SEQ ID NO: 436319 - DNA, 16 bp, M. musculus
tctgaagagacatcat

SEQ ID NO: 436320 - DNA, 16 bp, M. musculus
tctgaagagagcaata

SEQ ID NO: 436321 - DNA, 16 bp, M. musculus
tctgaagagtctgtct

SEQ ID NO: 436322 - DNA, 16 bp, M. musculus
tctgaagatagcgaca

SEQ ID NO: 436323 - DNA, 16 bp, M. musculus
tctgaagatagctaca

SEQ ID NO: 436324 - DNA, 16 bp, M. musculus
tctgaagatagtgaca

SEQ ID NO: 436325 - DNA, 16 bp, M. musculus
tctgaagatggctaca

SEQ ID NO: 436326 - DNA, 16 bp, M. musculus
tctgaagattgtaagt

SEQ ID NO: 436327 - DNA, 16 bp, M. musculus
tctgaagatttggaac

SEQ ID NO: 436328 - DNA, 16 bp, M. musculus
tctgaagcaagtgaag

SEQ ID NO: 436329 - DNA, 19 bp, M. musculus
tctgaagcagatgaagaat

SEQ ID NO: 436330 - DNA, 16 bp, M. musculus
tctgaagcagccccat

SEQ ID NO: 436331 - DNA, 16 bp, M. musculus
tctgaagccagctaca

SEQ ID NO: 436332 - DNA, 16 bp, M. musculus
tctgaagccttcttct

SEQ ID NO: 436333 - DNA, 16 bp, M. musculus
tctgaaggaaggaagg

SEQ ID NO: 436334 - DNA, 16 bp, M. musculus
tctgaaggcaaaggca

SEQ ID NO: 436335 - DNA, 16 bp, M. musculus
tctgaaggcactgcat

SEQ ID NO: 436336 - DNA, 16 bp, M. musculus
tctgaaggccagaaga

SEQ ID NO: 436337 - DNA, 16 bp, M. musculus
tctgaaggccttccag

SEQ ID NO: 436338 - DNA, 16 bp, M. musculus
tctgaaggctgctggc

SEQ ID NO: 436339 - DNA, 16 bp, M. musculus
tctgaagggaaacaga

SEQ ID NO: 436340 - DNA, 16 bp, M. musculus
tctgaagtactgggat

SEQ ID NO: 436341 - DNA, 16 bp, M. musculus
tctgaagtcagcaaca

SEQ ID NO: 436342 - DNA, 18 bp, M. musculus
tctgaagtcagctacagt

SEQ ID NO: 436343 - DNA, 16 bp, M. musculus
tctgaagttaaaaaaa

SEQ ID NO: 436344 - DNA, 16 bp, M. musculus
tctgaagttttatttt

SEQ ID NO: 436345 - DNA, 16 bp, M. musculus
tctgaatattttaaat

SEQ ID NO: 436346 - DNA, 16 bp, M. musculus
tctgaatccatgcagt

SEQ ID NO: 436347 - DNA, 16 bp, M. musculus
tctgaatgaaaaatta

SEQ ID NO: 436348 - DNA, 16 bp, M. musculus
tctgaatgaattacag

SEQ ID NO: 436349 - DNA, 16 bp, M. musculus
tctgaatgctaggatt

SEQ ID NO: 436350 - DNA, 16 bp, M. musculus
tctgaatgtattgtca

SEQ ID NO: 436351 - DNA, 16 bp, M. musculus
tctgaatgtattttgt

SEQ ID NO: 436352 - DNA, 16 bp, M. musculus
tctgaattgagaaaat

SEQ ID NO: 436353 - DNA, 16 bp, M. musculus
tctgaattttaaaaat

SEQ ID NO: 436354 - DNA, 16 bp, M. musculus
tctgacaagaatgcct

SEQ ID NO: 436355 - DNA, 16 bp, M. musculus
tctgacaagattgaga

SEQ ID NO: 436356 - DNA, 16 bp, M. musculus
tctgacaagctggctt

SEQ ID NO: 436357 - DNA, 47 bp, M. musculus
tctgacaatggtggttaggaagaggaacatagcttagcaaaccagct

SEQ ID NO: 436358 - DNA, 16 bp, M. musculus
tctgacaccctcctct

SEQ ID NO: 436359 - DNA, 16 bp, M. musculus
tctgacaccttcctct

SEQ ID NO: 436360 - DNA, 16 bp, M. musculus
tctgacaggcttgcct

SEQ ID NO: 436361 - DNA, 16 bp, M. musculus
tctgacagggaaggtg

SEQ ID NO: 436362 - DNA, 16 bp, M. musculus
tctgacagtctgttaa

SEQ ID NO: 436363 - DNA, 16 bp, M. musculus
tctgacagttcctcag

SEQ ID NO: 436364 - DNA, 16 bp, M. musculus
tctgacatatatatat

SEQ ID NO: 436365 - DNA, 16 bp, M. musculus
tctgacatcctcttct

SEQ ID NO: 436366 - DNA, 16 bp, M. musculus
tctgacatgcaggtgt

SEQ ID NO: 436367 - DNA, 16 bp, M. musculus
tctgacatgtgtcctg

SEQ ID NO: 436368 - DNA, 16 bp, M. musculus
tctgacctccaagggt

SEQ ID NO: 436369 - DNA, 16 bp, M. musculus
tctgacctccacaagc

SEQ ID NO: 436370 - DNA, 16 bp, M. musculus
tctgacctccacatgc

SEQ ID NO: 436371 - DNA, 16 bp, M. musculus
tctgacctccacatgg

SEQ ID NO: 436372 - DNA, 16 bp, M. musculus
tctgacctccacctgc

SEQ ID NO: 436373 - DNA, 16 bp, M. musculus
tctgacctccacgcat

SEQ ID NO: 436374 - DNA, 16 bp, M. musculus
tctgacctccacgggc

SEQ ID NO: 436375 - DNA, 16 bp, M. musculus
tctgacctccatacat

SEQ ID NO: 436376 - DNA, 18 bp, M. musculus
tctgacctccatgggcac

SEQ ID NO: 436377 - DNA, 16 bp, M. musculus
tctgacctccttgggc

SEQ ID NO: 436378 - DNA, 16 bp, M. musculus
tctgacctctgacctc

SEQ ID NO: 436379 - DNA, 16 bp, M. musculus
tctgacctctggcctc

SEQ ID NO: 436380 - DNA, 16 bp, M. musculus
tctgacctctgtgggt

SEQ ID NO: 436381 - DNA, 16 bp, M. musculus
tctgacctctgtgtgt

SEQ ID NO: 436382 - DNA, 16 bp, M. musculus
tctgacctgcaggcta

SEQ ID NO: 436383 - DNA, 16 bp, M. musculus
tctgaccttcacatat

SEQ ID NO: 436384 - DNA, 16 bp, M. musculus
tctgaccttcctgctt

SEQ ID NO: 436385 - DNA, 18 bp, M. musculus
tctgaccttgatggctct

SEQ ID NO: 436386 - DNA, 16 bp, M. musculus
tctgactagtgtaagg

SEQ ID NO: 436387 - DNA, 16 bp, M. musculus
tctgactcagactctg

SEQ ID NO: 436388 - DNA, 16 bp, M. musculus
tctgactcagagctcc

SEQ ID NO: 436389 - DNA, 16 bp, M. musculus
tctgactcccacatgt

SEQ ID NO: 436390 - DNA, 16 bp, M. musculus
tctgactcccttttct

SEQ ID NO: 436391 - DNA, 16 bp, M. musculus
tctgactctgtcttct

SEQ ID NO: 436392 - DNA, 16 bp, M. musculus
tctgactctgtttcct

SEQ ID NO: 436393 - DNA, 16 bp, M. musculus
tctgactggagtctgt

SEQ ID NO: 436394 - DNA, 16 bp, M. musculus
tctgactggtctggaa

SEQ ID NO: 436395 - DNA, 16 bp, M. musculus
tctgactggtgagagg

SEQ ID NO: 436396 - DNA, 16 bp, M. musculus
tctgactgttgcctgc

SEQ ID NO: 436397 - DNA, 16 bp, M. musculus
tctgacttccaaatgc

SEQ ID NO: 436398 - DNA, 16 bp, M. musculus
tctgacttccacaagc

SEQ ID NO: 436399 - DNA, 16 bp, M. musculus
tctgacttccaggcag

SEQ ID NO: 436400 - DNA, 16 bp, M. musculus
tctgactttggtcaga

SEQ ID NO: 436401 - DNA, 16 bp, M. musculus
tctgagaaaatatttt

SEQ ID NO: 436402 - DNA, 16 bp, M. musculus
tctgagaaatgctttc

SEQ ID NO: 436403 - DNA, 16 bp, M. musculus
tctgagaacaaccaca

SEQ ID NO: 436404 - DNA, 16 bp, M. musculus
tctgagaaccccaagg

SEQ ID NO: 436405 - DNA, 16 bp, M. musculus
tctgagaagagggagc

SEQ ID NO: 436406 - DNA, 16 bp, M. musculus
tctgagacaggatctc

SEQ ID NO: 436407 - DNA, 16 bp, M. musculus
tctgagacagggtttt

SEQ ID NO: 436408 - DNA, 16 bp, M. musculus
tctgagaccagtctgc

SEQ ID NO: 436409 - DNA, 16 bp, M. musculus
tctgagaccctgagat

SEQ ID NO: 436410 - DNA, 16 bp, M. musculus
tctgagacctcaaagc

SEQ ID NO: 436411 - DNA, 16 bp, M. musculus
tctgagagaactcagg

SEQ ID NO: 436412 - DNA, 16 bp, M. musculus
tctgagagagggagaa

SEQ ID NO: 436413 - DNA, 16 bp, M. musculus
tctgagagctcccaga

SEQ ID NO: 436414 - DNA, 16 bp, M. musculus
tctgagaggctcttcc

SEQ ID NO: 436415 - DNA, 16 bp, M. musculus
tctgagatcaagaatc

SEQ ID NO: 436416 - DNA, 16 bp, M. musculus
tctgagatcctgagat

SEQ ID NO: 436417 - DNA, 16 bp, M. musculus
tctgagatcttcattt

SEQ ID NO: 436418 - DNA, 16 bp, M. musculus
tctgagatggaggcca

SEQ ID NO: 436419 - DNA, 16 bp, M. musculus
tctgagattctgggct

SEQ ID NO: 436420 - DNA, 16 bp, M. musculus
tctgagattctgtctt

SEQ ID NO: 436421 - DNA, 16 bp, M. musculus
tctgagcactggagag

SEQ ID NO: 436422 - DNA, 16 bp, M. musculus
tctgagcagtctcagt

SEQ ID NO: 436423 - DNA, 16 bp, M. musculus
tctgagcatataccca

SEQ ID NO: 436424 - DNA, 16 bp, M. musculus
tctgagccaggcagtg

SEQ ID NO: 436425 - DNA, 16 bp, M. musculus
tctgagccatctctct

SEQ ID NO: 436426 - DNA, 16 bp, M. musculus
tctgagcccagtgaca

SEQ ID NO: 436427 - DNA, 16 bp, M. musculus
tctgagccccatgttt

SEQ ID NO: 436428 - DNA, 16 bp, M. musculus
tctgagccccattttt

SEQ ID NO: 436429 - DNA, 16 bp, M. musculus
tctgagccctgagggg

SEQ ID NO: 436430 - DNA, 16 bp, M. musculus
tctgagcctcagatct

SEQ ID NO: 436431 - DNA, 16 bp, M. musculus
tctgagcctcagtttc

SEQ ID NO: 436432 - DNA, 16 bp, M. musculus
tctgagcctcctgcct

SEQ ID NO: 436433 - DNA, 16 bp, M. musculus
tctgagcctcggtttc

SEQ ID NO: 436434 - DNA, 16 bp, M. musculus
tctgagctacatagtg

SEQ ID NO: 436435 - DNA, 16 bp, M. musculus
tctgagctccagactt

SEQ ID NO: 436436 - DNA, 16 bp, M. musculus
tctgagctgagacaga

SEQ ID NO: 436437 - DNA, 16 bp, M. musculus
tctgagctttgaaacc

SEQ ID NO: 436438 - DNA, 16 bp, M. musculus
tctgaggaaattttaa

SEQ ID NO: 436439 - DNA, 16 bp, M. musculus
tctgaggaacttccag

SEQ ID NO: 436440 - DNA, 16 bp, M. musculus
tctgaggaatgaaatt

SEQ ID NO: 436441 - DNA, 16 bp, M. musculus
tctgaggacacacaca

SEQ ID NO: 436442 - DNA, 19 bp, M. musculus
tctgaggacagcaacagtg

SEQ ID NO: 436443 - DNA, 18 bp, M. musculus
tctgaggacagcgacagt

SEQ ID NO: 436444 - DNA, 23 bp, M. musculus
tctgaggacagctacagtgtact

SEQ ID NO: 436445 - DNA, 16 bp, M. musculus
tctgaggagaaagaga

SEQ ID NO: 436446 - DNA, 16 bp, M. musculus
tctgaggagaaggaga

SEQ ID NO: 436447 - DNA, 16 bp, M. musculus
tctgaggcaaaaagtt

SEQ ID NO: 436448 - DNA, 16 bp, M. musculus
tctgaggcaggaggat

SEQ ID NO: 436449 - DNA, 16 bp, M. musculus
tctgagggaaaaaaat

SEQ ID NO: 436450 - DNA, 16 bp, M. musculus
tctgagggggaaaaaa

SEQ ID NO: 436451 - DNA, 16 bp, M. musculus
tctgagggtaccaggc

SEQ ID NO: 436452 - DNA, 16 bp, M. musculus
tctgaggtagtgtgtg

SEQ ID NO: 436453 - DNA, 16 bp, M. musculus
tctgaggtcagcctga

SEQ ID NO: 436454 - DNA, 16 bp, M. musculus
tctgaggtcagcctgg

SEQ ID NO: 436455 - DNA, 16 bp, M. musculus
tctgaggtttcagaag

SEQ ID NO: 436456 - DNA, 16 bp, M. musculus
tctgaggtttttgaag

SEQ ID NO: 436457 - DNA, 16 bp, M. musculus
tctgaggtttttgttt

SEQ ID NO: 436458 - DNA, 16 bp, M. musculus
tctgagtacgaggcca

SEQ ID NO: 436459 - DNA, 16 bp, M. musculus
tctgagtactaggatt

SEQ ID NO: 436460 - DNA, 16 bp, M. musculus
tctgagtccaaggcca

SEQ ID NO: 436461 - DNA, 16 bp, M. musculus
tctgagtccctcttct

SEQ ID NO: 436462 - DNA, 16 bp, M. musculus
tctgagtctgagacca

SEQ ID NO: 436463 - DNA, 18 bp, M. musculus
tctgagtgaggtaaccca

SEQ ID NO: 436464 - DNA, 16 bp, M. musculus
tctgagtgccaggatt

SEQ ID NO: 436465 - DNA, 16 bp, M. musculus
tctgagtgctgagatt

SEQ ID NO: 436466 - DNA, 16 bp, M. musculus
tctgagtgctggaatt

SEQ ID NO: 436467 - DNA, 16 bp, M. musculus
tctgagtgctgggatt

SEQ ID NO: 436468 - DNA, 16 bp, M. musculus
tctgagtgggtggggg

SEQ ID NO: 436469 - DNA, 16 bp, M. musculus
tctgagtgtattttgc

SEQ ID NO: 436470 - DNA, 16 bp, M. musculus
tctgagtgtgtctgtg

SEQ ID NO: 436471 - DNA, 16 bp, M. musculus
tctgagttagaggcca

SEQ ID NO: 436472 - DNA, 16 bp, M. musculus
tctgagttcaagccca

SEQ ID NO: 436473 - DNA, 16 bp, M. musculus
tctgagttcaatgcca

SEQ ID NO: 436474 - DNA, 16 bp, M. musculus
tctgagttcaatgtca

SEQ ID NO: 436475 - DNA, 16 bp, M. musculus
tctgagttcagtcaga

SEQ ID NO: 436476 - DNA, 16 bp, M. musculus
tctgagttcagttccc

SEQ ID NO: 436477 - DNA, 16 bp, M. musculus
tctgagttctaggcca

SEQ ID NO: 436478 - DNA, 16 bp, M. musculus
tctgagttctgtgcag

SEQ ID NO: 436479 - DNA, 16 bp, M. musculus
tctgagttcttcttta

SEQ ID NO: 436480 - DNA, 16 bp, M. musculus
tctgagttgaggccag

SEQ ID NO: 436481 - DNA, 16 bp, M. musculus
tctgagttgcttccag

SEQ ID NO: 436482 - DNA, 16 bp, M. musculus
tctgagttggagacca

SEQ ID NO: 436483 - DNA, 16 bp, M. musculus
tctgagtttaaagtca

SEQ ID NO: 436484 - DNA, 16 bp, M. musculus
tctgagtttaaggtca

SEQ ID NO: 436485 - DNA, 16 bp, M. musculus
tctgagtttgaagaca

SEQ ID NO: 436486 - DNA, 16 bp, M. musculus
tctgagtttgagacca

SEQ ID NO: 436487 - DNA, 16 bp, M. musculus
tctgagtttgaggcaa

SEQ ID NO: 436488 - DNA, 16 bp, M. musculus
tctgagtttgaggccc

SEQ ID NO: 436489 - DNA, 16 bp, M. musculus
tctgagtttggggcca

SEQ ID NO: 436490 - DNA, 16 bp, M. musculus
tctgagttttcctctt

SEQ ID NO: 436491 - DNA, 16 bp, M. musculus
tctgataaagggctaa

SEQ ID NO: 436492 - DNA, 16 bp, M. musculus
tctgatacagctgtct

SEQ ID NO: 436493 - DNA, 16 bp, M. musculus
tctgataccttcttct

SEQ ID NO: 436494 - DNA, 16 bp, M. musculus
tctgatagatctctgc

SEQ ID NO: 436495 - DNA, 17 bp, M. musculus
tctgataggatgcatgg

SEQ ID NO: 436496 - DNA, 16 bp, M. musculus
tctgatatgtgaccct

SEQ ID NO: 436497 - DNA, 16 bp, M. musculus
tctgatattaaaatgg

SEQ ID NO: 436498 - DNA, 16 bp, M. musculus
tctgatattcaggata

SEQ ID NO: 436499 - DNA, 16 bp, M. musculus
tctgatcaaagctcaa

SEQ ID NO: 436500 - DNA, 16 bp, M. musculus
tctgatcaaggttcaa

SEQ ID NO: 436501 - DNA, 16 bp, M. musculus
tctgatcatgatttaa

SEQ ID NO: 436502 - DNA, 16 bp, M. musculus
tctgatccacctgcct

SEQ ID NO: 436503 - DNA, 16 bp, M. musculus
tctgatccctggaacc

SEQ ID NO: 436504 - DNA, 16 bp, M. musculus
tctgatcctcctgcct

SEQ ID NO: 436505 - DNA, 16 bp, M. musculus
tctgatcctcctgctt

SEQ ID NO: 436506 - DNA, 16 bp, M. musculus
tctgatcctgatataa

SEQ ID NO: 436507 - DNA, 17 bp, M. musculus
tctgatcgtgaacctct

SEQ ID NO: 436508 - DNA, 16 bp, M. musculus
tctgatcgtgatttaa

SEQ ID NO: 436509 - DNA, 16 bp, M. musculus
tctgatctccacatgt

SEQ ID NO: 436510 - DNA, 16 bp, M. musculus
tctgatctccagaacc

SEQ ID NO: 436511 - DNA, 16 bp, M. musculus
tctgatctccatacac

SEQ ID NO: 436512 - DNA, 16 bp, M. musculus
tctgatgatgaactaa

SEQ ID NO: 436513 - DNA, 16 bp, M. musculus
tctgatgatgattatg

SEQ ID NO: 436514 - DNA, 16 bp, M. musculus
tctgatgatttttgaa

SEQ ID NO: 436515 - DNA, 16 bp, M. musculus
tctgatgcataatgac

SEQ ID NO: 436516 - DNA, 16 bp, M. musculus
tctgatgccctcatct

SEQ ID NO: 436517 - DNA, 16 bp, M. musculus
tctgatgccctcctct

SEQ ID NO: 436518 - DNA, 16 bp, M. musculus
tctgatgccctcgtct

SEQ ID NO: 436519 - DNA, 17 bp, M. musculus
tctgatgccctcttctg

SEQ ID NO: 436520 - DNA, 16 bp, M. musculus
tctgatgccctctttt

SEQ ID NO: 436521 - DNA, 16 bp, M. musculus
tctgatgccctgttct

SEQ ID NO: 436522 - DNA, 16 bp, M. musculus
tctgatgcccttttct

SEQ ID NO: 436523 - DNA, 16 bp, M. musculus
tctgatgccttctttg

SEQ ID NO: 436524 - DNA, 16 bp, M. musculus
tctgatgctctcttct

SEQ ID NO: 436525 - DNA, 16 bp, M. musculus
tctgatggagacaatt

SEQ ID NO: 436526 - DNA, 16 bp, M. musculus
tctgatggggacattt

SEQ ID NO: 436527 - DNA, 16 bp, M. musculus
tctgatggtcttagga

SEQ ID NO: 436528 - DNA, 16 bp, M. musculus
tctgatgtcttcttct

SEQ ID NO: 436529 - DNA, 16 bp, M. musculus
tctgatgtgggtgctg

SEQ ID NO: 436530 - DNA, 17 bp, M. musculus
tctgattctgtttatgt

SEQ ID NO: 436531 - DNA, 16 bp, M. musculus
tctgattggtgtaaga

SEQ ID NO: 436532 - DNA, 16 bp, M. musculus
tctgatttccttttct

SEQ ID NO: 436533 - DNA, 16 bp, M. musculus
tctgatttctacatgt

SEQ ID NO: 436534 - DNA, 16 bp, M. musculus
tctgatttctgtttct

SEQ ID NO: 436535 - DNA, 16 bp, M. musculus
tctgatttcttcttca

SEQ ID NO: 436536 - DNA, 16 bp, M. musculus
tctgatttctttctta

SEQ ID NO: 436537 - DNA, 16 bp, M. musculus
tctgatttgtgtgtgt

SEQ ID NO: 436538 - DNA, 16 bp, M. musculus
tctgattttatgtgaa

SEQ ID NO: 436539 - DNA, 16 bp, M. musculus
tctgatttttaaatgt

SEQ ID NO: 436540 - DNA, 16 bp, M. musculus
tctgcaaagaattgtg

SEQ ID NO: 436541 - DNA, 16 bp, M. musculus
tctgcaaaggcagcaa

SEQ ID NO: 436542 - DNA, 16 bp, M. musculus
tctgcaaattcatgtg

SEQ ID NO: 436543 - DNA, 16 bp, M. musculus
tctgcaacagctcctg

SEQ ID NO: 436544 - DNA, 17 bp, M. musculus
tctgcaacctgataggt

SEQ ID NO: 436545 - DNA, 16 bp, M. musculus
tctgcaagaacagcaa

SEQ ID NO: 436546 - DNA, 16 bp, M. musculus
tctgcaagagcaacaa

SEQ ID NO: 436547 - DNA, 16 bp, M. musculus
tctgcaagtgtgtgtg

SEQ ID NO: 436548 - DNA, 16 bp, M. musculus
tctgcaataatgtctg

SEQ ID NO: 436549 - DNA, 16 bp, M. musculus
tctgcaatagcaacaa

SEQ ID NO: 436550 - DNA, 16 bp, M. musculus
tctgcaatctcagcac

SEQ ID NO: 436551 - DNA, 16 bp, M. musculus
tctgcaatgattcctg

SEQ ID NO: 436552 - DNA, 16 bp, M. musculus
tctgcaatgggatctg

SEQ ID NO: 436553 - DNA, 16 bp, M. musculus
tctgcacaagatcaag

SEQ ID NO: 436554 - DNA, 16 bp, M. musculus
tctgcacacatgcaca

SEQ ID NO: 436555 - DNA, 16 bp, M. musculus
tctgcacactgccatg

SEQ ID NO: 436556 - DNA, 16 bp, M. musculus
tctgcacaggtgagag

SEQ ID NO: 436557 - DNA, 16 bp, M. musculus
tctgcacatgtgcagg

SEQ ID NO: 436558 - DNA, 16 bp, M. musculus
tctgcaccacactttg

SEQ ID NO: 436559 - DNA, 16 bp, M. musculus
tctgcaccagctcctg

SEQ ID NO: 436560 - DNA, 16 bp, M. musculus
tctgcaccagtctctt

SEQ ID NO: 436561 - DNA, 16 bp, M. musculus
tctgcacctgagtttc

SEQ ID NO: 436562 - DNA, 16 bp, M. musculus
tctgcaccttgaccag

SEQ ID NO: 436563 - DNA, 16 bp, M. musculus
tctgcactgctctcaa

SEQ ID NO: 436564 - DNA, 16 bp, M. musculus
tctgcactgtgagagg

SEQ ID NO: 436565 - DNA, 16 bp, M. musculus
tctgcactttgtctcc

SEQ ID NO: 436566 - DNA, 16 bp, M. musculus
tctgcagaacatttca

SEQ ID NO: 436567 - DNA, 16 bp, M. musculus
tctgcagaagcagcaa

SEQ ID NO: 436568 - DNA, 16 bp, M. musculus
tctgcagaagctgctg

SEQ ID NO: 436569 - DNA, 16 bp, M. musculus
tctgcagaagtggcaa

SEQ ID NO: 436570 - DNA, 16 bp, M. musculus
tctgcagacaagctct

SEQ ID NO: 436571 - DNA, 16 bp, M. musculus
tctgcagacagcagaa

SEQ ID NO: 436572 - DNA, 16 bp, M. musculus
tctgcagacagctaca

SEQ ID NO: 436573 - DNA, 16 bp, M. musculus
tctgcagacctgggag

SEQ ID NO: 436574 - DNA, 16 bp, M. musculus
tctgcagactctgtgc

SEQ ID NO: 436575 - DNA, 16 bp, M. musculus
tctgcagagatctgct

SEQ ID NO: 436576 - DNA, 16 bp, M. musculus
tctgcagagcttaaga

SEQ ID NO: 436577 - DNA, 16 bp, M. musculus
tctgcagagtgagctc

SEQ ID NO: 436578 - DNA, 16 bp, M. musculus
tctgcagagttttagc

SEQ ID NO: 436579 - DNA, 16 bp, M. musculus
tctgcagatcaggctg

SEQ ID NO: 436580 - DNA, 20 bp, M. musculus
tctgcagatttatccaggtg

SEQ ID NO: 436581 - DNA, 16 bp, M. musculus
tctgcagcatagcttt

SEQ ID NO: 436582 - DNA, 16 bp, M. musculus
tctgcagcccaggctg

SEQ ID NO: 436583 - DNA, 16 bp, M. musculus
tctgcagccctggctg

SEQ ID NO: 436584 - DNA, 16 bp, M. musculus
tctgcagcctgtctct

SEQ ID NO: 436585 - DNA, 27 bp, M. musculus
tctgcagcgtcgcgactgggaaaaccc

SEQ ID NO: 436586 - DNA, 16 bp, M. musculus
tctgcagctggcaaag

SEQ ID NO: 436587 - DNA, 16 bp, M. musculus
tctgcagctggcagaa

SEQ ID NO: 436588 - DNA, 16 bp, M. musculus
tctgcagcttcctgca

SEQ ID NO: 436589 - DNA, 16 bp, M. musculus
tctgcaggacctgaga

SEQ ID NO: 436590 - DNA, 16 bp, M. musculus
tctgcaggcagcagca

SEQ ID NO: 436591 - DNA, 16 bp, M. musculus
tctgcaggcagcagga

SEQ ID NO: 436592 - DNA, 16 bp, M. musculus
tctgcaggggaggagg

SEQ ID NO: 436593 - DNA, 16 bp, M. musculus
tctgcagtacagcttg

SEQ ID NO: 436594 - DNA, 16 bp, M. musculus
tctgcagtcaggaagc

SEQ ID NO: 436595 - DNA, 16 bp, M. musculus
tctgcagtgttctgtg

SEQ ID NO: 436596 - DNA, 16 bp, M. musculus
tctgcatatgtgtatg

SEQ ID NO: 436597 - DNA, 16 bp, M. musculus
tctgcatattcatctg

SEQ ID NO: 436598 - DNA, 16 bp, M. musculus
tctgcatcagcacctg

SEQ ID NO: 436599 - DNA, 16 bp, M. musculus
tctgcatcagcccctg

SEQ ID NO: 436600 - DNA, 16 bp, M. musculus
tctgcatcagctcctg

SEQ ID NO: 436601 - DNA, 16 bp, M. musculus
tctgcatcaggtcctc

SEQ ID NO: 436602 - DNA, 16 bp, M. musculus
tctgcatcagtttctg

SEQ ID NO: 436603 - DNA, 16 bp, M. musculus
tctgcatcatctcctg

SEQ ID NO: 436604 - DNA, 17 bp, M. musculus
tctgcatctccatggct

SEQ ID NO: 436605 - DNA, 16 bp, M. musculus
tctgcatctctttcca

SEQ ID NO: 436606 - DNA, 16 bp, M. musculus
tctgcatctgcagcct

SEQ ID NO: 436607 - DNA, 16 bp, M. musculus
tctgcatctgcatctg

SEQ ID NO: 436608 - DNA, 16 bp, M. musculus
tctgcatctgtctcag

SEQ ID NO: 436609 - DNA, 16 bp, M. musculus
tctgcatctgtctgtc

SEQ ID NO: 436610 - DNA, 16 bp, M. musculus
tctgcatctttgggag

SEQ ID NO: 436611 - DNA, 16 bp, M. musculus
tctgcatgctaccaaa

SEQ ID NO: 436612 - DNA, 16 bp, M. musculus
tctgcatgctaggcaa

SEQ ID NO: 436613 - DNA, 16 bp, M. musculus
tctgcatgtacacttg

SEQ ID NO: 436614 - DNA, 16 bp, M. musculus
tctgcatgtacatctg

SEQ ID NO: 436615 - DNA, 16 bp, M. musculus
tctgcatgtctgtctg

SEQ ID NO: 436616 - DNA, 16 bp, M. musculus
tctgcatgtgtgcatg

SEQ ID NO: 436617 - DNA, 16 bp, M. musculus
tctgcatgtgtgtgca

SEQ ID NO: 436618 - DNA, 16 bp, M. musculus
tctgcattggtggtca

SEQ ID NO: 436619 - DNA, 16 bp, M. musculus
tctgcatttacatttc

SEQ ID NO: 436620 - DNA, 16 bp, M. musculus
tctgcatttgattatt

SEQ ID NO: 436621 - DNA, 16 bp, M. musculus
tctgcatttgtttctg

SEQ ID NO: 436622 - DNA, 16 bp, M. musculus
tctgcattttatttct

SEQ ID NO: 436623 - DNA, 16 bp, M. musculus
tctgcattttatttta

SEQ ID NO: 436624 - DNA, 16 bp, M. musculus
tctgccaaagcctgac

SEQ ID NO: 436625 - DNA, 16 bp, M. musculus
tctgccacacatgtgg

SEQ ID NO: 436626 - DNA, 16 bp, M. musculus
tctgccacagaaggaa

SEQ ID NO: 436627 - DNA, 16 bp, M. musculus
tctgccacatctgcag

SEQ ID NO: 436628 - DNA, 16 bp, M. musculus
tctgccagagccagac

SEQ ID NO: 436629 - DNA, 16 bp, M. musculus
tctgccagcatcatga

SEQ ID NO: 436630 - DNA, 16 bp, M. musculus
tctgccagcctctgtc

SEQ ID NO: 436631 - DNA, 16 bp, M. musculus
tctgccagtaatttct

SEQ ID NO: 436632 - DNA, 16 bp, M. musculus
tctgccagtgcctggc

SEQ ID NO: 436633 - DNA, 16 bp, M. musculus
tctgccagttcctgac

SEQ ID NO: 436634 - DNA, 16 bp, M. musculus
tctgccatgacaataa

SEQ ID NO: 436635 - DNA, 16 bp, M. musculus
tctgccatgatgataa

SEQ ID NO: 436636 - DNA, 16 bp, M. musculus
tctgccatgggtcctc

SEQ ID NO: 436637 - DNA, 16 bp, M. musculus
tctgccatgtgggtgc

SEQ ID NO: 436638 - DNA, 16 bp, M. musculus
tctgccatttcccctg

SEQ ID NO: 436639 - DNA, 16 bp, M. musculus
tctgcccagcctgaga

SEQ ID NO: 436640 - DNA, 16 bp, M. musculus
tctgcccagctacagg

SEQ ID NO: 436641 - DNA, 16 bp, M. musculus
tctgcccagctattgg

SEQ ID NO: 436642 - DNA, 16 bp, M. musculus
tctgcccagtgtggaa

SEQ ID NO: 436643 - DNA, 16 bp, M. musculus
tctgccccagccttcc

SEQ ID NO: 436644 - DNA, 16 bp, M. musculus
tctgccccctaagtgc

SEQ ID NO: 436645 - DNA, 16 bp, M. musculus
tctgcccgcccagagc

SEQ ID NO: 436646 - DNA, 16 bp, M. musculus
tctgccctccacacat

SEQ ID NO: 436647 - DNA, 16 bp, M. musculus
tctgccctctgtctct

SEQ ID NO: 436648 - DNA, 16 bp, M. musculus
tctgccctgcccagga

SEQ ID NO: 436649 - DNA, 16 bp, M. musculus
tctgccctgctcccca

SEQ ID NO: 436650 - DNA, 16 bp, M. musculus
tctgccctgcttggtc

SEQ ID NO: 436651 - DNA, 16 bp, M. musculus
tctgcccttctctgcc

SEQ ID NO: 436652 - DNA, 16 bp, M. musculus
tctgcctatctgtctg

SEQ ID NO: 436653 - DNA, 16 bp, M. musculus
tctgcctattacaaat

SEQ ID NO: 436654 - DNA, 16 bp, M. musculus
tctgcctcactattct

SEQ ID NO: 436655 - DNA, 16 bp, M. musculus
tctgcctcagcctcct

SEQ ID NO: 436656 - DNA, 16 bp, M. musculus
tctgcctcagcctctc

SEQ ID NO: 436657 - DNA, 16 bp, M. musculus
tctgcctcagccttct

SEQ ID NO: 436658 - DNA, 16 bp, M. musculus
tctgcctcagcttcca

SEQ ID NO: 436659 - DNA, 16 bp, M. musculus
tctgcctcagcttccc

SEQ ID NO: 436660 - DNA, 16 bp, M. musculus
tctgcctcagtttcct

SEQ ID NO: 436661 - DNA, 16 bp, M. musculus
tctgcctcagttttct

SEQ ID NO: 436662 - DNA, 16 bp, M. musculus
tctgcctccacctcca

SEQ ID NO: 436663 - DNA, 16 bp, M. musculus
tctgcctccacctccc

SEQ ID NO: 436664 - DNA, 16 bp, M. musculus
tctgcctccaccttcc

SEQ ID NO: 436665 - DNA, 16 bp, M. musculus
tctgcctccagcttcc

SEQ ID NO: 436666 - DNA, 16 bp, M. musculus
tctgcctccagggtgc

SEQ ID NO: 436667 - DNA, 16 bp, M. musculus
tctgcctccagtgctg

SEQ ID NO: 436668 - DNA, 16 bp, M. musculus
tctgcctccatctcct

SEQ ID NO: 436669 - DNA, 18 bp, M. musculus
tctgcctcccaagtgcta

SEQ ID NO: 436670 - DNA, 16 bp, M. musculus
tctgcctcccaagtgg

SEQ ID NO: 436671 - DNA, 16 bp, M. musculus
tctgcctcccaagtgt

SEQ ID NO: 436672 - DNA, 16 bp, M. musculus
tctgcctcccagagtg

SEQ ID NO: 436673 - DNA, 16 bp, M. musculus
tctgcctcccagctgc

SEQ ID NO: 436674 - DNA, 16 bp, M. musculus
tctgcctccccaagtg

SEQ ID NO: 436675 - DNA, 16 bp, M. musculus
tctgcctcctctgctg

SEQ ID NO: 436676 - DNA, 16 bp, M. musculus
tctgcctcctcttcca

SEQ ID NO: 436677 - DNA, 16 bp, M. musculus
tctgcctcctgagagc

SEQ ID NO: 436678 - DNA, 17 bp, M. musculus
tctgcctcctgagtgct

SEQ ID NO: 436679 - DNA, 16 bp, M. musculus
tctgcctcctgagtgt

SEQ ID NO: 436680 - DNA, 16 bp, M. musculus
tctgcctcctgcctga

SEQ ID NO: 436681 - DNA, 16 bp, M. musculus
tctgcctctacttcct

SEQ ID NO: 436682 - DNA, 16 bp, M. musculus
tctgcctctcatctca

SEQ ID NO: 436683 - DNA, 16 bp, M. musculus
tctgcctctctctctg

SEQ ID NO: 436684 - DNA, 16 bp, M. musculus
tctgcctctgaatgct

SEQ ID NO: 436685 - DNA, 16 bp, M. musculus
tctgcctctgactctt

SEQ ID NO: 436686 - DNA, 16 bp, M. musculus
tctgcctctgcctcct

SEQ ID NO: 436687 - DNA, 16 bp, M. musculus
tctgcctctgcctcta

SEQ ID NO: 436688 - DNA, 16 bp, M. musculus
tctgcctctgcctctc

SEQ ID NO: 436689 - DNA, 18 bp, M. musculus
tctgcctctgcctctgct

SEQ ID NO: 436690 - DNA, 16 bp, M. musculus
tctgcctctgccttcc

SEQ ID NO: 436691 - DNA, 16 bp, M. musculus
tctgcctctgcttcct

SEQ ID NO: 436692 - DNA, 16 bp, M. musculus
tctgcctctgctttct

SEQ ID NO: 436693 - DNA, 16 bp, M. musculus
tctgcctctgggagag

SEQ ID NO: 436694 - DNA, 16 bp, M. musculus
tctgcctctgtctgtc

SEQ ID NO: 436695 - DNA, 16 bp, M. musculus
tctgcctctgtcttcc

SEQ ID NO: 436696 - DNA, 16 bp, M. musculus
tctgcctctgtcttct

SEQ ID NO: 436697 - DNA, 16 bp, M. musculus
tctgcctctgtgcctc

SEQ ID NO: 436698 - DNA, 16 bp, M. musculus
tctgcctctgtgctgg

SEQ ID NO: 436699 - DNA, 16 bp, M. musculus
tctgcctctgtttcca

SEQ ID NO: 436700 - DNA, 16 bp, M. musculus
tctgcctcttcctctg

SEQ ID NO: 436701 - DNA, 16 bp, M. musculus
tctgcctcttgagtgt

SEQ ID NO: 436702 - DNA, 16 bp, M. musculus
tctgcctcttgagttc

SEQ ID NO: 436703 - DNA, 16 bp, M. musculus
tctgcctgcatcctgc

SEQ ID NO: 436704 - DNA, 16 bp, M. musculus
tctgcctgcatctgcc

SEQ ID NO: 436705 - DNA, 16 bp, M. musculus
tctgcctgcatgctgc

SEQ ID NO: 436706 - DNA, 16 bp, M. musculus
tctgcctgccctgccc

SEQ ID NO: 436707 - DNA, 16 bp, M. musculus
tctgcctgcctcagtc

SEQ ID NO: 436708 - DNA, 16 bp, M. musculus
tctgcctgcctctact

SEQ ID NO: 436709 - DNA, 16 bp, M. musculus
tctgcctgcctctcca

SEQ ID NO: 436710 - DNA, 16 bp, M. musculus
tctgcctgcctctgca

SEQ ID NO: 436711 - DNA, 16 bp, M. musculus
tctgcctgcctgcctc

SEQ ID NO: 436712 - DNA, 16 bp, M. musculus
tctgcctgcctttgta

SEQ ID NO: 436713 - DNA, 16 bp, M. musculus
tctgcctgctcaagga

SEQ ID NO: 436714 - DNA, 16 bp, M. musculus
tctgcctgctctgcct

SEQ ID NO: 436715 - DNA, 16 bp, M. musculus
tctgcctgctgagcca

SEQ ID NO: 436716 - DNA, 16 bp, M. musculus
tctgcctgcttctctt

SEQ ID NO: 436717 - DNA, 16 bp, M. musculus
tctgcctggatgctgc

SEQ ID NO: 436718 - DNA, 16 bp, M. musculus
tctgcctggctcagaa

SEQ ID NO: 436719 - DNA, 16 bp, M. musculus
tctgcctgggatacaa

SEQ ID NO: 436720 - DNA, 16 bp, M. musculus
tctgcctggttctgcc

SEQ ID NO: 436721 - DNA, 17 bp, M. musculus
tctgcctgtaccatgcc

SEQ ID NO: 436722 - DNA, 16 bp, M. musculus
tctgcctgtccagagc

SEQ ID NO: 436723 - DNA, 16 bp, M. musculus
tctgcctgtccatcca

SEQ ID NO: 436724 - DNA, 16 bp, M. musculus
tctgcctgtcctggaa

SEQ ID NO: 436725 - DNA, 16 bp, M. musculus
tctgcctgtctctctg

SEQ ID NO: 436726 - DNA, 16 bp, M. musculus
tctgcctgtctctgtt

SEQ ID NO: 436727 - DNA, 16 bp, M. musculus
tctgcctgtctgcctg

SEQ ID NO: 436728 - DNA, 16 bp, M. musculus
tctgcctgtctgtttg

SEQ ID NO: 436729 - DNA, 16 bp, M. musculus
tctgcctgtgtgtgtg

SEQ ID NO: 436730 - DNA, 16 bp, M. musculus
tctgcctgtttctgct

SEQ ID NO: 436731 - DNA, 16 bp, M. musculus
tctgccttcccagtgc

SEQ ID NO: 436732 - DNA, 16 bp, M. musculus
tctgccttcctctctg

SEQ ID NO: 436733 - DNA, 16 bp, M. musculus
tctgccttcctctgct

SEQ ID NO: 436734 - DNA, 16 bp, M. musculus
tctgccttctctgcct

SEQ ID NO: 436735 - DNA, 16 bp, M. musculus
tctgccttctcttcca

SEQ ID NO: 436736 - DNA, 16 bp, M. musculus
tctgccttctgcctct

SEQ ID NO: 436737 - DNA, 16 bp, M. musculus
tctgccttctgccttc

SEQ ID NO: 436738 - DNA, 16 bp, M. musculus
tctgccttgtcaataa

SEQ ID NO: 436739 - DNA, 16 bp, M. musculus
tctgcctttatatttt

SEQ ID NO: 436740 - DNA, 16 bp, M. musculus
tctgcctttcgccatc

SEQ ID NO: 436741 - DNA, 16 bp, M. musculus
tctgcctttgtatatt

SEQ ID NO: 436742 - DNA, 16 bp, M. musculus
tctgccttttcatttc

SEQ ID NO: 436743 - DNA, 16 bp, M. musculus
tctgcctttttatgtt

SEQ ID NO: 436744 - DNA, 16 bp, M. musculus
tctgcctttttccctg

SEQ ID NO: 436745 - DNA, 16 bp, M. musculus
tctgcgcactgcctct

SEQ ID NO: 436746 - DNA, 16 bp, M. musculus
tctgctaacccaggcc

SEQ ID NO: 436747 - DNA, 16 bp, M. musculus
tctgctaactgagctg

SEQ ID NO: 436748 - DNA, 16 bp, M. musculus
tctgctacatttgcaa

SEQ ID NO: 436749 - DNA, 16 bp, M. musculus
tctgctacctatgcag

SEQ ID NO: 436750 - DNA, 16 bp, M. musculus
tctgctactctagaga

SEQ ID NO: 436751 - DNA, 16 bp, M. musculus
tctgctagtgcctggc

SEQ ID NO: 436752 - DNA, 16 bp, M. musculus
tctgctatgtatgtat

SEQ ID NO: 436753 - DNA, 16 bp, M. musculus
tctgctcacagcaatg

SEQ ID NO: 436754 - DNA, 16 bp, M. musculus
tctgctcactccggtc

SEQ ID NO: 436755 - DNA, 16 bp, M. musculus
tctgctcagcacctca

SEQ ID NO: 436756 - DNA, 16 bp, M. musculus
tctgctcagggcactg

SEQ ID NO: 436757 - DNA, 16 bp, M. musculus
tctgctcatcctctgc

SEQ ID NO: 436758 - DNA, 16 bp, M. musculus
tctgctccaatctttg

SEQ ID NO: 436759 - DNA, 16 bp, M. musculus
tctgctccacacattg

SEQ ID NO: 436760 - DNA, 16 bp, M. musculus
tctgctccacacgttg

SEQ ID NO: 436761 - DNA, 16 bp, M. musculus
tctgctccagtgaaga

SEQ ID NO: 436762 - DNA, 16 bp, M. musculus
tctgctccagttgttg

SEQ ID NO: 436763 - DNA, 16 bp, M. musculus
tctgctccagtttctg

SEQ ID NO: 436764 - DNA, 16 bp, M. musculus
tctgctccatccacca

SEQ ID NO: 436765 - DNA, 16 bp, M. musculus
tctgctccatccccca

SEQ ID NO: 436766 - DNA, 16 bp, M. musculus
tctgctccattccctg

SEQ ID NO: 436767 - DNA, 16 bp, M. musculus
tctgctccatttctgt

SEQ ID NO: 436768 - DNA, 16 bp, M. musculus
tctgctcccatcagtt

SEQ ID NO: 436769 - DNA, 16 bp, M. musculus
tctgctcctatcagtt

SEQ ID NO: 436770 - DNA, 16 bp, M. musculus
tctgctcctcctcctg

SEQ ID NO: 436771 - DNA, 16 bp, M. musculus
tctgctcctctctctg

SEQ ID NO: 436772 - DNA, 16 bp, M. musculus
tctgctcctgaagatg

SEQ ID NO: 436773 - DNA, 16 bp, M. musculus
tctgctcctggcttcc

SEQ ID NO: 436774 - DNA, 16 bp, M. musculus
tctgctcctgtgaaga

SEQ ID NO: 436775 - DNA, 16 bp, M. musculus
tctgctctcacctgaa

SEQ ID NO: 436776 - DNA, 16 bp, M. musculus
tctgctctctgctctg

SEQ ID NO: 436777 - DNA, 16 bp, M. musculus
tctgctctgacttccc

SEQ ID NO: 436778 - DNA, 16 bp, M. musculus
tctgctctgcactttg

SEQ ID NO: 436779 - DNA, 16 bp, M. musculus
tctgctctgctcccct

SEQ ID NO: 436780 - DNA, 16 bp, M. musculus
tctgctctgctctctc

SEQ ID NO: 436781 - DNA, 16 bp, M. musculus
tctgctctgttctgtt

SEQ ID NO: 436782 - DNA, 17 bp, M. musculus
tctgctcttccagagga

SEQ ID NO: 436783 - DNA, 16 bp, M. musculus
tctgctcttgcagaag

SEQ ID NO: 436784 - DNA, 16 bp, M. musculus
tctgctgacagaggct

SEQ ID NO: 436785 - DNA, 16 bp, M. musculus
tctgctgagattaaag

SEQ ID NO: 436786 - DNA, 16 bp, M. musculus
tctgctgaggcctgtt

SEQ ID NO: 436787 - DNA, 16 bp, M. musculus
tctgctgatagactgt

SEQ ID NO: 436788 - DNA, 16 bp, M. musculus
tctgctgcaagaggaa

SEQ ID NO: 436789 - DNA, 16 bp, M. musculus
tctgctgcacacaggg

SEQ ID NO: 436790 - DNA, 16 bp, M. musculus
tctgctgccaagcctg

SEQ ID NO: 436791 - DNA, 16 bp, M. musculus
tctgctgcctctgcct

SEQ ID NO: 436792 - DNA, 16 bp, M. musculus
tctgctgcctgcctgc

SEQ ID NO: 436793 - DNA, 16 bp, M. musculus
tctgctgcctgtggag

SEQ ID NO: 436794 - DNA, 16 bp, M. musculus
tctgctgctgatgctt

SEQ ID NO: 436795 - DNA, 16 bp, M. musculus
tctgctgctgctgctg

SEQ ID NO: 436796 - DNA, 16 bp, M. musculus
tctgctgctggcaaaa

SEQ ID NO: 436797 - DNA, 16 bp, M. musculus
tctgctgctgttgctg

SEQ ID NO: 436798 - DNA, 16 bp, M. musculus
tctgctgcttacaaga

SEQ ID NO: 436799 - DNA, 16 bp, M. musculus
tctgctggaagtgggc

SEQ ID NO: 436800 - DNA, 16 bp, M. musculus
tctgctggagctggag

SEQ ID NO: 436801 - DNA, 16 bp, M. musculus
tctgctggcactcagg

SEQ ID NO: 436802 - DNA, 16 bp, M. musculus
tctgctggccctcggg

SEQ ID NO: 436803 - DNA, 16 bp, M. musculus
tctgctggcctctcag

SEQ ID NO: 436804 - DNA, 16 bp, M. musculus
tctgctgggctctgtg

SEQ ID NO: 436805 - DNA, 16 bp, M. musculus
tctgctgggggactct

SEQ ID NO: 436806 - DNA, 16 bp, M. musculus
tctgctgggtctccag

SEQ ID NO: 436807 - DNA, 16 bp, M. musculus
tctgctggtcttcctg

SEQ ID NO: 436808 - DNA, 16 bp, M. musculus
tctgctgtaacctgaa

SEQ ID NO: 436809 - DNA, 16 bp, M. musculus
tctgctgtaactcctt

SEQ ID NO: 436810 - DNA, 16 bp, M. musculus
tctgctgtcacctaag

SEQ ID NO: 436811 - DNA, 16 bp, M. musculus
tctgctgtcacgtgag

SEQ ID NO: 436812 - DNA, 16 bp, M. musculus
tctgctgtgccaagga

SEQ ID NO: 436813 - DNA, 16 bp, M. musculus
tctgctgtgcctttct

SEQ ID NO: 436814 - DNA, 16 bp, M. musculus
tctgctgtgctgccca

SEQ ID NO: 436815 - DNA, 16 bp, M. musculus
tctgctgtgttctcag

SEQ ID NO: 436816 - DNA, 16 bp, M. musculus
tctgctgttgctgctg

SEQ ID NO: 436817 - DNA, 16 bp, M. musculus
tctgctgtttacagga

SEQ ID NO: 436818 - DNA, 16 bp, M. musculus
tctgcttagtcaccat

SEQ ID NO: 436819 - DNA, 16 bp, M. musculus
tctgcttcaacaaaac

SEQ ID NO: 436820 - DNA, 16 bp, M. musculus
tctgcttcaaggattt

SEQ ID NO: 436821 - DNA, 16 bp, M. musculus
tctgcttcactctttg

SEQ ID NO: 436822 - DNA, 16 bp, M. musculus
tctgcttcagcaaaaa

SEQ ID NO: 436823 - DNA, 16 bp, M. musculus
tctgcttcagttcctg

SEQ ID NO: 436824 - DNA, 16 bp, M. musculus
tctgcttcatgtttgt

SEQ ID NO: 436825 - DNA, 16 bp, M. musculus
tctgcttcccaaatac

SEQ ID NO: 436826 - DNA, 17 bp, M. musculus
tctgcttcccaagtgct

SEQ ID NO: 436827 - DNA, 16 bp, M. musculus
tctgcttccctgccct

SEQ ID NO: 436828 - DNA, 16 bp, M. musculus
tctgcttccctgtcct

SEQ ID NO: 436829 - DNA, 16 bp, M. musculus
tctgcttcctcctctg

SEQ ID NO: 436830 - DNA, 16 bp, M. musculus
tctgcttcctctttca

SEQ ID NO: 436831 - DNA, 16 bp, M. musculus
tctgcttcctggcttc

SEQ ID NO: 436832 - DNA, 16 bp, M. musculus
tctgcttcctgtctgt

SEQ ID NO: 436833 - DNA, 16 bp, M. musculus
tctgcttcctgtttgt

SEQ ID NO: 436834 - DNA, 16 bp, M. musculus
tctgcttctatgaagg

SEQ ID NO: 436835 - DNA, 16 bp, M. musculus
tctgcttctctctgcc

SEQ ID NO: 436836 - DNA, 16 bp, M. musculus
tctgcttctctctgct

SEQ ID NO: 436837 - DNA, 16 bp, M. musculus
tctgcttctctgcctc

SEQ ID NO: 436838 - DNA, 16 bp, M. musculus
tctgcttctgcctccc

SEQ ID NO: 436839 - DNA, 16 bp, M. musculus
tctgcttctgcctcct

SEQ ID NO: 436840 - DNA, 16 bp, M. musculus
tctgcttctgcttctg

SEQ ID NO: 436841 - DNA, 16 bp, M. musculus
tctgcttctgtgaaga

SEQ ID NO: 436842 - DNA, 16 bp, M. musculus
tctgcttctgtttcag

SEQ ID NO: 436843 - DNA, 16 bp, M. musculus
tctgcttcttggccct

SEQ ID NO: 436844 - DNA, 16 bp, M. musculus
tctgcttgaatgaatt

SEQ ID NO: 436845 - DNA, 16 bp, M. musculus
tctgcttgctctgcag

SEQ ID NO: 436846 - DNA, 22 bp, M. musculus
tctgcttggagggtggcacaga

SEQ ID NO: 436847 - DNA, 16 bp, M. musculus
tctgctttcacctgaa

SEQ ID NO: 436848 - DNA, 16 bp, M. musculus
tctgctttctgcttgt

SEQ ID NO: 436849 - DNA, 16 bp, M. musculus
tctgctttctgttgct

SEQ ID NO: 436850 - DNA, 16 bp, M. musculus
tctgctttcttacaca

SEQ ID NO: 436851 - DNA, 16 bp, M. musculus
tctgcttttcattgtg

SEQ ID NO: 436852 - DNA, 16 bp, M. musculus
tctgcttttctctgcc

SEQ ID NO: 436853 - DNA, 16 bp, M. musculus
tctggaaaaaaccaaa

SEQ ID NO: 436854 - DNA, 16 bp, M. musculus
tctggaaaaataaaaa

SEQ ID NO: 436855 - DNA, 16 bp, M. musculus
tctggaaaagcagcag

SEQ ID NO: 436856 - DNA, 16 bp, M. musculus
tctggaaacaaaacct

SEQ ID NO: 436857 - DNA, 16 bp, M. musculus
tctggaaaccctctat

SEQ ID NO: 436858 - DNA, 16 bp, M. musculus
tctggaaactgtctta

SEQ ID NO: 436859 - DNA, 16 bp, M. musculus
tctggaaagaacccag

SEQ ID NO: 436860 - DNA, 16 bp, M. musculus
tctggaaagctgtctc

SEQ ID NO: 436861 - DNA, 16 bp, M. musculus
tctggaaagttccaga

SEQ ID NO: 436862 - DNA, 16 bp, M. musculus
tctggaaatcagtatg

SEQ ID NO: 436863 - DNA, 16 bp, M. musculus
tctggaaatgaaaaat

SEQ ID NO: 436864 - DNA, 16 bp, M. musculus
tctggaacagcagcaa

SEQ ID NO: 436865 - DNA, 16 bp, M. musculus
tctggaaccagagatg

SEQ ID NO: 436866 - DNA, 16 bp, M. musculus
tctggaactataagcc

SEQ ID NO: 436867 - DNA, 27 bp, M. musculus
tctggaactcactttgtagaccaggct

SEQ ID NO: 436868 - DNA, 16 bp, M. musculus
tctggaactcagtctg

SEQ ID NO: 436869 - DNA, 16 bp, M. musculus
tctggaactctctatg

SEQ ID NO: 436870 - DNA, 16 bp, M. musculus
tctggaactgaagtta

SEQ ID NO: 436871 - DNA, 16 bp, M. musculus
tctggaactggagtta

SEQ ID NO: 436872 - DNA, 16 bp, M. musculus
tctggaacttgctatg

SEQ ID NO: 436873 - DNA, 16 bp, M. musculus
tctggaactttctatg

SEQ ID NO: 436874 - DNA, 16 bp, M. musculus
tctggaagaacagcaa

SEQ ID NO: 436875 - DNA, 16 bp, M. musculus
tctggaagaacagcac

SEQ ID NO: 436876 - DNA, 16 bp, M. musculus
tctggaagaacagcag

SEQ ID NO: 436877 - DNA, 16 bp, M. musculus
tctggaagaacagtat

SEQ ID NO: 436878 - DNA, 16 bp, M. musculus
tctggaagaacatcaa

SEQ ID NO: 436879 - DNA, 16 bp, M. musculus
tctggaagaagagtca

SEQ ID NO: 436880 - DNA, 16 bp, M. musculus
tctggaagagcaacag

SEQ ID NO: 436881 - DNA, 16 bp, M. musculus
tctggaagagcaacca

SEQ ID NO: 436882 - DNA, 16 bp, M. musculus
tctggaagagcaactg

SEQ ID NO: 436883 - DNA, 17 bp, M. musculus
tctggaagagcagtcaa

SEQ ID NO: 436884 - DNA, 16 bp, M. musculus
tctggaagagccagtg

SEQ ID NO: 436885 - DNA, 16 bp, M. musculus
tctggaagagcggtca

SEQ ID NO: 436886 - DNA, 16 bp, M. musculus
tctggaagagctgcaa

SEQ ID NO: 436887 - DNA, 16 bp, M. musculus
tctggaagagtagtaa

SEQ ID NO: 436888 - DNA, 16 bp, M. musculus
tctggaagtcagtgct

SEQ ID NO: 436889 - DNA, 16 bp, M. musculus
tctggaagtcattctg

SEQ ID NO: 436890 - DNA, 16 bp, M. musculus
tctggaagtcctgcct

SEQ ID NO: 436891 - DNA, 16 bp, M. musculus
tctggaatcagttgtt

SEQ ID NO: 436892 - DNA, 16 bp, M. musculus
tctggaattcattctg

SEQ ID NO: 436893 - DNA, 16 bp, M. musculus
tctggacaaaagagaa

SEQ ID NO: 436894 - DNA, 16 bp, M. musculus
tctggaccagaggaca

SEQ ID NO: 436895 - DNA, 16 bp, M. musculus
tctggaccctggagat

SEQ ID NO: 436896 - DNA, 16 bp, M. musculus
tctggactccatgggc

SEQ ID NO: 436897 - DNA, 16 bp, M. musculus
tctggactctgtaggc

SEQ ID NO: 436898 - DNA, 16 bp, M. musculus
tctggactcttccaga

SEQ ID NO: 436899 - DNA, 16 bp, M. musculus
tctggacttggtggcc

SEQ ID NO: 436900 - DNA, 16 bp, M. musculus
tctggagaaactgctg

SEQ ID NO: 436901 - DNA, 16 bp, M. musculus
tctggagaaatcacca

SEQ ID NO: 436902 - DNA, 16 bp, M. musculus
tctggagaaccctgac

SEQ ID NO: 436903 - DNA, 16 bp, M. musculus
tctggagaagcagcca

SEQ ID NO: 436904 - DNA, 16 bp, M. musculus
tctggagacagaagca

SEQ ID NO: 436905 - DNA, 16 bp, M. musculus
tctggagacagctaca

SEQ ID NO: 436906 - DNA, 16 bp, M. musculus
tctggagagatggctc

SEQ ID NO: 436907 - DNA, 16 bp, M. musculus
tctggagagcagtcag

SEQ ID NO: 436908 - DNA, 16 bp, M. musculus
tctggagaggatgtgg

SEQ ID NO: 436909 - DNA, 16 bp, M. musculus
tctggagatctccaga

SEQ ID NO: 436910 - DNA, 16 bp, M. musculus
tctggagatggaaaat

SEQ ID NO: 436911 - DNA, 16 bp, M. musculus
tctggagctagagtta

SEQ ID NO: 436912 - DNA, 16 bp, M. musculus
tctggaggaagaggca

SEQ ID NO: 436913 - DNA, 16 bp, M. musculus
tctggaggagcagcca

SEQ ID NO: 436914 - DNA, 16 bp, M. musculus
tctggaggatatcctg

SEQ ID NO: 436915 - DNA, 16 bp, M. musculus
tctggaggcagaggct

SEQ ID NO: 436916 - DNA, 16 bp, M. musculus
tctggaggccagaaga

SEQ ID NO: 436917 - DNA, 16 bp, M. musculus
tctggaggccccaggg

SEQ ID NO: 436918 - DNA, 16 bp, M. musculus
tctggaggctgaggca

SEQ ID NO: 436919 - DNA, 16 bp, M. musculus
tctggagggagaggca

SEQ ID NO: 436920 - DNA, 16 bp, M. musculus
tctggaggggaaggtg

SEQ ID NO: 436921 - DNA, 16 bp, M. musculus
tctggaggtcagagcc

SEQ ID NO: 436922 - DNA, 16 bp, M. musculus
tctggaggtgtgggtg

SEQ ID NO: 436923 - DNA, 16 bp, M. musculus
tctggaggttcctctg

SEQ ID NO: 436924 - DNA, 17 bp, M. musculus
tctggaggttcttcaga

SEQ ID NO: 436925 - DNA, 16 bp, M. musculus
tctggagtctctgaag

SEQ ID NO: 436926 - DNA, 16 bp, M. musculus
tctggagtctgacttc

SEQ ID NO: 436927 - DNA, 16 bp, M. musculus
tctggagtttctgaag

SEQ ID NO: 436928 - DNA, 16 bp, M. musculus
tctggagtttgaggcc

SEQ ID NO: 436929 - DNA, 16 bp, M. musculus
tctggataaatcttgg

SEQ ID NO: 436930 - DNA, 16 bp, M. musculus
tctggatacatgccca

SEQ ID NO: 436931 - DNA, 16 bp, M. musculus
tctggatattataaat

SEQ ID NO: 436932 - DNA, 16 bp, M. musculus
tctggatcacgaggaa

SEQ ID NO: 436933 - DNA, 16 bp, M. musculus
tctggatcctgttctc

SEQ ID NO: 436934 - DNA, 16 bp, M. musculus
tctggatcctttcgat

SEQ ID NO: 436935 - DNA, 16 bp, M. musculus
tctggatctggatctg

SEQ ID NO: 436936 - DNA, 16 bp, M. musculus
tctggatgaaaaatgt

SEQ ID NO: 436937 - DNA, 16 bp, M. musculus
tctggatgaagcctct

SEQ ID NO: 436938 - DNA, 16 bp, M. musculus
tctggatgttctggaa

SEQ ID NO: 436939 - DNA, 16 bp, M. musculus
tctggattacttcact

SEQ ID NO: 436940 - DNA, 16 bp, M. musculus
tctggattctttccaa

SEQ ID NO: 436941 - DNA, 16 bp, M. musculus
tctggatttggtggct

SEQ ID NO: 436942 - DNA, 16 bp, M. musculus
tctggcaatctgttct

SEQ ID NO: 436943 - DNA, 16 bp, M. musculus
tctggcactcaggagg

SEQ ID NO: 436944 - DNA, 16 bp, M. musculus
tctggcactctcttct

SEQ ID NO: 436945 - DNA, 16 bp, M. musculus
tctggcagagagagag

SEQ ID NO: 436946 - DNA, 16 bp, M. musculus
tctggcagagttcctg

SEQ ID NO: 436947 - DNA, 16 bp, M. musculus
tctggcagccaccgtg

SEQ ID NO: 436948 - DNA, 16 bp, M. musculus
tctggcagcttcttgc

SEQ ID NO: 436949 - DNA, 16 bp, M. musculus
tctggcaggagtcctg

SEQ ID NO: 436950 - DNA, 16 bp, M. musculus
tctggcagggaatgtg

SEQ ID NO: 436951 - DNA, 16 bp, M. musculus
tctggcagtcagagcc

SEQ ID NO: 436952 - DNA, 16 bp, M. musculus
tctggcagttcctgag

SEQ ID NO: 436953 - DNA, 16 bp, M. musculus
tctggcatctggaact

SEQ ID NO: 436954 - DNA, 16 bp, M. musculus
tctggcatctgggact

SEQ ID NO: 436955 - DNA, 16 bp, M. musculus
tctggccaggaaagtg

SEQ ID NO: 436956 - DNA, 16 bp, M. musculus
tctggccatctctcct

SEQ ID NO: 436957 - DNA, 16 bp, M. musculus
tctggccatttctcct

SEQ ID NO: 436958 - DNA, 16 bp, M. musculus
tctggcccatagtcag

SEQ ID NO: 436959 - DNA, 16 bp, M. musculus
tctggccctgcttgct

SEQ ID NO: 436960 - DNA, 16 bp, M. musculus
tctggccctgtgcttt

SEQ ID NO: 436961 - DNA, 16 bp, M. musculus
tctggccgttcctcag

SEQ ID NO: 436962 - DNA, 16 bp, M. musculus
tctggcctcaaactca

SEQ ID NO: 436963 - DNA, 16 bp, M. musculus
tctggcctcagactca

SEQ ID NO: 436964 - DNA, 16 bp, M. musculus
tctggcctcagcagga

SEQ ID NO: 436965 - DNA, 16 bp, M. musculus
tctggcctcagtggga

SEQ ID NO: 436966 - DNA, 16 bp, M. musculus
tctggcctcagttgga

SEQ ID NO: 436967 - DNA, 16 bp, M. musculus
tctggcctcagtttct

SEQ ID NO: 436968 - DNA, 16 bp, M. musculus
tctggcctccacacgc

SEQ ID NO: 436969 - DNA, 16 bp, M. musculus
tctggcctcctagggc

SEQ ID NO: 436970 - DNA, 16 bp, M. musculus
tctggcctcctctggc

SEQ ID NO: 436971 - DNA, 16 bp, M. musculus
tctggcctctacatgc

SEQ ID NO: 436972 - DNA, 16 bp, M. musculus
tctggcctctatgggc

SEQ ID NO: 436973 - DNA, 16 bp, M. musculus
tctggcctctctgggc

SEQ ID NO: 436974 - DNA, 16 bp, M. musculus
tctggcctctggaggc

SEQ ID NO: 436975 - DNA, 16 bp, M. musculus
tctggcctgaaagggt

SEQ ID NO: 436976 - DNA, 16 bp, M. musculus
tctggccttcatcttc

SEQ ID NO: 436977 - DNA, 16 bp, M. musculus
tctggccttcctggcc

SEQ ID NO: 436978 - DNA, 17 bp, M. musculus
tctggctaatatttcaa

SEQ ID NO: 436979 - DNA, 16 bp, M. musculus
tctggctagcctgaaa

SEQ ID NO: 436980 - DNA, 16 bp, M. musculus
tctggctaggacatca

SEQ ID NO: 436981 - DNA, 16 bp, M. musculus
tctggctaggagttca

SEQ ID NO: 436982 - DNA, 16 bp, M. musculus
tctggctagggcttca

SEQ ID NO: 436983 - DNA, 16 bp, M. musculus
tctggctcaaactcct

SEQ ID NO: 436984 - DNA, 16 bp, M. musculus
tctggctccttcactg

SEQ ID NO: 436985 - DNA, 16 bp, M. musculus
tctggctctgcctctg

SEQ ID NO: 436986 - DNA, 16 bp, M. musculus
tctggctctggcattc

SEQ ID NO: 436987 - DNA, 16 bp, M. musculus
tctggctctgggcttt

SEQ ID NO: 436988 - DNA, 16 bp, M. musculus
tctggctctgttcttt

SEQ ID NO: 436989 - DNA, 16 bp, M. musculus
tctggctgaggatgaa

SEQ ID NO: 436990 - DNA, 16 bp, M. musculus
tctggctgcagtggga

SEQ ID NO: 436991 - DNA, 16 bp, M. musculus
tctggctgctctggaa

SEQ ID NO: 436992 - DNA, 16 bp, M. musculus
tctggctggcctggaa

SEQ ID NO: 436993 - DNA, 16 bp, M. musculus
tctggctgggcatggt

SEQ ID NO: 436994 - DNA, 16 bp, M. musculus
tctggctgtcctgaaa

SEQ ID NO: 436995 - DNA, 16 bp, M. musculus
tctggctgtcctggaa

SEQ ID NO: 436996 - DNA, 16 bp, M. musculus
tctggctgtcctggag

SEQ ID NO: 436997 - DNA, 16 bp, M. musculus
tctggctgtcttcttt

SEQ ID NO: 436998 - DNA, 16 bp, M. musculus
tctggctgtcttggaa

SEQ ID NO: 436999 - DNA, 16 bp, M. musculus
tctggctgtgagaagc

SEQ ID NO: 437000 - DNA, 16 bp, M. musculus
tctggctgttacaaat

SEQ ID NO: 437001 - DNA, 16 bp, M. musculus
tctggctgttctggaa

SEQ ID NO: 437002 - DNA, 16 bp, M. musculus
tctggcttacttcact

SEQ ID NO: 437003 - DNA, 16 bp, M. musculus
tctggcttcagtggaa

SEQ ID NO: 437004 - DNA, 16 bp, M. musculus
tctggcttccatgagc

SEQ ID NO: 437005 - DNA, 16 bp, M. musculus
tctggcttcctcaggc

SEQ ID NO: 437006 - DNA, 16 bp, M. musculus
tctggcttcctttgga

SEQ ID NO: 437007 - DNA, 16 bp, M. musculus
tctggcttctctctgc

SEQ ID NO: 437008 - DNA, 16 bp, M. musculus
tctggcttctgtccat

SEQ ID NO: 437009 - DNA, 16 bp, M. musculus
tctggcttgctcccca

SEQ ID NO: 437010 - DNA, 16 bp, M. musculus
tctggctttcctggaa

SEQ ID NO: 437011 - DNA, 16 bp, M. musculus
tctggctttggtgtct

SEQ ID NO: 437012 - DNA, 16 bp, M. musculus
tctgggaaaaaaaaaa

SEQ ID NO: 437013 - DNA, 16 bp, M. musculus
tctgggaaagagtcag

SEQ ID NO: 437014 - DNA, 16 bp, M. musculus
tctgggaaagcagcca

SEQ ID NO: 437015 - DNA, 16 bp, M. musculus
tctgggaaatgtagtt

SEQ ID NO: 437016 - DNA, 16 bp, M. musculus
tctgggaaccaaactc

SEQ ID NO: 437017 - DNA, 16 bp, M. musculus
tctgggaactggacct

SEQ ID NO: 437018 - DNA, 16 bp, M. musculus
tctgggaagaaggaac

SEQ ID NO: 437019 - DNA, 16 bp, M. musculus
tctgggaagagcagtc

SEQ ID NO: 437020 - DNA, 16 bp, M. musculus
tctgggaagatggaga

SEQ ID NO: 437021 - DNA, 16 bp, M. musculus
tctgggaagatggctc

SEQ ID NO: 437022 - DNA, 16 bp, M. musculus
tctgggaaggaagatg

SEQ ID NO: 437023 - DNA, 16 bp, M. musculus
tctgggaaggcagagg

SEQ ID NO: 437024 - DNA, 16 bp, M. musculus
tctgggaaggggagtt

SEQ ID NO: 437025 - DNA, 16 bp, M. musculus
tctgggaagtgtttcc

SEQ ID NO: 437026 - DNA, 16 bp, M. musculus
tctgggaatcattttg

SEQ ID NO: 437027 - DNA, 16 bp, M. musculus
tctgggacagaccccg

SEQ ID NO: 437028 - DNA, 16 bp, M. musculus
tctgggacattttcct

SEQ ID NO: 437029 - DNA, 16 bp, M. musculus
tctgggactagagtta

SEQ ID NO: 437030 - DNA, 16 bp, M. musculus
tctgggactcagcaga

SEQ ID NO: 437031 - DNA, 16 bp, M. musculus
tctgggactggagtta

SEQ ID NO: 437032 - DNA, 16 bp, M. musculus
tctgggacttcttaga

SEQ ID NO: 437033 - DNA, 16 bp, M. musculus
tctgggacttgctggt

SEQ ID NO: 437034 - DNA, 16 bp, M. musculus
tctgggactttctaaa

SEQ ID NO: 437035 - DNA, 16 bp, M. musculus
tctgggagaatccaga

SEQ ID NO: 437036 - DNA, 16 bp, M. musculus
tctgggagaccagctc

SEQ ID NO: 437037 - DNA, 16 bp, M. musculus
tctgggagagagagag

SEQ ID NO: 437038 - DNA, 16 bp, M. musculus
tctgggagagcagcag

SEQ ID NO: 437039 - DNA, 16 bp, M. musculus
tctgggagagcagcca

SEQ ID NO: 437040 - DNA, 16 bp, M. musculus
tctgggagagcctctc

SEQ ID NO: 437041 - DNA, 16 bp, M. musculus
tctgggagaggaggct

SEQ ID NO: 437042 - DNA, 16 bp, M. musculus
tctgggagctcctagg

SEQ ID NO: 437043 - DNA, 16 bp, M. musculus
tctgggagctctcagg

SEQ ID NO: 437044 - DNA, 16 bp, M. musculus
tctgggagctctgagg

SEQ ID NO: 437045 - DNA, 16 bp, M. musculus
tctgggagctctggga

SEQ ID NO: 437046 - DNA, 16 bp, M. musculus
tctgggaggagaggag

SEQ ID NO: 437047 - DNA, 16 bp, M. musculus
tctgggatccaattca

SEQ ID NO: 437048 - DNA, 16 bp, M. musculus
tctgggatcctgtgaa

SEQ ID NO: 437049 - DNA, 16 bp, M. musculus
tctgggatgaagccaa

SEQ ID NO: 437050 - DNA, 16 bp, M. musculus
tctgggatgagctaga

SEQ ID NO: 437051 - DNA, 16 bp, M. musculus
tctgggatgtccgaga

SEQ ID NO: 437052 - DNA, 16 bp, M. musculus
tctgggattacaggca

SEQ ID NO: 437053 - DNA, 16 bp, M. musculus
tctgggattacaggta

SEQ ID NO: 437054 - DNA, 16 bp, M. musculus
tctgggattatttatt

SEQ ID NO: 437055 - DNA, 16 bp, M. musculus
tctgggcaggaactca

SEQ ID NO: 437056 - DNA, 16 bp, M. musculus
tctgggcatgctcagt

SEQ ID NO: 437057 - DNA, 16 bp, M. musculus
tctgggccagccaggg

SEQ ID NO: 437058 - DNA, 16 bp, M. musculus
tctgggccagcctggg

SEQ ID NO: 437059 - DNA, 16 bp, M. musculus
tctgggccccattttt

SEQ ID NO: 437060 - DNA, 16 bp, M. musculus
tctgggccctgtgtct

SEQ ID NO: 437061 - DNA, 16 bp, M. musculus
tctgggcctggagaga

SEQ ID NO: 437062 - DNA, 16 bp, M. musculus
tctgggcctgggtggt

SEQ ID NO: 437063 - DNA, 16 bp, M. musculus
tctgggccttcagttt

SEQ ID NO: 437064 - DNA, 16 bp, M. musculus
tctgggcgaggacacc

SEQ ID NO: 437065 - DNA, 16 bp, M. musculus
tctgggctagagagat

SEQ ID NO: 437066 - DNA, 17 bp, M. musculus
tctgggctatgcctttc

SEQ ID NO: 437067 - DNA, 16 bp, M. musculus
tctgggctcctgtgaa

SEQ ID NO: 437068 - DNA, 16 bp, M. musculus
tctgggctggtagtcc

SEQ ID NO: 437069 - DNA, 16 bp, M. musculus
tctgggcttcagtttc

SEQ ID NO: 437070 - DNA, 16 bp, M. musculus
tctgggcttctttcct

SEQ ID NO: 437071 - DNA, 16 bp, M. musculus
tctggggaaactgagg

SEQ ID NO: 437072 - DNA, 16 bp, M. musculus
tctggggaagactatt

SEQ ID NO: 437073 - DNA, 16 bp, M. musculus
tctggggacttttggg

SEQ ID NO: 437074 - DNA, 17 bp, M. musculus
tctggggcagaccccgt

SEQ ID NO: 437075 - DNA, 16 bp, M. musculus
tctggggctggaaaga

SEQ ID NO: 437076 - DNA, 16 bp, M. musculus
tctgggggagagggaa

SEQ ID NO: 437077 - DNA, 16 bp, M. musculus
tctgggggatctgaca

SEQ ID NO: 437078 - DNA, 16 bp, M. musculus
tctgggggccttccca

SEQ ID NO: 437079 - DNA, 16 bp, M. musculus
tctgggggctggtgag

SEQ ID NO: 437080 - DNA, 16 bp, M. musculus
tctgggggctgtggga

SEQ ID NO: 437081 - DNA, 16 bp, M. musculus
tctggggggaaaaaaa

SEQ ID NO: 437082 - DNA, 16 bp, M. musculus
tctgggggtctttgct

SEQ ID NO: 437083 - DNA, 16 bp, M. musculus
tctggggtttaaacct

SEQ ID NO: 437084 - DNA, 16 bp, M. musculus
tctgggtcagcctggg

SEQ ID NO: 437085 - DNA, 16 bp, M. musculus
tctgggtcctcaggaa

SEQ ID NO: 437086 - DNA, 16 bp, M. musculus
tctgggtctagctttt

SEQ ID NO: 437087 - DNA, 16 bp, M. musculus
tctgggtctcagctct

SEQ ID NO: 437088 - DNA, 17 bp, M. musculus
tctgggtctccaaatat

SEQ ID NO: 437089 - DNA, 16 bp, M. musculus
tctgggtctggagaga

SEQ ID NO: 437090 - DNA, 16 bp, M. musculus
tctgggtcttcagttt

SEQ ID NO: 437091 - DNA, 17 bp, M. musculus
tctgggtcttccctcct

SEQ ID NO: 437092 - DNA, 16 bp, M. musculus
tctgggtgaagcctct

SEQ ID NO: 437093 - DNA, 16 bp, M. musculus
tctgggtgactcttac

SEQ ID NO: 437094 - DNA, 16 bp, M. musculus
tctgggtgggagaggg

SEQ ID NO: 437095 - DNA, 16 bp, M. musculus
tctgggtgtcctggaa

SEQ ID NO: 437096 - DNA, 16 bp, M. musculus
tctgggtgtgtctgtg

SEQ ID NO: 437097 - DNA, 16 bp, M. musculus
tctgggttatatcact

SEQ ID NO: 437098 - DNA, 16 bp, M. musculus
tctgggttcagttccc

SEQ ID NO: 437099 - DNA, 16 bp, M. musculus
tctgggttccatctcc

SEQ ID NO: 437100 - DNA, 16 bp, M. musculus
tctgggttcctgcctt

SEQ ID NO: 437101 - DNA, 16 bp, M. musculus
tctgggttctttccac

SEQ ID NO: 437102 - DNA, 16 bp, M. musculus
tctgggttgtttcaag

SEQ ID NO: 437103 - DNA, 16 bp, M. musculus
tctgggttgttttcag

SEQ ID NO: 437104 - DNA, 16 bp, M. musculus
tctgggtttgatctcc

SEQ ID NO: 437105 - DNA, 16 bp, M. musculus
tctgggtttgggatga

SEQ ID NO: 437106 - DNA, 16 bp, M. musculus
tctgggttttgtgatt

SEQ ID NO: 437107 - DNA, 16 bp, M. musculus
tctgggttttgtggct

SEQ ID NO: 437108 - DNA, 16 bp, M. musculus
tctggtaaatccattt

SEQ ID NO: 437109 - DNA, 16 bp, M. musculus
tctggtactggagtta

SEQ ID NO: 437110 - DNA, 16 bp, M. musculus
tctggtcaactctgct

SEQ ID NO: 437111 - DNA, 16 bp, M. musculus
tctggtcagccctgct

SEQ ID NO: 437112 - DNA, 16 bp, M. musculus
tctggtcagtcaggca

SEQ ID NO: 437113 - DNA, 16 bp, M. musculus
tctggtcctcatgttt

SEQ ID NO: 437114 - DNA, 16 bp, M. musculus
tctggtcctcttgctt

SEQ ID NO: 437115 - DNA, 16 bp, M. musculus
tctggtcctgggcctt

SEQ ID NO: 437116 - DNA, 16 bp, M. musculus
tctggtcctgggcttc

SEQ ID NO: 437117 - DNA, 16 bp, M. musculus
tctggtcctgtggaaa

SEQ ID NO: 437118 - DNA, 16 bp, M. musculus
tctggtctacagaatg

SEQ ID NO: 437119 - DNA, 16 bp, M. musculus
tctggtctccatgtgt

SEQ ID NO: 437120 - DNA, 16 bp, M. musculus
tctggtctctgtctgt

SEQ ID NO: 437121 - DNA, 16 bp, M. musculus
tctggtctgcatagtg

SEQ ID NO: 437122 - DNA, 16 bp, M. musculus
tctggtcttctggaag

SEQ ID NO: 437123 - DNA, 16 bp, M. musculus
tctggtgacacagttc

SEQ ID NO: 437124 - DNA, 16 bp, M. musculus
tctggtgacccctgct

SEQ ID NO: 437125 - DNA, 16 bp, M. musculus
tctggtgaggatgtgg

SEQ ID NO: 437126 - DNA, 16 bp, M. musculus
tctggtgcactctggg

SEQ ID NO: 437127 - DNA, 16 bp, M. musculus
tctggtgctgctgtgt

SEQ ID NO: 437128 - DNA, 16 bp, M. musculus
tctggtgcttcctcca

SEQ ID NO: 437129 - DNA, 16 bp, M. musculus
tctggtgcttctgaag

SEQ ID NO: 437130 - DNA, 16 bp, M. musculus
tctggtggatatcatc

SEQ ID NO: 437131 - DNA, 16 bp, M. musculus
tctggtggctccagcc

SEQ ID NO: 437132 - DNA, 16 bp, M. musculus
tctggtggctcctcag

SEQ ID NO: 437133 - DNA, 16 bp, M. musculus
tctggtgtaaatctga

SEQ ID NO: 437134 - DNA, 20 bp, M. musculus
tctggtgtaattctgatagg

SEQ ID NO: 437135 - DNA, 16 bp, M. musculus
tctggtgtctgaagag

SEQ ID NO: 437136 - DNA, 16 bp, M. musculus
tctggtgtgcctgaag

SEQ ID NO: 437137 - DNA, 16 bp, M. musculus
tctggtgtgtctgtaa

SEQ ID NO: 437138 - DNA, 16 bp, M. musculus
tctggttcagttccca

SEQ ID NO: 437139 - DNA, 16 bp, M. musculus
tctggttgaggaacaa

SEQ ID NO: 437140 - DNA, 16 bp, M. musculus
tctggttggccctgct

SEQ ID NO: 437141 - DNA, 16 bp, M. musculus
tctggtttcagtcaga

SEQ ID NO: 437142 - DNA, 16 bp, M. musculus
tctggtttcccacagt

SEQ ID NO: 437143 - DNA, 16 bp, M. musculus
tctggtttctggtttc

SEQ ID NO: 437144 - DNA, 16 bp, M. musculus
tctggtttgaacttgt

SEQ ID NO: 437145 - DNA, 16 bp, M. musculus
tctggttttatgtgga

SEQ ID NO: 437146 - DNA, 16 bp, M. musculus
tctggttttatttgga

SEQ ID NO: 437147 - DNA, 16 bp, M. musculus
tctgtaaaaacaaaca

SEQ ID NO: 437148 - DNA, 16 bp, M. musculus
tctgtaaaactctcct

SEQ ID NO: 437149 - DNA, 16 bp, M. musculus
tctgtaaaagcagcaa

SEQ ID NO: 437150 - DNA, 16 bp, M. musculus
tctgtaaacacatcat

SEQ ID NO: 437151 - DNA, 16 bp, M. musculus
tctgtaaagaaagaaa

SEQ ID NO: 437152 - DNA, 16 bp, M. musculus
tctgtaactcactctg

SEQ ID NO: 437153 - DNA, 16 bp, M. musculus
tctgtaactccagtcc

SEQ ID NO: 437154 - DNA, 19 bp, M. musculus
tctgtaactccagttccaa

SEQ ID NO: 437155 - DNA, 17 bp, M. musculus
tctgtaactccagttct

SEQ ID NO: 437156 - DNA, 16 bp, M. musculus
tctgtaactccagttt

SEQ ID NO: 437157 - DNA, 16 bp, M. musculus
tctgtaactctagctc

SEQ ID NO: 437158 - DNA, 16 bp, M. musculus
tctgtaactctgtcca

SEQ ID NO: 437159 - DNA, 16 bp, M. musculus
tctgtaactgtaagcc

SEQ ID NO: 437160 - DNA, 16 bp, M. musculus
tctgtaacttcaattc

SEQ ID NO: 437161 - DNA, 16 bp, M. musculus
tctgtaagaaagcagg

SEQ ID NO: 437162 - DNA, 16 bp, M. musculus
tctgtaaggaaaagaa

SEQ ID NO: 437163 - DNA, 16 bp, M. musculus
tctgtaatcccagccc

SEQ ID NO: 437164 - DNA, 16 bp, M. musculus
tctgtaatgaatgtgg

SEQ ID NO: 437165 - DNA, 16 bp, M. musculus
tctgtaatgagatctc

SEQ ID NO: 437166 - DNA, 18 bp, M. musculus
tctgtaatgggatccgat

SEQ ID NO: 437167 - DNA, 16 bp, M. musculus
tctgtaatgggatcta

SEQ ID NO: 437168 - DNA, 16 bp, M. musculus
tctgtaatgggattcg

SEQ ID NO: 437169 - DNA, 16 bp, M. musculus
tctgtaatgggatttg

SEQ ID NO: 437170 - DNA, 16 bp, M. musculus
tctgtaattattttta

SEQ ID NO: 437171 - DNA, 16 bp, M. musculus
tctgtaatttctttct

SEQ ID NO: 437172 - DNA, 16 bp, M. musculus
tctgtacaacaagaac

SEQ ID NO: 437173 - DNA, 16 bp, M. musculus
tctgtacacaaaggat

SEQ ID NO: 437174 - DNA, 16 bp, M. musculus
tctgtaccaatatcat

SEQ ID NO: 437175 - DNA, 16 bp, M. musculus
tctgtaccaatgccat

SEQ ID NO: 437176 - DNA, 16 bp, M. musculus
tctgtaccaggtcctc

SEQ ID NO: 437177 - DNA, 16 bp, M. musculus
tctgtaccccatgttt

SEQ ID NO: 437178 - DNA, 16 bp, M. musculus
tctgtacccccatttt

SEQ ID NO: 437179 - DNA, 16 bp, M. musculus
tctgtagaaatctgtt

SEQ ID NO: 437180 - DNA, 16 bp, M. musculus
tctgtagacagggctg

SEQ ID NO: 437181 - DNA, 16 bp, M. musculus
tctgtagaccaaggtg

SEQ ID NO: 437182 - DNA, 16 bp, M. musculus
tctgtagaccagactg

SEQ ID NO: 437183 - DNA, 16 bp, M. musculus
tctgtagaccaggctt

SEQ ID NO: 437184 - DNA, 16 bp, M. musculus
tctgtagacctggctg

SEQ ID NO: 437185 - DNA, 16 bp, M. musculus
tctgtagatcagactg

SEQ ID NO: 437186 - DNA, 16 bp, M. musculus
tctgtagattgtcttt

SEQ ID NO: 437187 - DNA, 16 bp, M. musculus
tctgtagccaacaaga

SEQ ID NO: 437188 - DNA, 16 bp, M. musculus
tctgtagcccaggcta

SEQ ID NO: 437189 - DNA, 21 bp, M. musculus
tctgtaggagcttggaagata

SEQ ID NO: 437190 - DNA, 16 bp, M. musculus
tctgtaggctgcctct

SEQ ID NO: 437191 - DNA, 16 bp, M. musculus
tctgtaggctgctgct

SEQ ID NO: 437192 - DNA, 16 bp, M. musculus
tctgtaggcttcctgt

SEQ ID NO: 437193 - DNA, 16 bp, M. musculus
tctgtaggtcttcctg

SEQ ID NO: 437194 - DNA, 16 bp, M. musculus
tctgtaggtttggttt

SEQ ID NO: 437195 - DNA, 21 bp, M. musculus
tctgtagtacagctttaggtc

SEQ ID NO: 437196 - DNA, 16 bp, M. musculus
tctgtagtccaggcta

SEQ ID NO: 437197 - DNA, 16 bp, M. musculus
tctgtataagcagaaa

SEQ ID NO: 437198 - DNA, 16 bp, M. musculus
tctgtataccagactg

SEQ ID NO: 437199 - DNA, 16 bp, M. musculus
tctgtataccaggctg

SEQ ID NO: 437200 - DNA, 16 bp, M. musculus
tctgtatatatatata

SEQ ID NO: 437201 - DNA, 16 bp, M. musculus
tctgtatatatgtata

SEQ ID NO: 437202 - DNA, 16 bp, M. musculus
tctgtatatctgtata

SEQ ID NO: 437203 - DNA, 16 bp, M. musculus
tctgtatccatcctct

SEQ ID NO: 437204 - DNA, 16 bp, M. musculus
tctgtatctctctctg

SEQ ID NO: 437205 - DNA, 16 bp, M. musculus
tctgtatctgtgtgta

SEQ ID NO: 437206 - DNA, 16 bp, M. musculus
tctgtatctgttcttt

SEQ ID NO: 437207 - DNA, 16 bp, M. musculus
tctgtatgatatctgt

SEQ ID NO: 437208 - DNA, 16 bp, M. musculus
tctgtatggttcagga

SEQ ID NO: 437209 - DNA, 16 bp, M. musculus
tctgtatgtatgtgta

SEQ ID NO: 437210 - DNA, 16 bp, M. musculus
tctgtatgtgtctctg

SEQ ID NO: 437211 - DNA, 16 bp, M. musculus
tctgtatgtgtctgtg

SEQ ID NO: 437212 - DNA, 16 bp, M. musculus
tctgtatgtgtttctt

SEQ ID NO: 437213 - DNA, 16 bp, M. musculus
tctgtattccacacct

SEQ ID NO: 437214 - DNA, 16 bp, M. musculus
tctgtattccacactc

SEQ ID NO: 437215 - DNA, 16 bp, M. musculus
tctgtatttacatttc

SEQ ID NO: 437216 - DNA, 16 bp, M. musculus
tctgtatttgctcctg

SEQ ID NO: 437217 - DNA, 16 bp, M. musculus
tctgtatttgtaaggc

SEQ ID NO: 437218 - DNA, 16 bp, M. musculus
tctgtatttgtcaggc

SEQ ID NO: 437219 - DNA, 16 bp, M. musculus
tctgtattttattatg

SEQ ID NO: 437220 - DNA, 16 bp, M. musculus
tctgtatttttttaaa

SEQ ID NO: 437221 - DNA, 16 bp, M. musculus
tctgtcaaatctctct

SEQ ID NO: 437222 - DNA, 16 bp, M. musculus
tctgtcaccctcttct

SEQ ID NO: 437223 - DNA, 16 bp, M. musculus
tctgtcactagctcca

SEQ ID NO: 437224 - DNA, 16 bp, M. musculus
tctgtcactccttcca

SEQ ID NO: 437225 - DNA, 16 bp, M. musculus
tctgtcagggaaggtg

SEQ ID NO: 437226 - DNA, 16 bp, M. musculus
tctgtcagtctctgct

SEQ ID NO: 437227 - DNA, 16 bp, M. musculus
tctgtcatcccagcac

SEQ ID NO: 437228 - DNA, 16 bp, M. musculus
tctgtcatctctgtct

SEQ ID NO: 437229 - DNA, 16 bp, M. musculus
tctgtcatggagtcag

SEQ ID NO: 437230 - DNA, 16 bp, M. musculus
tctgtcattttttaaa

SEQ ID NO: 437231 - DNA, 16 bp, M. musculus
tctgtccattgctgag

SEQ ID NO: 437232 - DNA, 16 bp, M. musculus
tctgtcccaacaccac

SEQ ID NO: 437233 - DNA, 16 bp, M. musculus
tctgtcccagaaactg

SEQ ID NO: 437234 - DNA, 16 bp, M. musculus
tctgtcccctcacccc

SEQ ID NO: 437235 - DNA, 16 bp, M. musculus
tctgtccctcataagg

SEQ ID NO: 437236 - DNA, 16 bp, M. musculus
tctgtccctgtgaaga

SEQ ID NO: 437237 - DNA, 16 bp, M. musculus
tctgtccctgtgtctg

SEQ ID NO: 437238 - DNA, 16 bp, M. musculus
tctgtccgtccgtcca

SEQ ID NO: 437239 - DNA, 16 bp, M. musculus
tctgtcctcacagcaa

SEQ ID NO: 437240 - DNA, 16 bp, M. musculus
tctgtcctccacaggc

SEQ ID NO: 437241 - DNA, 16 bp, M. musculus
tctgtcctccatgggc

SEQ ID NO: 437242 - DNA, 16 bp, M. musculus
tctgtcctctcacccc

SEQ ID NO: 437243 - DNA, 16 bp, M. musculus
tctgtcctctcttcca

SEQ ID NO: 437244 - DNA, 16 bp, M. musculus
tctgtcctctgccctc

SEQ ID NO: 437245 - DNA, 16 bp, M. musculus
tctgtcctggaactca

SEQ ID NO: 437246 - DNA, 16 bp, M. musculus
tctgtcctggctgtcc

SEQ ID NO: 437247 - DNA, 16 bp, M. musculus
tctgtcctggcttcct

SEQ ID NO: 437248 - DNA, 16 bp, M. musculus
tctgtcctttctctag

SEQ ID NO: 437249 - DNA, 16 bp, M. musculus
tctgtctagaaatttt

SEQ ID NO: 437250 - DNA, 16 bp, M. musculus
tctgtctatcatctat

SEQ ID NO: 437251 - DNA, 16 bp, M. musculus
tctgtctcaaaaacaa

SEQ ID NO: 437252 - DNA, 16 bp, M. musculus
tctgtctcaaaaataa

SEQ ID NO: 437253 - DNA, 16 bp, M. musculus
tctgtctccatccctc

SEQ ID NO: 437254 - DNA, 16 bp, M. musculus
tctgtctccatctcca

SEQ ID NO: 437255 - DNA, 16 bp, M. musculus
tctgtctccatctctc

SEQ ID NO: 437256 - DNA, 16 bp, M. musculus
tctgtctccatctctg

SEQ ID NO: 437257 - DNA, 16 bp, M. musculus
tctgtctcccaagagc

SEQ ID NO: 437258 - DNA, 16 bp, M. musculus
tctgtctccccagcac

SEQ ID NO: 437259 - DNA, 16 bp, M. musculus
tctgtctcccccaccc

SEQ ID NO: 437260 - DNA, 16 bp, M. musculus
tctgtctccctgtccc

SEQ ID NO: 437261 - DNA, 16 bp, M. musculus
tctgtctccctttgtc

SEQ ID NO: 437262 - DNA, 16 bp, M. musculus
tctgtctcctcaactc

SEQ ID NO: 437263 - DNA, 16 bp, M. musculus
tctgtctcctctgtct

SEQ ID NO: 437264 - DNA, 16 bp, M. musculus
tctgtctcctgggaat

SEQ ID NO: 437265 - DNA, 16 bp, M. musculus
tctgtctcctgtggga

SEQ ID NO: 437266 - DNA, 16 bp, M. musculus
tctgtctctaaataaa

SEQ ID NO: 437267 - DNA, 16 bp, M. musculus
tctgtctctccagccc

SEQ ID NO: 437268 - DNA, 16 bp, M. musculus
tctgtctctctcagct

SEQ ID NO: 437269 - DNA, 16 bp, M. musculus
tctgtctctctcagtc

SEQ ID NO: 437270 - DNA, 16 bp, M. musculus
tctgtctctctctcac

SEQ ID NO: 437271 - DNA, 16 bp, M. musculus
tctgtctctctctgac

SEQ ID NO: 437272 - DNA, 16 bp, M. musculus
tctgtctctctctgtg

SEQ ID NO: 437273 - DNA, 16 bp, M. musculus
tctgtctctctgagct

SEQ ID NO: 437274 - DNA, 16 bp, M. musculus
tctgtctctctgcctc

SEQ ID NO: 437275 - DNA, 16 bp, M. musculus
tctgtctctctgcctg

SEQ ID NO: 437276 - DNA, 16 bp, M. musculus
tctgtctctctgtctg

SEQ ID NO: 437277 - DNA, 16 bp, M. musculus
tctgtctctctgtgtg

SEQ ID NO: 437278 - DNA, 16 bp, M. musculus
tctgtctctgccctcc

SEQ ID NO: 437279 - DNA, 16 bp, M. musculus
tctgtctctgcctccc

SEQ ID NO: 437280 - DNA, 16 bp, M. musculus
tctgtctctgcctcct

SEQ ID NO: 437281 - DNA, 16 bp, M. musculus
tctgtctctgcctctt

SEQ ID NO: 437282 - DNA, 16 bp, M. musculus
tctgtctctgcctgtc

SEQ ID NO: 437283 - DNA, 16 bp, M. musculus
tctgtctctgcttccc

SEQ ID NO: 437284 - DNA, 16 bp, M. musculus
tctgtctctgcttcct

SEQ ID NO: 437285 - DNA, 16 bp, M. musculus
tctgtctctgcttctc

SEQ ID NO: 437286 - DNA, 16 bp, M. musculus
tctgtctctgtacaaa

SEQ ID NO: 437287 - DNA, 16 bp, M. musculus
tctgtctctgtccctc

SEQ ID NO: 437288 - DNA, 16 bp, M. musculus
tctgtctctgtctcag

SEQ ID NO: 437289 - DNA, 16 bp, M. musculus
tctgtctctgtctccc

SEQ ID NO: 437290 - DNA, 23 bp, M. musculus
tctgtctctgtctctctctgtct

SEQ ID NO: 437291 - DNA, 16 bp, M. musculus
tctgtctctgtctctg

SEQ ID NO: 437292 - DNA, 19 bp, M. musculus
tctgtctctgtctctgtct

SEQ ID NO: 437293 - DNA, 16 bp, M. musculus
tctgtctctgtctgtc

SEQ ID NO: 437294 - DNA, 16 bp, M. musculus
tctgtctctgtgcctc

SEQ ID NO: 437295 - DNA, 16 bp, M. musculus
tctgtctctgtgtctc

SEQ ID NO: 437296 - DNA, 16 bp, M. musculus
tctgtctctttctcac

SEQ ID NO: 437297 - DNA, 16 bp, M. musculus
tctgtctgaagacagt

SEQ ID NO: 437298 - DNA, 16 bp, M. musculus
tctgtctgcaagcaca

SEQ ID NO: 437299 - DNA, 16 bp, M. musculus
tctgtctgcatgtaca

SEQ ID NO: 437300 - DNA, 16 bp, M. musculus
tctgtctgcccctgcc

SEQ ID NO: 437301 - DNA, 16 bp, M. musculus
tctgtctgcctctccc

SEQ ID NO: 437302 - DNA, 16 bp, M. musculus
tctgtctgcctctggc

SEQ ID NO: 437303 - DNA, 16 bp, M. musculus
tctgtctgcctgcctc

SEQ ID NO: 437304 - DNA, 16 bp, M. musculus
tctgtctgcctgtgcc

SEQ ID NO: 437305 - DNA, 16 bp, M. musculus
tctgtctgccttcctg

SEQ ID NO: 437306 - DNA, 16 bp, M. musculus
tctgtctggagtctgc

SEQ ID NO: 437307 - DNA, 16 bp, M. musculus
tctgtctggcctggaa

SEQ ID NO: 437308 - DNA, 16 bp, M. musculus
tctgtctgtatgtctg

SEQ ID NO: 437309 - DNA, 16 bp, M. musculus
tctgtctgtccatcca

SEQ ID NO: 437310 - DNA, 16 bp, M. musculus
tctgtctgtccatccc

SEQ ID NO: 437311 - DNA, 16 bp, M. musculus
tctgtctgtccatcta

SEQ ID NO: 437312 - DNA, 16 bp, M. musculus
tctgtctgtccctctg

SEQ ID NO: 437313 - DNA, 16 bp, M. musculus
tctgtctgtctaccca

SEQ ID NO: 437314 - DNA, 16 bp, M. musculus
tctgtctgtctatcat

SEQ ID NO: 437315 - DNA, 16 bp, M. musculus
tctgtctgtctatctc

SEQ ID NO: 437316 - DNA, 16 bp, M. musculus
tctgtctgtctatctg

SEQ ID NO: 437317 - DNA, 16 bp, M. musculus
tctgtctgtctcactg

SEQ ID NO: 437318 - DNA, 16 bp, M. musculus
tctgtctgtctctctc

SEQ ID NO: 437319 - DNA, 16 bp, M. musculus
tctgtctgtctctctg

SEQ ID NO: 437320 - DNA, 16 bp, M. musculus
tctgtctgtctctgcc

SEQ ID NO: 437321 - DNA, 16 bp, M. musculus
tctgtctgtctctgtc

SEQ ID NO: 437322 - DNA, 16 bp, M. musculus
tctgtctgtctgcata

SEQ ID NO: 437323 - DNA, 16 bp, M. musculus
tctgtctgtctgcttc

SEQ ID NO: 437324 - DNA, 16 bp, M. musculus
tctgtctgtctggttt

SEQ ID NO: 437325 - DNA, 16 bp, M. musculus
tctgtctgtctgtaac

SEQ ID NO: 437326 - DNA, 16 bp, M. musculus
tctgtctgtctgtcta

SEQ ID NO: 437327 - DNA, 18 bp, M. musculus
tctgtctgtctgtctctg

SEQ ID NO: 437328 - DNA, 16 bp, M. musculus
tctgtctgtctgtctg

SEQ ID NO: 437329 - DNA, 16 bp, M. musculus
tctgtctgtctgtgtc

SEQ ID NO: 437330 - DNA, 16 bp, M. musculus
tctgtctgtcttggaa

SEQ ID NO: 437331 - DNA, 16 bp, M. musculus
tctgtctgtcttgttc

SEQ ID NO: 437332 - DNA, 16 bp, M. musculus
tctgtctgtgggtctg

SEQ ID NO: 437333 - DNA, 16 bp, M. musculus
tctgtctgtgtgtatc

SEQ ID NO: 437334 - DNA, 16 bp, M. musculus
tctgtctgttcatctg

SEQ ID NO: 437335 - DNA, 16 bp, M. musculus
tctgtctgttgtctgt

SEQ ID NO: 437336 - DNA, 16 bp, M. musculus
tctgtcttcccagtgt

SEQ ID NO: 437337 - DNA, 16 bp, M. musculus
tctgtcttcctgcctg

SEQ ID NO: 437338 - DNA, 16 bp, M. musculus
tctgtcttcctgctgc

SEQ ID NO: 437339 - DNA, 16 bp, M. musculus
tctgtcttctggctga

SEQ ID NO: 437340 - DNA, 16 bp, M. musculus
tctgtctttaaaaata

SEQ ID NO: 437341 - DNA, 16 bp, M. musculus
tctgtctttctatcta

SEQ ID NO: 437342 - DNA, 16 bp, M. musculus
tctgtctttctgtgtg

SEQ ID NO: 437343 - DNA, 16 bp, M. musculus
tctgtctttgagtttg

SEQ ID NO: 437344 - DNA, 16 bp, M. musculus
tctgtctttgccaggc

SEQ ID NO: 437345 - DNA, 16 bp, M. musculus
tctgtcttttccctga

SEQ ID NO: 437346 - DNA, 16 bp, M. musculus
tctgtgaaaactccag

SEQ ID NO: 437347 - DNA, 16 bp, M. musculus
tctgtgaaaagacacc

SEQ ID NO: 437348 - DNA, 16 bp, M. musculus
tctgtgaaaattttta

SEQ ID NO: 437349 - DNA, 16 bp, M. musculus
tctgtgaactgctgga

SEQ ID NO: 437350 - DNA, 16 bp, M. musculus
tctgtgaacttttcgc

SEQ ID NO: 437351 - DNA, 16 bp, M. musculus
tctgtgaagaaagaaa

SEQ ID NO: 437352 - DNA, 16 bp, M. musculus
tctgtgaattcttttt

SEQ ID NO: 437353 - DNA, 16 bp, M. musculus
tctgtgaatttgaggc

SEQ ID NO: 437354 - DNA, 16 bp, M. musculus
tctgtgacatcatcaa

SEQ ID NO: 437355 - DNA, 16 bp, M. musculus
tctgtgactccagctc

SEQ ID NO: 437356 - DNA, 16 bp, M. musculus
tctgtgactcctgttc

SEQ ID NO: 437357 - DNA, 16 bp, M. musculus
tctgtgactctgaggc

SEQ ID NO: 437358 - DNA, 16 bp, M. musculus
tctgtgagacaggaaa

SEQ ID NO: 437359 - DNA, 16 bp, M. musculus
tctgtgagagtgtttc

SEQ ID NO: 437360 - DNA, 16 bp, M. musculus
tctgtgagcacaaaga

SEQ ID NO: 437361 - DNA, 16 bp, M. musculus
tctgtgagcatccact

SEQ ID NO: 437362 - DNA, 16 bp, M. musculus
tctgtgagccccaatg

SEQ ID NO: 437363 - DNA, 16 bp, M. musculus
tctgtgaggacatttc

SEQ ID NO: 437364 - DNA, 18 bp, M. musculus
tctgtgaggagccgccct

SEQ ID NO: 437365 - DNA, 16 bp, M. musculus
tctgtgaggagcgggt

SEQ ID NO: 437366 - DNA, 16 bp, M. musculus
tctgtgagggtgtttc

SEQ ID NO: 437367 - DNA, 16 bp, M. musculus
tctgtgagtctgagac

SEQ ID NO: 437368 - DNA, 16 bp, M. musculus
tctgtgagttcaaggt

SEQ ID NO: 437369 - DNA, 17 bp, M. musculus
tctgtgataactccagc

SEQ ID NO: 437370 - DNA, 16 bp, M. musculus
tctgtgatacctccag

SEQ ID NO: 437371 - DNA, 16 bp, M. musculus
tctgtgatcctatgat

SEQ ID NO: 437372 - DNA, 16 bp, M. musculus
tctgtgatcttcttta

SEQ ID NO: 437373 - DNA, 16 bp, M. musculus
tctgtgattggacagg

SEQ ID NO: 437374 - DNA, 16 bp, M. musculus
tctgtgcacgtgtgtg

SEQ ID NO: 437375 - DNA, 17 bp, M. musculus
tctgtgcagggtacact

SEQ ID NO: 437376 - DNA, 16 bp, M. musculus
tctgtgcatcatgtgt

SEQ ID NO: 437377 - DNA, 16 bp, M. musculus
tctgtgcatgtgtctg

SEQ ID NO: 437378 - DNA, 16 bp, M. musculus
tctgtgccacctccag

SEQ ID NO: 437379 - DNA, 16 bp, M. musculus
tctgtgccaggcactg

SEQ ID NO: 437380 - DNA, 16 bp, M. musculus
tctgtgcctttgagct

SEQ ID NO: 437381 - DNA, 16 bp, M. musculus
tctgtgctccacactt

SEQ ID NO: 437382 - DNA, 16 bp, M. musculus
tctgtgctccattttt

SEQ ID NO: 437383 - DNA, 16 bp, M. musculus
tctgtgctctctctct

SEQ ID NO: 437384 - DNA, 16 bp, M. musculus
tctgtgctctgggcag

SEQ ID NO: 437385 - DNA, 16 bp, M. musculus
tctgtgctctgtgttc

SEQ ID NO: 437386 - DNA, 16 bp, M. musculus
tctgtgctgcagcctg

SEQ ID NO: 437387 - DNA, 16 bp, M. musculus
tctgtgctgctgctgc

SEQ ID NO: 437388 - DNA, 16 bp, M. musculus
tctgtgcttcagtttc

SEQ ID NO: 437389 - DNA, 16 bp, M. musculus
tctgtgcttccagtca

SEQ ID NO: 437390 - DNA, 16 bp, M. musculus
tctgtggacacctgca

SEQ ID NO: 437391 - DNA, 16 bp, M. musculus
tctgtggaccaagctg

SEQ ID NO: 437392 - DNA, 16 bp, M. musculus
tctgtggaccaggctg

SEQ ID NO: 437393 - DNA, 16 bp, M. musculus
tctgtggactgtattt

SEQ ID NO: 437394 - DNA, 16 bp, M. musculus
tctgtggagggacatc

SEQ ID NO: 437395 - DNA, 16 bp, M. musculus
tctgtggagtcctgga

SEQ ID NO: 437396 - DNA, 16 bp, M. musculus
tctgtggatggtcatt

SEQ ID NO: 437397 - DNA, 16 bp, M. musculus
tctgtggcaaaagctt

SEQ ID NO: 437398 - DNA, 16 bp, M. musculus
tctgtggccatcagtc

SEQ ID NO: 437399 - DNA, 16 bp, M. musculus
tctgtggcctgtgcac

SEQ ID NO: 437400 - DNA, 16 bp, M. musculus
tctgtggctataccag

SEQ ID NO: 437401 - DNA, 16 bp, M. musculus
tctgtggctcctgcct

SEQ ID NO: 437402 - DNA, 16 bp, M. musculus
tctgtggcttctgcct

SEQ ID NO: 437403 - DNA, 16 bp, M. musculus
tctgtggctttaactg

SEQ ID NO: 437404 - DNA, 16 bp, M. musculus
tctgtgggactcctaa

SEQ ID NO: 437405 - DNA, 16 bp, M. musculus
tctgtgggcaagcctg

SEQ ID NO: 437406 - DNA, 16 bp, M. musculus
tctgtgggcacctgca

SEQ ID NO: 437407 - DNA, 16 bp, M. musculus
tctgtgggggtccttc

SEQ ID NO: 437408 - DNA, 16 bp, M. musculus
tctgtgggtgtaagga

SEQ ID NO: 437409 - DNA, 16 bp, M. musculus
tctgtggtcaggaagc

SEQ ID NO: 437410 - DNA, 16 bp, M. musculus
tctgtggtccagcttc

SEQ ID NO: 437411 - DNA, 16 bp, M. musculus
tctgtggtccaggctg

SEQ ID NO: 437412 - DNA, 16 bp, M. musculus
tctgtggtctctgcat

SEQ ID NO: 437413 - DNA, 16 bp, M. musculus
tctgtggtgtgtatgt

SEQ ID NO: 437414 - DNA, 16 bp, M. musculus
tctgtggttcctgcct

SEQ ID NO: 437415 - DNA, 16 bp, M. musculus
tctgtgtacattgtct

SEQ ID NO: 437416 - DNA, 16 bp, M. musculus
tctgtgtactacatgt

SEQ ID NO: 437417 - DNA, 16 bp, M. musculus
tctgtgtagctttagc

SEQ ID NO: 437418 - DNA, 16 bp, M. musculus
tctgtgtatatgttat

SEQ ID NO: 437419 - DNA, 16 bp, M. musculus
tctgtgtatgtgtgtg

SEQ ID NO: 437420 - DNA, 16 bp, M. musculus
tctgtgtatgtttgtg

SEQ ID NO: 437421 - DNA, 16 bp, M. musculus
tctgtgtattcatgtg

SEQ ID NO: 437422 - DNA, 16 bp, M. musculus
tctgtgtcagtgtctg

SEQ ID NO: 437423 - DNA, 17 bp, M. musculus
tctgtgtccactcccct

SEQ ID NO: 437424 - DNA, 16 bp, M. musculus
tctgtgtcccaagtgc

SEQ ID NO: 437425 - DNA, 16 bp, M. musculus
tctgtgtcctgctctg

SEQ ID NO: 437426 - DNA, 16 bp, M. musculus
tctgtgtcctgtgtcc

SEQ ID NO: 437427 - DNA, 16 bp, M. musculus
tctgtgtctagatttt

SEQ ID NO: 437428 - DNA, 16 bp, M. musculus
tctgtgtctcagtttc

SEQ ID NO: 437429 - DNA, 16 bp, M. musculus
tctgtgtctctccctc

SEQ ID NO: 437430 - DNA, 16 bp, M. musculus
tctgtgtctctgtgcc

SEQ ID NO: 437431 - DNA, 16 bp, M. musculus
tctgtgtctgcatctg

SEQ ID NO: 437432 - DNA, 16 bp, M. musculus
tctgtgtctgtctcct

SEQ ID NO: 437433 - DNA, 16 bp, M. musculus
tctgtgtctgtctgcc

SEQ ID NO: 437434 - DNA, 16 bp, M. musculus
tctgtgtctgtcttct

SEQ ID NO: 437435 - DNA, 16 bp, M. musculus
tctgtgtctgtgcatg

SEQ ID NO: 437436 - DNA, 16 bp, M. musculus
tctgtgtctgtggtgt

SEQ ID NO: 437437 - DNA, 16 bp, M. musculus
tctgtgtctgtgtcag

SEQ ID NO: 437438 - DNA, 16 bp, M. musculus
tctgtgtctgtgtcca

SEQ ID NO: 437439 - DNA, 20 bp, M. musculus
tctgtgtctgtgtctgtgtg

SEQ ID NO: 437440 - DNA, 16 bp, M. musculus
tctgtgtctgtgtgcc

SEQ ID NO: 437441 - DNA, 16 bp, M. musculus
tctgtgtctgtttctc

SEQ ID NO: 437442 - DNA, 16 bp, M. musculus
tctgtgtgactacaac

SEQ ID NO: 437443 - DNA, 16 bp, M. musculus
tctgtgtgactgatag

SEQ ID NO: 437444 - DNA, 16 bp, M. musculus
tctgtgtgactgtgtg

SEQ ID NO: 437445 - DNA, 16 bp, M. musculus
tctgtgtgagggtgtt

SEQ ID NO: 437446 - DNA, 16 bp, M. musculus
tctgtgtgcagatgtg

SEQ ID NO: 437447 - DNA, 16 bp, M. musculus
tctgtgtgcatgagtg

SEQ ID NO: 437448 - DNA, 16 bp, M. musculus
tctgtgtgcatttgtg

SEQ ID NO: 437449 - DNA, 16 bp, M. musculus
tctgtgtgccaccatg

SEQ ID NO: 437450 - DNA, 16 bp, M. musculus
tctgtgtgccatgtgt

SEQ ID NO: 437451 - DNA, 16 bp, M. musculus
tctgtgtgcctctgtg

SEQ ID NO: 437452 - DNA, 16 bp, M. musculus
tctgtgtgctttctgt

SEQ ID NO: 437453 - DNA, 16 bp, M. musculus
tctgtgtggctctgtg

SEQ ID NO: 437454 - DNA, 16 bp, M. musculus
tctgtgtgtacacaca

SEQ ID NO: 437455 - DNA, 16 bp, M. musculus
tctgtgtgtatgtgtc

SEQ ID NO: 437456 - DNA, 16 bp, M. musculus
tctgtgtgtatgtgtg

SEQ ID NO: 437457 - DNA, 16 bp, M. musculus
tctgtgtgtatttctg

SEQ ID NO: 437458 - DNA, 16 bp, M. musculus
tctgtgtgtccaaatg

SEQ ID NO: 437459 - DNA, 16 bp, M. musculus
tctgtgtgtccctggc

SEQ ID NO: 437460 - DNA, 16 bp, M. musculus
tctgtgtgtctatgtg

SEQ ID NO: 437461 - DNA, 16 bp, M. musculus
tctgtgtgtctctgtg

SEQ ID NO: 437462 - DNA, 16 bp, M. musculus
tctgtgtgtctgaggg

SEQ ID NO: 437463 - DNA, 16 bp, M. musculus
tctgtgtgtctgggtg

SEQ ID NO: 437464 - DNA, 16 bp, M. musculus
tctgtgtgtctgtctg

SEQ ID NO: 437465 - DNA, 16 bp, M. musculus
tctgtgtgtctgtgta

SEQ ID NO: 437466 - DNA, 16 bp, M. musculus
tctgtgtgtctgtgtc

SEQ ID NO: 437467 - DNA, 16 bp, M. musculus
tctgtgtgtgcatctg

SEQ ID NO: 437468 - DNA, 16 bp, M. musculus
tctgtgtgtgggtatg

SEQ ID NO: 437469 - DNA, 16 bp, M. musculus
tctgtgtgtgtatgta

SEQ ID NO: 437470 - DNA, 16 bp, M. musculus
tctgtgtgtgtccgtg

SEQ ID NO: 437471 - DNA, 16 bp, M. musculus
tctgtgtgtgtctgtc

SEQ ID NO: 437472 - DNA, 16 bp, M. musculus
tctgtgtgtgtgtgcc

SEQ ID NO: 437473 - DNA, 16 bp, M. musculus
tctgtgtgtgtgtgcg

SEQ ID NO: 437474 - DNA, 16 bp, M. musculus
tctgtgtgtgtgtgct

SEQ ID NO: 437475 - DNA, 16 bp, M. musculus
tctgtgtgtgtgtgta

SEQ ID NO: 437476 - DNA, 16 bp, M. musculus
tctgtgtgtgtgtgtc

SEQ ID NO: 437477 - DNA, 16 bp, M. musculus
tctgtgtgttcatgca

SEQ ID NO: 437478 - DNA, 16 bp, M. musculus
tctgtgtgttcatttt

SEQ ID NO: 437479 - DNA, 16 bp, M. musculus
tctgtgtgttggagtt

SEQ ID NO: 437480 - DNA, 16 bp, M. musculus
tctgtgtgtttgagtg

SEQ ID NO: 437481 - DNA, 16 bp, M. musculus
tctgtgttccagccag

SEQ ID NO: 437482 - DNA, 16 bp, M. musculus
tctgtgttcttggact

SEQ ID NO: 437483 - DNA, 16 bp, M. musculus
tctgtgttctttcaga

SEQ ID NO: 437484 - DNA, 16 bp, M. musculus
tctgtgttctttccag

SEQ ID NO: 437485 - DNA, 16 bp, M. musculus
tctgtgttgtttatgt

SEQ ID NO: 437486 - DNA, 16 bp, M. musculus
tctgtgtttgctaagc

SEQ ID NO: 437487 - DNA, 16 bp, M. musculus
tctgtgtttgcttccc

SEQ ID NO: 437488 - DNA, 16 bp, M. musculus
tctgtgtttgtatgtg

SEQ ID NO: 437489 - DNA, 16 bp, M. musculus
tctgtgtttgtctctg

SEQ ID NO: 437490 - DNA, 16 bp, M. musculus
tctgtgtttgtgtctc

SEQ ID NO: 437491 - DNA, 16 bp, M. musculus
tctgttaaatccattt

SEQ ID NO: 437492 - DNA, 16 bp, M. musculus
tctgttaccatcaaag

SEQ ID NO: 437493 - DNA, 16 bp, M. musculus
tctgttactgtgataa

SEQ ID NO: 437494 - DNA, 16 bp, M. musculus
tctgttactgtttgaa

SEQ ID NO: 437495 - DNA, 16 bp, M. musculus
tctgttagcaagaatt

SEQ ID NO: 437496 - DNA, 16 bp, M. musculus
tctgttatcctctatc

SEQ ID NO: 437497 - DNA, 18 bp, M. musculus
tctgttcaagagactgag

SEQ ID NO: 437498 - DNA, 16 bp, M. musculus
tctgttcacaacagta

SEQ ID NO: 437499 - DNA, 16 bp, M. musculus
tctgttcacagcaaca

SEQ ID NO: 437500 - DNA, 16 bp, M. musculus
tctgttcacagcagaa

SEQ ID NO: 437501 - DNA, 18 bp, M. musculus
tctgttcacagcaggaaa

SEQ ID NO: 437502 - DNA, 18 bp, M. musculus
tctgttcacagcagtaaa

SEQ ID NO: 437503 - DNA, 16 bp, M. musculus
tctgttcacagcagtt

SEQ ID NO: 437504 - DNA, 16 bp, M. musculus
tctgttcacgtgttca

SEQ ID NO: 437505 - DNA, 16 bp, M. musculus
tctgttcaggatcttc

SEQ ID NO: 437506 - DNA, 16 bp, M. musculus
tctgttccactgtcca

SEQ ID NO: 437507 - DNA, 16 bp, M. musculus
tctgttccattgttct

SEQ ID NO: 437508 - DNA, 16 bp, M. musculus
tctgttcccatcagtt

SEQ ID NO: 437509 - DNA, 16 bp, M. musculus
tctgttcccatctgct

SEQ ID NO: 437510 - DNA, 16 bp, M. musculus
tctgttccccagctga

SEQ ID NO: 437511 - DNA, 16 bp, M. musculus
tctgttctcagcttct

SEQ ID NO: 437512 - DNA, 16 bp, M. musculus
tctgttctctgcccta

SEQ ID NO: 437513 - DNA, 16 bp, M. musculus
tctgttctctgtgtgt

SEQ ID NO: 437514 - DNA, 16 bp, M. musculus
tctgttctgtgttctg

SEQ ID NO: 437515 - DNA, 16 bp, M. musculus
tctgttcttctgtgag

SEQ ID NO: 437516 - DNA, 16 bp, M. musculus
tctgttcttgctgctg

SEQ ID NO: 437517 - DNA, 17 bp, M. musculus
tctgttcttgtggcagt

SEQ ID NO: 437518 - DNA, 16 bp, M. musculus
tctgttgaaagacatc

SEQ ID NO: 437519 - DNA, 16 bp, M. musculus
tctgttgagaagtcag

SEQ ID NO: 437520 - DNA, 16 bp, M. musculus
tctgttgagaagttgg

SEQ ID NO: 437521 - DNA, 16 bp, M. musculus
tctgttgagatctgag

SEQ ID NO: 437522 - DNA, 17 bp, M. musculus
tctgttgagggacatct

SEQ ID NO: 437523 - DNA, 16 bp, M. musculus
tctgttgatgatactt

SEQ ID NO: 437524 - DNA, 16 bp, M. musculus
tctgttgatgatgttt

SEQ ID NO: 437525 - DNA, 16 bp, M. musculus
tctgttgcccaggctg

SEQ ID NO: 437526 - DNA, 16 bp, M. musculus
tctgttgctgatgatc

SEQ ID NO: 437527 - DNA, 16 bp, M. musculus
tctgttgctgcaacaa

SEQ ID NO: 437528 - DNA, 16 bp, M. musculus
tctgttgctggtgctc

SEQ ID NO: 437529 - DNA, 16 bp, M. musculus
tctgttgctgtggcaa

SEQ ID NO: 437530 - DNA, 16 bp, M. musculus
tctgttgctgttgctg

SEQ ID NO: 437531 - DNA, 16 bp, M. musculus
tctgttgcttctgttg

SEQ ID NO: 437532 - DNA, 16 bp, M. musculus
tctgttggcttcttgt

SEQ ID NO: 437533 - DNA, 16 bp, M. musculus
tctgttggtctccctg

SEQ ID NO: 437534 - DNA, 16 bp, M. musculus
tctgttggtgatattt

SEQ ID NO: 437535 - DNA, 16 bp, M. musculus
tctgttgtattctgtt

SEQ ID NO: 437536 - DNA, 23 bp, M. musculus
tctgttgttatgtctcccttttc

SEQ ID NO: 437537 - DNA, 16 bp, M. musculus
tctgttgttcctgttc

SEQ ID NO: 437538 - DNA, 16 bp, M. musculus
tctgttgtttctattg

SEQ ID NO: 437539 - DNA, 16 bp, M. musculus
tctgtttaaattattt

SEQ ID NO: 437540 - DNA, 16 bp, M. musculus
tctgtttaaattgttt

SEQ ID NO: 437541 - DNA, 16 bp, M. musculus
tctgtttaactctgta

SEQ ID NO: 437542 - DNA, 16 bp, M. musculus
tctgtttaagaatttt

SEQ ID NO: 437543 - DNA, 16 bp, M. musculus
tctgtttagcttttgt

SEQ ID NO: 437544 - DNA, 16 bp, M. musculus
tctgtttagggatttt

SEQ ID NO: 437545 - DNA, 16 bp, M. musculus
tctgtttagttctgtg

SEQ ID NO: 437546 - DNA, 16 bp, M. musculus
tctgtttccagggtct

SEQ ID NO: 437547 - DNA, 16 bp, M. musculus
tctgtttcccaaatgc

SEQ ID NO: 437548 - DNA, 16 bp, M. musculus
tctgtttctactttat

SEQ ID NO: 437549 - DNA, 16 bp, M. musculus
tctgtttctcctgctg

SEQ ID NO: 437550 - DNA, 16 bp, M. musculus
tctgtttctctctatc

SEQ ID NO: 437551 - DNA, 16 bp, M. musculus
tctgtttctctctgcc

SEQ ID NO: 437552 - DNA, 16 bp, M. musculus
tctgtttctctgtgtg

SEQ ID NO: 437553 - DNA, 16 bp, M. musculus
tctgtttctcttccat

SEQ ID NO: 437554 - DNA, 16 bp, M. musculus
tctgtttctgagacag

SEQ ID NO: 437555 - DNA, 16 bp, M. musculus
tctgtttcttgactgt

SEQ ID NO: 437556 - DNA, 16 bp, M. musculus
tctgtttcttttctga

SEQ ID NO: 437557 - DNA, 16 bp, M. musculus
tctgtttgtcactcat

SEQ ID NO: 437558 - DNA, 16 bp, M. musculus
tctgtttgtctatata

SEQ ID NO: 437559 - DNA, 16 bp, M. musculus
tctgtttgtctgcctg

SEQ ID NO: 437560 - DNA, 16 bp, M. musculus
tctgtttgtctgtctg

SEQ ID NO: 437561 - DNA, 16 bp, M. musculus
tctgtttgtgtctctc

SEQ ID NO: 437562 - DNA, 16 bp, M. musculus
tctgtttgtgtttccc

SEQ ID NO: 437563 - DNA, 16 bp, M. musculus
tctgttttcatctgct

SEQ ID NO: 437564 - DNA, 16 bp, M. musculus
tctgttttccaaatcc

SEQ ID NO: 437565 - DNA, 16 bp, M. musculus
tctgttttccaagtgc

SEQ ID NO: 437566 - DNA, 16 bp, M. musculus
tctgttttgttactgt

SEQ ID NO: 437567 - DNA, 16 bp, M. musculus
tctgtttttgaaacag

SEQ ID NO: 437568 - DNA, 16 bp, M. musculus
tctgttttttaaagat

SEQ ID NO: 437569 - DNA, 16 bp, M. musculus
tctgtttttttaaaat

SEQ ID NO: 437570 - DNA, 16 bp, M. musculus
tcttaaaaaaaaaagt

SEQ ID NO: 437571 - DNA, 16 bp, M. musculus
tcttaaaaaaaaagtt

SEQ ID NO: 437572 - DNA, 16 bp, M. musculus
tcttaaaaaaaaatgt

SEQ ID NO: 437573 - DNA, 16 bp, M. musculus
tcttaaaaaagaagaa

SEQ ID NO: 437574 - DNA, 16 bp, M. musculus
tcttaaaaacaaattt

SEQ ID NO: 437575 - DNA, 16 bp, M. musculus
tcttaaaaatgaaaaa

SEQ ID NO: 437576 - DNA, 16 bp, M. musculus
tcttaaaacaaaagaa

SEQ ID NO: 437577 - DNA, 16 bp, M. musculus
tcttaaaacaacaaca

SEQ ID NO: 437578 - DNA, 16 bp, M. musculus
tcttaaaagaaaattt

SEQ ID NO: 437579 - DNA, 16 bp, M. musculus
tcttaaaagaacaaca

SEQ ID NO: 437580 - DNA, 16 bp, M. musculus
tcttaaaatccaaagt

SEQ ID NO: 437581 - DNA, 16 bp, M. musculus
tcttaaacagttttat

SEQ ID NO: 437582 - DNA, 16 bp, M. musculus
tcttaaacttctgatc

SEQ ID NO: 437583 - DNA, 16 bp, M. musculus
tcttaaagaaaagaaa

SEQ ID NO: 437584 - DNA, 16 bp, M. musculus
tcttaaagattttttt

SEQ ID NO: 437585 - DNA, 16 bp, M. musculus
tcttaaagcataagcc

SEQ ID NO: 437586 - DNA, 16 bp, M. musculus
tcttaaagtcctccat

SEQ ID NO: 437587 - DNA, 16 bp, M. musculus
tcttaaagtttttaat

SEQ ID NO: 437588 - DNA, 16 bp, M. musculus
tcttaaatattttgat

SEQ ID NO: 437589 - DNA, 16 bp, M. musculus
tcttaaatcttgaaga

SEQ ID NO: 437590 - DNA, 16 bp, M. musculus
tcttaaatgtttattt

SEQ ID NO: 437591 - DNA, 18 bp, M. musculus
tcttaaatttgaaatcaa

SEQ ID NO: 437592 - DNA, 17 bp, M. musculus
tcttaaccactgagcca

SEQ ID NO: 437593 - DNA, 16 bp, M. musculus
tcttaaccactgagct

SEQ ID NO: 437594 - DNA, 16 bp, M. musculus
tcttaaccatggagcc

SEQ ID NO: 437595 - DNA, 17 bp, M. musculus
tcttaaccgctgagcca

SEQ ID NO: 437596 - DNA, 16 bp, M. musculus
tcttaacctctgagtt

SEQ ID NO: 437597 - DNA, 16 bp, M. musculus
tcttaacctctgtgcc

SEQ ID NO: 437598 - DNA, 16 bp, M. musculus
tcttaactactgagcc

SEQ ID NO: 437599 - DNA, 16 bp, M. musculus
tcttaactgctgagct

SEQ ID NO: 437600 - DNA, 16 bp, M. musculus
tcttaactgctggacc

SEQ ID NO: 437601 - DNA, 16 bp, M. musculus
tcttaactggcttgct

SEQ ID NO: 437602 - DNA, 16 bp, M. musculus
tcttaacttctgagct

SEQ ID NO: 437603 - DNA, 16 bp, M. musculus
tcttaagacttggtag

SEQ ID NO: 437604 - DNA, 16 bp, M. musculus
tcttaaggaaggtgcc

SEQ ID NO: 437605 - DNA, 16 bp, M. musculus
tcttaaggtagaacta

SEQ ID NO: 437606 - DNA, 16 bp, M. musculus
tcttaagtgctgagtc

SEQ ID NO: 437607 - DNA, 16 bp, M. musculus
tcttaatgtgttcttg

SEQ ID NO: 437608 - DNA, 16 bp, M. musculus
tcttaattaagaaaat

SEQ ID NO: 437609 - DNA, 16 bp, M. musculus
tcttaattagtgacta

SEQ ID NO: 437610 - DNA, 16 bp, M. musculus
tcttaattgtcaactt

SEQ ID NO: 437611 - DNA, 16 bp, M. musculus
tcttaattttctaaaa

SEQ ID NO: 437612 - DNA, 16 bp, M. musculus
tcttacaaaggacctg

SEQ ID NO: 437613 - DNA, 16 bp, M. musculus
tcttacaagaacaaca

SEQ ID NO: 437614 - DNA, 16 bp, M. musculus
tcttacaagccacctc

SEQ ID NO: 437615 - DNA, 16 bp, M. musculus
tcttacaatttttcca

SEQ ID NO: 437616 - DNA, 16 bp, M. musculus
tcttacacgcgttcgc

SEQ ID NO: 437617 - DNA, 16 bp, M. musculus
tcttacacgcgttctc

SEQ ID NO: 437618 - DNA, 16 bp, M. musculus
tcttacagcacaagcc

SEQ ID NO: 437619 - DNA, 16 bp, M. musculus
tcttacagctctctcc

SEQ ID NO: 437620 - DNA, 16 bp, M. musculus
tcttacagtttgccca

SEQ ID NO: 437621 - DNA, 16 bp, M. musculus
tcttacatcacaagcc

SEQ ID NO: 437622 - DNA, 16 bp, M. musculus
tcttacattctctctg

SEQ ID NO: 437623 - DNA, 16 bp, M. musculus
tcttacattctttttg

SEQ ID NO: 437624 - DNA, 16 bp, M. musculus
tcttacatttatttgt

SEQ ID NO: 437625 - DNA, 16 bp, M. musculus
tcttacctcagcctcc

SEQ ID NO: 437626 - DNA, 16 bp, M. musculus
tcttactatgtagcct

SEQ ID NO: 437627 - DNA, 16 bp, M. musculus
tcttactcttgcctct

SEQ ID NO: 437628 - DNA, 16 bp, M. musculus
tcttactgaaagcaat

SEQ ID NO: 437629 - DNA, 16 bp, M. musculus
tcttactgctgagcca

SEQ ID NO: 437630 - DNA, 16 bp, M. musculus
tcttacttcaaaagtc

SEQ ID NO: 437631 - DNA, 16 bp, M. musculus
tcttacttctcagtct

SEQ ID NO: 437632 - DNA, 16 bp, M. musculus
tcttactttttaaaaa

SEQ ID NO: 437633 - DNA, 16 bp, M. musculus
tcttagaagggggaag

SEQ ID NO: 437634 - DNA, 16 bp, M. musculus
tcttagaagggggagc

SEQ ID NO: 437635 - DNA, 16 bp, M. musculus
tcttagcacttgggag

SEQ ID NO: 437636 - DNA, 16 bp, M. musculus
tcttagccattttgat

SEQ ID NO: 437637 - DNA, 16 bp, M. musculus
tcttagcttcctgctc

SEQ ID NO: 437638 - DNA, 16 bp, M. musculus
tcttaggagaaaaaaa

SEQ ID NO: 437639 - DNA, 16 bp, M. musculus
tcttagtaaacattgg

SEQ ID NO: 437640 - DNA, 16 bp, M. musculus
tcttagtcagggtttt

SEQ ID NO: 437641 - DNA, 16 bp, M. musculus
tcttagtcaggtttct

SEQ ID NO: 437642 - DNA, 16 bp, M. musculus
tcttagtcattctgaa

SEQ ID NO: 437643 - DNA, 29 bp, M. musculus
tcttagtgtctgtataacatctgtccagg

SEQ ID NO: 437644 - DNA, 16 bp, M. musculus
tcttagttttaaaaaa

SEQ ID NO: 437645 - DNA, 16 bp, M. musculus
tcttataaaacagaaa

SEQ ID NO: 437646 - DNA, 16 bp, M. musculus
tcttataaaggacagc

SEQ ID NO: 437647 - DNA, 16 bp, M. musculus
tcttataaaggacatt

SEQ ID NO: 437648 - DNA, 16 bp, M. musculus
tcttataaggaaaaca

SEQ ID NO: 437649 - DNA, 16 bp, M. musculus
tcttataaggagaaca

SEQ ID NO: 437650 - DNA, 16 bp, M. musculus
tcttataatatttctg

SEQ ID NO: 437651 - DNA, 16 bp, M. musculus
tcttatatagcccagg

SEQ ID NO: 437652 - DNA, 31 bp, M. musculus
tcttatccacttgattattgaactcctcctc

SEQ ID NO: 437653 - DNA, 17 bp, M. musculus
tcttatcctaaaaggta

SEQ ID NO: 437654 - DNA, 16 bp, M. musculus
tcttatcgacagtgtc

SEQ ID NO: 437655 - DNA, 16 bp, M. musculus
tcttatgaatattgat

SEQ ID NO: 437656 - DNA, 16 bp, M. musculus
tcttatggaagaacag

SEQ ID NO: 437657 - DNA, 16 bp, M. musculus
tcttattaaaagaaaa

SEQ ID NO: 437658 - DNA, 16 bp, M. musculus
tcttattcatggtttc

SEQ ID NO: 437659 - DNA, 16 bp, M. musculus
tcttattcattcattc

SEQ ID NO: 437660 - DNA, 16 bp, M. musculus
tcttatttacatttca

SEQ ID NO: 437661 - DNA, 16 bp, M. musculus
tcttcaaaacaaaaca

SEQ ID NO: 437662 - DNA, 16 bp, M. musculus
tcttcaaaaggtcctg

SEQ ID NO: 437663 - DNA, 16 bp, M. musculus
tcttcaaacataagta

SEQ ID NO: 437664 - DNA, 16 bp, M. musculus
tcttcaaactcttcca

SEQ ID NO: 437665 - DNA, 16 bp, M. musculus
tcttcaaagaaaaaaa

SEQ ID NO: 437666 - DNA, 16 bp, M. musculus
tcttcaaagacatgaa

SEQ ID NO: 437667 - DNA, 16 bp, M. musculus
tcttcaaagacttgaa

SEQ ID NO: 437668 - DNA, 16 bp, M. musculus
tcttcaaaggaagaga

SEQ ID NO: 437669 - DNA, 16 bp, M. musculus
tcttcaaattcatctg

SEQ ID NO: 437670 - DNA, 16 bp, M. musculus
tcttcaacaacattat

SEQ ID NO: 437671 - DNA, 16 bp, M. musculus
tcttcaacaaggccac

SEQ ID NO: 437672 - DNA, 16 bp, M. musculus
tcttcaactcctttca

SEQ ID NO: 437673 - DNA, 16 bp, M. musculus
tcttcaagaatttttt

SEQ ID NO: 437674 - DNA, 16 bp, M. musculus
tcttcaagagcaacaa

SEQ ID NO: 437675 - DNA, 16 bp, M. musculus
tcttcaagagcagcca

SEQ ID NO: 437676 - DNA, 16 bp, M. musculus
tcttcaaggaaaaaaa

SEQ ID NO: 437677 - DNA, 17 bp, M. musculus
tcttcaaggcttttccc

SEQ ID NO: 437678 - DNA, 16 bp, M. musculus
tcttcaaggcttttct

SEQ ID NO: 437679 - DNA, 16 bp, M. musculus
tcttcaagtctctgaa

SEQ ID NO: 437680 - DNA, 17 bp, M. musculus
tcttcaataaaaacata

SEQ ID NO: 437681 - DNA, 16 bp, M. musculus
tcttcaataaaagaaa

SEQ ID NO: 437682 - DNA, 16 bp, M. musculus
tcttcaataacaagaa

SEQ ID NO: 437683 - DNA, 20 bp, M. musculus
tcttcaattctattccattg

SEQ ID NO: 437684 - DNA, 16 bp, M. musculus
tcttcacaaaaataga

SEQ ID NO: 437685 - DNA, 16 bp, M. musculus
tcttcacaaactattc

SEQ ID NO: 437686 - DNA, 16 bp, M. musculus
tcttcacaaaggataa

SEQ ID NO: 437687 - DNA, 16 bp, M. musculus
tcttcacaatccaaaa

SEQ ID NO: 437688 - DNA, 16 bp, M. musculus
tcttcacagatcttga

SEQ ID NO: 437689 - DNA, 16 bp, M. musculus
tcttcacagcaatggg

SEQ ID NO: 437690 - DNA, 16 bp, M. musculus
tcttcacagccacaga

SEQ ID NO: 437691 - DNA, 17 bp, M. musculus
tcttcacatcctcgcca

SEQ ID NO: 437692 - DNA, 16 bp, M. musculus
tcttcaccaccaccac

SEQ ID NO: 437693 - DNA, 16 bp, M. musculus
tcttcacccctgagcc

SEQ ID NO: 437694 - DNA, 16 bp, M. musculus
tcttcacctgcttcag

SEQ ID NO: 437695 - DNA, 16 bp, M. musculus
tcttcacctgcttgcc

SEQ ID NO: 437696 - DNA, 16 bp, M. musculus
tcttcactctgccagg

SEQ ID NO: 437697 - DNA, 16 bp, M. musculus
tcttcactggagcaga

SEQ ID NO: 437698 - DNA, 16 bp, M. musculus
tcttcacttaaaaaaa

SEQ ID NO: 437699 - DNA, 16 bp, M. musculus
tcttcacttacatttt

SEQ ID NO: 437700 - DNA, 16 bp, M. musculus
tcttcagaaaaggaag

SEQ ID NO: 437701 - DNA, 16 bp, M. musculus
tcttcagaaactccag

SEQ ID NO: 437702 - DNA, 16 bp, M. musculus
tcttcagaaacttgaa

SEQ ID NO: 437703 - DNA, 16 bp, M. musculus
tcttcagaaagaccag

SEQ ID NO: 437704 - DNA, 16 bp, M. musculus
tcttcagacaaaccag

SEQ ID NO: 437705 - DNA, 16 bp, M. musculus
tcttcagacaagggca

SEQ ID NO: 437706 - DNA, 16 bp, M. musculus
tcttcagacacaacag

SEQ ID NO: 437707 - DNA, 16 bp, M. musculus
tcttcagacacacccg

SEQ ID NO: 437708 - DNA, 16 bp, M. musculus
tcttcagagaagggga

SEQ ID NO: 437709 - DNA, 16 bp, M. musculus
tcttcagagacatgaa

SEQ ID NO: 437710 - DNA, 16 bp, M. musculus
tcttcagagactccag

SEQ ID NO: 437711 - DNA, 16 bp, M. musculus
tcttcagagactggaa

SEQ ID NO: 437712 - DNA, 16 bp, M. musculus
tcttcagaggagcaga

SEQ ID NO: 437713 - DNA, 16 bp, M. musculus
tcttcagagtgctggg

SEQ ID NO: 437714 - DNA, 16 bp, M. musculus
tcttcagataccagaa

SEQ ID NO: 437715 - DNA, 16 bp, M. musculus
tcttcagatgtttgaa

SEQ ID NO: 437716 - DNA, 16 bp, M. musculus
tcttcagcaataggga

SEQ ID NO: 437717 - DNA, 16 bp, M. musculus
tcttcagcagcagcag

SEQ ID NO: 437718 - DNA, 16 bp, M. musculus
tcttcagcattgcctc

SEQ ID NO: 437719 - DNA, 18 bp, M. musculus
tcttcagccaggagggag

SEQ ID NO: 437720 - DNA, 16 bp, M. musculus
tcttcagctctgccct

SEQ ID NO: 437721 - DNA, 16 bp, M. musculus
tcttcaggattttttt

SEQ ID NO: 437722 - DNA, 16 bp, M. musculus
tcttcaggctcctctc

SEQ ID NO: 437723 - DNA, 16 bp, M. musculus
tcttcaggctttcata

SEQ ID NO: 437724 - DNA, 16 bp, M. musculus
tcttcagggatagaaa

SEQ ID NO: 437725 - DNA, 16 bp, M. musculus
tcttcagtacaggcta

SEQ ID NO: 437726 - DNA, 16 bp, M. musculus
tcttcagtggccccta

SEQ ID NO: 437727 - DNA, 16 bp, M. musculus
tcttcagtggtgaaaa

SEQ ID NO: 437728 - DNA, 16 bp, M. musculus
tcttcagttgaggaaa

SEQ ID NO: 437729 - DNA, 16 bp, M. musculus
tcttcagtttcatgag

SEQ ID NO: 437730 - DNA, 16 bp, M. musculus
tcttcagtttcttcct

SEQ ID NO: 437731 - DNA, 16 bp, M. musculus
tcttcatagcaacaaa

SEQ ID NO: 437732 - DNA, 16 bp, M. musculus
tcttcatccatccatc

SEQ ID NO: 437733 - DNA, 16 bp, M. musculus
tcttcatcctcagcca

SEQ ID NO: 437734 - DNA, 16 bp, M. musculus
tcttcatcctcatctt

SEQ ID NO: 437735 - DNA, 16 bp, M. musculus
tcttcatcctcctcat

SEQ ID NO: 437736 - DNA, 16 bp, M. musculus
tcttcatcctgactga

SEQ ID NO: 437737 - DNA, 16 bp, M. musculus
tcttcatctatgatga

SEQ ID NO: 437738 - DNA, 16 bp, M. musculus
tcttcatctctgtctc

SEQ ID NO: 437739 - DNA, 20 bp, M. musculus
tcttcatctgaaggctgcta

SEQ ID NO: 437740 - DNA, 16 bp, M. musculus
tcttcatcttggctgg

SEQ ID NO: 437741 - DNA, 16 bp, M. musculus
tcttcatctttgtctt

SEQ ID NO: 437742 - DNA, 16 bp, M. musculus
tcttcatgaagatctg

SEQ ID NO: 437743 - DNA, 16 bp, M. musculus
tcttcatgagacacag

SEQ ID NO: 437744 - DNA, 16 bp, M. musculus
tcttcatggcttactc

SEQ ID NO: 437745 - DNA, 16 bp, M. musculus
tcttcatggtgggaag

SEQ ID NO: 437746 - DNA, 16 bp, M. musculus
tcttcatgttcaatga

SEQ ID NO: 437747 - DNA, 16 bp, M. musculus
tcttcattcaaaccac

SEQ ID NO: 437748 - DNA, 16 bp, M. musculus
tcttcattgatttctt

SEQ ID NO: 437749 - DNA, 16 bp, M. musculus
tcttcattggtaaaat

SEQ ID NO: 437750 - DNA, 16 bp, M. musculus
tcttcatttccatccc

SEQ ID NO: 437751 - DNA, 16 bp, M. musculus
tcttccaaactttata

SEQ ID NO: 437752 - DNA, 16 bp, M. musculus
tcttccaaaggaccag

SEQ ID NO: 437753 - DNA, 16 bp, M. musculus
tcttccaagtgctgca

SEQ ID NO: 437754 - DNA, 16 bp, M. musculus
tcttccaagttcccac

SEQ ID NO: 437755 - DNA, 16 bp, M. musculus
tcttccacaagactcc

SEQ ID NO: 437756 - DNA, 16 bp, M. musculus
tcttccacagaattcc

SEQ ID NO: 437757 - DNA, 16 bp, M. musculus
tcttccacagcatcca

SEQ ID NO: 437758 - DNA, 16 bp, M. musculus
tcttccacaggacctg

SEQ ID NO: 437759 - DNA, 16 bp, M. musculus
tcttccacatcaatca

SEQ ID NO: 437760 - DNA, 16 bp, M. musculus
tcttccacattcctcc

SEQ ID NO: 437761 - DNA, 16 bp, M. musculus
tcttccacattccttc

SEQ ID NO: 437762 - DNA, 16 bp, M. musculus
tcttccaccaaggcca

SEQ ID NO: 437763 - DNA, 16 bp, M. musculus
tcttccactagcagct

SEQ ID NO: 437764 - DNA, 16 bp, M. musculus
tcttccagaaaaccca

SEQ ID NO: 437765 - DNA, 16 bp, M. musculus
tcttccagaagacaca

SEQ ID NO: 437766 - DNA, 16 bp, M. musculus
tcttccagaagaccaa

SEQ ID NO: 437767 - DNA, 16 bp, M. musculus
tcttccagaagtttct

SEQ ID NO: 437768 - DNA, 16 bp, M. musculus
tcttccagagaacctg

SEQ ID NO: 437769 - DNA, 16 bp, M. musculus
tcttccagagcaccca

SEQ ID NO: 437770 - DNA, 16 bp, M. musculus
tcttccagaggaccag

SEQ ID NO: 437771 - DNA, 16 bp, M. musculus
tcttccagaggaccct

SEQ ID NO: 437772 - DNA, 16 bp, M. musculus
tcttccagaggaccta

SEQ ID NO: 437773 - DNA, 16 bp, M. musculus
tcttccagaggacctg

SEQ ID NO: 437774 - DNA, 16 bp, M. musculus
tcttccagaggatcag

SEQ ID NO: 437775 - DNA, 16 bp, M. musculus
tcttccagaggatgca

SEQ ID NO: 437776 - DNA, 16 bp, M. musculus
tcttccagagggcctg

SEQ ID NO: 437777 - DNA, 16 bp, M. musculus
tcttccagagttcctg

SEQ ID NO: 437778 - DNA, 16 bp, M. musculus
tcttccagatgaccca

SEQ ID NO: 437779 - DNA, 20 bp, M. musculus
tcttccagattccaagatgc

SEQ ID NO: 437780 - DNA, 16 bp, M. musculus
tcttccagcctcagcc

SEQ ID NO: 437781 - DNA, 16 bp, M. musculus
tcttccagcctccaca

SEQ ID NO: 437782 - DNA, 16 bp, M. musculus
tcttccagcctctgtg

SEQ ID NO: 437783 - DNA, 16 bp, M. musculus
tcttccagccttttcc

SEQ ID NO: 437784 - DNA, 16 bp, M. musculus
tcttccagctcttaca

SEQ ID NO: 437785 - DNA, 16 bp, M. musculus
tcttccaggaggggag

SEQ ID NO: 437786 - DNA, 16 bp, M. musculus
tcttccagggaacctg

SEQ ID NO: 437787 - DNA, 16 bp, M. musculus
tcttccagtagtatta

SEQ ID NO: 437788 - DNA, 16 bp, M. musculus
tcttccagtctctgct

SEQ ID NO: 437789 - DNA, 16 bp, M. musculus
tcttccagtcttccct

SEQ ID NO: 437790 - DNA, 16 bp, M. musculus
tcttccagtgtgtctg

SEQ ID NO: 437791 - DNA, 16 bp, M. musculus
tcttccagttccaaga

SEQ ID NO: 437792 - DNA, 16 bp, M. musculus
tcttccataagagtcc

SEQ ID NO: 437793 - DNA, 16 bp, M. musculus
tcttccatagtggtcc

SEQ ID NO: 437794 - DNA, 16 bp, M. musculus
tcttccatattccttc

SEQ ID NO: 437795 - DNA, 16 bp, M. musculus
tcttccatgattttgt

SEQ ID NO: 437796 - DNA, 16 bp, M. musculus
tcttccatgttcctac

SEQ ID NO: 437797 - DNA, 16 bp, M. musculus
tcttccatgttctttt

SEQ ID NO: 437798 - DNA, 16 bp, M. musculus
tcttccattccctctg

SEQ ID NO: 437799 - DNA, 16 bp, M. musculus
tcttccatttttaaaa

SEQ ID NO: 437800 - DNA, 16 bp, M. musculus
tcttcccacttcaaat

SEQ ID NO: 437801 - DNA, 16 bp, M. musculus
tcttcccagagttcct

SEQ ID NO: 437802 - DNA, 16 bp, M. musculus
tcttcccagatccttc

SEQ ID NO: 437803 - DNA, 16 bp, M. musculus
tcttcccagtcccacc

SEQ ID NO: 437804 - DNA, 16 bp, M. musculus
tcttcccatacctggt

SEQ ID NO: 437805 - DNA, 16 bp, M. musculus
tcttcccatatctatt

SEQ ID NO: 437806 - DNA, 16 bp, M. musculus
tcttcccattgatgac

SEQ ID NO: 437807 - DNA, 16 bp, M. musculus
tcttccccaagctgct

SEQ ID NO: 437808 - DNA, 16 bp, M. musculus
tcttccccaaggaaga

SEQ ID NO: 437809 - DNA, 16 bp, M. musculus
tcttccccacttactt

SEQ ID NO: 437810 - DNA, 16 bp, M. musculus
tcttccccagcagcct

SEQ ID NO: 437811 - DNA, 16 bp, M. musculus
tcttccccagggaaaa

SEQ ID NO: 437812 - DNA, 16 bp, M. musculus
tcttcccgaggacctg

SEQ ID NO: 437813 - DNA, 16 bp, M. musculus
tcttccctctgagtct

SEQ ID NO: 437814 - DNA, 16 bp, M. musculus
tcttccctcttgaaga

SEQ ID NO: 437815 - DNA, 16 bp, M. musculus
tcttccctgccagagg

SEQ ID NO: 437816 - DNA, 16 bp, M. musculus
tcttccctggagaaaa

SEQ ID NO: 437817 - DNA, 16 bp, M. musculus
tcttccctggggaagg

SEQ ID NO: 437818 - DNA, 16 bp, M. musculus
tcttccgaaggacctg

SEQ ID NO: 437819 - DNA, 16 bp, M. musculus
tcttcctacagggaag

SEQ ID NO: 437820 - DNA, 16 bp, M. musculus
tcttcctagcacatct

SEQ ID NO: 437821 - DNA, 16 bp, M. musculus
tcttcctatggggcca

SEQ ID NO: 437822 - DNA, 16 bp, M. musculus
tcttcctcagcctctt

SEQ ID NO: 437823 - DNA, 16 bp, M. musculus
tcttcctcagtcactt

SEQ ID NO: 437824 - DNA, 16 bp, M. musculus
tcttcctcagtgatgg

SEQ ID NO: 437825 - DNA, 16 bp, M. musculus
tcttcctcagtttctt

SEQ ID NO: 437826 - DNA, 16 bp, M. musculus
tcttcctcatttacat

SEQ ID NO: 437827 - DNA, 16 bp, M. musculus
tcttcctccaccatgt

SEQ ID NO: 437828 - DNA, 16 bp, M. musculus
tcttcctccagcctcc

SEQ ID NO: 437829 - DNA, 16 bp, M. musculus
tcttcctccagcctct

SEQ ID NO: 437830 - DNA, 16 bp, M. musculus
tcttcctccatatcct

SEQ ID NO: 437831 - DNA, 16 bp, M. musculus
tcttcctcccaagtgt

SEQ ID NO: 437832 - DNA, 16 bp, M. musculus
tcttcctcctccatgt

SEQ ID NO: 437833 - DNA, 16 bp, M. musculus
tcttcctcctctgcat

SEQ ID NO: 437834 - DNA, 16 bp, M. musculus
tcttcctcctgggacc

SEQ ID NO: 437835 - DNA, 16 bp, M. musculus
tcttcctctcaagtcc

SEQ ID NO: 437836 - DNA, 16 bp, M. musculus
tcttcctctccaattt

SEQ ID NO: 437837 - DNA, 16 bp, M. musculus
tcttcctctctagcct

SEQ ID NO: 437838 - DNA, 16 bp, M. musculus
tcttcctctgggtgtt

SEQ ID NO: 437839 - DNA, 16 bp, M. musculus
tcttcctgaacctgga

SEQ ID NO: 437840 - DNA, 16 bp, M. musculus
tcttcctgaagaccca

SEQ ID NO: 437841 - DNA, 16 bp, M. musculus
tcttcctgactctgtc

SEQ ID NO: 437842 - DNA, 16 bp, M. musculus
tcttcctgagatggtt

SEQ ID NO: 437843 - DNA, 16 bp, M. musculus
tcttcctgaggaccca

SEQ ID NO: 437844 - DNA, 16 bp, M. musculus
tcttcctgcagcagat

SEQ ID NO: 437845 - DNA, 16 bp, M. musculus
tcttcctgcctcacct

SEQ ID NO: 437846 - DNA, 16 bp, M. musculus
tcttcctgcctcagcc

SEQ ID NO: 437847 - DNA, 16 bp, M. musculus
tcttcctgcctcagct

SEQ ID NO: 437848 - DNA, 16 bp, M. musculus
tcttcctgcctgtctt

SEQ ID NO: 437849 - DNA, 16 bp, M. musculus
tcttcctgccttcact

SEQ ID NO: 437850 - DNA, 16 bp, M. musculus
tcttcctgctgctgct

SEQ ID NO: 437851 - DNA, 16 bp, M. musculus
tcttcctgctgtctgc

SEQ ID NO: 437852 - DNA, 16 bp, M. musculus
tcttcctggccctggc

SEQ ID NO: 437853 - DNA, 16 bp, M. musculus
tcttcctgtccccacc

SEQ ID NO: 437854 - DNA, 16 bp, M. musculus
tcttcctgtctcagcc

SEQ ID NO: 437855 - DNA, 16 bp, M. musculus
tcttcctgtcttcctg

SEQ ID NO: 437856 - DNA, 16 bp, M. musculus
tcttcctgtggagtct

SEQ ID NO: 437857 - DNA, 16 bp, M. musculus
tcttcctgtgtgtctg

SEQ ID NO: 437858 - DNA, 16 bp, M. musculus
tcttcctgtttagcag

SEQ ID NO: 437859 - DNA, 16 bp, M. musculus
tcttccttcaggtctg

SEQ ID NO: 437860 - DNA, 16 bp, M. musculus
tcttccttcctcagtt

SEQ ID NO: 437861 - DNA, 16 bp, M. musculus
tcttccttctcatcta

SEQ ID NO: 437862 - DNA, 16 bp, M. musculus
tcttccttggccaagt

SEQ ID NO: 437863 - DNA, 16 bp, M. musculus
tcttccttggtttctg

SEQ ID NO: 437864 - DNA, 16 bp, M. musculus
tcttccttgttactta

SEQ ID NO: 437865 - DNA, 16 bp, M. musculus
tcttccttttcagttt

SEQ ID NO: 437866 - DNA, 16 bp, M. musculus
tcttcgctgatcttca

SEQ ID NO: 437867 - DNA, 16 bp, M. musculus
tcttctaaaggacctg

SEQ ID NO: 437868 - DNA, 16 bp, M. musculus
tcttctaaaggtcctg

SEQ ID NO: 437869 - DNA, 16 bp, M. musculus
tcttctaagactcaga

SEQ ID NO: 437870 - DNA, 16 bp, M. musculus
tcttctaatgtcctta

SEQ ID NO: 437871 - DNA, 16 bp, M. musculus
tcttctacatgatgac

SEQ ID NO: 437872 - DNA, 16 bp, M. musculus
tcttctacatgcagaa

SEQ ID NO: 437873 - DNA, 16 bp, M. musculus
tcttctacctgtttag

SEQ ID NO: 437874 - DNA, 16 bp, M. musculus
tcttctagaactttca

SEQ ID NO: 437875 - DNA, 16 bp, M. musculus
tcttctagaagacctg

SEQ ID NO: 437876 - DNA, 16 bp, M. musculus
tcttctagaagtttct

SEQ ID NO: 437877 - DNA, 16 bp, M. musculus
tcttctagagaaccca

SEQ ID NO: 437878 - DNA, 16 bp, M. musculus
tcttctagaggaccca

SEQ ID NO: 437879 - DNA, 16 bp, M. musculus
tcttctagaggacctg

SEQ ID NO: 437880 - DNA, 16 bp, M. musculus
tcttctagcctctgca

SEQ ID NO: 437881 - DNA, 16 bp, M. musculus
tcttctattaaattca

SEQ ID NO: 437882 - DNA, 16 bp, M. musculus
tcttctcagagaaggg

SEQ ID NO: 437883 - DNA, 16 bp, M. musculus
tcttctcatacatatg

SEQ ID NO: 437884 - DNA, 16 bp, M. musculus
tcttctccaagagcag

SEQ ID NO: 437885 - DNA, 16 bp, M. musculus
tcttctccaaggaaga

SEQ ID NO: 437886 - DNA, 16 bp, M. musculus
tcttctccaagttgct

SEQ ID NO: 437887 - DNA, 16 bp, M. musculus
tcttctccagagaaga

SEQ ID NO: 437888 - DNA, 16 bp, M. musculus
tcttctccatgcagac

SEQ ID NO: 437889 - DNA, 16 bp, M. musculus
tcttctcctagcagct

SEQ ID NO: 437890 - DNA, 16 bp, M. musculus
tcttctcctcagagaa

SEQ ID NO: 437891 - DNA, 16 bp, M. musculus
tcttctcctctgagag

SEQ ID NO: 437892 - DNA, 16 bp, M. musculus
tcttctctacagccag

SEQ ID NO: 437893 - DNA, 16 bp, M. musculus
tcttctctatccagag

SEQ ID NO: 437894 - DNA, 16 bp, M. musculus
tcttctctcctgaaga

SEQ ID NO: 437895 - DNA, 16 bp, M. musculus
tcttctctctagctgc

SEQ ID NO: 437896 - DNA, 16 bp, M. musculus
tcttctctgagaagag

SEQ ID NO: 437897 - DNA, 16 bp, M. musculus
tcttctctggcaggga

SEQ ID NO: 437898 - DNA, 16 bp, M. musculus
tcttctctggcctctg

SEQ ID NO: 437899 - DNA, 16 bp, M. musculus
tcttctctggggaaga

SEQ ID NO: 437900 - DNA, 16 bp, M. musculus
tcttctctggggcatc

SEQ ID NO: 437901 - DNA, 16 bp, M. musculus
tcttctctggtctctg

SEQ ID NO: 437902 - DNA, 16 bp, M. musculus
tcttctctgtgtagcc

SEQ ID NO: 437903 - DNA, 16 bp, M. musculus
tcttctcttagtgtct

SEQ ID NO: 437904 - DNA, 16 bp, M. musculus
tcttctcttccagatt

SEQ ID NO: 437905 - DNA, 16 bp, M. musculus
tcttctcttcctccaa

SEQ ID NO: 437906 - DNA, 16 bp, M. musculus
tcttctcttcttcagt

SEQ ID NO: 437907 - DNA, 16 bp, M. musculus
tcttctcttgcagaga

SEQ ID NO: 437908 - DNA, 16 bp, M. musculus
tcttctgaaaggctct

SEQ ID NO: 437909 - DNA, 16 bp, M. musculus
tcttctgaagttcctg

SEQ ID NO: 437910 - DNA, 16 bp, M. musculus
tcttctgacatccatg

SEQ ID NO: 437911 - DNA, 16 bp, M. musculus
tcttctgacctccaca

SEQ ID NO: 437912 - DNA, 16 bp, M. musculus
tcttctgacctccatg

SEQ ID NO: 437913 - DNA, 16 bp, M. musculus
tcttctgacctctaca

SEQ ID NO: 437914 - DNA, 16 bp, M. musculus
tcttctgacctctcca

SEQ ID NO: 437915 - DNA, 16 bp, M. musculus
tcttctgacctctgag

SEQ ID NO: 437916 - DNA, 16 bp, M. musculus
tcttctgactcccaca

SEQ ID NO: 437917 - DNA, 16 bp, M. musculus
tcttctgacttccaca

SEQ ID NO: 437918 - DNA, 16 bp, M. musculus
tcttctgacttccatg

SEQ ID NO: 437919 - DNA, 16 bp, M. musculus
tcttctgagacaggat

SEQ ID NO: 437920 - DNA, 16 bp, M. musculus
tcttctgagagcttct

SEQ ID NO: 437921 - DNA, 16 bp, M. musculus
tcttctgagatcatct

SEQ ID NO: 437922 - DNA, 16 bp, M. musculus
tcttctgagtgctgag

SEQ ID NO: 437923 - DNA, 16 bp, M. musculus
tcttctgagttcttca

SEQ ID NO: 437924 - DNA, 16 bp, M. musculus
tcttctgatatatatg

SEQ ID NO: 437925 - DNA, 16 bp, M. musculus
tcttctgatctccaag

SEQ ID NO: 437926 - DNA, 16 bp, M. musculus
tcttctgatgtccttg

SEQ ID NO: 437927 - DNA, 16 bp, M. musculus
tcttctgatgtgtcta

SEQ ID NO: 437928 - DNA, 16 bp, M. musculus
tcttctgcaagagctg

SEQ ID NO: 437929 - DNA, 29 bp, M. musculus
tcttctgcacctgagattctctcttccat

SEQ ID NO: 437930 - DNA, 16 bp, M. musculus
tcttctgcacctgata

SEQ ID NO: 437931 - DNA, 16 bp, M. musculus
tcttctgcaggcagcc

SEQ ID NO: 437932 - DNA, 16 bp, M. musculus
tcttctgcatgaaccc

SEQ ID NO: 437933 - DNA, 16 bp, M. musculus
tcttctgccaggaagc

SEQ ID NO: 437934 - DNA, 16 bp, M. musculus
tcttctgccaggaggt

SEQ ID NO: 437935 - DNA, 17 bp, M. musculus
tcttctgcccctgagat

SEQ ID NO: 437936 - DNA, 16 bp, M. musculus
tcttctgcctcccacc

SEQ ID NO: 437937 - DNA, 16 bp, M. musculus
tcttctgcctctgctt

SEQ ID NO: 437938 - DNA, 16 bp, M. musculus
tcttctgctacatctg

SEQ ID NO: 437939 - DNA, 16 bp, M. musculus
tcttctgctctcagca

SEQ ID NO: 437940 - DNA, 16 bp, M. musculus
tcttctgctgcatatg

SEQ ID NO: 437941 - DNA, 16 bp, M. musculus
tcttctgctgtgtctg

SEQ ID NO: 437942 - DNA, 16 bp, M. musculus
tcttctggaaaagcag

SEQ ID NO: 437943 - DNA, 16 bp, M. musculus
tcttctggaagagcaa

SEQ ID NO: 437944 - DNA, 16 bp, M. musculus
tcttctggaagagctg

SEQ ID NO: 437945 - DNA, 16 bp, M. musculus
tcttctggaagagtgg

SEQ ID NO: 437946 - DNA, 16 bp, M. musculus
tcttctggaagatcag

SEQ ID NO: 437947 - DNA, 16 bp, M. musculus
tcttctggaagggcag

SEQ ID NO: 437948 - DNA, 16 bp, M. musculus
tcttctggaatgtctg

SEQ ID NO: 437949 - DNA, 16 bp, M. musculus
tcttctggacacagca

SEQ ID NO: 437950 - DNA, 16 bp, M. musculus
tcttctggacatgata

SEQ ID NO: 437951 - DNA, 16 bp, M. musculus
tcttctggactccaag

SEQ ID NO: 437952 - DNA, 16 bp, M. musculus
tcttctggactccatg

SEQ ID NO: 437953 - DNA, 16 bp, M. musculus
tcttctggactctgaa

SEQ ID NO: 437954 - DNA, 16 bp, M. musculus
tcttctggaggagcag

SEQ ID NO: 437955 - DNA, 16 bp, M. musculus
tcttctggaggttctg

SEQ ID NO: 437956 - DNA, 31 bp, M. musculus
tcttctggatatatgcccaggagaggtattg

SEQ ID NO: 437957 - DNA, 16 bp, M. musculus
tcttctggatccttct

SEQ ID NO: 437958 - DNA, 16 bp, M. musculus
tcttctggccaccatg

SEQ ID NO: 437959 - DNA, 16 bp, M. musculus
tcttctggccactgca

SEQ ID NO: 437960 - DNA, 16 bp, M. musculus
tcttctggccttcaca

SEQ ID NO: 437961 - DNA, 16 bp, M. musculus
tcttctggcctttggg

SEQ ID NO: 437962 - DNA, 16 bp, M. musculus
tcttctggctccttct

SEQ ID NO: 437963 - DNA, 16 bp, M. musculus
tcttctggcttccaca

SEQ ID NO: 437964 - DNA, 16 bp, M. musculus
tcttctggcttctaca

SEQ ID NO: 437965 - DNA, 16 bp, M. musculus
tcttctggcttctgag

SEQ ID NO: 437966 - DNA, 16 bp, M. musculus
tcttctggctttcaca

SEQ ID NO: 437967 - DNA, 16 bp, M. musculus
tcttctggcttttatg

SEQ ID NO: 437968 - DNA, 16 bp, M. musculus
tcttctggcttttgca

SEQ ID NO: 437969 - DNA, 17 bp, M. musculus
tcttctgggcttctcca

SEQ ID NO: 437970 - DNA, 16 bp, M. musculus
tcttctggggactgtg

SEQ ID NO: 437971 - DNA, 16 bp, M. musculus
tcttctgggtgtcctt

SEQ ID NO: 437972 - DNA, 16 bp, M. musculus
tcttctggtccagtct

SEQ ID NO: 437973 - DNA, 16 bp, M. musculus
tcttctggtctctctg

SEQ ID NO: 437974 - DNA, 16 bp, M. musculus
tcttctggtctctgca

SEQ ID NO: 437975 - DNA, 16 bp, M. musculus
tcttctggtcttcaca

SEQ ID NO: 437976 - DNA, 16 bp, M. musculus
tcttctggtctttgtg

SEQ ID NO: 437977 - DNA, 16 bp, M. musculus
tcttctggtgtgcctg

SEQ ID NO: 437978 - DNA, 17 bp, M. musculus
tcttctggtgtgtctga

SEQ ID NO: 437979 - DNA, 18 bp, M. musculus
tcttctggtgtgtctgaa

SEQ ID NO: 437980 - DNA, 16 bp, M. musculus
tcttctgtagcccagg

SEQ ID NO: 437981 - DNA, 16 bp, M. musculus
tcttctgtatagtgtg

SEQ ID NO: 437982 - DNA, 16 bp, M. musculus
tcttctgtccagctat

SEQ ID NO: 437983 - DNA, 16 bp, M. musculus
tcttctgtctcttata

SEQ ID NO: 437984 - DNA, 16 bp, M. musculus
tcttctgtctggtggc

SEQ ID NO: 437985 - DNA, 16 bp, M. musculus
tcttctgtcttctgtg

SEQ ID NO: 437986 - DNA, 16 bp, M. musculus
tcttctgtgactccca

SEQ ID NO: 437987 - DNA, 16 bp, M. musculus
tcttctgtgatcttct

SEQ ID NO: 437988 - DNA, 16 bp, M. musculus
tcttctgtgatgttcc

SEQ ID NO: 437989 - DNA, 16 bp, M. musculus
tcttctgtgatgtttc

SEQ ID NO: 437990 - DNA, 16 bp, M. musculus
tcttctgtgctgttcc

SEQ ID NO: 437991 - DNA, 16 bp, M. musculus
tcttctgtggagttcc

SEQ ID NO: 437992 - DNA, 16 bp, M. musculus
tcttctgtgtttgcat

SEQ ID NO: 437993 - DNA, 16 bp, M. musculus
tcttctgtttagacta

SEQ ID NO: 437994 - DNA, 16 bp, M. musculus
tcttcttaaaattgaa

SEQ ID NO: 437995 - DNA, 16 bp, M. musculus
tcttcttaaaggaaca

SEQ ID NO: 437996 - DNA, 16 bp, M. musculus
tcttcttactggttgg

SEQ ID NO: 437997 - DNA, 16 bp, M. musculus
tcttcttattctctgg

SEQ ID NO: 437998 - DNA, 16 bp, M. musculus
tcttcttcagtgcctg

SEQ ID NO: 437999 - DNA, 16 bp, M. musculus
tcttcttcatcatcat

SEQ ID NO: 438000 - DNA, 16 bp, M. musculus
tcttcttcatcctcac

SEQ ID NO: 438001 - DNA, 16 bp, M. musculus
tcttcttccactatgt

SEQ ID NO: 438002 - DNA, 16 bp, M. musculus
tcttcttccactgtgt

SEQ ID NO: 438003 - DNA, 16 bp, M. musculus
tcttcttccaggaggc

SEQ ID NO: 438004 - DNA, 16 bp, M. musculus
tcttcttcctcccaag

SEQ ID NO: 438005 - DNA, 16 bp, M. musculus
tcttcttccttcccag

SEQ ID NO: 438006 - DNA, 16 bp, M. musculus
tcttcttccttgaacc

SEQ ID NO: 438007 - DNA, 16 bp, M. musculus
tcttcttctatcatgt

SEQ ID NO: 438008 - DNA, 16 bp, M. musculus
tcttcttctgctgctg

SEQ ID NO: 438009 - DNA, 16 bp, M. musculus
tcttcttctggctgcc

SEQ ID NO: 438010 - DNA, 16 bp, M. musculus
tcttcttctggtccac

SEQ ID NO: 438011 - DNA, 16 bp, M. musculus
tcttcttgcctccaag

SEQ ID NO: 438012 - DNA, 16 bp, M. musculus
tcttcttggagatggg

SEQ ID NO: 438013 - DNA, 17 bp, M. musculus
tcttcttggccacaatc

SEQ ID NO: 438014 - DNA, 16 bp, M. musculus
tcttcttggccatggc

SEQ ID NO: 438015 - DNA, 16 bp, M. musculus
tcttcttggctaccat

SEQ ID NO: 438016 - DNA, 16 bp, M. musculus
tcttcttgggtttcat

SEQ ID NO: 438017 - DNA, 16 bp, M. musculus
tcttcttggtctcctg

SEQ ID NO: 438018 - DNA, 16 bp, M. musculus
tcttcttgtctcctga

SEQ ID NO: 438019 - DNA, 16 bp, M. musculus
tcttctttacctgctt

SEQ ID NO: 438020 - DNA, 16 bp, M. musculus
tcttctttatggctga

SEQ ID NO: 438021 - DNA, 16 bp, M. musculus
tcttctttcaccacat

SEQ ID NO: 438022 - DNA, 16 bp, M. musculus
tcttctttcttcttga

SEQ ID NO: 438023 - DNA, 16 bp, M. musculus
tcttctttgaaattct

SEQ ID NO: 438024 - DNA, 16 bp, M. musculus
tcttctttgaaccaag

SEQ ID NO: 438025 - DNA, 16 bp, M. musculus
tcttctttgaagatct

SEQ ID NO: 438026 - DNA, 16 bp, M. musculus
tcttctttgaatatct

SEQ ID NO: 438027 - DNA, 16 bp, M. musculus
tcttctttggagaaat

SEQ ID NO: 438028 - DNA, 16 bp, M. musculus
tcttctttgtcttcat

SEQ ID NO: 438029 - DNA, 16 bp, M. musculus
tcttcttttaaggtct

SEQ ID NO: 438030 - DNA, 16 bp, M. musculus
tcttcttttttaaagt

SEQ ID NO: 438031 - DNA, 16 bp, M. musculus
tcttgaaaaaaataaa

SEQ ID NO: 438032 - DNA, 16 bp, M. musculus
tcttgaaaaacaaaaa

SEQ ID NO: 438033 - DNA, 16 bp, M. musculus
tcttgaaaaacaacaa

SEQ ID NO: 438034 - DNA, 16 bp, M. musculus
tcttgaaaaacaagca

SEQ ID NO: 438035 - DNA, 16 bp, M. musculus
tcttgaaaaacagaaa

SEQ ID NO: 438036 - DNA, 16 bp, M. musculus
tcttgaaaaaccaaaa

SEQ ID NO: 438037 - DNA, 16 bp, M. musculus
tcttgaaaaacccaaa

SEQ ID NO: 438038 - DNA, 16 bp, M. musculus
tcttgaaaaagaaaca

SEQ ID NO: 438039 - DNA, 16 bp, M. musculus
tcttgaaaaatcaaaa

SEQ ID NO: 438040 - DNA, 16 bp, M. musculus
tcttgaaaaatgaaaa

SEQ ID NO: 438041 - DNA, 16 bp, M. musculus
tcttgaaaagaaaaaa

SEQ ID NO: 438042 - DNA, 16 bp, M. musculus
tcttgaaaataaaata

SEQ ID NO: 438043 - DNA, 16 bp, M. musculus
tcttgaaagaaaaaaa

SEQ ID NO: 438044 - DNA, 16 bp, M. musculus
tcttgaaataaaaagt

SEQ ID NO: 438045 - DNA, 16 bp, M. musculus
tcttgaactcagagat

SEQ ID NO: 438046 - DNA, 16 bp, M. musculus
tcttgaactcctgatc

SEQ ID NO: 438047 - DNA, 16 bp, M. musculus
tcttgaagaaaaaaaa

SEQ ID NO: 438048 - DNA, 16 bp, M. musculus
tcttgaagaagaagaa

SEQ ID NO: 438049 - DNA, 16 bp, M. musculus
tcttgaagaggaccag

SEQ ID NO: 438050 - DNA, 16 bp, M. musculus
tcttgaaggggaacag

SEQ ID NO: 438051 - DNA, 16 bp, M. musculus
tcttgaatttgaggcc

SEQ ID NO: 438052 - DNA, 16 bp, M. musculus
tcttgacctctctggc

SEQ ID NO: 438053 - DNA, 16 bp, M. musculus
tcttgactgatgattg

SEQ ID NO: 438054 - DNA, 16 bp, M. musculus
tcttgagacaaagtct

SEQ ID NO: 438055 - DNA, 16 bp, M. musculus
tcttgagacagggtct

SEQ ID NO: 438056 - DNA, 16 bp, M. musculus
tcttgagacccatccc

SEQ ID NO: 438057 - DNA, 16 bp, M. musculus
tcttgagagactctgc

SEQ ID NO: 438058 - DNA, 16 bp, M. musculus
tcttgagaggcagagg

SEQ ID NO: 438059 - DNA, 16 bp, M. musculus
tcttgagcttcaggtg

SEQ ID NO: 438060 - DNA, 16 bp, M. musculus
tcttgaggctggagag

SEQ ID NO: 438061 - DNA, 16 bp, M. musculus
tcttgagggcacagag

SEQ ID NO: 438062 - DNA, 16 bp, M. musculus
tcttgaggtagatcta

SEQ ID NO: 438063 - DNA, 16 bp, M. musculus
tcttgagtactgagat

SEQ ID NO: 438064 - DNA, 16 bp, M. musculus
tcttgagtactggaat

SEQ ID NO: 438065 - DNA, 16 bp, M. musculus
tcttgagtattttgtt

SEQ ID NO: 438066 - DNA, 16 bp, M. musculus
tcttgagtggctgaga

SEQ ID NO: 438067 - DNA, 16 bp, M. musculus
tcttgagtgttgagat

SEQ ID NO: 438068 - DNA, 16 bp, M. musculus
tcttgagttcaagtcc

SEQ ID NO: 438069 - DNA, 16 bp, M. musculus
tcttgagttctttgca

SEQ ID NO: 438070 - DNA, 16 bp, M. musculus
tcttgatccacttgga

SEQ ID NO: 438071 - DNA, 16 bp, M. musculus
tcttgatctgcaagca

SEQ ID NO: 438072 - DNA, 16 bp, M. musculus
tcttgatcttcatgtg

SEQ ID NO: 438073 - DNA, 16 bp, M. musculus
tcttgatcttgcagca

SEQ ID NO: 438074 - DNA, 16 bp, M. musculus
tcttgatggaggaagt

SEQ ID NO: 438075 - DNA, 16 bp, M. musculus
tcttgattcatgattg

SEQ ID NO: 438076 - DNA, 16 bp, M. musculus
tcttgattctaccagg

SEQ ID NO: 438077 - DNA, 16 bp, M. musculus
tcttgattgatggttg

SEQ ID NO: 438078 - DNA, 16 bp, M. musculus
tcttgatttagttttg

SEQ ID NO: 438079 - DNA, 16 bp, M. musculus
tcttgatttgactttg

SEQ ID NO: 438080 - DNA, 16 bp, M. musculus
tcttgattttaaaaaa

SEQ ID NO: 438081 - DNA, 16 bp, M. musculus
tcttgatttttttaaa

SEQ ID NO: 438082 - DNA, 16 bp, M. musculus
tcttgcaaaggtcctg

SEQ ID NO: 438083 - DNA, 16 bp, M. musculus
tcttgcagaagacctg

SEQ ID NO: 438084 - DNA, 16 bp, M. musculus
tcttgcagaagactca

SEQ ID NO: 438085 - DNA, 16 bp, M. musculus
tcttgcagagaacctg

SEQ ID NO: 438086 - DNA, 16 bp, M. musculus
tcttgcagaggacctg

SEQ ID NO: 438087 - DNA, 16 bp, M. musculus
tcttgcagagggcctg

SEQ ID NO: 438088 - DNA, 16 bp, M. musculus
tcttgcagggaaggtg

SEQ ID NO: 438089 - DNA, 16 bp, M. musculus
tcttgcattctttctg

SEQ ID NO: 438090 - DNA, 17 bp, M. musculus
tcttgccaaaaagcaat

SEQ ID NO: 438091 - DNA, 19 bp, M. musculus
tcttgccaaaagcaatcta

SEQ ID NO: 438092 - DNA, 16 bp, M. musculus
tcttgccacttccaca

SEQ ID NO: 438093 - DNA, 16 bp, M. musculus
tcttgccacttccatg

SEQ ID NO: 438094 - DNA, 16 bp, M. musculus
tcttgccatgtagccc

SEQ ID NO: 438095 - DNA, 16 bp, M. musculus
tcttgcccttgccttt

SEQ ID NO: 438096 - DNA, 16 bp, M. musculus
tcttgcctcagcatgt

SEQ ID NO: 438097 - DNA, 16 bp, M. musculus
tcttgcctcagccttc

SEQ ID NO: 438098 - DNA, 16 bp, M. musculus
tcttgcctcagcttct

SEQ ID NO: 438099 - DNA, 16 bp, M. musculus
tcttgcctcaggctcc

SEQ ID NO: 438100 - DNA, 16 bp, M. musculus
tcttgcctgcatccca

SEQ ID NO: 438101 - DNA, 16 bp, M. musculus
tcttgcctgcctgcct

SEQ ID NO: 438102 - DNA, 16 bp, M. musculus
tcttgcctgctgagcc

SEQ ID NO: 438103 - DNA, 16 bp, M. musculus
tcttgcctggcactag

SEQ ID NO: 438104 - DNA, 16 bp, M. musculus
tcttgcctttaatccc

SEQ ID NO: 438105 - DNA, 18 bp, M. musculus
tcttgctcctttgcctgc

SEQ ID NO: 438106 - DNA, 16 bp, M. musculus
tcttgctctgtgtgtg

SEQ ID NO: 438107 - DNA, 16 bp, M. musculus
tcttgctcttcaggtg

SEQ ID NO: 438108 - DNA, 16 bp, M. musculus
tcttgctcttccagag

SEQ ID NO: 438109 - DNA, 16 bp, M. musculus
tcttgctgaacccaga

SEQ ID NO: 438110 - DNA, 16 bp, M. musculus
tcttgctgaacctgaa

SEQ ID NO: 438111 - DNA, 16 bp, M. musculus
tcttgctgcctgcaga

SEQ ID NO: 438112 - DNA, 16 bp, M. musculus
tcttgctgtgtatccc

SEQ ID NO: 438113 - DNA, 16 bp, M. musculus
tcttgcttcagcctcc

SEQ ID NO: 438114 - DNA, 16 bp, M. musculus
tcttgcttccctggag

SEQ ID NO: 438115 - DNA, 16 bp, M. musculus
tcttgctttctgacct

SEQ ID NO: 438116 - DNA, 16 bp, M. musculus
tcttggaactcacaga

SEQ ID NO: 438117 - DNA, 16 bp, M. musculus
tcttggaactcactat

SEQ ID NO: 438118 - DNA, 16 bp, M. musculus
tcttggaactggaaga

SEQ ID NO: 438119 - DNA, 16 bp, M. musculus
tcttggaagattttta

SEQ ID NO: 438120 - DNA, 16 bp, M. musculus
tcttggaaggttttac

SEQ ID NO: 438121 - DNA, 16 bp, M. musculus
tcttggaatgtgttct

SEQ ID NO: 438122 - DNA, 16 bp, M. musculus
tcttggagaaaatcaa

SEQ ID NO: 438123 - DNA, 16 bp, M. musculus
tcttggagaaacagga

SEQ ID NO: 438124 - DNA, 16 bp, M. musculus
tcttggagaccccaag

SEQ ID NO: 438125 - DNA, 16 bp, M. musculus
tcttggagatttataa

SEQ ID NO: 438126 - DNA, 16 bp, M. musculus
tcttggagctcactct

SEQ ID NO: 438127 - DNA, 16 bp, M. musculus
tcttggagctggagtt

SEQ ID NO: 438128 - DNA, 16 bp, M. musculus
tcttggaggaaactgt

SEQ ID NO: 438129 - DNA, 16 bp, M. musculus
tcttggaggagagcag

SEQ ID NO: 438130 - DNA, 16 bp, M. musculus
tcttggatattctaaa

SEQ ID NO: 438131 - DNA, 16 bp, M. musculus
tcttggatattttgtt

SEQ ID NO: 438132 - DNA, 16 bp, M. musculus
tcttggatgctttggg

SEQ ID NO: 438133 - DNA, 16 bp, M. musculus
tcttggattaaagatg

SEQ ID NO: 438134 - DNA, 16 bp, M. musculus
tcttggattaaaggtg

SEQ ID NO: 438135 - DNA, 16 bp, M. musculus
tcttggattcagcttg

SEQ ID NO: 438136 - DNA, 16 bp, M. musculus
tcttggatttctgatg

SEQ ID NO: 438137 - DNA, 16 bp, M. musculus
tcttggcaggcctcat

SEQ ID NO: 438138 - DNA, 17 bp, M. musculus
tcttggcatctgcaata

SEQ ID NO: 438139 - DNA, 16 bp, M. musculus
tcttggccagcctggt

SEQ ID NO: 438140 - DNA, 16 bp, M. musculus
tcttggcccagggagt

SEQ ID NO: 438141 - DNA, 16 bp, M. musculus
tcttggcccccaggtg

SEQ ID NO: 438142 - DNA, 16 bp, M. musculus
tcttggcctcccaagt

SEQ ID NO: 438143 - DNA, 16 bp, M. musculus
tcttggcctctgtggg

SEQ ID NO: 438144 - DNA, 16 bp, M. musculus
tcttggcctggcattc

SEQ ID NO: 438145 - DNA, 16 bp, M. musculus
tcttggccttttggct

SEQ ID NO: 438146 - DNA, 16 bp, M. musculus
tcttggctgaagatga

SEQ ID NO: 438147 - DNA, 16 bp, M. musculus
tcttggctggcctgga

SEQ ID NO: 438148 - DNA, 16 bp, M. musculus
tcttggctgtcctgaa

SEQ ID NO: 438149 - DNA, 16 bp, M. musculus
tcttggcttccctcag

SEQ ID NO: 438150 - DNA, 16 bp, M. musculus
tcttgggaaaaaaaaa

SEQ ID NO: 438151 - DNA, 16 bp, M. musculus
tcttgggaccatttcc

SEQ ID NO: 438152 - DNA, 16 bp, M. musculus
tcttgggcaccgctgg

SEQ ID NO: 438153 - DNA, 16 bp, M. musculus
tcttgggccaggtctg

SEQ ID NO: 438154 - DNA, 16 bp, M. musculus
tcttgggctggttcta

SEQ ID NO: 438155 - DNA, 16 bp, M. musculus
tcttggggaatcacca

SEQ ID NO: 438156 - DNA, 16 bp, M. musculus
tcttggggtttccaag

SEQ ID NO: 438157 - DNA, 16 bp, M. musculus
tcttgggtattcttag

SEQ ID NO: 438158 - DNA, 16 bp, M. musculus
tcttgggtctgtttgc

SEQ ID NO: 438159 - DNA, 16 bp, M. musculus
tcttgggtgcagaaga

SEQ ID NO: 438160 - DNA, 16 bp, M. musculus
tcttgggtgctggaat

SEQ ID NO: 438161 - DNA, 16 bp, M. musculus
tcttgggttttgaatt

SEQ ID NO: 438162 - DNA, 16 bp, M. musculus
tcttggtcatcctgat

SEQ ID NO: 438163 - DNA, 17 bp, M. musculus
tcttggtcatggtgtct

SEQ ID NO: 438164 - DNA, 16 bp, M. musculus
tcttggtcccttgtct

SEQ ID NO: 438165 - DNA, 16 bp, M. musculus
tcttggtctctgcttc

SEQ ID NO: 438166 - DNA, 16 bp, M. musculus
tcttggtcttcctgtg

SEQ ID NO: 438167 - DNA, 16 bp, M. musculus
tcttggtggacacctt

SEQ ID NO: 438168 - DNA, 37 bp, M. musculus
tcttggtggtcatctcatggtactggcatctccaaaa

SEQ ID NO: 438169 - DNA, 16 bp, M. musculus
tcttggttattccaag

SEQ ID NO: 438170 - DNA, 16 bp, M. musculus
tcttggtttaattttg

SEQ ID NO: 438171 - DNA, 16 bp, M. musculus
tcttggtttcatcttt

SEQ ID NO: 438172 - DNA, 16 bp, M. musculus
tcttgtaaaaaaaaaa

SEQ ID NO: 438173 - DNA, 16 bp, M. musculus
tcttgtaaaaataaaa

SEQ ID NO: 438174 - DNA, 16 bp, M. musculus
tcttgtaagcaggaca

SEQ ID NO: 438175 - DNA, 16 bp, M. musculus
tcttgtacttgcctct

SEQ ID NO: 438176 - DNA, 16 bp, M. musculus
tcttgtatatttatag

SEQ ID NO: 438177 - DNA, 16 bp, M. musculus
tcttgtatgtatgtgt

SEQ ID NO: 438178 - DNA, 16 bp, M. musculus
tcttgtattctgtggc

SEQ ID NO: 438179 - DNA, 23 bp, M. musculus
tcttgtattctgttgctgatgct

SEQ ID NO: 438180 - DNA, 16 bp, M. musculus
tcttgtatttctttaa

SEQ ID NO: 438181 - DNA, 16 bp, M. musculus
tcttgtattttcatgg

SEQ ID NO: 438182 - DNA, 16 bp, M. musculus
tcttgtcagcactgtt

SEQ ID NO: 438183 - DNA, 16 bp, M. musculus
tcttgtctcaaaaaat

SEQ ID NO: 438184 - DNA, 16 bp, M. musculus
tcttgtctttagctgc

SEQ ID NO: 438185 - DNA, 16 bp, M. musculus
tcttgtgcactgtgtg

SEQ ID NO: 438186 - DNA, 16 bp, M. musculus
tcttgtgcatgctgtc

SEQ ID NO: 438187 - DNA, 16 bp, M. musculus
tcttgtggaatagttt

SEQ ID NO: 438188 - DNA, 16 bp, M. musculus
tcttgtggaattttta

SEQ ID NO: 438189 - DNA, 16 bp, M. musculus
tcttgtggagtgggcc

SEQ ID NO: 438190 - DNA, 16 bp, M. musculus
tcttgtggtgtccttg

SEQ ID NO: 438191 - DNA, 16 bp, M. musculus
tcttgtgtattctgtt

SEQ ID NO: 438192 - DNA, 16 bp, M. musculus
tcttgtgttttggaaa

SEQ ID NO: 438193 - DNA, 16 bp, M. musculus
tcttgttaaacttctt

SEQ ID NO: 438194 - DNA, 16 bp, M. musculus
tcttgttcattttctc

SEQ ID NO: 438195 - DNA, 16 bp, M. musculus
tcttgttgaagcagga

SEQ ID NO: 438196 - DNA, 16 bp, M. musculus
tcttgttgagcttcat

SEQ ID NO: 438197 - DNA, 16 bp, M. musculus
tcttgttgctacttca

SEQ ID NO: 438198 - DNA, 16 bp, M. musculus
tcttgttgctatgata

SEQ ID NO: 438199 - DNA, 16 bp, M. musculus
tcttgttggatgtcag

SEQ ID NO: 438200 - DNA, 16 bp, M. musculus
tcttgttgtagtaggt

SEQ ID NO: 438201 - DNA, 16 bp, M. musculus
tcttgtttatatatct

SEQ ID NO: 438202 - DNA, 16 bp, M. musculus
tcttgtttccactgga

SEQ ID NO: 438203 - DNA, 16 bp, M. musculus
tcttgtttccacttag

SEQ ID NO: 438204 - DNA, 16 bp, M. musculus
tcttgtttttaaagat

SEQ ID NO: 438205 - DNA, 16 bp, M. musculus
tctttaaaaaaaaaag

SEQ ID NO: 438206 - DNA, 16 bp, M. musculus
tctttaaaaaaaagaa

SEQ ID NO: 438207 - DNA, 16 bp, M. musculus
tctttaaaaaaatatg

SEQ ID NO: 438208 - DNA, 16 bp, M. musculus
tctttaaaaaagaaaa

SEQ ID NO: 438209 - DNA, 16 bp, M. musculus
tctttaaaaacagaaa

SEQ ID NO: 438210 - DNA, 16 bp, M. musculus
tctttaaaaacataca

SEQ ID NO: 438211 - DNA, 16 bp, M. musculus
tctttaaaaaccaaaa

SEQ ID NO: 438212 - DNA, 16 bp, M. musculus
tctttaaaaagtaaag

SEQ ID NO: 438213 - DNA, 16 bp, M. musculus
tctttaaaacaaaaac

SEQ ID NO: 438214 - DNA, 16 bp, M. musculus
tctttaaaacttttaa

SEQ ID NO: 438215 - DNA, 16 bp, M. musculus
tctttaaaagtatttt

SEQ ID NO: 438216 - DNA, 16 bp, M. musculus
tctttaaaataaaatg

SEQ ID NO: 438217 - DNA, 16 bp, M. musculus
tctttaaaataaagtt

SEQ ID NO: 438218 - DNA, 16 bp, M. musculus
tctttaaagaggaaat

SEQ ID NO: 438219 - DNA, 16 bp, M. musculus
tctttaaaggagttat

SEQ ID NO: 438220 - DNA, 16 bp, M. musculus
tctttaaatcttctac

SEQ ID NO: 438221 - DNA, 16 bp, M. musculus
tctttaaattgctttt

SEQ ID NO: 438222 - DNA, 16 bp, M. musculus
tctttaagaaaacaaa

SEQ ID NO: 438223 - DNA, 16 bp, M. musculus
tctttaagaaataaaa

SEQ ID NO: 438224 - DNA, 16 bp, M. musculus
tctttaaggaaaaaaa

SEQ ID NO: 438225 - DNA, 16 bp, M. musculus
tctttaaggactttta

SEQ ID NO: 438226 - DNA, 16 bp, M. musculus
tctttaagggattttt

SEQ ID NO: 438227 - DNA, 18 bp, M. musculus
tctttaagtgacttatga

SEQ ID NO: 438228 - DNA, 16 bp, M. musculus
tctttaagttgctttg

SEQ ID NO: 438229 - DNA, 16 bp, M. musculus
tctttaataccagcac

SEQ ID NO: 438230 - DNA, 16 bp, M. musculus
tctttaatgaatgtgg

SEQ ID NO: 438231 - DNA, 16 bp, M. musculus
tctttaatgccagcac

SEQ ID NO: 438232 - DNA, 16 bp, M. musculus
tctttaatgtttctat

SEQ ID NO: 438233 - DNA, 16 bp, M. musculus
tctttaattgttgaga

SEQ ID NO: 438234 - DNA, 16 bp, M. musculus
tctttagaaacttgaa

SEQ ID NO: 438235 - DNA, 16 bp, M. musculus
tctttagaaatcattt

SEQ ID NO: 438236 - DNA, 16 bp, M. musculus
tctttagaatagggaa

SEQ ID NO: 438237 - DNA, 16 bp, M. musculus
tctttagaatgatact

SEQ ID NO: 438238 - DNA, 16 bp, M. musculus
tctttagagacccagc

SEQ ID NO: 438239 - DNA, 16 bp, M. musculus
tctttagaggaaagcc

SEQ ID NO: 438240 - DNA, 16 bp, M. musculus
tctttagttggtggtt

SEQ ID NO: 438241 - DNA, 16 bp, M. musculus
tctttatatattctgg

SEQ ID NO: 438242 - DNA, 20 bp, M. musculus
tctttatattaacttccaaa

SEQ ID NO: 438243 - DNA, 16 bp, M. musculus
tctttatattttgatg

SEQ ID NO: 438244 - DNA, 16 bp, M. musculus
tctttatctgctgagc

SEQ ID NO: 438245 - DNA, 16 bp, M. musculus
tctttatggacttcta

SEQ ID NO: 438246 - DNA, 16 bp, M. musculus
tctttatgtgggtgct

SEQ ID NO: 438247 - DNA, 16 bp, M. musculus
tctttatgtgtttctc

SEQ ID NO: 438248 - DNA, 16 bp, M. musculus
tctttattaaaaatca

SEQ ID NO: 438249 - DNA, 16 bp, M. musculus
tctttattcttccaaa

SEQ ID NO: 438250 - DNA, 17 bp, M. musculus
tctttattgatcaatca

SEQ ID NO: 438251 - DNA, 16 bp, M. musculus
tctttattgtaaacat

SEQ ID NO: 438252 - DNA, 16 bp, M. musculus
tctttatttttgagac

SEQ ID NO: 438253 - DNA, 16 bp, M. musculus
tctttcaacagaagaa

SEQ ID NO: 438254 - DNA, 16 bp, M. musculus
tctttcaactgatggc

SEQ ID NO: 438255 - DNA, 16 bp, M. musculus
tctttcactccctgaa

SEQ ID NO: 438256 - DNA, 16 bp, M. musculus
tctttcacttcctcag

SEQ ID NO: 438257 - DNA, 16 bp, M. musculus
tctttcacttccttgg

SEQ ID NO: 438258 - DNA, 16 bp, M. musculus
tctttcagaccaattt

SEQ ID NO: 438259 - DNA, 16 bp, M. musculus
tctttcagaggacaca

SEQ ID NO: 438260 - DNA, 16 bp, M. musculus
tctttcagaggactgg

SEQ ID NO: 438261 - DNA, 16 bp, M. musculus
tctttcagagggcctg

SEQ ID NO: 438262 - DNA, 16 bp, M. musculus
tctttcagaggttctg

SEQ ID NO: 438263 - DNA, 16 bp, M. musculus
tctttcagattttcca

SEQ ID NO: 438264 - DNA, 16 bp, M. musculus
tctttcagcttctggc

SEQ ID NO: 438265 - DNA, 16 bp, M. musculus
tctttcagggattttt

SEQ ID NO: 438266 - DNA, 16 bp, M. musculus
tctttcatctgtgtct

SEQ ID NO: 438267 - DNA, 16 bp, M. musculus
tctttcattctttctg

SEQ ID NO: 438268 - DNA, 16 bp, M. musculus
tctttcatttccttag

SEQ ID NO: 438269 - DNA, 16 bp, M. musculus
tctttccaatgatggc

SEQ ID NO: 438270 - DNA, 16 bp, M. musculus
tctttccacatcaatt

SEQ ID NO: 438271 - DNA, 16 bp, M. musculus
tctttccactgatggt

SEQ ID NO: 438272 - DNA, 16 bp, M. musculus
tctttccagccccacc

SEQ ID NO: 438273 - DNA, 16 bp, M. musculus
tctttccagcccctgc

SEQ ID NO: 438274 - DNA, 16 bp, M. musculus
tctttccagtgttggc

SEQ ID NO: 438275 - DNA, 16 bp, M. musculus
tctttccatacctatt

SEQ ID NO: 438276 - DNA, 16 bp, M. musculus
tctttccatcatgtgg

SEQ ID NO: 438277 - DNA, 16 bp, M. musculus
tctttccatggattcc

SEQ ID NO: 438278 - DNA, 16 bp, M. musculus
tctttcccagagttcc

SEQ ID NO: 438279 - DNA, 16 bp, M. musculus
tctttccctcttctga

SEQ ID NO: 438280 - DNA, 16 bp, M. musculus
tctttcccttgtttgg

SEQ ID NO: 438281 - DNA, 16 bp, M. musculus
tctttccgtcttctga

SEQ ID NO: 438282 - DNA, 22 bp, M. musculus
tctttcctagggtttctatctc

SEQ ID NO: 438283 - DNA, 16 bp, M. musculus
tctttcctaggttttc

SEQ ID NO: 438284 - DNA, 16 bp, M. musculus
tctttcctagttttct

SEQ ID NO: 438285 - DNA, 16 bp, M. musculus
tctttcctctgaaatg

SEQ ID NO: 438286 - DNA, 16 bp, M. musculus
tctttcctgagtctca

SEQ ID NO: 438287 - DNA, 16 bp, M. musculus
tctttcctgtgctgtt

SEQ ID NO: 438288 - DNA, 16 bp, M. musculus
tctttccttcaggctc

SEQ ID NO: 438289 - DNA, 16 bp, M. musculus
tctttccttccaccac

SEQ ID NO: 438290 - DNA, 16 bp, M. musculus
tctttcctttaaaatt

SEQ ID NO: 438291 - DNA, 16 bp, M. musculus
tctttcctttagattt

SEQ ID NO: 438292 - DNA, 16 bp, M. musculus
tctttctaaacatcat

SEQ ID NO: 438293 - DNA, 16 bp, M. musculus
tctttctaactccatg

SEQ ID NO: 438294 - DNA, 16 bp, M. musculus
tctttctacctcagcc

SEQ ID NO: 438295 - DNA, 16 bp, M. musculus
tctttctaggtctggg

SEQ ID NO: 438296 - DNA, 16 bp, M. musculus
tctttctatctctgtg

SEQ ID NO: 438297 - DNA, 16 bp, M. musculus
tctttctatgtctctg

SEQ ID NO: 438298 - DNA, 16 bp, M. musculus
tctttctcaaaaacaa

SEQ ID NO: 438299 - DNA, 16 bp, M. musculus
tctttctcagaccatt

SEQ ID NO: 438300 - DNA, 16 bp, M. musculus
tctttctcagcacatt

SEQ ID NO: 438301 - DNA, 16 bp, M. musculus
tctttctcagtcactc

SEQ ID NO: 438302 - DNA, 16 bp, M. musculus
tctttctcagtcactt

SEQ ID NO: 438303 - DNA, 16 bp, M. musculus
tctttctcagtgtgtt

SEQ ID NO: 438304 - DNA, 16 bp, M. musculus
tctttctccacattct

SEQ ID NO: 438305 - DNA, 16 bp, M. musculus
tctttctccacgtcct

SEQ ID NO: 438306 - DNA, 16 bp, M. musculus
tctttctctacaacct

SEQ ID NO: 438307 - DNA, 16 bp, M. musculus
tctttctctacacaaa

SEQ ID NO: 438308 - DNA, 16 bp, M. musculus
tctttctctaggtttg

SEQ ID NO: 438309 - DNA, 16 bp, M. musculus
tctttctctctagcct

SEQ ID NO: 438310 - DNA, 16 bp, M. musculus
tctttctctgattctt

SEQ ID NO: 438311 - DNA, 16 bp, M. musculus
tctttctcttaaaaaa

SEQ ID NO: 438312 - DNA, 16 bp, M. musculus
tctttctctttaaaat

SEQ ID NO: 438313 - DNA, 16 bp, M. musculus
tctttctgaatctggg

SEQ ID NO: 438314 - DNA, 16 bp, M. musculus
tctttctgagactttt

SEQ ID NO: 438315 - DNA, 16 bp, M. musculus
tctttctgatctgctt

SEQ ID NO: 438316 - DNA, 16 bp, M. musculus
tctttctgcctcagcc

SEQ ID NO: 438317 - DNA, 16 bp, M. musculus
tctttctgcctctctg

SEQ ID NO: 438318 - DNA, 16 bp, M. musculus
tctttctgctgcccca

SEQ ID NO: 438319 - DNA, 16 bp, M. musculus
tctttctgctgcccct

SEQ ID NO: 438320 - DNA, 16 bp, M. musculus
tctttctgcttcccag

SEQ ID NO: 438321 - DNA, 16 bp, M. musculus
tctttctgcttcccca

SEQ ID NO: 438322 - DNA, 16 bp, M. musculus
tctttctggaggcact

SEQ ID NO: 438323 - DNA, 16 bp, M. musculus
tctttctggggaatat

SEQ ID NO: 438324 - DNA, 16 bp, M. musculus
tctttctgggtctggg

SEQ ID NO: 438325 - DNA, 16 bp, M. musculus
tctttctgtctgcctg

SEQ ID NO: 438326 - DNA, 16 bp, M. musculus
tctttctgtgctttag

SEQ ID NO: 438327 - DNA, 16 bp, M. musculus
tctttctgtgtatctg

SEQ ID NO: 438328 - DNA, 16 bp, M. musculus
tctttctgtgtctggg

SEQ ID NO: 438329 - DNA, 16 bp, M. musculus
tctttcttcacatcct

SEQ ID NO: 438330 - DNA, 16 bp, M. musculus
tctttcttcagagatg

SEQ ID NO: 438331 - DNA, 16 bp, M. musculus
tctttcttcagcgact

SEQ ID NO: 438332 - DNA, 16 bp, M. musculus
tctttcttccctaagt

SEQ ID NO: 438333 - DNA, 16 bp, M. musculus
tctttcttctgtaagt

SEQ ID NO: 438334 - DNA, 16 bp, M. musculus
tctttctttctcagaa

SEQ ID NO: 438335 - DNA, 16 bp, M. musculus
tctttctttgttggat

SEQ ID NO: 438336 - DNA, 16 bp, M. musculus
tctttcttttaaaaaa

SEQ ID NO: 438337 - DNA, 16 bp, M. musculus
tctttcttttcctgat

SEQ ID NO: 438338 - DNA, 16 bp, M. musculus
tctttgaaaaaaaatc

SEQ ID NO: 438339 - DNA, 16 bp, M. musculus
tctttgaaaatataaa

SEQ ID NO: 438340 - DNA, 16 bp, M. musculus
tctttgaaaatatcaa

SEQ ID NO: 438341 - DNA, 16 bp, M. musculus
tctttgaaaatattta

SEQ ID NO: 438342 - DNA, 16 bp, M. musculus
tctttgaagttctggt

SEQ ID NO: 438343 - DNA, 16 bp, M. musculus
tctttgaattgttctt

SEQ ID NO: 438344 - DNA, 16 bp, M. musculus
tctttgacaaaggagc

SEQ ID NO: 438345 - DNA, 16 bp, M. musculus
tctttgactcttgtgt

SEQ ID NO: 438346 - DNA, 16 bp, M. musculus
tctttgagaaaaatca

SEQ ID NO: 438347 - DNA, 16 bp, M. musculus
tctttgagaaaatcca

SEQ ID NO: 438348 - DNA, 16 bp, M. musculus
tctttgagaaagtcaa

SEQ ID NO: 438349 - DNA, 16 bp, M. musculus
tctttgagaaataaaa

SEQ ID NO: 438350 - DNA, 16 bp, M. musculus
tctttgagaacatcaa

SEQ ID NO: 438351 - DNA, 16 bp, M. musculus
tctttgagaacttcat

SEQ ID NO: 438352 - DNA, 16 bp, M. musculus
tctttgagaagataaa

SEQ ID NO: 438353 - DNA, 16 bp, M. musculus
tctttgagaagatcaa

SEQ ID NO: 438354 - DNA, 16 bp, M. musculus
tctttgagtcatttct

SEQ ID NO: 438355 - DNA, 16 bp, M. musculus
tctttgataccacaag

SEQ ID NO: 438356 - DNA, 16 bp, M. musculus
tctttgatgtgttcct

SEQ ID NO: 438357 - DNA, 16 bp, M. musculus
tctttgatgtgtttct

SEQ ID NO: 438358 - DNA, 16 bp, M. musculus
tctttgattcctttct

SEQ ID NO: 438359 - DNA, 16 bp, M. musculus
tctttgattggtggct

SEQ ID NO: 438360 - DNA, 16 bp, M. musculus
tctttgatttccttct

SEQ ID NO: 438361 - DNA, 16 bp, M. musculus
tctttgcaaaaagctt

SEQ ID NO: 438362 - DNA, 16 bp, M. musculus
tctttgcatcttctga

SEQ ID NO: 438363 - DNA, 16 bp, M. musculus
tctttgcccatctgcc

SEQ ID NO: 438364 - DNA, 16 bp, M. musculus
tctttgcctctctctg

SEQ ID NO: 438365 - DNA, 16 bp, M. musculus
tctttgctgctgctgc

SEQ ID NO: 438366 - DNA, 16 bp, M. musculus
tctttgctggtcttca

SEQ ID NO: 438367 - DNA, 16 bp, M. musculus
tctttgcttctgagag

SEQ ID NO: 438368 - DNA, 16 bp, M. musculus
tctttgcttttaatag

SEQ ID NO: 438369 - DNA, 16 bp, M. musculus
tctttggagactcggt

SEQ ID NO: 438370 - DNA, 16 bp, M. musculus
tctttggagccctgca

SEQ ID NO: 438371 - DNA, 16 bp, M. musculus
tctttggaggcactca

SEQ ID NO: 438372 - DNA, 16 bp, M. musculus
tctttggctacacagt

SEQ ID NO: 438373 - DNA, 16 bp, M. musculus
tctttgggaagagagg

SEQ ID NO: 438374 - DNA, 16 bp, M. musculus
tctttggggggaaaaa

SEQ ID NO: 438375 - DNA, 16 bp, M. musculus
tctttgggtctgtgaa

SEQ ID NO: 438376 - DNA, 16 bp, M. musculus
tctttggttggtggtc

SEQ ID NO: 438377 - DNA, 16 bp, M. musculus
tctttggtttaaaaaa

SEQ ID NO: 438378 - DNA, 16 bp, M. musculus
tctttgtaaaaaaaaa

SEQ ID NO: 438379 - DNA, 16 bp, M. musculus
tctttgtaaattttat

SEQ ID NO: 438380 - DNA, 16 bp, M. musculus
tctttgtaagttcaag

SEQ ID NO: 438381 - DNA, 16 bp, M. musculus
tctttgtagggctgga

SEQ ID NO: 438382 - DNA, 16 bp, M. musculus
tctttgtatattcaat

SEQ ID NO: 438383 - DNA, 16 bp, M. musculus
tctttgtccttgtatt

SEQ ID NO: 438384 - DNA, 16 bp, M. musculus
tctttgtcttattgat

SEQ ID NO: 438385 - DNA, 16 bp, M. musculus
tctttgtgcctcagtt

SEQ ID NO: 438386 - DNA, 16 bp, M. musculus
tctttgtgttttaaaa

SEQ ID NO: 438387 - DNA, 16 bp, M. musculus
tctttgttacatccca

SEQ ID NO: 438388 - DNA, 16 bp, M. musculus
tctttgttgctgagat

SEQ ID NO: 438389 - DNA, 16 bp, M. musculus
tctttgttgtgtgcat

SEQ ID NO: 438390 - DNA, 16 bp, M. musculus
tctttgttttattaaa

SEQ ID NO: 438391 - DNA, 16 bp, M. musculus
tctttgttttgtgaat

SEQ ID NO: 438392 - DNA, 16 bp, M. musculus
tcttttaaaaaaagaa

SEQ ID NO: 438393 - DNA, 16 bp, M. musculus
tcttttaaaaaatgaa

SEQ ID NO: 438394 - DNA, 16 bp, M. musculus
tcttttaaaaacaatt

SEQ ID NO: 438395 - DNA, 16 bp, M. musculus
tcttttaaaaacacag

SEQ ID NO: 438396 - DNA, 16 bp, M. musculus
tcttttaaaaacattt

SEQ ID NO: 438397 - DNA, 16 bp, M. musculus
tcttttaaaaactgtt

SEQ ID NO: 438398 - DNA, 16 bp, M. musculus
tcttttaaaaatactt

SEQ ID NO: 438399 - DNA, 16 bp, M. musculus
tcttttaaaaatgttc

SEQ ID NO: 438400 - DNA, 16 bp, M. musculus
tcttttaaaagaaaac

SEQ ID NO: 438401 - DNA, 16 bp, M. musculus
tcttttaaaatcaaaa

SEQ ID NO: 438402 - DNA, 16 bp, M. musculus
tcttttaaagaagaaa

SEQ ID NO: 438403 - DNA, 16 bp, M. musculus
tcttttaaagacttct

SEQ ID NO: 438404 - DNA, 16 bp, M. musculus
tcttttaaataaagaa

SEQ ID NO: 438405 - DNA, 16 bp, M. musculus
tcttttaaggtctgat

SEQ ID NO: 438406 - DNA, 16 bp, M. musculus
tcttttaccacatcct

SEQ ID NO: 438407 - DNA, 16 bp, M. musculus
tcttttagaaaacaaa

SEQ ID NO: 438408 - DNA, 16 bp, M. musculus
tcttttagtttttgag

SEQ ID NO: 438409 - DNA, 16 bp, M. musculus
tcttttataaaagttg

SEQ ID NO: 438410 - DNA, 16 bp, M. musculus
tcttttataaatgtga

SEQ ID NO: 438411 - DNA, 16 bp, M. musculus
tcttttataagttacc

SEQ ID NO: 438412 - DNA, 16 bp, M. musculus
tcttttatacaaatga

SEQ ID NO: 438413 - DNA, 16 bp, M. musculus
tcttttatactttcag

SEQ ID NO: 438414 - DNA, 16 bp, M. musculus
tcttttattgttaagg

SEQ ID NO: 438415 - DNA, 16 bp, M. musculus
tcttttattgttcaga

SEQ ID NO: 438416 - DNA, 16 bp, M. musculus
tcttttatttttcaga

SEQ ID NO: 438417 - DNA, 16 bp, M. musculus
tcttttcaaatagtgc

SEQ ID NO: 438418 - DNA, 16 bp, M. musculus
tcttttcacaacaaac

SEQ ID NO: 438419 - DNA, 16 bp, M. musculus
tcttttcatagcaata

SEQ ID NO: 438420 - DNA, 16 bp, M. musculus
tcttttcattgtgccc

SEQ ID NO: 438421 - DNA, 16 bp, M. musculus
tcttttccaatttata

SEQ ID NO: 438422 - DNA, 16 bp, M. musculus
tcttttccacttaatg

SEQ ID NO: 438423 - DNA, 16 bp, M. musculus
tcttttccagcctttc

SEQ ID NO: 438424 - DNA, 16 bp, M. musculus
tcttttccatctcttg

SEQ ID NO: 438425 - DNA, 16 bp, M. musculus
tcttttcccactctgt

SEQ ID NO: 438426 - DNA, 16 bp, M. musculus
tcttttcccattgatg

SEQ ID NO: 438427 - DNA, 16 bp, M. musculus
tcttttcctcctactg

SEQ ID NO: 438428 - DNA, 16 bp, M. musculus
tcttttctaggttttc

SEQ ID NO: 438429 - DNA, 16 bp, M. musculus
tcttttctatcagttt

SEQ ID NO: 438430 - DNA, 16 bp, M. musculus
tcttttctcataaaat

SEQ ID NO: 438431 - DNA, 16 bp, M. musculus
tcttttctccagtgta

SEQ ID NO: 438432 - DNA, 16 bp, M. musculus
tcttttctgctggttg

SEQ ID NO: 438433 - DNA, 16 bp, M. musculus
tcttttctggttcagt

SEQ ID NO: 438434 - DNA, 16 bp, M. musculus
tcttttctgtaattca

SEQ ID NO: 438435 - DNA, 16 bp, M. musculus
tcttttctgtcattat

SEQ ID NO: 438436 - DNA, 16 bp, M. musculus
tcttttcttcaggctt

SEQ ID NO: 438437 - DNA, 16 bp, M. musculus
tcttttctttaagatt

SEQ ID NO: 438438 - DNA, 16 bp, M. musculus
tcttttcttttctaag

SEQ ID NO: 438439 - DNA, 16 bp, M. musculus
tcttttgaaaacattt

SEQ ID NO: 438440 - DNA, 16 bp, M. musculus
tcttttgaaaatattt

SEQ ID NO: 438441 - DNA, 16 bp, M. musculus
tcttttgacctccaca

SEQ ID NO: 438442 - DNA, 16 bp, M. musculus
tcttttgacctctgca

SEQ ID NO: 438443 - DNA, 16 bp, M. musculus
tcttttgagaaatatc

SEQ ID NO: 438444 - DNA, 16 bp, M. musculus
tcttttgagaattctt

SEQ ID NO: 438445 - DNA, 16 bp, M. musculus
tcttttgagacaaggt

SEQ ID NO: 438446 - DNA, 16 bp, M. musculus
tcttttgagacagggt

SEQ ID NO: 438447 - DNA, 16 bp, M. musculus
tcttttgagagagaga

SEQ ID NO: 438448 - DNA, 16 bp, M. musculus
tcttttgagggttagg

SEQ ID NO: 438449 - DNA, 16 bp, M. musculus
tcttttgaggtggaaa

SEQ ID NO: 438450 - DNA, 16 bp, M. musculus
tcttttgagttgaaaa

SEQ ID NO: 438451 - DNA, 16 bp, M. musculus
tcttttgatacataca

SEQ ID NO: 438452 - DNA, 16 bp, M. musculus
tcttttgcaacattaa

SEQ ID NO: 438453 - DNA, 16 bp, M. musculus
tcttttgcagtggtat

SEQ ID NO: 438454 - DNA, 16 bp, M. musculus
tcttttgctctgtgat

SEQ ID NO: 438455 - DNA, 16 bp, M. musculus
tcttttgctgtgatga

SEQ ID NO: 438456 - DNA, 16 bp, M. musculus
tcttttggaaaaaaaa

SEQ ID NO: 438457 - DNA, 16 bp, M. musculus
tcttttggaactggag

SEQ ID NO: 438458 - DNA, 17 bp, M. musculus
tcttttggactcctcct

SEQ ID NO: 438459 - DNA, 16 bp, M. musculus
tcttttggagacaggg

SEQ ID NO: 438460 - DNA, 16 bp, M. musculus
tcttttggcccttggg

SEQ ID NO: 438461 - DNA, 16 bp, M. musculus
tcttttggcctccatg

SEQ ID NO: 438462 - DNA, 16 bp, M. musculus
tcttttggcctcctca

SEQ ID NO: 438463 - DNA, 16 bp, M. musculus
tcttttggcctcttca

SEQ ID NO: 438464 - DNA, 16 bp, M. musculus
tcttttggccttcatg

SEQ ID NO: 438465 - DNA, 16 bp, M. musculus
tcttttggggttttcc

SEQ ID NO: 438466 - DNA, 16 bp, M. musculus
tcttttggtctccatg

SEQ ID NO: 438467 - DNA, 16 bp, M. musculus
tcttttgtaactgagt

SEQ ID NO: 438468 - DNA, 16 bp, M. musculus
tcttttgtgactggtt

SEQ ID NO: 438469 - DNA, 16 bp, M. musculus
tcttttgtggtccagt

SEQ ID NO: 438470 - DNA, 16 bp, M. musculus
tcttttgtgtttggat

SEQ ID NO: 438471 - DNA, 16 bp, M. musculus
tctttttaaaaaacat

SEQ ID NO: 438472 - DNA, 16 bp, M. musculus
tctttttaaaaaagaa

SEQ ID NO: 438473 - DNA, 16 bp, M. musculus
tctttttaaaaaagat

SEQ ID NO: 438474 - DNA, 16 bp, M. musculus
tctttttaaaaacaaa

SEQ ID NO: 438475 - DNA, 16 bp, M. musculus
tctttttaaaaagcaa

SEQ ID NO: 438476 - DNA, 16 bp, M. musculus
tctttttaaaaatcat

SEQ ID NO: 438477 - DNA, 16 bp, M. musculus
tctttttaaaagaaaa

SEQ ID NO: 438478 - DNA, 16 bp, M. musculus
tctttttaaaagaaca

SEQ ID NO: 438479 - DNA, 16 bp, M. musculus
tctttttaaaagtgaa

SEQ ID NO: 438480 - DNA, 16 bp, M. musculus
tctttttaaaataaag

SEQ ID NO: 438481 - DNA, 16 bp, M. musculus
tctttttaaaataaca

SEQ ID NO: 438482 - DNA, 16 bp, M. musculus
tctttttaaattagat

SEQ ID NO: 438483 - DNA, 16 bp, M. musculus
tctttttataaataca

SEQ ID NO: 438484 - DNA, 16 bp, M. musculus
tctttttatgtgtgtg

SEQ ID NO: 438485 - DNA, 16 bp, M. musculus
tctttttattggaaaa

SEQ ID NO: 438486 - DNA, 16 bp, M. musculus
tctttttcaattaaaa

SEQ ID NO: 438487 - DNA, 16 bp, M. musculus
tctttttcccttgcag

SEQ ID NO: 438488 - DNA, 16 bp, M. musculus
tctttttcctcagccc

SEQ ID NO: 438489 - DNA, 16 bp, M. musculus
tctttttcctttaaaa

SEQ ID NO: 438490 - DNA, 16 bp, M. musculus
tctttttcctttcaaa

SEQ ID NO: 438491 - DNA, 16 bp, M. musculus
tctttttcttctagag

SEQ ID NO: 438492 - DNA, 16 bp, M. musculus
tctttttcttttggaa

SEQ ID NO: 438493 - DNA, 16 bp, M. musculus
tctttttgaaggtctg

SEQ ID NO: 438494 - DNA, 17 bp, M. musculus
tctttttgcactcctaa

SEQ ID NO: 438495 - DNA, 16 bp, M. musculus
tctttttggaaaaaaa

SEQ ID NO: 438496 - DNA, 16 bp, M. musculus
tcttttttaaaagaga

SEQ ID NO: 438497 - DNA, 16 bp, M. musculus
tcttttttaaaagatg

SEQ ID NO: 438498 - DNA, 16 bp, M. musculus
tcttttttaaaatcaa

SEQ ID NO: 438499 - DNA, 16 bp, M. musculus
tcttttttaaaatgat

SEQ ID NO: 438500 - DNA, 16 bp, M. musculus
tcttttttataaaaca

SEQ ID NO: 438501 - DNA, 16 bp, M. musculus
tcttttttccacttgg

SEQ ID NO: 438502 - DNA, 16 bp, M. musculus
tcttttttgaaacagg

SEQ ID NO: 438503 - DNA, 16 bp, M. musculus
tcttttttgacaactt

SEQ ID NO: 438504 - DNA, 16 bp, M. musculus
tcttttttggggggaa

SEQ ID NO: 438505 - DNA, 16 bp, M. musculus
tctttttttaaaaaag

SEQ ID NO: 438506 - DNA, 16 bp, M. musculus
tctttttttaaaatgt

SEQ ID NO: 438507 - DNA, 16 bp, M. musculus
tctttttttaaagaat

SEQ ID NO: 438508 - DNA, 16 bp, M. musculus
tctttttttaaaggca

SEQ ID NO: 438509 - DNA, 16 bp, M. musculus
tcttttttttaaagat

SEQ ID NO: 438510 - DNA, 16 bp, M. musculus
tctttttttttcaaga

SEQ ID NO: 438511 - DNA, 16 bp, M. musculus
tgaaaaaaaaaatccc

SEQ ID NO: 438512 - DNA, 16 bp, M. musculus
tgaaaaaaaaatctgt

SEQ ID NO: 438513 - DNA, 16 bp, M. musculus
tgaaaaaaatatttct

SEQ ID NO: 438514 - DNA, 16 bp, M. musculus
tgaaaaaacacagaca

SEQ ID NO: 438515 - DNA, 16 bp, M. musculus
tgaaaaaatgcctcca

SEQ ID NO: 438516 - DNA, 16 bp, M. musculus
tgaaaaaattcacaga

SEQ ID NO: 438517 - DNA, 16 bp, M. musculus
tgaaaaacaaattatt

SEQ ID NO: 438518 - DNA, 16 bp, M. musculus
tgaaaaacacagatat

SEQ ID NO: 438519 - DNA, 16 bp, M. musculus
tgaaaaacagaaagct

SEQ ID NO: 438520 - DNA, 16 bp, M. musculus
tgaaaaacaggaaaag

SEQ ID NO: 438521 - DNA, 16 bp, M. musculus
tgaaaaaccaaaaacc

SEQ ID NO: 438522 - DNA, 16 bp, M. musculus
tgaaaaacttctgtaa

SEQ ID NO: 438523 - DNA, 16 bp, M. musculus
tgaaaaagaaggcaca

SEQ ID NO: 438524 - DNA, 16 bp, M. musculus
tgaaaaagaatatttt

SEQ ID NO: 438525 - DNA, 16 bp, M. musculus
tgaaaaagtaactttc

SEQ ID NO: 438526 - DNA, 16 bp, M. musculus
tgaaaaataaaaccag

SEQ ID NO: 438527 - DNA, 16 bp, M. musculus
tgaaaaatacatattt

SEQ ID NO: 438528 - DNA, 16 bp, M. musculus
tgaaaaatattttcaa

SEQ ID NO: 438529 - DNA, 16 bp, M. musculus
tgaaaaatatttttca

SEQ ID NO: 438530 - DNA, 16 bp, M. musculus
tgaaaaatgcaaaaag

SEQ ID NO: 438531 - DNA, 16 bp, M. musculus
tgaaaaatgttttatt

SEQ ID NO: 438532 - DNA, 16 bp, M. musculus
tgaaaaattggctttt

SEQ ID NO: 438533 - DNA, 16 bp, M. musculus
tgaaaaattgttcaac

SEQ ID NO: 438534 - DNA, 16 bp, M. musculus
tgaaaaattgttttct

SEQ ID NO: 438535 - DNA, 16 bp, M. musculus
tgaaaacaaaatttaa

SEQ ID NO: 438536 - DNA, 16 bp, M. musculus
tgaaaacaatgacttc

SEQ ID NO: 438537 - DNA, 16 bp, M. musculus
tgaaaacaattttttt

SEQ ID NO: 438538 - DNA, 16 bp, M. musculus
tgaaaacacatttgaa

SEQ ID NO: 438539 - DNA, 16 bp, M. musculus
tgaaaacaccacacac

SEQ ID NO: 438540 - DNA, 16 bp, M. musculus
tgaaaacagctacagt

SEQ ID NO: 438541 - DNA, 16 bp, M. musculus
tgaaaacaggaaaaat

SEQ ID NO: 438542 - DNA, 16 bp, M. musculus
tgaaaacatattttaa

SEQ ID NO: 438543 - DNA, 16 bp, M. musculus
tgaaaacatgactcag

SEQ ID NO: 438544 - DNA, 16 bp, M. musculus
tgaaaacattattatg

SEQ ID NO: 438545 - DNA, 28 bp, M. musculus
tgaaaaccactgaggaagtggctcttca

SEQ ID NO: 438546 - DNA, 16 bp, M. musculus
tgaaaacccagacata

SEQ ID NO: 438547 - DNA, 16 bp, M. musculus
tgaaaactattcttaa

SEQ ID NO: 438548 - DNA, 16 bp, M. musculus
tgaaaactctaaaaca

SEQ ID NO: 438549 - DNA, 16 bp, M. musculus
tgaaaactctaagggg

SEQ ID NO: 438550 - DNA, 16 bp, M. musculus
tgaaaactgaagagct

SEQ ID NO: 438551 - DNA, 16 bp, M. musculus
tgaaaactgaattttt

SEQ ID NO: 438552 - DNA, 16 bp, M. musculus
tgaaaactttaaaaat

SEQ ID NO: 438553 - DNA, 16 bp, M. musculus
tgaaaactttaagaca

SEQ ID NO: 438554 - DNA, 16 bp, M. musculus
tgaaaagaattatttt

SEQ ID NO: 438555 - DNA, 16 bp, M. musculus
tgaaaagactcctgag

SEQ ID NO: 438556 - DNA, 16 bp, M. musculus
tgaaaagagatgcaga

SEQ ID NO: 438557 - DNA, 16 bp, M. musculus
tgaaaagagcaatggt

SEQ ID NO: 438558 - DNA, 16 bp, M. musculus
tgaaaagatggaccat

SEQ ID NO: 438559 - DNA, 16 bp, M. musculus
tgaaaagcaacagtat

SEQ ID NO: 438560 - DNA, 16 bp, M. musculus
tgaaaagcagcctgtt

SEQ ID NO: 438561 - DNA, 16 bp, M. musculus
tgaaaagctaaaagaa

SEQ ID NO: 438562 - DNA, 16 bp, M. musculus
tgaaaaggagaaagtg

SEQ ID NO: 438563 - DNA, 16 bp, M. musculus
tgaaaagggagacaga

SEQ ID NO: 438564 - DNA, 16 bp, M. musculus
tgaaaaggtgttggat

SEQ ID NO: 438565 - DNA, 16 bp, M. musculus
tgaaaagtattttagt

SEQ ID NO: 438566 - DNA, 16 bp, M. musculus
tgaaaagtctggtata

SEQ ID NO: 438567 - DNA, 16 bp, M. musculus
tgaaaagttcttcttg

SEQ ID NO: 438568 - DNA, 16 bp, M. musculus
tgaaaataaatctaaa

SEQ ID NO: 438569 - DNA, 16 bp, M. musculus
tgaaaataaatctttt

SEQ ID NO: 438570 - DNA, 16 bp, M. musculus
tgaaaataatgtattt

SEQ ID NO: 438571 - DNA, 16 bp, M. musculus
tgaaaataatttcatg

SEQ ID NO: 438572 - DNA, 16 bp, M. musculus
tgaaaataattttatg

SEQ ID NO: 438573 - DNA, 16 bp, M. musculus
tgaaaatagaaaacct

SEQ ID NO: 438574 - DNA, 16 bp, M. musculus
tgaaaatagatttttt

SEQ ID NO: 438575 - DNA, 16 bp, M. musculus
tgaaaatagtttttgt

SEQ ID NO: 438576 - DNA, 16 bp, M. musculus
tgaaaatataagcaaa

SEQ ID NO: 438577 - DNA, 16 bp, M. musculus
tgaaaatatatttgaa

SEQ ID NO: 438578 - DNA, 16 bp, M. musculus
tgaaaatatggaaaat

SEQ ID NO: 438579 - DNA, 16 bp, M. musculus
tgaaaatattctcaat

SEQ ID NO: 438580 - DNA, 16 bp, M. musculus
tgaaaatattgtattt

SEQ ID NO: 438581 - DNA, 16 bp, M. musculus
tgaaaatattttcatt

SEQ ID NO: 438582 - DNA, 16 bp, M. musculus
tgaaaatatttttaag

SEQ ID NO: 438583 - DNA, 16 bp, M. musculus
tgaaaatatttttttc

SEQ ID NO: 438584 - DNA, 16 bp, M. musculus
tgaaaatcaggaagct

SEQ ID NO: 438585 - DNA, 16 bp, M. musculus
tgaaaatcagtgtggc

SEQ ID NO: 438586 - DNA, 16 bp, M. musculus
tgaaaatcatggaaaa

SEQ ID NO: 438587 - DNA, 16 bp, M. musculus
tgaaaatgaaaagaca

SEQ ID NO: 438588 - DNA, 16 bp, M. musculus
tgaaaatgaaaagctt

SEQ ID NO: 438589 - DNA, 16 bp, M. musculus
tgaaaatgaaaataca

SEQ ID NO: 438590 - DNA, 16 bp, M. musculus
tgaaaatgaaaatgta

SEQ ID NO: 438591 - DNA, 16 bp, M. musculus
tgaaaatgaaattatt

SEQ ID NO: 438592 - DNA, 16 bp, M. musculus
tgaaaatgaagcaaaa

SEQ ID NO: 438593 - DNA, 16 bp, M. musculus
tgaaaatgaagccaaa

SEQ ID NO: 438594 - DNA, 16 bp, M. musculus
tgaaaatgaagccacc

SEQ ID NO: 438595 - DNA, 16 bp, M. musculus
tgaaaatgaaggtaca

SEQ ID NO: 438596 - DNA, 16 bp, M. musculus
tgaaaatgaattttaa

SEQ ID NO: 438597 - DNA, 16 bp, M. musculus
tgaaaatgaggaaaat

SEQ ID NO: 438598 - DNA, 16 bp, M. musculus
tgaaaatgccatcttt

SEQ ID NO: 438599 - DNA, 16 bp, M. musculus
tgaaaatgcctttgac

SEQ ID NO: 438600 - DNA, 17 bp, M. musculus
tgaaaatgctgtcattt

SEQ ID NO: 438601 - DNA, 16 bp, M. musculus
tgaaaatgctgtctct

SEQ ID NO: 438602 - DNA, 16 bp, M. musculus
tgaaaatggagaaaat

SEQ ID NO: 438603 - DNA, 16 bp, M. musculus
tgaaaatggccatcct

SEQ ID NO: 438604 - DNA, 16 bp, M. musculus
tgaaaatgtacacaca

SEQ ID NO: 438605 - DNA, 16 bp, M. musculus
tgaaaatgtaccacat

SEQ ID NO: 438606 - DNA, 16 bp, M. musculus
tgaaaatgtatatttt

SEQ ID NO: 438607 - DNA, 16 bp, M. musculus
tgaaaatgtatttatt

SEQ ID NO: 438608 - DNA, 16 bp, M. musculus
tgaaaatgtcaaaata

SEQ ID NO: 438609 - DNA, 16 bp, M. musculus
tgaaaatgttaaatct

SEQ ID NO: 438610 - DNA, 16 bp, M. musculus
tgaaaatgttttaaaa

SEQ ID NO: 438611 - DNA, 16 bp, M. musculus
tgaaaatgttttatat

SEQ ID NO: 438612 - DNA, 16 bp, M. musculus
tgaaaatgttttcaaa

SEQ ID NO: 438613 - DNA, 16 bp, M. musculus
tgaaaatgtttttgtt

SEQ ID NO: 438614 - DNA, 16 bp, M. musculus
tgaaaattatttgaaa

SEQ ID NO: 438615 - DNA, 16 bp, M. musculus
tgaaaattctttgttt

SEQ ID NO: 438616 - DNA, 16 bp, M. musculus
tgaaaattgctccttc

SEQ ID NO: 438617 - DNA, 16 bp, M. musculus
tgaaacaaaaagaact

SEQ ID NO: 438618 - DNA, 16 bp, M. musculus
tgaaacaaaagaagtg

SEQ ID NO: 438619 - DNA, 16 bp, M. musculus
tgaaacaaaagaatat

SEQ ID NO: 438620 - DNA, 16 bp, M. musculus
tgaaacaaataaatct

SEQ ID NO: 438621 - DNA, 16 bp, M. musculus
tgaaacaaatgcactt

SEQ ID NO: 438622 - DNA, 16 bp, M. musculus
tgaaacaacctcaaaa

SEQ ID NO: 438623 - DNA, 16 bp, M. musculus
tgaaacaaggtctcac

SEQ ID NO: 438624 - DNA, 16 bp, M. musculus
tgaaacacaagaaaat

SEQ ID NO: 438625 - DNA, 16 bp, M. musculus
tgaaacacatgaagct

SEQ ID NO: 438626 - DNA, 16 bp, M. musculus
tgaaacaccatgactg

SEQ ID NO: 438627 - DNA, 16 bp, M. musculus
tgaaacagaaacagaa

SEQ ID NO: 438628 - DNA, 16 bp, M. musculus
tgaaacagaaaccaca

SEQ ID NO: 438629 - DNA, 16 bp, M. musculus
tgaaacagaacaaaac

SEQ ID NO: 438630 - DNA, 16 bp, M. musculus
tgaaacagaagaagaa

SEQ ID NO: 438631 - DNA, 16 bp, M. musculus
tgaaacagagtctcat

SEQ ID NO: 438632 - DNA, 16 bp, M. musculus
tgaaacaggctctcac

SEQ ID NO: 438633 - DNA, 16 bp, M. musculus
tgaaacatccaggaaa

SEQ ID NO: 438634 - DNA, 16 bp, M. musculus
tgaaacatcccatcat

SEQ ID NO: 438635 - DNA, 16 bp, M. musculus
tgaaacatttagaaaa

SEQ ID NO: 438636 - DNA, 16 bp, M. musculus
tgaaacatttttttaa

SEQ ID NO: 438637 - DNA, 16 bp, M. musculus
tgaaaccatatacaca

SEQ ID NO: 438638 - DNA, 16 bp, M. musculus
tgaaacccagggcttc

SEQ ID NO: 438639 - DNA, 16 bp, M. musculus
tgaaaccctatcttaa

SEQ ID NO: 438640 - DNA, 16 bp, M. musculus
tgaaaccctctctcaa

SEQ ID NO: 438641 - DNA, 16 bp, M. musculus
tgaaaccctgtcttga

SEQ ID NO: 438642 - DNA, 16 bp, M. musculus
tgaaacctcagagccc

SEQ ID NO: 438643 - DNA, 16 bp, M. musculus
tgaaacctcagagcct

SEQ ID NO: 438644 - DNA, 16 bp, M. musculus
tgaaacctgtttgctc

SEQ ID NO: 438645 - DNA, 16 bp, M. musculus
tgaaaccttgtctcaa

SEQ ID NO: 438646 - DNA, 16 bp, M. musculus
tgaaacgcaagaagaa

SEQ ID NO: 438647 - DNA, 16 bp, M. musculus
tgaaactaaagaagaa

SEQ ID NO: 438648 - DNA, 16 bp, M. musculus
tgaaactaaggagagg

SEQ ID NO: 438649 - DNA, 16 bp, M. musculus
tgaaactagatgttcc

SEQ ID NO: 438650 - DNA, 16 bp, M. musculus
tgaaactcaagaaaat

SEQ ID NO: 438651 - DNA, 16 bp, M. musculus
tgaaactcaataagaa

SEQ ID NO: 438652 - DNA, 16 bp, M. musculus
tgaaactcactatgta

SEQ ID NO: 438653 - DNA, 16 bp, M. musculus
tgaaactcactgtgta

SEQ ID NO: 438654 - DNA, 16 bp, M. musculus
tgaaactcaggaaaga

SEQ ID NO: 438655 - DNA, 16 bp, M. musculus
tgaaactcattctgta

SEQ ID NO: 438656 - DNA, 16 bp, M. musculus
tgaaactccctgcctc

SEQ ID NO: 438657 - DNA, 16 bp, M. musculus
tgaaactcctagcagt

SEQ ID NO: 438658 - DNA, 16 bp, M. musculus
tgaaactctcccagag

SEQ ID NO: 438659 - DNA, 16 bp, M. musculus
tgaaactcttttcctc

SEQ ID NO: 438660 - DNA, 16 bp, M. musculus
tgaaactgaaaaactt

SEQ ID NO: 438661 - DNA, 16 bp, M. musculus
tgaaactgaaagcaag

SEQ ID NO: 438662 - DNA, 16 bp, M. musculus
tgaaactgaagaagga

SEQ ID NO: 438663 - DNA, 16 bp, M. musculus
tgaaactgaagccaca

SEQ ID NO: 438664 - DNA, 16 bp, M. musculus
tgaaactggaaaactt

SEQ ID NO: 438665 - DNA, 16 bp, M. musculus
tgaaactgtaaagctt

SEQ ID NO: 438666 - DNA, 16 bp, M. musculus
tgaaactgtcaaagaa

SEQ ID NO: 438667 - DNA, 16 bp, M. musculus
tgaaactgtgagcaag

SEQ ID NO: 438668 - DNA, 16 bp, M. musculus
tgaaacttcaaagcca

SEQ ID NO: 438669 - DNA, 16 bp, M. musculus
tgaaacttcttgagct

SEQ ID NO: 438670 - DNA, 16 bp, M. musculus
tgaaactttaaaactt

SEQ ID NO: 438671 - DNA, 16 bp, M. musculus
tgaaagaaaacatgca

SEQ ID NO: 438672 - DNA, 16 bp, M. musculus
tgaaagaaaaggatac

SEQ ID NO: 438673 - DNA, 16 bp, M. musculus
tgaaagaaaatatttt

SEQ ID NO: 438674 - DNA, 16 bp, M. musculus
tgaaagaaaatgtttt

SEQ ID NO: 438675 - DNA, 16 bp, M. musculus
tgaaagaaagcaaaga

SEQ ID NO: 438676 - DNA, 16 bp, M. musculus
tgaaagaaagcaagaa

SEQ ID NO: 438677 - DNA, 16 bp, M. musculus
tgaaagaaagcatgca

SEQ ID NO: 438678 - DNA, 16 bp, M. musculus
tgaaagaacacatact

SEQ ID NO: 438679 - DNA, 16 bp, M. musculus
tgaaagaactgcagag

SEQ ID NO: 438680 - DNA, 16 bp, M. musculus
tgaaagaagatgagga

SEQ ID NO: 438681 - DNA, 16 bp, M. musculus
tgaaagaagattattt

SEQ ID NO: 438682 - DNA, 16 bp, M. musculus
tgaaagaagcagaaac

SEQ ID NO: 438683 - DNA, 16 bp, M. musculus
tgaaagaattaaacaa

SEQ ID NO: 438684 - DNA, 75 bp, M. musculus
tgaaagacacaggtgaagggaaatcttcacagtgggcagaacttcgggcagtacacatggtattacagtttgttt

SEQ ID NO: 438685 - DNA, 16 bp, M. musculus
tgaaagacccagcaag

SEQ ID NO: 438686 - DNA, 31 bp, M. musculus
tgaaagacccccgaagggagaccctcactca

SEQ ID NO: 438687 - DNA, 20 bp, M. musculus
tgaaagacccccgaggtggg

SEQ ID NO: 438688 - DNA, 16 bp, M. musculus
tgaaagactctgaaag

SEQ ID NO: 438689 - DNA, 16 bp, M. musculus
tgaaagagaacaagga

SEQ ID NO: 438690 - DNA, 16 bp, M. musculus
tgaaagagagcaagaa

SEQ ID NO: 438691 - DNA, 27 bp, M. musculus
tgaaagagcaagatgaaccccaagatg

SEQ ID NO: 438692 - DNA, 16 bp, M. musculus
tgaaagagcagctagt

SEQ ID NO: 438693 - DNA, 16 bp, M. musculus
tgaaagagctgtatga

SEQ ID NO: 438694 - DNA, 16 bp, M. musculus
tgaaagagctgtcagt

SEQ ID NO: 438695 - DNA, 16 bp, M. musculus
tgaaagagtagcaagt

SEQ ID NO: 438696 - DNA, 28 bp, M. musculus
tgaaagagtagtaaactcagtgctccaa

SEQ ID NO: 438697 - DNA, 16 bp, M. musculus
tgaaagagttagatgc

SEQ ID NO: 438698 - DNA, 16 bp, M. musculus
tgaaagatatgtatga

SEQ ID NO: 438699 - DNA, 16 bp, M. musculus
tgaaagatctgtgtga

SEQ ID NO: 438700 - DNA, 16 bp, M. musculus
tgaaagatgaaaatag

SEQ ID NO: 438701 - DNA, 16 bp, M. musculus
tgaaagatgtatatga

SEQ ID NO: 438702 - DNA, 16 bp, M. musculus
tgaaagattatttctt

SEQ ID NO: 438703 - DNA, 16 bp, M. musculus
tgaaagatttatttat

SEQ ID NO: 438704 - DNA, 16 bp, M. musculus
tgaaagcacacctgaa

SEQ ID NO: 438705 - DNA, 16 bp, M. musculus
tgaaagcagccctaag

SEQ ID NO: 438706 - DNA, 16 bp, M. musculus
tgaaagcatatctcat

SEQ ID NO: 438707 - DNA, 16 bp, M. musculus
tgaaagcatgaagacc

SEQ ID NO: 438708 - DNA, 16 bp, M. musculus
tgaaagcattgcttgt

SEQ ID NO: 438709 - DNA, 16 bp, M. musculus
tgaaagcatttctaaa

SEQ ID NO: 438710 - DNA, 16 bp, M. musculus
tgaaagccagccccaa

SEQ ID NO: 438711 - DNA, 16 bp, M. musculus
tgaaagccaggagatc

SEQ ID NO: 438712 - DNA, 16 bp, M. musculus
tgaaagcctcctccct

SEQ ID NO: 438713 - DNA, 16 bp, M. musculus
tgaaagcctgctagct

SEQ ID NO: 438714 - DNA, 16 bp, M. musculus
tgaaagctagaagata

SEQ ID NO: 438715 - DNA, 16 bp, M. musculus
tgaaagctgtcttctg

SEQ ID NO: 438716 - DNA, 16 bp, M. musculus
tgaaaggacaaaggga

SEQ ID NO: 438717 - DNA, 16 bp, M. musculus
tgaaaggacccatgat

SEQ ID NO: 438718 - DNA, 16 bp, M. musculus
tgaaaggactcatgat

SEQ ID NO: 438719 - DNA, 16 bp, M. musculus
tgaaaggagttgcaga

SEQ ID NO: 438720 - DNA, 16 bp, M. musculus
tgaaaggcaaaggaca

SEQ ID NO: 438721 - DNA, 16 bp, M. musculus
tgaaaggcaaatgtaa

SEQ ID NO: 438722 - DNA, 16 bp, M. musculus
tgaaaggcaacctgtt

SEQ ID NO: 438723 - DNA, 16 bp, M. musculus
tgaaaggcacttcccc

SEQ ID NO: 438724 - DNA, 16 bp, M. musculus
tgaaaggcagaagcag

SEQ ID NO: 438725 - DNA, 16 bp, M. musculus
tgaaaggctggagaga

SEQ ID NO: 438726 - DNA, 16 bp, M. musculus
tgaaaggcttatggaa

SEQ ID NO: 438727 - DNA, 16 bp, M. musculus
tgaaagggtcgtttga

SEQ ID NO: 438728 - DNA, 16 bp, M. musculus
tgaaagggtttgcagc

SEQ ID NO: 438729 - DNA, 16 bp, M. musculus
tgaaaggtctgtatga

SEQ ID NO: 438730 - DNA, 16 bp, M. musculus
tgaaaggtgtgtggct

SEQ ID NO: 438731 - DNA, 16 bp, M. musculus
tgaaaggtgttatttc

SEQ ID NO: 438732 - DNA, 16 bp, M. musculus
tgaaagtaaaatattt

SEQ ID NO: 438733 - DNA, 16 bp, M. musculus
tgaaagtaattttatg

SEQ ID NO: 438734 - DNA, 16 bp, M. musculus
tgaaagtcagatgcag

SEQ ID NO: 438735 - DNA, 16 bp, M. musculus
tgaaagtctattttat

SEQ ID NO: 438736 - DNA, 16 bp, M. musculus
tgaaagttctagaaga

SEQ ID NO: 438737 - DNA, 16 bp, M. musculus
tgaaataaaacatttt

SEQ ID NO: 438738 - DNA, 16 bp, M. musculus
tgaaataaaactcaaa

SEQ ID NO: 438739 - DNA, 16 bp, M. musculus
tgaaataaacactttc

SEQ ID NO: 438740 - DNA, 16 bp, M. musculus
tgaaataaagattttt

SEQ ID NO: 438741 - DNA, 16 bp, M. musculus
tgaaataaagttttta

SEQ ID NO: 438742 - DNA, 16 bp, M. musculus
tgaaataaatacattt

SEQ ID NO: 438743 - DNA, 16 bp, M. musculus
tgaaataaatacctaa

SEQ ID NO: 438744 - DNA, 16 bp, M. musculus
tgaaataaatacttaa

SEQ ID NO: 438745 - DNA, 16 bp, M. musculus
tgaaataaatatggcc

SEQ ID NO: 438746 - DNA, 16 bp, M. musculus
tgaaataaatcatttc

SEQ ID NO: 438747 - DNA, 16 bp, M. musculus
tgaaataaatcctttc

SEQ ID NO: 438748 - DNA, 16 bp, M. musculus
tgaaataaatgaatga

SEQ ID NO: 438749 - DNA, 16 bp, M. musculus
tgaaataacaatgaaa

SEQ ID NO: 438750 - DNA, 16 bp, M. musculus
tgaaataattttattg

SEQ ID NO: 438751 - DNA, 16 bp, M. musculus
tgaaatacaaatcaaa

SEQ ID NO: 438752 - DNA, 16 bp, M. musculus
tgaaatacttccttct

SEQ ID NO: 438753 - DNA, 16 bp, M. musculus
tgaaatagagccaaca

SEQ ID NO: 438754 - DNA, 16 bp, M. musculus
tgaaatataaacattt

SEQ ID NO: 438755 - DNA, 16 bp, M. musculus
tgaaatatatttttgg

SEQ ID NO: 438756 - DNA, 16 bp, M. musculus
tgaaatcaaatcaaag

SEQ ID NO: 438757 - DNA, 16 bp, M. musculus
tgaaatcaaccaaaca

SEQ ID NO: 438758 - DNA, 16 bp, M. musculus
tgaaatcaaccaaaga

SEQ ID NO: 438759 - DNA, 16 bp, M. musculus
tgaaatcaaccaaata

SEQ ID NO: 438760 - DNA, 16 bp, M. musculus
tgaaatcaaggttgcc

SEQ ID NO: 438761 - DNA, 16 bp, M. musculus
tgaaatcatatataca

SEQ ID NO: 438762 - DNA, 16 bp, M. musculus
tgaaatcatgatcact

SEQ ID NO: 438763 - DNA, 16 bp, M. musculus
tgaaatccagaggctc

SEQ ID NO: 438764 - DNA, 16 bp, M. musculus
tgaaatccattatttt

SEQ ID NO: 438765 - DNA, 16 bp, M. musculus
tgaaatcccaccaaca

SEQ ID NO: 438766 - DNA, 16 bp, M. musculus
tgaaatccgcctgcct

SEQ ID NO: 438767 - DNA, 16 bp, M. musculus
tgaaatctagaggctc

SEQ ID NO: 438768 - DNA, 16 bp, M. musculus
tgaaatctcagcactc

SEQ ID NO: 438769 - DNA, 16 bp, M. musculus
tgaaatctctctctct

SEQ ID NO: 438770 - DNA, 16 bp, M. musculus
tgaaatcttctgggat

SEQ ID NO: 438771 - DNA, 16 bp, M. musculus
tgaaatctttttcttt

SEQ ID NO: 438772 - DNA, 16 bp, M. musculus
tgaaatgaatgctttt

SEQ ID NO: 438773 - DNA, 16 bp, M. musculus
tgaaatgagccaattc

SEQ ID NO: 438774 - DNA, 16 bp, M. musculus
tgaaatgctgtctttt

SEQ ID NO: 438775 - DNA, 16 bp, M. musculus
tgaaatggaaaaattt

SEQ ID NO: 438776 - DNA, 16 bp, M. musculus
tgaaatggacacattt

SEQ ID NO: 438777 - DNA, 16 bp, M. musculus
tgaaatggatggtttt

SEQ ID NO: 438778 - DNA, 16 bp, M. musculus
tgaaatgtgaaaataa

SEQ ID NO: 438779 - DNA, 16 bp, M. musculus
tgaaatgtgaataaat

SEQ ID NO: 438780 - DNA, 16 bp, M. musculus
tgaaatgttctgtaaa

SEQ ID NO: 438781 - DNA, 16 bp, M. musculus
tgaaatgtttaatttc

SEQ ID NO: 438782 - DNA, 16 bp, M. musculus
tgaaattaagaaaaca

SEQ ID NO: 438783 - DNA, 16 bp, M. musculus
tgaaattacagatgtg

SEQ ID NO: 438784 - DNA, 16 bp, M. musculus
tgaaattatttctaat

SEQ ID NO: 438785 - DNA, 16 bp, M. musculus
tgaaattcaagaaaaa

SEQ ID NO: 438786 - DNA, 16 bp, M. musculus
tgaaattcacaaagaa

SEQ ID NO: 438787 - DNA, 16 bp, M. musculus
tgaaattcctaagcaa

SEQ ID NO: 438788 - DNA, 16 bp, M. musculus
tgaaattccttttctt

SEQ ID NO: 438789 - DNA, 17 bp, M. musculus
tgaaattctaccttgta

SEQ ID NO: 438790 - DNA, 16 bp, M. musculus
tgaaattctcaaaaat

SEQ ID NO: 438791 - DNA, 16 bp, M. musculus
tgaaattctcaaagaa

SEQ ID NO: 438792 - DNA, 16 bp, M. musculus
tgaaattcttaaaaaa

SEQ ID NO: 438793 - DNA, 16 bp, M. musculus
tgaaattcttagataa

SEQ ID NO: 438794 - DNA, 16 bp, M. musculus
tgaaattgaagaagaa

SEQ ID NO: 438795 - DNA, 16 bp, M. musculus
tgaaattgccaaataa

SEQ ID NO: 438796 - DNA, 16 bp, M. musculus
tgaaattggcaaaata

SEQ ID NO: 438797 - DNA, 16 bp, M. musculus
tgaaattgtcaaagaa

SEQ ID NO: 438798 - DNA, 16 bp, M. musculus
tgaaattgtcttagct

SEQ ID NO: 438799 - DNA, 16 bp, M. musculus
tgaaattgttttcttt

SEQ ID NO: 438800 - DNA, 16 bp, M. musculus
tgaaatttaaaaacat

SEQ ID NO: 438801 - DNA, 16 bp, M. musculus
tgaaatttcacaagtc

SEQ ID NO: 438802 - DNA, 16 bp, M. musculus
tgaaatttcagggttg

SEQ ID NO: 438803 - DNA, 16 bp, M. musculus
tgaaatttccaaagaa

SEQ ID NO: 438804 - DNA, 16 bp, M. musculus
tgaaatttgaaggaaa

SEQ ID NO: 438805 - DNA, 16 bp, M. musculus
tgaaatttgcatgcaa

SEQ ID NO: 438806 - DNA, 16 bp, M. musculus
tgaaattttcaaataa

SEQ ID NO: 438807 - DNA, 16 bp, M. musculus
tgaaattttccttcta

SEQ ID NO: 438808 - DNA, 16 bp, M. musculus
tgaaattttctataga

SEQ ID NO: 438809 - DNA, 16 bp, M. musculus
tgaaattttcttaaaa

SEQ ID NO: 438810 - DNA, 16 bp, M. musculus
tgaaatttttcatgat

SEQ ID NO: 438811 - DNA, 16 bp, M. musculus
tgaacaaaaatatttt

SEQ ID NO: 438812 - DNA, 16 bp, M. musculus
tgaacaaaatcataca

SEQ ID NO: 438813 - DNA, 16 bp, M. musculus
tgaacaaaatcatcca

SEQ ID NO: 438814 - DNA, 16 bp, M. musculus
tgaacaaagccatcca

SEQ ID NO: 438815 - DNA, 16 bp, M. musculus
tgaacaaccctttcac

SEQ ID NO: 438816 - DNA, 16 bp, M. musculus
tgaacaactctctgct

SEQ ID NO: 438817 - DNA, 16 bp, M. musculus
tgaacaactctttact

SEQ ID NO: 438818 - DNA, 16 bp, M. musculus
tgaacaactggagcag

SEQ ID NO: 438819 - DNA, 16 bp, M. musculus
tgaacaaggaatagtt

SEQ ID NO: 438820 - DNA, 16 bp, M. musculus
tgaacaagggagatat

SEQ ID NO: 438821 - DNA, 16 bp, M. musculus
tgaacaattggtttat

SEQ ID NO: 438822 - DNA, 17 bp, M. musculus
tgaacacacacacacat

SEQ ID NO: 438823 - DNA, 16 bp, M. musculus
tgaacacacacataca

SEQ ID NO: 438824 - DNA, 16 bp, M. musculus
tgaacacacagctgag

SEQ ID NO: 438825 - DNA, 16 bp, M. musculus
tgaacacagacacaca

SEQ ID NO: 438826 - DNA, 16 bp, M. musculus
tgaacacaggcacaca

SEQ ID NO: 438827 - DNA, 16 bp, M. musculus
tgaacacattttttaa

SEQ ID NO: 438828 - DNA, 16 bp, M. musculus
tgaacaccaagctgca

SEQ ID NO: 438829 - DNA, 16 bp, M. musculus
tgaacactttgctcct

SEQ ID NO: 438830 - DNA, 16 bp, M. musculus
tgaacagaaatatgga

SEQ ID NO: 438831 - DNA, 16 bp, M. musculus
tgaacagagcacaggg

SEQ ID NO: 438832 - DNA, 16 bp, M. musculus
tgaacagataccatga

SEQ ID NO: 438833 - DNA, 16 bp, M. musculus
tgaacagctggaataa

SEQ ID NO: 438834 - DNA, 16 bp, M. musculus
tgaacatacaagaaga

SEQ ID NO: 438835 - DNA, 16 bp, M. musculus
tgaacatacaagaagt

SEQ ID NO: 438836 - DNA, 16 bp, M. musculus
tgaacatagacacaaa

SEQ ID NO: 438837 - DNA, 16 bp, M. musculus
tgaacatatttataat

SEQ ID NO: 438838 - DNA, 16 bp, M. musculus
tgaacatatttttagg

SEQ ID NO: 438839 - DNA, 16 bp, M. musculus
tgaacatcaatgtgga

SEQ ID NO: 438840 - DNA, 16 bp, M. musculus
tgaacatcgtggagca

SEQ ID NO: 438841 - DNA, 16 bp, M. musculus
tgaacatctgtgcccc

SEQ ID NO: 438842 - DNA, 16 bp, M. musculus
tgaacatgcatgtgtg

SEQ ID NO: 438843 - DNA, 16 bp, M. musculus
tgaacatggagaagtc

SEQ ID NO: 438844 - DNA, 16 bp, M. musculus
tgaacatgggagatct

SEQ ID NO: 438845 - DNA, 16 bp, M. musculus
tgaacatgtatgtgtg

SEQ ID NO: 438846 - DNA, 16 bp, M. musculus
tgaacatgtgtttgtt

SEQ ID NO: 438847 - DNA, 16 bp, M. musculus
tgaacattctcactaa

SEQ ID NO: 438848 - DNA, 16 bp, M. musculus
tgaacattgtggaaca

SEQ ID NO: 438849 - DNA, 16 bp, M. musculus
tgaacatttaaaaaca

SEQ ID NO: 438850 - DNA, 16 bp, M. musculus
tgaacatttcttttga

SEQ ID NO: 438851 - DNA, 16 bp, M. musculus
tgaacatttcttttgg

SEQ ID NO: 438852 - DNA, 16 bp, M. musculus
tgaacattttaaaaag

SEQ ID NO: 438853 - DNA, 16 bp, M. musculus
tgaacattttaaaaat

SEQ ID NO: 438854 - DNA, 16 bp, M. musculus
tgaacattttaaaact

SEQ ID NO: 438855 - DNA, 16 bp, M. musculus
tgaacattttctcagg

SEQ ID NO: 438856 - DNA, 16 bp, M. musculus
tgaacatttttaaggt

SEQ ID NO: 438857 - DNA, 16 bp, M. musculus
tgaacattttttaaaa

SEQ ID NO: 438858 - DNA, 16 bp, M. musculus
tgaaccaaaataaact

SEQ ID NO: 438859 - DNA, 16 bp, M. musculus
tgaaccaatgccagag

SEQ ID NO: 438860 - DNA, 16 bp, M. musculus
tgaaccacaatttctg

SEQ ID NO: 438861 - DNA, 16 bp, M. musculus
tgaaccaccatgccta

SEQ ID NO: 438862 - DNA, 16 bp, M. musculus
tgaaccagaaaataaa

SEQ ID NO: 438863 - DNA, 16 bp, M. musculus
tgaaccaggctacctc

SEQ ID NO: 438864 - DNA, 16 bp, M. musculus
tgaaccatcttcccag

SEQ ID NO: 438865 - DNA, 16 bp, M. musculus
tgaacccaaggcttca

SEQ ID NO: 438866 - DNA, 16 bp, M. musculus
tgaacccagaaatctg

SEQ ID NO: 438867 - DNA, 16 bp, M. musculus
tgaacccagagcttgc

SEQ ID NO: 438868 - DNA, 16 bp, M. musculus
tgaacccagagtttgc

SEQ ID NO: 438869 - DNA, 16 bp, M. musculus
tgaacccaggaccttt

SEQ ID NO: 438870 - DNA, 16 bp, M. musculus
tgaacccaggccctct

SEQ ID NO: 438871 - DNA, 16 bp, M. musculus
tgaacccagggctttg

SEQ ID NO: 438872 - DNA, 16 bp, M. musculus
tgaacccaggtccact

SEQ ID NO: 438873 - DNA, 16 bp, M. musculus
tgaacccaggtcctgt

SEQ ID NO: 438874 - DNA, 16 bp, M. musculus
tgaacccaggtctttt

SEQ ID NO: 438875 - DNA, 16 bp, M. musculus
tgaaccccagtcctct

SEQ ID NO: 438876 - DNA, 16 bp, M. musculus
tgaaccccagttctct

SEQ ID NO: 438877 - DNA, 16 bp, M. musculus
tgaaccctgggacctg

SEQ ID NO: 438878 - DNA, 16 bp, M. musculus
tgaacctaacagaagt

SEQ ID NO: 438879 - DNA, 16 bp, M. musculus
tgaacctcctccagca

SEQ ID NO: 438880 - DNA, 16 bp, M. musculus
tgaacctgaacctgaa

SEQ ID NO: 438881 - DNA, 16 bp, M. musculus
tgaacctggagctaag

SEQ ID NO: 438882 - DNA, 16 bp, M. musculus
tgaacctgggccctct

SEQ ID NO: 438883 - DNA, 16 bp, M. musculus
tgaacctggggccttg

SEQ ID NO: 438884 - DNA, 16 bp, M. musculus
tgaacctgggtccttt

SEQ ID NO: 438885 - DNA, 16 bp, M. musculus
tgaacctgggtcttct

SEQ ID NO: 438886 - DNA, 16 bp, M. musculus
tgaacctggtcctctg

SEQ ID NO: 438887 - DNA, 16 bp, M. musculus
tgaacctgtaagccaa

SEQ ID NO: 438888 - DNA, 16 bp, M. musculus
tgaacctgtcagccag

SEQ ID NO: 438889 - DNA, 16 bp, M. musculus
tgaacctgtgcaggtc

SEQ ID NO: 438890 - DNA, 16 bp, M. musculus
tgaaccttatagagga

SEQ ID NO: 438891 - DNA, 16 bp, M. musculus
tgaaccttcccctaat

SEQ ID NO: 438892 - DNA, 16 bp, M. musculus
tgaaccttctccccac

SEQ ID NO: 438893 - DNA, 16 bp, M. musculus
tgaaccttggtcctct

SEQ ID NO: 438894 - DNA, 22 bp, M. musculus
tgaacggttcgactgagaaggc

SEQ ID NO: 438895 - DNA, 16 bp, M. musculus
tgaactaaataaagat

SEQ ID NO: 438896 - DNA, 16 bp, M. musculus
tgaactacaacccaga

SEQ ID NO: 438897 - DNA, 16 bp, M. musculus
tgaactacagactgta

SEQ ID NO: 438898 - DNA, 16 bp, M. musculus
tgaactacatagtaag

SEQ ID NO: 438899 - DNA, 16 bp, M. musculus
tgaactacatctccag

SEQ ID NO: 438900 - DNA, 16 bp, M. musculus
tgaactaccaaccaga

SEQ ID NO: 438901 - DNA, 16 bp, M. musculus
tgaactagcaccattt

SEQ ID NO: 438902 - DNA, 16 bp, M. musculus
tgaactataatgtaaa

SEQ ID NO: 438903 - DNA, 16 bp, M. musculus
tgaactcaaaaatcca

SEQ ID NO: 438904 - DNA, 16 bp, M. musculus
tgaactcaaagatcta

SEQ ID NO: 438905 - DNA, 16 bp, M. musculus
tgaactcaagacctct

SEQ ID NO: 438906 - DNA, 16 bp, M. musculus
tgaactcaagaccttc

SEQ ID NO: 438907 - DNA, 16 bp, M. musculus
tgaactcaagatcctc

SEQ ID NO: 438908 - DNA, 16 bp, M. musculus
tgaactcaagatctct

SEQ ID NO: 438909 - DNA, 16 bp, M. musculus
tgaactcaaggccagc

SEQ ID NO: 438910 - DNA, 16 bp, M. musculus
tgaactcacagaaatc

SEQ ID NO: 438911 - DNA, 16 bp, M. musculus
tgaactcacagaaatt

SEQ ID NO: 438912 - DNA, 16 bp, M. musculus
tgaactcacagaattc

SEQ ID NO: 438913 - DNA, 16 bp, M. musculus
tgaactcacagagact

SEQ ID NO: 438914 - DNA, 16 bp, M. musculus
tgaactcacagagagc

SEQ ID NO: 438915 - DNA, 16 bp, M. musculus
tgaactcacagagata

SEQ ID NO: 438916 - DNA, 16 bp, M. musculus
tgaactcacagagatc

SEQ ID NO: 438917 - DNA, 16 bp, M. musculus
tgaactcacagagatg

SEQ ID NO: 438918 - DNA, 16 bp, M. musculus
tgaactcacagagatt

SEQ ID NO: 438919 - DNA, 16 bp, M. musculus
tgaactcacagagctc

SEQ ID NO: 438920 - DNA, 16 bp, M. musculus
tgaactcacagaggtc

SEQ ID NO: 438921 - DNA, 16 bp, M. musculus
tgaactcacagcgatc

SEQ ID NO: 438922 - DNA, 16 bp, M. musculus
tgaactcacagggatc

SEQ ID NO: 438923 - DNA, 16 bp, M. musculus
tgaactcactctgtag

SEQ ID NO: 438924 - DNA, 16 bp, M. musculus
tgaactcactttgtag

SEQ ID NO: 438925 - DNA, 16 bp, M. musculus
tgaactcagaaacccg

SEQ ID NO: 438926 - DNA, 16 bp, M. musculus
tgaactcagaaatcca

SEQ ID NO: 438927 - DNA, 16 bp, M. musculus
tgaactcagaaatccg

SEQ ID NO: 438928 - DNA, 16 bp, M. musculus
tgaactcagaaatcct

SEQ ID NO: 438929 - DNA, 16 bp, M. musculus
tgaactcagaaatcta

SEQ ID NO: 438930 - DNA, 16 bp, M. musculus
tgaactcagaaatctg

SEQ ID NO: 438931 - DNA, 16 bp, M. musculus
tgaactcagaacctct

SEQ ID NO: 438932 - DNA, 16 bp, M. musculus
tgaactcagaacttct

SEQ ID NO: 438933 - DNA, 16 bp, M. musculus
tgaactcagagaccca

SEQ ID NO: 438934 - DNA, 16 bp, M. musculus
tgaactcagagagatc

SEQ ID NO: 438935 - DNA, 17 bp, M. musculus
tgaactcagagatcctc

SEQ ID NO: 438936 - DNA, 16 bp, M. musculus
tgaactcagagatctg

SEQ ID NO: 438937 - DNA, 16 bp, M. musculus
tgaactcagagattca

SEQ ID NO: 438938 - DNA, 16 bp, M. musculus
tgaactcagagatttg

SEQ ID NO: 438939 - DNA, 16 bp, M. musculus
tgaactcagagcagtt

SEQ ID NO: 438940 - DNA, 16 bp, M. musculus
tgaactcagagctcca

SEQ ID NO: 438941 - DNA, 16 bp, M. musculus
tgaactcagatcctca

SEQ ID NO: 438942 - DNA, 16 bp, M. musculus
tgaactcagatcctta

SEQ ID NO: 438943 - DNA, 16 bp, M. musculus
tgaactcagatccttt

SEQ ID NO: 438944 - DNA, 16 bp, M. musculus
tgaactcagctcctca

SEQ ID NO: 438945 - DNA, 16 bp, M. musculus
tgaactcaggaccact

SEQ ID NO: 438946 - DNA, 16 bp, M. musculus
tgaactcaggccatca

SEQ ID NO: 438947 - DNA, 16 bp, M. musculus
tgaactcaggtactca

SEQ ID NO: 438948 - DNA, 16 bp, M. musculus
tgaactcagttcttct

SEQ ID NO: 438949 - DNA, 16 bp, M. musculus
tgaactcatagagatc

SEQ ID NO: 438950 - DNA, 16 bp, M. musculus
tgaactccagtcctct

SEQ ID NO: 438951 - DNA, 16 bp, M. musculus
tgaactcctgatcctt

SEQ ID NO: 438952 - DNA, 16 bp, M. musculus
tgaactctgatcctct

SEQ ID NO: 438953 - DNA, 16 bp, M. musculus
tgaactctgcagccag

SEQ ID NO: 438954 - DNA, 16 bp, M. musculus
tgaactcttcctcacc

SEQ ID NO: 438955 - DNA, 16 bp, M. musculus
tgaactgaagacccag

SEQ ID NO: 438956 - DNA, 16 bp, M. musculus
tgaactgagttcaatc

SEQ ID NO: 438957 - DNA, 16 bp, M. musculus
tgaactgcagctgctg

SEQ ID NO: 438958 - DNA, 16 bp, M. musculus
tgaactgctctgcttg

SEQ ID NO: 438959 - DNA, 16 bp, M. musculus
tgaactgctgttgctg

SEQ ID NO: 438960 - DNA, 16 bp, M. musculus
tgaactggtcaggcat

SEQ ID NO: 438961 - DNA, 16 bp, M. musculus
tgaactgtaatgtaaa

SEQ ID NO: 438962 - DNA, 19 bp, M. musculus
tgaactgtcactgccatgg

SEQ ID NO: 438963 - DNA, 16 bp, M. musculus
tgaactgtctccccag

SEQ ID NO: 438964 - DNA, 16 bp, M. musculus
tgaactgtctctccag

SEQ ID NO: 438965 - DNA, 16 bp, M. musculus
tgaactgtgggggcct

SEQ ID NO: 438966 - DNA, 16 bp, M. musculus
tgaacttacaaagatc

SEQ ID NO: 438967 - DNA, 16 bp, M. musculus
tgaacttacagagatc

SEQ ID NO: 438968 - DNA, 16 bp, M. musculus
tgaacttgaacttgaa

SEQ ID NO: 438969 - DNA, 16 bp, M. musculus
tgaacttgctgtgtag

SEQ ID NO: 438970 - DNA, 16 bp, M. musculus
tgaacttggaaatatt

SEQ ID NO: 438971 - DNA, 16 bp, M. musculus
tgaacttgggtcctcc

SEQ ID NO: 438972 - DNA, 16 bp, M. musculus
tgaacttgggtcctct

SEQ ID NO: 438973 - DNA, 16 bp, M. musculus
tgaacttgggttttct

SEQ ID NO: 438974 - DNA, 16 bp, M. musculus
tgaactttccagccca

SEQ ID NO: 438975 - DNA, 16 bp, M. musculus
tgaactttctcaaata

SEQ ID NO: 438976 - DNA, 16 bp, M. musculus
tgaactttgtacaaga

SEQ ID NO: 438977 - DNA, 16 bp, M. musculus
tgaacttttaaaaaga

SEQ ID NO: 438978 - DNA, 16 bp, M. musculus
tgaacttttaaaagaa

SEQ ID NO: 438979 - DNA, 16 bp, M. musculus
tgaacttttaatatgt

SEQ ID NO: 438980 - DNA, 16 bp, M. musculus
tgaacttttattttta

SEQ ID NO: 438981 - DNA, 16 bp, M. musculus
tgaacttttgaaacct

SEQ ID NO: 438982 - DNA, 16 bp, M. musculus
tgaagaaaaacatttt

SEQ ID NO: 438983 - DNA, 16 bp, M. musculus
tgaagaaaacttccct

SEQ ID NO: 438984 - DNA, 16 bp, M. musculus
tgaagaaaataatttc

SEQ ID NO: 438985 - DNA, 16 bp, M. musculus
tgaagaaaatgaaatg

SEQ ID NO: 438986 - DNA, 16 bp, M. musculus
tgaagaaacaccatgg

SEQ ID NO: 438987 - DNA, 16 bp, M. musculus
tgaagaaaccaccagg

SEQ ID NO: 438988 - DNA, 16 bp, M. musculus
tgaagaaactgaggca

SEQ ID NO: 438989 - DNA, 16 bp, M. musculus
tgaagaaactgcaagg

SEQ ID NO: 438990 - DNA, 16 bp, M. musculus
tgaagaaagaaatgta

SEQ ID NO: 438991 - DNA, 16 bp, M. musculus
tgaagaaagaacttga

SEQ ID NO: 438992 - DNA, 16 bp, M. musculus
tgaagaaagaagctgg

SEQ ID NO: 438993 - DNA, 16 bp, M. musculus
tgaagaaagagaactt

SEQ ID NO: 438994 - DNA, 16 bp, M. musculus
tgaagaaagagattga

SEQ ID NO: 438995 - DNA, 16 bp, M. musculus
tgaagaaagaggaaca

SEQ ID NO: 438996 - DNA, 16 bp, M. musculus
tgaagaaagtgtgtca

SEQ ID NO: 438997 - DNA, 16 bp, M. musculus
tgaagaaatatggaaa

SEQ ID NO: 438998 - DNA, 16 bp, M. musculus
tgaagaaatcctgcca

SEQ ID NO: 438999 - DNA, 16 bp, M. musculus
tgaagaaatgaaaaca

SEQ ID NO: 439000 - DNA, 16 bp, M. musculus
tgaagaaatgaatgaa

SEQ ID NO: 439001 - DNA, 16 bp, M. musculus
tgaagaaatgactcag

SEQ ID NO: 439002 - DNA, 16 bp, M. musculus
tgaagaaatgcaaaac

SEQ ID NO: 439003 - DNA, 16 bp, M. musculus
tgaagaaatggctcag

SEQ ID NO: 439004 - DNA, 16 bp, M. musculus
tgaagaaattcaaaac

SEQ ID NO: 439005 - DNA, 16 bp, M. musculus
tgaagaaattcaaaga

SEQ ID NO: 439006 - DNA, 16 bp, M. musculus
tgaagaaattcccaga

SEQ ID NO: 439007 - DNA, 16 bp, M. musculus
tgaagaaattgaagaa

SEQ ID NO: 439008 - DNA, 16 bp, M. musculus
tgaagaacaagctgca

SEQ ID NO: 439009 - DNA, 16 bp, M. musculus
tgaagaacagtcagtg

SEQ ID NO: 439010 - DNA, 16 bp, M. musculus
tgaagaacagtttgtc

SEQ ID NO: 439011 - DNA, 16 bp, M. musculus
tgaagaacatccctcc

SEQ ID NO: 439012 - DNA, 16 bp, M. musculus
tgaagaactcaagaaa

SEQ ID NO: 439013 - DNA, 16 bp, M. musculus
tgaagaactctcagct

SEQ ID NO: 439014 - DNA, 16 bp, M. musculus
tgaagaactgaaatta

SEQ ID NO: 439015 - DNA, 16 bp, M. musculus
tgaagaacttttccca

SEQ ID NO: 439016 - DNA, 16 bp, M. musculus
tgaagaagaaaattga

SEQ ID NO: 439017 - DNA, 16 bp, M. musculus
tgaagaagaaatcaga

SEQ ID NO: 439018 - DNA, 16 bp, M. musculus
tgaagaagaacaaaga

SEQ ID NO: 439019 - DNA, 16 bp, M. musculus
tgaagaagacacctga

SEQ ID NO: 439020 - DNA, 16 bp, M. musculus
tgaagaagagactgaa

SEQ ID NO: 439021 - DNA, 16 bp, M. musculus
tgaagaagagcctgag

SEQ ID NO: 439022 - DNA, 16 bp, M. musculus
tgaagaagaggacttt

SEQ ID NO: 439023 - DNA, 16 bp, M. musculus
tgaagaagatattaga

SEQ ID NO: 439024 - DNA, 16 bp, M. musculus
tgaagaagcaacaaaa

SEQ ID NO: 439025 - DNA, 16 bp, M. musculus
tgaagaagctgaaggg

SEQ ID NO: 439026 - DNA, 16 bp, M. musculus
tgaagaaggaaactga

SEQ ID NO: 439027 - DNA, 16 bp, M. musculus
tgaagaaggagctgag

SEQ ID NO: 439028 - DNA, 16 bp, M. musculus
tgaagaagtcaggaca

SEQ ID NO: 439029 - DNA, 16 bp, M. musculus
tgaagaagtcatgaag

SEQ ID NO: 439030 - DNA, 16 bp, M. musculus
tgaagaagtccaaaac

SEQ ID NO: 439031 - DNA, 17 bp, M. musculus
tgaagaagtgacccaag

SEQ ID NO: 439032 - DNA, 16 bp, M. musculus
tgaagaagttagagaa

SEQ ID NO: 439033 - DNA, 16 bp, M. musculus
tgaagaatcagagaaa

SEQ ID NO: 439034 - DNA, 16 bp, M. musculus
tgaagaatggataaaa

SEQ ID NO: 439035 - DNA, 18 bp, M. musculus
tgaagaattgagttggaa

SEQ ID NO: 439036 - DNA, 16 bp, M. musculus
tgaagaattgcctcca

SEQ ID NO: 439037 - DNA, 16 bp, M. musculus
tgaagaattgtattgg

SEQ ID NO: 439038 - DNA, 16 bp, M. musculus
tgaagacaaagaaatg

SEQ ID NO: 439039 - DNA, 16 bp, M. musculus
tgaagacaatgacagt

SEQ ID NO: 439040 - DNA, 16 bp, M. musculus
tgaagacacatcatat

SEQ ID NO: 439041 - DNA, 16 bp, M. musculus
tgaagacactgttgac

SEQ ID NO: 439042 - DNA, 16 bp, M. musculus
tgaagacagaagtttg

SEQ ID NO: 439043 - DNA, 16 bp, M. musculus
tgaagacagaatgaga

SEQ ID NO: 439044 - DNA, 16 bp, M. musculus
tgaagacagagctgca

SEQ ID NO: 439045 - DNA, 16 bp, M. musculus
tgaagacagatacagt

SEQ ID NO: 439046 - DNA, 16 bp, M. musculus
tgaagacagatgctcc

SEQ ID NO: 439047 - DNA, 16 bp, M. musculus
tgaagacagccacaag

SEQ ID NO: 439048 - DNA, 16 bp, M. musculus
tgaagacagccacagt

SEQ ID NO: 439049 - DNA, 18 bp, M. musculus
tgaagacagctacagtga

SEQ ID NO: 439050 - DNA, 19 bp, M. musculus
tgaagacagctacagtgtt

SEQ ID NO: 439051 - DNA, 16 bp, M. musculus
tgaagacagtgacaga

SEQ ID NO: 439052 - DNA, 16 bp, M. musculus
tgaagacagtgacatt

SEQ ID NO: 439053 - DNA, 16 bp, M. musculus
tgaagacagtgtactt

SEQ ID NO: 439054 - DNA, 16 bp, M. musculus
tgaagaccaactgaga

SEQ ID NO: 439055 - DNA, 16 bp, M. musculus
tgaagaccaagaaata

SEQ ID NO: 439056 - DNA, 16 bp, M. musculus
tgaagaccaagctgaa

SEQ ID NO: 439057 - DNA, 16 bp, M. musculus
tgaagaccaagctgca

SEQ ID NO: 439058 - DNA, 16 bp, M. musculus
tgaagaccaagcttca

SEQ ID NO: 439059 - DNA, 16 bp, M. musculus
tgaagaccagaggaca

SEQ ID NO: 439060 - DNA, 16 bp, M. musculus
tgaagaccagagtgtg

SEQ ID NO: 439061 - DNA, 16 bp, M. musculus
tgaagaccagatgaga

SEQ ID NO: 439062 - DNA, 16 bp, M. musculus
tgaagaccaggctgac

SEQ ID NO: 439063 - DNA, 16 bp, M. musculus
tgaagacccccccccc

SEQ ID NO: 439064 - DNA, 16 bp, M. musculus
tgaagaccgaagtgtg

SEQ ID NO: 439065 - DNA, 16 bp, M. musculus
tgaagacctaagtgtg

SEQ ID NO: 439066 - DNA, 16 bp, M. musculus
tgaagacctaagttca

SEQ ID NO: 439067 - DNA, 16 bp, M. musculus
tgaagacctcccagga

SEQ ID NO: 439068 - DNA, 16 bp, M. musculus
tgaagacctgagctca

SEQ ID NO: 439069 - DNA, 16 bp, M. musculus
tgaagacctgagcttg

SEQ ID NO: 439070 - DNA, 16 bp, M. musculus
tgaagactcagagatg

SEQ ID NO: 439071 - DNA, 16 bp, M. musculus
tgaagactccatatcc

SEQ ID NO: 439072 - DNA, 16 bp, M. musculus
tgaagactcgtcttca

SEQ ID NO: 439073 - DNA, 16 bp, M. musculus
tgaagactggacttgc

SEQ ID NO: 439074 - DNA, 16 bp, M. musculus
tgaagacttgatgccc

SEQ ID NO: 439075 - DNA, 16 bp, M. musculus
tgaagagaaacagaaa

SEQ ID NO: 439076 - DNA, 16 bp, M. musculus
tgaagagaaacagagg

SEQ ID NO: 439077 - DNA, 16 bp, M. musculus
tgaagagaaaccatga

SEQ ID NO: 439078 - DNA, 16 bp, M. musculus
tgaagagacattatga

SEQ ID NO: 439079 - DNA, 16 bp, M. musculus
tgaagagaccagcatc

SEQ ID NO: 439080 - DNA, 16 bp, M. musculus
tgaagagaccccaagc

SEQ ID NO: 439081 - DNA, 16 bp, M. musculus
tgaagagaccccatga

SEQ ID NO: 439082 - DNA, 16 bp, M. musculus
tgaagagagcaatggt

SEQ ID NO: 439083 - DNA, 16 bp, M. musculus
tgaagagagcccagga

SEQ ID NO: 439084 - DNA, 18 bp, M. musculus
tgaagagagcctatgaga

SEQ ID NO: 439085 - DNA, 16 bp, M. musculus
tgaagagagtgaagat

SEQ ID NO: 439086 - DNA, 16 bp, M. musculus
tgaagagatggctcaa

SEQ ID NO: 439087 - DNA, 16 bp, M. musculus
tgaagagatggctcag

SEQ ID NO: 439088 - DNA, 16 bp, M. musculus
tgaagagatggctgag

SEQ ID NO: 439089 - DNA, 17 bp, M. musculus
tgaagagcagtcagtgt

SEQ ID NO: 439090 - DNA, 16 bp, M. musculus
tgaagagccacttcct

SEQ ID NO: 439091 - DNA, 16 bp, M. musculus
tgaagagctgagtttg

SEQ ID NO: 439092 - DNA, 16 bp, M. musculus
tgaagaggacagaaga

SEQ ID NO: 439093 - DNA, 16 bp, M. musculus
tgaagaggacctgggt

SEQ ID NO: 439094 - DNA, 16 bp, M. musculus
tgaagaggagacagaa

SEQ ID NO: 439095 - DNA, 16 bp, M. musculus
tgaagaggatgtggag

SEQ ID NO: 439096 - DNA, 16 bp, M. musculus
tgaagaggccagagga

SEQ ID NO: 439097 - DNA, 16 bp, M. musculus
tgaagagggcatcaga

SEQ ID NO: 439098 - DNA, 16 bp, M. musculus
tgaagaggtggctcag

SEQ ID NO: 439099 - DNA, 16 bp, M. musculus
tgaagaggtggttcag

SEQ ID NO: 439100 - DNA, 16 bp, M. musculus
tgaagagtttcaactt

SEQ ID NO: 439101 - DNA, 16 bp, M. musculus
tgaagataactacagt

SEQ ID NO: 439102 - DNA, 16 bp, M. musculus
tgaagatagcagttgc

SEQ ID NO: 439103 - DNA, 21 bp, M. musculus
tgaagatatggcaaaggctga

SEQ ID NO: 439104 - DNA, 16 bp, M. musculus
tgaagatattactggc

SEQ ID NO: 439105 - DNA, 16 bp, M. musculus
tgaagatatttttaaa

SEQ ID NO: 439106 - DNA, 16 bp, M. musculus
tgaagatcagtgaaga

SEQ ID NO: 439107 - DNA, 16 bp, M. musculus
tgaagatctgagtttg

SEQ ID NO: 439108 - DNA, 16 bp, M. musculus
tgaagatctgcagtta

SEQ ID NO: 439109 - DNA, 16 bp, M. musculus
tgaagatcttagaaga

SEQ ID NO: 439110 - DNA, 16 bp, M. musculus
tgaagatcttttccca

SEQ ID NO: 439111 - DNA, 16 bp, M. musculus
tgaagatgaagaaatt

SEQ ID NO: 439112 - DNA, 16 bp, M. musculus
tgaagatgaagaactc

SEQ ID NO: 439113 - DNA, 16 bp, M. musculus
tgaagatgaagatgat

SEQ ID NO: 439114 - DNA, 16 bp, M. musculus
tgaagatgaccttgag

SEQ ID NO: 439115 - DNA, 16 bp, M. musculus
tgaagatgactttgaa

SEQ ID NO: 439116 - DNA, 17 bp, M. musculus
tgaagatgatgatgatg

SEQ ID NO: 439117 - DNA, 16 bp, M. musculus
tgaagatgcagctcat

SEQ ID NO: 439118 - DNA, 16 bp, M. musculus
tgaagatgctctccct

SEQ ID NO: 439119 - DNA, 16 bp, M. musculus
tgaagatgctgccttt

SEQ ID NO: 439120 - DNA, 16 bp, M. musculus
tgaagatgtaattgaa

SEQ ID NO: 439121 - DNA, 16 bp, M. musculus
tgaagatgtagagctc

SEQ ID NO: 439122 - DNA, 16 bp, M. musculus
tgaagatgtggctcag

SEQ ID NO: 439123 - DNA, 16 bp, M. musculus
tgaagatgttgtgaag

SEQ ID NO: 439124 - DNA, 16 bp, M. musculus
tgaagattatattccc

SEQ ID NO: 439125 - DNA, 16 bp, M. musculus
tgaagattctttcttt

SEQ ID NO: 439126 - DNA, 16 bp, M. musculus
tgaagatttccattca

SEQ ID NO: 439127 - DNA, 16 bp, M. musculus
tgaagatttgctttta

SEQ ID NO: 439128 - DNA, 16 bp, M. musculus
tgaagatttttcccca

SEQ ID NO: 439129 - DNA, 16 bp, M. musculus
tgaagattttttccca

SEQ ID NO: 439130 - DNA, 16 bp, M. musculus
tgaagatttttttaaa

SEQ ID NO: 439131 - DNA, 16 bp, M. musculus
tgaagcaaaaggcaaa

SEQ ID NO: 439132 - DNA, 16 bp, M. musculus
tgaagcaaatagaagt

SEQ ID NO: 439133 - DNA, 16 bp, M. musculus
tgaagcaagaggattg

SEQ ID NO: 439134 - DNA, 16 bp, M. musculus
tgaagcacaagaagaa

SEQ ID NO: 439135 - DNA, 16 bp, M. musculus
tgaagcacagggctgg

SEQ ID NO: 439136 - DNA, 16 bp, M. musculus
tgaagcagaaaagaaa

SEQ ID NO: 439137 - DNA, 16 bp, M. musculus
tgaagcagaaaagatt

SEQ ID NO: 439138 - DNA, 16 bp, M. musculus
tgaagcagaaacaaaa

SEQ ID NO: 439139 - DNA, 16 bp, M. musculus
tgaagcagagaatgaa

SEQ ID NO: 439140 - DNA, 16 bp, M. musculus
tgaagcagcaagcaca

SEQ ID NO: 439141 - DNA, 16 bp, M. musculus
tgaagcaggaggatta

SEQ ID NO: 439142 - DNA, 16 bp, M. musculus
tgaagcaggaggattc

SEQ ID NO: 439143 - DNA, 16 bp, M. musculus
tgaagcaggaggcagg

SEQ ID NO: 439144 - DNA, 16 bp, M. musculus
tgaagcagggggaagc

SEQ ID NO: 439145 - DNA, 16 bp, M. musculus
tgaagcagggggattg

SEQ ID NO: 439146 - DNA, 17 bp, M. musculus
tgaagcatataaagttt

SEQ ID NO: 439147 - DNA, 16 bp, M. musculus
tgaagcatccacacat

SEQ ID NO: 439148 - DNA, 16 bp, M. musculus
tgaagcatccccactt

SEQ ID NO: 439149 - DNA, 16 bp, M. musculus
tgaagcattttttaaa

SEQ ID NO: 439150 - DNA, 16 bp, M. musculus
tgaagccaacctgagc

SEQ ID NO: 439151 - DNA, 16 bp, M. musculus
tgaagccaccacatac

SEQ ID NO: 439152 - DNA, 16 bp, M. musculus
tgaagccagccagggc

SEQ ID NO: 439153 - DNA, 16 bp, M. musculus
tgaagccagcctgagc

SEQ ID NO: 439154 - DNA, 16 bp, M. musculus
tgaagccagcctggtc

SEQ ID NO: 439155 - DNA, 16 bp, M. musculus
tgaagccatggatccc

SEQ ID NO: 439156 - DNA, 16 bp, M. musculus
tgaagccctggctgtc

SEQ ID NO: 439157 - DNA, 16 bp, M. musculus
tgaagccctgggttca

SEQ ID NO: 439158 - DNA, 16 bp, M. musculus
tgaagccctgtctatc

SEQ ID NO: 439159 - DNA, 16 bp, M. musculus
tgaagcctaagaagaa

SEQ ID NO: 439160 - DNA, 16 bp, M. musculus
tgaagcctacttgatc

SEQ ID NO: 439161 - DNA, 25 bp, M. musculus
tgaagcctcaggccatcaagcccaa

SEQ ID NO: 439162 - DNA, 16 bp, M. musculus
tgaagctattttgaag

SEQ ID NO: 439163 - DNA, 16 bp, M. musculus
tgaagctcaaggagaa

SEQ ID NO: 439164 - DNA, 16 bp, M. musculus
tgaagctcctttctcc

SEQ ID NO: 439165 - DNA, 16 bp, M. musculus
tgaagctctgcccagt

SEQ ID NO: 439166 - DNA, 16 bp, M. musculus
tgaagctgaccttgaa

SEQ ID NO: 439167 - DNA, 16 bp, M. musculus
tgaagctgccaagttc

SEQ ID NO: 439168 - DNA, 16 bp, M. musculus
tgaagctgctgcccag

SEQ ID NO: 439169 - DNA, 16 bp, M. musculus
tgaagctggaagacac

SEQ ID NO: 439170 - DNA, 16 bp, M. musculus
tgaagctggagccatg

SEQ ID NO: 439171 - DNA, 16 bp, M. musculus
tgaagctggagctcac

SEQ ID NO: 439172 - DNA, 16 bp, M. musculus
tgaagctggagtttca

SEQ ID NO: 439173 - DNA, 16 bp, M. musculus
tgaagctggccatctc

SEQ ID NO: 439174 - DNA, 16 bp, M. musculus
tgaagctgggcagtgg

SEQ ID NO: 439175 - DNA, 16 bp, M. musculus
tgaagctgggtggtgg

SEQ ID NO: 439176 - DNA, 16 bp, M. musculus
tgaagctttgctcttc

SEQ ID NO: 439177 - DNA, 16 bp, M. musculus
tgaaggaaaacaaaac

SEQ ID NO: 439178 - DNA, 16 bp, M. musculus
tgaaggaaaacagagg

SEQ ID NO: 439179 - DNA, 16 bp, M. musculus
tgaaggaaaacatcac

SEQ ID NO: 439180 - DNA, 16 bp, M. musculus
tgaaggaaaagtcatc

SEQ ID NO: 439181 - DNA, 16 bp, M. musculus
tgaaggaaaggccatc

SEQ ID NO: 439182 - DNA, 16 bp, M. musculus
tgaaggaaatgaaggg

SEQ ID NO: 439183 - DNA, 16 bp, M. musculus
tgaaggaaatgcaaat

SEQ ID NO: 439184 - DNA, 16 bp, M. musculus
tgaaggaacaagctgg

SEQ ID NO: 439185 - DNA, 16 bp, M. musculus
tgaaggaacatttagc

SEQ ID NO: 439186 - DNA, 16 bp, M. musculus
tgaaggaacgtttcac

SEQ ID NO: 439187 - DNA, 16 bp, M. musculus
tgaaggaactgaaagg

SEQ ID NO: 439188 - DNA, 16 bp, M. musculus
tgaaggaactgaaggg

SEQ ID NO: 439189 - DNA, 16 bp, M. musculus
tgaaggaagaaatcaa

SEQ ID NO: 439190 - DNA, 16 bp, M. musculus
tgaaggaagcagagaa

SEQ ID NO: 439191 - DNA, 16 bp, M. musculus
tgaaggaagccaaggc

SEQ ID NO: 439192 - DNA, 16 bp, M. musculus
tgaaggaagtcaggac

SEQ ID NO: 439193 - DNA, 16 bp, M. musculus
tgaaggaattaaacaa

SEQ ID NO: 439194 - DNA, 16 bp, M. musculus
tgaaggaattacagag

SEQ ID NO: 439195 - DNA, 16 bp, M. musculus
tgaaggaattgagcaa

SEQ ID NO: 439196 - DNA, 16 bp, M. musculus
tgaaggaatttaacaa

SEQ ID NO: 439197 - DNA, 16 bp, M. musculus
tgaaggacagaggaca

SEQ ID NO: 439198 - DNA, 16 bp, M. musculus
tgaaggacatgtgggt

SEQ ID NO: 439199 - DNA, 16 bp, M. musculus
tgaaggagaaaaccaa

SEQ ID NO: 439200 - DNA, 16 bp, M. musculus
tgaaggagagaccaga

SEQ ID NO: 439201 - DNA, 16 bp, M. musculus
tgaaggagatgaaggg

SEQ ID NO: 439202 - DNA, 16 bp, M. musculus
tgaaggagatgaatgg

SEQ ID NO: 439203 - DNA, 16 bp, M. musculus
tgaaggagcagagaca

SEQ ID NO: 439204 - DNA, 16 bp, M. musculus
tgaaggagctagagaa

SEQ ID NO: 439205 - DNA, 16 bp, M. musculus
tgaaggagctgaagga

SEQ ID NO: 439206 - DNA, 16 bp, M. musculus
tgaaggagctgaaggg

SEQ ID NO: 439207 - DNA, 16 bp, M. musculus
tgaaggagctgaaggt

SEQ ID NO: 439208 - DNA, 16 bp, M. musculus
tgaaggagctgaggag

SEQ ID NO: 439209 - DNA, 16 bp, M. musculus
tgaaggagctgcaggg

SEQ ID NO: 439210 - DNA, 16 bp, M. musculus
tgaaggagctggagaa

SEQ ID NO: 439211 - DNA, 16 bp, M. musculus
tgaaggaggaaatgga

SEQ ID NO: 439212 - DNA, 16 bp, M. musculus
tgaaggaggaacatga

SEQ ID NO: 439213 - DNA, 16 bp, M. musculus
tgaaggaggagctgag

SEQ ID NO: 439214 - DNA, 16 bp, M. musculus
tgaaggagtcagagaa

SEQ ID NO: 439215 - DNA, 16 bp, M. musculus
tgaaggagttacagag

SEQ ID NO: 439216 - DNA, 16 bp, M. musculus
tgaaggatctgtatga

SEQ ID NO: 439217 - DNA, 16 bp, M. musculus
tgaaggatggtttgaa

SEQ ID NO: 439218 - DNA, 16 bp, M. musculus
tgaaggcaaacagaag

SEQ ID NO: 439219 - DNA, 16 bp, M. musculus
tgaaggcaaggagagg

SEQ ID NO: 439220 - DNA, 16 bp, M. musculus
tgaaggcagaagctga

SEQ ID NO: 439221 - DNA, 16 bp, M. musculus
tgaaggcagaggcaag

SEQ ID NO: 439222 - DNA, 16 bp, M. musculus
tgaaggcagaggcagg

SEQ ID NO: 439223 - DNA, 16 bp, M. musculus
tgaaggcagtgacagt

SEQ ID NO: 439224 - DNA, 16 bp, M. musculus
tgaaggcatgaagggt

SEQ ID NO: 439225 - DNA, 16 bp, M. musculus
tgaaggccaagagacc

SEQ ID NO: 439226 - DNA, 16 bp, M. musculus
tgaaggccaagctgca

SEQ ID NO: 439227 - DNA, 16 bp, M. musculus
tgaaggccaaggctgg

SEQ ID NO: 439228 - DNA, 16 bp, M. musculus
tgaaggccaatcttgt

SEQ ID NO: 439229 - DNA, 16 bp, M. musculus
tgaaggccttccagga

SEQ ID NO: 439230 - DNA, 16 bp, M. musculus
tgaaggctcaatgcct

SEQ ID NO: 439231 - DNA, 16 bp, M. musculus
tgaaggctccatgccc

SEQ ID NO: 439232 - DNA, 16 bp, M. musculus
tgaaggctcgatagat

SEQ ID NO: 439233 - DNA, 16 bp, M. musculus
tgaagggaaatggaga

SEQ ID NO: 439234 - DNA, 16 bp, M. musculus
tgaagggatttgtaac

SEQ ID NO: 439235 - DNA, 16 bp, M. musculus
tgaagggctggatttt

SEQ ID NO: 439236 - DNA, 16 bp, M. musculus
tgaagggctggggaga

SEQ ID NO: 439237 - DNA, 17 bp, M. musculus
tgaagggcttagccaat

SEQ ID NO: 439238 - DNA, 16 bp, M. musculus
tgaaggggatggcaac

SEQ ID NO: 439239 - DNA, 16 bp, M. musculus
tgaaggggccagaaga

SEQ ID NO: 439240 - DNA, 16 bp, M. musculus
tgaaggggtttgcaac

SEQ ID NO: 439241 - DNA, 16 bp, M. musculus
tgaaggtcagatgaca

SEQ ID NO: 439242 - DNA, 16 bp, M. musculus
tgaaggtcagcctggg

SEQ ID NO: 439243 - DNA, 16 bp, M. musculus
tgaaggtcctgatttc

SEQ ID NO: 439244 - DNA, 16 bp, M. musculus
tgaaggtccttgttcc

SEQ ID NO: 439245 - DNA, 16 bp, M. musculus
tgaaggtgaagcatgt

SEQ ID NO: 439246 - DNA, 16 bp, M. musculus
tgaaggtggaaggaga

SEQ ID NO: 439247 - DNA, 16 bp, M. musculus
tgaaggtgtttgcagc

SEQ ID NO: 439248 - DNA, 16 bp, M. musculus
tgaaggttttgtggct

SEQ ID NO: 439249 - DNA, 16 bp, M. musculus
tgaagtaagacctaat

SEQ ID NO: 439250 - DNA, 16 bp, M. musculus
tgaagtagaaaccatg

SEQ ID NO: 439251 - DNA, 16 bp, M. musculus
tgaagtagcaacaaag

SEQ ID NO: 439252 - DNA, 16 bp, M. musculus
tgaagtaggaggatca

SEQ ID NO: 439253 - DNA, 16 bp, M. musculus
tgaagtataaatgaag

SEQ ID NO: 439254 - DNA, 16 bp, M. musculus
tgaagtcagagacccc

SEQ ID NO: 439255 - DNA, 16 bp, M. musculus
tgaagtcagcaacagt

SEQ ID NO: 439256 - DNA, 16 bp, M. musculus
tgaagtcagcctgagc

SEQ ID NO: 439257 - DNA, 16 bp, M. musculus
tgaagtcagcctgggc

SEQ ID NO: 439258 - DNA, 16 bp, M. musculus
tgaagtcagcctgtga

SEQ ID NO: 439259 - DNA, 16 bp, M. musculus
tgaagtcattggcaca

SEQ ID NO: 439260 - DNA, 16 bp, M. musculus
tgaagtcattttttaa

SEQ ID NO: 439261 - DNA, 16 bp, M. musculus
tgaagtccatcttctt

SEQ ID NO: 439262 - DNA, 16 bp, M. musculus
tgaagtcctatccaga

SEQ ID NO: 439263 - DNA, 16 bp, M. musculus
tgaagtcctctatgaa

SEQ ID NO: 439264 - DNA, 16 bp, M. musculus
tgaagtcctggctgtc

SEQ ID NO: 439265 - DNA, 16 bp, M. musculus
tgaagtctgtcatgga

SEQ ID NO: 439266 - DNA, 16 bp, M. musculus
tgaagtctgtctgtct

SEQ ID NO: 439267 - DNA, 16 bp, M. musculus
tgaagtctttgttttt

SEQ ID NO: 439268 - DNA, 16 bp, M. musculus
tgaagtcttttgggat

SEQ ID NO: 439269 - DNA, 16 bp, M. musculus
tgaagtgccagggtgg

SEQ ID NO: 439270 - DNA, 16 bp, M. musculus
tgaagtggaaacttct

SEQ ID NO: 439271 - DNA, 16 bp, M. musculus
tgaagtgggaatttct

SEQ ID NO: 439272 - DNA, 16 bp, M. musculus
tgaagtgtctttcctt

SEQ ID NO: 439273 - DNA, 16 bp, M. musculus
tgaagtgttatcacta

SEQ ID NO: 439274 - DNA, 16 bp, M. musculus
tgaagtgtttatcaaa

SEQ ID NO: 439275 - DNA, 16 bp, M. musculus
tgaagttcaccttctt

SEQ ID NO: 439276 - DNA, 16 bp, M. musculus
tgaagttcactgtaaa

SEQ ID NO: 439277 - DNA, 18 bp, M. musculus
tgaagttcctttctctgt

SEQ ID NO: 439278 - DNA, 16 bp, M. musculus
tgaagttcttatcaaa

SEQ ID NO: 439279 - DNA, 16 bp, M. musculus
tgaagttgcttccttt

SEQ ID NO: 439280 - DNA, 16 bp, M. musculus
tgaagttgtcttggag

SEQ ID NO: 439281 - DNA, 16 bp, M. musculus
tgaagttgttaatcag

SEQ ID NO: 439282 - DNA, 16 bp, M. musculus
tgaagttgttctctga

SEQ ID NO: 439283 - DNA, 16 bp, M. musculus
tgaagtttactgagag

SEQ ID NO: 439284 - DNA, 16 bp, M. musculus
tgaagtttcctttttc

SEQ ID NO: 439285 - DNA, 16 bp, M. musculus
tgaagtttgcaggcaa

SEQ ID NO: 439286 - DNA, 16 bp, M. musculus
tgaagtttggagctga

SEQ ID NO: 439287 - DNA, 16 bp, M. musculus
tgaagtttgtgtgtgt

SEQ ID NO: 439288 - DNA, 16 bp, M. musculus
tgaagttttcaaagaa

SEQ ID NO: 439289 - DNA, 16 bp, M. musculus
tgaataaaaccatcaa

SEQ ID NO: 439290 - DNA, 16 bp, M. musculus
tgaataaaatccaacc

SEQ ID NO: 439291 - DNA, 16 bp, M. musculus
tgaataaaatgtattt

SEQ ID NO: 439292 - DNA, 16 bp, M. musculus
tgaataaacacagacc

SEQ ID NO: 439293 - DNA, 16 bp, M. musculus
tgaataaactctattt

SEQ ID NO: 439294 - DNA, 16 bp, M. musculus
tgaataaagaaatcaa

SEQ ID NO: 439295 - DNA, 16 bp, M. musculus
tgaataaagcagcaat

SEQ ID NO: 439296 - DNA, 16 bp, M. musculus
tgaataaagctgctgt

SEQ ID NO: 439297 - DNA, 16 bp, M. musculus
tgaataaagttttatt

SEQ ID NO: 439298 - DNA, 16 bp, M. musculus
tgaataaataaaacat

SEQ ID NO: 439299 - DNA, 16 bp, M. musculus
tgaataaatacatttt

SEQ ID NO: 439300 - DNA, 16 bp, M. musculus
tgaataaatatatcaa

SEQ ID NO: 439301 - DNA, 39 bp, M. musculus
tgaataaatcactcatggttttaaagttcaatggagtta

SEQ ID NO: 439302 - DNA, 16 bp, M. musculus
tgaataaatctcttaa

SEQ ID NO: 439303 - DNA, 16 bp, M. musculus
tgaataaatgaatgta

SEQ ID NO: 439304 - DNA, 16 bp, M. musculus
tgaataagaatgcccc

SEQ ID NO: 439305 - DNA, 16 bp, M. musculus
tgaataagtgaatgaa

SEQ ID NO: 439306 - DNA, 16 bp, M. musculus
tgaataatttcttttt

SEQ ID NO: 439307 - DNA, 16 bp, M. musculus
tgaataatttttcatt

SEQ ID NO: 439308 - DNA, 16 bp, M. musculus
tgaatacacacacatg

SEQ ID NO: 439309 - DNA, 16 bp, M. musculus
tgaatacatatgtgtg

SEQ ID NO: 439310 - DNA, 16 bp, M. musculus
tgaatacatgaatgaa

SEQ ID NO: 439311 - DNA, 16 bp, M. musculus
tgaatacatttttttt

SEQ ID NO: 439312 - DNA, 16 bp, M. musculus
tgaataccaagctgca

SEQ ID NO: 439313 - DNA, 16 bp, M. musculus
tgaataccatcaataa

SEQ ID NO: 439314 - DNA, 16 bp, M. musculus
tgaatacctactatgt

SEQ ID NO: 439315 - DNA, 16 bp, M. musculus
tgaatactctttggtt

SEQ ID NO: 439316 - DNA, 16 bp, M. musculus
tgaatacttcagtcct

SEQ ID NO: 439317 - DNA, 16 bp, M. musculus
tgaatacttggtcacc

SEQ ID NO: 439318 - DNA, 17 bp, M. musculus
tgaatagatctgtaaca

SEQ ID NO: 439319 - DNA, 16 bp, M. musculus
tgaatagttttattca

SEQ ID NO: 439320 - DNA, 16 bp, M. musculus
tgaatataacagcaat

SEQ ID NO: 439321 - DNA, 16 bp, M. musculus
tgaatataagcaatgt

SEQ ID NO: 439322 - DNA, 16 bp, M. musculus
tgaatataatcaaaat

SEQ ID NO: 439323 - DNA, 16 bp, M. musculus
tgaatatactgtagct

SEQ ID NO: 439324 - DNA, 16 bp, M. musculus
tgaatatatatatgta

SEQ ID NO: 439325 - DNA, 16 bp, M. musculus
tgaatatatatgtgca

SEQ ID NO: 439326 - DNA, 16 bp, M. musculus
tgaatatatgtgtgca

SEQ ID NO: 439327 - DNA, 18 bp, M. musculus
tgaatatctttgctccaa

SEQ ID NO: 439328 - DNA, 16 bp, M. musculus
tgaatatgaagtgtcc

SEQ ID NO: 439329 - DNA, 16 bp, M. musculus
tgaatatgaagtgtct

SEQ ID NO: 439330 - DNA, 16 bp, M. musculus
tgaatatgaatatttt

SEQ ID NO: 439331 - DNA, 16 bp, M. musculus
tgaatatgtaaatata

SEQ ID NO: 439332 - DNA, 16 bp, M. musculus
tgaatatgtgagtgtg

SEQ ID NO: 439333 - DNA, 16 bp, M. musculus
tgaatatttatgaaaa

SEQ ID NO: 439334 - DNA, 16 bp, M. musculus
tgaatattttaaatgt

SEQ ID NO: 439335 - DNA, 16 bp, M. musculus
tgaatattttcatata

SEQ ID NO: 439336 - DNA, 16 bp, M. musculus
tgaatattttgtgtca

SEQ ID NO: 439337 - DNA, 16 bp, M. musculus
tgaatcaccaaccaga

SEQ ID NO: 439338 - DNA, 16 bp, M. musculus
tgaatcagattctttc

SEQ ID NO: 439339 - DNA, 16 bp, M. musculus
tgaatcatattttctg

SEQ ID NO: 439340 - DNA, 16 bp, M. musculus
tgaatcatttaaaaat

SEQ ID NO: 439341 - DNA, 16 bp, M. musculus
tgaatccaagaacaaa

SEQ ID NO: 439342 - DNA, 16 bp, M. musculus
tgaatcccagcacttg

SEQ ID NO: 439343 - DNA, 16 bp, M. musculus
tgaatcccagcatttg

SEQ ID NO: 439344 - DNA, 16 bp, M. musculus
tgaatctaatttcttt

SEQ ID NO: 439345 - DNA, 16 bp, M. musculus
tgaatctatagattac

SEQ ID NO: 439346 - DNA, 16 bp, M. musculus
tgaatctcagaagaga

SEQ ID NO: 439347 - DNA, 16 bp, M. musculus
tgaatctcaggagaga

SEQ ID NO: 439348 - DNA, 16 bp, M. musculus
tgaatctgaaaagctt

SEQ ID NO: 439349 - DNA, 17 bp, M. musculus
tgaatctgttgaggcct

SEQ ID NO: 439350 - DNA, 16 bp, M. musculus
tgaatcttcactctct

SEQ ID NO: 439351 - DNA, 16 bp, M. musculus
tgaatgaaaacctagc

SEQ ID NO: 439352 - DNA, 16 bp, M. musculus
tgaatgaaaggaagga

SEQ ID NO: 439353 - DNA, 16 bp, M. musculus
tgaatgaaataaagtt

SEQ ID NO: 439354 - DNA, 16 bp, M. musculus
tgaatgaacaaatgaa

SEQ ID NO: 439355 - DNA, 16 bp, M. musculus
tgaatgaagaaaatat

SEQ ID NO: 439356 - DNA, 16 bp, M. musculus
tgaatgaatacatgaa

SEQ ID NO: 439357 - DNA, 16 bp, M. musculus
tgaatgaatccagaga

SEQ ID NO: 439358 - DNA, 16 bp, M. musculus
tgaatgaatgaagaga

SEQ ID NO: 439359 - DNA, 16 bp, M. musculus
tgaatgaatgaataag

SEQ ID NO: 439360 - DNA, 16 bp, M. musculus
tgaatgaatgaatcta

SEQ ID NO: 439361 - DNA, 16 bp, M. musculus
tgaatgaatgaatgaa

SEQ ID NO: 439362 - DNA, 16 bp, M. musculus
tgaatgaatgaatgga

SEQ ID NO: 439363 - DNA, 16 bp, M. musculus
tgaatgaatgaatttt

SEQ ID NO: 439364 - DNA, 16 bp, M. musculus
tgaatgaatgagaaaa

SEQ ID NO: 439365 - DNA, 16 bp, M. musculus
tgaatgatggttttga

SEQ ID NO: 439366 - DNA, 16 bp, M. musculus
tgaatgcacacacaca

SEQ ID NO: 439367 - DNA, 16 bp, M. musculus
tgaatgcatacacttt

SEQ ID NO: 439368 - DNA, 16 bp, M. musculus
tgaatgctcttctgaa

SEQ ID NO: 439369 - DNA, 16 bp, M. musculus
tgaatgcttgacccat

SEQ ID NO: 439370 - DNA, 16 bp, M. musculus
tgaatgcttttcaaaa

SEQ ID NO: 439371 - DNA, 16 bp, M. musculus
tgaatggatctgtgtg

SEQ ID NO: 439372 - DNA, 16 bp, M. musculus
tgaatggatgaatgaa

SEQ ID NO: 439373 - DNA, 16 bp, M. musculus
tgaatggatggatgga

SEQ ID NO: 439374 - DNA, 16 bp, M. musculus
tgaatggatgttgcat

SEQ ID NO: 439375 - DNA, 16 bp, M. musculus
tgaatggcttttcctt

SEQ ID NO: 439376 - DNA, 16 bp, M. musculus
tgaatggtcagggtgg

SEQ ID NO: 439377 - DNA, 16 bp, M. musculus
tgaatggtccatcctt

SEQ ID NO: 439378 - DNA, 16 bp, M. musculus
tgaatggttttagctt

SEQ ID NO: 439379 - DNA, 16 bp, M. musculus
tgaatgtatgtataca

SEQ ID NO: 439380 - DNA, 16 bp, M. musculus
tgaatgtattgtcaca

SEQ ID NO: 439381 - DNA, 16 bp, M. musculus
tgaatgtccaggaccc

SEQ ID NO: 439382 - DNA, 16 bp, M. musculus
tgaatgtccccacccc

SEQ ID NO: 439383 - DNA, 16 bp, M. musculus
tgaatgtctgtgtgag

SEQ ID NO: 439384 - DNA, 16 bp, M. musculus
tgaatgtctgtgtgtg

SEQ ID NO: 439385 - DNA, 16 bp, M. musculus
tgaatgtgactcatct

SEQ ID NO: 439386 - DNA, 18 bp, M. musculus
tgaatgtgagcatccact

SEQ ID NO: 439387 - DNA, 16 bp, M. musculus
tgaatgtgcacacaca

SEQ ID NO: 439388 - DNA, 16 bp, M. musculus
tgaatgtggattccct

SEQ ID NO: 439389 - DNA, 16 bp, M. musculus
tgaatgtggctgacct

SEQ ID NO: 439390 - DNA, 16 bp, M. musculus
tgaatgtgtacacaca

SEQ ID NO: 439391 - DNA, 16 bp, M. musculus
tgaatgtgtgtctctg

SEQ ID NO: 439392 - DNA, 17 bp, M. musculus
tgaatgttcatgggcat

SEQ ID NO: 439393 - DNA, 16 bp, M. musculus
tgaatgttctgtatga

SEQ ID NO: 439394 - DNA, 16 bp, M. musculus
tgaatgtttgctttct

SEQ ID NO: 439395 - DNA, 16 bp, M. musculus
tgaatgtttgtatgtg

SEQ ID NO: 439396 - DNA, 16 bp, M. musculus
tgaattaattgcttta

SEQ ID NO: 439397 - DNA, 16 bp, M. musculus
tgaattaggggaagaa

SEQ ID NO: 439398 - DNA, 16 bp, M. musculus
tgaattatttactttt

SEQ ID NO: 439399 - DNA, 16 bp, M. musculus
tgaattattttcttct

SEQ ID NO: 439400 - DNA, 16 bp, M. musculus
tgaattcaaggcaagc

SEQ ID NO: 439401 - DNA, 16 bp, M. musculus
tgaattcaaggccatc

SEQ ID NO: 439402 - DNA, 16 bp, M. musculus
tgaattcaaggctagc

SEQ ID NO: 439403 - DNA, 16 bp, M. musculus
tgaattcacagagatc

SEQ ID NO: 439404 - DNA, 16 bp, M. musculus
tgaattcacagcagtt

SEQ ID NO: 439405 - DNA, 16 bp, M. musculus
tgaattcagaaatccg

SEQ ID NO: 439406 - DNA, 16 bp, M. musculus
tgaattcatttttctt

SEQ ID NO: 439407 - DNA, 16 bp, M. musculus
tgaattccaaaattca

SEQ ID NO: 439408 - DNA, 16 bp, M. musculus
tgaattccaggccaat

SEQ ID NO: 439409 - DNA, 16 bp, M. musculus
tgaattccaggccagt

SEQ ID NO: 439410 - DNA, 16 bp, M. musculus
tgaattccatccccag

SEQ ID NO: 439411 - DNA, 16 bp, M. musculus
tgaattcctgaaattc

SEQ ID NO: 439412 - DNA, 16 bp, M. musculus
tgaattcctgatcttt

SEQ ID NO: 439413 - DNA, 16 bp, M. musculus
tgaattcctgattctc

SEQ ID NO: 439414 - DNA, 16 bp, M. musculus
tgaattctaatgtaaa

SEQ ID NO: 439415 - DNA, 16 bp, M. musculus
tgaattcttgatctct

SEQ ID NO: 439416 - DNA, 16 bp, M. musculus
tgaattctttattgtt

SEQ ID NO: 439417 - DNA, 16 bp, M. musculus
tgaattctttctttct

SEQ ID NO: 439418 - DNA, 16 bp, M. musculus
tgaattgctctgcttg

SEQ ID NO: 439419 - DNA, 16 bp, M. musculus
tgaattgctcttcttg

SEQ ID NO: 439420 - DNA, 16 bp, M. musculus
tgaattggctcatttc

SEQ ID NO: 439421 - DNA, 16 bp, M. musculus
tgaattggtgggaatg

SEQ ID NO: 439422 - DNA, 16 bp, M. musculus
tgaattgtttcttggg

SEQ ID NO: 439423 - DNA, 16 bp, M. musculus
tgaatttaaaagattt

SEQ ID NO: 439424 - DNA, 16 bp, M. musculus
tgaatttaatccctgg

SEQ ID NO: 439425 - DNA, 16 bp, M. musculus
tgaatttacatttcaa

SEQ ID NO: 439426 - DNA, 16 bp, M. musculus
tgaatttaggtcctct

SEQ ID NO: 439427 - DNA, 57 bp, M. musculus
tgaatttatgaaattcctaggcaaatggatggacctggagggtatcatcctgagtga

SEQ ID NO: 439428 - DNA, 16 bp, M. musculus
tgaatttatgaacttc

SEQ ID NO: 439429 - DNA, 16 bp, M. musculus
tgaatttatgtaattc

SEQ ID NO: 439430 - DNA, 16 bp, M. musculus
tgaatttatgtctggg

SEQ ID NO: 439431 - DNA, 16 bp, M. musculus
tgaatttcacatcata

SEQ ID NO: 439432 - DNA, 16 bp, M. musculus
tgaatttctgagttca

SEQ ID NO: 439433 - DNA, 16 bp, M. musculus
tgaatttctgagttcg

SEQ ID NO: 439434 - DNA, 16 bp, M. musculus
tgaatttctgccacct

SEQ ID NO: 439435 - DNA, 16 bp, M. musculus
tgaatttcttttttaa

SEQ ID NO: 439436 - DNA, 16 bp, M. musculus
tgaatttgaaggaaag

SEQ ID NO: 439437 - DNA, 16 bp, M. musculus
tgaatttgagagggag

SEQ ID NO: 439438 - DNA, 16 bp, M. musculus
tgaatttgagagtgag

SEQ ID NO: 439439 - DNA, 16 bp, M. musculus
tgaatttgaggtcagc

SEQ ID NO: 439440 - DNA, 16 bp, M. musculus
tgaatttgaggtcagt

SEQ ID NO: 439441 - DNA, 16 bp, M. musculus
tgaatttgattatttc

SEQ ID NO: 439442 - DNA, 16 bp, M. musculus
tgaatttgcaaataaa

SEQ ID NO: 439443 - DNA, 16 bp, M. musculus
tgaatttgcagactgc

SEQ ID NO: 439444 - DNA, 16 bp, M. musculus
tgaatttgggtcctct

SEQ ID NO: 439445 - DNA, 16 bp, M. musculus
tgaatttggttttgta

SEQ ID NO: 439446 - DNA, 16 bp, M. musculus
tgaatttgtttttatc

SEQ ID NO: 439447 - DNA, 16 bp, M. musculus
tgaattttaaaagaga

SEQ ID NO: 439448 - DNA, 16 bp, M. musculus
tgaattttaaagatag

SEQ ID NO: 439449 - DNA, 16 bp, M. musculus
tgaattttcgtatatt

SEQ ID NO: 439450 - DNA, 16 bp, M. musculus
tgaattttctcaaatg

SEQ ID NO: 439451 - DNA, 16 bp, M. musculus
tgaattttctttaaaa

SEQ ID NO: 439452 - DNA, 16 bp, M. musculus
tgaattttctttttaa

SEQ ID NO: 439453 - DNA, 16 bp, M. musculus
tgaattttgtcaagtg

SEQ ID NO: 439454 - DNA, 16 bp, M. musculus
tgaatttttaaaagat

SEQ ID NO: 439455 - DNA, 16 bp, M. musculus
tgaatttttaaagact

SEQ ID NO: 439456 - DNA, 16 bp, M. musculus
tgaatttttaaatgaa

SEQ ID NO: 439457 - DNA, 16 bp, M. musculus
tgaattttttgacctt

SEQ ID NO: 439458 - DNA, 16 bp, M. musculus
tgacaaaaagaaactt

SEQ ID NO: 439459 - DNA, 16 bp, M. musculus
tgacaaaaagcaattt

SEQ ID NO: 439460 - DNA, 16 bp, M. musculus
tgacaaaaccaaactt

SEQ ID NO: 439461 - DNA, 16 bp, M. musculus
tgacaaaactaaattc

SEQ ID NO: 439462 - DNA, 16 bp, M. musculus
tgacaaaactaaccag

SEQ ID NO: 439463 - DNA, 16 bp, M. musculus
tgacaaaagcaaagta

SEQ ID NO: 439464 - DNA, 16 bp, M. musculus
tgacaaaagcaactta

SEQ ID NO: 439465 - DNA, 16 bp, M. musculus
tgacaaaaggagatca

SEQ ID NO: 439466 - DNA, 16 bp, M. musculus
tgacaaaatgaaattt

SEQ ID NO: 439467 - DNA, 16 bp, M. musculus
tgacaaaatgatggac

SEQ ID NO: 439468 - DNA, 16 bp, M. musculus
tgacaaaatgcctgac

SEQ ID NO: 439469 - DNA, 16 bp, M. musculus
tgacaaacatttacat

SEQ ID NO: 439470 - DNA, 16 bp, M. musculus
tgacaaactttctcca

SEQ ID NO: 439471 - DNA, 16 bp, M. musculus
tgacaaagaagccaat

SEQ ID NO: 439472 - DNA, 16 bp, M. musculus
tgacaaagaagtaaaa

SEQ ID NO: 439473 - DNA, 16 bp, M. musculus
tgacaaatacagaggc

SEQ ID NO: 439474 - DNA, 16 bp, M. musculus
tgacaaatcagagaaa

SEQ ID NO: 439475 - DNA, 16 bp, M. musculus
tgacaaccaacagatt

SEQ ID NO: 439476 - DNA, 16 bp, M. musculus
tgacaaccaagattaa

SEQ ID NO: 439477 - DNA, 25 bp, M. musculus
tgacaaccaggaatagccactacac

SEQ ID NO: 439478 - DNA, 16 bp, M. musculus
tgacaactttatttac

SEQ ID NO: 439479 - DNA, 199 bp, M. musculus
tgacaagaaaagaagcccgtgacattgttactcaatgtcaaagctgctgtgagttcttgccagttcctcatgtgggaattaacccacgcggtattcgacctctacaggtctggcaaatggatgttacacatgtttcttcctttggaaaacttcaatatctccatgtgtccattgacacatgttctggcatcatgtttgc

SEQ ID NO: 439480 - DNA, 16 bp, M. musculus
tgacaagaacttccag

SEQ ID NO: 439481 - DNA, 16 bp, M. musculus
tgacaagaggaatttc

SEQ ID NO: 439482 - DNA, 16 bp, M. musculus
tgacaagctggctcac

SEQ ID NO: 439483 - DNA, 16 bp, M. musculus
tgacaagctggctcat

SEQ ID NO: 439484 - DNA, 16 bp, M. musculus
tgacaaggactgtgaa

SEQ ID NO: 439485 - DNA, 21 bp, M. musculus
tgacaaggtgattataactca

SEQ ID NO: 439486 - DNA, 42 bp, M. musculus
tgacaaggtgattataactcaggcacttttagctattgaaaa

SEQ ID NO: 439487 - DNA, 16 bp, M. musculus
tgacaatgaaaattaa

SEQ ID NO: 439488 - DNA, 16 bp, M. musculus
tgacaatgaagatgaa

SEQ ID NO: 439489 - DNA, 16 bp, M. musculus
tgacaatgagttcaag

SEQ ID NO: 439490 - DNA, 16 bp, M. musculus
tgacaatgatggagga

SEQ ID NO: 439491 - DNA, 16 bp, M. musculus
tgacaatgatttattc

SEQ ID NO: 439492 - DNA, 16 bp, M. musculus
tgacaatggagattgg

SEQ ID NO: 439493 - DNA, 16 bp, M. musculus
tgacaatgttgatcct

SEQ ID NO: 439494 - DNA, 16 bp, M. musculus
tgacaattttcttttt

SEQ ID NO: 439495 - DNA, 16 bp, M. musculus
tgacacaaaaccagcc

SEQ ID NO: 439496 - DNA, 16 bp, M. musculus
tgacacaacagtcaag

SEQ ID NO: 439497 - DNA, 16 bp, M. musculus
tgacacaagccagggt

SEQ ID NO: 439498 - DNA, 16 bp, M. musculus
tgacacacacacacat

SEQ ID NO: 439499 - DNA, 16 bp, M. musculus
tgacacacacctgtaa

SEQ ID NO: 439500 - DNA, 16 bp, M. musculus
tgacacacacctttaa

SEQ ID NO: 439501 - DNA, 16 bp, M. musculus
tgacacacatctgtaa

SEQ ID NO: 439502 - DNA, 16 bp, M. musculus
tgacacacatctttaa

SEQ ID NO: 439503 - DNA, 16 bp, M. musculus
tgacacaccagaagag

SEQ ID NO: 439504 - DNA, 16 bp, M. musculus
tgacacacctagaatc

SEQ ID NO: 439505 - DNA, 16 bp, M. musculus
tgacacacctcctcca

SEQ ID NO: 439506 - DNA, 16 bp, M. musculus
tgacacacctcttcca

SEQ ID NO: 439507 - DNA, 16 bp, M. musculus
tgacacacttcctcca

SEQ ID NO: 439508 - DNA, 16 bp, M. musculus
tgacacacttctccaa

SEQ ID NO: 439509 - DNA, 16 bp, M. musculus
tgacacactttctcca

SEQ ID NO: 439510 - DNA, 16 bp, M. musculus
tgacacagctggagct

SEQ ID NO: 439511 - DNA, 16 bp, M. musculus
tgacacatgcctttaa

SEQ ID NO: 439512 - DNA, 16 bp, M. musculus
tgacaccaaacccaga

SEQ ID NO: 439513 - DNA, 25 bp, M. musculus
tgacaccattgcatacactagcaag

SEQ ID NO: 439514 - DNA, 20 bp, M. musculus
tgacaccattgcatacactg

SEQ ID NO: 439515 - DNA, 16 bp, M. musculus
tgacacccagtttact

SEQ ID NO: 439516 - DNA, 16 bp, M. musculus
tgacacccttcctcca

SEQ ID NO: 439517 - DNA, 16 bp, M. musculus
tgacacctttttctgg

SEQ ID NO: 439518 - DNA, 16 bp, M. musculus
tgacactacctcagag

SEQ ID NO: 439519 - DNA, 16 bp, M. musculus
tgacactctcttctgg

SEQ ID NO: 439520 - DNA, 16 bp, M. musculus
tgacactgggcctggc

SEQ ID NO: 439521 - DNA, 16 bp, M. musculus
tgacacttcaagtctc

SEQ ID NO: 439522 - DNA, 16 bp, M. musculus
tgacacttgaggttgt

SEQ ID NO: 439523 - DNA, 17 bp, M. musculus
tgacacttgggagactg

SEQ ID NO: 439524 - DNA, 16 bp, M. musculus
tgacagacaggcagac

SEQ ID NO: 439525 - DNA, 16 bp, M. musculus
tgacagagacacagag

SEQ ID NO: 439526 - DNA, 16 bp, M. musculus
tgacagagaggtagat

SEQ ID NO: 439527 - DNA, 16 bp, M. musculus
tgacagagctggagaa

SEQ ID NO: 439528 - DNA, 16 bp, M. musculus
tgacagaggagctaaa

SEQ ID NO: 439529 - DNA, 16 bp, M. musculus
tgacagaggctgagct

SEQ ID NO: 439530 - DNA, 16 bp, M. musculus
tgacagcaaatgctgg

SEQ ID NO: 439531 - DNA, 16 bp, M. musculus
tgacagcagatgctgt

SEQ ID NO: 439532 - DNA, 16 bp, M. musculus
tgacagccagaagctg

SEQ ID NO: 439533 - DNA, 16 bp, M. musculus
tgacagcctcttctga

SEQ ID NO: 439534 - DNA, 16 bp, M. musculus
tgacagcttgatcaat

SEQ ID NO: 439535 - DNA, 16 bp, M. musculus
tgacagcttttttttt

SEQ ID NO: 439536 - DNA, 16 bp, M. musculus
tgacaggaaacaccaa

SEQ ID NO: 439537 - DNA, 16 bp, M. musculus
tgacaggagatgctgg

SEQ ID NO: 439538 - DNA, 16 bp, M. musculus
tgacaggagcctggca

SEQ ID NO: 439539 - DNA, 16 bp, M. musculus
tgacaggcccaaactg

SEQ ID NO: 439540 - DNA, 21 bp, M. musculus
tgacaggcctagaaacctgga

SEQ ID NO: 439541 - DNA, 16 bp, M. musculus
tgacaggcctcaagaa

SEQ ID NO: 439542 - DNA, 16 bp, M. musculus
tgacaggcctctgtgg

SEQ ID NO: 439543 - DNA, 16 bp, M. musculus
tgacagggaagctaca

SEQ ID NO: 439544 - DNA, 16 bp, M. musculus
tgacaggtgtgagatg

SEQ ID NO: 439545 - DNA, 16 bp, M. musculus
tgacagtaactactaa

SEQ ID NO: 439546 - DNA, 16 bp, M. musculus
tgacagtagagagagg

SEQ ID NO: 439547 - DNA, 16 bp, M. musculus
tgacagtatttttttt

SEQ ID NO: 439548 - DNA, 16 bp, M. musculus
tgacagtggcctttgc

SEQ ID NO: 439549 - DNA, 16 bp, M. musculus
tgacagtgggcatgtg

SEQ ID NO: 439550 - DNA, 16 bp, M. musculus
tgacagtgtccttagc

SEQ ID NO: 439551 - DNA, 16 bp, M. musculus
tgacagtgtcttttga

SEQ ID NO: 439552 - DNA, 16 bp, M. musculus
tgacagtgtgctcata

SEQ ID NO: 439553 - DNA, 16 bp, M. musculus
tgacagttcatgctgg

SEQ ID NO: 439554 - DNA, 16 bp, M. musculus
tgacatactacagctt

SEQ ID NO: 439555 - DNA, 16 bp, M. musculus
tgacatacttcctcca

SEQ ID NO: 439556 - DNA, 16 bp, M. musculus
tgacatagaaacagca

SEQ ID NO: 439557 - DNA, 16 bp, M. musculus
tgacatcactctgcca

SEQ ID NO: 439558 - DNA, 16 bp, M. musculus
tgacatcactctgcta

SEQ ID NO: 439559 - DNA, 16 bp, M. musculus
tgacatcagcatagat

SEQ ID NO: 439560 - DNA, 16 bp, M. musculus
tgacatcctcttctgg

SEQ ID NO: 439561 - DNA, 16 bp, M. musculus
tgacatccttcagaga

SEQ ID NO: 439562 - DNA, 16 bp, M. musculus
tgacatctgcccagaa

SEQ ID NO: 439563 - DNA, 16 bp, M. musculus
tgacatctgtaagtta

SEQ ID NO: 439564 - DNA, 16 bp, M. musculus
tgacatcttcctctgg

SEQ ID NO: 439565 - DNA, 16 bp, M. musculus
tgacatgcactcactg

SEQ ID NO: 439566 - DNA, 16 bp, M. musculus
tgacatgcacttccct

SEQ ID NO: 439567 - DNA, 16 bp, M. musculus
tgacatggaagctgaa

SEQ ID NO: 439568 - DNA, 16 bp, M. musculus
tgacatggttcctgcc

SEQ ID NO: 439569 - DNA, 16 bp, M. musculus
tgacattaaaattgaa

SEQ ID NO: 439570 - DNA, 16 bp, M. musculus
tgacattaggaagaag

SEQ ID NO: 439571 - DNA, 16 bp, M. musculus
tgacattgaaaaaaaa

SEQ ID NO: 439572 - DNA, 16 bp, M. musculus
tgacattgaacttctg

SEQ ID NO: 439573 - DNA, 16 bp, M. musculus
tgacattggctaagga

SEQ ID NO: 439574 - DNA, 16 bp, M. musculus
tgacatttattttatt

SEQ ID NO: 439575 - DNA, 16 bp, M. musculus
tgacatttctagaaga

SEQ ID NO: 439576 - DNA, 16 bp, M. musculus
tgacatttctttcttt

SEQ ID NO: 439577 - DNA, 16 bp, M. musculus
tgacatttgaaatata

SEQ ID NO: 439578 - DNA, 16 bp, M. musculus
tgacatttgaaattct

SEQ ID NO: 439579 - DNA, 16 bp, M. musculus
tgacatttgtttttct

SEQ ID NO: 439580 - DNA, 16 bp, M. musculus
tgacattttcatacac

SEQ ID NO: 439581 - DNA, 16 bp, M. musculus
tgacattttgatctta

SEQ ID NO: 439582 - DNA, 16 bp, M. musculus
tgacattttgtttctt

SEQ ID NO: 439583 - DNA, 16 bp, M. musculus
tgacatttttcatttt

SEQ ID NO: 439584 - DNA, 16 bp, M. musculus
tgacatttttctattt

SEQ ID NO: 439585 - DNA, 16 bp, M. musculus
tgaccaaaagaaagtt

SEQ ID NO: 439586 - DNA, 16 bp, M. musculus
tgaccaaaagcaactt

SEQ ID NO: 439587 - DNA, 16 bp, M. musculus
tgaccaaaagcaattt

SEQ ID NO: 439588 - DNA, 16 bp, M. musculus
tgaccaaaagcagcct

SEQ ID NO: 439589 - DNA, 16 bp, M. musculus
tgaccaaaagcagttt

SEQ ID NO: 439590 - DNA, 16 bp, M. musculus
tgaccaaagcaactta

SEQ ID NO: 439591 - DNA, 16 bp, M. musculus
tgaccaacagcaacca

SEQ ID NO: 439592 - DNA, 16 bp, M. musculus
tgaccaagaagccaaa

SEQ ID NO: 439593 - DNA, 16 bp, M. musculus
tgaccaagatcctggg

SEQ ID NO: 439594 - DNA, 16 bp, M. musculus
tgaccaagccagctca

SEQ ID NO: 439595 - DNA, 16 bp, M. musculus
tgaccaagctcctgtt

SEQ ID NO: 439596 - DNA, 16 bp, M. musculus
tgaccaaggcaaatct

SEQ ID NO: 439597 - DNA, 16 bp, M. musculus
tgaccaaggcaactct

SEQ ID NO: 439598 - DNA, 16 bp, M. musculus
tgaccaaggcaactta

SEQ ID NO: 439599 - DNA, 16 bp, M. musculus
tgaccaaggcagctta

SEQ ID NO: 439600 - DNA, 16 bp, M. musculus
tgaccaagtagttttc

SEQ ID NO: 439601 - DNA, 16 bp, M. musculus
tgaccaatgagctgag

SEQ ID NO: 439602 - DNA, 16 bp, M. musculus
tgaccaattacatggt

SEQ ID NO: 439603 - DNA, 16 bp, M. musculus
tgaccacaaccataaa

SEQ ID NO: 439604 - DNA, 16 bp, M. musculus
tgaccacactctggaa

SEQ ID NO: 439605 - DNA, 16 bp, M. musculus
tgaccacagtgacaca

SEQ ID NO: 439606 - DNA, 16 bp, M. musculus
tgaccaccaagaacag

SEQ ID NO: 439607 - DNA, 16 bp, M. musculus
tgaccacctgtggaca

SEQ ID NO: 439608 - DNA, 16 bp, M. musculus
tgaccactctctccct

SEQ ID NO: 439609 - DNA, 16 bp, M. musculus
tgaccactgggactca

SEQ ID NO: 439610 - DNA, 17 bp, M. musculus
tgaccacttcatgcctt

SEQ ID NO: 439611 - DNA, 16 bp, M. musculus
tgaccagaaagctgtg

SEQ ID NO: 439612 - DNA, 16 bp, M. musculus
tgaccagagtgtgcag

SEQ ID NO: 439613 - DNA, 16 bp, M. musculus
tgaccagcaagcccca

SEQ ID NO: 439614 - DNA, 16 bp, M. musculus
tgaccagctgcctcat

SEQ ID NO: 439615 - DNA, 16 bp, M. musculus
tgaccaggatcacaag

SEQ ID NO: 439616 - DNA, 21 bp, M. musculus
tgaccaggctggcctcgaact

SEQ ID NO: 439617 - DNA, 16 bp, M. musculus
tgaccatataattgat

SEQ ID NO: 439618 - DNA, 16 bp, M. musculus
tgaccatcattgggaa

SEQ ID NO: 439619 - DNA, 16 bp, M. musculus
tgaccatcctggaact

SEQ ID NO: 439620 - DNA, 16 bp, M. musculus
tgaccatcttgccaaa

SEQ ID NO: 439621 - DNA, 16 bp, M. musculus
tgaccatgaacataca

SEQ ID NO: 439622 - DNA, 16 bp, M. musculus
tgaccatgacacccca

SEQ ID NO: 439623 - DNA, 16 bp, M. musculus
tgaccatgaccatgac

SEQ ID NO: 439624 - DNA, 16 bp, M. musculus
tgaccattccttgaac

SEQ ID NO: 439625 - DNA, 33 bp, M. musculus
tgacccaacagtatcaccaactcaaatcaatag

SEQ ID NO: 439626 - DNA, 16 bp, M. musculus
tgacccagctggagtt

SEQ ID NO: 439627 - DNA, 16 bp, M. musculus
tgacccaggaactcag

SEQ ID NO: 439628 - DNA, 16 bp, M. musculus
tgacccaggctggagt

SEQ ID NO: 439629 - DNA, 16 bp, M. musculus
tgaccccaaccataaa

SEQ ID NO: 439630 - DNA, 16 bp, M. musculus
tgaccccagccccttg

SEQ ID NO: 439631 - DNA, 16 bp, M. musculus
tgaccccaggcaggag

SEQ ID NO: 439632 - DNA, 16 bp, M. musculus
tgaccccatccctcaa

SEQ ID NO: 439633 - DNA, 16 bp, M. musculus
tgacccccacacacac

SEQ ID NO: 439634 - DNA, 16 bp, M. musculus
tgacccccatgaaagg

SEQ ID NO: 439635 - DNA, 16 bp, M. musculus
tgaccccccccccaaa

SEQ ID NO: 439636 - DNA, 16 bp, M. musculus
tgacccctctccctgc

SEQ ID NO: 439637 - DNA, 17 bp, M. musculus
tgacccgctggctgctc

SEQ ID NO: 439638 - DNA, 16 bp, M. musculus
tgaccctgacattccc

SEQ ID NO: 439639 - DNA, 16 bp, M. musculus
tgaccctggctggcct

SEQ ID NO: 439640 - DNA, 16 bp, M. musculus
tgaccctggcttgtgt

SEQ ID NO: 439641 - DNA, 16 bp, M. musculus
tgaccctgggcttttt

SEQ ID NO: 439642 - DNA, 16 bp, M. musculus
tgaccctgttggtctt

SEQ ID NO: 439643 - DNA, 16 bp, M. musculus
tgaccctttcacaggg

SEQ ID NO: 439644 - DNA, 16 bp, M. musculus
tgaccctttgatggga

SEQ ID NO: 439645 - DNA, 17 bp, M. musculus
tgaccgtgaccgtgacc

SEQ ID NO: 439646 - DNA, 16 bp, M. musculus
tgacctagcagagaca

SEQ ID NO: 439647 - DNA, 16 bp, M. musculus
tgacctcaaactcaaa

SEQ ID NO: 439648 - DNA, 16 bp, M. musculus
tgacctcaaactcact

SEQ ID NO: 439649 - DNA, 16 bp, M. musculus
tgacctcaaactcaga

SEQ ID NO: 439650 - DNA, 21 bp, M. musculus
tgacctcaactacatggtcta

SEQ ID NO: 439651 - DNA, 16 bp, M. musculus
tgacctcagagatcca

SEQ ID NO: 439652 - DNA, 16 bp, M. musculus
tgacctcagcaactct

SEQ ID NO: 439653 - DNA, 16 bp, M. musculus
tgacctcaggtggcag

SEQ ID NO: 439654 - DNA, 16 bp, M. musculus
tgacctcagtacaagg

SEQ ID NO: 439655 - DNA, 16 bp, M. musculus
tgacctccaactcaga

SEQ ID NO: 439656 - DNA, 16 bp, M. musculus
tgacctccacacacac

SEQ ID NO: 439657 - DNA, 16 bp, M. musculus
tgacctccacaggctc

SEQ ID NO: 439658 - DNA, 16 bp, M. musculus
tgacctccacattcac

SEQ ID NO: 439659 - DNA, 16 bp, M. musculus
tgacctccaggcaact

SEQ ID NO: 439660 - DNA, 16 bp, M. musculus
tgacctcctctctgtc

SEQ ID NO: 439661 - DNA, 16 bp, M. musculus
tgacctcctgcctcag

SEQ ID NO: 439662 - DNA, 16 bp, M. musculus
tgacctctcacagtgc

SEQ ID NO: 439663 - DNA, 16 bp, M. musculus
tgacctctctgtgcct

SEQ ID NO: 439664 - DNA, 16 bp, M. musculus
tgacctctgaaagagc

SEQ ID NO: 439665 - DNA, 16 bp, M. musculus
tgacctctgaccccca

SEQ ID NO: 439666 - DNA, 16 bp, M. musculus
tgacctctgacccctg

SEQ ID NO: 439667 - DNA, 16 bp, M. musculus
tgacctctgacctcca

SEQ ID NO: 439668 - DNA, 16 bp, M. musculus
tgacctctgacctctg

SEQ ID NO: 439669 - DNA, 16 bp, M. musculus
tgacctctgacctgca

SEQ ID NO: 439670 - DNA, 16 bp, M. musculus
tgacctctgcacatgc

SEQ ID NO: 439671 - DNA, 16 bp, M. musculus
tgacctctgtgactca

SEQ ID NO: 439672 - DNA, 16 bp, M. musculus
tgacctgcagccctcc

SEQ ID NO: 439673 - DNA, 16 bp, M. musculus
tgacctgcccattggt

SEQ ID NO: 439674 - DNA, 16 bp, M. musculus
tgacctggaactctct

SEQ ID NO: 439675 - DNA, 16 bp, M. musculus
tgacctggagaaactg

SEQ ID NO: 439676 - DNA, 16 bp, M. musculus
tgacctgtttctggca

SEQ ID NO: 439677 - DNA, 16 bp, M. musculus
tgaccttaaactcaca

SEQ ID NO: 439678 - DNA, 16 bp, M. musculus
tgaccttagcagaaat

SEQ ID NO: 439679 - DNA, 16 bp, M. musculus
tgaccttagccaaaat

SEQ ID NO: 439680 - DNA, 16 bp, M. musculus
tgaccttgaaatcaga

SEQ ID NO: 439681 - DNA, 16 bp, M. musculus
tgaccttgaacttatg

SEQ ID NO: 439682 - DNA, 16 bp, M. musculus
tgaccttgaacttatt

SEQ ID NO: 439683 - DNA, 16 bp, M. musculus
tgaccttgaacttctg

SEQ ID NO: 439684 - DNA, 16 bp, M. musculus
tgaccttgaatttaca

SEQ ID NO: 439685 - DNA, 16 bp, M. musculus
tgaccttgaatttctg

SEQ ID NO: 439686 - DNA, 16 bp, M. musculus
tgaccttgaccttgaa

SEQ ID NO: 439687 - DNA, 16 bp, M. musculus
tgaccttgtctcaaaa

SEQ ID NO: 439688 - DNA, 16 bp, M. musculus
tgacctttaatttgat

SEQ ID NO: 439689 - DNA, 16 bp, M. musculus
tgacctttctctacac

SEQ ID NO: 439690 - DNA, 16 bp, M. musculus
tgacctttctctctta

SEQ ID NO: 439691 - DNA, 16 bp, M. musculus
tgacctttctgcctct

SEQ ID NO: 439692 - DNA, 16 bp, M. musculus
tgacctttgacctcca

SEQ ID NO: 439693 - DNA, 16 bp, M. musculus
tgacctttgacctttg

SEQ ID NO: 439694 - DNA, 16 bp, M. musculus
tgacctttgtccctta

SEQ ID NO: 439695 - DNA, 16 bp, M. musculus
tgacctttttccatta

SEQ ID NO: 439696 - DNA, 16 bp, M. musculus
tgacggtgtggaatac

SEQ ID NO: 439697 - DNA, 16 bp, M. musculus
tgactaagacagacat

SEQ ID NO: 439698 - DNA, 16 bp, M. musculus
tgactaagacagaccc

SEQ ID NO: 439699 - DNA, 16 bp, M. musculus
tgactaagacagcaag

SEQ ID NO: 439700 - DNA, 16 bp, M. musculus
tgactaagtccagatg

SEQ ID NO: 439701 - DNA, 16 bp, M. musculus
tgactaatattacctg

SEQ ID NO: 439702 - DNA, 17 bp, M. musculus
tgactacattgacagct

SEQ ID NO: 439703 - DNA, 16 bp, M. musculus
tgactacattgcctgc

SEQ ID NO: 439704 - DNA, 16 bp, M. musculus
tgactacctttggcct

SEQ ID NO: 439705 - DNA, 16 bp, M. musculus
tgactactcttccaga

SEQ ID NO: 439706 - DNA, 30 bp, M. musculus
tgactacttctctagcatgccaagccacac

SEQ ID NO: 439707 - DNA, 17 bp, M. musculus
tgactaggccatcctct

SEQ ID NO: 439708 - DNA, 16 bp, M. musculus
tgactatatctgggat

SEQ ID NO: 439709 - DNA, 16 bp, M. musculus
tgactatcagaaagga

SEQ ID NO: 439710 - DNA, 16 bp, M. musculus
tgactatcctggaatt

SEQ ID NO: 439711 - DNA, 16 bp, M. musculus
tgactattctggaact

SEQ ID NO: 439712 - DNA, 16 bp, M. musculus
tgactattcttccaga

SEQ ID NO: 439713 - DNA, 16 bp, M. musculus
tgactcaaagatagct

SEQ ID NO: 439714 - DNA, 16 bp, M. musculus
tgactcacaaccatca

SEQ ID NO: 439715 - DNA, 16 bp, M. musculus
tgactcacctggggat

SEQ ID NO: 439716 - DNA, 16 bp, M. musculus
tgactcactcttctgg

SEQ ID NO: 439717 - DNA, 16 bp, M. musculus
tgactcactgggtaaa

SEQ ID NO: 439718 - DNA, 16 bp, M. musculus
tgactcagaaaacaaa

SEQ ID NO: 439719 - DNA, 16 bp, M. musculus
tgactcagtggataaa

SEQ ID NO: 439720 - DNA, 16 bp, M. musculus
tgactcagtggtagaa

SEQ ID NO: 439721 - DNA, 17 bp, M. musculus
tgactccatgagatcca

SEQ ID NO: 439722 - DNA, 16 bp, M. musculus
tgactcccaaaggggt

SEQ ID NO: 439723 - DNA, 16 bp, M. musculus
tgactccctcttatgg

SEQ ID NO: 439724 - DNA, 16 bp, M. musculus
tgactcctacaatctt

SEQ ID NO: 439725 - DNA, 16 bp, M. musculus
tgactcctgacttctt

SEQ ID NO: 439726 - DNA, 16 bp, M. musculus
tgactcctgagagctg

SEQ ID NO: 439727 - DNA, 17 bp, M. musculus
tgactcctgtgcaccct

SEQ ID NO: 439728 - DNA, 16 bp, M. musculus
tgactctaggttgtgt

SEQ ID NO: 439729 - DNA, 16 bp, M. musculus
tgactctgggctgtgt

SEQ ID NO: 439730 - DNA, 16 bp, M. musculus
tgactctgtaggtttt

SEQ ID NO: 439731 - DNA, 16 bp, M. musculus
tgactctgtcctttgc

SEQ ID NO: 439732 - DNA, 16 bp, M. musculus
tgactcttccagctgc

SEQ ID NO: 439733 - DNA, 16 bp, M. musculus
tgactgaaacagacac

SEQ ID NO: 439734 - DNA, 16 bp, M. musculus
tgactgaacccaaacc

SEQ ID NO: 439735 - DNA, 16 bp, M. musculus
tgactgaagaagagaa

SEQ ID NO: 439736 - DNA, 16 bp, M. musculus
tgactgacaaggccat

SEQ ID NO: 439737 - DNA, 16 bp, M. musculus
tgactgacctggaact

SEQ ID NO: 439738 - DNA, 16 bp, M. musculus
tgactgagaaaaacaa

SEQ ID NO: 439739 - DNA, 16 bp, M. musculus
tgactgagacagatgc

SEQ ID NO: 439740 - DNA, 16 bp, M. musculus
tgactgaggaagatac

SEQ ID NO: 439741 - DNA, 16 bp, M. musculus
tgactgaggctatgga

SEQ ID NO: 439742 - DNA, 16 bp, M. musculus
tgactgattgactgat

SEQ ID NO: 439743 - DNA, 16 bp, M. musculus
tgactgcaacacactt

SEQ ID NO: 439744 - DNA, 16 bp, M. musculus
tgactgcagatgcaat

SEQ ID NO: 439745 - DNA, 16 bp, M. musculus
tgactgcagtgggcct

SEQ ID NO: 439746 - DNA, 16 bp, M. musculus
tgactgccaagaattc

SEQ ID NO: 439747 - DNA, 16 bp, M. musculus
tgactgccctcctaaa

SEQ ID NO: 439748 - DNA, 16 bp, M. musculus
tgactgccctgcccac

SEQ ID NO: 439749 - DNA, 16 bp, M. musculus
tgactgccttatgaaa

SEQ ID NO: 439750 - DNA, 16 bp, M. musculus
tgactgctcttccagg

SEQ ID NO: 439751 - DNA, 16 bp, M. musculus
tgactgcttctatttc

SEQ ID NO: 439752 - DNA, 16 bp, M. musculus
tgactgcttttcagtt

SEQ ID NO: 439753 - DNA, 16 bp, M. musculus
tgactggagcctgata

SEQ ID NO: 439754 - DNA, 16 bp, M. musculus
tgactggatctggctg

SEQ ID NO: 439755 - DNA, 16 bp, M. musculus
tgactggccaggaaga

SEQ ID NO: 439756 - DNA, 16 bp, M. musculus
tgactggccttcctta

SEQ ID NO: 439757 - DNA, 16 bp, M. musculus
tgactgggctacctca

SEQ ID NO: 439758 - DNA, 16 bp, M. musculus
tgactggtgtgacatg

SEQ ID NO: 439759 - DNA, 16 bp, M. musculus
tgactgtaacacactt

SEQ ID NO: 439760 - DNA, 16 bp, M. musculus
tgactgtaaccaatgt

SEQ ID NO: 439761 - DNA, 16 bp, M. musculus
tgactgtactggaact

SEQ ID NO: 439762 - DNA, 16 bp, M. musculus
tgactgtatgtatgta

SEQ ID NO: 439763 - DNA, 16 bp, M. musculus
tgactgtcctgaaact

SEQ ID NO: 439764 - DNA, 16 bp, M. musculus
tgactgtcctggaact

SEQ ID NO: 439765 - DNA, 16 bp, M. musculus
tgactgtctgtctgtc

SEQ ID NO: 439766 - DNA, 16 bp, M. musculus
tgactgtcttagaact

SEQ ID NO: 439767 - DNA, 20 bp, M. musculus
tgactgtgagcatccactta

SEQ ID NO: 439768 - DNA, 23 bp, M. musculus
tgactgtgagcatccacttctgt

SEQ ID NO: 439769 - DNA, 16 bp, M. musculus
tgactgtgagtgtgtg

SEQ ID NO: 439770 - DNA, 16 bp, M. musculus
tgactgtgccctggtt

SEQ ID NO: 439771 - DNA, 16 bp, M. musculus
tgactgtggatctctg

SEQ ID NO: 439772 - DNA, 16 bp, M. musculus
tgactgtggctgccct

SEQ ID NO: 439773 - DNA, 16 bp, M. musculus
tgactgtgtcctttgc

SEQ ID NO: 439774 - DNA, 16 bp, M. musculus
tgactgtgtctgtgtc

SEQ ID NO: 439775 - DNA, 16 bp, M. musculus
tgactgtgtgagtgtg

SEQ ID NO: 439776 - DNA, 16 bp, M. musculus
tgactgtgtgtctgag

SEQ ID NO: 439777 - DNA, 16 bp, M. musculus
tgactgtgtgtgagtg

SEQ ID NO: 439778 - DNA, 16 bp, M. musculus
tgactgtgtgtgtgtg

SEQ ID NO: 439779 - DNA, 16 bp, M. musculus
tgactgttccacatca

SEQ ID NO: 439780 - DNA, 16 bp, M. musculus
tgacttaaaaaagaaa

SEQ ID NO: 439781 - DNA, 16 bp, M. musculus
tgacttaaaaatgtca

SEQ ID NO: 439782 - DNA, 16 bp, M. musculus
tgacttagcttttatt

SEQ ID NO: 439783 - DNA, 16 bp, M. musculus
tgacttcaaaaggaac

SEQ ID NO: 439784 - DNA, 16 bp, M. musculus
tgacttcaaaattatc

SEQ ID NO: 439785 - DNA, 16 bp, M. musculus
tgacttcaagatgtac

SEQ ID NO: 439786 - DNA, 16 bp, M. musculus
tgacttcacaggcaga

SEQ ID NO: 439787 - DNA, 16 bp, M. musculus
tgacttcagttcccag

SEQ ID NO: 439788 - DNA, 16 bp, M. musculus
tgacttcatggaattc

SEQ ID NO: 439789 - DNA, 16 bp, M. musculus
tgacttccaagttaaa

SEQ ID NO: 439790 - DNA, 16 bp, M. musculus
tgacttccagagtagt

SEQ ID NO: 439791 - DNA, 16 bp, M. musculus
tgacttccaggcagca

SEQ ID NO: 439792 - DNA, 16 bp, M. musculus
tgacttccaggccagc

SEQ ID NO: 439793 - DNA, 16 bp, M. musculus
tgacttccagtttagt

SEQ ID NO: 439794 - DNA, 16 bp, M. musculus
tgacttccccacagtg

SEQ ID NO: 439795 - DNA, 16 bp, M. musculus
tgacttccctgctatg

SEQ ID NO: 439796 - DNA, 16 bp, M. musculus
tgacttcctcaggcac

SEQ ID NO: 439797 - DNA, 16 bp, M. musculus
tgacttcctcctttcc

SEQ ID NO: 439798 - DNA, 16 bp, M. musculus
tgacttcctgtcctga

SEQ ID NO: 439799 - DNA, 16 bp, M. musculus
tgacttccttcagtgg

SEQ ID NO: 439800 - DNA, 16 bp, M. musculus
tgacttccttctgtga

SEQ ID NO: 439801 - DNA, 16 bp, M. musculus
tgacttctaagattaa

SEQ ID NO: 439802 - DNA, 16 bp, M. musculus
tgacttctctcaatga

SEQ ID NO: 439803 - DNA, 16 bp, M. musculus
tgacttctctcagtga

SEQ ID NO: 439804 - DNA, 16 bp, M. musculus
tgacttctggcctcca

SEQ ID NO: 439805 - DNA, 16 bp, M. musculus
tgacttctggtctcca

SEQ ID NO: 439806 - DNA, 16 bp, M. musculus
tgacttcttaattctt

SEQ ID NO: 439807 - DNA, 16 bp, M. musculus
tgacttcttcatgttc

SEQ ID NO: 439808 - DNA, 16 bp, M. musculus
tgacttcttccattcc

SEQ ID NO: 439809 - DNA, 18 bp, M. musculus
tgacttcttttgtgattg

SEQ ID NO: 439810 - DNA, 16 bp, M. musculus
tgacttgagtttcatt

SEQ ID NO: 439811 - DNA, 16 bp, M. musculus
tgacttggaggccagc

SEQ ID NO: 439812 - DNA, 16 bp, M. musculus
tgacttgtgccaaggc

SEQ ID NO: 439813 - DNA, 16 bp, M. musculus
tgactttagagtcaag

SEQ ID NO: 439814 - DNA, 16 bp, M. musculus
tgactttctctgcctc

SEQ ID NO: 439815 - DNA, 17 bp, M. musculus
tgactttctttgaatga

SEQ ID NO: 439816 - DNA, 16 bp, M. musculus
tgactttctttgatga

SEQ ID NO: 439817 - DNA, 16 bp, M. musculus
tgactttgaggccaac

SEQ ID NO: 439818 - DNA, 16 bp, M. musculus
tgactttgtgaggatg

SEQ ID NO: 439819 - DNA, 16 bp, M. musculus
tgactttgttggagga

SEQ ID NO: 439820 - DNA, 16 bp, M. musculus
tgactttgttggtctt

SEQ ID NO: 439821 - DNA, 16 bp, M. musculus
tgacttttaaaaaaat

SEQ ID NO: 439822 - DNA, 16 bp, M. musculus
tgacttttaaactgat

SEQ ID NO: 439823 - DNA, 16 bp, M. musculus
tgacttttcttccttt

SEQ ID NO: 439824 - DNA, 16 bp, M. musculus
tgacttttggttggaa

SEQ ID NO: 439825 - DNA, 16 bp, M. musculus
tgacttttgtgaaggg

SEQ ID NO: 439826 - DNA, 16 bp, M. musculus
tgacttttgtttttaa

SEQ ID NO: 439827 - DNA, 16 bp, M. musculus
tgactttttaaaaaga

SEQ ID NO: 439828 - DNA, 16 bp, M. musculus
tgactttttaaatatt

SEQ ID NO: 439829 - DNA, 16 bp, M. musculus
tgactttttgtcttat

SEQ ID NO: 439830 - DNA, 16 bp, M. musculus
tgagaaaaaaatctca

SEQ ID NO: 439831 - DNA, 16 bp, M. musculus
tgagaaaactgaggcc

SEQ ID NO: 439832 - DNA, 16 bp, M. musculus
tgagaaaagagaaaca

SEQ ID NO: 439833 - DNA, 16 bp, M. musculus
tgagaaaagattgtaa

SEQ ID NO: 439834 - DNA, 16 bp, M. musculus
tgagaaaatagcagaa

SEQ ID NO: 439835 - DNA, 16 bp, M. musculus
tgagaaaatcaacagg

SEQ ID NO: 439836 - DNA, 16 bp, M. musculus
tgagaaaatcaagaag

SEQ ID NO: 439837 - DNA, 16 bp, M. musculus
tgagaaaatgaacaag

SEQ ID NO: 439838 - DNA, 16 bp, M. musculus
tgagaaaatgactcca

SEQ ID NO: 439839 - DNA, 16 bp, M. musculus
tgagaaaatgcttccc

SEQ ID NO: 439840 - DNA, 16 bp, M. musculus
tgagaaacaacttcag

SEQ ID NO: 439841 - DNA, 16 bp, M. musculus
tgagaaacactgttct

SEQ ID NO: 439842 - DNA, 16 bp, M. musculus
tgagaaaccctgcctc

SEQ ID NO: 439843 - DNA, 16 bp, M. musculus
tgagaaaccctgtctc

SEQ ID NO: 439844 - DNA, 16 bp, M. musculus
tgagaaacctccagac

SEQ ID NO: 439845 - DNA, 16 bp, M. musculus
tgagaaactgagagaa

SEQ ID NO: 439846 - DNA, 16 bp, M. musculus
tgagaaactgaggcag

SEQ ID NO: 439847 - DNA, 16 bp, M. musculus
tgagaaacttgaggcc

SEQ ID NO: 439848 - DNA, 16 bp, M. musculus
tgagaaagaaacagag

SEQ ID NO: 439849 - DNA, 16 bp, M. musculus
tgagaaagagtcagaa

SEQ ID NO: 439850 - DNA, 16 bp, M. musculus
tgagaaagagtgtgtg

SEQ ID NO: 439851 - DNA, 16 bp, M. musculus
tgagaaagatgcagat

SEQ ID NO: 439852 - DNA, 16 bp, M. musculus
tgagaaagcaagcctt

SEQ ID NO: 439853 - DNA, 16 bp, M. musculus
tgagaaaggagctaaa

SEQ ID NO: 439854 - DNA, 16 bp, M. musculus
tgagaaagggtctctc

SEQ ID NO: 439855 - DNA, 16 bp, M. musculus
tgagaaaggtgttgtt

SEQ ID NO: 439856 - DNA, 16 bp, M. musculus
tgagaaaggttttttt

SEQ ID NO: 439857 - DNA, 16 bp, M. musculus
tgagaaagtgtgtgtg

SEQ ID NO: 439858 - DNA, 16 bp, M. musculus
tgagaaataaatttct

SEQ ID NO: 439859 - DNA, 16 bp, M. musculus
tgagaaatacagaggt

SEQ ID NO: 439860 - DNA, 16 bp, M. musculus
tgagaaataccgaatg

SEQ ID NO: 439861 - DNA, 16 bp, M. musculus
tgagaaatattttgaa

SEQ ID NO: 439862 - DNA, 16 bp, M. musculus
tgagaaattacactca

SEQ ID NO: 439863 - DNA, 16 bp, M. musculus
tgagaaattattttaa

SEQ ID NO: 439864 - DNA, 16 bp, M. musculus
tgagaaatttttgttt

SEQ ID NO: 439865 - DNA, 16 bp, M. musculus
tgagaacacacagcat

SEQ ID NO: 439866 - DNA, 16 bp, M. musculus
tgagaacagaacccag

SEQ ID NO: 439867 - DNA, 16 bp, M. musculus
tgagaacaggcagcag

SEQ ID NO: 439868 - DNA, 17 bp, M. musculus
tgagaacatattgtgtg

SEQ ID NO: 439869 - DNA, 16 bp, M. musculus
tgagaaccactaatct

SEQ ID NO: 439870 - DNA, 16 bp, M. musculus
tgagaaccactgagct

SEQ ID NO: 439871 - DNA, 16 bp, M. musculus
tgagaaccactgcctt

SEQ ID NO: 439872 - DNA, 16 bp, M. musculus
tgagaaccactgctct

SEQ ID NO: 439873 - DNA, 16 bp, M. musculus
tgagaaccactgctgt

SEQ ID NO: 439874 - DNA, 16 bp, M. musculus
tgagaaccactggtct

SEQ ID NO: 439875 - DNA, 16 bp, M. musculus
tgagaaccatcccatg

SEQ ID NO: 439876 - DNA, 16 bp, M. musculus
tgagaacctatctcaa

SEQ ID NO: 439877 - DNA, 16 bp, M. musculus
tgagaacctgatgaat

SEQ ID NO: 439878 - DNA, 16 bp, M. musculus
tgagaactctctgctt

SEQ ID NO: 439879 - DNA, 16 bp, M. musculus
tgagaactgaaccctg

SEQ ID NO: 439880 - DNA, 16 bp, M. musculus
tgagaactgagaactg

SEQ ID NO: 439881 - DNA, 16 bp, M. musculus
tgagaactgagcccag

SEQ ID NO: 439882 - DNA, 16 bp, M. musculus
tgagaactgtgcaggt

SEQ ID NO: 439883 - DNA, 16 bp, M. musculus
tgagaagaaagtatat

SEQ ID NO: 439884 - DNA, 16 bp, M. musculus
tgagaagaactggaat

SEQ ID NO: 439885 - DNA, 16 bp, M. musculus
tgagaagaagatatat

SEQ ID NO: 439886 - DNA, 17 bp, M. musculus
tgagaagaaggcatttg

SEQ ID NO: 439887 - DNA, 16 bp, M. musculus
tgagaagaaggctgcc

SEQ ID NO: 439888 - DNA, 16 bp, M. musculus
tgagaagatttttttt

SEQ ID NO: 439889 - DNA, 16 bp, M. musculus
tgagaagcacctggaa

SEQ ID NO: 439890 - DNA, 16 bp, M. musculus
tgagaagcagaaacag

SEQ ID NO: 439891 - DNA, 16 bp, M. musculus
tgagaagcagaggcag

SEQ ID NO: 439892 - DNA, 16 bp, M. musculus
tgagaagccaggagag

SEQ ID NO: 439893 - DNA, 16 bp, M. musculus
tgagaagcctacagaa

SEQ ID NO: 439894 - DNA, 16 bp, M. musculus
tgagaagctgaagcag

SEQ ID NO: 439895 - DNA, 16 bp, M. musculus
tgagaaggaatctcag

SEQ ID NO: 439896 - DNA, 16 bp, M. musculus
tgagaaggagaaactg

SEQ ID NO: 439897 - DNA, 16 bp, M. musculus
tgagaaggagccagag

SEQ ID NO: 439898 - DNA, 16 bp, M. musculus
tgagaaggccagaaga

SEQ ID NO: 439899 - DNA, 16 bp, M. musculus
tgagaagggtgtgtct

SEQ ID NO: 439900 - DNA, 16 bp, M. musculus
tgagaagtacctgctg

SEQ ID NO: 439901 - DNA, 16 bp, M. musculus
tgagaagtacttcctc

SEQ ID NO: 439902 - DNA, 16 bp, M. musculus
tgagaagtcaggtgta

SEQ ID NO: 439903 - DNA, 16 bp, M. musculus
tgagaatagacaaatg

SEQ ID NO: 439904 - DNA, 16 bp, M. musculus
tgagaatagttttcat

SEQ ID NO: 439905 - DNA, 16 bp, M. musculus
tgagaatattttttaa

SEQ ID NO: 439906 - DNA, 16 bp, M. musculus
tgagaatcaaacctgg

SEQ ID NO: 439907 - DNA, 16 bp, M. musculus
tgagaatcactgccct

SEQ ID NO: 439908 - DNA, 16 bp, M. musculus
tgagaatcactggtct

SEQ ID NO: 439909 - DNA, 16 bp, M. musculus
tgagaatgaagagttt

SEQ ID NO: 439910 - DNA, 16 bp, M. musculus
tgagaatgaagattat

SEQ ID NO: 439911 - DNA, 16 bp, M. musculus
tgagaatgaagatttc

SEQ ID NO: 439912 - DNA, 16 bp, M. musculus
tgagaatgcatgcaag

SEQ ID NO: 439913 - DNA, 16 bp, M. musculus
tgagaatgcatttgac

SEQ ID NO: 439914 - DNA, 16 bp, M. musculus
tgagaatgtagctcag

SEQ ID NO: 439915 - DNA, 16 bp, M. musculus
tgagaatgttctagaa

SEQ ID NO: 439916 - DNA, 16 bp, M. musculus
tgagaattctttgatt

SEQ ID NO: 439917 - DNA, 17 bp, M. musculus
tgagaattctttgttta

SEQ ID NO: 439918 - DNA, 16 bp, M. musculus
tgagaattgctctgtc

SEQ ID NO: 439919 - DNA, 16 bp, M. musculus
tgagaattgtttgttt

SEQ ID NO: 439920 - DNA, 16 bp, M. musculus
tgagaatttattgata

SEQ ID NO: 439921 - DNA, 16 bp, M. musculus
tgagaattttattcag

SEQ ID NO: 439922 - DNA, 16 bp, M. musculus
tgagaattttatttag

SEQ ID NO: 439923 - DNA, 16 bp, M. musculus
tgagaattttgtacaa

SEQ ID NO: 439924 - DNA, 16 bp, M. musculus
tgagacaaagtctcac

SEQ ID NO: 439925 - DNA, 16 bp, M. musculus
tgagacaaggtctcac

SEQ ID NO: 439926 - DNA, 16 bp, M. musculus
tgagacaaggtcttgc

SEQ ID NO: 439927 - DNA, 16 bp, M. musculus
tgagacaaggtttcat

SEQ ID NO: 439928 - DNA, 16 bp, M. musculus
tgagacacagacactg

SEQ ID NO: 439929 - DNA, 16 bp, M. musculus
tgagacacctctccag

SEQ ID NO: 439930 - DNA, 16 bp, M. musculus
tgagacactgtctcag

SEQ ID NO: 439931 - DNA, 16 bp, M. musculus
tgagacagaaacttct

SEQ ID NO: 439932 - DNA, 16 bp, M. musculus
tgagacagaatctcat

SEQ ID NO: 439933 - DNA, 16 bp, M. musculus
tgagacagaatttctt

SEQ ID NO: 439934 - DNA, 16 bp, M. musculus
tgagacagacagacag

SEQ ID NO: 439935 - DNA, 16 bp, M. musculus
tgagacagagtctctg

SEQ ID NO: 439936 - DNA, 16 bp, M. musculus
tgagacagatgtagat

SEQ ID NO: 439937 - DNA, 16 bp, M. musculus
tgagacagctttccag

SEQ ID NO: 439938 - DNA, 16 bp, M. musculus
tgagacaggatcttat

SEQ ID NO: 439939 - DNA, 16 bp, M. musculus
tgagacaggatgtcac

SEQ ID NO: 439940 - DNA, 16 bp, M. musculus
tgagacagggcctcat

SEQ ID NO: 439941 - DNA, 16 bp, M. musculus
tgagacagggtatcac

SEQ ID NO: 439942 - DNA, 16 bp, M. musculus
tgagacagggtcacat

SEQ ID NO: 439943 - DNA, 16 bp, M. musculus
tgagacagggtcccac

SEQ ID NO: 439944 - DNA, 16 bp, M. musculus
tgagacagggtctctc

SEQ ID NO: 439945 - DNA, 16 bp, M. musculus
tgagacagggtctctt

SEQ ID NO: 439946 - DNA, 16 bp, M. musculus
tgagacagggtcttag

SEQ ID NO: 439947 - DNA, 16 bp, M. musculus
tgagacagggtcttgt

SEQ ID NO: 439948 - DNA, 16 bp, M. musculus
tgagacagggtctttc

SEQ ID NO: 439949 - DNA, 16 bp, M. musculus
tgagacagggtctttt

SEQ ID NO: 439950 - DNA, 16 bp, M. musculus
tgagacagggtttcat

SEQ ID NO: 439951 - DNA, 16 bp, M. musculus
tgagacagggtttcta

SEQ ID NO: 439952 - DNA, 17 bp, M. musculus
tgagacagggtttctct

SEQ ID NO: 439953 - DNA, 16 bp, M. musculus
tgagacagtctctcat

SEQ ID NO: 439954 - DNA, 16 bp, M. musculus
tgagacagtgtctctt

SEQ ID NO: 439955 - DNA, 16 bp, M. musculus
tgagacatggtctcac

SEQ ID NO: 439956 - DNA, 16 bp, M. musculus
tgagaccagcctgggt

SEQ ID NO: 439957 - DNA, 16 bp, M. musculus
tgagaccagtctgggc

SEQ ID NO: 439958 - DNA, 16 bp, M. musculus
tgagacccacatggtg

SEQ ID NO: 439959 - DNA, 16 bp, M. musculus
tgagacccatcccttg

SEQ ID NO: 439960 - DNA, 16 bp, M. musculus
tgagaccctctctcaa

SEQ ID NO: 439961 - DNA, 16 bp, M. musculus
tgagaccctgactcaa

SEQ ID NO: 439962 - DNA, 16 bp, M. musculus
tgagaccctgaggaca

SEQ ID NO: 439963 - DNA, 16 bp, M. musculus
tgagaccctgtccaaa

SEQ ID NO: 439964 - DNA, 16 bp, M. musculus
tgagaccctgtcccca

SEQ ID NO: 439965 - DNA, 16 bp, M. musculus
tgagaccctgtcttag

SEQ ID NO: 439966 - DNA, 16 bp, M. musculus
tgagaccctttctcag

SEQ ID NO: 439967 - DNA, 16 bp, M. musculus
tgagacctcaaagcct

SEQ ID NO: 439968 - DNA, 16 bp, M. musculus
tgagacctcagagccc

SEQ ID NO: 439969 - DNA, 17 bp, M. musculus
tgagacctctctgtact

SEQ ID NO: 439970 - DNA, 16 bp, M. musculus
tgagaccttcaggaca

SEQ ID NO: 439971 - DNA, 16 bp, M. musculus
tgagaccttgtccaaa

SEQ ID NO: 439972 - DNA, 16 bp, M. musculus
tgagactagcctcatg

SEQ ID NO: 439973 - DNA, 16 bp, M. musculus
tgagactataagtagt

SEQ ID NO: 439974 - DNA, 16 bp, M. musculus
tgagactcaggaaaga

SEQ ID NO: 439975 - DNA, 17 bp, M. musculus
tgagactctgccctcag

SEQ ID NO: 439976 - DNA, 16 bp, M. musculus
tgagactgaaggcaaa

SEQ ID NO: 439977 - DNA, 16 bp, M. musculus
tgagactgctggtcct

SEQ ID NO: 439978 - DNA, 16 bp, M. musculus
tgagactgctttttta

SEQ ID NO: 439979 - DNA, 16 bp, M. musculus
tgagactgggggattg

SEQ ID NO: 439980 - DNA, 16 bp, M. musculus
tgagactgggtctctc

SEQ ID NO: 439981 - DNA, 16 bp, M. musculus
tgagactttgtttcaa

SEQ ID NO: 439982 - DNA, 16 bp, M. musculus
tgagagaaaatatttt

SEQ ID NO: 439983 - DNA, 16 bp, M. musculus
tgagagaaagaaatgt

SEQ ID NO: 439984 - DNA, 16 bp, M. musculus
tgagagaagccaattt

SEQ ID NO: 439985 - DNA, 16 bp, M. musculus
tgagagaagctgagga

SEQ ID NO: 439986 - DNA, 16 bp, M. musculus
tgagagaagtcagagc

SEQ ID NO: 439987 - DNA, 16 bp, M. musculus
tgagagacaaaggcag

SEQ ID NO: 439988 - DNA, 16 bp, M. musculus
tgagagacactgcctc

SEQ ID NO: 439989 - DNA, 16 bp, M. musculus
tgagagacactgtctc

SEQ ID NO: 439990 - DNA, 16 bp, M. musculus
tgagagaccaaactgt

SEQ ID NO: 439991 - DNA, 16 bp, M. musculus
tgagagaccctgactc

SEQ ID NO: 439992 - DNA, 16 bp, M. musculus
tgagagaccctgtctc

SEQ ID NO: 439993 - DNA, 16 bp, M. musculus
tgagagactctcagaa

SEQ ID NO: 439994 - DNA, 16 bp, M. musculus
tgagagactgccccag

SEQ ID NO: 439995 - DNA, 16 bp, M. musculus
tgagagagaaaaagtt

SEQ ID NO: 439996 - DNA, 16 bp, M. musculus
tgagagagaaacagag

SEQ ID NO: 439997 - DNA, 16 bp, M. musculus
tgagagagagagagcg

SEQ ID NO: 439998 - DNA, 16 bp, M. musculus
tgagagagagagagtg

SEQ ID NO: 439999 - DNA, 16 bp, M. musculus
tgagagagagagcgag

SEQ ID NO: 440000 - DNA, 16 bp, M. musculus
tgagagagagtgagag

SEQ ID NO: 440001 - DNA, 16 bp, M. musculus
tgagagagagtgtgta

SEQ ID NO: 440002 - DNA, 16 bp, M. musculus
tgagagagcctgtctt

SEQ ID NO: 440003 - DNA, 16 bp, M. musculus
tgagagaggatggaga

SEQ ID NO: 440004 - DNA, 16 bp, M. musculus
tgagagatattaaaga

SEQ ID NO: 440005 - DNA, 16 bp, M. musculus
tgagagatctcagggg

SEQ ID NO: 440006 - DNA, 16 bp, M. musculus
tgagagatgcactgat

SEQ ID NO: 440007 - DNA, 16 bp, M. musculus
tgagagatttcagggg

SEQ ID NO: 440008 - DNA, 16 bp, M. musculus
tgagagatttttaaaa

SEQ ID NO: 440009 - DNA, 16 bp, M. musculus
tgagagcaaggattta

SEQ ID NO: 440010 - DNA, 16 bp, M. musculus
tgagagcaggagaggt

SEQ ID NO: 440011 - DNA, 16 bp, M. musculus
tgagagcatccacatc

SEQ ID NO: 440012 - DNA, 17 bp, M. musculus
tgagagcatccacctct

SEQ ID NO: 440013 - DNA, 16 bp, M. musculus
tgagagccaccatgtg

SEQ ID NO: 440014 - DNA, 16 bp, M. musculus
tgagagcctctcagga

SEQ ID NO: 440015 - DNA, 16 bp, M. musculus
tgagagcctgagtttg

SEQ ID NO: 440016 - DNA, 16 bp, M. musculus
tgagagcctgtctcag

SEQ ID NO: 440017 - DNA, 16 bp, M. musculus
tgagagcgagagcgag

SEQ ID NO: 440018 - DNA, 17 bp, M. musculus
tgagagctgcacaggtg

SEQ ID NO: 440019 - DNA, 16 bp, M. musculus
tgagagcttacatctt

SEQ ID NO: 440020 - DNA, 16 bp, M. musculus
tgagaggcacaggcag

SEQ ID NO: 440021 - DNA, 16 bp, M. musculus
tgagaggcagaagcag

SEQ ID NO: 440022 - DNA, 16 bp, M. musculus
tgagaggcagaggcaa

SEQ ID NO: 440023 - DNA, 28 bp, M. musculus
tgagaggccatggaaggccattggtgaa

SEQ ID NO: 440024 - DNA, 16 bp, M. musculus
tgagaggccctgtctc

SEQ ID NO: 440025 - DNA, 16 bp, M. musculus
tgagaggctccagcca

SEQ ID NO: 440026 - DNA, 16 bp, M. musculus
tgagaggctctaccag

SEQ ID NO: 440027 - DNA, 16 bp, M. musculus
tgagaggctgaggaag

SEQ ID NO: 440028 - DNA, 16 bp, M. musculus
tgagaggtccaacaag

SEQ ID NO: 440029 - DNA, 16 bp, M. musculus
tgagaggtggaagcag

SEQ ID NO: 440030 - DNA, 16 bp, M. musculus
tgagagtactcagtct

SEQ ID NO: 440031 - DNA, 16 bp, M. musculus
tgagagtctctctctc

SEQ ID NO: 440032 - DNA, 17 bp, M. musculus
tgagagtcttaagccca

SEQ ID NO: 440033 - DNA, 16 bp, M. musculus
tgagagtgagagcaag

SEQ ID NO: 440034 - DNA, 16 bp, M. musculus
tgagagtgtgtgtgaa

SEQ ID NO: 440035 - DNA, 16 bp, M. musculus
tgagagttctacatcc

SEQ ID NO: 440036 - DNA, 16 bp, M. musculus
tgagagttctacatct

SEQ ID NO: 440037 - DNA, 16 bp, M. musculus
tgagagttcttggtag

SEQ ID NO: 440038 - DNA, 16 bp, M. musculus
tgagagttttacattt

SEQ ID NO: 440039 - DNA, 16 bp, M. musculus
tgagataaagtctcac

SEQ ID NO: 440040 - DNA, 16 bp, M. musculus
tgagataatattttat

SEQ ID NO: 440041 - DNA, 16 bp, M. musculus
tgagatacaatgtgtg

SEQ ID NO: 440042 - DNA, 16 bp, M. musculus
tgagatagctcagctg

SEQ ID NO: 440043 - DNA, 16 bp, M. musculus
tgagatagggtcttac

SEQ ID NO: 440044 - DNA, 16 bp, M. musculus
tgagatataatattga

SEQ ID NO: 440045 - DNA, 16 bp, M. musculus
tgagatataattcaca

SEQ ID NO: 440046 - DNA, 16 bp, M. musculus
tgagatatgttcttct

SEQ ID NO: 440047 - DNA, 16 bp, M. musculus
tgagatattattttaa

SEQ ID NO: 440048 - DNA, 16 bp, M. musculus
tgagatccaggttcag

SEQ ID NO: 440049 - DNA, 16 bp, M. musculus
tgagatcctgcctcaa

SEQ ID NO: 440050 - DNA, 16 bp, M. musculus
tgagatcctgtcttaa

SEQ ID NO: 440051 - DNA, 16 bp, M. musculus
tgagatctgcctgctt

SEQ ID NO: 440052 - DNA, 16 bp, M. musculus
tgagatcttcgatttc

SEQ ID NO: 440053 - DNA, 16 bp, M. musculus
tgagatcttggggatg

SEQ ID NO: 440054 - DNA, 16 bp, M. musculus
tgagatctttgatttc

SEQ ID NO: 440055 - DNA, 16 bp, M. musculus
tgagatgcaatgtgtg

SEQ ID NO: 440056 - DNA, 16 bp, M. musculus
tgagatgctgtcttct

SEQ ID NO: 440057 - DNA, 16 bp, M. musculus
tgagatggagtctcac

SEQ ID NO: 440058 - DNA, 16 bp, M. musculus
tgagatggatcagtgg

SEQ ID NO: 440059 - DNA, 16 bp, M. musculus
tgagatggctcaatgg

SEQ ID NO: 440060 - DNA, 20 bp, M. musculus
tgagatggctcagaggttaa

SEQ ID NO: 440061 - DNA, 16 bp, M. musculus
tgagatggctcagtga

SEQ ID NO: 440062 - DNA, 16 bp, M. musculus
tgagatgggaagcaga

SEQ ID NO: 440063 - DNA, 16 bp, M. musculus
tgagatgggtcagtgg

SEQ ID NO: 440064 - DNA, 16 bp, M. musculus
tgagatggtttctctg

SEQ ID NO: 440065 - DNA, 16 bp, M. musculus
tgagatgtcatcttgg

SEQ ID NO: 440066 - DNA, 16 bp, M. musculus
tgagatgtgattttaa

SEQ ID NO: 440067 - DNA, 16 bp, M. musculus
tgagattaaaggcaca

SEQ ID NO: 440068 - DNA, 16 bp, M. musculus
tgagattaaaggtgtg

SEQ ID NO: 440069 - DNA, 16 bp, M. musculus
tgagattaaatgcatg

SEQ ID NO: 440070 - DNA, 17 bp, M. musculus
tgagattatctcttcca

SEQ ID NO: 440071 - DNA, 16 bp, M. musculus
tgagattccctcctct

SEQ ID NO: 440072 - DNA, 16 bp, M. musculus
tgagattctcttccca

SEQ ID NO: 440073 - DNA, 16 bp, M. musculus
tgagattcttccatct

SEQ ID NO: 440074 - DNA, 16 bp, M. musculus
tgagattctttttctt

SEQ ID NO: 440075 - DNA, 16 bp, M. musculus
tgagattgctggtctt

SEQ ID NO: 440076 - DNA, 17 bp, M. musculus
tgagattgtggactaca

SEQ ID NO: 440077 - DNA, 16 bp, M. musculus
tgagatttctagctcc

SEQ ID NO: 440078 - DNA, 17 bp, M. musculus
tgagatttctgtgggaa

SEQ ID NO: 440079 - DNA, 16 bp, M. musculus
tgagatttggtgccct

SEQ ID NO: 440080 - DNA, 16 bp, M. musculus
tgagattttgggtgtg

SEQ ID NO: 440081 - DNA, 16 bp, M. musculus
tgagatttttgtctca

SEQ ID NO: 440082 - DNA, 16 bp, M. musculus
tgagatttttttctct

SEQ ID NO: 440083 - DNA, 16 bp, M. musculus
tgagcaagcagactgc

SEQ ID NO: 440084 - DNA, 16 bp, M. musculus
tgagcaagccagagag

SEQ ID NO: 440085 - DNA, 16 bp, M. musculus
tgagcaagctatgaag

SEQ ID NO: 440086 - DNA, 16 bp, M. musculus
tgagcaaggaaaaata

SEQ ID NO: 440087 - DNA, 16 bp, M. musculus
tgagcaaggagttggc

SEQ ID NO: 440088 - DNA, 16 bp, M. musculus
tgagcaagtcatggag

SEQ ID NO: 440089 - DNA, 16 bp, M. musculus
tgagcaagtcatggga

SEQ ID NO: 440090 - DNA, 16 bp, M. musculus
tgagcacaaagacctc

SEQ ID NO: 440091 - DNA, 16 bp, M. musculus
tgagcacacaggcaca

SEQ ID NO: 440092 - DNA, 16 bp, M. musculus
tgagcacaggctcccc

SEQ ID NO: 440093 - DNA, 16 bp, M. musculus
tgagcacaggtaacca

SEQ ID NO: 440094 - DNA, 16 bp, M. musculus
tgagcacatgagcaca

SEQ ID NO: 440095 - DNA, 16 bp, M. musculus
tgagcacatgtgtgtg

SEQ ID NO: 440096 - DNA, 16 bp, M. musculus
tgagcacgtggagaga

SEQ ID NO: 440097 - DNA, 16 bp, M. musculus
tgagcactctctgcag

SEQ ID NO: 440098 - DNA, 16 bp, M. musculus
tgagcactgtgtgtgt

SEQ ID NO: 440099 - DNA, 16 bp, M. musculus
tgagcagaggcccagc

SEQ ID NO: 440100 - DNA, 16 bp, M. musculus
tgagcagcacaaattg

SEQ ID NO: 440101 - DNA, 16 bp, M. musculus
tgagcagcttagccca

SEQ ID NO: 440102 - DNA, 16 bp, M. musculus
tgagcaggaagagggg

SEQ ID NO: 440103 - DNA, 16 bp, M. musculus
tgagcaggaagctcca

SEQ ID NO: 440104 - DNA, 21 bp, M. musculus
tgagcaggaagctccacccct

SEQ ID NO: 440105 - DNA, 16 bp, M. musculus
tgagcaggaggaggag

SEQ ID NO: 440106 - DNA, 16 bp, M. musculus
tgagcaggaggaggga

SEQ ID NO: 440107 - DNA, 16 bp, M. musculus
tgagcagtcagtgctc

SEQ ID NO: 440108 - DNA, 16 bp, M. musculus
tgagcatacacacaca

SEQ ID NO: 440109 - DNA, 16 bp, M. musculus
tgagcataggagacct

SEQ ID NO: 440110 - DNA, 16 bp, M. musculus
tgagcatcaccaacag

SEQ ID NO: 440111 - DNA, 16 bp, M. musculus
tgagcatgctcaggaa

SEQ ID NO: 440112 - DNA, 16 bp, M. musculus
tgagcatgtgtgcaca

SEQ ID NO: 440113 - DNA, 16 bp, M. musculus
tgagccaaaataaacc

SEQ ID NO: 440114 - DNA, 16 bp, M. musculus
tgagccacaccccaac

SEQ ID NO: 440115 - DNA, 16 bp, M. musculus
tgagccacactgggca

SEQ ID NO: 440116 - DNA, 16 bp, M. musculus
tgagccacagctccag

SEQ ID NO: 440117 - DNA, 16 bp, M. musculus
tgagccaccacaccca

SEQ ID NO: 440118 - DNA, 16 bp, M. musculus
tgagccaccacacctg

SEQ ID NO: 440119 - DNA, 16 bp, M. musculus
tgagccaccacgcctg

SEQ ID NO: 440120 - DNA, 16 bp, M. musculus
tgagccaccactgccc

SEQ ID NO: 440121 - DNA, 16 bp, M. musculus
tgagccaccactgcct

SEQ ID NO: 440122 - DNA, 16 bp, M. musculus
tgagccaccatgtgac

SEQ ID NO: 440123 - DNA, 20 bp, M. musculus
tgagccaccatgtggttact

SEQ ID NO: 440124 - DNA, 16 bp, M. musculus
tgagccacctcacagg

SEQ ID NO: 440125 - DNA, 16 bp, M. musculus
tgagccacctcttcag

SEQ ID NO: 440126 - DNA, 16 bp, M. musculus
tgagccacctgtccag

SEQ ID NO: 440127 - DNA, 16 bp, M. musculus
tgagccaccttaccag

SEQ ID NO: 440128 - DNA, 16 bp, M. musculus
tgagccacgcccccag

SEQ ID NO: 440129 - DNA, 16 bp, M. musculus
tgagccactgtgtgga

SEQ ID NO: 440130 - DNA, 16 bp, M. musculus
tgagccagctccccag

SEQ ID NO: 440131 - DNA, 16 bp, M. musculus
tgagccagctctccaa

SEQ ID NO: 440132 - DNA, 16 bp, M. musculus
tgagccaggagtggtg

SEQ ID NO: 440133 - DNA, 16 bp, M. musculus
tgagccaggcccccac

SEQ ID NO: 440134 - DNA, 16 bp, M. musculus
tgagccaggtggtggt

SEQ ID NO: 440135 - DNA, 16 bp, M. musculus
tgagccatagctccag

SEQ ID NO: 440136 - DNA, 17 bp, M. musculus
tgagccatataaagttt

SEQ ID NO: 440137 - DNA, 16 bp, M. musculus
tgagccatcaccccag

SEQ ID NO: 440138 - DNA, 16 bp, M. musculus
tgagccatcatgtgag

SEQ ID NO: 440139 - DNA, 20 bp, M. musculus
tgagccatctcaccagccca

SEQ ID NO: 440140 - DNA, 16 bp, M. musculus
tgagccatctccccag

SEQ ID NO: 440141 - DNA, 16 bp, M. musculus
tgagccatctccctaa

SEQ ID NO: 440142 - DNA, 16 bp, M. musculus
tgagccatctcctcag

SEQ ID NO: 440143 - DNA, 16 bp, M. musculus
tgagccatctctatgg

SEQ ID NO: 440144 - DNA, 16 bp, M. musculus
tgagccatctctttat

SEQ ID NO: 440145 - DNA, 16 bp, M. musculus
tgagccatcttgccag

SEQ ID NO: 440146 - DNA, 16 bp, M. musculus
tgagccatctttccaa

SEQ ID NO: 440147 - DNA, 16 bp, M. musculus
tgagccatgttcccag

SEQ ID NO: 440148 - DNA, 16 bp, M. musculus
tgagccatgtttccag

SEQ ID NO: 440149 - DNA, 16 bp, M. musculus
tgagccattttaccag

SEQ ID NO: 440150 - DNA, 16 bp, M. musculus
tgagcccagcagaggc

SEQ ID NO: 440151 - DNA, 16 bp, M. musculus
tgagcccagggccttg

SEQ ID NO: 440152 - DNA, 16 bp, M. musculus
tgagcccaggtccttt

SEQ ID NO: 440153 - DNA, 16 bp, M. musculus
tgagcccctatgagtc

SEQ ID NO: 440154 - DNA, 16 bp, M. musculus
tgagccctccatttct

SEQ ID NO: 440155 - DNA, 16 bp, M. musculus
tgagccctctcactgg

SEQ ID NO: 440156 - DNA, 16 bp, M. musculus
tgagccctctccccag

SEQ ID NO: 440157 - DNA, 16 bp, M. musculus
tgagccctgtctccag

SEQ ID NO: 440158 - DNA, 16 bp, M. musculus
tgagcctaagagtcaa

SEQ ID NO: 440159 - DNA, 16 bp, M. musculus
tgagcctcagctgctc

SEQ ID NO: 440160 - DNA, 16 bp, M. musculus
tgagcctcagttttcc

SEQ ID NO: 440161 - DNA, 16 bp, M. musculus
tgagcctctatgtggg

SEQ ID NO: 440162 - DNA, 16 bp, M. musculus
tgagcctctcctgtgg

SEQ ID NO: 440163 - DNA, 16 bp, M. musculus
tgagcctggagctagg

SEQ ID NO: 440164 - DNA, 16 bp, M. musculus
tgagccttctcctcag

SEQ ID NO: 440165 - DNA, 16 bp, M. musculus
tgagccttctctgcag

SEQ ID NO: 440166 - DNA, 16 bp, M. musculus
tgagccttgggaggag

SEQ ID NO: 440167 - DNA, 16 bp, M. musculus
tgagcctttcaaggaa

SEQ ID NO: 440168 - DNA, 16 bp, M. musculus
tgagcctttctcaggg

SEQ ID NO: 440169 - DNA, 16 bp, M. musculus
tgagcgtgggagatct

SEQ ID NO: 440170 - DNA, 16 bp, M. musculus
tgagctaaataaacct

SEQ ID NO: 440171 - DNA, 16 bp, M. musculus
tgagctacagaatgag

SEQ ID NO: 440172 - DNA, 16 bp, M. musculus
tgagctacagcctcag

SEQ ID NO: 440173 - DNA, 16 bp, M. musculus
tgagctacagtgtgag

SEQ ID NO: 440174 - DNA, 16 bp, M. musculus
tgagctacatccccag

SEQ ID NO: 440175 - DNA, 16 bp, M. musculus
tgagctacatgagacc

SEQ ID NO: 440176 - DNA, 16 bp, M. musculus
tgagctaccatgtagg

SEQ ID NO: 440177 - DNA, 16 bp, M. musculus
tgagctagaagatcca

SEQ ID NO: 440178 - DNA, 16 bp, M. musculus
tgagctatactcccag

SEQ ID NO: 440179 - DNA, 16 bp, M. musculus
tgagctatatctccag

SEQ ID NO: 440180 - DNA, 16 bp, M. musculus
tgagctatctcactgg

SEQ ID NO: 440181 - DNA, 16 bp, M. musculus
tgagctatgtctccag

SEQ ID NO: 440182 - DNA, 16 bp, M. musculus
tgagctcaaggccagc

SEQ ID NO: 440183 - DNA, 16 bp, M. musculus
tgagctcaaggttcag

SEQ ID NO: 440184 - DNA, 16 bp, M. musculus
tgagctcagaggagct

SEQ ID NO: 440185 - DNA, 16 bp, M. musculus
tgagctcatatgcagg

SEQ ID NO: 440186 - DNA, 16 bp, M. musculus
tgagctcatgagtgca

SEQ ID NO: 440187 - DNA, 16 bp, M. musculus
tgagctccaagccagc

SEQ ID NO: 440188 - DNA, 16 bp, M. musculus
tgagctccagaccagc

SEQ ID NO: 440189 - DNA, 16 bp, M. musculus
tgagctccagattcag

SEQ ID NO: 440190 - DNA, 16 bp, M. musculus
tgagctccaggagagc

SEQ ID NO: 440191 - DNA, 16 bp, M. musculus
tgagctccaggttcag

SEQ ID NO: 440192 - DNA, 16 bp, M. musculus
tgagctccatccccag

SEQ ID NO: 440193 - DNA, 16 bp, M. musculus
tgagctccatcctcag

SEQ ID NO: 440194 - DNA, 16 bp, M. musculus
tgagctccattcccag

SEQ ID NO: 440195 - DNA, 16 bp, M. musculus
tgagctcccagagact

SEQ ID NO: 440196 - DNA, 16 bp, M. musculus
tgagctctatggctgc

SEQ ID NO: 440197 - DNA, 16 bp, M. musculus
tgagctctcagctcct

SEQ ID NO: 440198 - DNA, 16 bp, M. musculus
tgagctctgaggagag

SEQ ID NO: 440199 - DNA, 16 bp, M. musculus
tgagctctgcttgtgg

SEQ ID NO: 440200 - DNA, 16 bp, M. musculus
tgagctctgggtgtac

SEQ ID NO: 440201 - DNA, 16 bp, M. musculus
tgagctctgggttcag

SEQ ID NO: 440202 - DNA, 16 bp, M. musculus
tgagctgaaataaacc

SEQ ID NO: 440203 - DNA, 16 bp, M. musculus
tgagctgaacaaagac

SEQ ID NO: 440204 - DNA, 16 bp, M. musculus
tgagctgaactgctga

SEQ ID NO: 440205 - DNA, 16 bp, M. musculus
tgagctgcaaagaaga

SEQ ID NO: 440206 - DNA, 16 bp, M. musculus
tgagctgcacccccag

SEQ ID NO: 440207 - DNA, 16 bp, M. musculus
tgagctgccacaccca

SEQ ID NO: 440208 - DNA, 16 bp, M. musculus
tgagctgcccaatgtg

SEQ ID NO: 440209 - DNA, 16 bp, M. musculus
tgagctgcccagtgtg

SEQ ID NO: 440210 - DNA, 16 bp, M. musculus
tgagctgccctgtgga

SEQ ID NO: 440211 - DNA, 16 bp, M. musculus
tgagctgcctgacatg

SEQ ID NO: 440212 - DNA, 16 bp, M. musculus
tgagctgcctgatgtg

SEQ ID NO: 440213 - DNA, 16 bp, M. musculus
tgagctgcctgctgtg

SEQ ID NO: 440214 - DNA, 16 bp, M. musculus
tgagctgcctggcatg

SEQ ID NO: 440215 - DNA, 16 bp, M. musculus
tgagctgctggctggc

SEQ ID NO: 440216 - DNA, 16 bp, M. musculus
tgagctggactgctgg

SEQ ID NO: 440217 - DNA, 16 bp, M. musculus
tgagctggaggtcagc

SEQ ID NO: 440218 - DNA, 16 bp, M. musculus
tgagctggatcccatt

SEQ ID NO: 440219 - DNA, 16 bp, M. musculus
tgagctggcttggtca

SEQ ID NO: 440220 - DNA, 16 bp, M. musculus
tgagctgggccctccc

SEQ ID NO: 440221 - DNA, 16 bp, M. musculus
tgagctgggccttcca

SEQ ID NO: 440222 - DNA, 16 bp, M. musculus
tgagctgggcggtggt

SEQ ID NO: 440223 - DNA, 16 bp, M. musculus
tgagctggggctggag

SEQ ID NO: 440224 - DNA, 16 bp, M. musculus
tgagctgggtcctccc

SEQ ID NO: 440225 - DNA, 16 bp, M. musculus
tgagctggtgaaggaa

SEQ ID NO: 440226 - DNA, 17 bp, M. musculus
tgagctggtggttttcc

SEQ ID NO: 440227 - DNA, 16 bp, M. musculus
tgagctgtattcccag

SEQ ID NO: 440228 - DNA, 16 bp, M. musculus
tgagctgtcacccatg

SEQ ID NO: 440229 - DNA, 16 bp, M. musculus
tgagctgtccagtgtg

SEQ ID NO: 440230 - DNA, 16 bp, M. musculus
tgagctgtctctccag

SEQ ID NO: 440231 - DNA, 16 bp, M. musculus
tgagctgtctctgcag

SEQ ID NO: 440232 - DNA, 16 bp, M. musculus
tgagctgtctcttcag

SEQ ID NO: 440233 - DNA, 16 bp, M. musculus
tgagctgtgtgacctt

SEQ ID NO: 440234 - DNA, 16 bp, M. musculus
tgagcttatagaatga

SEQ ID NO: 440235 - DNA, 16 bp, M. musculus
tgagcttcagattcag

SEQ ID NO: 440236 - DNA, 16 bp, M. musculus
tgagcttcagggatcc

SEQ ID NO: 440237 - DNA, 16 bp, M. musculus
tgagcttcagtttcct

SEQ ID NO: 440238 - DNA, 16 bp, M. musculus
tgagcttctttttggc

SEQ ID NO: 440239 - DNA, 16 bp, M. musculus
tgagcttgaggctagc

SEQ ID NO: 440240 - DNA, 16 bp, M. musculus
tgagcttggagagagg

SEQ ID NO: 440241 - DNA, 16 bp, M. musculus
tgagcttggagggccg

SEQ ID NO: 440242 - DNA, 16 bp, M. musculus
tgagcttgtgatcaaa

SEQ ID NO: 440243 - DNA, 16 bp, M. musculus
tgagctttgaacagga

SEQ ID NO: 440244 - DNA, 16 bp, M. musculus
tgagctttgctcatgt

SEQ ID NO: 440245 - DNA, 16 bp, M. musculus
tgagctttgtacaagg

SEQ ID NO: 440246 - DNA, 16 bp, M. musculus
tgagctttgtgcaaag

SEQ ID NO: 440247 - DNA, 16 bp, M. musculus
tgaggaaaagaagttc

SEQ ID NO: 440248 - DNA, 16 bp, M. musculus
tgaggaaacaccatga

SEQ ID NO: 440249 - DNA, 16 bp, M. musculus
tgaggaaacccagacc

SEQ ID NO: 440250 - DNA, 16 bp, M. musculus
tgaggaaactgaagct

SEQ ID NO: 440251 - DNA, 16 bp, M. musculus
tgaggaaactgaggaa

SEQ ID NO: 440252 - DNA, 16 bp, M. musculus
tgaggaaactgaggct

SEQ ID NO: 440253 - DNA, 16 bp, M. musculus
tgaggaaagtaactaa

SEQ ID NO: 440254 - DNA, 16 bp, M. musculus
tgaggaaatccagaga

SEQ ID NO: 440255 - DNA, 16 bp, M. musculus
tgaggaaattcaaaac

SEQ ID NO: 440256 - DNA, 16 bp, M. musculus
tgaggaaattgaaaaa

SEQ ID NO: 440257 - DNA, 16 bp, M. musculus
tgaggaacaagccagt

SEQ ID NO: 440258 - DNA, 16 bp, M. musculus
tgaggaaccaagggga

SEQ ID NO: 440259 - DNA, 16 bp, M. musculus
tgaggaaccagccaca

SEQ ID NO: 440260 - DNA, 16 bp, M. musculus
tgaggaacctggaggg

SEQ ID NO: 440261 - DNA, 16 bp, M. musculus
tgaggaactgccagag

SEQ ID NO: 440262 - DNA, 16 bp, M. musculus
tgaggaactgcctcca

SEQ ID NO: 440263 - DNA, 16 bp, M. musculus
tgaggaactgtgttaa

SEQ ID NO: 440264 - DNA, 16 bp, M. musculus
tgaggaactgttggag

SEQ ID NO: 440265 - DNA, 16 bp, M. musculus
tgaggaagaagaggca

SEQ ID NO: 440266 - DNA, 16 bp, M. musculus
tgaggaagacatctga

SEQ ID NO: 440267 - DNA, 16 bp, M. musculus
tgaggaagatacctaa

SEQ ID NO: 440268 - DNA, 16 bp, M. musculus
tgaggaagatctcaga

SEQ ID NO: 440269 - DNA, 16 bp, M. musculus
tgaggaagcagaagca

SEQ ID NO: 440270 - DNA, 16 bp, M. musculus
tgaggaagcagaatta

SEQ ID NO: 440271 - DNA, 16 bp, M. musculus
tgaggaagcagagaga

SEQ ID NO: 440272 - DNA, 16 bp, M. musculus
tgaggaagccatggga

SEQ ID NO: 440273 - DNA, 16 bp, M. musculus
tgaggaaggctgagaa

SEQ ID NO: 440274 - DNA, 16 bp, M. musculus
tgaggaataatgaatg

SEQ ID NO: 440275 - DNA, 16 bp, M. musculus
tgaggaatactgaaag

SEQ ID NO: 440276 - DNA, 16 bp, M. musculus
tgaggaatcagagaaa

SEQ ID NO: 440277 - DNA, 16 bp, M. musculus
tgaggaattcaaggcc

SEQ ID NO: 440278 - DNA, 16 bp, M. musculus
tgaggacaaagagaag

SEQ ID NO: 440279 - DNA, 16 bp, M. musculus
tgaggacaaagagatg

SEQ ID NO: 440280 - DNA, 16 bp, M. musculus
tgaggacaaggcaggc

SEQ ID NO: 440281 - DNA, 16 bp, M. musculus
tgaggacacagatgtc

SEQ ID NO: 440282 - DNA, 16 bp, M. musculus
tgaggacagagctcag

SEQ ID NO: 440283 - DNA, 16 bp, M. musculus
tgaggacagcctgagc

SEQ ID NO: 440284 - DNA, 16 bp, M. musculus
tgaggaccctgtgttc

SEQ ID NO: 440285 - DNA, 16 bp, M. musculus
tgaggacctcagtttg

SEQ ID NO: 440286 - DNA, 16 bp, M. musculus
tgaggacctggaggag

SEQ ID NO: 440287 - DNA, 16 bp, M. musculus
tgaggacgaagtccct

SEQ ID NO: 440288 - DNA, 16 bp, M. musculus
tgaggactcaggctcc

SEQ ID NO: 440289 - DNA, 16 bp, M. musculus
tgaggacttttaaagt

SEQ ID NO: 440290 - DNA, 16 bp, M. musculus
tgaggagaaaaggagc

SEQ ID NO: 440291 - DNA, 16 bp, M. musculus
tgaggagaaagccagt

SEQ ID NO: 440292 - DNA, 16 bp, M. musculus
tgaggagaagggtgat

SEQ ID NO: 440293 - DNA, 16 bp, M. musculus
tgaggagacagagaaa

SEQ ID NO: 440294 - DNA, 16 bp, M. musculus
tgaggagagctgtgtg

SEQ ID NO: 440295 - DNA, 16 bp, M. musculus
tgaggagatcagaaga

SEQ ID NO: 440296 - DNA, 16 bp, M. musculus
tgaggagatgaggaga

SEQ ID NO: 440297 - DNA, 16 bp, M. musculus
tgaggagatggagaca

SEQ ID NO: 440298 - DNA, 16 bp, M. musculus
tgaggagatggctcag

SEQ ID NO: 440299 - DNA, 16 bp, M. musculus
tgaggagcaaggcagt

SEQ ID NO: 440300 - DNA, 16 bp, M. musculus
tgaggagctgaggcag

SEQ ID NO: 440301 - DNA, 16 bp, M. musculus
tgaggagctgttggca

SEQ ID NO: 440302 - DNA, 16 bp, M. musculus
tgaggaggaaagggct

SEQ ID NO: 440303 - DNA, 16 bp, M. musculus
tgaggaggagagtgac

SEQ ID NO: 440304 - DNA, 16 bp, M. musculus
tgaggaggaggagcag

SEQ ID NO: 440305 - DNA, 16 bp, M. musculus
tgaggaggaggatgac

SEQ ID NO: 440306 - DNA, 16 bp, M. musculus
tgaggaggaggcagag

SEQ ID NO: 440307 - DNA, 16 bp, M. musculus
tgaggaggagggcagc

SEQ ID NO: 440308 - DNA, 16 bp, M. musculus
tgaggaggatgtggag

SEQ ID NO: 440309 - DNA, 16 bp, M. musculus
tgaggaggcagaagag

SEQ ID NO: 440310 - DNA, 16 bp, M. musculus
tgaggagggaacagtg

SEQ ID NO: 440311 - DNA, 16 bp, M. musculus
tgaggaggtcagaaga

SEQ ID NO: 440312 - DNA, 16 bp, M. musculus
tgaggaggtggaggca

SEQ ID NO: 440313 - DNA, 16 bp, M. musculus
tgaggaggtgtgtcac

SEQ ID NO: 440314 - DNA, 21 bp, M. musculus
tgaggagtccctatcccaact

SEQ ID NO: 440315 - DNA, 18 bp, M. musculus
tgaggagtgttcctcttt

SEQ ID NO: 440316 - DNA, 16 bp, M. musculus
tgaggagttattggca

SEQ ID NO: 440317 - DNA, 16 bp, M. musculus
tgaggatcaaactcag

SEQ ID NO: 440318 - DNA, 16 bp, M. musculus
tgaggatccagtactg

SEQ ID NO: 440319 - DNA, 16 bp, M. musculus
tgaggatgaagaagat

SEQ ID NO: 440320 - DNA, 16 bp, M. musculus
tgaggatgactctgaa

SEQ ID NO: 440321 - DNA, 16 bp, M. musculus
tgaggatgagaggtat

SEQ ID NO: 440322 - DNA, 16 bp, M. musculus
tgaggatgaggagaaa

SEQ ID NO: 440323 - DNA, 16 bp, M. musculus
tgaggatgcagagaaa

SEQ ID NO: 440324 - DNA, 16 bp, M. musculus
tgaggatgcttgcagc

SEQ ID NO: 440325 - DNA, 16 bp, M. musculus
tgaggatgtagctcag

SEQ ID NO: 440326 - DNA, 16 bp, M. musculus
tgaggatgtgccagac

SEQ ID NO: 440327 - DNA, 16 bp, M. musculus
tgaggatgtggagcaa

SEQ ID NO: 440328 - DNA, 16 bp, M. musculus
tgaggatttggagaaa

SEQ ID NO: 440329 - DNA, 16 bp, M. musculus
tgaggcaaagtctctc

SEQ ID NO: 440330 - DNA, 16 bp, M. musculus
tgaggcagaaggatca

SEQ ID NO: 440331 - DNA, 16 bp, M. musculus
tgaggcagaaggatta

SEQ ID NO: 440332 - DNA, 16 bp, M. musculus
tgaggcagagagagag

SEQ ID NO: 440333 - DNA, 16 bp, M. musculus
tgaggcaggaactgaa

SEQ ID NO: 440334 - DNA, 16 bp, M. musculus
tgaggcaggaaggctg

SEQ ID NO: 440335 - DNA, 16 bp, M. musculus
tgaggcaggagaatca

SEQ ID NO: 440336 - DNA, 16 bp, M. musculus
tgaggcaggagaatga

SEQ ID NO: 440337 - DNA, 16 bp, M. musculus
tgaggcaggagaattt

SEQ ID NO: 440338 - DNA, 16 bp, M. musculus
tgaggcaggagcatgg

SEQ ID NO: 440339 - DNA, 16 bp, M. musculus
tgaggcaggaggatca

SEQ ID NO: 440340 - DNA, 16 bp, M. musculus
tgaggcaggaggatcc

SEQ ID NO: 440341 - DNA, 16 bp, M. musculus
tgaggcaggaggatct

SEQ ID NO: 440342 - DNA, 16 bp, M. musculus
tgaggcaggagggctg

SEQ ID NO: 440343 - DNA, 16 bp, M. musculus
tgaggcaggatctcat

SEQ ID NO: 440344 - DNA, 16 bp, M. musculus
tgaggcaggattagaa

SEQ ID NO: 440345 - DNA, 16 bp, M. musculus
tgaggcagggagcaaa

SEQ ID NO: 440346 - DNA, 16 bp, M. musculus
tgaggcagggggatgg

SEQ ID NO: 440347 - DNA, 16 bp, M. musculus
tgaggcatctcttcag

SEQ ID NO: 440348 - DNA, 16 bp, M. musculus
tgaggccagacaaggt

SEQ ID NO: 440349 - DNA, 16 bp, M. musculus
tgaggccagaccagga

SEQ ID NO: 440350 - DNA, 16 bp, M. musculus
tgaggccagccagagc

SEQ ID NO: 440351 - DNA, 16 bp, M. musculus
tgaggccagcctggat

SEQ ID NO: 440352 - DNA, 16 bp, M. musculus
tgaggccagccttgcc

SEQ ID NO: 440353 - DNA, 16 bp, M. musculus
tgaggccaggcatgtg

SEQ ID NO: 440354 - DNA, 16 bp, M. musculus
tgaggccaggctgggc

SEQ ID NO: 440355 - DNA, 16 bp, M. musculus
tgaggccagtgtgggc

SEQ ID NO: 440356 - DNA, 16 bp, M. musculus
tgaggccatcctgggc

SEQ ID NO: 440357 - DNA, 16 bp, M. musculus
tgaggccatggctccc

SEQ ID NO: 440358 - DNA, 16 bp, M. musculus
tgaggcccagagaagg

SEQ ID NO: 440359 - DNA, 16 bp, M. musculus
tgaggccctgagtttg

SEQ ID NO: 440360 - DNA, 16 bp, M. musculus
tgaggcctcctgggct

SEQ ID NO: 440361 - DNA, 16 bp, M. musculus
tgaggcctgcctgggc

SEQ ID NO: 440362 - DNA, 16 bp, M. musculus
tgaggcctgctccttt

SEQ ID NO: 440363 - DNA, 17 bp, M. musculus
tgaggcctgttttgtga

SEQ ID NO: 440364 - DNA, 16 bp, M. musculus
tgaggccttgcctggt

SEQ ID NO: 440365 - DNA, 16 bp, M. musculus
tgaggctaaattgaaa

SEQ ID NO: 440366 - DNA, 16 bp, M. musculus
tgaggctagacaaggc

SEQ ID NO: 440367 - DNA, 20 bp, M. musculus
tgaggctatgtcagtgcctg

SEQ ID NO: 440368 - DNA, 16 bp, M. musculus
tgaggctcagcactat

SEQ ID NO: 440369 - DNA, 16 bp, M. musculus
tgaggctcctgagctc

SEQ ID NO: 440370 - DNA, 16 bp, M. musculus
tgaggctctttcccac

SEQ ID NO: 440371 - DNA, 16 bp, M. musculus
tgaggctgaaagacac

SEQ ID NO: 440372 - DNA, 16 bp, M. musculus
tgaggctgactttgaa

SEQ ID NO: 440373 - DNA, 16 bp, M. musculus
tgaggctgaggcctgg

SEQ ID NO: 440374 - DNA, 20 bp, M. musculus
tgaggctgaggctgaggctg

SEQ ID NO: 440375 - DNA, 16 bp, M. musculus
tgaggctggagtgggt

SEQ ID NO: 440376 - DNA, 16 bp, M. musculus
tgaggctggcctagaa

SEQ ID NO: 440377 - DNA, 16 bp, M. musculus
tgaggctggcttacag

SEQ ID NO: 440378 - DNA, 16 bp, M. musculus
tgaggctgtgtctgtg

SEQ ID NO: 440379 - DNA, 16 bp, M. musculus
tgaggcttgctccaga

SEQ ID NO: 440380 - DNA, 16 bp, M. musculus
tgaggcttgcttgcag

SEQ ID NO: 440381 - DNA, 16 bp, M. musculus
tgaggcttgttttgtg

SEQ ID NO: 440382 - DNA, 16 bp, M. musculus
tgagggaatgaagaaa

SEQ ID NO: 440383 - DNA, 16 bp, M. musculus
tgagggacagagacag

SEQ ID NO: 440384 - DNA, 16 bp, M. musculus
tgagggagctggagag

SEQ ID NO: 440385 - DNA, 16 bp, M. musculus
tgagggaggcacactg

SEQ ID NO: 440386 - DNA, 16 bp, M. musculus
tgagggagtttctaga

SEQ ID NO: 440387 - DNA, 16 bp, M. musculus
tgagggattgcctaga

SEQ ID NO: 440388 - DNA, 16 bp, M. musculus
tgagggcacagagaca

SEQ ID NO: 440389 - DNA, 16 bp, M. musculus
tgagggcacagggaca

SEQ ID NO: 440390 - DNA, 16 bp, M. musculus
tgagggcaggcacaag

SEQ ID NO: 440391 - DNA, 16 bp, M. musculus
tgagggcagggaggtg

SEQ ID NO: 440392 - DNA, 16 bp, M. musculus
tgagggccagaagagg

SEQ ID NO: 440393 - DNA, 17 bp, M. musculus
tgagggctggtgagatg

SEQ ID NO: 440394 - DNA, 16 bp, M. musculus
tgaggggctcctggtg

SEQ ID NO: 440395 - DNA, 16 bp, M. musculus
tgaggggctgaagaga

SEQ ID NO: 440396 - DNA, 16 bp, M. musculus
tgaggggctgagaaga

SEQ ID NO: 440397 - DNA, 16 bp, M. musculus
tgaggggctgggagtg

SEQ ID NO: 440398 - DNA, 16 bp, M. musculus
tgaggggctgggccag

SEQ ID NO: 440399 - DNA, 16 bp, M. musculus
tgagggggctggagag

SEQ ID NO: 440400 - DNA, 16 bp, M. musculus
tgaggggtatctgggt

SEQ ID NO: 440401 - DNA, 16 bp, M. musculus
tgaggggtgtgaactt

SEQ ID NO: 440402 - DNA, 16 bp, M. musculus
tgaggggttccttgca

SEQ ID NO: 440403 - DNA, 16 bp, M. musculus
tgagggtctctcttcc

SEQ ID NO: 440404 - DNA, 16 bp, M. musculus
tgagggtctttttttt

SEQ ID NO: 440405 - DNA, 16 bp, M. musculus
tgagggtgctccccat

SEQ ID NO: 440406 - DNA, 16 bp, M. musculus
tgagggtgctcctcca

SEQ ID NO: 440407 - DNA, 16 bp, M. musculus
tgagggtgttcttcca

SEQ ID NO: 440408 - DNA, 16 bp, M. musculus
tgaggtaacccagagc

SEQ ID NO: 440409 - DNA, 16 bp, M. musculus
tgaggtacagagaaga

SEQ ID NO: 440410 - DNA, 16 bp, M. musculus
tgaggtacctaaaggc

SEQ ID NO: 440411 - DNA, 16 bp, M. musculus
tgaggtaggaggattg

SEQ ID NO: 440412 - DNA, 16 bp, M. musculus
tgaggtcaaggccaac

SEQ ID NO: 440413 - DNA, 16 bp, M. musculus
tgaggtcatcctgggc

SEQ ID NO: 440414 - DNA, 16 bp, M. musculus
tgaggtcatcctggtc

SEQ ID NO: 440415 - DNA, 16 bp, M. musculus
tgaggtcatggagcag

SEQ ID NO: 440416 - DNA, 16 bp, M. musculus
tgaggtccagagttca

SEQ ID NO: 440417 - DNA, 16 bp, M. musculus
tgaggtcccctcctct

SEQ ID NO: 440418 - DNA, 16 bp, M. musculus
tgaggtctgagaaaaa

SEQ ID NO: 440419 - DNA, 28 bp, M. musculus
tgaggtgatgtgacctgtggtgattggt

SEQ ID NO: 440420 - DNA, 16 bp, M. musculus
tgaggtgcctacttaa

SEQ ID NO: 440421 - DNA, 16 bp, M. musculus
tgaggtgctgagaaga

SEQ ID NO: 440422 - DNA, 16 bp, M. musculus
tgaggtgctgagaagg

SEQ ID NO: 440423 - DNA, 18 bp, M. musculus
tgaggtgctggctgaagg

SEQ ID NO: 440424 - DNA, 16 bp, M. musculus
tgaggtgctgtgaaga

SEQ ID NO: 440425 - DNA, 16 bp, M. musculus
tgaggtggaagtgctg

SEQ ID NO: 440426 - DNA, 16 bp, M. musculus
tgaggtggagggactg

SEQ ID NO: 440427 - DNA, 16 bp, M. musculus
tgaggtggctcacctg

SEQ ID NO: 440428 - DNA, 16 bp, M. musculus
tgaggtggctcagctg

SEQ ID NO: 440429 - DNA, 24 bp, M. musculus
tgaggtggctgggactcccacagg

SEQ ID NO: 440430 - DNA, 16 bp, M. musculus
tgaggtgggagtgctg

SEQ ID NO: 440431 - DNA, 16 bp, M. musculus
tgaggtgtcctcactt

SEQ ID NO: 440432 - DNA, 16 bp, M. musculus
tgaggtgtgtttcctg

SEQ ID NO: 440433 - DNA, 16 bp, M. musculus
tgaggttggaagacac

SEQ ID NO: 440434 - DNA, 48 bp, M. musculus
tgaggttgttccaggaggcccttatctcaaaaatgttcttggaacagt

SEQ ID NO: 440435 - DNA, 16 bp, M. musculus
tgaggttgttctctgg

SEQ ID NO: 440436 - DNA, 16 bp, M. musculus
tgaggtttcaaaagac

SEQ ID NO: 440437 - DNA, 16 bp, M. musculus
tgaggtttcaaaagtc

SEQ ID NO: 440438 - DNA, 16 bp, M. musculus
tgaggtttcaaatgct

SEQ ID NO: 440439 - DNA, 16 bp, M. musculus
tgaggtttcagaagtc

SEQ ID NO: 440440 - DNA, 16 bp, M. musculus
tgaggtttcttctgga

SEQ ID NO: 440441 - DNA, 16 bp, M. musculus
tgagtaagggtctttt

SEQ ID NO: 440442 - DNA, 16 bp, M. musculus
tgagtacaccattgct

SEQ ID NO: 440443 - DNA, 16 bp, M. musculus
tgagtacactattgct

SEQ ID NO: 440444 - DNA, 16 bp, M. musculus
tgagtacactggagct

SEQ ID NO: 440445 - DNA, 17 bp, M. musculus
tgagtacactgttgctg

SEQ ID NO: 440446 - DNA, 16 bp, M. musculus
tgagtacagcagaata

SEQ ID NO: 440447 - DNA, 16 bp, M. musculus
tgagtacatactgtgt

SEQ ID NO: 440448 - DNA, 16 bp, M. musculus
tgagtacattgatatt

SEQ ID NO: 440449 - DNA, 20 bp, M. musculus
tgagtacggtaagtaactca

SEQ ID NO: 440450 - DNA, 16 bp, M. musculus
tgagtactgggaacca

SEQ ID NO: 440451 - DNA, 16 bp, M. musculus
tgagtaggtgtgtgtg

SEQ ID NO: 440452 - DNA, 16 bp, M. musculus
tgagtatactgtcact

SEQ ID NO: 440453 - DNA, 16 bp, M. musculus
tgagtatatgtgtgta

SEQ ID NO: 440454 - DNA, 16 bp, M. musculus
tgagtatgggagagct

SEQ ID NO: 440455 - DNA, 16 bp, M. musculus
tgagtatgtggagaaa

SEQ ID NO: 440456 - DNA, 16 bp, M. musculus
tgagtattataaataa

SEQ ID NO: 440457 - DNA, 16 bp, M. musculus
tgagtattttgttcct

SEQ ID NO: 440458 - DNA, 16 bp, M. musculus
tgagtcacagaggtca

SEQ ID NO: 440459 - DNA, 16 bp, M. musculus
tgagtcagaattttga

SEQ ID NO: 440460 - DNA, 16 bp, M. musculus
tgagtcagggtctccc

SEQ ID NO: 440461 - DNA, 16 bp, M. musculus
tgagtcagggtttctc

SEQ ID NO: 440462 - DNA, 16 bp, M. musculus
tgagtcatactcaggt

SEQ ID NO: 440463 - DNA, 16 bp, M. musculus
tgagtcatctcaccag

SEQ ID NO: 440464 - DNA, 16 bp, M. musculus
tgagtcatctcgccag

SEQ ID NO: 440465 - DNA, 16 bp, M. musculus
tgagtccagacaaggc

SEQ ID NO: 440466 - DNA, 16 bp, M. musculus
tgagtccagcctgggc

SEQ ID NO: 440467 - DNA, 18 bp, M. musculus
tgagtccagcctggtcta

SEQ ID NO: 440468 - DNA, 16 bp, M. musculus
tgagtccattgatgtg

SEQ ID NO: 440469 - DNA, 16 bp, M. musculus
tgagtcccagaacagc

SEQ ID NO: 440470 - DNA, 16 bp, M. musculus
tgagtcccaggggtca

SEQ ID NO: 440471 - DNA, 16 bp, M. musculus
tgagtcccctggaact

SEQ ID NO: 440472 - DNA, 16 bp, M. musculus
tgagtccctcacagcc

SEQ ID NO: 440473 - DNA, 16 bp, M. musculus
tgagtccctctgtgtg

SEQ ID NO: 440474 - DNA, 16 bp, M. musculus
tgagtcctctggaaaa

SEQ ID NO: 440475 - DNA, 16 bp, M. musculus
tgagtcctgagagtct

SEQ ID NO: 440476 - DNA, 16 bp, M. musculus
tgagtcctggatactc

SEQ ID NO: 440477 - DNA, 16 bp, M. musculus
tgagtcctggatatcc

SEQ ID NO: 440478 - DNA, 16 bp, M. musculus
tgagtcgtctctccag

SEQ ID NO: 440479 - DNA, 16 bp, M. musculus
tgagtctcagtttccc

SEQ ID NO: 440480 - DNA, 16 bp, M. musculus
tgagtctctgagttca

SEQ ID NO: 440481 - DNA, 16 bp, M. musculus
tgagtctctgcatctg

SEQ ID NO: 440482 - DNA, 16 bp, M. musculus
tgagtctgatccccag

SEQ ID NO: 440483 - DNA, 16 bp, M. musculus
tgagtctggtttattt

SEQ ID NO: 440484 - DNA, 16 bp, M. musculus
tgagtctgtaagccag

SEQ ID NO: 440485 - DNA, 16 bp, M. musculus
tgagtctgtctgtctg

SEQ ID NO: 440486 - DNA, 16 bp, M. musculus
tgagtctgttagcctc

SEQ ID NO: 440487 - DNA, 16 bp, M. musculus
tgagtcttctctctag

SEQ ID NO: 440488 - DNA, 31 bp, M. musculus
tgagtgagggtctcccttcgggggtctttca

SEQ ID NO: 440489 - DNA, 16 bp, M. musculus
tgagtgcacatgtgtg

SEQ ID NO: 440490 - DNA, 16 bp, M. musculus
tgagtgcagatgccct

SEQ ID NO: 440491 - DNA, 16 bp, M. musculus
tgagtgcagttgccca

SEQ ID NO: 440492 - DNA, 16 bp, M. musculus
tgagtgcatactatgt

SEQ ID NO: 440493 - DNA, 16 bp, M. musculus
tgagtgccctgactgt

SEQ ID NO: 440494 - DNA, 16 bp, M. musculus
tgagtgcctacaaaaa

SEQ ID NO: 440495 - DNA, 16 bp, M. musculus
tgagtgcgtgtgtgtg

SEQ ID NO: 440496 - DNA, 16 bp, M. musculus
tgagtgctcagattaa

SEQ ID NO: 440497 - DNA, 16 bp, M. musculus
tgagtgctgaaattaa

SEQ ID NO: 440498 - DNA, 16 bp, M. musculus
tgagtgctgagatgac

SEQ ID NO: 440499 - DNA, 16 bp, M. musculus
tgagtgctgggaacca

SEQ ID NO: 440500 - DNA, 16 bp, M. musculus
tgagtgctgggaatca

SEQ ID NO: 440501 - DNA, 16 bp, M. musculus
tgagtgcttaccatgt

SEQ ID NO: 440502 - DNA, 16 bp, M. musculus
tgagtggaacacacca

SEQ ID NO: 440503 - DNA, 16 bp, M. musculus
tgagtggaacagaact

SEQ ID NO: 440504 - DNA, 16 bp, M. musculus
tgagtggaggaacacc

SEQ ID NO: 440505 - DNA, 16 bp, M. musculus
tgagtggaggcccagc

SEQ ID NO: 440506 - DNA, 16 bp, M. musculus
tgagtggatcccagat

SEQ ID NO: 440507 - DNA, 16 bp, M. musculus
tgagtggatgggtgga

SEQ ID NO: 440508 - DNA, 16 bp, M. musculus
tgagtggctctgccag

SEQ ID NO: 440509 - DNA, 16 bp, M. musculus
tgagtgggttggagag

SEQ ID NO: 440510 - DNA, 16 bp, M. musculus
tgagtggtgctatccc

SEQ ID NO: 440511 - DNA, 16 bp, M. musculus
tgagtgtatatgtgtg

SEQ ID NO: 440512 - DNA, 16 bp, M. musculus
tgagtgtatgtctgtg

SEQ ID NO: 440513 - DNA, 16 bp, M. musculus
tgagtgtatgtgtgtg

SEQ ID NO: 440514 - DNA, 16 bp, M. musculus
tgagtgtgaagccagc

SEQ ID NO: 440515 - DNA, 16 bp, M. musculus
tgagtgtgaggctggg

SEQ ID NO: 440516 - DNA, 16 bp, M. musculus
tgagtgtgagtatgta

SEQ ID NO: 440517 - DNA, 16 bp, M. musculus
tgagtgtgcaagtgtg

SEQ ID NO: 440518 - DNA, 16 bp, M. musculus
tgagtgtgcacatgtg

SEQ ID NO: 440519 - DNA, 16 bp, M. musculus
tgagtgtgcaggtgtg

SEQ ID NO: 440520 - DNA, 16 bp, M. musculus
tgagtgtgcatgtgag

SEQ ID NO: 440521 - DNA, 16 bp, M. musculus
tgagtgtgcatgtgtg

SEQ ID NO: 440522 - DNA, 16 bp, M. musculus
tgagtgtggatgtgtg

SEQ ID NO: 440523 - DNA, 16 bp, M. musculus
tgagtgtggtaacaca

SEQ ID NO: 440524 - DNA, 16 bp, M. musculus
tgagtgtgtatgagtg

SEQ ID NO: 440525 - DNA, 16 bp, M. musculus
tgagtgtgtctgtgag

SEQ ID NO: 440526 - DNA, 16 bp, M. musculus
tgagtgtgtgaatgtg

SEQ ID NO: 440527 - DNA, 16 bp, M. musculus
tgagtgtgtgcatgag

SEQ ID NO: 440528 - DNA, 16 bp, M. musculus
tgagtgtgtgtatgtg

SEQ ID NO: 440529 - DNA, 16 bp, M. musculus
tgagtgtgtgtgcatg

SEQ ID NO: 440530 - DNA, 16 bp, M. musculus
tgagtgtgtgtgcctg

SEQ ID NO: 440531 - DNA, 16 bp, M. musculus
tgagtgtgtgtgtgca

SEQ ID NO: 440532 - DNA, 16 bp, M. musculus
tgagtgttctgtctgc

SEQ ID NO: 440533 - DNA, 16 bp, M. musculus
tgagtgttgagagctc

SEQ ID NO: 440534 - DNA, 16 bp, M. musculus
tgagtgtttgcatgtg

SEQ ID NO: 440535 - DNA, 16 bp, M. musculus
tgagttaattttgtgt

SEQ ID NO: 440536 - DNA, 16 bp, M. musculus
tgagttacagaacagc

SEQ ID NO: 440537 - DNA, 16 bp, M. musculus
tgagttagaggccagt

SEQ ID NO: 440538 - DNA, 16 bp, M. musculus
tgagttagtgtgtgtg

SEQ ID NO: 440539 - DNA, 16 bp, M. musculus
tgagttcaaaaccagc

SEQ ID NO: 440540 - DNA, 16 bp, M. musculus
tgagttcaaagccaac

SEQ ID NO: 440541 - DNA, 16 bp, M. musculus
tgagttcaaagctagc

SEQ ID NO: 440542 - DNA, 17 bp, M. musculus
tgagttcaagaccagct

SEQ ID NO: 440543 - DNA, 16 bp, M. musculus
tgagttcaagatcagc

SEQ ID NO: 440544 - DNA, 16 bp, M. musculus
tgagttcaagccctgg

SEQ ID NO: 440545 - DNA, 19 bp, M. musculus
tgagttcaaggccagccta

SEQ ID NO: 440546 - DNA, 16 bp, M. musculus
tgagttcaaggtcacc

SEQ ID NO: 440547 - DNA, 16 bp, M. musculus
tgagttcaagtccagc

SEQ ID NO: 440548 - DNA, 16 bp, M. musculus
tgagttcaatcccaag

SEQ ID NO: 440549 - DNA, 16 bp, M. musculus
tgagttcaatccccag

SEQ ID NO: 440550 - DNA, 16 bp, M. musculus
tgagttcaatccctag

SEQ ID NO: 440551 - DNA, 16 bp, M. musculus
tgagttcagatcctca

SEQ ID NO: 440552 - DNA, 16 bp, M. musculus
tgagttcagggacagc

SEQ ID NO: 440553 - DNA, 16 bp, M. musculus
tgagttcaggtcccag

SEQ ID NO: 440554 - DNA, 16 bp, M. musculus
tgagttcagttctcag

SEQ ID NO: 440555 - DNA, 16 bp, M. musculus
tgagttcagttcttag

SEQ ID NO: 440556 - DNA, 16 bp, M. musculus
tgagttcatggctagc

SEQ ID NO: 440557 - DNA, 16 bp, M. musculus
tgagttcattttgtat

SEQ ID NO: 440558 - DNA, 16 bp, M. musculus
tgagttccaagctagc

SEQ ID NO: 440559 - DNA, 16 bp, M. musculus
tgagttccaagtcagc

SEQ ID NO: 440560 - DNA, 16 bp, M. musculus
tgagttccagaccacc

SEQ ID NO: 440561 - DNA, 16 bp, M. musculus
tgagttccagaccagc

SEQ ID NO: 440562 - DNA, 16 bp, M. musculus
tgagttccagagcagc

SEQ ID NO: 440563 - DNA, 18 bp, M. musculus
tgagttccaggacagccc

SEQ ID NO: 440564 - DNA, 16 bp, M. musculus
tgagttccaggacagg

SEQ ID NO: 440565 - DNA, 16 bp, M. musculus
tgagttccaggactgc

SEQ ID NO: 440566 - DNA, 16 bp, M. musculus
tgagttccaggccacc

SEQ ID NO: 440567 - DNA, 16 bp, M. musculus
tgagttccaggccatc

SEQ ID NO: 440568 - DNA, 16 bp, M. musculus
tgagttccaggtcagt

SEQ ID NO: 440569 - DNA, 16 bp, M. musculus
tgagttccaggttcag

SEQ ID NO: 440570 - DNA, 16 bp, M. musculus
tgagttccattgtgat

SEQ ID NO: 440571 - DNA, 16 bp, M. musculus
tgagttcctgtcctga

SEQ ID NO: 440572 - DNA, 16 bp, M. musculus
tgagttcctgtctcaa

SEQ ID NO: 440573 - DNA, 16 bp, M. musculus
tgagttcctttttgat

SEQ ID NO: 440574 - DNA, 16 bp, M. musculus
tgagttcgaggccagt

SEQ ID NO: 440575 - DNA, 16 bp, M. musculus
tgagttcgattcctgg

SEQ ID NO: 440576 - DNA, 16 bp, M. musculus
tgagttctagaccagc

SEQ ID NO: 440577 - DNA, 16 bp, M. musculus
tgagttctaggacagt

SEQ ID NO: 440578 - DNA, 16 bp, M. musculus
tgagttctaggccagt

SEQ ID NO: 440579 - DNA, 16 bp, M. musculus
tgagttctaggctagt

SEQ ID NO: 440580 - DNA, 17 bp, M. musculus
tgagttctaggtcagct

SEQ ID NO: 440581 - DNA, 16 bp, M. musculus
tgagttctgagagttt

SEQ ID NO: 440582 - DNA, 16 bp, M. musculus
tgagttctgctgcttt

SEQ ID NO: 440583 - DNA, 16 bp, M. musculus
tgagttcttctttgat

SEQ ID NO: 440584 - DNA, 18 bp, M. musculus
tgagttcttttgtgattg

SEQ ID NO: 440585 - DNA, 16 bp, M. musculus
tgagttgatctttaaa

SEQ ID NO: 440586 - DNA, 16 bp, M. musculus
tgagttggaaattgat

SEQ ID NO: 440587 - DNA, 16 bp, M. musculus
tgagttggaatttgat

SEQ ID NO: 440588 - DNA, 16 bp, M. musculus
tgagttggaattttgg

SEQ ID NO: 440589 - DNA, 16 bp, M. musculus
tgagttggatccccag

SEQ ID NO: 440590 - DNA, 16 bp, M. musculus
tgagttggattcccag

SEQ ID NO: 440591 - DNA, 16 bp, M. musculus
tgagttggctcagcag

SEQ ID NO: 440592 - DNA, 16 bp, M. musculus
tgagttgggaatcttc

SEQ ID NO: 440593 - DNA, 16 bp, M. musculus
tgagttggggagcagg

SEQ ID NO: 440594 - DNA, 16 bp, M. musculus
tgagttgtaggccagc

SEQ ID NO: 440595 - DNA, 16 bp, M. musculus
tgagttgtatatttta

SEQ ID NO: 440596 - DNA, 16 bp, M. musculus
tgagttgtccccagag

SEQ ID NO: 440597 - DNA, 16 bp, M. musculus
tgagttgtttccagct

SEQ ID NO: 440598 - DNA, 16 bp, M. musculus
tgagtttaaggccaat

SEQ ID NO: 440599 - DNA, 16 bp, M. musculus
tgagtttaaggccagt

SEQ ID NO: 440600 - DNA, 16 bp, M. musculus
tgagtttaatccccag

SEQ ID NO: 440601 - DNA, 16 bp, M. musculus
tgagtttaatcttcag

SEQ ID NO: 440602 - DNA, 16 bp, M. musculus
tgagtttaattcccag

SEQ ID NO: 440603 - DNA, 16 bp, M. musculus
tgagtttagatcccca

SEQ ID NO: 440604 - DNA, 16 bp, M. musculus
tgagtttcagaacagt

SEQ ID NO: 440605 - DNA, 16 bp, M. musculus
tgagtttcaggatagt

SEQ ID NO: 440606 - DNA, 16 bp, M. musculus
tgagtttcaggccagc

SEQ ID NO: 440607 - DNA, 16 bp, M. musculus
tgagtttcagtccagc

SEQ ID NO: 440608 - DNA, 16 bp, M. musculus
tgagtttcatatcatg

SEQ ID NO: 440609 - DNA, 16 bp, M. musculus
tgagtttcatcttcag

SEQ ID NO: 440610 - DNA, 16 bp, M. musculus
tgagtttcatgacagc

SEQ ID NO: 440611 - DNA, 16 bp, M. musculus
tgagtttgaagacagc

SEQ ID NO: 440612 - DNA, 16 bp, M. musculus
tgagtttgaagtcagc

SEQ ID NO: 440613 - DNA, 16 bp, M. musculus
tgagtttgaatccagc

SEQ ID NO: 440614 - DNA, 16 bp, M. musculus
tgagtttgaatcctgg

SEQ ID NO: 440615 - DNA, 16 bp, M. musculus
tgagtttgagaccaat

SEQ ID NO: 440616 - DNA, 16 bp, M. musculus
tgagtttgagaccagc

SEQ ID NO: 440617 - DNA, 16 bp, M. musculus
tgagtttgagcctcag

SEQ ID NO: 440618 - DNA, 16 bp, M. musculus
tgagtttgaggacatc

SEQ ID NO: 440619 - DNA, 16 bp, M. musculus
tgagtttgaggccaac

SEQ ID NO: 440620 - DNA, 16 bp, M. musculus
tgagtttgatctctgg

SEQ ID NO: 440621 - DNA, 16 bp, M. musculus
tgagtttgatgtcagc

SEQ ID NO: 440622 - DNA, 16 bp, M. musculus
tgagtttgattccctg

SEQ ID NO: 440623 - DNA, 16 bp, M. musculus
tgagtttgctttctgt

SEQ ID NO: 440624 - DNA, 16 bp, M. musculus
tgagtttggggacagc

SEQ ID NO: 440625 - DNA, 16 bp, M. musculus
tgagtttggtcctcag

SEQ ID NO: 440626 - DNA, 16 bp, M. musculus
tgagtttggttcccac

SEQ ID NO: 440627 - DNA, 16 bp, M. musculus
tgagtttggttcccag

SEQ ID NO: 440628 - DNA, 16 bp, M. musculus
tgagttttcttcttac

SEQ ID NO: 440629 - DNA, 16 bp, M. musculus
tgagttttgtgaaggg

SEQ ID NO: 440630 - DNA, 16 bp, M. musculus
tgagtttttgaaacct

SEQ ID NO: 440631 - DNA, 16 bp, M. musculus
tgagttttttaactta

SEQ ID NO: 440632 - DNA, 16 bp, M. musculus
tgataaaaactgcttg

SEQ ID NO: 440633 - DNA, 16 bp, M. musculus
tgataaaagtcttaaa

SEQ ID NO: 440634 - DNA, 16 bp, M. musculus
tgataaaataccatga

SEQ ID NO: 440635 - DNA, 16 bp, M. musculus
tgataaaatacccaga

SEQ ID NO: 440636 - DNA, 16 bp, M. musculus
tgataaaatactctga

SEQ ID NO: 440637 - DNA, 16 bp, M. musculus
tgataaaattattcat

SEQ ID NO: 440638 - DNA, 16 bp, M. musculus
tgataaaattcttaaa

SEQ ID NO: 440639 - DNA, 16 bp, M. musculus
tgataaacaaattcag

SEQ ID NO: 440640 - DNA, 16 bp, M. musculus
tgataaacagctttgt

SEQ ID NO: 440641 - DNA, 16 bp, M. musculus
tgataaacagtgatat

SEQ ID NO: 440642 - DNA, 16 bp, M. musculus
tgataaacagtgatgt

SEQ ID NO: 440643 - DNA, 16 bp, M. musculus
tgataaagatgctgaa

SEQ ID NO: 440644 - DNA, 16 bp, M. musculus
tgataaatactttcag

SEQ ID NO: 440645 - DNA, 16 bp, M. musculus
tgataaatagcttcag

SEQ ID NO: 440646 - DNA, 16 bp, M. musculus
tgataaatatggatct

SEQ ID NO: 440647 - DNA, 16 bp, M. musculus
tgataaatttcacagc

SEQ ID NO: 440648 - DNA, 17 bp, M. musculus
tgataaccagctcctag

SEQ ID NO: 440649 - DNA, 16 bp, M. musculus
tgataacctgagtttg

SEQ ID NO: 440650 - DNA, 16 bp, M. musculus
tgataactaagaatgt

SEQ ID NO: 440651 - DNA, 16 bp, M. musculus
tgataactcagaatta

SEQ ID NO: 440652 - DNA, 16 bp, M. musculus
tgataagaacatcaag

SEQ ID NO: 440653 - DNA, 16 bp, M. musculus
tgataagaacctcaag

SEQ ID NO: 440654 - DNA, 16 bp, M. musculus
tgataagaacttcaag

SEQ ID NO: 440655 - DNA, 16 bp, M. musculus
tgataagtctgccttt

SEQ ID NO: 440656 - DNA, 16 bp, M. musculus
tgataatattttggat

SEQ ID NO: 440657 - DNA, 16 bp, M. musculus
tgataatgctgtcttt

SEQ ID NO: 440658 - DNA, 16 bp, M. musculus
tgataatggtagagga

SEQ ID NO: 440659 - DNA, 16 bp, M. musculus
tgataatgttgttctt

SEQ ID NO: 440660 - DNA, 16 bp, M. musculus
tgataattaagaatgt

SEQ ID NO: 440661 - DNA, 16 bp, M. musculus
tgatacaactcatgga

SEQ ID NO: 440662 - DNA, 16 bp, M. musculus
tgatacaagagtctgg

SEQ ID NO: 440663 - DNA, 16 bp, M. musculus
tgatacacagacatac

SEQ ID NO: 440664 - DNA, 16 bp, M. musculus
tgatacaccccacaga

SEQ ID NO: 440665 - DNA, 16 bp, M. musculus
tgatacattttaaaat

SEQ ID NO: 440666 - DNA, 16 bp, M. musculus
tgataccctcttcttg

SEQ ID NO: 440667 - DNA, 16 bp, M. musculus
tgataccctgtcttcc

SEQ ID NO: 440668 - DNA, 16 bp, M. musculus
tgatactaaaaggaaa

SEQ ID NO: 440669 - DNA, 16 bp, M. musculus
tgatactctgttttgc

SEQ ID NO: 440670 - DNA, 16 bp, M. musculus
tgatactggttagctg

SEQ ID NO: 440671 - DNA, 17 bp, M. musculus
tgatagaaatctgcact

SEQ ID NO: 440672 - DNA, 16 bp, M. musculus
tgatagaagctgagga

SEQ ID NO: 440673 - DNA, 16 bp, M. musculus
tgatagaggactaata

SEQ ID NO: 440674 - DNA, 16 bp, M. musculus
tgatagatgatagaga

SEQ ID NO: 440675 - DNA, 16 bp, M. musculus
tgatagcctccagata

SEQ ID NO: 440676 - DNA, 16 bp, M. musculus
tgataggaggccccca

SEQ ID NO: 440677 - DNA, 16 bp, M. musculus
tgataggcctgaccat

SEQ ID NO: 440678 - DNA, 16 bp, M. musculus
tgataggcctgactat

SEQ ID NO: 440679 - DNA, 16 bp, M. musculus
tgatagtgagtggaac

SEQ ID NO: 440680 - DNA, 16 bp, M. musculus
tgatagttaagaaaaa

SEQ ID NO: 440681 - DNA, 16 bp, M. musculus
tgatagtttgtatatg

SEQ ID NO: 440682 - DNA, 16 bp, M. musculus
tgatatagtaaaaatg

SEQ ID NO: 440683 - DNA, 16 bp, M. musculus
tgatatcagtgattcc

SEQ ID NO: 440684 - DNA, 16 bp, M. musculus
tgatatcattaatctt

SEQ ID NO: 440685 - DNA, 16 bp, M. musculus
tgatatctgtccagaa

SEQ ID NO: 440686 - DNA, 16 bp, M. musculus
tgatatgatgtgtctt

SEQ ID NO: 440687 - DNA, 16 bp, M. musculus
tgatatgatttaataa

SEQ ID NO: 440688 - DNA, 16 bp, M. musculus
tgatatgcaggatatg

SEQ ID NO: 440689 - DNA, 16 bp, M. musculus
tgatatgggtgctggg

SEQ ID NO: 440690 - DNA, 16 bp, M. musculus
tgatatggtagtatat

SEQ ID NO: 440691 - DNA, 16 bp, M. musculus
tgatatgtgacccccc

SEQ ID NO: 440692 - DNA, 16 bp, M. musculus
tgatatgtgacctctg

SEQ ID NO: 440693 - DNA, 16 bp, M. musculus
tgatatgtgatatgtg

SEQ ID NO: 440694 - DNA, 16 bp, M. musculus
tgatatgtttataaaa

SEQ ID NO: 440695 - DNA, 16 bp, M. musculus
tgatattacaatggct

SEQ ID NO: 440696 - DNA, 16 bp, M. musculus
tgatattcaaaatata

SEQ ID NO: 440697 - DNA, 16 bp, M. musculus
tgatattgttattctt

SEQ ID NO: 440698 - DNA, 16 bp, M. musculus
tgatattgttgtactt

SEQ ID NO: 440699 - DNA, 16 bp, M. musculus
tgatatttaaaccaca

SEQ ID NO: 440700 - DNA, 16 bp, M. musculus
tgatatttctccaaaa

SEQ ID NO: 440701 - DNA, 16 bp, M. musculus
tgatattttaaaatct

SEQ ID NO: 440702 - DNA, 16 bp, M. musculus
tgatattttgctgaaa

SEQ ID NO: 440703 - DNA, 16 bp, M. musculus
tgatcaaagaaaatgt

SEQ ID NO: 440704 - DNA, 16 bp, M. musculus
tgatcaacctgtctgt

SEQ ID NO: 440705 - DNA, 16 bp, M. musculus
tgatcaagaagcaagt

SEQ ID NO: 440706 - DNA, 16 bp, M. musculus
tgatcaagaattgata

SEQ ID NO: 440707 - DNA, 16 bp, M. musculus
tgatcaaggcagctct

SEQ ID NO: 440708 - DNA, 16 bp, M. musculus
tgatcaaggctccaag

SEQ ID NO: 440709 - DNA, 16 bp, M. musculus
tgatcaatattgctgc

SEQ ID NO: 440710 - DNA, 16 bp, M. musculus
tgatcaatgaaataga

SEQ ID NO: 440711 - DNA, 16 bp, M. musculus
tgatcaattttggaga

SEQ ID NO: 440712 - DNA, 16 bp, M. musculus
tgatcacagcagtaaa

SEQ ID NO: 440713 - DNA, 16 bp, M. musculus
tgatcagaagttcaag

SEQ ID NO: 440714 - DNA, 16 bp, M. musculus
tgatcagcacttgcac

SEQ ID NO: 440715 - DNA, 16 bp, M. musculus
tgatcatattcacctt

SEQ ID NO: 440716 - DNA, 16 bp, M. musculus
tgatcatccaccatga

SEQ ID NO: 440717 - DNA, 16 bp, M. musculus
tgatcatgaaaaattt

SEQ ID NO: 440718 - DNA, 16 bp, M. musculus
tgatcatgccaatcca

SEQ ID NO: 440719 - DNA, 16 bp, M. musculus
tgatcatggtggatga

SEQ ID NO: 440720 - DNA, 16 bp, M. musculus
tgatcatgtggtttta

SEQ ID NO: 440721 - DNA, 16 bp, M. musculus
tgatcatgtttttgtt

SEQ ID NO: 440722 - DNA, 17 bp, M. musculus
tgatcattcacttctgt

SEQ ID NO: 440723 - DNA, 16 bp, M. musculus
tgatcatttttactat

SEQ ID NO: 440724 - DNA, 16 bp, M. musculus
tgatcatttttctttc

SEQ ID NO: 440725 - DNA, 16 bp, M. musculus
tgatccaaatacaagg

SEQ ID NO: 440726 - DNA, 16 bp, M. musculus
tgatccactcacaaac

SEQ ID NO: 440727 - DNA, 16 bp, M. musculus
tgatccagaccttgag

SEQ ID NO: 440728 - DNA, 16 bp, M. musculus
tgatccatacctatct

SEQ ID NO: 440729 - DNA, 16 bp, M. musculus
tgatccatattactct

SEQ ID NO: 440730 - DNA, 23 bp, M. musculus
tgatccatccattagctgactgt

SEQ ID NO: 440731 - DNA, 16 bp, M. musculus
tgatccatcctgacca

SEQ ID NO: 440732 - DNA, 16 bp, M. musculus
tgatccatctctccag

SEQ ID NO: 440733 - DNA, 16 bp, M. musculus
tgatcccagagctact

SEQ ID NO: 440734 - DNA, 16 bp, M. musculus
tgatcccagtactcag

SEQ ID NO: 440735 - DNA, 16 bp, M. musculus
tgatcccctggaactg

SEQ ID NO: 440736 - DNA, 21 bp, M. musculus
tgatccctgtcttaggttggt

SEQ ID NO: 440737 - DNA, 16 bp, M. musculus
tgatcccttcattcct

SEQ ID NO: 440738 - DNA, 16 bp, M. musculus
tgatcctagcactcag

SEQ ID NO: 440739 - DNA, 16 bp, M. musculus
tgatcctataagaatt

SEQ ID NO: 440740 - DNA, 16 bp, M. musculus
tgatcctatgccacag

SEQ ID NO: 440741 - DNA, 16 bp, M. musculus
tgatcctcaggaccca

SEQ ID NO: 440742 - DNA, 16 bp, M. musculus
tgatcctcagtcctct

SEQ ID NO: 440743 - DNA, 17 bp, M. musculus
tgatcctcctgccccag

SEQ ID NO: 440744 - DNA, 16 bp, M. musculus
tgatcctcctgcctca

SEQ ID NO: 440745 - DNA, 16 bp, M. musculus
tgatcctcctgcctct

SEQ ID NO: 440746 - DNA, 16 bp, M. musculus
tgatcctccttcctct

SEQ ID NO: 440747 - DNA, 16 bp, M. musculus
tgatcctgcctcagcc

SEQ ID NO: 440748 - DNA, 16 bp, M. musculus
tgatcctggggaaaca

SEQ ID NO: 440749 - DNA, 16 bp, M. musculus
tgatcctgtgccacag

SEQ ID NO: 440750 - DNA, 16 bp, M. musculus
tgatccttctgcctcc

SEQ ID NO: 440751 - DNA, 16 bp, M. musculus
tgatctaaatgaaatc

SEQ ID NO: 440752 - DNA, 16 bp, M. musculus
tgatctacttgcctgt

SEQ ID NO: 440753 - DNA, 16 bp, M. musculus
tgatctcagaagctaa

SEQ ID NO: 440754 - DNA, 16 bp, M. musculus
tgatctcagcacttgg

SEQ ID NO: 440755 - DNA, 16 bp, M. musculus
tgatctccatcagaaa

SEQ ID NO: 440756 - DNA, 16 bp, M. musculus
tgatctcccatgctca

SEQ ID NO: 440757 - DNA, 16 bp, M. musculus
tgatctccctgcctgt

SEQ ID NO: 440758 - DNA, 16 bp, M. musculus
tgatctctctggctcc

SEQ ID NO: 440759 - DNA, 16 bp, M. musculus
tgatctctgctgctgt

SEQ ID NO: 440760 - DNA, 16 bp, M. musculus
tgatctctggaaccca

SEQ ID NO: 440761 - DNA, 16 bp, M. musculus
tgatctcttttgttgt

SEQ ID NO: 440762 - DNA, 16 bp, M. musculus
tgatctgacaccctct

SEQ ID NO: 440763 - DNA, 21 bp, M. musculus
tgatctgactccctcttctgg

SEQ ID NO: 440764 - DNA, 16 bp, M. musculus
tgatctgcaggcagag

SEQ ID NO: 440765 - DNA, 16 bp, M. musculus
tgatctgcaggcagca

SEQ ID NO: 440766 - DNA, 16 bp, M. musculus
tgatctgcattcctgc

SEQ ID NO: 440767 - DNA, 16 bp, M. musculus
tgatctggaagtataa

SEQ ID NO: 440768 - DNA, 16 bp, M. musculus
tgatctggggcacaag

SEQ ID NO: 440769 - DNA, 16 bp, M. musculus
tgatctgtaactccag

SEQ ID NO: 440770 - DNA, 16 bp, M. musculus
tgatctgtcagtaaag

SEQ ID NO: 440771 - DNA, 16 bp, M. musculus
tgatctgtttgagttc

SEQ ID NO: 440772 - DNA, 16 bp, M. musculus
tgatcttagagcatat

SEQ ID NO: 440773 - DNA, 16 bp, M. musculus
tgatcttagggcataa

SEQ ID NO: 440774 - DNA, 16 bp, M. musculus
tgatcttagttattct

SEQ ID NO: 440775 - DNA, 16 bp, M. musculus
tgatcttcaataataa

SEQ ID NO: 440776 - DNA, 16 bp, M. musculus
tgatcttcagaaccca

SEQ ID NO: 440777 - DNA, 16 bp, M. musculus
tgatcttccctcttct

SEQ ID NO: 440778 - DNA, 16 bp, M. musculus
tgatcttcctgagatg

SEQ ID NO: 440779 - DNA, 16 bp, M. musculus
tgatcttcctgcctca

SEQ ID NO: 440780 - DNA, 16 bp, M. musculus
tgatcttcgcttccct

SEQ ID NO: 440781 - DNA, 16 bp, M. musculus
tgatcttcttgcctct

SEQ ID NO: 440782 - DNA, 16 bp, M. musculus
tgatcttctttcttct

SEQ ID NO: 440783 - DNA, 16 bp, M. musculus
tgatcttctttggcag

SEQ ID NO: 440784 - DNA, 16 bp, M. musculus
tgatcttggtcattct

SEQ ID NO: 440785 - DNA, 16 bp, M. musculus
tgatctttcagaggac

SEQ ID NO: 440786 - DNA, 16 bp, M. musculus
tgatctttccaagagt

SEQ ID NO: 440787 - DNA, 16 bp, M. musculus
tgatctttcttcttct

SEQ ID NO: 440788 - DNA, 16 bp, M. musculus
tgatctttgtacaagg

SEQ ID NO: 440789 - DNA, 16 bp, M. musculus
tgatctttgtgagttt

SEQ ID NO: 440790 - DNA, 16 bp, M. musculus
tgatcttttcaaagaa

SEQ ID NO: 440791 - DNA, 16 bp, M. musculus
tgatctttttaaatat

SEQ ID NO: 440792 - DNA, 16 bp, M. musculus
tgatgaaaattttttg

SEQ ID NO: 440793 - DNA, 16 bp, M. musculus
tgatgaaacaaatgaa

SEQ ID NO: 440794 - DNA, 16 bp, M. musculus
tgatgaaacaccacaa

SEQ ID NO: 440795 - DNA, 16 bp, M. musculus
tgatgaaaggaatggg

SEQ ID NO: 440796 - DNA, 16 bp, M. musculus
tgatgaaatgccagac

SEQ ID NO: 440797 - DNA, 16 bp, M. musculus
tgatgaacagcaatgc

SEQ ID NO: 440798 - DNA, 16 bp, M. musculus
tgatgaacagcaatgt

SEQ ID NO: 440799 - DNA, 17 bp, M. musculus
tgatgaacagcagcatg

SEQ ID NO: 440800 - DNA, 20 bp, M. musculus
tgatgaacagcagtgtggaa

SEQ ID NO: 440801 - DNA, 16 bp, M. musculus
tgatgaacatcagtat

SEQ ID NO: 440802 - DNA, 16 bp, M. musculus
tgatgaacttggagac

SEQ ID NO: 440803 - DNA, 16 bp, M. musculus
tgatgaagaagccatg

SEQ ID NO: 440804 - DNA, 16 bp, M. musculus
tgatgaagaaggacac

SEQ ID NO: 440805 - DNA, 16 bp, M. musculus
tgatgaagagcagtat

SEQ ID NO: 440806 - DNA, 16 bp, M. musculus
tgatgaagatgatggt

SEQ ID NO: 440807 - DNA, 16 bp, M. musculus
tgatgaaggagctaga

SEQ ID NO: 440808 - DNA, 16 bp, M. musculus
tgatgaaggcactgta

SEQ ID NO: 440809 - DNA, 16 bp, M. musculus
tgatgaatagcagtgt

SEQ ID NO: 440810 - DNA, 16 bp, M. musculus
tgatgaatcagagaaa

SEQ ID NO: 440811 - DNA, 16 bp, M. musculus
tgatgaatttgagaat

SEQ ID NO: 440812 - DNA, 16 bp, M. musculus
tgatgacaaaattgtt

SEQ ID NO: 440813 - DNA, 16 bp, M. musculus
tgatgacaacaacaac

SEQ ID NO: 440814 - DNA, 16 bp, M. musculus
tgatgacaatgaagat

SEQ ID NO: 440815 - DNA, 16 bp, M. musculus
tgatgacaatgatgat

SEQ ID NO: 440816 - DNA, 16 bp, M. musculus
tgatgacaatggatta

SEQ ID NO: 440817 - DNA, 16 bp, M. musculus
tgatgaccaagctgca

SEQ ID NO: 440818 - DNA, 16 bp, M. musculus
tgatgacccaggactg

SEQ ID NO: 440819 - DNA, 16 bp, M. musculus
tgatgacctgagtctg

SEQ ID NO: 440820 - DNA, 16 bp, M. musculus
tgatgacgatgatgat

SEQ ID NO: 440821 - DNA, 16 bp, M. musculus
tgatgactacttctat

SEQ ID NO: 440822 - DNA, 16 bp, M. musculus
tgatgactatgaagtg

SEQ ID NO: 440823 - DNA, 16 bp, M. musculus
tgatgactatttctat

SEQ ID NO: 440824 - DNA, 16 bp, M. musculus
tgatgactattttgtt

SEQ ID NO: 440825 - DNA, 16 bp, M. musculus
tgatgactcagcagtt

SEQ ID NO: 440826 - DNA, 16 bp, M. musculus
tgatgactgagcaagg

SEQ ID NO: 440827 - DNA, 16 bp, M. musculus
tgatgacttgagttta

SEQ ID NO: 440828 - DNA, 16 bp, M. musculus
tgatgagaaaaatggg

SEQ ID NO: 440829 - DNA, 16 bp, M. musculus
tgatgagaaaatgcct

SEQ ID NO: 440830 - DNA, 16 bp, M. musculus
tgatgagaatgaagaa

SEQ ID NO: 440831 - DNA, 16 bp, M. musculus
tgatgagcagcagtgt

SEQ ID NO: 440832 - DNA, 16 bp, M. musculus
tgatgaggatgtggag

SEQ ID NO: 440833 - DNA, 18 bp, M. musculus
tgatgataatggactgaa

SEQ ID NO: 440834 - DNA, 16 bp, M. musculus
tgatgatcagagacag

SEQ ID NO: 440835 - DNA, 16 bp, M. musculus
tgatgatctgagttca

SEQ ID NO: 440836 - DNA, 16 bp, M. musculus
tgatgatgaagaggag

SEQ ID NO: 440837 - DNA, 16 bp, M. musculus
tgatgatgacaatgac

SEQ ID NO: 440838 - DNA, 16 bp, M. musculus
tgatgatgacaatgat

SEQ ID NO: 440839 - DNA, 19 bp, M. musculus
tgatgatgacgacgacgat

SEQ ID NO: 440840 - DNA, 16 bp, M. musculus
tgatgatgagatgatg

SEQ ID NO: 440841 - DNA, 16 bp, M. musculus
tgatgatgatgaagac

SEQ ID NO: 440842 - DNA, 18 bp, M. musculus
tgatgatgatgaggagga

SEQ ID NO: 440843 - DNA, 16 bp, M. musculus
tgatgatgatgataac

SEQ ID NO: 440844 - DNA, 19 bp, M. musculus
tgatgatgatgatgacgac

SEQ ID NO: 440845 - DNA, 16 bp, M. musculus
tgatgatgatgatgat

SEQ ID NO: 440846 - DNA, 16 bp, M. musculus
tgatgatgatgatgcc

SEQ ID NO: 440847 - DNA, 16 bp, M. musculus
tgatgatgatgatgtc

SEQ ID NO: 440848 - DNA, 16 bp, M. musculus
tgatgatgatgttgtt

SEQ ID NO: 440849 - DNA, 16 bp, M. musculus
tgatgatgccaagaag

SEQ ID NO: 440850 - DNA, 16 bp, M. musculus
tgatgatggtacagga

SEQ ID NO: 440851 - DNA, 16 bp, M. musculus
tgatgatggtgataaa

SEQ ID NO: 440852 - DNA, 16 bp, M. musculus
tgatgatggtggtggt

SEQ ID NO: 440853 - DNA, 16 bp, M. musculus
tgatgatggtgtgtgg

SEQ ID NO: 440854 - DNA, 17 bp, M. musculus
tgatgatgtaaagaatg

SEQ ID NO: 440855 - DNA, 16 bp, M. musculus
tgatgatgtaatagaa

SEQ ID NO: 440856 - DNA, 16 bp, M. musculus
tgatgatgtcacagaa

SEQ ID NO: 440857 - DNA, 16 bp, M. musculus
tgatgatgtgatgatg

SEQ ID NO: 440858 - DNA, 16 bp, M. musculus
tgatgatgttgagtgg

SEQ ID NO: 440859 - DNA, 16 bp, M. musculus
tgatgatgttgatggt

SEQ ID NO: 440860 - DNA, 16 bp, M. musculus
tgatgattaagaatgt

SEQ ID NO: 440861 - DNA, 16 bp, M. musculus
tgatgattggacagat

SEQ ID NO: 440862 - DNA, 16 bp, M. musculus
tgatgcacatatgaat

SEQ ID NO: 440863 - DNA, 16 bp, M. musculus
tgatgcacctgctgca

SEQ ID NO: 440864 - DNA, 16 bp, M. musculus
tgatgcagaaaccatg

SEQ ID NO: 440865 - DNA, 17 bp, M. musculus
tgatgcagagccatgga

SEQ ID NO: 440866 - DNA, 16 bp, M. musculus
tgatgcagaggccaag

SEQ ID NO: 440867 - DNA, 17 bp, M. musculus
tgatgcagaggccatga

SEQ ID NO: 440868 - DNA, 16 bp, M. musculus
tgatgccagcactcag

SEQ ID NO: 440869 - DNA, 16 bp, M. musculus
tgatgccataaagttg

SEQ ID NO: 440870 - DNA, 16 bp, M. musculus
tgatgccatgctccca

SEQ ID NO: 440871 - DNA, 16 bp, M. musculus
tgatgcccaataaggc

SEQ ID NO: 440872 - DNA, 16 bp, M. musculus
tgatgccctcttctga

SEQ ID NO: 440873 - DNA, 16 bp, M. musculus
tgatgcctctggcctc

SEQ ID NO: 440874 - DNA, 16 bp, M. musculus
tgatgcctttatgaga

SEQ ID NO: 440875 - DNA, 16 bp, M. musculus
tgatgctaactttgac

SEQ ID NO: 440876 - DNA, 17 bp, M. musculus
tgatgctcacatctatg

SEQ ID NO: 440877 - DNA, 16 bp, M. musculus
tgatgctctcttctga

SEQ ID NO: 440878 - DNA, 16 bp, M. musculus
tgatgctcttttctgg

SEQ ID NO: 440879 - DNA, 16 bp, M. musculus
tgatgctggagaagaa

SEQ ID NO: 440880 - DNA, 16 bp, M. musculus
tgatgctggagaagga

SEQ ID NO: 440881 - DNA, 16 bp, M. musculus
tgatgctggtgctggt

SEQ ID NO: 440882 - DNA, 16 bp, M. musculus
tgatgctgtgttgtgc

SEQ ID NO: 440883 - DNA, 16 bp, M. musculus
tgatgctgttctcttc

SEQ ID NO: 440884 - DNA, 16 bp, M. musculus
tgatgctgttcttggt

SEQ ID NO: 440885 - DNA, 16 bp, M. musculus
tgatgcttgaattcat

SEQ ID NO: 440886 - DNA, 16 bp, M. musculus
tgatgcttgcatatat

SEQ ID NO: 440887 - DNA, 16 bp, M. musculus
tgatgcttgcatctat

SEQ ID NO: 440888 - DNA, 16 bp, M. musculus
tgatgcttgcttctat

SEQ ID NO: 440889 - DNA, 16 bp, M. musculus
tgatggaagaagagaa

SEQ ID NO: 440890 - DNA, 16 bp, M. musculus
tgatggaagcagatgc

SEQ ID NO: 440891 - DNA, 16 bp, M. musculus
tgatggaagcctgata

SEQ ID NO: 440892 - DNA, 16 bp, M. musculus
tgatggaaggagggaa

SEQ ID NO: 440893 - DNA, 16 bp, M. musculus
tgatggaatcaccatg

SEQ ID NO: 440894 - DNA, 16 bp, M. musculus
tgatggaattaaaggc

SEQ ID NO: 440895 - DNA, 16 bp, M. musculus
tgatggagaaggagct

SEQ ID NO: 440896 - DNA, 16 bp, M. musculus
tgatggagcagaaata

SEQ ID NO: 440897 - DNA, 16 bp, M. musculus
tgatggagcagagact

SEQ ID NO: 440898 - DNA, 16 bp, M. musculus
tgatggagctggagag

SEQ ID NO: 440899 - DNA, 17 bp, M. musculus
tgatggatgaccatttt

SEQ ID NO: 440900 - DNA, 16 bp, M. musculus
tgatggatttcaatat

SEQ ID NO: 440901 - DNA, 16 bp, M. musculus
tgatggcacaggcctg

SEQ ID NO: 440902 - DNA, 16 bp, M. musculus
tgatggcatatgcctt

SEQ ID NO: 440903 - DNA, 16 bp, M. musculus
tgatggccaaccaggc

SEQ ID NO: 440904 - DNA, 17 bp, M. musculus
tgatggccaactgggcc

SEQ ID NO: 440905 - DNA, 22 bp, M. musculus
tgatggccgactaggccatctt

SEQ ID NO: 440906 - DNA, 22 bp, M. musculus
tgatggccgactaggtcatctt

SEQ ID NO: 440907 - DNA, 20 bp, M. musculus
tgatggccggctaggccatc

SEQ ID NO: 440908 - DNA, 16 bp, M. musculus
tgatggcctgagttca

SEQ ID NO: 440909 - DNA, 16 bp, M. musculus
tgatggctagttttaa

SEQ ID NO: 440910 - DNA, 16 bp, M. musculus
tgatggctgacgaggc

SEQ ID NO: 440911 - DNA, 16 bp, M. musculus
tgatggctgtgagcat

SEQ ID NO: 440912 - DNA, 16 bp, M. musculus
tgatggctgtgagcca

SEQ ID NO: 440913 - DNA, 16 bp, M. musculus
tgatggcttcagaaca

SEQ ID NO: 440914 - DNA, 16 bp, M. musculus
tgatggcttctggagg

SEQ ID NO: 440915 - DNA, 16 bp, M. musculus
tgatggcttctggtgg

SEQ ID NO: 440916 - DNA, 16 bp, M. musculus
tgatgggagcagatgc

SEQ ID NO: 440917 - DNA, 16 bp, M. musculus
tgatgggagccctggg

SEQ ID NO: 440918 - DNA, 16 bp, M. musculus
tgatgggattacaggc

SEQ ID NO: 440919 - DNA, 16 bp, M. musculus
tgatggggctggagag

SEQ ID NO: 440920 - DNA, 16 bp, M. musculus
tgatgggggaggggca

SEQ ID NO: 440921 - DNA, 18 bp, M. musculus
tgatggtaatggactgaa

SEQ ID NO: 440922 - DNA, 16 bp, M. musculus
tgatggtagagctttg

SEQ ID NO: 440923 - DNA, 16 bp, M. musculus
tgatggtctgtatatg

SEQ ID NO: 440924 - DNA, 16 bp, M. musculus
tgatggtgagaggtct

SEQ ID NO: 440925 - DNA, 16 bp, M. musculus
tgatggtgatgatgat

SEQ ID NO: 440926 - DNA, 16 bp, M. musculus
tgatggtgatggtgac

SEQ ID NO: 440927 - DNA, 16 bp, M. musculus
tgatggtgatggtgat

SEQ ID NO: 440928 - DNA, 16 bp, M. musculus
tgatggtgcatacctg

SEQ ID NO: 440929 - DNA, 16 bp, M. musculus
tgatggtgctgggtgg

SEQ ID NO: 440930 - DNA, 16 bp, M. musculus
tgatggtggtggtgat

SEQ ID NO: 440931 - DNA, 16 bp, M. musculus
tgatggtgtttggatt

SEQ ID NO: 440932 - DNA, 16 bp, M. musculus
tgatggttaattttga

SEQ ID NO: 440933 - DNA, 16 bp, M. musculus
tgatggtttgcatatg

SEQ ID NO: 440934 - DNA, 16 bp, M. musculus
tgatgtaaaagcatga

SEQ ID NO: 440935 - DNA, 24 bp, M. musculus
tgatgtaacaattattagaggaca

SEQ ID NO: 440936 - DNA, 16 bp, M. musculus
tgatgtagagaccatg

SEQ ID NO: 440937 - DNA, 16 bp, M. musculus
tgatgtagctgtctct

SEQ ID NO: 440938 - DNA, 16 bp, M. musculus
tgatgtattttcatat

SEQ ID NO: 440939 - DNA, 16 bp, M. musculus
tgatgtcaccaccact

SEQ ID NO: 440940 - DNA, 16 bp, M. musculus
tgatgtcagttatccc

SEQ ID NO: 440941 - DNA, 16 bp, M. musculus
tgatgtcattattttt

SEQ ID NO: 440942 - DNA, 16 bp, M. musculus
tgatgtccaacaaggc

SEQ ID NO: 440943 - DNA, 16 bp, M. musculus
tgatgtcctccaggtc

SEQ ID NO: 440944 - DNA, 16 bp, M. musculus
tgatgtcctgtcttct

SEQ ID NO: 440945 - DNA, 16 bp, M. musculus
tgatgtctcttcacag

SEQ ID NO: 440946 - DNA, 16 bp, M. musculus
tgatgtgaaatctcag

SEQ ID NO: 440947 - DNA, 16 bp, M. musculus
tgatgtgcatttctct

SEQ ID NO: 440948 - DNA, 16 bp, M. musculus
tgatgtgcctttcctg

SEQ ID NO: 440949 - DNA, 16 bp, M. musculus
tgatgtgctgagaaga

SEQ ID NO: 440950 - DNA, 16 bp, M. musculus
tgatgtggaaaggccc

SEQ ID NO: 440951 - DNA, 16 bp, M. musculus
tgatgtggatgctgga

SEQ ID NO: 440952 - DNA, 16 bp, M. musculus
tgatgtgggaaggctc

SEQ ID NO: 440953 - DNA, 16 bp, M. musculus
tgatgtgtgtctgaag

SEQ ID NO: 440954 - DNA, 16 bp, M. musculus
tgatgtgtgtgtgtat

SEQ ID NO: 440955 - DNA, 16 bp, M. musculus
tgatgtgtttctggat

SEQ ID NO: 440956 - DNA, 16 bp, M. musculus
tgatgttccctgagcc

SEQ ID NO: 440957 - DNA, 16 bp, M. musculus
tgatgttgaagaacag

SEQ ID NO: 440958 - DNA, 19 bp, M. musculus
tgatgttgttaattaggat

SEQ ID NO: 440959 - DNA, 16 bp, M. musculus
tgatgtttggctgtga

SEQ ID NO: 440960 - DNA, 16 bp, M. musculus
tgatgtttggctgtgg

SEQ ID NO: 440961 - DNA, 16 bp, M. musculus
tgattaaaagcaactt

SEQ ID NO: 440962 - DNA, 16 bp, M. musculus
tgattaaaggtgtgta

SEQ ID NO: 440963 - DNA, 16 bp, M. musculus
tgattaaaggtgtgtg

SEQ ID NO: 440964 - DNA, 21 bp, M. musculus
tgattaagaagagaccagcat

SEQ ID NO: 440965 - DNA, 16 bp, M. musculus
tgattaatggaattga

SEQ ID NO: 440966 - DNA, 16 bp, M. musculus
tgattacctgagttca

SEQ ID NO: 440967 - DNA, 16 bp, M. musculus
tgattacttcctgggt

SEQ ID NO: 440968 - DNA, 16 bp, M. musculus
tgattactttcttctc

SEQ ID NO: 440969 - DNA, 16 bp, M. musculus
tgattatagttttccc

SEQ ID NO: 440970 - DNA, 16 bp, M. musculus
tgattattttattctc

SEQ ID NO: 440971 - DNA, 16 bp, M. musculus
tgattattttatttca

SEQ ID NO: 440972 - DNA, 16 bp, M. musculus
tgattcaaatttggta

SEQ ID NO: 440973 - DNA, 16 bp, M. musculus
tgattcacacttctat

SEQ ID NO: 440974 - DNA, 16 bp, M. musculus
tgattcacattcttct

SEQ ID NO: 440975 - DNA, 16 bp, M. musculus
tgattcagtgtatctg

SEQ ID NO: 440976 - DNA, 16 bp, M. musculus
tgattcatcacttttt

SEQ ID NO: 440977 - DNA, 16 bp, M. musculus
tgattccaccagtggt

SEQ ID NO: 440978 - DNA, 16 bp, M. musculus
tgattcccagcatcct

SEQ ID NO: 440979 - DNA, 16 bp, M. musculus
tgattcccaggagctc

SEQ ID NO: 440980 - DNA, 16 bp, M. musculus
tgattcctggaactca

SEQ ID NO: 440981 - DNA, 16 bp, M. musculus
tgattctaaagatgat

SEQ ID NO: 440982 - DNA, 16 bp, M. musculus
tgattctagtgggatt

SEQ ID NO: 440983 - DNA, 16 bp, M. musculus
tgattctattttgtgg

SEQ ID NO: 440984 - DNA, 16 bp, M. musculus
tgattctcaccatgtg

SEQ ID NO: 440985 - DNA, 16 bp, M. musculus
tgattctcctgggaat

SEQ ID NO: 440986 - DNA, 16 bp, M. musculus
tgattctgagctacta

SEQ ID NO: 440987 - DNA, 16 bp, M. musculus
tgattctgccaagaca

SEQ ID NO: 440988 - DNA, 16 bp, M. musculus
tgattctgccagaggt

SEQ ID NO: 440989 - DNA, 16 bp, M. musculus
tgattctgtgccttct

SEQ ID NO: 440990 - DNA, 17 bp, M. musculus
tgattctgttagcctct

SEQ ID NO: 440991 - DNA, 16 bp, M. musculus
tgattctgttgatctt

SEQ ID NO: 440992 - DNA, 16 bp, M. musculus
tgattcttcctctctc

SEQ ID NO: 440993 - DNA, 16 bp, M. musculus
tgattctttgaataat

SEQ ID NO: 440994 - DNA, 16 bp, M. musculus
tgattctttgaatact

SEQ ID NO: 440995 - DNA, 16 bp, M. musculus
tgattgacatgggagg

SEQ ID NO: 440996 - DNA, 16 bp, M. musculus
tgattgatataggagg

SEQ ID NO: 440997 - DNA, 16 bp, M. musculus
tgattgatgattgatg

SEQ ID NO: 440998 - DNA, 16 bp, M. musculus
tgattgatggggaagg

SEQ ID NO: 440999 - DNA, 16 bp, M. musculus
tgattgatgtagaagg

SEQ ID NO: 441000 - DNA, 16 bp, M. musculus
tgattgatgtgggagg

SEQ ID NO: 441001 - DNA, 16 bp, M. musculus
tgattgattgagacag

SEQ ID NO: 441002 - DNA, 16 bp, M. musculus
tgattgccattttgtc

SEQ ID NO: 441003 - DNA, 16 bp, M. musculus
tgattgctgagattaa

SEQ ID NO: 441004 - DNA, 16 bp, M. musculus
tgattgctttaatgta

SEQ ID NO: 441005 - DNA, 16 bp, M. musculus
tgattgcttttctccc

SEQ ID NO: 441006 - DNA, 16 bp, M. musculus
tgattgcttttctcct

SEQ ID NO: 441007 - DNA, 16 bp, M. musculus
tgattggacagagaaa

SEQ ID NO: 441008 - DNA, 16 bp, M. musculus
tgattggacagggaaa

SEQ ID NO: 441009 - DNA, 16 bp, M. musculus
tgattggcagaacagt

SEQ ID NO: 441010 - DNA, 16 bp, M. musculus
tgattggcaggaagca

SEQ ID NO: 441011 - DNA, 16 bp, M. musculus
tgattggctgagagca

SEQ ID NO: 441012 - DNA, 16 bp, M. musculus
tgattggcttacctca

SEQ ID NO: 441013 - DNA, 16 bp, M. musculus
tgattggctttaataa

SEQ ID NO: 441014 - DNA, 16 bp, M. musculus
tgattgggaaataaag

SEQ ID NO: 441015 - DNA, 31 bp, M. musculus
tgattgggaggagtcagtagggtatttaagg

SEQ ID NO: 441016 - DNA, 16 bp, M. musculus
tgattgggcagaaaaa

SEQ ID NO: 441017 - DNA, 16 bp, M. musculus
tgattggtcaataaag

SEQ ID NO: 441018 - DNA, 16 bp, M. musculus
tgattggtgagacatg

SEQ ID NO: 441019 - DNA, 16 bp, M. musculus
tgattggtggaacagt

SEQ ID NO: 441020 - DNA, 16 bp, M. musculus
tgattggtgtaaagta

SEQ ID NO: 441021 - DNA, 16 bp, M. musculus
tgattggtgtgggaag

SEQ ID NO: 441022 - DNA, 16 bp, M. musculus
tgattggtttaataaa

SEQ ID NO: 441023 - DNA, 16 bp, M. musculus
tgattgtattttccta

SEQ ID NO: 441024 - DNA, 16 bp, M. musculus
tgattgtatttttctg

SEQ ID NO: 441025 - DNA, 16 bp, M. musculus
tgattgtgaacatcca

SEQ ID NO: 441026 - DNA, 16 bp, M. musculus
tgattgtgagccacct

SEQ ID NO: 441027 - DNA, 16 bp, M. musculus
tgattgtgatgtagaa

SEQ ID NO: 441028 - DNA, 16 bp, M. musculus
tgattgtgtaaaattg

SEQ ID NO: 441029 - DNA, 16 bp, M. musculus
tgattgtgttcttaca

SEQ ID NO: 441030 - DNA, 16 bp, M. musculus
tgattgttgtgtccat

SEQ ID NO: 441031 - DNA, 16 bp, M. musculus
tgattgttgtttccat

SEQ ID NO: 441032 - DNA, 16 bp, M. musculus
tgatttaaaaatcaca

SEQ ID NO: 441033 - DNA, 16 bp, M. musculus
tgatttaaaagatgct

SEQ ID NO: 441034 - DNA, 16 bp, M. musculus
tgatttaaaatcaaat

SEQ ID NO: 441035 - DNA, 16 bp, M. musculus
tgatttaaacaaacaa

SEQ ID NO: 441036 - DNA, 16 bp, M. musculus
tgatttaaataatgtg

SEQ ID NO: 441037 - DNA, 16 bp, M. musculus
tgatttaggatatgta

SEQ ID NO: 441038 - DNA, 16 bp, M. musculus
tgatttatatgttgat

SEQ ID NO: 441039 - DNA, 16 bp, M. musculus
tgatttattgattgat

SEQ ID NO: 441040 - DNA, 16 bp, M. musculus
tgatttatttacttat

SEQ ID NO: 441041 - DNA, 16 bp, M. musculus
tgatttcacccctgtg

SEQ ID NO: 441042 - DNA, 16 bp, M. musculus
tgatttcatttattta

SEQ ID NO: 441043 - DNA, 16 bp, M. musculus
tgatttccagagtgac

SEQ ID NO: 441044 - DNA, 16 bp, M. musculus
tgatttccagagtttt

SEQ ID NO: 441045 - DNA, 16 bp, M. musculus
tgatttcctgacaatg

SEQ ID NO: 441046 - DNA, 16 bp, M. musculus
tgatttcctggcatct

SEQ ID NO: 441047 - DNA, 16 bp, M. musculus
tgatttctctgtgtcc

SEQ ID NO: 441048 - DNA, 16 bp, M. musculus
tgatttctggagagag

SEQ ID NO: 441049 - DNA, 16 bp, M. musculus
tgatttcttctttgac

SEQ ID NO: 441050 - DNA, 16 bp, M. musculus
tgatttcttttctcct

SEQ ID NO: 441051 - DNA, 16 bp, M. musculus
tgatttctttttaaaa

SEQ ID NO: 441052 - DNA, 16 bp, M. musculus
tgatttctttttcagt

SEQ ID NO: 441053 - DNA, 16 bp, M. musculus
tgatttgaaaacaaaa

SEQ ID NO: 441054 - DNA, 16 bp, M. musculus
tgatttgaaaatattt

SEQ ID NO: 441055 - DNA, 16 bp, M. musculus
tgatttgaactgtggg

SEQ ID NO: 441056 - DNA, 16 bp, M. musculus
tgatttgaatgagaaa

SEQ ID NO: 441057 - DNA, 16 bp, M. musculus
tgatttgaatgagaac

SEQ ID NO: 441058 - DNA, 16 bp, M. musculus
tgatttgcatctccct

SEQ ID NO: 441059 - DNA, 16 bp, M. musculus
tgatttgcctcatgct

SEQ ID NO: 441060 - DNA, 16 bp, M. musculus
tgatttgcctcgtgct

SEQ ID NO: 441061 - DNA, 16 bp, M. musculus
tgatttgtactcactg

SEQ ID NO: 441062 - DNA, 16 bp, M. musculus
tgatttgtagctccat

SEQ ID NO: 441063 - DNA, 17 bp, M. musculus
tgattttaaatcagagt

SEQ ID NO: 441064 - DNA, 16 bp, M. musculus
tgattttagtgaaaat

SEQ ID NO: 441065 - DNA, 16 bp, M. musculus
tgattttatatataca

SEQ ID NO: 441066 - DNA, 16 bp, M. musculus
tgattttattttcaaa

SEQ ID NO: 441067 - DNA, 16 bp, M. musculus
tgattttcagttttct

SEQ ID NO: 441068 - DNA, 16 bp, M. musculus
tgattttcattttcct

SEQ ID NO: 441069 - DNA, 16 bp, M. musculus
tgattttcccaaagaa

SEQ ID NO: 441070 - DNA, 16 bp, M. musculus
tgattttcctcctgtt

SEQ ID NO: 441071 - DNA, 16 bp, M. musculus
tgattttcctgtctca

SEQ ID NO: 441072 - DNA, 16 bp, M. musculus
tgattttctcaaggaa

SEQ ID NO: 441073 - DNA, 16 bp, M. musculus
tgattttctcagagaa

SEQ ID NO: 441074 - DNA, 16 bp, M. musculus
tgattttctgtagtct

SEQ ID NO: 441075 - DNA, 16 bp, M. musculus
tgattttcttgaagaa

SEQ ID NO: 441076 - DNA, 16 bp, M. musculus
tgattttctttaagga

SEQ ID NO: 441077 - DNA, 16 bp, M. musculus
tgattttcttttaaat

SEQ ID NO: 441078 - DNA, 16 bp, M. musculus
tgattttcttttccct

SEQ ID NO: 441079 - DNA, 16 bp, M. musculus
tgattttgaacttctg

SEQ ID NO: 441080 - DNA, 16 bp, M. musculus
tgattttgctactgtt

SEQ ID NO: 441081 - DNA, 16 bp, M. musculus
tgattttggtaattag

SEQ ID NO: 441082 - DNA, 16 bp, M. musculus
tgattttggtcatggt

SEQ ID NO: 441083 - DNA, 16 bp, M. musculus
tgattttgtcatggaa

SEQ ID NO: 441084 - DNA, 16 bp, M. musculus
tgattttgttgaaaat

SEQ ID NO: 441085 - DNA, 16 bp, M. musculus
tgattttgttgaagac

SEQ ID NO: 441086 - DNA, 16 bp, M. musculus
tgatttttaaaacatt

SEQ ID NO: 441087 - DNA, 16 bp, M. musculus
tgatttttaaagagaa

SEQ ID NO: 441088 - DNA, 16 bp, M. musculus
tgatttttaacaaaaa

SEQ ID NO: 441089 - DNA, 16 bp, M. musculus
tgatttttataaagaa

SEQ ID NO: 441090 - DNA, 16 bp, M. musculus
tgatttttctctttcc

SEQ ID NO: 441091 - DNA, 17 bp, M. musculus
tgatttttgcttttgat

SEQ ID NO: 441092 - DNA, 16 bp, M. musculus
tgattttttaaaaaca

SEQ ID NO: 441093 - DNA, 16 bp, M. musculus
tgattttttaaaaact

SEQ ID NO: 441094 - DNA, 16 bp, M. musculus
tgatttttttaatgca

SEQ ID NO: 441095 - DNA, 16 bp, M. musculus
tgatttttttcaaaat

SEQ ID NO: 441096 - DNA, 16 bp, M. musculus
tgatttttttcccctt

SEQ ID NO: 441097 - DNA, 16 bp, M. musculus
tgatttttttccctct

SEQ ID NO: 441098 - DNA, 16 bp, M. musculus
tgatttttttcctctg

SEQ ID NO: 441099 - DNA, 16 bp, M. musculus
tgatttttttttccaa

SEQ ID NO: 441100 - DNA, 16 bp, M. musculus
tgcaaaaaaaaatttt

SEQ ID NO: 441101 - DNA, 16 bp, M. musculus
tgcaaaaaattttcat

SEQ ID NO: 441102 - DNA, 16 bp, M. musculus
tgcaaaaagtgatagt

SEQ ID NO: 441103 - DNA, 16 bp, M. musculus
tgcaaaaatactcaac

SEQ ID NO: 441104 - DNA, 16 bp, M. musculus
tgcaaaacacaaaaag

SEQ ID NO: 441105 - DNA, 16 bp, M. musculus
tgcaaaacacaagaaa

SEQ ID NO: 441106 - DNA, 16 bp, M. musculus
tgcaaaacagaagaaa

SEQ ID NO: 441107 - DNA, 16 bp, M. musculus
tgcaaaaccagccagt

SEQ ID NO: 441108 - DNA, 16 bp, M. musculus
tgcaaaactcatgaaa

SEQ ID NO: 441109 - DNA, 16 bp, M. musculus
tgcaaaagaaaacaca

SEQ ID NO: 441110 - DNA, 16 bp, M. musculus
tgcaaaagaggccagc

SEQ ID NO: 441111 - DNA, 16 bp, M. musculus
tgcaaaagatatttaa

SEQ ID NO: 441112 - DNA, 16 bp, M. musculus
tgcaaaaggtatttaa

SEQ ID NO: 441113 - DNA, 16 bp, M. musculus
tgcaaaatacatgaaa

SEQ ID NO: 441114 - DNA, 16 bp, M. musculus
tgcaaacacacgaggt

SEQ ID NO: 441115 - DNA, 16 bp, M. musculus
tgcaaacatgaggact

SEQ ID NO: 441116 - DNA, 16 bp, M. musculus
tgcaaacatggaagaa

SEQ ID NO: 441117 - DNA, 16 bp, M. musculus
tgcaaacatttatttt

SEQ ID NO: 441118 - DNA, 17 bp, M. musculus
tgcaaaccacttcagct

SEQ ID NO: 441119 - DNA, 16 bp, M. musculus
tgcaaaccccctcaga

SEQ ID NO: 441120 - DNA, 16 bp, M. musculus
tgcaaacctctttagc

SEQ ID NO: 441121 - DNA, 17 bp, M. musculus
tgcaaactcagatctca

SEQ ID NO: 441122 - DNA, 16 bp, M. musculus
tgcaaactgaaataaa

SEQ ID NO: 441123 - DNA, 16 bp, M. musculus
tgcaaactgatattaa

SEQ ID NO: 441124 - DNA, 16 bp, M. musculus
tgcaaactgcaagagg

SEQ ID NO: 441125 - DNA, 16 bp, M. musculus
tgcaaactttacatgc

SEQ ID NO: 441126 - DNA, 23 bp, M. musculus
tgcaaactttatctgcctcagta

SEQ ID NO: 441127 - DNA, 16 bp, M. musculus
tgcaaagactgtggga

SEQ ID NO: 441128 - DNA, 16 bp, M. musculus
tgcaaagagaaagaaa

SEQ ID NO: 441129 - DNA, 16 bp, M. musculus
tgcaaagattttgctt

SEQ ID NO: 441130 - DNA, 16 bp, M. musculus
tgcaaagcctttccca

SEQ ID NO: 441131 - DNA, 16 bp, M. musculus
tgcaaagcttctgaaa

SEQ ID NO: 441132 - DNA, 16 bp, M. musculus
tgcaaagcttttgcaa

SEQ ID NO: 441133 - DNA, 16 bp, M. musculus
tgcaaaggccctgagg

SEQ ID NO: 441134 - DNA, 16 bp, M. musculus
tgcaaaggtgctcttt

SEQ ID NO: 441135 - DNA, 16 bp, M. musculus
tgcaaataaaattaaa

SEQ ID NO: 441136 - DNA, 16 bp, M. musculus
tgcaaataaatttctt

SEQ ID NO: 441137 - DNA, 16 bp, M. musculus
tgcaaatatacataca

SEQ ID NO: 441138 - DNA, 16 bp, M. musculus
tgcaaatatcttcatc

SEQ ID NO: 441139 - DNA, 16 bp, M. musculus
tgcaaatatgtatgtg

SEQ ID NO: 441140 - DNA, 16 bp, M. musculus
tgcaaatcaaaaccac

SEQ ID NO: 441141 - DNA, 16 bp, M. musculus
tgcaaatcaaaatgat

SEQ ID NO: 441142 - DNA, 16 bp, M. musculus
tgcaaatcaacacaac

SEQ ID NO: 441143 - DNA, 16 bp, M. musculus
tgcaaatcagatattt

SEQ ID NO: 441144 - DNA, 16 bp, M. musculus
tgcaaattaaggtgcc

SEQ ID NO: 441145 - DNA, 16 bp, M. musculus
tgcaaattccttcagc

SEQ ID NO: 441146 - DNA, 16 bp, M. musculus
tgcaaattgctcttcc

SEQ ID NO: 441147 - DNA, 16 bp, M. musculus
tgcaaattgtgatatt

SEQ ID NO: 441148 - DNA, 16 bp, M. musculus
tgcaaatttatctttt

SEQ ID NO: 441149 - DNA, 16 bp, M. musculus
tgcaacacacttctct

SEQ ID NO: 441150 - DNA, 16 bp, M. musculus
tgcaacaccacacctg

SEQ ID NO: 441151 - DNA, 32 bp, M. musculus
tgcaacaccgggctcactccctgcctatctac

SEQ ID NO: 441152 - DNA, 16 bp, M. musculus
tgcaacagctcctgct

SEQ ID NO: 441153 - DNA, 22 bp, M. musculus
tgcaaccacatggtggctcaca

SEQ ID NO: 441154 - DNA, 16 bp, M. musculus
tgcaaccccaccagca

SEQ ID NO: 441155 - DNA, 17 bp, M. musculus
tgcaacccccctcagct

SEQ ID NO: 441156 - DNA, 16 bp, M. musculus
tgcaaccctgtaggtg

SEQ ID NO: 441157 - DNA, 16 bp, M. musculus
tgcaacctcaggaggt

SEQ ID NO: 441158 - DNA, 16 bp, M. musculus
tgcaacctgcaggaaa

SEQ ID NO: 441159 - DNA, 16 bp, M. musculus
tgcaacctgtctctgt

SEQ ID NO: 441160 - DNA, 34 bp, M. musculus
tgcaactctctcgggctgctgaagcacactcact

SEQ ID NO: 441161 - DNA, 16 bp, M. musculus
tgcaacttccctgcaa

SEQ ID NO: 441162 - DNA, 16 bp, M. musculus
tgcaagaacagcaggt

SEQ ID NO: 441163 - DNA, 16 bp, M. musculus
tgcaagaagcccacca

SEQ ID NO: 441164 - DNA, 16 bp, M. musculus
tgcaagaagctacctg

SEQ ID NO: 441165 - DNA, 16 bp, M. musculus
tgcaagaatatacaaa

SEQ ID NO: 441166 - DNA, 16 bp, M. musculus
tgcaagaccaagggga

SEQ ID NO: 441167 - DNA, 16 bp, M. musculus
tgcaagagagagaaaa

SEQ ID NO: 441168 - DNA, 16 bp, M. musculus
tgcaagagcaaaagca

SEQ ID NO: 441169 - DNA, 16 bp, M. musculus
tgcaagagcaatacat

SEQ ID NO: 441170 - DNA, 16 bp, M. musculus
tgcaagagcagccagt

SEQ ID NO: 441171 - DNA, 16 bp, M. musculus
tgcaagaggaactgag

SEQ ID NO: 441172 - DNA, 16 bp, M. musculus
tgcaagaggaagcttc

SEQ ID NO: 441173 - DNA, 16 bp, M. musculus
tgcaagaggactttta

SEQ ID NO: 441174 - DNA, 16 bp, M. musculus
tgcaagagtagagaac

SEQ ID NO: 441175 - DNA, 16 bp, M. musculus
tgcaagagtcagttct

SEQ ID NO: 441176 - DNA, 16 bp, M. musculus
tgcaagatgtaaagca

SEQ ID NO: 441177 - DNA, 16 bp, M. musculus
tgcaagatttaagaaa

SEQ ID NO: 441178 - DNA, 16 bp, M. musculus
tgcaagcacatcatag

SEQ ID NO: 441179 - DNA, 16 bp, M. musculus
tgcaagcaccaccaac

SEQ ID NO: 441180 - DNA, 16 bp, M. musculus
tgcaagcataaagacc

SEQ ID NO: 441181 - DNA, 16 bp, M. musculus
tgcaagcatcagcatc

SEQ ID NO: 441182 - DNA, 16 bp, M. musculus
tgcaagcatctgcctc

SEQ ID NO: 441183 - DNA, 16 bp, M. musculus
tgcaagcatttttttt

SEQ ID NO: 441184 - DNA, 16 bp, M. musculus
tgcaagccagccccag

SEQ ID NO: 441185 - DNA, 16 bp, M. musculus
tgcaagccattgctgt

SEQ ID NO: 441186 - DNA, 16 bp, M. musculus
tgcaagcctgtaatcc

SEQ ID NO: 441187 - DNA, 16 bp, M. musculus
tgcaagcctgtgtgtc

SEQ ID NO: 441188 - DNA, 16 bp, M. musculus
tgcaagcgtgaggacc

SEQ ID NO: 441189 - DNA, 16 bp, M. musculus
tgcaagctgagcaagc

SEQ ID NO: 441190 - DNA, 16 bp, M. musculus
tgcaaggatagttcaa

SEQ ID NO: 441191 - DNA, 16 bp, M. musculus
tgcaaggcaaatgaca

SEQ ID NO: 441192 - DNA, 16 bp, M. musculus
tgcaaggcaagcattt

SEQ ID NO: 441193 - DNA, 16 bp, M. musculus
tgcaaggccaaagaca

SEQ ID NO: 441194 - DNA, 16 bp, M. musculus
tgcaagggacagaagg

SEQ ID NO: 441195 - DNA, 16 bp, M. musculus
tgcaagtcaaaagaca

SEQ ID NO: 441196 - DNA, 16 bp, M. musculus
tgcaagtctgtgtgtc

SEQ ID NO: 441197 - DNA, 16 bp, M. musculus
tgcaagtctttaatcc

SEQ ID NO: 441198 - DNA, 16 bp, M. musculus
tgcaagtgcacacatg

SEQ ID NO: 441199 - DNA, 16 bp, M. musculus
tgcaagtggagagctt

SEQ ID NO: 441200 - DNA, 16 bp, M. musculus
tgcaagtggtacacag

SEQ ID NO: 441201 - DNA, 16 bp, M. musculus
tgcaagtgtgtatgtg

SEQ ID NO: 441202 - DNA, 16 bp, M. musculus
tgcaataccaaggggc

SEQ ID NO: 441203 - DNA, 16 bp, M. musculus
tgcaatagtgtcagtg

SEQ ID NO: 441204 - DNA, 16 bp, M. musculus
tgcaatcacacacaca

SEQ ID NO: 441205 - DNA, 17 bp, M. musculus
tgcaatccagctagact

SEQ ID NO: 441206 - DNA, 16 bp, M. musculus
tgcaatcccacagtca

SEQ ID NO: 441207 - DNA, 16 bp, M. musculus
tgcaatcccaccaaca

SEQ ID NO: 441208 - DNA, 16 bp, M. musculus
tgcaatcttcctgcct

SEQ ID NO: 441209 - DNA, 16 bp, M. musculus
tgcaatgaacatttgc

SEQ ID NO: 441210 - DNA, 16 bp, M. musculus
tgcaatgagaactctg

SEQ ID NO: 441211 - DNA, 16 bp, M. musculus
tgcaatgccaccaaca

SEQ ID NO: 441212 - DNA, 16 bp, M. musculus
tgcaatggtcatggtg

SEQ ID NO: 441213 - DNA, 28 bp, M. musculus
tgcaatggtgtcagcgtttggaagctga

SEQ ID NO: 441214 - DNA, 16 bp, M. musculus
tgcaatgtgagctttg

SEQ ID NO: 441215 - DNA, 16 bp, M. musculus
tgcaatgtgttttgat

SEQ ID NO: 441216 - DNA, 18 bp, M. musculus
tgcaattggtgcgatgct

SEQ ID NO: 441217 - DNA, 16 bp, M. musculus
tgcaattgtgattatt

SEQ ID NO: 441218 - DNA, 16 bp, M. musculus
tgcaattttggggacc

SEQ ID NO: 441219 - DNA, 16 bp, M. musculus
tgcacaaaacaaggaa

SEQ ID NO: 441220 - DNA, 16 bp, M. musculus
tgcacaaacatacatg

SEQ ID NO: 441221 - DNA, 16 bp, M. musculus
tgcacaaagccctagg

SEQ ID NO: 441222 - DNA, 16 bp, M. musculus
tgcacaaagctctggg

SEQ ID NO: 441223 - DNA, 16 bp, M. musculus
tgcacaaatacataaa

SEQ ID NO: 441224 - DNA, 16 bp, M. musculus
tgcacaaatacatgca

SEQ ID NO: 441225 - DNA, 16 bp, M. musculus
tgcacaaatgtgcaca

SEQ ID NO: 441226 - DNA, 16 bp, M. musculus
tgcacacaaacacaca

SEQ ID NO: 441227 - DNA, 16 bp, M. musculus
tgcacacaaacacaga

SEQ ID NO: 441228 - DNA, 16 bp, M. musculus
tgcacacaaacatata

SEQ ID NO: 441229 - DNA, 16 bp, M. musculus
tgcacacaagtgtgtg

SEQ ID NO: 441230 - DNA, 16 bp, M. musculus
tgcacacacaaaataa

SEQ ID NO: 441231 - DNA, 16 bp, M. musculus
tgcacacacaaacaca

SEQ ID NO: 441232 - DNA, 16 bp, M. musculus
tgcacacacaaagaga

SEQ ID NO: 441233 - DNA, 16 bp, M. musculus
tgcacacacaaataaa

SEQ ID NO: 441234 - DNA, 16 bp, M. musculus
tgcacacacaaataca

SEQ ID NO: 441235 - DNA, 16 bp, M. musculus
tgcacacacacacacc

SEQ ID NO: 441236 - DNA, 16 bp, M. musculus
tgcacacacaccccca

SEQ ID NO: 441237 - DNA, 16 bp, M. musculus
tgcacacacacctgca

SEQ ID NO: 441238 - DNA, 16 bp, M. musculus
tgcacacacatataca

SEQ ID NO: 441239 - DNA, 16 bp, M. musculus
tgcacacacatggcat

SEQ ID NO: 441240 - DNA, 16 bp, M. musculus
tgcacacacatgtaca

SEQ ID NO: 441241 - DNA, 16 bp, M. musculus
tgcacacacatgtata

SEQ ID NO: 441242 - DNA, 16 bp, M. musculus
tgcacacacccacaca

SEQ ID NO: 441243 - DNA, 16 bp, M. musculus
tgcacacacctgcaca

SEQ ID NO: 441244 - DNA, 16 bp, M. musculus
tgcacacacgtgcaca

SEQ ID NO: 441245 - DNA, 16 bp, M. musculus
tgcacacacgtgtaca

SEQ ID NO: 441246 - DNA, 16 bp, M. musculus
tgcacacactcatgta

SEQ ID NO: 441247 - DNA, 16 bp, M. musculus
tgcacacactgctgcc

SEQ ID NO: 441248 - DNA, 16 bp, M. musculus
tgcacacagccaacca

SEQ ID NO: 441249 - DNA, 16 bp, M. musculus
tgcacacaggagaggt

SEQ ID NO: 441250 - DNA, 16 bp, M. musculus
tgcacacagtcacaca

SEQ ID NO: 441251 - DNA, 16 bp, M. musculus
tgcacacatacaaaca

SEQ ID NO: 441252 - DNA, 16 bp, M. musculus
tgcacacatacatgct

SEQ ID NO: 441253 - DNA, 16 bp, M. musculus
tgcacacatatacaca

SEQ ID NO: 441254 - DNA, 16 bp, M. musculus
tgcacacatgaatgca

SEQ ID NO: 441255 - DNA, 16 bp, M. musculus
tgcacacatgcaaatg

SEQ ID NO: 441256 - DNA, 16 bp, M. musculus
tgcacacatgcacaga

SEQ ID NO: 441257 - DNA, 16 bp, M. musculus
tgcacacatgcatgca

SEQ ID NO: 441258 - DNA, 16 bp, M. musculus
tgcacacatgccatgg

SEQ ID NO: 441259 - DNA, 16 bp, M. musculus
tgcacacatgtgcaca

SEQ ID NO: 441260 - DNA, 16 bp, M. musculus
tgcacacatgtgtaca

SEQ ID NO: 441261 - DNA, 16 bp, M. musculus
tgcacacatgtgtgca

SEQ ID NO: 441262 - DNA, 16 bp, M. musculus
tgcacacattacaaca

SEQ ID NO: 441263 - DNA, 16 bp, M. musculus
tgcacacctgtaattc

SEQ ID NO: 441264 - DNA, 16 bp, M. musculus
tgcacacctttaagcc

SEQ ID NO: 441265 - DNA, 16 bp, M. musculus
tgcacacctttgatcc

SEQ ID NO: 441266 - DNA, 16 bp, M. musculus
tgcacacgaacacaca

SEQ ID NO: 441267 - DNA, 16 bp, M. musculus
tgcacacgcacacgca

SEQ ID NO: 441268 - DNA, 16 bp, M. musculus
tgcacacgtgtgtgca

SEQ ID NO: 441269 - DNA, 16 bp, M. musculus
tgcacagaaacacaca

SEQ ID NO: 441270 - DNA, 16 bp, M. musculus
tgcacagaactcagaa

SEQ ID NO: 441271 - DNA, 16 bp, M. musculus
tgcacagaagtctgga

SEQ ID NO: 441272 - DNA, 16 bp, M. musculus
tgcacagacatgcaca

SEQ ID NO: 441273 - DNA, 16 bp, M. musculus
tgcacagaccaaccta

SEQ ID NO: 441274 - DNA, 16 bp, M. musculus
tgcacagagccctggg

SEQ ID NO: 441275 - DNA, 16 bp, M. musculus
tgcacagaggccagag

SEQ ID NO: 441276 - DNA, 16 bp, M. musculus
tgcacagaggtctggt

SEQ ID NO: 441277 - DNA, 16 bp, M. musculus
tgcacagatcctggaa

SEQ ID NO: 441278 - DNA, 16 bp, M. musculus
tgcacagatgtgcaca

SEQ ID NO: 441279 - DNA, 16 bp, M. musculus
tgcacagatgtgtgca

SEQ ID NO: 441280 - DNA, 16 bp, M. musculus
tgcacagccctcagac

SEQ ID NO: 441281 - DNA, 16 bp, M. musculus
tgcacaggcacacatg

SEQ ID NO: 441282 - DNA, 16 bp, M. musculus
tgcacaggcagcctgg

SEQ ID NO: 441283 - DNA, 16 bp, M. musculus
tgcacagggtctgcac

SEQ ID NO: 441284 - DNA, 16 bp, M. musculus
tgcacaggtgtgtgtg

SEQ ID NO: 441285 - DNA, 16 bp, M. musculus
tgcacagtgctctggc

SEQ ID NO: 441286 - DNA, 16 bp, M. musculus
tgcacagtggtctgca

SEQ ID NO: 441287 - DNA, 16 bp, M. musculus
tgcacataaaataaaa

SEQ ID NO: 441288 - DNA, 16 bp, M. musculus
tgcacataaataaaaa

SEQ ID NO: 441289 - DNA, 16 bp, M. musculus
tgcacataaattcaca

SEQ ID NO: 441290 - DNA, 16 bp, M. musculus
tgcacatacagacaag

SEQ ID NO: 441291 - DNA, 16 bp, M. musculus
tgcacatacaggcaca

SEQ ID NO: 441292 - DNA, 16 bp, M. musculus
tgcacatacatacaca

SEQ ID NO: 441293 - DNA, 16 bp, M. musculus
tgcacatacatacata

SEQ ID NO: 441294 - DNA, 16 bp, M. musculus
tgcacatactcacaca

SEQ ID NO: 441295 - DNA, 16 bp, M. musculus
tgcacatatacacatg

SEQ ID NO: 441296 - DNA, 16 bp, M. musculus
tgcacatatatgcaca

SEQ ID NO: 441297 - DNA, 16 bp, M. musculus
tgcacatatgcacaca

SEQ ID NO: 441298 - DNA, 16 bp, M. musculus
tgcacatatgtagcaa

SEQ ID NO: 441299 - DNA, 16 bp, M. musculus
tgcacatctgatacat

SEQ ID NO: 441300 - DNA, 16 bp, M. musculus
tgcacatgaatgtgca

SEQ ID NO: 441301 - DNA, 16 bp, M. musculus
tgcacatgagtgtgta

SEQ ID NO: 441302 - DNA, 16 bp, M. musculus
tgcacatgcaagcaca

SEQ ID NO: 441303 - DNA, 16 bp, M. musculus
tgcacatgcatataca

SEQ ID NO: 441304 - DNA, 16 bp, M. musculus
tgcacatgcatgtctg

SEQ ID NO: 441305 - DNA, 16 bp, M. musculus
tgcacatgccagcaag

SEQ ID NO: 441306 - DNA, 16 bp, M. musculus
tgcacatgccaggcaa

SEQ ID NO: 441307 - DNA, 16 bp, M. musculus
tgcacatgcctgcaca

SEQ ID NO: 441308 - DNA, 16 bp, M. musculus
tgcacatgcctgtgtg

SEQ ID NO: 441309 - DNA, 16 bp, M. musculus
tgcacatgcgcacaca

SEQ ID NO: 441310 - DNA, 16 bp, M. musculus
tgcacatgcgtgtgtg

SEQ ID NO: 441311 - DNA, 16 bp, M. musculus
tgcacatgggatgggt

SEQ ID NO: 441312 - DNA, 16 bp, M. musculus
tgcacatgggtgtgca

SEQ ID NO: 441313 - DNA, 16 bp, M. musculus
tgcacatggtacacat

SEQ ID NO: 441314 - DNA, 16 bp, M. musculus
tgcacatgtatacaca

SEQ ID NO: 441315 - DNA, 16 bp, M. musculus
tgcacatgtatgtatt

SEQ ID NO: 441316 - DNA, 16 bp, M. musculus
tgcacatgtgtacaca

SEQ ID NO: 441317 - DNA, 16 bp, M. musculus
tgcacatgtgtggaag

SEQ ID NO: 441318 - DNA, 16 bp, M. musculus
tgcacatgtgtgggtg

SEQ ID NO: 441319 - DNA, 16 bp, M. musculus
tgcacatgtgtgtgct

SEQ ID NO: 441320 - DNA, 16 bp, M. musculus
tgcacatgtgtgtgtc

SEQ ID NO: 441321 - DNA, 16 bp, M. musculus
tgcacatgtgtgtgtt

SEQ ID NO: 441322 - DNA, 16 bp, M. musculus
tgcacattgttttgag

SEQ ID NO: 441323 - DNA, 16 bp, M. musculus
tgcaccacaatgcctg

SEQ ID NO: 441324 - DNA, 16 bp, M. musculus
tgcaccacatgcatgc

SEQ ID NO: 441325 - DNA, 16 bp, M. musculus
tgcaccaccacaccta

SEQ ID NO: 441326 - DNA, 16 bp, M. musculus
tgcaccaccacacctg

SEQ ID NO: 441327 - DNA, 16 bp, M. musculus
tgcaccaccacatctg

SEQ ID NO: 441328 - DNA, 16 bp, M. musculus
tgcaccaccaccaccc

SEQ ID NO: 441329 - DNA, 16 bp, M. musculus
tgcaccaccacgcctg

SEQ ID NO: 441330 - DNA, 16 bp, M. musculus
tgcaccaccacttccc

SEQ ID NO: 441331 - DNA, 16 bp, M. musculus
tgcaccaccagggtga

SEQ ID NO: 441332 - DNA, 16 bp, M. musculus
tgcaccaccatgccca

SEQ ID NO: 441333 - DNA, 16 bp, M. musculus
tgcaccaccatgccta

SEQ ID NO: 441334 - DNA, 16 bp, M. musculus
tgcaccaccatgcctg

SEQ ID NO: 441335 - DNA, 16 bp, M. musculus
tgcaccactgctgcct

SEQ ID NO: 441336 - DNA, 18 bp, M. musculus
tgcaccagaaggccagga

SEQ ID NO: 441337 - DNA, 16 bp, M. musculus
tgcaccagcactgcct

SEQ ID NO: 441338 - DNA, 16 bp, M. musculus
tgcaccagctcctgct

SEQ ID NO: 441339 - DNA, 16 bp, M. musculus
tgcaccaggcctgcct

SEQ ID NO: 441340 - DNA, 16 bp, M. musculus
tgcaccatcacaccag

SEQ ID NO: 441341 - DNA, 16 bp, M. musculus
tgcaccatcatgccca

SEQ ID NO: 441342 - DNA, 16 bp, M. musculus
tgcacctactgtgtgc

SEQ ID NO: 441343 - DNA, 16 bp, M. musculus
tgcacctcactgccag

SEQ ID NO: 441344 - DNA, 16 bp, M. musculus
tgcacctccctgaaag

SEQ ID NO: 441345 - DNA, 16 bp, M. musculus
tgcacctgaggttctc

SEQ ID NO: 441346 - DNA, 16 bp, M. musculus
tgcacctgcacataca

SEQ ID NO: 441347 - DNA, 16 bp, M. musculus
tgcacctgtaattcca

SEQ ID NO: 441348 - DNA, 16 bp, M. musculus
tgcacctgtgattctc

SEQ ID NO: 441349 - DNA, 16 bp, M. musculus
tgcaccttcactaatg

SEQ ID NO: 441350 - DNA, 25 bp, M. musculus
tgcacgacaaactcctcaagagcca

SEQ ID NO: 441351 - DNA, 16 bp, M. musculus
tgcacgcacacacaca

SEQ ID NO: 441352 - DNA, 16 bp, M. musculus
tgcacgcacacatgca

SEQ ID NO: 441353 - DNA, 16 bp, M. musculus
tgcacgcacgcacgca

SEQ ID NO: 441354 - DNA, 16 bp, M. musculus
tgcacgcacgcgcgca

SEQ ID NO: 441355 - DNA, 16 bp, M. musculus
tgcacgcatacataca

SEQ ID NO: 441356 - DNA, 17 bp, M. musculus
tgcacgcctttaatccc

SEQ ID NO: 441357 - DNA, 16 bp, M. musculus
tgcacgcctttagtcc

SEQ ID NO: 441358 - DNA, 16 bp, M. musculus
tgcactaaacccaact

SEQ ID NO: 441359 - DNA, 16 bp, M. musculus
tgcactacagaagcta

SEQ ID NO: 441360 - DNA, 16 bp, M. musculus
tgcactacatgtgtgt

SEQ ID NO: 441361 - DNA, 16 bp, M. musculus
tgcactaccactgccc

SEQ ID NO: 441362 - DNA, 16 bp, M. musculus
tgcactaggaaaagaa

SEQ ID NO: 441363 - DNA, 16 bp, M. musculus
tgcactcacacatgca

SEQ ID NO: 441364 - DNA, 16 bp, M. musculus
tgcactcatgtgcaca

SEQ ID NO: 441365 - DNA, 16 bp, M. musculus
tgcactcatgtgcata

SEQ ID NO: 441366 - DNA, 16 bp, M. musculus
tgcactcgtgtgcaca

SEQ ID NO: 441367 - DNA, 16 bp, M. musculus
tgcactctgctcctga

SEQ ID NO: 441368 - DNA, 17 bp, M. musculus
tgcactctggaggcaga

SEQ ID NO: 441369 - DNA, 16 bp, M. musculus
tgcactgacacacaca

SEQ ID NO: 441370 - DNA, 17 bp, M. musculus
tgcactgatgggagaga

SEQ ID NO: 441371 - DNA, 16 bp, M. musculus
tgcactgcactgctgt

SEQ ID NO: 441372 - DNA, 16 bp, M. musculus
tgcactgcttcccact

SEQ ID NO: 441373 - DNA, 16 bp, M. musculus
tgcactgctttcattg

SEQ ID NO: 441374 - DNA, 16 bp, M. musculus
tgcactggtgcttggt

SEQ ID NO: 441375 - DNA, 16 bp, M. musculus
tgcactgtgcctgcct

SEQ ID NO: 441376 - DNA, 16 bp, M. musculus
tgcactgtggcacaca

SEQ ID NO: 441377 - DNA, 16 bp, M. musculus
tgcactgtgtgtgtgc

SEQ ID NO: 441378 - DNA, 16 bp, M. musculus
tgcactgtgtgtgtgt

SEQ ID NO: 441379 - DNA, 16 bp, M. musculus
tgcacttgaaaaaatg

SEQ ID NO: 441380 - DNA, 16 bp, M. musculus
tgcacttgccttttgc

SEQ ID NO: 441381 - DNA, 17 bp, M. musculus
tgcacttgggaggcaga

SEQ ID NO: 441382 - DNA, 16 bp, M. musculus
tgcacttgtaatccca

SEQ ID NO: 441383 - DNA, 16 bp, M. musculus
tgcagaaaagaatttc

SEQ ID NO: 441384 - DNA, 16 bp, M. musculus
tgcagaaagagccagg

SEQ ID NO: 441385 - DNA, 16 bp, M. musculus
tgcagaaagagcctgg

SEQ ID NO: 441386 - DNA, 16 bp, M. musculus
tgcagaagaagaagaa

SEQ ID NO: 441387 - DNA, 16 bp, M. musculus
tgcagaagacctgagt

SEQ ID NO: 441388 - DNA, 16 bp, M. musculus
tgcagaagaggagaca

SEQ ID NO: 441389 - DNA, 16 bp, M. musculus
tgcagaagaggaggag

SEQ ID NO: 441390 - DNA, 16 bp, M. musculus
tgcagaagatggaagc

SEQ ID NO: 441391 - DNA, 18 bp, M. musculus
tgcagaagatggaggcct

SEQ ID NO: 441392 - DNA, 16 bp, M. musculus
tgcagaagattctggt

SEQ ID NO: 441393 - DNA, 16 bp, M. musculus
tgcagaagcagaaagc

SEQ ID NO: 441394 - DNA, 16 bp, M. musculus
tgcagaagcagaagga

SEQ ID NO: 441395 - DNA, 16 bp, M. musculus
tgcagaagccagagaa

SEQ ID NO: 441396 - DNA, 17 bp, M. musculus
tgcagaagctgctggca

SEQ ID NO: 441397 - DNA, 16 bp, M. musculus
tgcagaagtacttaca

SEQ ID NO: 441398 - DNA, 16 bp, M. musculus
tgcagaagtcagaaga

SEQ ID NO: 441399 - DNA, 16 bp, M. musculus
tgcagaataaacgctc

SEQ ID NO: 441400 - DNA, 16 bp, M. musculus
tgcagaattaaacttt

SEQ ID NO: 441401 - DNA, 16 bp, M. musculus
tgcagaatttggagtt

SEQ ID NO: 441402 - DNA, 16 bp, M. musculus
tgcagaattttaccag

SEQ ID NO: 441403 - DNA, 16 bp, M. musculus
tgcagacaaaacacct

SEQ ID NO: 441404 - DNA, 16 bp, M. musculus
tgcagacaaggctggc

SEQ ID NO: 441405 - DNA, 16 bp, M. musculus
tgcagacacacaaaca

SEQ ID NO: 441406 - DNA, 16 bp, M. musculus
tgcagacacagacaca

SEQ ID NO: 441407 - DNA, 16 bp, M. musculus
tgcagacaccaggcac

SEQ ID NO: 441408 - DNA, 16 bp, M. musculus
tgcagacagacatggt

SEQ ID NO: 441409 - DNA, 16 bp, M. musculus
tgcagacagcaggaag

SEQ ID NO: 441410 - DNA, 16 bp, M. musculus
tgcagacatatatgca

SEQ ID NO: 441411 - DNA, 16 bp, M. musculus
tgcagacatgggcttt

SEQ ID NO: 441412 - DNA, 16 bp, M. musculus
tgcagaccaagtattt

SEQ ID NO: 441413 - DNA, 16 bp, M. musculus
tgcagaccaggttggc

SEQ ID NO: 441414 - DNA, 16 bp, M. musculus
tgcagacccatgcaga

SEQ ID NO: 441415 - DNA, 16 bp, M. musculus
tgcagaccccatcagc

SEQ ID NO: 441416 - DNA, 16 bp, M. musculus
tgcagacctgagtttg

SEQ ID NO: 441417 - DNA, 16 bp, M. musculus
tgcagacctgtactgt

SEQ ID NO: 441418 - DNA, 17 bp, M. musculus
tgcagacgaggctgcag

SEQ ID NO: 441419 - DNA, 16 bp, M. musculus
tgcagactagtctagg

SEQ ID NO: 441420 - DNA, 16 bp, M. musculus
tgcagactctcacctg

SEQ ID NO: 441421 - DNA, 16 bp, M. musculus
tgcagagaaaacattt

SEQ ID NO: 441422 - DNA, 16 bp, M. musculus
tgcagagaaaccctgt

SEQ ID NO: 441423 - DNA, 16 bp, M. musculus
tgcagagaacccaagt

SEQ ID NO: 441424 - DNA, 16 bp, M. musculus
tgcagagaataagaga

SEQ ID NO: 441425 - DNA, 16 bp, M. musculus
tgcagagaattttttt

SEQ ID NO: 441426 - DNA, 16 bp, M. musculus
tgcagagaccatgaag

SEQ ID NO: 441427 - DNA, 16 bp, M. musculus
tgcagagacccactgc

SEQ ID NO: 441428 - DNA, 16 bp, M. musculus
tgcagagacggctcag

SEQ ID NO: 441429 - DNA, 16 bp, M. musculus
tgcagagagaacaagc

SEQ ID NO: 441430 - DNA, 16 bp, M. musculus
tgcagagagagagaga

SEQ ID NO: 441431 - DNA, 16 bp, M. musculus
tgcagagagaggaagg

SEQ ID NO: 441432 - DNA, 16 bp, M. musculus
tgcagagaggaaactg

SEQ ID NO: 441433 - DNA, 16 bp, M. musculus
tgcagagagtgctctg

SEQ ID NO: 441434 - DNA, 16 bp, M. musculus
tgcagagagttggcag

SEQ ID NO: 441435 - DNA, 16 bp, M. musculus
tgcagagatcagaaga

SEQ ID NO: 441436 - DNA, 16 bp, M. musculus
tgcagagatggacagt

SEQ ID NO: 441437 - DNA, 16 bp, M. musculus
tgcagagatggctcag

SEQ ID NO: 441438 - DNA, 16 bp, M. musculus
tgcagagcacattttc

SEQ ID NO: 441439 - DNA, 16 bp, M. musculus
tgcagagctggagaag

SEQ ID NO: 441440 - DNA, 16 bp, M. musculus
tgcagagctggctcag

SEQ ID NO: 441441 - DNA, 16 bp, M. musculus
tgcagaggacagaaga

SEQ ID NO: 441442 - DNA, 16 bp, M. musculus
tgcagaggaccagggt

SEQ ID NO: 441443 - DNA, 16 bp, M. musculus
tgcagaggacccagct

SEQ ID NO: 441444 - DNA, 16 bp, M. musculus
tgcagaggacccagga

SEQ ID NO: 441445 - DNA, 16 bp, M. musculus
tgcagaggacctagat

SEQ ID NO: 441446 - DNA, 16 bp, M. musculus
tgcagaggacctgatt

SEQ ID NO: 441447 - DNA, 16 bp, M. musculus
tgcagaggacctggct

SEQ ID NO: 441448 - DNA, 16 bp, M. musculus
tgcagaggacctgggt

SEQ ID NO: 441449 - DNA, 16 bp, M. musculus
tgcagaggagaaactg

SEQ ID NO: 441450 - DNA, 16 bp, M. musculus
tgcagaggcaggagga

SEQ ID NO: 441451 - DNA, 16 bp, M. musculus
tgcagaggccagaaaa

SEQ ID NO: 441452 - DNA, 16 bp, M. musculus
tgcagaggccagagga

SEQ ID NO: 441453 - DNA, 16 bp, M. musculus
tgcagaggccagggag

SEQ ID NO: 441454 - DNA, 16 bp, M. musculus
tgcagaggcccacagc

SEQ ID NO: 441455 - DNA, 16 bp, M. musculus
tgcagagggcctgggt

SEQ ID NO: 441456 - DNA, 16 bp, M. musculus
tgcagaggtaggcaga

SEQ ID NO: 441457 - DNA, 16 bp, M. musculus
tgcagagtcctatcag

SEQ ID NO: 441458 - DNA, 16 bp, M. musculus
tgcagagtgaattcca

SEQ ID NO: 441459 - DNA, 16 bp, M. musculus
tgcagagtgtgctgca

SEQ ID NO: 441460 - DNA, 16 bp, M. musculus
tgcagagtgtgtgcag

SEQ ID NO: 441461 - DNA, 16 bp, M. musculus
tgcagagttgtggagc

SEQ ID NO: 441462 - DNA, 16 bp, M. musculus
tgcagagtttgaagtt

SEQ ID NO: 441463 - DNA, 16 bp, M. musculus
tgcagatacacacaca

SEQ ID NO: 441464 - DNA, 16 bp, M. musculus
tgcagataccaagaag

SEQ ID NO: 441465 - DNA, 16 bp, M. musculus
tgcagatacccacagt

SEQ ID NO: 441466 - DNA, 16 bp, M. musculus
tgcagatccagatgta

SEQ ID NO: 441467 - DNA, 16 bp, M. musculus
tgcagatgagagtgtg

SEQ ID NO: 441468 - DNA, 16 bp, M. musculus
tgcagatgcacatgca

SEQ ID NO: 441469 - DNA, 16 bp, M. musculus
tgcagatgcagtgtga

SEQ ID NO: 441470 - DNA, 16 bp, M. musculus
tgcagatgccagaaga

SEQ ID NO: 441471 - DNA, 16 bp, M. musculus
tgcagatgccctcaga

SEQ ID NO: 441472 - DNA, 16 bp, M. musculus
tgcagatgctaagaag

SEQ ID NO: 441473 - DNA, 16 bp, M. musculus
tgcagatggagaccag

SEQ ID NO: 441474 - DNA, 16 bp, M. musculus
tgcagatgggatggat

SEQ ID NO: 441475 - DNA, 16 bp, M. musculus
tgcagatggttgtgag

SEQ ID NO: 441476 - DNA, 16 bp, M. musculus
tgcagattccttttct

SEQ ID NO: 441477 - DNA, 16 bp, M. musculus
tgcagattgctcttcc

SEQ ID NO: 441478 - DNA, 16 bp, M. musculus
tgcagcaaagctttta

SEQ ID NO: 441479 - DNA, 16 bp, M. musculus
tgcagcaacagaaaag

SEQ ID NO: 441480 - DNA, 16 bp, M. musculus
tgcagcacacactgca

SEQ ID NO: 441481 - DNA, 16 bp, M. musculus
tgcagcactcagaaga

SEQ ID NO: 441482 - DNA, 16 bp, M. musculus
tgcagcactcaggaga

SEQ ID NO: 441483 - DNA, 16 bp, M. musculus
tgcagcactggggaga

SEQ ID NO: 441484 - DNA, 16 bp, M. musculus
tgcagcacttggaaga

SEQ ID NO: 441485 - DNA, 17 bp, M. musculus
tgcagcagaagactcca

SEQ ID NO: 441486 - DNA, 16 bp, M. musculus
tgcagcagaaggatgg

SEQ ID NO: 441487 - DNA, 16 bp, M. musculus
tgcagcagagcactca

SEQ ID NO: 441488 - DNA, 16 bp, M. musculus
tgcagcagatggagac

SEQ ID NO: 441489 - DNA, 16 bp, M. musculus
tgcagcagcagcagcc

SEQ ID NO: 441490 - DNA, 16 bp, M. musculus
tgcagcagcagcagct

SEQ ID NO: 441491 - DNA, 16 bp, M. musculus
tgcagcaggcaggaga

SEQ ID NO: 441492 - DNA, 16 bp, M. musculus
tgcagcagtcctcctg

SEQ ID NO: 441493 - DNA, 16 bp, M. musculus
tgcagcagtctctgga

SEQ ID NO: 441494 - DNA, 16 bp, M. musculus
tgcagcagtgtgtgtg

SEQ ID NO: 441495 - DNA, 16 bp, M. musculus
tgcagcattaagaagg

SEQ ID NO: 441496 - DNA, 16 bp, M. musculus
tgcagcattaggaaga

SEQ ID NO: 441497 - DNA, 16 bp, M. musculus
tgcagccaaacatcag

SEQ ID NO: 441498 - DNA, 16 bp, M. musculus
tgcagccaagcctgat

SEQ ID NO: 441499 - DNA, 16 bp, M. musculus
tgcagccactttgctg

SEQ ID NO: 441500 - DNA, 16 bp, M. musculus
tgcagccagacatggt

SEQ ID NO: 441501 - DNA, 16 bp, M. musculus
tgcagccagcctgggc

SEQ ID NO: 441502 - DNA, 16 bp, M. musculus
tgcagcccagcctggc

SEQ ID NO: 441503 - DNA, 16 bp, M. musculus
tgcagcccaggctact

SEQ ID NO: 441504 - DNA, 16 bp, M. musculus
tgcagcccaggctgac

SEQ ID NO: 441505 - DNA, 16 bp, M. musculus
tgcagcccaggctggc

SEQ ID NO: 441506 - DNA, 16 bp, M. musculus
tgcagccccagcctcc

SEQ ID NO: 441507 - DNA, 16 bp, M. musculus
tgcagcccctccctgc

SEQ ID NO: 441508 - DNA, 16 bp, M. musculus
tgcagccctggctgcc

SEQ ID NO: 441509 - DNA, 16 bp, M. musculus
tgcagccggagccatg

SEQ ID NO: 441510 - DNA, 16 bp, M. musculus
tgcagcctcatttgca

SEQ ID NO: 441511 - DNA, 16 bp, M. musculus
tgcagcctcctcttct

SEQ ID NO: 441512 - DNA, 16 bp, M. musculus
tgcagcctgccctcct

SEQ ID NO: 441513 - DNA, 16 bp, M. musculus
tgcagccttcactgtt

SEQ ID NO: 441514 - DNA, 16 bp, M. musculus
tgcagccttgctggag

SEQ ID NO: 441515 - DNA, 16 bp, M. musculus
tgcagccttggctggc

SEQ ID NO: 441516 - DNA, 16 bp, M. musculus
tgcagcctttctgcaa

SEQ ID NO: 441517 - DNA, 16 bp, M. musculus
tgcagctagagctctg

SEQ ID NO: 441518 - DNA, 16 bp, M. musculus
tgcagctagaggcatg

SEQ ID NO: 441519 - DNA, 16 bp, M. musculus
tgcagctcagtggcag

SEQ ID NO: 441520 - DNA, 16 bp, M. musculus
tgcagctcccagggga

SEQ ID NO: 441521 - DNA, 16 bp, M. musculus
tgcagctccctcctct

SEQ ID NO: 441522 - DNA, 16 bp, M. musculus
tgcagctcctttctct

SEQ ID NO: 441523 - DNA, 16 bp, M. musculus
tgcagctctggctgtc

SEQ ID NO: 441524 - DNA, 16 bp, M. musculus
tgcagctctgtggcag

SEQ ID NO: 441525 - DNA, 16 bp, M. musculus
tgcagctcttccagag

SEQ ID NO: 441526 - DNA, 16 bp, M. musculus
tgcagctgaagccatg

SEQ ID NO: 441527 - DNA, 16 bp, M. musculus
tgcagctgcctctgtt

SEQ ID NO: 441528 - DNA, 16 bp, M. musculus
tgcagctggaaccatg

SEQ ID NO: 441529 - DNA, 16 bp, M. musculus
tgcagctggactccaa

SEQ ID NO: 441530 - DNA, 16 bp, M. musculus
tgcagctggagagatg

SEQ ID NO: 441531 - DNA, 16 bp, M. musculus
tgcagctggagtcaag

SEQ ID NO: 441532 - DNA, 16 bp, M. musculus
tgcagctggcaaagat

SEQ ID NO: 441533 - DNA, 16 bp, M. musculus
tgcagctggcaagggg

SEQ ID NO: 441534 - DNA, 16 bp, M. musculus
tgcagctggggccatg

SEQ ID NO: 441535 - DNA, 16 bp, M. musculus
tgcagctgtcttcaga

SEQ ID NO: 441536 - DNA, 16 bp, M. musculus
tgcagcttcagttgca

SEQ ID NO: 441537 - DNA, 16 bp, M. musculus
tgcagcttctggcctc

SEQ ID NO: 441538 - DNA, 16 bp, M. musculus
tgcagctttctgactt

SEQ ID NO: 441539 - DNA, 16 bp, M. musculus
tgcagctttggctctg

SEQ ID NO: 441540 - DNA, 17 bp, M. musculus
tgcagcttttactacag

SEQ ID NO: 441541 - DNA, 16 bp, M. musculus
tgcaggaaaatgaatg

SEQ ID NO: 441542 - DNA, 16 bp, M. musculus
tgcaggaaactggtct

SEQ ID NO: 441543 - DNA, 38 bp, M. musculus
tgcaggaaatccagcatgggatagggatatgctgcttg

SEQ ID NO: 441544 - DNA, 16 bp, M. musculus
tgcaggaaatccagga

SEQ ID NO: 441545 - DNA, 16 bp, M. musculus
tgcaggaactagaaca

SEQ ID NO: 441546 - DNA, 16 bp, M. musculus
tgcaggaagcagctga

SEQ ID NO: 441547 - DNA, 16 bp, M. musculus
tgcaggaagccctgga

SEQ ID NO: 441548 - DNA, 16 bp, M. musculus
tgcaggaagccctggg

SEQ ID NO: 441549 - DNA, 16 bp, M. musculus
tgcaggaagctgcaga

SEQ ID NO: 441550 - DNA, 16 bp, M. musculus
tgcaggaagtgctgtt

SEQ ID NO: 441551 - DNA, 16 bp, M. musculus
tgcaggaatggtttaa

SEQ ID NO: 441552 - DNA, 16 bp, M. musculus
tgcaggacctgagaga

SEQ ID NO: 441553 - DNA, 16 bp, M. musculus
tgcaggacctgctctc

SEQ ID NO: 441554 - DNA, 16 bp, M. musculus
tgcaggagagaaagca

SEQ ID NO: 441555 - DNA, 16 bp, M. musculus
tgcaggagagctggcc

SEQ ID NO: 441556 - DNA, 16 bp, M. musculus
tgcaggagcacctggg

SEQ ID NO: 441557 - DNA, 16 bp, M. musculus
tgcaggagcagctgag

SEQ ID NO: 441558 - DNA, 16 bp, M. musculus
tgcaggagcagctgca

SEQ ID NO: 441559 - DNA, 16 bp, M. musculus
tgcaggagccagagga

SEQ ID NO: 441560 - DNA, 16 bp, M. musculus
tgcaggagccatcttg

SEQ ID NO: 441561 - DNA, 16 bp, M. musculus
tgcaggagcccacaga

SEQ ID NO: 441562 - DNA, 16 bp, M. musculus
tgcaggaggaccagca

SEQ ID NO: 441563 - DNA, 16 bp, M. musculus
tgcaggaggagctgaa

SEQ ID NO: 441564 - DNA, 16 bp, M. musculus
tgcaggaggctgaggc

SEQ ID NO: 441565 - DNA, 16 bp, M. musculus
tgcaggagtagaaacc

SEQ ID NO: 441566 - DNA, 16 bp, M. musculus
tgcaggatatctgata

SEQ ID NO: 441567 - DNA, 16 bp, M. musculus
tgcaggattggacctc

SEQ ID NO: 441568 - DNA, 16 bp, M. musculus
tgcaggattttttttt

SEQ ID NO: 441569 - DNA, 16 bp, M. musculus
tgcaggcaaaaacact

SEQ ID NO: 441570 - DNA, 16 bp, M. musculus
tgcaggcaaaacactt

SEQ ID NO: 441571 - DNA, 16 bp, M. musculus
tgcaggcaaaatacct

SEQ ID NO: 441572 - DNA, 16 bp, M. musculus
tgcaggcaaagcatcc

SEQ ID NO: 441573 - DNA, 16 bp, M. musculus
tgcaggcaagacactc

SEQ ID NO: 441574 - DNA, 16 bp, M. musculus
tgcaggcacacataca

SEQ ID NO: 441575 - DNA, 16 bp, M. musculus
tgcaggcacatgcaca

SEQ ID NO: 441576 - DNA, 16 bp, M. musculus
tgcaggcagatctctg

SEQ ID NO: 441577 - DNA, 16 bp, M. musculus
tgcaggcagcaaggag

SEQ ID NO: 441578 - DNA, 16 bp, M. musculus
tgcaggcagcagaagg

SEQ ID NO: 441579 - DNA, 16 bp, M. musculus
tgcaggcagcaggaga

SEQ ID NO: 441580 - DNA, 16 bp, M. musculus
tgcaggcaggaagcag

SEQ ID NO: 441581 - DNA, 16 bp, M. musculus
tgcaggcaggcactgg

SEQ ID NO: 441582 - DNA, 16 bp, M. musculus
tgcaggcaggctctcc

SEQ ID NO: 441583 - DNA, 16 bp, M. musculus
tgcaggcagggagggg

SEQ ID NO: 441584 - DNA, 16 bp, M. musculus
tgcaggcatacatgca

SEQ ID NO: 441585 - DNA, 16 bp, M. musculus
tgcaggcatgcataca

SEQ ID NO: 441586 - DNA, 16 bp, M. musculus
tgcaggccaccatgct

SEQ ID NO: 441587 - DNA, 16 bp, M. musculus
tgcaggccagaaaagg

SEQ ID NO: 441588 - DNA, 16 bp, M. musculus
tgcaggccagccaggg

SEQ ID NO: 441589 - DNA, 16 bp, M. musculus
tgcaggccttctacaa

SEQ ID NO: 441590 - DNA, 16 bp, M. musculus
tgcaggctgcagacag

SEQ ID NO: 441591 - DNA, 16 bp, M. musculus
tgcaggctggtgagat

SEQ ID NO: 441592 - DNA, 16 bp, M. musculus
tgcaggctgtgctgtg

SEQ ID NO: 441593 - DNA, 16 bp, M. musculus
tgcagggaaggtggac

SEQ ID NO: 441594 - DNA, 16 bp, M. musculus
tgcagggagggcaggg

SEQ ID NO: 441595 - DNA, 16 bp, M. musculus
tgcagggcaagcactt

SEQ ID NO: 441596 - DNA, 16 bp, M. musculus
tgcagggcatggtggc

SEQ ID NO: 441597 - DNA, 16 bp, M. musculus
tgcagggcctgctttc

SEQ ID NO: 441598 - DNA, 16 bp, M. musculus
tgcagggctccaaagg

SEQ ID NO: 441599 - DNA, 16 bp, M. musculus
tgcagggctggctgcc

SEQ ID NO: 441600 - DNA, 16 bp, M. musculus
tgcaggggaaggtcca

SEQ ID NO: 441601 - DNA, 16 bp, M. musculus
tgcaggggacctaggt

SEQ ID NO: 441602 - DNA, 18 bp, M. musculus
tgcaggggcagttttccc

SEQ ID NO: 441603 - DNA, 16 bp, M. musculus
tgcagggggagctgag

SEQ ID NO: 441604 - DNA, 16 bp, M. musculus
tgcagggttttctgaa

SEQ ID NO: 441605 - DNA, 16 bp, M. musculus
tgcaggtatggtttaa

SEQ ID NO: 441606 - DNA, 16 bp, M. musculus
tgcaggtcagaggtca

SEQ ID NO: 441607 - DNA, 16 bp, M. musculus
tgcaggtgacagcaga

SEQ ID NO: 441608 - DNA, 16 bp, M. musculus
tgcaggtgcccttgga

SEQ ID NO: 441609 - DNA, 16 bp, M. musculus
tgcaggtgcttgcaga

SEQ ID NO: 441610 - DNA, 16 bp, M. musculus
tgcaggtggaggtcag

SEQ ID NO: 441611 - DNA, 16 bp, M. musculus
tgcaggtgggcaagga

SEQ ID NO: 441612 - DNA, 16 bp, M. musculus
tgcaggtgtacataca

SEQ ID NO: 441613 - DNA, 16 bp, M. musculus
tgcaggtgtgcaggtg

SEQ ID NO: 441614 - DNA, 16 bp, M. musculus
tgcaggtgtgtctgtg

SEQ ID NO: 441615 - DNA, 29 bp, M. musculus
tgcaggtgtttgagcaggtgaatcagatt

SEQ ID NO: 441616 - DNA, 18 bp, M. musculus
tgcaggttctgggtgact

SEQ ID NO: 441617 - DNA, 16 bp, M. musculus
tgcagtaaatctccaa

SEQ ID NO: 441618 - DNA, 18 bp, M. musculus
tgcagtagtatgttcatg

SEQ ID NO: 441619 - DNA, 16 bp, M. musculus
tgcagtatgtgtgtgt

SEQ ID NO: 441620 - DNA, 16 bp, M. musculus
tgcagtcaatgctctc

SEQ ID NO: 441621 - DNA, 16 bp, M. musculus
tgcagtcaggtgtggg

SEQ ID NO: 441622 - DNA, 17 bp, M. musculus
tgcagtcagtgcaggca

SEQ ID NO: 441623 - DNA, 16 bp, M. musculus
tgcagtccaggctggc

SEQ ID NO: 441624 - DNA, 16 bp, M. musculus
tgcagtcccaccaaca

SEQ ID NO: 441625 - DNA, 16 bp, M. musculus
tgcagtcccaggcgcc

SEQ ID NO: 441626 - DNA, 16 bp, M. musculus
tgcagtctttatcact

SEQ ID NO: 441627 - DNA, 16 bp, M. musculus
tgcagtgaacatttgc

SEQ ID NO: 441628 - DNA, 16 bp, M. musculus
tgcagtgagaattttg

SEQ ID NO: 441629 - DNA, 16 bp, M. musculus
tgcagtgcagtggagt

SEQ ID NO: 441630 - DNA, 16 bp, M. musculus
tgcagtgccagcctca

SEQ ID NO: 441631 - DNA, 16 bp, M. musculus
tgcagtgctcatggag

SEQ ID NO: 441632 - DNA, 16 bp, M. musculus
tgcagtgctctcagag

SEQ ID NO: 441633 - DNA, 16 bp, M. musculus
tgcagtgctggagatc

SEQ ID NO: 441634 - DNA, 16 bp, M. musculus
tgcagtgctggggatg

SEQ ID NO: 441635 - DNA, 17 bp, M. musculus
tgcagtgcttagctgtg

SEQ ID NO: 441636 - DNA, 16 bp, M. musculus
tgcagtggccagaaga

SEQ ID NO: 441637 - DNA, 16 bp, M. musculus
tgcagtggccatggag

SEQ ID NO: 441638 - DNA, 16 bp, M. musculus
tgcagtgggacttggt

SEQ ID NO: 441639 - DNA, 16 bp, M. musculus
tgcagtgggcagcagt

SEQ ID NO: 441640 - DNA, 16 bp, M. musculus
tgcagtggtcatggtg

SEQ ID NO: 441641 - DNA, 16 bp, M. musculus
tgcagtggttaagagc

SEQ ID NO: 441642 - DNA, 16 bp, M. musculus
tgcagtgtccacagag

SEQ ID NO: 441643 - DNA, 16 bp, M. musculus
tgcagtgtgcatgtgt

SEQ ID NO: 441644 - DNA, 16 bp, M. musculus
tgcagtgtgctccagg

SEQ ID NO: 441645 - DNA, 16 bp, M. musculus
tgcagtgtgtgctgca

SEQ ID NO: 441646 - DNA, 16 bp, M. musculus
tgcagtgtgtgtgcca

SEQ ID NO: 441647 - DNA, 16 bp, M. musculus
tgcagtgtgtgtgtgt

SEQ ID NO: 441648 - DNA, 16 bp, M. musculus
tgcagtgtttatcaca

SEQ ID NO: 441649 - DNA, 16 bp, M. musculus
tgcagtgtttggagat

SEQ ID NO: 441650 - DNA, 16 bp, M. musculus
tgcagtgtttgtcttt

SEQ ID NO: 441651 - DNA, 16 bp, M. musculus
tgcagttcccttcagc

SEQ ID NO: 441652 - DNA, 16 bp, M. musculus
tgcagttgctgggatt

SEQ ID NO: 441653 - DNA, 16 bp, M. musculus
tgcagtttctgactgc

SEQ ID NO: 441654 - DNA, 16 bp, M. musculus
tgcagttttatcacta

SEQ ID NO: 441655 - DNA, 16 bp, M. musculus
tgcagtttttaatatt

SEQ ID NO: 441656 - DNA, 16 bp, M. musculus
tgcagtttttgtttgt

SEQ ID NO: 441657 - DNA, 16 bp, M. musculus
tgcataaacacataaa

SEQ ID NO: 441658 - DNA, 16 bp, M. musculus
tgcataaagatcctaa

SEQ ID NO: 441659 - DNA, 16 bp, M. musculus
tgcatacacacataca

SEQ ID NO: 441660 - DNA, 16 bp, M. musculus
tgcatacacacattca

SEQ ID NO: 441661 - DNA, 16 bp, M. musculus
tgcatacacacgcaca

SEQ ID NO: 441662 - DNA, 16 bp, M. musculus
tgcatacacatgtaca

SEQ ID NO: 441663 - DNA, 16 bp, M. musculus
tgcatacacgtgcaca

SEQ ID NO: 441664 - DNA, 16 bp, M. musculus
tgcataccaccatgct

SEQ ID NO: 441665 - DNA, 16 bp, M. musculus
tgcataccatgtgcat

SEQ ID NO: 441666 - DNA, 16 bp, M. musculus
tgcatactggagaaaa

SEQ ID NO: 441667 - DNA, 16 bp, M. musculus
tgcatagaacaaagaa

SEQ ID NO: 441668 - DNA, 16 bp, M. musculus
tgcatagacatacatg

SEQ ID NO: 441669 - DNA, 16 bp, M. musculus
tgcatagaccaggctg

SEQ ID NO: 441670 - DNA, 16 bp, M. musculus
tgcatagcaaacactt

SEQ ID NO: 441671 - DNA, 16 bp, M. musculus
tgcatagcaagttcaa

SEQ ID NO: 441672 - DNA, 16 bp, M. musculus
tgcatagtgagactct

SEQ ID NO: 441673 - DNA, 16 bp, M. musculus
tgcatataaatacatg

SEQ ID NO: 441674 - DNA, 16 bp, M. musculus
tgcatataagatattt

SEQ ID NO: 441675 - DNA, 16 bp, M. musculus
tgcatatacacacaaa

SEQ ID NO: 441676 - DNA, 16 bp, M. musculus
tgcatatacacagaca

SEQ ID NO: 441677 - DNA, 16 bp, M. musculus
tgcatatatacacata

SEQ ID NO: 441678 - DNA, 16 bp, M. musculus
tgcatatatgcctgca

SEQ ID NO: 441679 - DNA, 16 bp, M. musculus
tgcatatatgtacata

SEQ ID NO: 441680 - DNA, 16 bp, M. musculus
tgcatatatgtgtgtt

SEQ ID NO: 441681 - DNA, 16 bp, M. musculus
tgcatatatttatgtg

SEQ ID NO: 441682 - DNA, 20 bp, M. musculus
tgcatatcatgtgagttctt

SEQ ID NO: 441683 - DNA, 16 bp, M. musculus
tgcatatgcagcagag

SEQ ID NO: 441684 - DNA, 16 bp, M. musculus
tgcatatgcagctgga

SEQ ID NO: 441685 - DNA, 17 bp, M. musculus
tgcatatgccagaaaga

SEQ ID NO: 441686 - DNA, 16 bp, M. musculus
tgcatatgtaaatatg

SEQ ID NO: 441687 - DNA, 16 bp, M. musculus
tgcatatgtatccaaa

SEQ ID NO: 441688 - DNA, 16 bp, M. musculus
tgcatatgtatgtggt

SEQ ID NO: 441689 - DNA, 16 bp, M. musculus
tgcatatgtatgtgtg

SEQ ID NO: 441690 - DNA, 16 bp, M. musculus
tgcatatgtgaatata

SEQ ID NO: 441691 - DNA, 16 bp, M. musculus
tgcatatgtgacagag

SEQ ID NO: 441692 - DNA, 16 bp, M. musculus
tgcatatgtgtatatg

SEQ ID NO: 441693 - DNA, 16 bp, M. musculus
tgcatatgtgtgtctg

SEQ ID NO: 441694 - DNA, 16 bp, M. musculus
tgcatatttgcatatt

SEQ ID NO: 441695 - DNA, 17 bp, M. musculus
tgcatcaaaagatgacc

SEQ ID NO: 441696 - DNA, 16 bp, M. musculus
tgcatcaccaccaccc

SEQ ID NO: 441697 - DNA, 16 bp, M. musculus
tgcatcaccataccca

SEQ ID NO: 441698 - DNA, 16 bp, M. musculus
tgcatcactgtgcctg

SEQ ID NO: 441699 - DNA, 16 bp, M. musculus
tgcatcagagacctgg

SEQ ID NO: 441700 - DNA, 16 bp, M. musculus
tgcatcagatcccatt

SEQ ID NO: 441701 - DNA, 16 bp, M. musculus
tgcatcagcttctgct

SEQ ID NO: 441702 - DNA, 16 bp, M. musculus
tgcatcatctctgatt

SEQ ID NO: 441703 - DNA, 16 bp, M. musculus
tgcatccatgcacaca

SEQ ID NO: 441704 - DNA, 16 bp, M. musculus
tgcatccctgagatga

SEQ ID NO: 441705 - DNA, 16 bp, M. musculus
tgcatcctcatcctcc

SEQ ID NO: 441706 - DNA, 16 bp, M. musculus
tgcatctatggctcag

SEQ ID NO: 441707 - DNA, 16 bp, M. musculus
tgcatctctgggatga

SEQ ID NO: 441708 - DNA, 16 bp, M. musculus
tgcatctgactcctgc

SEQ ID NO: 441709 - DNA, 16 bp, M. musculus
tgcatctgctcccatc

SEQ ID NO: 441710 - DNA, 16 bp, M. musculus
tgcatctgctcctgct

SEQ ID NO: 441711 - DNA, 16 bp, M. musculus
tgcatcttctctgtct

SEQ ID NO: 441712 - DNA, 16 bp, M. musculus
tgcatcttggtcttca

SEQ ID NO: 441713 - DNA, 16 bp, M. musculus
tgcatctttaaaaaaa

SEQ ID NO: 441714 - DNA, 16 bp, M. musculus
tgcatgaatgaataaa

SEQ ID NO: 441715 - DNA, 16 bp, M. musculus
tgcatgaatgcatgca

SEQ ID NO: 441716 - DNA, 16 bp, M. musculus
tgcatgacagtgcaag

SEQ ID NO: 441717 - DNA, 23 bp, M. musculus
tgcatgaccccttcagtcctggg

SEQ ID NO: 441718 - DNA, 16 bp, M. musculus
tgcatgagagaagaat

SEQ ID NO: 441719 - DNA, 16 bp, M. musculus
tgcatgagcatgtatg

SEQ ID NO: 441720 - DNA, 16 bp, M. musculus
tgcatgagtgagtgtg

SEQ ID NO: 441721 - DNA, 16 bp, M. musculus
tgcatgagtgtgtgta

SEQ ID NO: 441722 - DNA, 16 bp, M. musculus
tgcatgagtgtgtgtg

SEQ ID NO: 441723 - DNA, 16 bp, M. musculus
tgcatgagttccagtc

SEQ ID NO: 441724 - DNA, 16 bp, M. musculus
tgcatgcaagcatgtg

SEQ ID NO: 441725 - DNA, 16 bp, M. musculus
tgcatgcaagtgtgtg

SEQ ID NO: 441726 - DNA, 16 bp, M. musculus
tgcatgcacacaagca

SEQ ID NO: 441727 - DNA, 16 bp, M. musculus
tgcatgcacacacaca

SEQ ID NO: 441728 - DNA, 16 bp, M. musculus
tgcatgcacacatgca

SEQ ID NO: 441729 - DNA, 16 bp, M. musculus
tgcatgcacacatgct

SEQ ID NO: 441730 - DNA, 16 bp, M. musculus
tgcatgcacatacaca

SEQ ID NO: 441731 - DNA, 16 bp, M. musculus
tgcatgcacatatata

SEQ ID NO: 441732 - DNA, 16 bp, M. musculus
tgcatgcacctgtgtg

SEQ ID NO: 441733 - DNA, 16 bp, M. musculus
tgcatgcagacagaca

SEQ ID NO: 441734 - DNA, 16 bp, M. musculus
tgcatgcagcaggtgc

SEQ ID NO: 441735 - DNA, 16 bp, M. musculus
tgcatgcaggcagaca

SEQ ID NO: 441736 - DNA, 16 bp, M. musculus
tgcatgcaggtgtgtg

SEQ ID NO: 441737 - DNA, 16 bp, M. musculus
tgcatgcagtgcctgc

SEQ ID NO: 441738 - DNA, 16 bp, M. musculus
tgcatgcatatatgaa

SEQ ID NO: 441739 - DNA, 16 bp, M. musculus
tgcatgcatatatgtg

SEQ ID NO: 441740 - DNA, 16 bp, M. musculus
tgcatgcatgcacaca

SEQ ID NO: 441741 - DNA, 16 bp, M. musculus
tgcatgcatgcatcca

SEQ ID NO: 441742 - DNA, 16 bp, M. musculus
tgcatgcatgcatgca

SEQ ID NO: 441743 - DNA, 16 bp, M. musculus
tgcatgcatgcatgga

SEQ ID NO: 441744 - DNA, 16 bp, M. musculus
tgcatgcatgcctgtg

SEQ ID NO: 441745 - DNA, 16 bp, M. musculus
tgcatgcatgggtgtg

SEQ ID NO: 441746 - DNA, 16 bp, M. musculus
tgcatgcatgtggtgc

SEQ ID NO: 441747 - DNA, 16 bp, M. musculus
tgcatgcatgtgtaca

SEQ ID NO: 441748 - DNA, 16 bp, M. musculus
tgcatgccatggcaca

SEQ ID NO: 441749 - DNA, 16 bp, M. musculus
tgcatgcctataatcc

SEQ ID NO: 441750 - DNA, 16 bp, M. musculus
tgcatgcctgcatgca

SEQ ID NO: 441751 - DNA, 16 bp, M. musculus
tgcatgcctggtgccc

SEQ ID NO: 441752 - DNA, 16 bp, M. musculus
tgcatgcctggtgcct

SEQ ID NO: 441753 - DNA, 16 bp, M. musculus
tgcatgcctgtgatcc

SEQ ID NO: 441754 - DNA, 16 bp, M. musculus
tgcatgcctttcatcc

SEQ ID NO: 441755 - DNA, 16 bp, M. musculus
tgcatgctagacaagc

SEQ ID NO: 441756 - DNA, 16 bp, M. musculus
tgcatgctaggcaaac

SEQ ID NO: 441757 - DNA, 16 bp, M. musculus
tgcatgctcacagtca

SEQ ID NO: 441758 - DNA, 16 bp, M. musculus
tgcatgctcttaacca

SEQ ID NO: 441759 - DNA, 16 bp, M. musculus
tgcatgctgggcaagt

SEQ ID NO: 441760 - DNA, 16 bp, M. musculus
tgcatgcttgtgcaca

SEQ ID NO: 441761 - DNA, 16 bp, M. musculus
tgcatgctttctttca

SEQ ID NO: 441762 - DNA, 16 bp, M. musculus
tgcatggccaatgggc

SEQ ID NO: 441763 - DNA, 16 bp, M. musculus
tgcatggccataatat

SEQ ID NO: 441764 - DNA, 16 bp, M. musculus
tgcatgggtgtgtgca

SEQ ID NO: 441765 - DNA, 16 bp, M. musculus
tgcatgtaaaataaaa

SEQ ID NO: 441766 - DNA, 16 bp, M. musculus
tgcatgtaattttaaa

SEQ ID NO: 441767 - DNA, 16 bp, M. musculus
tgcatgtaggtatgtg

SEQ ID NO: 441768 - DNA, 16 bp, M. musculus
tgcatgtatatgtgta

SEQ ID NO: 441769 - DNA, 16 bp, M. musculus
tgcatgtatgcatgtg

SEQ ID NO: 441770 - DNA, 16 bp, M. musculus
tgcatgtatgtatgta

SEQ ID NO: 441771 - DNA, 16 bp, M. musculus
tgcatgtatgtctgca

SEQ ID NO: 441772 - DNA, 16 bp, M. musculus
tgcatgtatgtctgta

SEQ ID NO: 441773 - DNA, 16 bp, M. musculus
tgcatgtatgtctgtg

SEQ ID NO: 441774 - DNA, 16 bp, M. musculus
tgcatgtatgtgtaca

SEQ ID NO: 441775 - DNA, 16 bp, M. musculus
tgcatgtatgtgtatg

SEQ ID NO: 441776 - DNA, 16 bp, M. musculus
tgcatgtatgtgtatt

SEQ ID NO: 441777 - DNA, 16 bp, M. musculus
tgcatgtatgtgtgca

SEQ ID NO: 441778 - DNA, 16 bp, M. musculus
tgcatgtatgtgtgtg

SEQ ID NO: 441779 - DNA, 16 bp, M. musculus
tgcatgtatttgtgtg

SEQ ID NO: 441780 - DNA, 16 bp, M. musculus
tgcatgtcatgtgagt

SEQ ID NO: 441781 - DNA, 16 bp, M. musculus
tgcatgtctgtgcacc

SEQ ID NO: 441782 - DNA, 16 bp, M. musculus
tgcatgtgaatgcagg

SEQ ID NO: 441783 - DNA, 16 bp, M. musculus
tgcatgtgagtgtgca

SEQ ID NO: 441784 - DNA, 16 bp, M. musculus
tgcatgtgcacacaca

SEQ ID NO: 441785 - DNA, 16 bp, M. musculus
tgcatgtgcacataca

SEQ ID NO: 441786 - DNA, 16 bp, M. musculus
tgcatgtgcacatgtg

SEQ ID NO: 441787 - DNA, 16 bp, M. musculus
tgcatgtgcacctgca

SEQ ID NO: 441788 - DNA, 16 bp, M. musculus
tgcatgtgcagacaca

SEQ ID NO: 441789 - DNA, 17 bp, M. musculus
tgcatgtgccagcaaga

SEQ ID NO: 441790 - DNA, 16 bp, M. musculus
tgcatgtgcctgcatg

SEQ ID NO: 441791 - DNA, 16 bp, M. musculus
tgcatgtgcgtgtgca

SEQ ID NO: 441792 - DNA, 16 bp, M. musculus
tgcatgtggatgtgtg

SEQ ID NO: 441793 - DNA, 16 bp, M. musculus
tgcatgtgtaaatgtg

SEQ ID NO: 441794 - DNA, 16 bp, M. musculus
tgcatgtgtacacaca

SEQ ID NO: 441795 - DNA, 16 bp, M. musculus
tgcatgtgtatatgtg

SEQ ID NO: 441796 - DNA, 16 bp, M. musculus
tgcatgtgtatgtata

SEQ ID NO: 441797 - DNA, 16 bp, M. musculus
tgcatgtgtatgtgtg

SEQ ID NO: 441798 - DNA, 16 bp, M. musculus
tgcatgtgtgaacaca

SEQ ID NO: 441799 - DNA, 16 bp, M. musculus
tgcatgtgtgcacgca

SEQ ID NO: 441800 - DNA, 16 bp, M. musculus
tgcatgtgtgcagatg

SEQ ID NO: 441801 - DNA, 16 bp, M. musculus
tgcatgtgtgcatgca

SEQ ID NO: 441802 - DNA, 16 bp, M. musculus
tgcatgtgtgcatgga

SEQ ID NO: 441803 - DNA, 16 bp, M. musculus
tgcatgtgtgcatgtg

SEQ ID NO: 441804 - DNA, 16 bp, M. musculus
tgcatgtgtgtacaca

SEQ ID NO: 441805 - DNA, 16 bp, M. musculus
tgcatgtgtgtacaga

SEQ ID NO: 441806 - DNA, 16 bp, M. musculus
tgcatgtgtgtatgca

SEQ ID NO: 441807 - DNA, 16 bp, M. musculus
tgcatgtgtgtatgta

SEQ ID NO: 441808 - DNA, 16 bp, M. musculus
tgcatgtgtgtatgtc

SEQ ID NO: 441809 - DNA, 16 bp, M. musculus
tgcatgtgtgtatgtg

SEQ ID NO: 441810 - DNA, 16 bp, M. musculus
tgcatgtgtgtctttg

SEQ ID NO: 441811 - DNA, 16 bp, M. musculus
tgcatgtgtgtgatgt

SEQ ID NO: 441812 - DNA, 16 bp, M. musculus
tgcatgtgtgtgcaca

SEQ ID NO: 441813 - DNA, 16 bp, M. musculus
tgcatgtgtgtgcgtg

SEQ ID NO: 441814 - DNA, 16 bp, M. musculus
tgcatgtgtgtgtaca

SEQ ID NO: 441815 - DNA, 16 bp, M. musculus
tgcatgtgtgtgtgag

SEQ ID NO: 441816 - DNA, 16 bp, M. musculus
tgcatgtgtgtgtgcg

SEQ ID NO: 441817 - DNA, 16 bp, M. musculus
tgcatgtgtgtgtttc

SEQ ID NO: 441818 - DNA, 16 bp, M. musculus
tgcatgtgttcacaca

SEQ ID NO: 441819 - DNA, 16 bp, M. musculus
tgcatgtgtttgtgtt

SEQ ID NO: 441820 - DNA, 16 bp, M. musculus
tgcatgttcacatgca

SEQ ID NO: 441821 - DNA, 16 bp, M. musculus
tgcatgttcatgtgtg

SEQ ID NO: 441822 - DNA, 16 bp, M. musculus
tgcatgttgtatgtgt

SEQ ID NO: 441823 - DNA, 16 bp, M. musculus
tgcatgtttgtatgta

SEQ ID NO: 441824 - DNA, 16 bp, M. musculus
tgcattaaataaagat

SEQ ID NO: 441825 - DNA, 16 bp, M. musculus
tgcattatttatttat

SEQ ID NO: 441826 - DNA, 16 bp, M. musculus
tgcattattttacatg

SEQ ID NO: 441827 - DNA, 16 bp, M. musculus
tgcattcatgcacaca

SEQ ID NO: 441828 - DNA, 16 bp, M. musculus
tgcattcatgcatgtg

SEQ ID NO: 441829 - DNA, 16 bp, M. musculus
tgcattccccatcaaa

SEQ ID NO: 441830 - DNA, 16 bp, M. musculus
tgcattctccttctaa

SEQ ID NO: 441831 - DNA, 17 bp, M. musculus
tgcattctttgtgcaaa

SEQ ID NO: 441832 - DNA, 16 bp, M. musculus
tgcattgcgcagatgc

SEQ ID NO: 441833 - DNA, 16 bp, M. musculus
tgcattggttcacctt

SEQ ID NO: 441834 - DNA, 16 bp, M. musculus
tgcatttaaaaaacaa

SEQ ID NO: 441835 - DNA, 16 bp, M. musculus
tgcatttaaataataa

SEQ ID NO: 441836 - DNA, 16 bp, M. musculus
tgcatttaatttattt

SEQ ID NO: 441837 - DNA, 16 bp, M. musculus
tgcatttatttatata

SEQ ID NO: 441838 - DNA, 16 bp, M. musculus
tgcatttatttatatg

SEQ ID NO: 441839 - DNA, 16 bp, M. musculus
tgcatttatttcattt

SEQ ID NO: 441840 - DNA, 16 bp, M. musculus
tgcatttcctgatgac

SEQ ID NO: 441841 - DNA, 16 bp, M. musculus
tgcatttctctctaca

SEQ ID NO: 441842 - DNA, 16 bp, M. musculus
tgcatttctctctgct

SEQ ID NO: 441843 - DNA, 16 bp, M. musculus
tgcatttctctttatg

SEQ ID NO: 441844 - DNA, 16 bp, M. musculus
tgcatttcttcaggat

SEQ ID NO: 441845 - DNA, 16 bp, M. musculus
tgcatttgaagcatag

SEQ ID NO: 441846 - DNA, 16 bp, M. musculus
tgcatttgacaaaatt

SEQ ID NO: 441847 - DNA, 16 bp, M. musculus
tgcatttgcttctttt

SEQ ID NO: 441848 - DNA, 16 bp, M. musculus
tgcatttgtatgtatg

SEQ ID NO: 441849 - DNA, 16 bp, M. musculus
tgcatttgtgtgtatg

SEQ ID NO: 441850 - DNA, 16 bp, M. musculus
tgcatttgtgttctct

SEQ ID NO: 441851 - DNA, 16 bp, M. musculus
tgcatttgttgggact

SEQ ID NO: 441852 - DNA, 16 bp, M. musculus
tgcatttgttgttatg

SEQ ID NO: 441853 - DNA, 16 bp, M. musculus
tgcattttcctctgtt

SEQ ID NO: 441854 - DNA, 16 bp, M. musculus
tgcattttgattgttt

SEQ ID NO: 441855 - DNA, 16 bp, M. musculus
tgcattttgtattttc

SEQ ID NO: 441856 - DNA, 16 bp, M. musculus
tgcattttgttttaaa

SEQ ID NO: 441857 - DNA, 16 bp, M. musculus
tgcatttttctttcct

SEQ ID NO: 441858 - DNA, 16 bp, M. musculus
tgccaaaacaaaacaa

SEQ ID NO: 441859 - DNA, 16 bp, M. musculus
tgccaaaacaatatta

SEQ ID NO: 441860 - DNA, 16 bp, M. musculus
tgccaaaaccaccatc

SEQ ID NO: 441861 - DNA, 16 bp, M. musculus
tgccaaagaatttcat

SEQ ID NO: 441862 - DNA, 16 bp, M. musculus
tgccaaagaccagcct

SEQ ID NO: 441863 - DNA, 16 bp, M. musculus
tgccaaagcttttaaa

SEQ ID NO: 441864 - DNA, 16 bp, M. musculus
tgccaaatacagaagt

SEQ ID NO: 441865 - DNA, 16 bp, M. musculus
tgccaaatggtcagcc

SEQ ID NO: 441866 - DNA, 16 bp, M. musculus
tgccaacaagattttt

SEQ ID NO: 441867 - DNA, 16 bp, M. musculus
tgccaacagctcctca

SEQ ID NO: 441868 - DNA, 16 bp, M. musculus
tgccaacaggaccctg

SEQ ID NO: 441869 - DNA, 16 bp, M. musculus
tgccaaccctgggcag

SEQ ID NO: 441870 - DNA, 16 bp, M. musculus
tgccaacctgacacaa

SEQ ID NO: 441871 - DNA, 16 bp, M. musculus
tgccaagcatcagctg

SEQ ID NO: 441872 - DNA, 16 bp, M. musculus
tgccaagccatttctc

SEQ ID NO: 441873 - DNA, 16 bp, M. musculus
tgccaagcctcagctt

SEQ ID NO: 441874 - DNA, 16 bp, M. musculus
tgccaaggacatggag

SEQ ID NO: 441875 - DNA, 16 bp, M. musculus
tgccaaggaccaagcc

SEQ ID NO: 441876 - DNA, 16 bp, M. musculus
tgccaaggatttgcta

SEQ ID NO: 441877 - DNA, 16 bp, M. musculus
tgccaaggccaagaag

SEQ ID NO: 441878 - DNA, 16 bp, M. musculus
tgccaagtcactgcct

SEQ ID NO: 441879 - DNA, 16 bp, M. musculus
tgccaagtctaacaac

SEQ ID NO: 441880 - DNA, 16 bp, M. musculus
tgccaagttgacataa

SEQ ID NO: 441881 - DNA, 16 bp, M. musculus
tgccaatccatgtgca

SEQ ID NO: 441882 - DNA, 16 bp, M. musculus
tgccaatcctgatgac

SEQ ID NO: 441883 - DNA, 16 bp, M. musculus
tgccaatgagctcaag

SEQ ID NO: 441884 - DNA, 16 bp, M. musculus
tgccaatgcaattaat

SEQ ID NO: 441885 - DNA, 16 bp, M. musculus
tgccaatttaaaaaaa

SEQ ID NO: 441886 - DNA, 16 bp, M. musculus
tgccacaaagctttcc

SEQ ID NO: 441887 - DNA, 16 bp, M. musculus
tgccacacacacacac

SEQ ID NO: 441888 - DNA, 16 bp, M. musculus
tgccacacactttcca

SEQ ID NO: 441889 - DNA, 16 bp, M. musculus
tgccacaccaacccca

SEQ ID NO: 441890 - DNA, 16 bp, M. musculus
tgccacaccctgggcc

SEQ ID NO: 441891 - DNA, 16 bp, M. musculus
tgccacagcactccat

SEQ ID NO: 441892 - DNA, 16 bp, M. musculus
tgccacagcatgcatg

SEQ ID NO: 441893 - DNA, 16 bp, M. musculus
tgccacagcctcctga

SEQ ID NO: 441894 - DNA, 16 bp, M. musculus
tgccacagctcttcat

SEQ ID NO: 441895 - DNA, 16 bp, M. musculus
tgccacaggggcacct

SEQ ID NO: 441896 - DNA, 16 bp, M. musculus
tgccacagtctctgag

SEQ ID NO: 441897 - DNA, 16 bp, M. musculus
tgccacagttggacct

SEQ ID NO: 441898 - DNA, 16 bp, M. musculus
tgccacataagcatga

SEQ ID NO: 441899 - DNA, 16 bp, M. musculus
tgccaccaacaatgga

SEQ ID NO: 441900 - DNA, 16 bp, M. musculus
tgccaccaagcctgac

SEQ ID NO: 441901 - DNA, 16 bp, M. musculus
tgccaccaagcctggc

SEQ ID NO: 441902 - DNA, 16 bp, M. musculus
tgccaccaagcttgat

SEQ ID NO: 441903 - DNA, 16 bp, M. musculus
tgccaccaagtctgag

SEQ ID NO: 441904 - DNA, 16 bp, M. musculus
tgccaccaatcctgat

SEQ ID NO: 441905 - DNA, 16 bp, M. musculus
tgccaccacacctggc

SEQ ID NO: 441906 - DNA, 16 bp, M. musculus
tgccaccacagcctgg

SEQ ID NO: 441907 - DNA, 16 bp, M. musculus
tgccaccacagctggc

SEQ ID NO: 441908 - DNA, 16 bp, M. musculus
tgccaccacatccaac

SEQ ID NO: 441909 - DNA, 16 bp, M. musculus
tgccaccaccaccacc

SEQ ID NO: 441910 - DNA, 16 bp, M. musculus
tgccaccaccaccctg

SEQ ID NO: 441911 - DNA, 16 bp, M. musculus
tgccaccaccacctcc

SEQ ID NO: 441912 - DNA, 16 bp, M. musculus
tgccaccaccactacc

SEQ ID NO: 441913 - DNA, 16 bp, M. musculus
tgccaccaccatccag

SEQ ID NO: 441914 - DNA, 16 bp, M. musculus
tgccaccaccatctgg

SEQ ID NO: 441915 - DNA, 16 bp, M. musculus
tgccaccacccccagc

SEQ ID NO: 441916 - DNA, 16 bp, M. musculus
tgccaccacctcccaa

SEQ ID NO: 441917 - DNA, 16 bp, M. musculus
tgccaccactcccagc

SEQ ID NO: 441918 - DNA, 16 bp, M. musculus
tgccaccactcctggc

SEQ ID NO: 441919 - DNA, 16 bp, M. musculus
tgccaccactgccagg

SEQ ID NO: 441920 - DNA, 16 bp, M. musculus
tgccaccactgcctga

SEQ ID NO: 441921 - DNA, 16 bp, M. musculus
tgccaccactgctgct

SEQ ID NO: 441922 - DNA, 16 bp, M. musculus
tgccaccagacccagc

SEQ ID NO: 441923 - DNA, 16 bp, M. musculus
tgccaccaggcctggt

SEQ ID NO: 441924 - DNA, 16 bp, M. musculus
tgccaccatggcacgg

SEQ ID NO: 441925 - DNA, 16 bp, M. musculus
tgccaccatgtccagc

SEQ ID NO: 441926 - DNA, 16 bp, M. musculus
tgccaccattcccagc

SEQ ID NO: 441927 - DNA, 16 bp, M. musculus
tgccaccattgcctgg

SEQ ID NO: 441928 - DNA, 16 bp, M. musculus
tgccacccacagacct

SEQ ID NO: 441929 - DNA, 16 bp, M. musculus
tgccacccacagtgag

SEQ ID NO: 441930 - DNA, 16 bp, M. musculus
tgccacccctgcccag

SEQ ID NO: 441931 - DNA, 16 bp, M. musculus
tgccaccgccaccacc

SEQ ID NO: 441932 - DNA, 16 bp, M. musculus
tgccacctcacagcag

SEQ ID NO: 441933 - DNA, 16 bp, M. musculus
tgccacctctgcctgg

SEQ ID NO: 441934 - DNA, 16 bp, M. musculus
tgccactcactccctg

SEQ ID NO: 441935 - DNA, 16 bp, M. musculus
tgccactccctggccc

SEQ ID NO: 441936 - DNA, 16 bp, M. musculus
tgccactccctggtgc

SEQ ID NO: 441937 - DNA, 16 bp, M. musculus
tgccactccctgtggg

SEQ ID NO: 441938 - DNA, 16 bp, M. musculus
tgccactgagctatgt

SEQ ID NO: 441939 - DNA, 16 bp, M. musculus
tgccactgaggctgca

SEQ ID NO: 441940 - DNA, 16 bp, M. musculus
tgccactgctgctgct

SEQ ID NO: 441941 - DNA, 16 bp, M. musculus
tgccactgtgtgtgtg

SEQ ID NO: 441942 - DNA, 16 bp, M. musculus
tgccacttccccaggg

SEQ ID NO: 441943 - DNA, 16 bp, M. musculus
tgccacttcctggacc

SEQ ID NO: 441944 - DNA, 16 bp, M. musculus
tgccagaaaaaaaaat

SEQ ID NO: 441945 - DNA, 16 bp, M. musculus
tgccagaaccaggaat

SEQ ID NO: 441946 - DNA, 16 bp, M. musculus
tgccagaagctggaaa

SEQ ID NO: 441947 - DNA, 16 bp, M. musculus
tgccagaagcttggga

SEQ ID NO: 441948 - DNA, 16 bp, M. musculus
tgccagacaagcactc

SEQ ID NO: 441949 - DNA, 16 bp, M. musculus
tgccagagagattggt

SEQ ID NO: 441950 - DNA, 16 bp, M. musculus
tgccagagccagacca

SEQ ID NO: 441951 - DNA, 17 bp, M. musculus
tgccagagccttacaaa

SEQ ID NO: 441952 - DNA, 16 bp, M. musculus
tgccagagctgtggga

SEQ ID NO: 441953 - DNA, 16 bp, M. musculus
tgccagaggacctggg

SEQ ID NO: 441954 - DNA, 16 bp, M. musculus
tgccagaggctccaaa

SEQ ID NO: 441955 - DNA, 16 bp, M. musculus
tgccagagtgattggt

SEQ ID NO: 441956 - DNA, 16 bp, M. musculus
tgccagagttcctgtg

SEQ ID NO: 441957 - DNA, 16 bp, M. musculus
tgccagagttctggtg

SEQ ID NO: 441958 - DNA, 16 bp, M. musculus
tgccagagtttcccta

SEQ ID NO: 441959 - DNA, 16 bp, M. musculus
tgccagatgacagtca

SEQ ID NO: 441960 - DNA, 16 bp, M. musculus
tgccagatgctcatct

SEQ ID NO: 441961 - DNA, 16 bp, M. musculus
tgccagatgctcctct

SEQ ID NO: 441962 - DNA, 16 bp, M. musculus
tgccagcacatctgtt

SEQ ID NO: 441963 - DNA, 16 bp, M. musculus
tgccagcaccaatttt

SEQ ID NO: 441964 - DNA, 16 bp, M. musculus
tgccagcacctgctgt

SEQ ID NO: 441965 - DNA, 17 bp, M. musculus
tgccagcagagagtact

SEQ ID NO: 441966 - DNA, 16 bp, M. musculus
tgccagcagaggtcag

SEQ ID NO: 441967 - DNA, 16 bp, M. musculus
tgccagcaggagcagg

SEQ ID NO: 441968 - DNA, 16 bp, M. musculus
tgccagcaggattttg

SEQ ID NO: 441969 - DNA, 16 bp, M. musculus
tgccagcatctgctga

SEQ ID NO: 441970 - DNA, 18 bp, M. musculus
tgccagcatctgctgtca

SEQ ID NO: 441971 - DNA, 16 bp, M. musculus
tgccagccagccagcc

SEQ ID NO: 441972 - DNA, 16 bp, M. musculus
tgccagccaggaggac

SEQ ID NO: 441973 - DNA, 18 bp, M. musculus
tgccagcccttaggagga

SEQ ID NO: 441974 - DNA, 16 bp, M. musculus
tgccagcctaggctat

SEQ ID NO: 441975 - DNA, 17 bp, M. musculus
tgccagcctggtctaca

SEQ ID NO: 441976 - DNA, 16 bp, M. musculus
tgccagcctttgcctc

SEQ ID NO: 441977 - DNA, 16 bp, M. musculus
tgccagcgtctgctgt

SEQ ID NO: 441978 - DNA, 16 bp, M. musculus
tgccagctcaaagaac

SEQ ID NO: 441979 - DNA, 16 bp, M. musculus
tgccaggaaaaaaaaa

SEQ ID NO: 441980 - DNA, 16 bp, M. musculus
tgccaggaaagcaaga

SEQ ID NO: 441981 - DNA, 16 bp, M. musculus
tgccaggaaaggaaga

SEQ ID NO: 441982 - DNA, 16 bp, M. musculus
tgccaggaacaggaag

SEQ ID NO: 441983 - DNA, 16 bp, M. musculus
tgccaggaaggaggca

SEQ ID NO: 441984 - DNA, 16 bp, M. musculus
tgccaggacagccagg

SEQ ID NO: 441985 - DNA, 16 bp, M. musculus
tgccaggacagctagg

SEQ ID NO: 441986 - DNA, 16 bp, M. musculus
tgccaggacagggaag

SEQ ID NO: 441987 - DNA, 16 bp, M. musculus
tgccaggaccaggaaa

SEQ ID NO: 441988 - DNA, 16 bp, M. musculus
tgccaggagagagctg

SEQ ID NO: 441989 - DNA, 16 bp, M. musculus
tgccaggaggtggtgg

SEQ ID NO: 441990 - DNA, 16 bp, M. musculus
tgccaggagttcaagg

SEQ ID NO: 441991 - DNA, 16 bp, M. musculus
tgccaggatctcatca

SEQ ID NO: 441992 - DNA, 16 bp, M. musculus
tgccaggcaatggtgg

SEQ ID NO: 441993 - DNA, 17 bp, M. musculus
tgccaggcactggcaga

SEQ ID NO: 441994 - DNA, 16 bp, M. musculus
tgccaggcactggtgg

SEQ ID NO: 441995 - DNA, 16 bp, M. musculus
tgccaggcactgttct

SEQ ID NO: 441996 - DNA, 16 bp, M. musculus
tgccaggcaggcactc

SEQ ID NO: 441997 - DNA, 18 bp, M. musculus
tgccaggcagtggtggca

SEQ ID NO: 441998 - DNA, 16 bp, M. musculus
tgccaggcatcaatgg

SEQ ID NO: 441999 - DNA, 16 bp, M. musculus
tgccaggcccaggaag

SEQ ID NO: 442000 - DNA, 16 bp, M. musculus
tgccaggccctgtgaa

SEQ ID NO: 442001 - DNA, 16 bp, M. musculus
tgccaggccttgggac

SEQ ID NO: 442002 - DNA, 16 bp, M. musculus
tgccaggctctggcat

SEQ ID NO: 442003 - DNA, 16 bp, M. musculus
tgccaggctggcctca

SEQ ID NO: 442004 - DNA, 16 bp, M. musculus
tgccaggcttctgtct

SEQ ID NO: 442005 - DNA, 16 bp, M. musculus
tgccagggacaggaag

SEQ ID NO: 442006 - DNA, 16 bp, M. musculus
tgccagggcaaggagg

SEQ ID NO: 442007 - DNA, 16 bp, M. musculus
tgccagggccaggaag

SEQ ID NO: 442008 - DNA, 16 bp, M. musculus
tgccaggggagagctt

SEQ ID NO: 442009 - DNA, 16 bp, M. musculus
tgccaggggccatgga

SEQ ID NO: 442010 - DNA, 16 bp, M. musculus
tgccaggtctggcctc

SEQ ID NO: 442011 - DNA, 16 bp, M. musculus
tgccagtaccatggaa

SEQ ID NO: 442012 - DNA, 16 bp, M. musculus
tgccagtccaggctac

SEQ ID NO: 442013 - DNA, 16 bp, M. musculus
tgccagtgaagggatg

SEQ ID NO: 442014 - DNA, 16 bp, M. musculus
tgccagtgactgacaa

SEQ ID NO: 442015 - DNA, 17 bp, M. musculus
tgccagtgcctggcaaa

SEQ ID NO: 442016 - DNA, 16 bp, M. musculus
tgccagtgcctggcac

SEQ ID NO: 442017 - DNA, 16 bp, M. musculus
tgccagtgtctggaaa

SEQ ID NO: 442018 - DNA, 16 bp, M. musculus
tgccagtgtgaagaca

SEQ ID NO: 442019 - DNA, 16 bp, M. musculus
tgccagttaatttgtg

SEQ ID NO: 442020 - DNA, 16 bp, M. musculus
tgccagtttaaaaaaa

SEQ ID NO: 442021 - DNA, 16 bp, M. musculus
tgccataaaaacctta

SEQ ID NO: 442022 - DNA, 16 bp, M. musculus
tgccatacagaagctt

SEQ ID NO: 442023 - DNA, 16 bp, M. musculus
tgccatatccaggtat

SEQ ID NO: 442024 - DNA, 16 bp, M. musculus
tgccatatgagtgctg

SEQ ID NO: 442025 - DNA, 16 bp, M. musculus
tgccatatgcaggaat

SEQ ID NO: 442026 - DNA, 16 bp, M. musculus
tgccatatggctggtt

SEQ ID NO: 442027 - DNA, 16 bp, M. musculus
tgccatccctgagctg

SEQ ID NO: 442028 - DNA, 16 bp, M. musculus
tgccatcctcctgcct

SEQ ID NO: 442029 - DNA, 16 bp, M. musculus
tgccatccttgggctg

SEQ ID NO: 442030 - DNA, 16 bp, M. musculus
tgccatctctccagcc

SEQ ID NO: 442031 - DNA, 16 bp, M. musculus
tgccatcttccttctg

SEQ ID NO: 442032 - DNA, 16 bp, M. musculus
tgccatgcccccacct

SEQ ID NO: 442033 - DNA, 16 bp, M. musculus
tgccatgcctacctgc

SEQ ID NO: 442034 - DNA, 16 bp, M. musculus
tgccatgcctgctgcc

SEQ ID NO: 442035 - DNA, 16 bp, M. musculus
tgccatgcttcccact

SEQ ID NO: 442036 - DNA, 16 bp, M. musculus
tgccatggcaacagac

SEQ ID NO: 442037 - DNA, 16 bp, M. musculus
tgccatgtaggtgctg

SEQ ID NO: 442038 - DNA, 16 bp, M. musculus
tgccatgtccccacct

SEQ ID NO: 442039 - DNA, 16 bp, M. musculus
tgccatgtccctgcct

SEQ ID NO: 442040 - DNA, 16 bp, M. musculus
tgccatgtctggcctc

SEQ ID NO: 442041 - DNA, 16 bp, M. musculus
tgccatgtgggtgcca

SEQ ID NO: 442042 - DNA, 17 bp, M. musculus
tgccatgtgggtgctgg

SEQ ID NO: 442043 - DNA, 16 bp, M. musculus
tgccatgttctgcctg

SEQ ID NO: 442044 - DNA, 16 bp, M. musculus
tgccattcaggctgta

SEQ ID NO: 442045 - DNA, 16 bp, M. musculus
tgccattctctgggcc

SEQ ID NO: 442046 - DNA, 16 bp, M. musculus
tgccattctttctctt

SEQ ID NO: 442047 - DNA, 16 bp, M. musculus
tgccattgttccattg

SEQ ID NO: 442048 - DNA, 16 bp, M. musculus
tgccattgttcttggt

SEQ ID NO: 442049 - DNA, 16 bp, M. musculus
tgccatttactcctct

SEQ ID NO: 442050 - DNA, 16 bp, M. musculus
tgccatttactttgat

SEQ ID NO: 442051 - DNA, 16 bp, M. musculus
tgccattttgtcccat

SEQ ID NO: 442052 - DNA, 16 bp, M. musculus
tgccattttgttttca

SEQ ID NO: 442053 - DNA, 16 bp, M. musculus
tgcccaaagaagccac

SEQ ID NO: 442054 - DNA, 18 bp, M. musculus
tgcccaacacccgcaagg

SEQ ID NO: 442055 - DNA, 16 bp, M. musculus
tgcccaaccattggcc

SEQ ID NO: 442056 - DNA, 16 bp, M. musculus
tgcccaagactgagaa

SEQ ID NO: 442057 - DNA, 16 bp, M. musculus
tgcccaagagtgagaa

SEQ ID NO: 442058 - DNA, 16 bp, M. musculus
tgcccaaggaagtcag

SEQ ID NO: 442059 - DNA, 16 bp, M. musculus
tgcccaaggtggcctg

SEQ ID NO: 442060 - DNA, 16 bp, M. musculus
tgcccacagaaaccag

SEQ ID NO: 442061 - DNA, 16 bp, M. musculus
tgcccacagagcccag

SEQ ID NO: 442062 - DNA, 16 bp, M. musculus
tgcccacagagtctcc

SEQ ID NO: 442063 - DNA, 16 bp, M. musculus
tgcccacagcaattct

SEQ ID NO: 442064 - DNA, 16 bp, M. musculus
tgcccacagcagccat

SEQ ID NO: 442065 - DNA, 16 bp, M. musculus
tgcccacagtgaactg

SEQ ID NO: 442066 - DNA, 16 bp, M. musculus
tgcccacccagctggg

SEQ ID NO: 442067 - DNA, 16 bp, M. musculus
tgcccacccggggccg

SEQ ID NO: 442068 - DNA, 17 bp, M. musculus
tgcccacctgccccaga

SEQ ID NO: 442069 - DNA, 16 bp, M. musculus
tgcccacgttctccct

SEQ ID NO: 442070 - DNA, 16 bp, M. musculus
tgcccactgctgcacc

SEQ ID NO: 442071 - DNA, 16 bp, M. musculus
tgcccactgctggaac

SEQ ID NO: 442072 - DNA, 16 bp, M. musculus
tgcccactgtgaagat

SEQ ID NO: 442073 - DNA, 16 bp, M. musculus
tgcccacttctgcctc

SEQ ID NO: 442074 - DNA, 16 bp, M. musculus
tgcccagactggcctt

SEQ ID NO: 442075 - DNA, 16 bp, M. musculus
tgcccagagaagccag

SEQ ID NO: 442076 - DNA, 16 bp, M. musculus
tgcccagagcacagga

SEQ ID NO: 442077 - DNA, 16 bp, M. musculus
tgcccagcaattgtgt

SEQ ID NO: 442078 - DNA, 16 bp, M. musculus
tgcccagcccagccca

SEQ ID NO: 442079 - DNA, 16 bp, M. musculus
tgcccaggaaaatgga

SEQ ID NO: 442080 - DNA, 16 bp, M. musculus
tgcccaggaagggaag

SEQ ID NO: 442081 - DNA, 16 bp, M. musculus
tgcccaggacatcaga

SEQ ID NO: 442082 - DNA, 16 bp, M. musculus
tgcccaggagagaaat

SEQ ID NO: 442083 - DNA, 20 bp, M. musculus
tgcccaggagaggtattgca

SEQ ID NO: 442084 - DNA, 16 bp, M. musculus
tgcccaggagcagtat

SEQ ID NO: 442085 - DNA, 16 bp, M. musculus
tgcccaggagctatct

SEQ ID NO: 442086 - DNA, 16 bp, M. musculus
tgcccaggagggcttt

SEQ ID NO: 442087 - DNA, 16 bp, M. musculus
tgcccaggcttcctgc

SEQ ID NO: 442088 - DNA, 16 bp, M. musculus
tgcccagggatctggg

SEQ ID NO: 442089 - DNA, 16 bp, M. musculus
tgcccagtgattggct

SEQ ID NO: 442090 - DNA, 16 bp, M. musculus
tgcccagtggtcttgg

SEQ ID NO: 442091 - DNA, 16 bp, M. musculus
tgcccatattttcaag

SEQ ID NO: 442092 - DNA, 16 bp, M. musculus
tgcccatctcagggca

SEQ ID NO: 442093 - DNA, 16 bp, M. musculus
tgcccatctgctgccc

SEQ ID NO: 442094 - DNA, 16 bp, M. musculus
tgcccatctgtgacaa

SEQ ID NO: 442095 - DNA, 16 bp, M. musculus
tgcccatgatcataaa

SEQ ID NO: 442096 - DNA, 16 bp, M. musculus
tgcccatgcctttaat

SEQ ID NO: 442097 - DNA, 16 bp, M. musculus
tgcccatgctccagtg

SEQ ID NO: 442098 - DNA, 16 bp, M. musculus
tgcccatggaggccag

SEQ ID NO: 442099 - DNA, 16 bp, M. musculus
tgcccatggaggctag

SEQ ID NO: 442100 - DNA, 16 bp, M. musculus
tgcccatgggggccag

SEQ ID NO: 442101 - DNA, 16 bp, M. musculus
tgcccatgtgtgtatg

SEQ ID NO: 442102 - DNA, 16 bp, M. musculus
tgcccatttccatgtg

SEQ ID NO: 442103 - DNA, 16 bp, M. musculus
tgccccaaatgcaaga

SEQ ID NO: 442104 - DNA, 18 bp, M. musculus
tgccccaaggtcccactc

SEQ ID NO: 442105 - DNA, 16 bp, M. musculus
tgccccaccatgcctg

SEQ ID NO: 442106 - DNA, 16 bp, M. musculus
tgccccactttctcct

SEQ ID NO: 442107 - DNA, 16 bp, M. musculus
tgccccagaagctctg

SEQ ID NO: 442108 - DNA, 17 bp, M. musculus
tgccccagatcaagccc

SEQ ID NO: 442109 - DNA, 16 bp, M. musculus
tgccccagcaaaacat

SEQ ID NO: 442110 - DNA, 16 bp, M. musculus
tgccccaggaaagggg

SEQ ID NO: 442111 - DNA, 16 bp, M. musculus
tgccccaggacatcag

SEQ ID NO: 442112 - DNA, 16 bp, M. musculus
tgccccagggaagagg

SEQ ID NO: 442113 - DNA, 16 bp, M. musculus
tgccccagggaagggg

SEQ ID NO: 442114 - DNA, 16 bp, M. musculus
tgccccatccagggat

SEQ ID NO: 442115 - DNA, 16 bp, M. musculus
tgccccattgtagggg

SEQ ID NO: 442116 - DNA, 16 bp, M. musculus
tgcccccaaccctgaa

SEQ ID NO: 442117 - DNA, 16 bp, M. musculus
tgccccccccccaagt

SEQ ID NO: 442118 - DNA, 16 bp, M. musculus
tgcccctcaattagac

SEQ ID NO: 442119 - DNA, 16 bp, M. musculus
tgcccctccctgggcc

SEQ ID NO: 442120 - DNA, 16 bp, M. musculus
tgcccctccttgtctc

SEQ ID NO: 442121 - DNA, 16 bp, M. musculus
tgcccctctgcctctg

SEQ ID NO: 442122 - DNA, 16 bp, M. musculus
tgcccctgcctcccag

SEQ ID NO: 442123 - DNA, 16 bp, M. musculus
tgcccctgcctccctg

SEQ ID NO: 442124 - DNA, 28 bp, M. musculus
tgcccctgctgccctgattagctgaagc

SEQ ID NO: 442125 - DNA, 30 bp, M. musculus
tgcccctgctgccctgattagctgaagctg

SEQ ID NO: 442126 - DNA, 16 bp, M. musculus
tgcccctgctgggtcc

SEQ ID NO: 442127 - DNA, 16 bp, M. musculus
tgcccctggaaactgt

SEQ ID NO: 442128 - DNA, 16 bp, M. musculus
tgcccctggaggccag

SEQ ID NO: 442129 - DNA, 16 bp, M. musculus
tgcccctgtgacatgg

SEQ ID NO: 442130 - DNA, 16 bp, M. musculus
tgccccttcctagaaa

SEQ ID NO: 442131 - DNA, 16 bp, M. musculus
tgccccttctccaccc

SEQ ID NO: 442132 - DNA, 16 bp, M. musculus
tgccccttggccaccc

SEQ ID NO: 442133 - DNA, 16 bp, M. musculus
tgccccttttccaccc

SEQ ID NO: 442134 - DNA, 16 bp, M. musculus
tgcccggcgtggtggc

SEQ ID NO: 442135 - DNA, 16 bp, M. musculus
tgcccgtctctgcctc

SEQ ID NO: 442136 - DNA, 16 bp, M. musculus
tgcccgtgcccgtgcc

SEQ ID NO: 442137 - DNA, 16 bp, M. musculus
tgccctacagaagctt

SEQ ID NO: 442138 - DNA, 16 bp, M. musculus
tgccctacaggcttgt

SEQ ID NO: 442139 - DNA, 16 bp, M. musculus
tgccctcaaactcaca

SEQ ID NO: 442140 - DNA, 16 bp, M. musculus
tgccctcactcttgct

SEQ ID NO: 442141 - DNA, 16 bp, M. musculus
tgccctcagaagtcag

SEQ ID NO: 442142 - DNA, 16 bp, M. musculus
tgccctcagaggccag

SEQ ID NO: 442143 - DNA, 16 bp, M. musculus
tgccctcagcttcctg

SEQ ID NO: 442144 - DNA, 16 bp, M. musculus
tgccctccagatccat

SEQ ID NO: 442145 - DNA, 16 bp, M. musculus
tgccctccctcagctc

SEQ ID NO: 442146 - DNA, 16 bp, M. musculus
tgccctccctgcagac

SEQ ID NO: 442147 - DNA, 16 bp, M. musculus
tgccctcctcagcttc

SEQ ID NO: 442148 - DNA, 16 bp, M. musculus
tgccctctcctggtgt

SEQ ID NO: 442149 - DNA, 16 bp, M. musculus
tgccctctgacctcca

SEQ ID NO: 442150 - DNA, 16 bp, M. musculus
tgccctctgacttcca

SEQ ID NO: 442151 - DNA, 16 bp, M. musculus
tgccctctgccctctg

SEQ ID NO: 442152 - DNA, 16 bp, M. musculus
tgccctctgcctctgc

SEQ ID NO: 442153 - DNA, 16 bp, M. musculus
tgccctctgctggctt

SEQ ID NO: 442154 - DNA, 16 bp, M. musculus
tgccctctgctggtct

SEQ ID NO: 442155 - DNA, 16 bp, M. musculus
tgccctctgcttcctg

SEQ ID NO: 442156 - DNA, 16 bp, M. musculus
tgccctctggcctctg

SEQ ID NO: 442157 - DNA, 16 bp, M. musculus
tgccctctggtggcca

SEQ ID NO: 442158 - DNA, 16 bp, M. musculus
tgccctctggtgtgtc

SEQ ID NO: 442159 - DNA, 16 bp, M. musculus
tgccctcttcaggcag

SEQ ID NO: 442160 - DNA, 16 bp, M. musculus
tgccctcttccagtgt

SEQ ID NO: 442161 - DNA, 16 bp, M. musculus
tgccctcttcctgcct

SEQ ID NO: 442162 - DNA, 16 bp, M. musculus
tgccctcttcctgtgt

SEQ ID NO: 442163 - DNA, 16 bp, M. musculus
tgccctcttctgacct

SEQ ID NO: 442164 - DNA, 16 bp, M. musculus
tgccctcttctgactc

SEQ ID NO: 442165 - DNA, 16 bp, M. musculus
tgccctcttctggcct

SEQ ID NO: 442166 - DNA, 16 bp, M. musculus
tgccctcttctggtat

SEQ ID NO: 442167 - DNA, 16 bp, M. musculus
tgccctcttctggttt

SEQ ID NO: 442168 - DNA, 16 bp, M. musculus
tgccctcttctgtcct

SEQ ID NO: 442169 - DNA, 16 bp, M. musculus
tgccctcttctgtgtg

SEQ ID NO: 442170 - DNA, 16 bp, M. musculus
tgccctgaaaaaaaaa

SEQ ID NO: 442171 - DNA, 16 bp, M. musculus
tgccctgaaactggag

SEQ ID NO: 442172 - DNA, 16 bp, M. musculus
tgccctgacttccttg

SEQ ID NO: 442173 - DNA, 16 bp, M. musculus
tgccctgacttctctg

SEQ ID NO: 442174 - DNA, 16 bp, M. musculus
tgccctgacttctgtc

SEQ ID NO: 442175 - DNA, 16 bp, M. musculus
tgccctgagaacatgg

SEQ ID NO: 442176 - DNA, 16 bp, M. musculus
tgccctgagcagcctg

SEQ ID NO: 442177 - DNA, 16 bp, M. musculus
tgccctgagctctggg

SEQ ID NO: 442178 - DNA, 17 bp, M. musculus
tgccctgaggcccagct

SEQ ID NO: 442179 - DNA, 16 bp, M. musculus
tgccctgcagctggag

SEQ ID NO: 442180 - DNA, 16 bp, M. musculus
tgccctgccctgccca

SEQ ID NO: 442181 - DNA, 16 bp, M. musculus
tgccctgccttcctgc

SEQ ID NO: 442182 - DNA, 16 bp, M. musculus
tgccctgccttccttc

SEQ ID NO: 442183 - DNA, 16 bp, M. musculus
tgccctgctccacaac

SEQ ID NO: 442184 - DNA, 16 bp, M. musculus
tgccctgctcccacct

SEQ ID NO: 442185 - DNA, 16 bp, M. musculus
tgccctgctcctgccc

SEQ ID NO: 442186 - DNA, 16 bp, M. musculus
tgccctgctgtgtctg

SEQ ID NO: 442187 - DNA, 17 bp, M. musculus
tgccctggaactcacta

SEQ ID NO: 442188 - DNA, 16 bp, M. musculus
tgccctggactgggag

SEQ ID NO: 442189 - DNA, 16 bp, M. musculus
tgccctggagctgacc

SEQ ID NO: 442190 - DNA, 16 bp, M. musculus
tgccctggagctggaa

SEQ ID NO: 442191 - DNA, 16 bp, M. musculus
tgccctggagctggag

SEQ ID NO: 442192 - DNA, 16 bp, M. musculus
tgccctggctggcctg

SEQ ID NO: 442193 - DNA, 16 bp, M. musculus
tgccctggtcatggtg

SEQ ID NO: 442194 - DNA, 16 bp, M. musculus
tgccctgtcttcctgt

SEQ ID NO: 442195 - DNA, 16 bp, M. musculus
tgccctgtgtcatgga

SEQ ID NO: 442196 - DNA, 16 bp, M. musculus
tgccctgtttgatttc

SEQ ID NO: 442197 - DNA, 16 bp, M. musculus
tgcccttaaagaagag

SEQ ID NO: 442198 - DNA, 16 bp, M. musculus
tgcccttacatttgga

SEQ ID NO: 442199 - DNA, 16 bp, M. musculus
tgcccttagaggtcag

SEQ ID NO: 442200 - DNA, 16 bp, M. musculus
tgcccttccagaggac

SEQ ID NO: 442201 - DNA, 16 bp, M. musculus
tgcccttccagaggtc

SEQ ID NO: 442202 - DNA, 16 bp, M. musculus
tgcccttcccacctcc

SEQ ID NO: 442203 - DNA, 16 bp, M. musculus
tgcccttctctgcctc

SEQ ID NO: 442204 - DNA, 16 bp, M. musculus
tgcccttgcaaaggac

SEQ ID NO: 442205 - DNA, 16 bp, M. musculus
tgcccttgcccttgcc

SEQ ID NO: 442206 - DNA, 16 bp, M. musculus
tgcccttgctgtctct

SEQ ID NO: 442207 - DNA, 16 bp, M. musculus
tgcccttggaggccag

SEQ ID NO: 442208 - DNA, 16 bp, M. musculus
tgccctttgtcatcct

SEQ ID NO: 442209 - DNA, 16 bp, M. musculus
tgcccttttctggcat

SEQ ID NO: 442210 - DNA, 16 bp, M. musculus
tgccgactgctcttcc

SEQ ID NO: 442211 - DNA, 16 bp, M. musculus
tgccgagccatctctc

SEQ ID NO: 442212 - DNA, 16 bp, M. musculus
tgccgaggacacggag

SEQ ID NO: 442213 - DNA, 16 bp, M. musculus
tgccgggacctagcaa

SEQ ID NO: 442214 - DNA, 16 bp, M. musculus
tgccgggcatggtggc

SEQ ID NO: 442215 - DNA, 16 bp, M. musculus
tgccgggcgtggtggc

SEQ ID NO: 442216 - DNA, 16 bp, M. musculus
tgcctaacaaggccat

SEQ ID NO: 442217 - DNA, 16 bp, M. musculus
tgcctaacagaagctt

SEQ ID NO: 442218 - DNA, 16 bp, M. musculus
tgcctaagaatttcat

SEQ ID NO: 442219 - DNA, 16 bp, M. musculus
tgcctaagaatttcct

SEQ ID NO: 442220 - DNA, 16 bp, M. musculus
tgcctaagaattttat

SEQ ID NO: 442221 - DNA, 16 bp, M. musculus
tgcctaagctctggga

SEQ ID NO: 442222 - DNA, 16 bp, M. musculus
tgcctaatggctgctg

SEQ ID NO: 442223 - DNA, 16 bp, M. musculus
tgcctacagagagtgc

SEQ ID NO: 442224 - DNA, 16 bp, M. musculus
tgcctacatgtgtgta

SEQ ID NO: 442225 - DNA, 16 bp, M. musculus
tgcctaccttgtcatg

SEQ ID NO: 442226 - DNA, 16 bp, M. musculus
tgcctactgtgtgctg

SEQ ID NO: 442227 - DNA, 16 bp, M. musculus
tgcctacttcctggca

SEQ ID NO: 442228 - DNA, 16 bp, M. musculus
tgcctactttctccct

SEQ ID NO: 442229 - DNA, 16 bp, M. musculus
tgcctagaaatttgtc

SEQ ID NO: 442230 - DNA, 17 bp, M. musculus
tgcctagaatcccccaa

SEQ ID NO: 442231 - DNA, 16 bp, M. musculus
tgcctagacagattag

SEQ ID NO: 442232 - DNA, 16 bp, M. musculus
tgcctagcagtagatg

SEQ ID NO: 442233 - DNA, 16 bp, M. musculus
tgcctagcatgtataa

SEQ ID NO: 442234 - DNA, 16 bp, M. musculus
tgcctagcatgtgcaa

SEQ ID NO: 442235 - DNA, 16 bp, M. musculus
tgcctaggaatttcct

SEQ ID NO: 442236 - DNA, 16 bp, M. musculus
tgcctagggaatagtg

SEQ ID NO: 442237 - DNA, 16 bp, M. musculus
tgcctagtcctgcaga

SEQ ID NO: 442238 - DNA, 18 bp, M. musculus
tgcctagttgctgatgct

SEQ ID NO: 442239 - DNA, 18 bp, M. musculus
tgcctataatcccagcac

SEQ ID NO: 442240 - DNA, 16 bp, M. musculus
tgcctataattccagc

SEQ ID NO: 442241 - DNA, 16 bp, M. musculus
tgcctatatgagggtg

SEQ ID NO: 442242 - DNA, 17 bp, M. musculus
tgcctatccactggata

SEQ ID NO: 442243 - DNA, 16 bp, M. musculus
tgcctatctgcctgcc

SEQ ID NO: 442244 - DNA, 16 bp, M. musculus
tgcctcaaaaagaaaa

SEQ ID NO: 442245 - DNA, 16 bp, M. musculus
tgcctcaaaacaaaca

SEQ ID NO: 442246 - DNA, 16 bp, M. musculus
tgcctcaaactcctct

SEQ ID NO: 442247 - DNA, 16 bp, M. musculus
tgcctcaacctcccca

SEQ ID NO: 442248 - DNA, 16 bp, M. musculus
tgcctcaacttcccaa

SEQ ID NO: 442249 - DNA, 16 bp, M. musculus
tgcctcaacttcccca

SEQ ID NO: 442250 - DNA, 16 bp, M. musculus
tgcctcaagaagaacc

SEQ ID NO: 442251 - DNA, 16 bp, M. musculus
tgcctcacaactgcct

SEQ ID NO: 442252 - DNA, 16 bp, M. musculus
tgcctcacagacatgc

SEQ ID NO: 442253 - DNA, 17 bp, M. musculus
tgcctcactttgtgttt

SEQ ID NO: 442254 - DNA, 16 bp, M. musculus
tgcctcagaagctttg

SEQ ID NO: 442255 - DNA, 16 bp, M. musculus
tgcctcagcacgtgca

SEQ ID NO: 442256 - DNA, 16 bp, M. musculus
tgcctcagcatgtgca

SEQ ID NO: 442257 - DNA, 16 bp, M. musculus
tgcctcagcctcagcc

SEQ ID NO: 442258 - DNA, 16 bp, M. musculus
tgcctcagcctccaaa

SEQ ID NO: 442259 - DNA, 16 bp, M. musculus
tgcctcagcctcccaa

SEQ ID NO: 442260 - DNA, 16 bp, M. musculus
tgcctcagcctcctag

SEQ ID NO: 442261 - DNA, 16 bp, M. musculus
tgcctcagcctctcaa

SEQ ID NO: 442262 - DNA, 16 bp, M. musculus
tgcctcagcctctgcc

SEQ ID NO: 442263 - DNA, 16 bp, M. musculus
tgcctcagctcctgct

SEQ ID NO: 442264 - DNA, 16 bp, M. musculus
tgcctcaggctcctgg

SEQ ID NO: 442265 - DNA, 16 bp, M. musculus
tgcctcagtctcactt

SEQ ID NO: 442266 - DNA, 16 bp, M. musculus
tgcctcagtctcccca

SEQ ID NO: 442267 - DNA, 16 bp, M. musculus
tgcctcagtctctgga

SEQ ID NO: 442268 - DNA, 16 bp, M. musculus
tgcctcagtttcccct

SEQ ID NO: 442269 - DNA, 16 bp, M. musculus
tgcctcagtttctcag

SEQ ID NO: 442270 - DNA, 16 bp, M. musculus
tgcctcagtttctctc

SEQ ID NO: 442271 - DNA, 16 bp, M. musculus
tgcctcagtttctctt

SEQ ID NO: 442272 - DNA, 16 bp, M. musculus
tgcctcagttttctga

SEQ ID NO: 442273 - DNA, 16 bp, M. musculus
tgcctcatctctgaat

SEQ ID NO: 442274 - DNA, 16 bp, M. musculus
tgcctcatgctctagc

SEQ ID NO: 442275 - DNA, 16 bp, M. musculus
tgcctccaaaaagaaa

SEQ ID NO: 442276 - DNA, 16 bp, M. musculus
tgcctccaaaaggaaa

SEQ ID NO: 442277 - DNA, 16 bp, M. musculus
tgcctccaaagtgctg

SEQ ID NO: 442278 - DNA, 16 bp, M. musculus
tgcctccacctcccca

SEQ ID NO: 442279 - DNA, 16 bp, M. musculus
tgcctccacctcctga

SEQ ID NO: 442280 - DNA, 16 bp, M. musculus
tgcctccacctctgcc

SEQ ID NO: 442281 - DNA, 16 bp, M. musculus
tgcctccaccttctga

SEQ ID NO: 442282 - DNA, 17 bp, M. musculus
tgcctccaggttcctgc

SEQ ID NO: 442283 - DNA, 16 bp, M. musculus
tgcctccagtgcctcc

SEQ ID NO: 442284 - DNA, 16 bp, M. musculus
tgcctccatcagtgtg

SEQ ID NO: 442285 - DNA, 16 bp, M. musculus
tgcctccatctcccaa

SEQ ID NO: 442286 - DNA, 16 bp, M. musculus
tgcctccatctcccat

SEQ ID NO: 442287 - DNA, 16 bp, M. musculus
tgcctccattagactg

SEQ ID NO: 442288 - DNA, 16 bp, M. musculus
tgcctccatttcccaa

SEQ ID NO: 442289 - DNA, 16 bp, M. musculus
tgcctccatttcctga

SEQ ID NO: 442290 - DNA, 16 bp, M. musculus
tgcctcccaactgctg

SEQ ID NO: 442291 - DNA, 16 bp, M. musculus
tgcctcccaagcacta

SEQ ID NO: 442292 - DNA, 16 bp, M. musculus
tgcctcccacccccag

SEQ ID NO: 442293 - DNA, 16 bp, M. musculus
tgcctcccatctcact

SEQ ID NO: 442294 - DNA, 16 bp, M. musculus
tgcctccccacccttg

SEQ ID NO: 442295 - DNA, 16 bp, M. musculus
tgcctcccctcccact

SEQ ID NO: 442296 - DNA, 16 bp, M. musculus
tgcctccctagagctg

SEQ ID NO: 442297 - DNA, 16 bp, M. musculus
tgcctccctcctttgg

SEQ ID NO: 442298 - DNA, 16 bp, M. musculus
tgcctccctgcctgct

SEQ ID NO: 442299 - DNA, 16 bp, M. musculus
tgcctccctgtcctgg

SEQ ID NO: 442300 - DNA, 16 bp, M. musculus
tgcctccgcctctgcc

SEQ ID NO: 442301 - DNA, 16 bp, M. musculus
tgcctcctaagtgcta

SEQ ID NO: 442302 - DNA, 16 bp, M. musculus
tgcctcctcagcatcc

SEQ ID NO: 442303 - DNA, 16 bp, M. musculus
tgcctcctcctcctga

SEQ ID NO: 442304 - DNA, 16 bp, M. musculus
tgcctcctgactgagg

SEQ ID NO: 442305 - DNA, 16 bp, M. musculus
tgcctcctgactgtgg

SEQ ID NO: 442306 - DNA, 16 bp, M. musculus
tgcctcctgagtgtag

SEQ ID NO: 442307 - DNA, 16 bp, M. musculus
tgcctcctgattgctg

SEQ ID NO: 442308 - DNA, 16 bp, M. musculus
tgcctcctgccagaag

SEQ ID NO: 442309 - DNA, 16 bp, M. musculus
tgcctcctgccagctg

SEQ ID NO: 442310 - DNA, 16 bp, M. musculus
tgcctcctgccatctt

SEQ ID NO: 442311 - DNA, 16 bp, M. musculus
tgcctcctgcctccca

SEQ ID NO: 442312 - DNA, 16 bp, M. musculus
tgcctcctgcctgctg

SEQ ID NO: 442313 - DNA, 16 bp, M. musculus
tgcctcctgctgatgg

SEQ ID NO: 442314 - DNA, 16 bp, M. musculus
tgcctcctggtgctgg

SEQ ID NO: 442315 - DNA, 16 bp, M. musculus
tgcctcctgtcatctg

SEQ ID NO: 442316 - DNA, 16 bp, M. musculus
tgcctccttctggtgt

SEQ ID NO: 442317 - DNA, 16 bp, M. musculus
tgcctcgaaaaagaaa

SEQ ID NO: 442318 - DNA, 17 bp, M. musculus
tgcctcgagatcttggc

SEQ ID NO: 442319 - DNA, 16 bp, M. musculus
tgcctcggcatgggcc

SEQ ID NO: 442320 - DNA, 16 bp, M. musculus
tgcctcggcttcctga

SEQ ID NO: 442321 - DNA, 16 bp, M. musculus
tgcctctacctcccta

SEQ ID NO: 442322 - DNA, 16 bp, M. musculus
tgcctctagccatctg

SEQ ID NO: 442323 - DNA, 16 bp, M. musculus
tgcctctatttcctga

SEQ ID NO: 442324 - DNA, 16 bp, M. musculus
tgcctctcaggtgctg

SEQ ID NO: 442325 - DNA, 16 bp, M. musculus
tgcctctccccatctg

SEQ ID NO: 442326 - DNA, 16 bp, M. musculus
tgcctctccctccaga

SEQ ID NO: 442327 - DNA, 16 bp, M. musculus
tgcctctctctgcctc

SEQ ID NO: 442328 - DNA, 16 bp, M. musculus
tgcctctctgcctcta

SEQ ID NO: 442329 - DNA, 16 bp, M. musculus
tgcctctctgcctgcc

SEQ ID NO: 442330 - DNA, 16 bp, M. musculus
tgcctctctgtctctc

SEQ ID NO: 442331 - DNA, 16 bp, M. musculus
tgcctctctgtctgtc

SEQ ID NO: 442332 - DNA, 16 bp, M. musculus
tgcctctgacctctga

SEQ ID NO: 442333 - DNA, 16 bp, M. musculus
tgcctctgactcttga

SEQ ID NO: 442334 - DNA, 16 bp, M. musculus
tgcctctgagaggatg

SEQ ID NO: 442335 - DNA, 16 bp, M. musculus
tgcctctgcatcccga

SEQ ID NO: 442336 - DNA, 16 bp, M. musculus
tgcctctgccctgctg

SEQ ID NO: 442337 - DNA, 16 bp, M. musculus
tgcctctgcctcagga

SEQ ID NO: 442338 - DNA, 16 bp, M. musculus
tgcctctgcctccaac

SEQ ID NO: 442339 - DNA, 16 bp, M. musculus
tgcctctgcctccaag

SEQ ID NO: 442340 - DNA, 16 bp, M. musculus
tgcctctgcctccacc

SEQ ID NO: 442341 - DNA, 16 bp, M. musculus
tgcctctgcctcccag

SEQ ID NO: 442342 - DNA, 16 bp, M. musculus
tgcctctgcctcctgc

SEQ ID NO: 442343 - DNA, 16 bp, M. musculus
tgcctctgcctctcca

SEQ ID NO: 442344 - DNA, 16 bp, M. musculus
tgcctctgcctctgca

SEQ ID NO: 442345 - DNA, 16 bp, M. musculus
tgcctctgcctctgcg

SEQ ID NO: 442346 - DNA, 16 bp, M. musculus
tgcctctgcctctgga

SEQ ID NO: 442347 - DNA, 16 bp, M. musculus
tgcctctgcctctgtg

SEQ ID NO: 442348 - DNA, 16 bp, M. musculus
tgcctctgcctcttgc

SEQ ID NO: 442349 - DNA, 16 bp, M. musculus
tgcctctgcctctttc

SEQ ID NO: 442350 - DNA, 16 bp, M. musculus
tgcctctgcctgccac

SEQ ID NO: 442351 - DNA, 16 bp, M. musculus
tgcctctgcctgccag

SEQ ID NO: 442352 - DNA, 16 bp, M. musculus
tgcctctgccttcctg

SEQ ID NO: 442353 - DNA, 16 bp, M. musculus
tgcctctgccttctaa

SEQ ID NO: 442354 - DNA, 16 bp, M. musculus
tgcctctgccttctga

SEQ ID NO: 442355 - DNA, 16 bp, M. musculus
tgcctctgcttcctgg

SEQ ID NO: 442356 - DNA, 16 bp, M. musculus
tgcctctggaattctg

SEQ ID NO: 442357 - DNA, 16 bp, M. musculus
tgcctctggagcactg

SEQ ID NO: 442358 - DNA, 16 bp, M. musculus
tgcctctggagtgcta

SEQ ID NO: 442359 - DNA, 16 bp, M. musculus
tgcctctggctatgct

SEQ ID NO: 442360 - DNA, 16 bp, M. musculus
tgcctctgggaccctg

SEQ ID NO: 442361 - DNA, 16 bp, M. musculus
tgcctctgtaactcct

SEQ ID NO: 442362 - DNA, 16 bp, M. musculus
tgcctctgtcattctg

SEQ ID NO: 442363 - DNA, 16 bp, M. musculus
tgcctctgtcattttg

SEQ ID NO: 442364 - DNA, 16 bp, M. musculus
tgcctctgtctcccac

SEQ ID NO: 442365 - DNA, 16 bp, M. musculus
tgcctctgtctctgag

SEQ ID NO: 442366 - DNA, 16 bp, M. musculus
tgcctctgtctgcctg

SEQ ID NO: 442367 - DNA, 16 bp, M. musculus
tgcctctgtcttctaa

SEQ ID NO: 442368 - DNA, 16 bp, M. musculus
tgcctctgtttccaga

SEQ ID NO: 442369 - DNA, 16 bp, M. musculus
tgcctctgtttcccaa

SEQ ID NO: 442370 - DNA, 16 bp, M. musculus
tgcctctgtttctctg

SEQ ID NO: 442371 - DNA, 16 bp, M. musculus
tgcctcttaagtgctg

SEQ ID NO: 442372 - DNA, 16 bp, M. musculus
tgcctcttcagtctct

SEQ ID NO: 442373 - DNA, 16 bp, M. musculus
tgcctcttcctcctga

SEQ ID NO: 442374 - DNA, 16 bp, M. musculus
tgcctcttctggagtg

SEQ ID NO: 442375 - DNA, 16 bp, M. musculus
tgcctcttgaaaattt

SEQ ID NO: 442376 - DNA, 16 bp, M. musculus
tgcctcttgcctccca

SEQ ID NO: 442377 - DNA, 16 bp, M. musculus
tgcctcttgccttctg

SEQ ID NO: 442378 - DNA, 16 bp, M. musculus
tgcctcttggcccttt

SEQ ID NO: 442379 - DNA, 16 bp, M. musculus
tgcctctttctgcctc

SEQ ID NO: 442380 - DNA, 17 bp, M. musculus
tgcctgaaagccagtat

SEQ ID NO: 442381 - DNA, 16 bp, M. musculus
tgcctgaaatctcagc

SEQ ID NO: 442382 - DNA, 16 bp, M. musculus
tgcctgaagaggccag

SEQ ID NO: 442383 - DNA, 16 bp, M. musculus
tgcctgaagccatgtt

SEQ ID NO: 442384 - DNA, 16 bp, M. musculus
tgcctgaatatatgtc

SEQ ID NO: 442385 - DNA, 17 bp, M. musculus
tgcctgaattcttaggg

SEQ ID NO: 442386 - DNA, 16 bp, M. musculus
tgcctgacaagaccat

SEQ ID NO: 442387 - DNA, 16 bp, M. musculus
tgcctgaccaatgggc

SEQ ID NO: 442388 - DNA, 16 bp, M. musculus
tgcctgaccagaggct

SEQ ID NO: 442389 - DNA, 16 bp, M. musculus
tgcctgagatcccagc

SEQ ID NO: 442390 - DNA, 16 bp, M. musculus
tgcctgagcccagcct

SEQ ID NO: 442391 - DNA, 16 bp, M. musculus
tgcctgaggacagtct

SEQ ID NO: 442392 - DNA, 16 bp, M. musculus
tgcctgaggaggtcag

SEQ ID NO: 442393 - DNA, 16 bp, M. musculus
tgcctgaggatcaaga

SEQ ID NO: 442394 - DNA, 16 bp, M. musculus
tgcctgagtgtatgtg

SEQ ID NO: 442395 - DNA, 16 bp, M. musculus
tgcctgatgcccatgg

SEQ ID NO: 442396 - DNA, 16 bp, M. musculus
tgcctgatgcctgcag

SEQ ID NO: 442397 - DNA, 16 bp, M. musculus
tgcctgcaaaggccag

SEQ ID NO: 442398 - DNA, 16 bp, M. musculus
tgcctgcaactccagc

SEQ ID NO: 442399 - DNA, 16 bp, M. musculus
tgcctgcacaggccag

SEQ ID NO: 442400 - DNA, 16 bp, M. musculus
tgcctgcacatttcat

SEQ ID NO: 442401 - DNA, 16 bp, M. musculus
tgcctgcagaggtcag

SEQ ID NO: 442402 - DNA, 16 bp, M. musculus
tgcctgcagatgccag

SEQ ID NO: 442403 - DNA, 16 bp, M. musculus
tgcctgcaggctgcca

SEQ ID NO: 442404 - DNA, 16 bp, M. musculus
tgcctgcatgcatgtc

SEQ ID NO: 442405 - DNA, 16 bp, M. musculus
tgcctgcatgcatgtg

SEQ ID NO: 442406 - DNA, 16 bp, M. musculus
tgcctgcatgctgcct

SEQ ID NO: 442407 - DNA, 16 bp, M. musculus
tgcctgcatgtacatt

SEQ ID NO: 442408 - DNA, 16 bp, M. musculus
tgcctgcatgtatgcc

SEQ ID NO: 442409 - DNA, 16 bp, M. musculus
tgcctgccaccatgtt

SEQ ID NO: 442410 - DNA, 16 bp, M. musculus
tgcctgccagtcactg

SEQ ID NO: 442411 - DNA, 16 bp, M. musculus
tgcctgcccacctgcc

SEQ ID NO: 442412 - DNA, 16 bp, M. musculus
tgcctgcccactgcca

SEQ ID NO: 442413 - DNA, 16 bp, M. musculus
tgcctgcctcagcctc

SEQ ID NO: 442414 - DNA, 16 bp, M. musculus
tgcctgcctcagcttc

SEQ ID NO: 442415 - DNA, 16 bp, M. musculus
tgcctgcctcccagga

SEQ ID NO: 442416 - DNA, 16 bp, M. musculus
tgcctgcctcccgagt

SEQ ID NO: 442417 - DNA, 16 bp, M. musculus
tgcctgcctcctgcca

SEQ ID NO: 442418 - DNA, 16 bp, M. musculus
tgcctgcctctccacc

SEQ ID NO: 442419 - DNA, 16 bp, M. musculus
tgcctgcctctgccat

SEQ ID NO: 442420 - DNA, 18 bp, M. musculus
tgcctgcctctgcctctg

SEQ ID NO: 442421 - DNA, 16 bp, M. musculus
tgcctgcctctgctcc

SEQ ID NO: 442422 - DNA, 16 bp, M. musculus
tgcctgcctctgtcct

SEQ ID NO: 442423 - DNA, 18 bp, M. musculus
tgcctgcctctgtctcct

SEQ ID NO: 442424 - DNA, 16 bp, M. musculus
tgcctgcctctttctc

SEQ ID NO: 442425 - DNA, 16 bp, M. musculus
tgcctgcctgccctgc

SEQ ID NO: 442426 - DNA, 16 bp, M. musculus
tgcctgcctgcctacc

SEQ ID NO: 442427 - DNA, 16 bp, M. musculus
tgcctgcctgcctccc

SEQ ID NO: 442428 - DNA, 17 bp, M. musculus
tgcctgcctgcctgcct

SEQ ID NO: 442429 - DNA, 16 bp, M. musculus
tgcctgcctgcctggc

SEQ ID NO: 442430 - DNA, 16 bp, M. musculus
tgcctgcctgccttgc

SEQ ID NO: 442431 - DNA, 16 bp, M. musculus
tgcctgcctgctgcca

SEQ ID NO: 442432 - DNA, 16 bp, M. musculus
tgcctgcctgctgctg

SEQ ID NO: 442433 - DNA, 16 bp, M. musculus
tgcctgcctggatcct

SEQ ID NO: 442434 - DNA, 16 bp, M. musculus
tgcctgcctgtgtctg

SEQ ID NO: 442435 - DNA, 16 bp, M. musculus
tgcctgcctgtgtgcc

SEQ ID NO: 442436 - DNA, 16 bp, M. musculus
tgcctgccttcctgtg

SEQ ID NO: 442437 - DNA, 16 bp, M. musculus
tgcctgccttcttcca

SEQ ID NO: 442438 - DNA, 16 bp, M. musculus
tgcctgcggaggtcag

SEQ ID NO: 442439 - DNA, 16 bp, M. musculus
tgcctgcgtgtgtgtc

SEQ ID NO: 442440 - DNA, 16 bp, M. musculus
tgcctgctcctgggac

SEQ ID NO: 442441 - DNA, 16 bp, M. musculus
tgcctgctgaggccag

SEQ ID NO: 442442 - DNA, 16 bp, M. musculus
tgcctgctgcctgctg

SEQ ID NO: 442443 - DNA, 16 bp, M. musculus
tgcctgctgcttgctg

SEQ ID NO: 442444 - DNA, 16 bp, M. musculus
tgcctgctgggcaagc

SEQ ID NO: 442445 - DNA, 16 bp, M. musculus
tgcctgctgtcatgct

SEQ ID NO: 442446 - DNA, 16 bp, M. musculus
tgcctgcttccttcca

SEQ ID NO: 442447 - DNA, 16 bp, M. musculus
tgcctgcttctctgtc

SEQ ID NO: 442448 - DNA, 16 bp, M. musculus
tgcctgcttctgcctt

SEQ ID NO: 442449 - DNA, 16 bp, M. musculus
tgcctgcttctttcca

SEQ ID NO: 442450 - DNA, 16 bp, M. musculus
tgcctgcttgcctgcc

SEQ ID NO: 442451 - DNA, 16 bp, M. musculus
tgcctgctttctccct

SEQ ID NO: 442452 - DNA, 16 bp, M. musculus
tgcctgcttttgcctc

SEQ ID NO: 442453 - DNA, 16 bp, M. musculus
tgcctggaccaggaag

SEQ ID NO: 442454 - DNA, 16 bp, M. musculus
tgcctggagccagccc

SEQ ID NO: 442455 - DNA, 16 bp, M. musculus
tgcctggattctgcca

SEQ ID NO: 442456 - DNA, 16 bp, M. musculus
tgcctggcaaggccat

SEQ ID NO: 442457 - DNA, 16 bp, M. musculus
tgcctggcaggtcagt

SEQ ID NO: 442458 - DNA, 16 bp, M. musculus
tgcctggcccagggag

SEQ ID NO: 442459 - DNA, 16 bp, M. musculus
tgcctggcctctgtgg

SEQ ID NO: 442460 - DNA, 16 bp, M. musculus
tgcctggcctttgtgt

SEQ ID NO: 442461 - DNA, 16 bp, M. musculus
tgcctggctctgcctt

SEQ ID NO: 442462 - DNA, 16 bp, M. musculus
tgcctggctggttcaa

SEQ ID NO: 442463 - DNA, 16 bp, M. musculus
tgcctggcttcctgtg

SEQ ID NO: 442464 - DNA, 16 bp, M. musculus
tgcctggcttggtggc

SEQ ID NO: 442465 - DNA, 16 bp, M. musculus
tgcctggctttatgtg

SEQ ID NO: 442466 - DNA, 16 bp, M. musculus
tgcctggctttttctt

SEQ ID NO: 442467 - DNA, 16 bp, M. musculus
tgcctgggaaaaataa

SEQ ID NO: 442468 - DNA, 17 bp, M. musculus
tgcctgggagccagtat

SEQ ID NO: 442469 - DNA, 16 bp, M. musculus
tgcctgggctgcagag

SEQ ID NO: 442470 - DNA, 16 bp, M. musculus
tgcctggggaggccag

SEQ ID NO: 442471 - DNA, 16 bp, M. musculus
tgcctggggccagcag

SEQ ID NO: 442472 - DNA, 16 bp, M. musculus
tgcctggggcttgctg

SEQ ID NO: 442473 - DNA, 16 bp, M. musculus
tgcctggtatccacag

SEQ ID NO: 442474 - DNA, 16 bp, M. musculus
tgcctggtctacaaag

SEQ ID NO: 442475 - DNA, 29 bp, M. musculus
tgcctggtgaggtggcgtggcctgctgtg

SEQ ID NO: 442476 - DNA, 16 bp, M. musculus
tgcctggtgcccaagg

SEQ ID NO: 442477 - DNA, 16 bp, M. musculus
tgcctggtgcccgagg

SEQ ID NO: 442478 - DNA, 16 bp, M. musculus
tgcctggtgcctgtga

SEQ ID NO: 442479 - DNA, 16 bp, M. musculus
tgcctggtgctcaagg

SEQ ID NO: 442480 - DNA, 16 bp, M. musculus
tgcctggtgcttgcag

SEQ ID NO: 442481 - DNA, 16 bp, M. musculus
tgcctggtgtccatgg

SEQ ID NO: 442482 - DNA, 16 bp, M. musculus
tgcctggttccaggag

SEQ ID NO: 442483 - DNA, 16 bp, M. musculus
tgcctggttggtggct

SEQ ID NO: 442484 - DNA, 16 bp, M. musculus
tgcctgtaactccagg

SEQ ID NO: 442485 - DNA, 16 bp, M. musculus
tgcctgtaatcccagg

SEQ ID NO: 442486 - DNA, 16 bp, M. musculus
tgcctgtaatcccagt

SEQ ID NO: 442487 - DNA, 16 bp, M. musculus
tgcctgtaattccaac

SEQ ID NO: 442488 - DNA, 16 bp, M. musculus
tgcctgtaattccaga

SEQ ID NO: 442489 - DNA, 16 bp, M. musculus
tgcctgtaattccagt

SEQ ID NO: 442490 - DNA, 16 bp, M. musculus
tgcctgtagatccaga

SEQ ID NO: 442491 - DNA, 16 bp, M. musculus
tgcctgtagctccagc

SEQ ID NO: 442492 - DNA, 16 bp, M. musculus
tgcctgtagctccagt

SEQ ID NO: 442493 - DNA, 16 bp, M. musculus
tgcctgtagtcccagc

SEQ ID NO: 442494 - DNA, 16 bp, M. musculus
tgcctgtatgtgtgtg

SEQ ID NO: 442495 - DNA, 16 bp, M. musculus
tgcctgtatttctttg

SEQ ID NO: 442496 - DNA, 16 bp, M. musculus
tgcctgtcactgtact

SEQ ID NO: 442497 - DNA, 16 bp, M. musculus
tgcctgtcctcaagct

SEQ ID NO: 442498 - DNA, 16 bp, M. musculus
tgcctgtcctggaact

SEQ ID NO: 442499 - DNA, 16 bp, M. musculus
tgcctgtctctctgtg

SEQ ID NO: 442500 - DNA, 16 bp, M. musculus
tgcctgtctctgccta

SEQ ID NO: 442501 - DNA, 16 bp, M. musculus
tgcctgtctctgcctc

SEQ ID NO: 442502 - DNA, 16 bp, M. musculus
tgcctgtctctgcttt

SEQ ID NO: 442503 - DNA, 17 bp, M. musculus
tgcctgtctgcctgtct

SEQ ID NO: 442504 - DNA, 16 bp, M. musculus
tgcctgtctgcttgcc

SEQ ID NO: 442505 - DNA, 16 bp, M. musculus
tgcctgtctgtctctt

SEQ ID NO: 442506 - DNA, 16 bp, M. musculus
tgcctgtctgtgtctg

SEQ ID NO: 442507 - DNA, 16 bp, M. musculus
tgcctgtctttctgtc

SEQ ID NO: 442508 - DNA, 16 bp, M. musculus
tgcctgtctttgtcac

SEQ ID NO: 442509 - DNA, 16 bp, M. musculus
tgcctgtgacctcagc

SEQ ID NO: 442510 - DNA, 16 bp, M. musculus
tgcctgtgagccacca

SEQ ID NO: 442511 - DNA, 16 bp, M. musculus
tgcctgtgagtgtgtg

SEQ ID NO: 442512 - DNA, 16 bp, M. musculus
tgcctgtgcctcccca

SEQ ID NO: 442513 - DNA, 16 bp, M. musculus
tgcctgtgcctctgcc

SEQ ID NO: 442514 - DNA, 16 bp, M. musculus
tgcctgtgcctgtgac

SEQ ID NO: 442515 - DNA, 16 bp, M. musculus
tgcctgtgcctgtgtg

SEQ ID NO: 442516 - DNA, 16 bp, M. musculus
tgcctgtggaagacag

SEQ ID NO: 442517 - DNA, 16 bp, M. musculus
tgcctgtggaggccag

SEQ ID NO: 442518 - DNA, 16 bp, M. musculus
tgcctgtggagtccag

SEQ ID NO: 442519 - DNA, 16 bp, M. musculus
tgcctgtggattcaga

SEQ ID NO: 442520 - DNA, 16 bp, M. musculus
tgcctgtggcatggag

SEQ ID NO: 442521 - DNA, 16 bp, M. musculus
tgcctgtgtatacatg

SEQ ID NO: 442522 - DNA, 16 bp, M. musculus
tgcctgtgtatatgtg

SEQ ID NO: 442523 - DNA, 16 bp, M. musculus
tgcctgtgtatgtgtg

SEQ ID NO: 442524 - DNA, 16 bp, M. musculus
tgcctgtgtctctgtc

SEQ ID NO: 442525 - DNA, 16 bp, M. musculus
tgcctgtgtctctgtg

SEQ ID NO: 442526 - DNA, 16 bp, M. musculus
tgcctgtgtctgcctg

SEQ ID NO: 442527 - DNA, 16 bp, M. musculus
tgcctgtgtctgcttc

SEQ ID NO: 442528 - DNA, 16 bp, M. musculus
tgcctgtgtgccacca

SEQ ID NO: 442529 - DNA, 16 bp, M. musculus
tgcctgtgtggaggtc

SEQ ID NO: 442530 - DNA, 16 bp, M. musculus
tgcctgtgtgtatatg

SEQ ID NO: 442531 - DNA, 16 bp, M. musculus
tgcctgtgtgtctgtg

SEQ ID NO: 442532 - DNA, 16 bp, M. musculus
tgcctgtgtgtgtacc

SEQ ID NO: 442533 - DNA, 16 bp, M. musculus
tgcctgtgtgtgtatg

SEQ ID NO: 442534 - DNA, 16 bp, M. musculus
tgcctgtgtgtgtgcc

SEQ ID NO: 442535 - DNA, 16 bp, M. musculus
tgcctgttccaggaat

SEQ ID NO: 442536 - DNA, 16 bp, M. musculus
tgccttaaaaacaaaa

SEQ ID NO: 442537 - DNA, 16 bp, M. musculus
tgccttaaaactaaga

SEQ ID NO: 442538 - DNA, 16 bp, M. musculus
tgccttaaatcccagc

SEQ ID NO: 442539 - DNA, 16 bp, M. musculus
tgccttaagatcaacg

SEQ ID NO: 442540 - DNA, 16 bp, M. musculus
tgccttacagtttgat

SEQ ID NO: 442541 - DNA, 16 bp, M. musculus
tgccttagcttcccaa

SEQ ID NO: 442542 - DNA, 16 bp, M. musculus
tgccttagttagggtt

SEQ ID NO: 442543 - DNA, 16 bp, M. musculus
tgccttatctgacatc

SEQ ID NO: 442544 - DNA, 16 bp, M. musculus
tgccttcaaagccagt

SEQ ID NO: 442545 - DNA, 16 bp, M. musculus
tgccttcaagaagaaa

SEQ ID NO: 442546 - DNA, 16 bp, M. musculus
tgccttcagattcctg

SEQ ID NO: 442547 - DNA, 16 bp, M. musculus
tgccttcattctcatt

SEQ ID NO: 442548 - DNA, 16 bp, M. musculus
tgccttccagaaatac

SEQ ID NO: 442549 - DNA, 16 bp, M. musculus
tgccttccagaagctt

SEQ ID NO: 442550 - DNA, 16 bp, M. musculus
tgccttccccaccatg

SEQ ID NO: 442551 - DNA, 16 bp, M. musculus
tgccttccctgggctg

SEQ ID NO: 442552 - DNA, 16 bp, M. musculus
tgccttcctcaatcac

SEQ ID NO: 442553 - DNA, 16 bp, M. musculus
tgccttcctcttcctg

SEQ ID NO: 442554 - DNA, 16 bp, M. musculus
tgccttcctgccttct

SEQ ID NO: 442555 - DNA, 16 bp, M. musculus
tgccttcctgctggag

SEQ ID NO: 442556 - DNA, 16 bp, M. musculus
tgccttcctggtgctg

SEQ ID NO: 442557 - DNA, 16 bp, M. musculus
tgccttccttcagtga

SEQ ID NO: 442558 - DNA, 16 bp, M. musculus
tgccttctattcctct

SEQ ID NO: 442559 - DNA, 16 bp, M. musculus
tgccttctctggcttc

SEQ ID NO: 442560 - DNA, 16 bp, M. musculus
tgccttctgaaagacc

SEQ ID NO: 442561 - DNA, 16 bp, M. musculus
tgccttctgacctctg

SEQ ID NO: 442562 - DNA, 16 bp, M. musculus
tgccttctgacttcca

SEQ ID NO: 442563 - DNA, 16 bp, M. musculus
tgccttctgcttccat

SEQ ID NO: 442564 - DNA, 16 bp, M. musculus
tgccttctggcctcca

SEQ ID NO: 442565 - DNA, 16 bp, M. musculus
tgccttcttctgcctt

SEQ ID NO: 442566 - DNA, 16 bp, M. musculus
tgccttcttctggact

SEQ ID NO: 442567 - DNA, 16 bp, M. musculus
tgccttcttctggcct

SEQ ID NO: 442568 - DNA, 16 bp, M. musculus
tgccttcttctggctt

SEQ ID NO: 442569 - DNA, 16 bp, M. musculus
tgccttgacttccttc

SEQ ID NO: 442570 - DNA, 16 bp, M. musculus
tgccttgagttcctgc

SEQ ID NO: 442571 - DNA, 16 bp, M. musculus
tgccttgagttccttc

SEQ ID NO: 442572 - DNA, 16 bp, M. musculus
tgccttgcctgcctgg

SEQ ID NO: 442573 - DNA, 16 bp, M. musculus
tgccttgctctgcctc

SEQ ID NO: 442574 - DNA, 16 bp, M. musculus
tgccttgcttcccacc

SEQ ID NO: 442575 - DNA, 16 bp, M. musculus
tgccttggagacccca

SEQ ID NO: 442576 - DNA, 16 bp, M. musculus
tgccttggagactcca

SEQ ID NO: 442577 - DNA, 16 bp, M. musculus
tgccttggccatgatg

SEQ ID NO: 442578 - DNA, 16 bp, M. musculus
tgccttggctatggtg

SEQ ID NO: 442579 - DNA, 16 bp, M. musculus
tgccttggcttcccct

SEQ ID NO: 442580 - DNA, 16 bp, M. musculus
tgccttggcttctctt

SEQ ID NO: 442581 - DNA, 16 bp, M. musculus
tgccttgggaggcaga

SEQ ID NO: 442582 - DNA, 16 bp, M. musculus
tgccttgtccagcctt

SEQ ID NO: 442583 - DNA, 16 bp, M. musculus
tgccttgtgggtgctg

SEQ ID NO: 442584 - DNA, 16 bp, M. musculus
tgccttgtgggttctg

SEQ ID NO: 442585 - DNA, 16 bp, M. musculus
tgcctttaaccccagt

SEQ ID NO: 442586 - DNA, 16 bp, M. musculus
tgcctttacacactga

SEQ ID NO: 442587 - DNA, 16 bp, M. musculus
tgcctttataagaatt

SEQ ID NO: 442588 - DNA, 16 bp, M. musculus
tgcctttatatcttac

SEQ ID NO: 442589 - DNA, 16 bp, M. musculus
tgcctttatattttat

SEQ ID NO: 442590 - DNA, 16 bp, M. musculus
tgcctttattgtgttt

SEQ ID NO: 442591 - DNA, 16 bp, M. musculus
tgcctttatttcttct

SEQ ID NO: 442592 - DNA, 16 bp, M. musculus
tgcctttcaccatctg

SEQ ID NO: 442593 - DNA, 16 bp, M. musculus
tgcctttcatcatctg

SEQ ID NO: 442594 - DNA, 17 bp, M. musculus
tgcctttcctgcacgta

SEQ ID NO: 442595 - DNA, 16 bp, M. musculus
tgcctttccttgcctt

SEQ ID NO: 442596 - DNA, 16 bp, M. musculus
tgcctttctgtgtctg

SEQ ID NO: 442597 - DNA, 16 bp, M. musculus
tgcctttctttgcctc

SEQ ID NO: 442598 - DNA, 16 bp, M. musculus
tgcctttgcctcccag

SEQ ID NO: 442599 - DNA, 16 bp, M. musculus
tgcctttgcctcccca

SEQ ID NO: 442600 - DNA, 18 bp, M. musculus
tgcctttgcctcccgagt

SEQ ID NO: 442601 - DNA, 16 bp, M. musculus
tgcctttggatctctt

SEQ ID NO: 442602 - DNA, 16 bp, M. musculus
tgcctttggatgaaga

SEQ ID NO: 442603 - DNA, 16 bp, M. musculus
tgcctttgtgtgtgtg

SEQ ID NO: 442604 - DNA, 16 bp, M. musculus
tgccttttaaataaaa

SEQ ID NO: 442605 - DNA, 16 bp, M. musculus
tgccttttcttcttga

SEQ ID NO: 442606 - DNA, 16 bp, M. musculus
tgccttttgccctctg

SEQ ID NO: 442607 - DNA, 16 bp, M. musculus
tgcctttttctggact

SEQ ID NO: 442608 - DNA, 16 bp, M. musculus
tgcctttttttttaaa

SEQ ID NO: 442609 - DNA, 16 bp, M. musculus
tgcgcacacacacaca

SEQ ID NO: 442610 - DNA, 16 bp, M. musculus
tgcgcacgcgcgcgca

SEQ ID NO: 442611 - DNA, 16 bp, M. musculus
tgcgcacgcgtgtgtg

SEQ ID NO: 442612 - DNA, 26 bp, M. musculus
tgcgcagagagatgcgcagagaggca

SEQ ID NO: 442613 - DNA, 23 bp, M. musculus
tgcgcagagaggcaatgcgcaga

SEQ ID NO: 442614 - DNA, 26 bp, M. musculus
tgcgcagagaggcagtgcgcagagag

SEQ ID NO: 442615 - DNA, 16 bp, M. musculus
tgcgccaccacaccca

SEQ ID NO: 442616 - DNA, 16 bp, M. musculus
tgcgccaccaccgctc

SEQ ID NO: 442617 - DNA, 16 bp, M. musculus
tgcgccaccacctccc

SEQ ID NO: 442618 - DNA, 16 bp, M. musculus
tgcgccaccacgccgg

SEQ ID NO: 442619 - DNA, 19 bp, M. musculus
tgcgccaccacgcctggcc

SEQ ID NO: 442620 - DNA, 16 bp, M. musculus
tgcgccaccactgcct

SEQ ID NO: 442621 - DNA, 16 bp, M. musculus
tgcgcccaaggtctgc

SEQ ID NO: 442622 - DNA, 16 bp, M. musculus
tgcgccctagctaccc

SEQ ID NO: 442623 - DNA, 16 bp, M. musculus
tgcgcgcgcacacaca

SEQ ID NO: 442624 - DNA, 16 bp, M. musculus
tgcgcgcgcacatgca

SEQ ID NO: 442625 - DNA, 16 bp, M. musculus
tgcgcgcgcgcacgtg

SEQ ID NO: 442626 - DNA, 16 bp, M. musculus
tgcgcgcgcgcgcgtg

SEQ ID NO: 442627 - DNA, 101 bp, M. musculus
tgcggaaagcctgggcattttaagaaagattgcagagctccagataaacagggagggactctcactctttgctctaagtgtggcaagggttatcatagagc

SEQ ID NO: 442628 - DNA, 16 bp, M. musculus
tgcggaagagctgaga

SEQ ID NO: 442629 - DNA, 16 bp, M. musculus
tgcggcaccactgccc

SEQ ID NO: 442630 - DNA, 16 bp, M. musculus
tgcggctggcttacag

SEQ ID NO: 442631 - DNA, 16 bp, M. musculus
tgcgggaagcgggtgc

SEQ ID NO: 442632 - DNA, 16 bp, M. musculus
tgcgtgcacgtgtgtg

SEQ ID NO: 442633 - DNA, 16 bp, M. musculus
tgcgtgcatacacaca

SEQ ID NO: 442634 - DNA, 16 bp, M. musculus
tgcgtgcatgcatgtg

SEQ ID NO: 442635 - DNA, 16 bp, M. musculus
tgcgtgcctggtgagg

SEQ ID NO: 442636 - DNA, 16 bp, M. musculus
tgcgtgtgcttgtgtg

SEQ ID NO: 442637 - DNA, 16 bp, M. musculus
tgcgtgtgtgcatgca

SEQ ID NO: 442638 - DNA, 16 bp, M. musculus
tgcgtgtgtgcatgtg

SEQ ID NO: 442639 - DNA, 16 bp, M. musculus
tgcgtgtgtgtgcatg

SEQ ID NO: 442640 - DNA, 18 bp, M. musculus
tgcgttcttcctggccgg

SEQ ID NO: 442641 - DNA, 16 bp, M. musculus
tgctaaacaagcactc

SEQ ID NO: 442642 - DNA, 16 bp, M. musculus
tgctaaaccatctctc

SEQ ID NO: 442643 - DNA, 16 bp, M. musculus
tgctaagagaagactg

SEQ ID NO: 442644 - DNA, 16 bp, M. musculus
tgctaagagagggaga

SEQ ID NO: 442645 - DNA, 16 bp, M. musculus
tgctaaggcaggagga

SEQ ID NO: 442646 - DNA, 16 bp, M. musculus
tgctaagttaaaaggc

SEQ ID NO: 442647 - DNA, 16 bp, M. musculus
tgctaagttcctgtct

SEQ ID NO: 442648 - DNA, 16 bp, M. musculus
tgctaatatccacata

SEQ ID NO: 442649 - DNA, 16 bp, M. musculus
tgctaatgccaagaag

SEQ ID NO: 442650 - DNA, 16 bp, M. musculus
tgctaatgcttttctt

SEQ ID NO: 442651 - DNA, 16 bp, M. musculus
tgctaatgtgtgtgtg

SEQ ID NO: 442652 - DNA, 16 bp, M. musculus
tgctaattctgttctc

SEQ ID NO: 442653 - DNA, 16 bp, M. musculus
tgctacacacctctgt

SEQ ID NO: 442654 - DNA, 16 bp, M. musculus
tgctacacccactcca

SEQ ID NO: 442655 - DNA, 16 bp, M. musculus
tgctacacctgcacca

SEQ ID NO: 442656 - DNA, 16 bp, M. musculus
tgctacactggggcat

SEQ ID NO: 442657 - DNA, 16 bp, M. musculus
tgctacagagagcaga

SEQ ID NO: 442658 - DNA, 16 bp, M. musculus
tgctacagatgtgtag

SEQ ID NO: 442659 - DNA, 16 bp, M. musculus
tgctacatagccaagg

SEQ ID NO: 442660 - DNA, 16 bp, M. musculus
tgctacatatgcagcc

SEQ ID NO: 442661 - DNA, 16 bp, M. musculus
tgctacatattcagct

SEQ ID NO: 442662 - DNA, 16 bp, M. musculus
tgctacatgtacagct

SEQ ID NO: 442663 - DNA, 16 bp, M. musculus
tgctaccagcccccac

SEQ ID NO: 442664 - DNA, 16 bp, M. musculus
tgctaccatgtcctgt

SEQ ID NO: 442665 - DNA, 17 bp, M. musculus
tgctacgttctgatgat

SEQ ID NO: 442666 - DNA, 16 bp, M. musculus
tgctactgttgtggat

SEQ ID NO: 442667 - DNA, 16 bp, M. musculus
tgctacttcacaacta

SEQ ID NO: 442668 - DNA, 16 bp, M. musculus
tgctagacaagcactc

SEQ ID NO: 442669 - DNA, 16 bp, M. musculus
tgctagactggatgtt

SEQ ID NO: 442670 - DNA, 16 bp, M. musculus
tgctagagaaatggct

SEQ ID NO: 442671 - DNA, 16 bp, M. musculus
tgctagagaaggagct

SEQ ID NO: 442672 - DNA, 16 bp, M. musculus
tgctagagcacttgcc

SEQ ID NO: 442673 - DNA, 16 bp, M. musculus
tgctagagcaggaggc

SEQ ID NO: 442674 - DNA, 16 bp, M. musculus
tgctagatcttctggt

SEQ ID NO: 442675 - DNA, 16 bp, M. musculus
tgctaggaactgaact

SEQ ID NO: 442676 - DNA, 16 bp, M. musculus
tgctaggaatcaaatt

SEQ ID NO: 442677 - DNA, 18 bp, M. musculus
tgctaggaattgaactca

SEQ ID NO: 442678 - DNA, 16 bp, M. musculus
tgctaggatggtgagg

SEQ ID NO: 442679 - DNA, 16 bp, M. musculus
tgctaggattaaagat

SEQ ID NO: 442680 - DNA, 16 bp, M. musculus
tgctaggattaagggt

SEQ ID NO: 442681 - DNA, 16 bp, M. musculus
tgctaggattacaggt

SEQ ID NO: 442682 - DNA, 16 bp, M. musculus
tgctaggatttgaatt

SEQ ID NO: 442683 - DNA, 16 bp, M. musculus
tgctaggcaagcactg

SEQ ID NO: 442684 - DNA, 16 bp, M. musculus
tgctaggcaagccctc

SEQ ID NO: 442685 - DNA, 16 bp, M. musculus
tgctaggcagcttccc

SEQ ID NO: 442686 - DNA, 17 bp, M. musculus
tgctaggccctggaata

SEQ ID NO: 442687 - DNA, 16 bp, M. musculus
tgctaggtaccagcct

SEQ ID NO: 442688 - DNA, 17 bp, M. musculus
tgctaggtacctgtcca

SEQ ID NO: 442689 - DNA, 16 bp, M. musculus
tgctaggtccctggga

SEQ ID NO: 442690 - DNA, 16 bp, M. musculus
tgctaggttcctgtct

SEQ ID NO: 442691 - DNA, 16 bp, M. musculus
tgctaggttccttttt

SEQ ID NO: 442692 - DNA, 16 bp, M. musculus
tgctagtataataaaa

SEQ ID NO: 442693 - DNA, 16 bp, M. musculus
tgctagtcctcctaca

SEQ ID NO: 442694 - DNA, 16 bp, M. musculus
tgctagtgaaggaatg

SEQ ID NO: 442695 - DNA, 16 bp, M. musculus
tgctagtgtgtgtgtg

SEQ ID NO: 442696 - DNA, 16 bp, M. musculus
tgctatacacacacac

SEQ ID NO: 442697 - DNA, 16 bp, M. musculus
tgctataccactgagc

SEQ ID NO: 442698 - DNA, 16 bp, M. musculus
tgctataccagtatca

SEQ ID NO: 442699 - DNA, 16 bp, M. musculus
tgctatataaaccagg

SEQ ID NO: 442700 - DNA, 16 bp, M. musculus
tgctatatagctcagg

SEQ ID NO: 442701 - DNA, 16 bp, M. musculus
tgctatcccagcactt

SEQ ID NO: 442702 - DNA, 16 bp, M. musculus
tgctatcctgaaagct

SEQ ID NO: 442703 - DNA, 16 bp, M. musculus
tgctatcctgaaggtc

SEQ ID NO: 442704 - DNA, 16 bp, M. musculus
tgctatcctgggattt

SEQ ID NO: 442705 - DNA, 16 bp, M. musculus
tgctatctcagaagca

SEQ ID NO: 442706 - DNA, 16 bp, M. musculus
tgctatcttgccaaaa

SEQ ID NO: 442707 - DNA, 16 bp, M. musculus
tgctatgaacttgcct

SEQ ID NO: 442708 - DNA, 16 bp, M. musculus
tgctatgaagagacac

SEQ ID NO: 442709 - DNA, 16 bp, M. musculus
tgctatgaatcataat

SEQ ID NO: 442710 - DNA, 16 bp, M. musculus
tgctatgacaaaatat

SEQ ID NO: 442711 - DNA, 16 bp, M. musculus
tgctatgagggccagt

SEQ ID NO: 442712 - DNA, 16 bp, M. musculus
tgctatgagttcatga

SEQ ID NO: 442713 - DNA, 16 bp, M. musculus
tgctatgcaagcctga

SEQ ID NO: 442714 - DNA, 16 bp, M. musculus
tgctatgctatgctat

SEQ ID NO: 442715 - DNA, 16 bp, M. musculus
tgctatggaagccctg

SEQ ID NO: 442716 - DNA, 16 bp, M. musculus
tgctatgggcatggat

SEQ ID NO: 442717 - DNA, 16 bp, M. musculus
tgctatgtagctctgg

SEQ ID NO: 442718 - DNA, 16 bp, M. musculus
tgctatgtgggtactg

SEQ ID NO: 442719 - DNA, 17 bp, M. musculus
tgctattaatatgcttt

SEQ ID NO: 442720 - DNA, 16 bp, M. musculus
tgctattataaataag

SEQ ID NO: 442721 - DNA, 16 bp, M. musculus
tgctattttgtcctat

SEQ ID NO: 442722 - DNA, 16 bp, M. musculus
tgctcaagcatgagga

SEQ ID NO: 442723 - DNA, 16 bp, M. musculus
tgctcaaggctggggg

SEQ ID NO: 442724 - DNA, 16 bp, M. musculus
tgctcaataaatactt

SEQ ID NO: 442725 - DNA, 16 bp, M. musculus
tgctcaataaatattt

SEQ ID NO: 442726 - DNA, 16 bp, M. musculus
tgctcacaaccatcca

SEQ ID NO: 442727 - DNA, 16 bp, M. musculus
tgctcacaatcatctg

SEQ ID NO: 442728 - DNA, 16 bp, M. musculus
tgctcacagacagcta

SEQ ID NO: 442729 - DNA, 16 bp, M. musculus
tgctcacagataagca

SEQ ID NO: 442730 - DNA, 16 bp, M. musculus
tgctcacagcagcctt

SEQ ID NO: 442731 - DNA, 16 bp, M. musculus
tgctcacagccaacca

SEQ ID NO: 442732 - DNA, 16 bp, M. musculus
tgctcacagccaacct

SEQ ID NO: 442733 - DNA, 16 bp, M. musculus
tgctcacagccacctg

SEQ ID NO: 442734 - DNA, 16 bp, M. musculus
tgctcacaggagcctg

SEQ ID NO: 442735 - DNA, 16 bp, M. musculus
tgctcaccagcccacc

SEQ ID NO: 442736 - DNA, 17 bp, M. musculus
tgctcaccatcatcaga

SEQ ID NO: 442737 - DNA, 16 bp, M. musculus
tgctcaccctgctact

SEQ ID NO: 442738 - DNA, 17 bp, M. musculus
tgctcacctcagccaca

SEQ ID NO: 442739 - DNA, 16 bp, M. musculus
tgctcactggctggct

SEQ ID NO: 442740 - DNA, 16 bp, M. musculus
tgctcactggcttgct

SEQ ID NO: 442741 - DNA, 16 bp, M. musculus
tgctcagagtcatcta

SEQ ID NO: 442742 - DNA, 16 bp, M. musculus
tgctcagcatccttaa

SEQ ID NO: 442743 - DNA, 16 bp, M. musculus
tgctcagcccccacct

SEQ ID NO: 442744 - DNA, 16 bp, M. musculus
tgctcagcctgcacct

SEQ ID NO: 442745 - DNA, 16 bp, M. musculus
tgctcagcctgctctc

SEQ ID NO: 442746 - DNA, 16 bp, M. musculus
tgctcagcctgctctt

SEQ ID NO: 442747 - DNA, 16 bp, M. musculus
tgctcagcctgcttct

SEQ ID NO: 442748 - DNA, 16 bp, M. musculus
tgctcagccttaaatg

SEQ ID NO: 442749 - DNA, 16 bp, M. musculus
tgctcagctagctctc

SEQ ID NO: 442750 - DNA, 16 bp, M. musculus
tgctcagctagctttt

SEQ ID NO: 442751 - DNA, 16 bp, M. musculus
tgctcagctattggct

SEQ ID NO: 442752 - DNA, 16 bp, M. musculus
tgctcagcttgctctt

SEQ ID NO: 442753 - DNA, 16 bp, M. musculus
tgctcaggaagcagag

SEQ ID NO: 442754 - DNA, 16 bp, M. musculus
tgctcaggaatttttc

SEQ ID NO: 442755 - DNA, 16 bp, M. musculus
tgctcaggaggcagaa

SEQ ID NO: 442756 - DNA, 16 bp, M. musculus
tgctcaggaggctgag

SEQ ID NO: 442757 - DNA, 16 bp, M. musculus
tgctcagtaaatattt

SEQ ID NO: 442758 - DNA, 16 bp, M. musculus
tgctcagtcagtcaac

SEQ ID NO: 442759 - DNA, 16 bp, M. musculus
tgctcagtcatctctc

SEQ ID NO: 442760 - DNA, 16 bp, M. musculus
tgctcagtccactggt

SEQ ID NO: 442761 - DNA, 16 bp, M. musculus
tgctcagtcccacaaa

SEQ ID NO: 442762 - DNA, 16 bp, M. musculus
tgctcagtcccacaca

SEQ ID NO: 442763 - DNA, 16 bp, M. musculus
tgctcagtggtagagc

SEQ ID NO: 442764 - DNA, 16 bp, M. musculus
tgctcagttgttgtgc

SEQ ID NO: 442765 - DNA, 16 bp, M. musculus
tgctcatcaatgggag

SEQ ID NO: 442766 - DNA, 16 bp, M. musculus
tgctcatgtgtttgag

SEQ ID NO: 442767 - DNA, 16 bp, M. musculus
tgctcattcagagatg

SEQ ID NO: 442768 - DNA, 16 bp, M. musculus
tgctcattggcttgct

SEQ ID NO: 442769 - DNA, 16 bp, M. musculus
tgctcatttgaccttt

SEQ ID NO: 442770 - DNA, 16 bp, M. musculus
tgctccaaactttgtc

SEQ ID NO: 442771 - DNA, 16 bp, M. musculus
tgctccaaagaatctt

SEQ ID NO: 442772 - DNA, 16 bp, M. musculus
tgctccaacatcccac

SEQ ID NO: 442773 - DNA, 16 bp, M. musculus
tgctccaccaccacca

SEQ ID NO: 442774 - DNA, 16 bp, M. musculus
tgctccactgtggtgt

SEQ ID NO: 442775 - DNA, 16 bp, M. musculus
tgctccagagtcagag

SEQ ID NO: 442776 - DNA, 16 bp, M. musculus
tgctccaggctcttcc

SEQ ID NO: 442777 - DNA, 16 bp, M. musculus
tgctccaggttcctgc

SEQ ID NO: 442778 - DNA, 16 bp, M. musculus
tgctccagttgctggg

SEQ ID NO: 442779 - DNA, 16 bp, M. musculus
tgctcccacctgtccc

SEQ ID NO: 442780 - DNA, 16 bp, M. musculus
tgctcccagccacagc

SEQ ID NO: 442781 - DNA, 16 bp, M. musculus
tgctccccaacaatgt

SEQ ID NO: 442782 - DNA, 16 bp, M. musculus
tgctccccaaccaccc

SEQ ID NO: 442783 - DNA, 16 bp, M. musculus
tgctccccaactcacc

SEQ ID NO: 442784 - DNA, 16 bp, M. musculus
tgctccccagtgctgg

SEQ ID NO: 442785 - DNA, 16 bp, M. musculus
tgctcccctttctaag

SEQ ID NO: 442786 - DNA, 16 bp, M. musculus
tgctccctctccaccc

SEQ ID NO: 442787 - DNA, 16 bp, M. musculus
tgctccctcttctgca

SEQ ID NO: 442788 - DNA, 16 bp, M. musculus
tgctccctgagtgctg

SEQ ID NO: 442789 - DNA, 16 bp, M. musculus
tgctcccttcagacac

SEQ ID NO: 442790 - DNA, 16 bp, M. musculus
tgctcctccagaggac

SEQ ID NO: 442791 - DNA, 16 bp, M. musculus
tgctcctccagattgc

SEQ ID NO: 442792 - DNA, 16 bp, M. musculus
tgctcctcctcctgtt

SEQ ID NO: 442793 - DNA, 16 bp, M. musculus
tgctcctcctgcttct

SEQ ID NO: 442794 - DNA, 16 bp, M. musculus
tgctcctctttttcca

SEQ ID NO: 442795 - DNA, 16 bp, M. musculus
tgctcctgaagatgta

SEQ ID NO: 442796 - DNA, 16 bp, M. musculus
tgctcctgaggcagag

SEQ ID NO: 442797 - DNA, 16 bp, M. musculus
tgctcctgcctctgct

SEQ ID NO: 442798 - DNA, 16 bp, M. musculus
tgctcctgctcttcct

SEQ ID NO: 442799 - DNA, 16 bp, M. musculus
tgctcctgctgccctg

SEQ ID NO: 442800 - DNA, 16 bp, M. musculus
tgctcctgggttctat

SEQ ID NO: 442801 - DNA, 16 bp, M. musculus
tgctcctgtaagtaat

SEQ ID NO: 442802 - DNA, 16 bp, M. musculus
tgctcctgtgtgtgta

SEQ ID NO: 442803 - DNA, 16 bp, M. musculus
tgctccttctcctgct

SEQ ID NO: 442804 - DNA, 16 bp, M. musculus
tgctccttgccctgct

SEQ ID NO: 442805 - DNA, 16 bp, M. musculus
tgctctacagagtgag

SEQ ID NO: 442806 - DNA, 16 bp, M. musculus
tgctctaccttaccaa

SEQ ID NO: 442807 - DNA, 16 bp, M. musculus
tgctctagagagcaca

SEQ ID NO: 442808 - DNA, 16 bp, M. musculus
tgctctatttcaaatt

SEQ ID NO: 442809 - DNA, 16 bp, M. musculus
tgctctcacctgaatt

SEQ ID NO: 442810 - DNA, 16 bp, M. musculus
tgctctcagaagccag

SEQ ID NO: 442811 - DNA, 16 bp, M. musculus
tgctctcagaggccag

SEQ ID NO: 442812 - DNA, 16 bp, M. musculus
tgctctcagattttct

SEQ ID NO: 442813 - DNA, 16 bp, M. musculus
tgctctcagcattcct

SEQ ID NO: 442814 - DNA, 16 bp, M. musculus
tgctctcatggcttgc

SEQ ID NO: 442815 - DNA, 16 bp, M. musculus
tgctctccagagtgct

SEQ ID NO: 442816 - DNA, 16 bp, M. musculus
tgctctcccactgagc

SEQ ID NO: 442817 - DNA, 16 bp, M. musculus
tgctctcctggctccc

SEQ ID NO: 442818 - DNA, 17 bp, M. musculus
tgctctctcccatttct

SEQ ID NO: 442819 - DNA, 16 bp, M. musculus
tgctctctcctctgag

SEQ ID NO: 442820 - DNA, 16 bp, M. musculus
tgctctctgacctcca

SEQ ID NO: 442821 - DNA, 16 bp, M. musculus
tgctctctgccatgat

SEQ ID NO: 442822 - DNA, 16 bp, M. musculus
tgctctctgcctcctg

SEQ ID NO: 442823 - DNA, 16 bp, M. musculus
tgctctctgctccctg

SEQ ID NO: 442824 - DNA, 16 bp, M. musculus
tgctctctgcttcagt

SEQ ID NO: 442825 - DNA, 16 bp, M. musculus
tgctctctgcttcttg

SEQ ID NO: 442826 - DNA, 16 bp, M. musculus
tgctctctgttgctgt

SEQ ID NO: 442827 - DNA, 16 bp, M. musculus
tgctctcttctggcct

SEQ ID NO: 442828 - DNA, 16 bp, M. musculus
tgctctcttctggttt

SEQ ID NO: 442829 - DNA, 16 bp, M. musculus
tgctctcttctgtcct

SEQ ID NO: 442830 - DNA, 16 bp, M. musculus
tgctctgaacctctga

SEQ ID NO: 442831 - DNA, 16 bp, M. musculus
tgctctgaactgctga

SEQ ID NO: 442832 - DNA, 16 bp, M. musculus
tgctctgaagaaacag

SEQ ID NO: 442833 - DNA, 16 bp, M. musculus
tgctctgaagagacat

SEQ ID NO: 442834 - DNA, 16 bp, M. musculus
tgctctgagcactgaa

SEQ ID NO: 442835 - DNA, 16 bp, M. musculus
tgctctgagcaggcag

SEQ ID NO: 442836 - DNA, 16 bp, M. musculus
tgctctgagtggcaag

SEQ ID NO: 442837 - DNA, 16 bp, M. musculus
tgctctgataaaatac

SEQ ID NO: 442838 - DNA, 16 bp, M. musculus
tgctctgcagtgtgag

SEQ ID NO: 442839 - DNA, 16 bp, M. musculus
tgctctgcatgttttc

SEQ ID NO: 442840 - DNA, 16 bp, M. musculus
tgctctgccaactgag

SEQ ID NO: 442841 - DNA, 16 bp, M. musculus
tgctctgccacttctg

SEQ ID NO: 442842 - DNA, 16 bp, M. musculus
tgctctgcccagggag

SEQ ID NO: 442843 - DNA, 16 bp, M. musculus
tgctctgctccggtgt

SEQ ID NO: 442844 - DNA, 16 bp, M. musculus
tgctctgctctctgct

SEQ ID NO: 442845 - DNA, 16 bp, M. musculus
tgctctgctctgctcc

SEQ ID NO: 442846 - DNA, 16 bp, M. musculus
tgctctgctctgctct

SEQ ID NO: 442847 - DNA, 16 bp, M. musculus
tgctctgctgtgctct

SEQ ID NO: 442848 - DNA, 16 bp, M. musculus
tgctctgcttgctgcc

SEQ ID NO: 442849 - DNA, 16 bp, M. musculus
tgctctgcttggcctt

SEQ ID NO: 442850 - DNA, 16 bp, M. musculus
tgctctgcttttctcc

SEQ ID NO: 442851 - DNA, 16 bp, M. musculus
tgctctggagaccagg

SEQ ID NO: 442852 - DNA, 16 bp, M. musculus
tgctctggaggcagag

SEQ ID NO: 442853 - DNA, 16 bp, M. musculus
tgctctggaggctgag

SEQ ID NO: 442854 - DNA, 16 bp, M. musculus
tgctctggcaaagcct

SEQ ID NO: 442855 - DNA, 16 bp, M. musculus
tgctctggcctctgca

SEQ ID NO: 442856 - DNA, 16 bp, M. musculus
tgctctggctgctcct

SEQ ID NO: 442857 - DNA, 16 bp, M. musculus
tgctctggctgctctg

SEQ ID NO: 442858 - DNA, 16 bp, M. musculus
tgctctgggaaggcag

SEQ ID NO: 442859 - DNA, 16 bp, M. musculus
tgctctggtccaaaga

SEQ ID NO: 442860 - DNA, 16 bp, M. musculus
tgctctgtagaccagc

SEQ ID NO: 442861 - DNA, 16 bp, M. musculus
tgctctgtgaggactg

SEQ ID NO: 442862 - DNA, 16 bp, M. musculus
tgctctgtgctctgtg

SEQ ID NO: 442863 - DNA, 16 bp, M. musculus
tgctctgtggaccttg

SEQ ID NO: 442864 - DNA, 16 bp, M. musculus
tgctctgtgtgtgcat

SEQ ID NO: 442865 - DNA, 16 bp, M. musculus
tgctctgttcaggaag

SEQ ID NO: 442866 - DNA, 16 bp, M. musculus
tgctcttaaaccctga

SEQ ID NO: 442867 - DNA, 16 bp, M. musculus
tgctcttaaccactga

SEQ ID NO: 442868 - DNA, 16 bp, M. musculus
tgctcttaacctttga

SEQ ID NO: 442869 - DNA, 16 bp, M. musculus
tgctcttaactgcgga

SEQ ID NO: 442870 - DNA, 16 bp, M. musculus
tgctcttaatcaccaa

SEQ ID NO: 442871 - DNA, 16 bp, M. musculus
tgctcttaatcatgga

SEQ ID NO: 442872 - DNA, 16 bp, M. musculus
tgctcttacagaggac

SEQ ID NO: 442873 - DNA, 16 bp, M. musculus
tgctcttactgctgag

SEQ ID NO: 442874 - DNA, 16 bp, M. musculus
tgctcttagccactgg

SEQ ID NO: 442875 - DNA, 16 bp, M. musculus
tgctcttagtcactga

SEQ ID NO: 442876 - DNA, 16 bp, M. musculus
tgctcttatagaggac

SEQ ID NO: 442877 - DNA, 16 bp, M. musculus
tgctcttcacctctga

SEQ ID NO: 442878 - DNA, 16 bp, M. musculus
tgctcttcagatctcc

SEQ ID NO: 442879 - DNA, 16 bp, M. musculus
tgctcttccaaaggac

SEQ ID NO: 442880 - DNA, 16 bp, M. musculus
tgctcttccagaggac

SEQ ID NO: 442881 - DNA, 16 bp, M. musculus
tgctcttccagaggat

SEQ ID NO: 442882 - DNA, 16 bp, M. musculus
tgctcttccagagttc

SEQ ID NO: 442883 - DNA, 16 bp, M. musculus
tgctcttccaggagac

SEQ ID NO: 442884 - DNA, 16 bp, M. musculus
tgctcttccagtggtc

SEQ ID NO: 442885 - DNA, 16 bp, M. musculus
tgctcttcctcctgct

SEQ ID NO: 442886 - DNA, 16 bp, M. musculus
tgctcttcctgaagac

SEQ ID NO: 442887 - DNA, 16 bp, M. musculus
tgctcttcctgctgcc

SEQ ID NO: 442888 - DNA, 16 bp, M. musculus
tgctcttcctgtggag

SEQ ID NO: 442889 - DNA, 16 bp, M. musculus
tgctcttctacaggac

SEQ ID NO: 442890 - DNA, 16 bp, M. musculus
tgctcttctagagaac

SEQ ID NO: 442891 - DNA, 16 bp, M. musculus
tgctcttctccaagac

SEQ ID NO: 442892 - DNA, 16 bp, M. musculus
tgctcttctgaaggac

SEQ ID NO: 442893 - DNA, 16 bp, M. musculus
tgctcttctgaaggcc

SEQ ID NO: 442894 - DNA, 16 bp, M. musculus
tgctcttctggtgtgt

SEQ ID NO: 442895 - DNA, 16 bp, M. musculus
tgctcttgcacaggac

SEQ ID NO: 442896 - DNA, 16 bp, M. musculus
tgctcttgcagaagac

SEQ ID NO: 442897 - DNA, 16 bp, M. musculus
tgctcttgcagagaac

SEQ ID NO: 442898 - DNA, 16 bp, M. musculus
tgctcttgcagaggac

SEQ ID NO: 442899 - DNA, 16 bp, M. musculus
tgctcttgcagaggat

SEQ ID NO: 442900 - DNA, 16 bp, M. musculus
tgctcttgcggaggac

SEQ ID NO: 442901 - DNA, 16 bp, M. musculus
tgctcttgctcctgct

SEQ ID NO: 442902 - DNA, 16 bp, M. musculus
tgctcttgctgaagac

SEQ ID NO: 442903 - DNA, 16 bp, M. musculus
tgctcttgctgaggac

SEQ ID NO: 442904 - DNA, 16 bp, M. musculus
tgctcttggagaagac

SEQ ID NO: 442905 - DNA, 16 bp, M. musculus
tgctcttggagaggac

SEQ ID NO: 442906 - DNA, 16 bp, M. musculus
tgctcttggctgctga

SEQ ID NO: 442907 - DNA, 16 bp, M. musculus
tgctcttggttgccca

SEQ ID NO: 442908 - DNA, 16 bp, M. musculus
tgctctttcaaaggac

SEQ ID NO: 442909 - DNA, 16 bp, M. musculus
tgctctttcagaagtc

SEQ ID NO: 442910 - DNA, 16 bp, M. musculus
tgctctttcagagacc

SEQ ID NO: 442911 - DNA, 16 bp, M. musculus
tgctctttcagaggac

SEQ ID NO: 442912 - DNA, 16 bp, M. musculus
tgctctttcccaggct

SEQ ID NO: 442913 - DNA, 16 bp, M. musculus
tgctgaaagaagctga

SEQ ID NO: 442914 - DNA, 16 bp, M. musculus
tgctgaaaggagccag

SEQ ID NO: 442915 - DNA, 16 bp, M. musculus
tgctgaaaggagcctg

SEQ ID NO: 442916 - DNA, 16 bp, M. musculus
tgctgaaaggagtctg

SEQ ID NO: 442917 - DNA, 17 bp, M. musculus
tgctgaaaggatcctga

SEQ ID NO: 442918 - DNA, 16 bp, M. musculus
tgctgaaaggtccttg

SEQ ID NO: 442919 - DNA, 16 bp, M. musculus
tgctgaacatcttttc

SEQ ID NO: 442920 - DNA, 16 bp, M. musculus
tgctgaacatttcttt

SEQ ID NO: 442921 - DNA, 16 bp, M. musculus
tgctgaaccacctctc

SEQ ID NO: 442922 - DNA, 16 bp, M. musculus
tgctgaaccctgtggt

SEQ ID NO: 442923 - DNA, 16 bp, M. musculus
tgctgaagacagcaca

SEQ ID NO: 442924 - DNA, 16 bp, M. musculus
tgctgaagaggcagag

SEQ ID NO: 442925 - DNA, 16 bp, M. musculus
tgctgaagatgtttat

SEQ ID NO: 442926 - DNA, 16 bp, M. musculus
tgctgaagcaggcaga

SEQ ID NO: 442927 - DNA, 16 bp, M. musculus
tgctgaaggagctgag

SEQ ID NO: 442928 - DNA, 16 bp, M. musculus
tgctgaaggaggcaga

SEQ ID NO: 442929 - DNA, 16 bp, M. musculus
tgctgaaggcctggag

SEQ ID NO: 442930 - DNA, 16 bp, M. musculus
tgctgaatctgaatgt

SEQ ID NO: 442931 - DNA, 16 bp, M. musculus
tgctgaatttgtgtct

SEQ ID NO: 442932 - DNA, 16 bp, M. musculus
tgctgacaacaaagat

SEQ ID NO: 442933 - DNA, 16 bp, M. musculus
tgctgacaagagctag

SEQ ID NO: 442934 - DNA, 16 bp, M. musculus
tgctgacaaggatgta

SEQ ID NO: 442935 - DNA, 16 bp, M. musculus
tgctgacaaggatgtg

SEQ ID NO: 442936 - DNA, 16 bp, M. musculus
tgctgacaatgaagat

SEQ ID NO: 442937 - DNA, 16 bp, M. musculus
tgctgacactggtctt

SEQ ID NO: 442938 - DNA, 16 bp, M. musculus
tgctgacaggaatctg

SEQ ID NO: 442939 - DNA, 16 bp, M. musculus
tgctgacaggaccttg

SEQ ID NO: 442940 - DNA, 16 bp, M. musculus
tgctgacaggagcctg

SEQ ID NO: 442941 - DNA, 16 bp, M. musculus
tgctgacattctggca

SEQ ID NO: 442942 - DNA, 16 bp, M. musculus
tgctgaccactgtggt

SEQ ID NO: 442943 - DNA, 16 bp, M. musculus
tgctgaccctcagggc

SEQ ID NO: 442944 - DNA, 16 bp, M. musculus
tgctgaccctgaggaa

SEQ ID NO: 442945 - DNA, 16 bp, M. musculus
tgctgacctgtgagct

SEQ ID NO: 442946 - DNA, 16 bp, M. musculus
tgctgactctcaggaa

SEQ ID NO: 442947 - DNA, 16 bp, M. musculus
tgctgagaaagagatc

SEQ ID NO: 442948 - DNA, 16 bp, M. musculus
tgctgagaaagttcat

SEQ ID NO: 442949 - DNA, 16 bp, M. musculus
tgctgagaacagacac

SEQ ID NO: 442950 - DNA, 16 bp, M. musculus
tgctgagaagaaagtg

SEQ ID NO: 442951 - DNA, 16 bp, M. musculus
tgctgagaagaagtta

SEQ ID NO: 442952 - DNA, 16 bp, M. musculus
tgctgagaagtgcttc

SEQ ID NO: 442953 - DNA, 16 bp, M. musculus
tgctgagaatcaaacc

SEQ ID NO: 442954 - DNA, 16 bp, M. musculus
tgctgagaattgaact

SEQ ID NO: 442955 - DNA, 16 bp, M. musculus
tgctgagacaagaccc

SEQ ID NO: 442956 - DNA, 16 bp, M. musculus
tgctgagacatctcac

SEQ ID NO: 442957 - DNA, 16 bp, M. musculus
tgctgagaccctttaa

SEQ ID NO: 442958 - DNA, 16 bp, M. musculus
tgctgagactcaaacc

SEQ ID NO: 442959 - DNA, 16 bp, M. musculus
tgctgagacttgaacc

SEQ ID NO: 442960 - DNA, 16 bp, M. musculus
tgctgagagagagaga

SEQ ID NO: 442961 - DNA, 16 bp, M. musculus
tgctgagagctcacat

SEQ ID NO: 442962 - DNA, 16 bp, M. musculus
tgctgagaggaccctg

SEQ ID NO: 442963 - DNA, 16 bp, M. musculus
tgctgagatgacaggc

SEQ ID NO: 442964 - DNA, 16 bp, M. musculus
tgctgagattaaagaa

SEQ ID NO: 442965 - DNA, 16 bp, M. musculus
tgctgagattaaagac

SEQ ID NO: 442966 - DNA, 16 bp, M. musculus
tgctgagattacaggt

SEQ ID NO: 442967 - DNA, 16 bp, M. musculus
tgctgagattttgtct

SEQ ID NO: 442968 - DNA, 16 bp, M. musculus
tgctgagatttttttt

SEQ ID NO: 442969 - DNA, 16 bp, M. musculus
tgctgagccatctctg

SEQ ID NO: 442970 - DNA, 16 bp, M. musculus
tgctgagctgagctga

SEQ ID NO: 442971 - DNA, 16 bp, M. musculus
tgctgagctgctgagc

SEQ ID NO: 442972 - DNA, 16 bp, M. musculus
tgctgaggaaagctgc

SEQ ID NO: 442973 - DNA, 16 bp, M. musculus
tgctgaggaccaaacc

SEQ ID NO: 442974 - DNA, 16 bp, M. musculus
tgctgaggacccaggt

SEQ ID NO: 442975 - DNA, 16 bp, M. musculus
tgctgaggaggaggag

SEQ ID NO: 442976 - DNA, 16 bp, M. musculus
tgctgaggaggatgtg

SEQ ID NO: 442977 - DNA, 16 bp, M. musculus
tgctgaggatgcggta

SEQ ID NO: 442978 - DNA, 16 bp, M. musculus
tgctgaggatggagcc

SEQ ID NO: 442979 - DNA, 16 bp, M. musculus
tgctgaggcaggaaga

SEQ ID NO: 442980 - DNA, 16 bp, M. musculus
tgctgaggcctggctg

SEQ ID NO: 442981 - DNA, 16 bp, M. musculus
tgctgaggctatggag

SEQ ID NO: 442982 - DNA, 16 bp, M. musculus
tgctgaggctgaggct

SEQ ID NO: 442983 - DNA, 16 bp, M. musculus
tgctgaggtgggggtg

SEQ ID NO: 442984 - DNA, 16 bp, M. musculus
tgctgagtggagcctc

SEQ ID NO: 442985 - DNA, 16 bp, M. musculus
tgctgagtggtggtgg

SEQ ID NO: 442986 - DNA, 16 bp, M. musculus
tgctgatatcctgaca

SEQ ID NO: 442987 - DNA, 16 bp, M. musculus
tgctgatgccaagaag

SEQ ID NO: 442988 - DNA, 16 bp, M. musculus
tgctgatggtggtgat

SEQ ID NO: 442989 - DNA, 16 bp, M. musculus
tgctgatgtttaaatg

SEQ ID NO: 442990 - DNA, 16 bp, M. musculus
tgctgattaggggtgt

SEQ ID NO: 442991 - DNA, 16 bp, M. musculus
tgctgattatgggatg

SEQ ID NO: 442992 - DNA, 16 bp, M. musculus
tgctgattcataggat

SEQ ID NO: 442993 - DNA, 16 bp, M. musculus
tgctgattcatctctc

SEQ ID NO: 442994 - DNA, 16 bp, M. musculus
tgctgcagaagattct

SEQ ID NO: 442995 - DNA, 16 bp, M. musculus
tgctgcagaaggagct

SEQ ID NO: 442996 - DNA, 16 bp, M. musculus
tgctgcagaccctctg

SEQ ID NO: 442997 - DNA, 16 bp, M. musculus
tgctgcagagggcaga

SEQ ID NO: 442998 - DNA, 16 bp, M. musculus
tgctgcagctgctgct

SEQ ID NO: 442999 - DNA, 16 bp, M. musculus
tgctgcaggaagaagc

SEQ ID NO: 443000 - DNA, 16 bp, M. musculus
tgctgcaggagaaagc

SEQ ID NO: 443001 - DNA, 16 bp, M. musculus
tgctgcaggtggtgag

SEQ ID NO: 443002 - DNA, 16 bp, M. musculus
tgctgcagtgggactt

SEQ ID NO: 443003 - DNA, 16 bp, M. musculus
tgctgcagtgggccag

SEQ ID NO: 443004 - DNA, 16 bp, M. musculus
tgctgcagtgtttgga

SEQ ID NO: 443005 - DNA, 16 bp, M. musculus
tgctgcagtttcttgt

SEQ ID NO: 443006 - DNA, 16 bp, M. musculus
tgctgcatcctcctgc

SEQ ID NO: 443007 - DNA, 16 bp, M. musculus
tgctgcatgctttcca

SEQ ID NO: 443008 - DNA, 16 bp, M. musculus
tgctgccaaaaagaaa

SEQ ID NO: 443009 - DNA, 16 bp, M. musculus
tgctgccaaggatgtg

SEQ ID NO: 443010 - DNA, 16 bp, M. musculus
tgctgccaaggctgat

SEQ ID NO: 443011 - DNA, 16 bp, M. musculus
tgctgccaaggctggc

SEQ ID NO: 443012 - DNA, 16 bp, M. musculus
tgctgccaatccagca

SEQ ID NO: 443013 - DNA, 16 bp, M. musculus
tgctgccaccaccacc

SEQ ID NO: 443014 - DNA, 16 bp, M. musculus
tgctgccaccacccag

SEQ ID NO: 443015 - DNA, 16 bp, M. musculus
tgctgccaccactgcc

SEQ ID NO: 443016 - DNA, 16 bp, M. musculus
tgctgccacctagtgg

SEQ ID NO: 443017 - DNA, 16 bp, M. musculus
tgctgccacctgctgg

SEQ ID NO: 443018 - DNA, 16 bp, M. musculus
tgctgccactgcccag

SEQ ID NO: 443019 - DNA, 16 bp, M. musculus
tgctgccaggagcaga

SEQ ID NO: 443020 - DNA, 16 bp, M. musculus
tgctgccatctagtgg

SEQ ID NO: 443021 - DNA, 16 bp, M. musculus
tgctgccatctgctgg

SEQ ID NO: 443022 - DNA, 16 bp, M. musculus
tgctgccatctgctgt

SEQ ID NO: 443023 - DNA, 16 bp, M. musculus
tgctgccatgcctccc

SEQ ID NO: 443024 - DNA, 16 bp, M. musculus
tgctgccatgctgccc

SEQ ID NO: 443025 - DNA, 16 bp, M. musculus
tgctgccatgttccct

SEQ ID NO: 443026 - DNA, 16 bp, M. musculus
tgctgcccacaatggg

SEQ ID NO: 443027 - DNA, 16 bp, M. musculus
tgctgcccactgtggg

SEQ ID NO: 443028 - DNA, 16 bp, M. musculus
tgctgcccagccaaag

SEQ ID NO: 443029 - DNA, 16 bp, M. musculus
tgctgccccctagtgg

SEQ ID NO: 443030 - DNA, 16 bp, M. musculus
tgctgccccctgctgg

SEQ ID NO: 443031 - DNA, 16 bp, M. musculus
tgctgccccctggtgg

SEQ ID NO: 443032 - DNA, 16 bp, M. musculus
tgctgcccccttctgg

SEQ ID NO: 443033 - DNA, 16 bp, M. musculus
tgctgcccctgcccct

SEQ ID NO: 443034 - DNA, 16 bp, M. musculus
tgctgcccctggcttg

SEQ ID NO: 443035 - DNA, 16 bp, M. musculus
tgctgcccctgtgccc

SEQ ID NO: 443036 - DNA, 16 bp, M. musculus
tgctgccctctgctgg

SEQ ID NO: 443037 - DNA, 16 bp, M. musculus
tgctgccctctggtgg

SEQ ID NO: 443038 - DNA, 16 bp, M. musculus
tgctgccctgtgtcat

SEQ ID NO: 443039 - DNA, 17 bp, M. musculus
tgctgccgccccagctg

SEQ ID NO: 443040 - DNA, 16 bp, M. musculus
tgctgccgctgctgcc

SEQ ID NO: 443041 - DNA, 16 bp, M. musculus
tgctgcctactggctt

SEQ ID NO: 443042 - DNA, 16 bp, M. musculus
tgctgcctcagcccct

SEQ ID NO: 443043 - DNA, 16 bp, M. musculus
tgctgcctctgctgct

SEQ ID NO: 443044 - DNA, 16 bp, M. musculus
tgctgcctgattggtg

SEQ ID NO: 443045 - DNA, 16 bp, M. musculus
tgctgcctgcctgcct

SEQ ID NO: 443046 - DNA, 16 bp, M. musculus
tgctgcctgctaacct

SEQ ID NO: 443047 - DNA, 17 bp, M. musculus
tgctgcctgctgcctgc

SEQ ID NO: 443048 - DNA, 16 bp, M. musculus
tgctgcctggctggtg

SEQ ID NO: 443049 - DNA, 16 bp, M. musculus
tgctgcctggttggta

SEQ ID NO: 443050 - DNA, 16 bp, M. musculus
tgctgcctgtgaatca

SEQ ID NO: 443051 - DNA, 16 bp, M. musculus
tgctgcctgtgccctg

SEQ ID NO: 443052 - DNA, 16 bp, M. musculus
tgctgcctgtggatct

SEQ ID NO: 443053 - DNA, 16 bp, M. musculus
tgctgccttgcttcct

SEQ ID NO: 443054 - DNA, 16 bp, M. musculus
tgctgcctttgcagag

SEQ ID NO: 443055 - DNA, 16 bp, M. musculus
tgctgcgatcctttaa

SEQ ID NO: 443056 - DNA, 16 bp, M. musculus
tgctgctactgctgtt

SEQ ID NO: 443057 - DNA, 16 bp, M. musculus
tgctgctactgttgct

SEQ ID NO: 443058 - DNA, 16 bp, M. musculus
tgctgctatgctccca

SEQ ID NO: 443059 - DNA, 16 bp, M. musculus
tgctgctcacagtggg

SEQ ID NO: 443060 - DNA, 16 bp, M. musculus
tgctgctcagcctccg

SEQ ID NO: 443061 - DNA, 16 bp, M. musculus
tgctgctcctccagag

SEQ ID NO: 443062 - DNA, 16 bp, M. musculus
tgctgctcctgcagaa

SEQ ID NO: 443063 - DNA, 16 bp, M. musculus
tgctgctcctgcagag

SEQ ID NO: 443064 - DNA, 16 bp, M. musculus
tgctgctcctgctgct

SEQ ID NO: 443065 - DNA, 17 bp, M. musculus
tgctgctcctgctgctc

SEQ ID NO: 443066 - DNA, 16 bp, M. musculus
tgctgctccttcagag

SEQ ID NO: 443067 - DNA, 16 bp, M. musculus
tgctgctctctgctct

SEQ ID NO: 443068 - DNA, 16 bp, M. musculus
tgctgctctctgtgtt

SEQ ID NO: 443069 - DNA, 16 bp, M. musculus
tgctgctcttacagag

SEQ ID NO: 443070 - DNA, 16 bp, M. musculus
tgctgctcttctggag

SEQ ID NO: 443071 - DNA, 16 bp, M. musculus
tgctgctcttgtagag

SEQ ID NO: 443072 - DNA, 16 bp, M. musculus
tgctgctgagcctgat

SEQ ID NO: 443073 - DNA, 16 bp, M. musculus
tgctgctgatgctgct

SEQ ID NO: 443074 - DNA, 16 bp, M. musculus
tgctgctgatttgtgt

SEQ ID NO: 443075 - DNA, 16 bp, M. musculus
tgctgctgcagggcca

SEQ ID NO: 443076 - DNA, 16 bp, M. musculus
tgctgctgcagttggc

SEQ ID NO: 443077 - DNA, 16 bp, M. musculus
tgctgctgctatgaat

SEQ ID NO: 443078 - DNA, 16 bp, M. musculus
tgctgctgctattgct

SEQ ID NO: 443079 - DNA, 16 bp, M. musculus
tgctgctgctccccct

SEQ ID NO: 443080 - DNA, 16 bp, M. musculus
tgctgctgctcctgtt

SEQ ID NO: 443081 - DNA, 16 bp, M. musculus
tgctgctgctcttgtt

SEQ ID NO: 443082 - DNA, 16 bp, M. musculus
tgctgctgctgaggct

SEQ ID NO: 443083 - DNA, 16 bp, M. musculus
tgctgctgctgatggt

SEQ ID NO: 443084 - DNA, 16 bp, M. musculus
tgctgctgctgccact

SEQ ID NO: 443085 - DNA, 16 bp, M. musculus
tgctgctgctgctaat

SEQ ID NO: 443086 - DNA, 16 bp, M. musculus
tgctgctgctgctact

SEQ ID NO: 443087 - DNA, 16 bp, M. musculus
tgctgctgctgctgat

SEQ ID NO: 443088 - DNA, 16 bp, M. musculus
tgctgctgctgctgca

SEQ ID NO: 443089 - DNA, 16 bp, M. musculus
tgctgctgctgctgct

SEQ ID NO: 443090 - DNA, 17 bp, M. musculus
tgctgctgctgctgggg

SEQ ID NO: 443091 - DNA, 16 bp, M. musculus
tgctgctgctgctgta

SEQ ID NO: 443092 - DNA, 16 bp, M. musculus
tgctgctgctgctgtc

SEQ ID NO: 443093 - DNA, 16 bp, M. musculus
tgctgctgctgcttcc

SEQ ID NO: 443094 - DNA, 16 bp, M. musculus
tgctgctgctggtgat

SEQ ID NO: 443095 - DNA, 18 bp, M. musculus
tgctgctgctggtgctgc

SEQ ID NO: 443096 - DNA, 16 bp, M. musculus
tgctgctgctggtggc

SEQ ID NO: 443097 - DNA, 16 bp, M. musculus
tgctgctgctggtggt

SEQ ID NO: 443098 - DNA, 16 bp, M. musculus
tgctgctgctggtgtg

SEQ ID NO: 443099 - DNA, 16 bp, M. musculus
tgctgctgctggtgtt

SEQ ID NO: 443100 - DNA, 16 bp, M. musculus
tgctgctgctgtgctg

SEQ ID NO: 443101 - DNA, 16 bp, M. musculus
tgctgctgctgtgtgc

SEQ ID NO: 443102 - DNA, 16 bp, M. musculus
tgctgctgctgtgtgt

SEQ ID NO: 443103 - DNA, 16 bp, M. musculus
tgctgctgctgttctt

SEQ ID NO: 443104 - DNA, 16 bp, M. musculus
tgctgctgctgttgat

SEQ ID NO: 443105 - DNA, 16 bp, M. musculus
tgctgctgctgttgca

SEQ ID NO: 443106 - DNA, 16 bp, M. musculus
tgctgctgctgttgtt

SEQ ID NO: 443107 - DNA, 16 bp, M. musculus
tgctgctgctgtttct

SEQ ID NO: 443108 - DNA, 16 bp, M. musculus
tgctgctgctgtttgt

SEQ ID NO: 443109 - DNA, 16 bp, M. musculus
tgctgctgcttctgct

SEQ ID NO: 443110 - DNA, 16 bp, M. musculus
tgctgctggagcagat

SEQ ID NO: 443111 - DNA, 16 bp, M. musculus
tgctgctggatgaagc

SEQ ID NO: 443112 - DNA, 16 bp, M. musculus
tgctgctggctgctgc

SEQ ID NO: 443113 - DNA, 16 bp, M. musculus
tgctgctgggagcctg

SEQ ID NO: 443114 - DNA, 16 bp, M. musculus
tgctgctggggcagac

SEQ ID NO: 443115 - DNA, 16 bp, M. musculus
tgctgctgtccttggt

SEQ ID NO: 443116 - DNA, 16 bp, M. musculus
tgctgctgtgaacaga

SEQ ID NO: 443117 - DNA, 16 bp, M. musculus
tgctgctgtgcctggc

SEQ ID NO: 443118 - DNA, 16 bp, M. musculus
tgctgctgtgctgctg

SEQ ID NO: 443119 - DNA, 16 bp, M. musculus
tgctgctgttgctgcc

SEQ ID NO: 443120 - DNA, 16 bp, M. musculus
tgctgctgttgctgct

SEQ ID NO: 443121 - DNA, 16 bp, M. musculus
tgctgctgttgctggt

SEQ ID NO: 443122 - DNA, 16 bp, M. musculus
tgctgctgttgcttct

SEQ ID NO: 443123 - DNA, 16 bp, M. musculus
tgctgctgttgtgaat

SEQ ID NO: 443124 - DNA, 16 bp, M. musculus
tgctgctgtttctgct

SEQ ID NO: 443125 - DNA, 16 bp, M. musculus
tgctgcttacagcaaa

SEQ ID NO: 443126 - DNA, 16 bp, M. musculus
tgctgcttctgctgcc

SEQ ID NO: 443127 - DNA, 16 bp, M. musculus
tgctgcttctgctgct

SEQ ID NO: 443128 - DNA, 16 bp, M. musculus
tgctgcttctgcttct

SEQ ID NO: 443129 - DNA, 16 bp, M. musculus
tgctgctttggtctct

SEQ ID NO: 443130 - DNA, 16 bp, M. musculus
tgctgcttttaatatt

SEQ ID NO: 443131 - DNA, 16 bp, M. musculus
tgctgcttttgcagag

SEQ ID NO: 443132 - DNA, 16 bp, M. musculus
tgctggaaaaactgtt

SEQ ID NO: 443133 - DNA, 16 bp, M. musculus
tgctggaaactaaact

SEQ ID NO: 443134 - DNA, 16 bp, M. musculus
tgctggaaagaaccca

SEQ ID NO: 443135 - DNA, 16 bp, M. musculus
tgctggaaatcaaact

SEQ ID NO: 443136 - DNA, 16 bp, M. musculus
tgctggaacttgaact

SEQ ID NO: 443137 - DNA, 16 bp, M. musculus
tgctggaagctctgta

SEQ ID NO: 443138 - DNA, 16 bp, M. musculus
tgctggaataaaaggc

SEQ ID NO: 443139 - DNA, 16 bp, M. musculus
tgctggaatcctgaag

SEQ ID NO: 443140 - DNA, 16 bp, M. musculus
tgctggaatgaaaggc

SEQ ID NO: 443141 - DNA, 16 bp, M. musculus
tgctggaattaaaagc

SEQ ID NO: 443142 - DNA, 18 bp, M. musculus
tgctggactgcacctgga

SEQ ID NO: 443143 - DNA, 16 bp, M. musculus
tgctggagaagcagag

SEQ ID NO: 443144 - DNA, 16 bp, M. musculus
tgctggagaagctgag

SEQ ID NO: 443145 - DNA, 16 bp, M. musculus
tgctggagaaggaact

SEQ ID NO: 443146 - DNA, 16 bp, M. musculus
tgctggagaaggagcc

SEQ ID NO: 443147 - DNA, 16 bp, M. musculus
tgctggagaaggagct

SEQ ID NO: 443148 - DNA, 16 bp, M. musculus
tgctggagacctacat

SEQ ID NO: 443149 - DNA, 16 bp, M. musculus
tgctggagagaaggct

SEQ ID NO: 443150 - DNA, 16 bp, M. musculus
tgctggagagctggcc

SEQ ID NO: 443151 - DNA, 16 bp, M. musculus
tgctggagaggagctg

SEQ ID NO: 443152 - DNA, 16 bp, M. musculus
tgctggagaggtagct

SEQ ID NO: 443153 - DNA, 16 bp, M. musculus
tgctggagattaaacc

SEQ ID NO: 443154 - DNA, 16 bp, M. musculus
tgctggagattgagcc

SEQ ID NO: 443155 - DNA, 16 bp, M. musculus
tgctggagcacatgaa

SEQ ID NO: 443156 - DNA, 16 bp, M. musculus
tgctggagcagatgct

SEQ ID NO: 443157 - DNA, 16 bp, M. musculus
tgctggagctggaaca

SEQ ID NO: 443158 - DNA, 16 bp, M. musculus
tgctggaggaagcatg

SEQ ID NO: 443159 - DNA, 16 bp, M. musculus
tgctggaggaagtgca

SEQ ID NO: 443160 - DNA, 16 bp, M. musculus
tgctggaggaagtggg

SEQ ID NO: 443161 - DNA, 16 bp, M. musculus
tgctggaggagccaag

SEQ ID NO: 443162 - DNA, 16 bp, M. musculus
tgctggaggagctgag

SEQ ID NO: 443163 - DNA, 16 bp, M. musculus
tgctggaggagggaga

SEQ ID NO: 443164 - DNA, 16 bp, M. musculus
tgctggaggaggtgtg

SEQ ID NO: 443165 - DNA, 16 bp, M. musculus
tgctggaggctgagaa

SEQ ID NO: 443166 - DNA, 16 bp, M. musculus
tgctggaggtgtgctc

SEQ ID NO: 443167 - DNA, 16 bp, M. musculus
tgctggagtttgaact

SEQ ID NO: 443168 - DNA, 16 bp, M. musculus
tgctggatcctctgga

SEQ ID NO: 443169 - DNA, 17 bp, M. musculus
tgctggatcttctggta

SEQ ID NO: 443170 - DNA, 16 bp, M. musculus
tgctggatgtgggctc

SEQ ID NO: 443171 - DNA, 16 bp, M. musculus
tgctggatttcctgca

SEQ ID NO: 443172 - DNA, 16 bp, M. musculus
tgctggcaaggatata

SEQ ID NO: 443173 - DNA, 16 bp, M. musculus
tgctggcaaggctgtg

SEQ ID NO: 443174 - DNA, 16 bp, M. musculus
tgctggcacagctggt

SEQ ID NO: 443175 - DNA, 16 bp, M. musculus
tgctggcagccaatgg

SEQ ID NO: 443176 - DNA, 16 bp, M. musculus
tgctggcaggaccctg

SEQ ID NO: 443177 - DNA, 16 bp, M. musculus
tgctggcatctttatt

SEQ ID NO: 443178 - DNA, 16 bp, M. musculus
tgctggcattaaaagc

SEQ ID NO: 443179 - DNA, 16 bp, M. musculus
tgctggccacaaaagt

SEQ ID NO: 443180 - DNA, 16 bp, M. musculus
tgctggccaccaagcc

SEQ ID NO: 443181 - DNA, 16 bp, M. musculus
tgctggcccaactggc

SEQ ID NO: 443182 - DNA, 16 bp, M. musculus
tgctggcccctgtggt

SEQ ID NO: 443183 - DNA, 16 bp, M. musculus
tgctggccctcagtgc

SEQ ID NO: 443184 - DNA, 16 bp, M. musculus
tgctggcctcctagga

SEQ ID NO: 443185 - DNA, 16 bp, M. musculus
tgctggcctggaactc

SEQ ID NO: 443186 - DNA, 16 bp, M. musculus
tgctggcgcatgcctt

SEQ ID NO: 443187 - DNA, 16 bp, M. musculus
tgctggcgctgactgg

SEQ ID NO: 443188 - DNA, 16 bp, M. musculus
tgctggctaattttat

SEQ ID NO: 443189 - DNA, 16 bp, M. musculus
tgctggctaggctgag

SEQ ID NO: 443190 - DNA, 16 bp, M. musculus
tgctggctgccagcct

SEQ ID NO: 443191 - DNA, 16 bp, M. musculus
tgctggcttgctcctc

SEQ ID NO: 443192 - DNA, 16 bp, M. musculus
tgctggctttgctgaa

SEQ ID NO: 443193 - DNA, 16 bp, M. musculus
tgctgggaaatgaact

SEQ ID NO: 443194 - DNA, 16 bp, M. musculus
tgctgggaacagaatt

SEQ ID NO: 443195 - DNA, 16 bp, M. musculus
tgctgggaaccaacct

SEQ ID NO: 443196 - DNA, 16 bp, M. musculus
tgctgggaactgtact

SEQ ID NO: 443197 - DNA, 16 bp, M. musculus
tgctgggaagcaaacc

SEQ ID NO: 443198 - DNA, 16 bp, M. musculus
tgctgggaaggtggag

SEQ ID NO: 443199 - DNA, 16 bp, M. musculus
tgctgggaagtggtgg

SEQ ID NO: 443200 - DNA, 19 bp, M. musculus
tgctgggaataaaggcgtg

SEQ ID NO: 443201 - DNA, 16 bp, M. musculus
tgctgggaatcaaagc

SEQ ID NO: 443202 - DNA, 16 bp, M. musculus
tgctgggaatgaaggt

SEQ ID NO: 443203 - DNA, 16 bp, M. musculus
tgctgggaatggaatc

SEQ ID NO: 443204 - DNA, 16 bp, M. musculus
tgctgggaattgaaac

SEQ ID NO: 443205 - DNA, 16 bp, M. musculus
tgctgggaattgaaat

SEQ ID NO: 443206 - DNA, 16 bp, M. musculus
tgctgggaattgaact

SEQ ID NO: 443207 - DNA, 16 bp, M. musculus
tgctgggaattgagct

SEQ ID NO: 443208 - DNA, 16 bp, M. musculus
tgctgggacccaaact

SEQ ID NO: 443209 - DNA, 16 bp, M. musculus
tgctgggaccctttaa

SEQ ID NO: 443210 - DNA, 16 bp, M. musculus
tgctgggacctgaact

SEQ ID NO: 443211 - DNA, 16 bp, M. musculus
tgctgggactaaagtt

SEQ ID NO: 443212 - DNA, 16 bp, M. musculus
tgctgggacttgaaca

SEQ ID NO: 443213 - DNA, 16 bp, M. musculus
tgctgggagaaagaaa

SEQ ID NO: 443214 - DNA, 16 bp, M. musculus
tgctgggagaaggaaa

SEQ ID NO: 443215 - DNA, 16 bp, M. musculus
tgctgggagaaggaga

SEQ ID NO: 443216 - DNA, 16 bp, M. musculus
tgctgggagagagaaa

SEQ ID NO: 443217 - DNA, 16 bp, M. musculus
tgctgggataaaacac

SEQ ID NO: 443218 - DNA, 20 bp, M. musculus
tgctgggatcaaaggcgtgt

SEQ ID NO: 443219 - DNA, 16 bp, M. musculus
tgctgggatcacaggt

SEQ ID NO: 443220 - DNA, 16 bp, M. musculus
tgctgggatcagaggt

SEQ ID NO: 443221 - DNA, 16 bp, M. musculus
tgctgggatcccaggc

SEQ ID NO: 443222 - DNA, 16 bp, M. musculus
tgctgggatgaaaagc

SEQ ID NO: 443223 - DNA, 16 bp, M. musculus
tgctgggatgtcctgt

SEQ ID NO: 443224 - DNA, 16 bp, M. musculus
tgctgggattaaaagc

SEQ ID NO: 443225 - DNA, 16 bp, M. musculus
tgctgggattaaagac

SEQ ID NO: 443226 - DNA, 16 bp, M. musculus
tgctgggattacaggc

SEQ ID NO: 443227 - DNA, 16 bp, M. musculus
tgctgggattacaggt

SEQ ID NO: 443228 - DNA, 16 bp, M. musculus
tgctgggattagaggt

SEQ ID NO: 443229 - DNA, 16 bp, M. musculus
tgctgggattatagac

SEQ ID NO: 443230 - DNA, 16 bp, M. musculus
tgctgggattatagat

SEQ ID NO: 443231 - DNA, 16 bp, M. musculus
tgctgggattatagga

SEQ ID NO: 443232 - DNA, 16 bp, M. musculus
tgctgggattataggc

SEQ ID NO: 443233 - DNA, 16 bp, M. musculus
tgctgggattcaaggt

SEQ ID NO: 443234 - DNA, 16 bp, M. musculus
tgctgggattgcaaac

SEQ ID NO: 443235 - DNA, 16 bp, M. musculus
tgctgggattggaggc

SEQ ID NO: 443236 - DNA, 16 bp, M. musculus
tgctgggatttcagac

SEQ ID NO: 443237 - DNA, 16 bp, M. musculus
tgctgggatttcaggc

SEQ ID NO: 443238 - DNA, 16 bp, M. musculus
tgctgggatttgaacc

SEQ ID NO: 443239 - DNA, 16 bp, M. musculus
tgctgggcctggtggc

SEQ ID NO: 443240 - DNA, 16 bp, M. musculus
tgctgggctctgatga

SEQ ID NO: 443241 - DNA, 16 bp, M. musculus
tgctgggcttaaaggt

SEQ ID NO: 443242 - DNA, 16 bp, M. musculus
tgctggggaagcctgg

SEQ ID NO: 443243 - DNA, 16 bp, M. musculus
tgctggggactgaagc

SEQ ID NO: 443244 - DNA, 16 bp, M. musculus
tgctggggactgagcc

SEQ ID NO: 443245 - DNA, 16 bp, M. musculus
tgctggggatgctggg

SEQ ID NO: 443246 - DNA, 16 bp, M. musculus
tgctggggatggaatc

SEQ ID NO: 443247 - DNA, 16 bp, M. musculus
tgctggggatgtagct

SEQ ID NO: 443248 - DNA, 16 bp, M. musculus
tgctggggctgctggg

SEQ ID NO: 443249 - DNA, 16 bp, M. musculus
tgctgggggcagggag

SEQ ID NO: 443250 - DNA, 16 bp, M. musculus
tgctgggggctggaga

SEQ ID NO: 443251 - DNA, 16 bp, M. musculus
tgctgggtctaaaggc

SEQ ID NO: 443252 - DNA, 16 bp, M. musculus
tgctgggtcttctggt

SEQ ID NO: 443253 - DNA, 16 bp, M. musculus
tgctggtaaaggattt

SEQ ID NO: 443254 - DNA, 16 bp, M. musculus
tgctggtcattgttgt

SEQ ID NO: 443255 - DNA, 16 bp, M. musculus
tgctggtctctggagt

SEQ ID NO: 443256 - DNA, 16 bp, M. musculus
tgctggtctttgctgg

SEQ ID NO: 443257 - DNA, 16 bp, M. musculus
tgctggtgagagtgca

SEQ ID NO: 443258 - DNA, 16 bp, M. musculus
tgctggtgaggatgca

SEQ ID NO: 443259 - DNA, 16 bp, M. musculus
tgctggtgatgatgat

SEQ ID NO: 443260 - DNA, 16 bp, M. musculus
tgctggtgctgctggt

SEQ ID NO: 443261 - DNA, 16 bp, M. musculus
tgctggtgctggtggt

SEQ ID NO: 443262 - DNA, 16 bp, M. musculus
tgctggtggaaatgca

SEQ ID NO: 443263 - DNA, 16 bp, M. musculus
tgctggtggccttttt

SEQ ID NO: 443264 - DNA, 16 bp, M. musculus
tgctggtgggaataca

SEQ ID NO: 443265 - DNA, 16 bp, M. musculus
tgctggtgtgtctgaa

SEQ ID NO: 443266 - DNA, 16 bp, M. musculus
tgctggtgtgtgcatg

SEQ ID NO: 443267 - DNA, 16 bp, M. musculus
tgctggttcaactggc

SEQ ID NO: 443268 - DNA, 16 bp, M. musculus
tgctggttcctcagaa

SEQ ID NO: 443269 - DNA, 16 bp, M. musculus
tgctggttcgtgcctg

SEQ ID NO: 443270 - DNA, 16 bp, M. musculus
tgctggttgggcctct

SEQ ID NO: 443271 - DNA, 16 bp, M. musculus
tgctggttgtttatgg

SEQ ID NO: 443272 - DNA, 18 bp, M. musculus
tgctgtaagatcgagaat

SEQ ID NO: 443273 - DNA, 16 bp, M. musculus
tgctgtaaggagacac

SEQ ID NO: 443274 - DNA, 16 bp, M. musculus
tgctgtaattttaaaa

SEQ ID NO: 443275 - DNA, 16 bp, M. musculus
tgctgtacaaagatga

SEQ ID NO: 443276 - DNA, 16 bp, M. musculus
tgctgtaccactgagc

SEQ ID NO: 443277 - DNA, 16 bp, M. musculus
tgctgtagaggatgtg

SEQ ID NO: 443278 - DNA, 16 bp, M. musculus
tgctgtagatttcttt

SEQ ID NO: 443279 - DNA, 16 bp, M. musculus
tgctgtcacagaccca

SEQ ID NO: 443280 - DNA, 16 bp, M. musculus
tgctgtcacatgagtt

SEQ ID NO: 443281 - DNA, 16 bp, M. musculus
tgctgtcacctgactt

SEQ ID NO: 443282 - DNA, 16 bp, M. musculus
tgctgtcaggagcctg

SEQ ID NO: 443283 - DNA, 16 bp, M. musculus
tgctgtcagtgtgaac

SEQ ID NO: 443284 - DNA, 16 bp, M. musculus
tgctgtcccccacccc

SEQ ID NO: 443285 - DNA, 16 bp, M. musculus
tgctgtccctgacctg

SEQ ID NO: 443286 - DNA, 16 bp, M. musculus
tgctgtccctgggctg

SEQ ID NO: 443287 - DNA, 16 bp, M. musculus
tgctgtccctgtactc

SEQ ID NO: 443288 - DNA, 16 bp, M. musculus
tgctgtcctcaatctc

SEQ ID NO: 443289 - DNA, 16 bp, M. musculus
tgctgtcctggaactc

SEQ ID NO: 443290 - DNA, 16 bp, M. musculus
tgctgtcctggagctc

SEQ ID NO: 443291 - DNA, 16 bp, M. musculus
tgctgtcgcctgagtt

SEQ ID NO: 443292 - DNA, 16 bp, M. musculus
tgctgtctactcatct

SEQ ID NO: 443293 - DNA, 16 bp, M. musculus
tgctgtctacttctct

SEQ ID NO: 443294 - DNA, 16 bp, M. musculus
tgctgtctcaactggc

SEQ ID NO: 443295 - DNA, 16 bp, M. musculus
tgctgtctctggctgg

SEQ ID NO: 443296 - DNA, 16 bp, M. musculus
tgctgtctgactggtg

SEQ ID NO: 443297 - DNA, 16 bp, M. musculus
tgctgtctgtttgatg

SEQ ID NO: 443298 - DNA, 16 bp, M. musculus
tgctgtcttcaaacac

SEQ ID NO: 443299 - DNA, 16 bp, M. musculus
tgctgtcttcagacac

SEQ ID NO: 443300 - DNA, 16 bp, M. musculus
tgctgtcttcaggcac

SEQ ID NO: 443301 - DNA, 16 bp, M. musculus
tgctgtcttctgacct

SEQ ID NO: 443302 - DNA, 17 bp, M. musculus
tgctgtcttttttccat

SEQ ID NO: 443303 - DNA, 16 bp, M. musculus
tgctgtgaaccaaact

SEQ ID NO: 443304 - DNA, 16 bp, M. musculus
tgctgtgaagaggcac

SEQ ID NO: 443305 - DNA, 16 bp, M. musculus
tgctgtgaattatctg

SEQ ID NO: 443306 - DNA, 16 bp, M. musculus
tgctgtgacaagacac

SEQ ID NO: 443307 - DNA, 16 bp, M. musculus
tgctgtgacaggcctg

SEQ ID NO: 443308 - DNA, 16 bp, M. musculus
tgctgtgagcaatcac

SEQ ID NO: 443309 - DNA, 16 bp, M. musculus
tgctgtgaggaaacac

SEQ ID NO: 443310 - DNA, 16 bp, M. musculus
tgctgtgataaaaccc

SEQ ID NO: 443311 - DNA, 16 bp, M. musculus
tgctgtgcaagcatga

SEQ ID NO: 443312 - DNA, 16 bp, M. musculus
tgctgtgcaccaagat

SEQ ID NO: 443313 - DNA, 16 bp, M. musculus
tgctgtgcagcccagg

SEQ ID NO: 443314 - DNA, 16 bp, M. musculus
tgctgtgctaaaatac

SEQ ID NO: 443315 - DNA, 16 bp, M. musculus
tgctgtgctgtgcagt

SEQ ID NO: 443316 - DNA, 16 bp, M. musculus
tgctgtgctgtgctct

SEQ ID NO: 443317 - DNA, 16 bp, M. musculus
tgctgtggattctgct

SEQ ID NO: 443318 - DNA, 16 bp, M. musculus
tgctgtggctgctgtg

SEQ ID NO: 443319 - DNA, 16 bp, M. musculus
tgctgtggtcacagtg

SEQ ID NO: 443320 - DNA, 16 bp, M. musculus
tgctgtggtcatgctg

SEQ ID NO: 443321 - DNA, 16 bp, M. musculus
tgctgtggtcattgtg

SEQ ID NO: 443322 - DNA, 16 bp, M. musculus
tgctgtggtctgaatg

SEQ ID NO: 443323 - DNA, 16 bp, M. musculus
tgctgtggtgtgctta

SEQ ID NO: 443324 - DNA, 16 bp, M. musculus
tgctgtggtgtgcttg

SEQ ID NO: 443325 - DNA, 16 bp, M. musculus
tgctgtgtagctcagg

SEQ ID NO: 443326 - DNA, 16 bp, M. musculus
tgctgtgtctgaagat

SEQ ID NO: 443327 - DNA, 16 bp, M. musculus
tgctgtgtgaccttga

SEQ ID NO: 443328 - DNA, 16 bp, M. musculus
tgctgtgtggatgctg

SEQ ID NO: 443329 - DNA, 16 bp, M. musculus
tgctgtgtggtattgg

SEQ ID NO: 443330 - DNA, 16 bp, M. musculus
tgctgtgtgtgctctg

SEQ ID NO: 443331 - DNA, 16 bp, M. musculus
tgctgtgtgtggatgg

SEQ ID NO: 443332 - DNA, 16 bp, M. musculus
tgctgtgttcttcctg

SEQ ID NO: 443333 - DNA, 16 bp, M. musculus
tgctgtgttcttggat

SEQ ID NO: 443334 - DNA, 16 bp, M. musculus
tgctgttatgaattat

SEQ ID NO: 443335 - DNA, 16 bp, M. musculus
tgctgttattgttgct

SEQ ID NO: 443336 - DNA, 16 bp, M. musculus
tgctgttcatcaccaa

SEQ ID NO: 443337 - DNA, 16 bp, M. musculus
tgctgttcattattga

SEQ ID NO: 443338 - DNA, 16 bp, M. musculus
tgctgttccagagcca

SEQ ID NO: 443339 - DNA, 16 bp, M. musculus
tgctgttccagctccc

SEQ ID NO: 443340 - DNA, 16 bp, M. musculus
tgctgttctgtccagg

SEQ ID NO: 443341 - DNA, 16 bp, M. musculus
tgctgttcttggtcat

SEQ ID NO: 443342 - DNA, 16 bp, M. musculus
tgctgttgccaagaag

SEQ ID NO: 443343 - DNA, 16 bp, M. musculus
tgctgttgccagaaac

SEQ ID NO: 443344 - DNA, 17 bp, M. musculus
tgctgttgccctgaggc

SEQ ID NO: 443345 - DNA, 16 bp, M. musculus
tgctgttgctaacctg

SEQ ID NO: 443346 - DNA, 16 bp, M. musculus
tgctgttgctgctact

SEQ ID NO: 443347 - DNA, 16 bp, M. musculus
tgctgttgctgctgtg

SEQ ID NO: 443348 - DNA, 16 bp, M. musculus
tgctgttgctgctgtt

SEQ ID NO: 443349 - DNA, 16 bp, M. musculus
tgctgttgctgtcttc

SEQ ID NO: 443350 - DNA, 16 bp, M. musculus
tgctgttgctgttctt

SEQ ID NO: 443351 - DNA, 17 bp, M. musculus
tgctgttgctgttgctg

SEQ ID NO: 443352 - DNA, 16 bp, M. musculus
tgctgttggcatcctg

SEQ ID NO: 443353 - DNA, 16 bp, M. musculus
tgctgttgttgctgct

SEQ ID NO: 443354 - DNA, 16 bp, M. musculus
tgctgtttgcattttg

SEQ ID NO: 443355 - DNA, 16 bp, M. musculus
tgctgttttgattgtg

SEQ ID NO: 443356 - DNA, 16 bp, M. musculus
tgctgtttttctttaa

SEQ ID NO: 443357 - DNA, 16 bp, M. musculus
tgcttaaaggaaaccc

SEQ ID NO: 443358 - DNA, 25 bp, M. musculus
tgcttaagcttgcccacaagtacag

SEQ ID NO: 443359 - DNA, 16 bp, M. musculus
tgcttaatgaaacttt

SEQ ID NO: 443360 - DNA, 16 bp, M. musculus
tgcttacaggaccctg

SEQ ID NO: 443361 - DNA, 16 bp, M. musculus
tgcttacaggagcatg

SEQ ID NO: 443362 - DNA, 17 bp, M. musculus
tgcttacagggaaccca

SEQ ID NO: 443363 - DNA, 16 bp, M. musculus
tgcttacagtttcaga

SEQ ID NO: 443364 - DNA, 16 bp, M. musculus
tgcttacatttttaaa

SEQ ID NO: 443365 - DNA, 16 bp, M. musculus
tgcttacccagcatgc

SEQ ID NO: 443366 - DNA, 16 bp, M. musculus
tgcttactgacttgct

SEQ ID NO: 443367 - DNA, 16 bp, M. musculus
tgcttactgccttgct

SEQ ID NO: 443368 - DNA, 16 bp, M. musculus
tgcttactgctcttcc

SEQ ID NO: 443369 - DNA, 17 bp, M. musculus
tgcttactggcttgctc

SEQ ID NO: 443370 - DNA, 16 bp, M. musculus
tgcttactggtttgct

SEQ ID NO: 443371 - DNA, 16 bp, M. musculus
tgcttacttatctgtg

SEQ ID NO: 443372 - DNA, 16 bp, M. musculus
tgcttagcatgcacga

SEQ ID NO: 443373 - DNA, 16 bp, M. musculus
tgcttagcatgcataa

SEQ ID NO: 443374 - DNA, 16 bp, M. musculus
tgcttagcatgtgtaa

SEQ ID NO: 443375 - DNA, 16 bp, M. musculus
tgcttatcctttgtgt

SEQ ID NO: 443376 - DNA, 16 bp, M. musculus
tgcttatgtatcaaaa

SEQ ID NO: 443377 - DNA, 16 bp, M. musculus
tgcttattaaacaaaa

SEQ ID NO: 443378 - DNA, 16 bp, M. musculus
tgcttatttataataa

SEQ ID NO: 443379 - DNA, 16 bp, M. musculus
tgcttcaaaaataaaa

SEQ ID NO: 443380 - DNA, 16 bp, M. musculus
tgcttcaagcttctct

SEQ ID NO: 443381 - DNA, 16 bp, M. musculus
tgcttcaagttcttgc

SEQ ID NO: 443382 - DNA, 16 bp, M. musculus
tgcttcacttcctgcc

SEQ ID NO: 443383 - DNA, 16 bp, M. musculus
tgcttcagaaacaaca

SEQ ID NO: 443384 - DNA, 16 bp, M. musculus
tgcttcagagaagcag

SEQ ID NO: 443385 - DNA, 16 bp, M. musculus
tgcttcagcctcccaa

SEQ ID NO: 443386 - DNA, 16 bp, M. musculus
tgcttcagcctcccat

SEQ ID NO: 443387 - DNA, 16 bp, M. musculus
tgcttcagttcttgcc

SEQ ID NO: 443388 - DNA, 16 bp, M. musculus
tgcttcagtttgtcca

SEQ ID NO: 443389 - DNA, 16 bp, M. musculus
tgcttcatggtcatga

SEQ ID NO: 443390 - DNA, 16 bp, M. musculus
tgcttcatttacacaa

SEQ ID NO: 443391 - DNA, 16 bp, M. musculus
tgcttcatttttgtcc

SEQ ID NO: 443392 - DNA, 16 bp, M. musculus
tgcttccaagaagaaa

SEQ ID NO: 443393 - DNA, 16 bp, M. musculus
tgcttccaccttccaa

SEQ ID NO: 443394 - DNA, 16 bp, M. musculus
tgcttccagccatgat

SEQ ID NO: 443395 - DNA, 16 bp, M. musculus
tgcttccagcctctca

SEQ ID NO: 443396 - DNA, 16 bp, M. musculus
tgcttccagcttctgt

SEQ ID NO: 443397 - DNA, 16 bp, M. musculus
tgcttccaggcctctc

SEQ ID NO: 443398 - DNA, 16 bp, M. musculus
tgcttccagtttctca

SEQ ID NO: 443399 - DNA, 16 bp, M. musculus
tgcttcccaacatgat

SEQ ID NO: 443400 - DNA, 16 bp, M. musculus
tgcttcccacaatgat

SEQ ID NO: 443401 - DNA, 16 bp, M. musculus
tgcttccccatgctaa

SEQ ID NO: 443402 - DNA, 16 bp, M. musculus
tgcttcccccacccca

SEQ ID NO: 443403 - DNA, 27 bp, M. musculus
tgcttcccctcatggtgttataactgt

SEQ ID NO: 443404 - DNA, 16 bp, M. musculus
tgcttccctggtgctg

SEQ ID NO: 443405 - DNA, 21 bp, M. musculus
tgcttcctatactgtggctca

SEQ ID NO: 443406 - DNA, 16 bp, M. musculus
tgcttcctcacctgct

SEQ ID NO: 443407 - DNA, 16 bp, M. musculus
tgcttcctcagaaaat

SEQ ID NO: 443408 - DNA, 16 bp, M. musculus
tgcttcctccaggaag

SEQ ID NO: 443409 - DNA, 16 bp, M. musculus
tgcttcctgagagctg

SEQ ID NO: 443410 - DNA, 16 bp, M. musculus
tgcttcctgctcttgc

SEQ ID NO: 443411 - DNA, 16 bp, M. musculus
tgcttcctgctgaaag

SEQ ID NO: 443412 - DNA, 16 bp, M. musculus
tgcttcctgctgaatt

SEQ ID NO: 443413 - DNA, 16 bp, M. musculus
tgcttcctgctgcttc

SEQ ID NO: 443414 - DNA, 16 bp, M. musculus
tgcttcctgcttgctt

SEQ ID NO: 443415 - DNA, 16 bp, M. musculus
tgcttcctggccacca

SEQ ID NO: 443416 - DNA, 16 bp, M. musculus
tgcttcctggccctga

SEQ ID NO: 443417 - DNA, 16 bp, M. musculus
tgcttcctgggcctgg

SEQ ID NO: 443418 - DNA, 16 bp, M. musculus
tgcttcctggtccagg

SEQ ID NO: 443419 - DNA, 16 bp, M. musculus
tgcttcctgtcatttt

SEQ ID NO: 443420 - DNA, 16 bp, M. musculus
tgcttcctgtctgtct

SEQ ID NO: 443421 - DNA, 16 bp, M. musculus
tgcttcctgtggcttg

SEQ ID NO: 443422 - DNA, 16 bp, M. musculus
tgcttccttatagaac

SEQ ID NO: 443423 - DNA, 16 bp, M. musculus
tgcttccttctacaaa

SEQ ID NO: 443424 - DNA, 16 bp, M. musculus
tgcttccttcttcctg

SEQ ID NO: 443425 - DNA, 16 bp, M. musculus
tgcttcctttcatttt

SEQ ID NO: 443426 - DNA, 16 bp, M. musculus
tgcttctacctctcaa

SEQ ID NO: 443427 - DNA, 16 bp, M. musculus
tgcttctatgagggtt

SEQ ID NO: 443428 - DNA, 16 bp, M. musculus
tgcttctcaagggaag

SEQ ID NO: 443429 - DNA, 16 bp, M. musculus
tgcttctcattcccct

SEQ ID NO: 443430 - DNA, 16 bp, M. musculus
tgcttctccagcacca

SEQ ID NO: 443431 - DNA, 16 bp, M. musculus
tgcttctctcagggaa

SEQ ID NO: 443432 - DNA, 16 bp, M. musculus
tgcttctcttcttcca

SEQ ID NO: 443433 - DNA, 16 bp, M. musculus
tgcttctgagtgctgg

SEQ ID NO: 443434 - DNA, 16 bp, M. musculus
tgcttctgcagaggac

SEQ ID NO: 443435 - DNA, 16 bp, M. musculus
tgcttctgcctctgcc

SEQ ID NO: 443436 - DNA, 16 bp, M. musculus
tgcttctgcctctgtc

SEQ ID NO: 443437 - DNA, 16 bp, M. musculus
tgcttctgcctgttcc

SEQ ID NO: 443438 - DNA, 16 bp, M. musculus
tgcttctgcctttcaa

SEQ ID NO: 443439 - DNA, 16 bp, M. musculus
tgcttctgctctgttt

SEQ ID NO: 443440 - DNA, 16 bp, M. musculus
tgcttctgcttcccaa

SEQ ID NO: 443441 - DNA, 16 bp, M. musculus
tgcttctgcttcctgg

SEQ ID NO: 443442 - DNA, 16 bp, M. musculus
tgcttctgcttcttcc

SEQ ID NO: 443443 - DNA, 16 bp, M. musculus
tgcttctgggtctcca

SEQ ID NO: 443444 - DNA, 16 bp, M. musculus
tgcttctgggttaggg

SEQ ID NO: 443445 - DNA, 16 bp, M. musculus
tgcttctggtgaactg

SEQ ID NO: 443446 - DNA, 16 bp, M. musculus
tgcttctgtctgttcc

SEQ ID NO: 443447 - DNA, 16 bp, M. musculus
tgcttctgtggacttg

SEQ ID NO: 443448 - DNA, 16 bp, M. musculus
tgcttctgtgtctgtg

SEQ ID NO: 443449 - DNA, 16 bp, M. musculus
tgcttctgtgtgtgtg

SEQ ID NO: 443450 - DNA, 16 bp, M. musculus
tgcttctgttgctgtg

SEQ ID NO: 443451 - DNA, 16 bp, M. musculus
tgcttctgtttcctga

SEQ ID NO: 443452 - DNA, 16 bp, M. musculus
tgcttctgtttgagaa

SEQ ID NO: 443453 - DNA, 16 bp, M. musculus
tgcttcttgatgaaga

SEQ ID NO: 443454 - DNA, 16 bp, M. musculus
tgcttcttgctgcttc

SEQ ID NO: 443455 - DNA, 17 bp, M. musculus
tgcttcttggtcatggt

SEQ ID NO: 443456 - DNA, 16 bp, M. musculus
tgcttctttatttata

SEQ ID NO: 443457 - DNA, 16 bp, M. musculus
tgcttctttgaggatg

SEQ ID NO: 443458 - DNA, 16 bp, M. musculus
tgcttcttttctgtca

SEQ ID NO: 443459 - DNA, 16 bp, M. musculus
tgcttgaatcacactt

SEQ ID NO: 443460 - DNA, 16 bp, M. musculus
tgcttgaccataggga

SEQ ID NO: 443461 - DNA, 16 bp, M. musculus
tgcttgacctcaagct

SEQ ID NO: 443462 - DNA, 16 bp, M. musculus
tgcttgagttcttgcc

SEQ ID NO: 443463 - DNA, 16 bp, M. musculus
tgcttgattagagtta

SEQ ID NO: 443464 - DNA, 16 bp, M. musculus
tgcttgcaaaactcat

SEQ ID NO: 443465 - DNA, 16 bp, M. musculus
tgcttgcaaggcaagt

SEQ ID NO: 443466 - DNA, 16 bp, M. musculus
tgcttgcaatcccagt

SEQ ID NO: 443467 - DNA, 16 bp, M. musculus
tgcttgcagacaggag

SEQ ID NO: 443468 - DNA, 16 bp, M. musculus
tgcttgcagagaggag

SEQ ID NO: 443469 - DNA, 16 bp, M. musculus
tgcttgcaggcaggag

SEQ ID NO: 443470 - DNA, 16 bp, M. musculus
tgcttgcatacaggag

SEQ ID NO: 443471 - DNA, 16 bp, M. musculus
tgcttgcatctgtgac

SEQ ID NO: 443472 - DNA, 16 bp, M. musculus
tgcttgcatgtgtgca

SEQ ID NO: 443473 - DNA, 16 bp, M. musculus
tgcttgccaggcaagc

SEQ ID NO: 443474 - DNA, 16 bp, M. musculus
tgcttgccatttccta

SEQ ID NO: 443475 - DNA, 16 bp, M. musculus
tgcttgcccagcaagc

SEQ ID NO: 443476 - DNA, 16 bp, M. musculus
tgcttgcctagcatgc

SEQ ID NO: 443477 - DNA, 16 bp, M. musculus
tgcttgcctagcatgt

SEQ ID NO: 443478 - DNA, 16 bp, M. musculus
tgcttgcctctccctc

SEQ ID NO: 443479 - DNA, 16 bp, M. musculus
tgcttgccttctgcca

SEQ ID NO: 443480 - DNA, 16 bp, M. musculus
tgcttgctcgctcgct

SEQ ID NO: 443481 - DNA, 16 bp, M. musculus
tgcttgctctctctct

SEQ ID NO: 443482 - DNA, 16 bp, M. musculus
tgcttgctctcttgct

SEQ ID NO: 443483 - DNA, 16 bp, M. musculus
tgcttgctgacaggaa

SEQ ID NO: 443484 - DNA, 16 bp, M. musculus
tgcttgctgccaagcc

SEQ ID NO: 443485 - DNA, 16 bp, M. musculus
tgcttgctgctcttcc

SEQ ID NO: 443486 - DNA, 16 bp, M. musculus
tgcttgctgcttcagt

SEQ ID NO: 443487 - DNA, 16 bp, M. musculus
tgcttgctgcttgctg

SEQ ID NO: 443488 - DNA, 16 bp, M. musculus
tgcttgctggcttgct

SEQ ID NO: 443489 - DNA, 16 bp, M. musculus
tgcttgcttagcatgc

SEQ ID NO: 443490 - DNA, 16 bp, M. musculus
tgcttgcttgctctca

SEQ ID NO: 443491 - DNA, 17 bp, M. musculus
tgcttgcttgcttgctt

SEQ ID NO: 443492 - DNA, 16 bp, M. musculus
tgcttgcttgcttggt

SEQ ID NO: 443493 - DNA, 16 bp, M. musculus
tgcttgcttgcttgtg

SEQ ID NO: 443494 - DNA, 16 bp, M. musculus
tgcttgcttgctttta

SEQ ID NO: 443495 - DNA, 16 bp, M. musculus
tgcttggagaactgtc

SEQ ID NO: 443496 - DNA, 16 bp, M. musculus
tgcttggagacaggag

SEQ ID NO: 443497 - DNA, 16 bp, M. musculus
tgcttggattacaggc

SEQ ID NO: 443498 - DNA, 16 bp, M. musculus
tgcttggattacaggt

SEQ ID NO: 443499 - DNA, 16 bp, M. musculus
tgcttggcaggcagag

SEQ ID NO: 443500 - DNA, 16 bp, M. musculus
tgcttggccagggagt

SEQ ID NO: 443501 - DNA, 16 bp, M. musculus
tgcttggcccacaggg

SEQ ID NO: 443502 - DNA, 16 bp, M. musculus
tgcttggcctctaact

SEQ ID NO: 443503 - DNA, 16 bp, M. musculus
tgcttggcttttctct

SEQ ID NO: 443504 - DNA, 16 bp, M. musculus
tgcttgggagacagag

SEQ ID NO: 443505 - DNA, 18 bp, M. musculus
tgcttgggggaaacccag

SEQ ID NO: 443506 - DNA, 16 bp, M. musculus
tgcttggtctacagag

SEQ ID NO: 443507 - DNA, 16 bp, M. musculus
tgcttggtgcctgtgg

SEQ ID NO: 443508 - DNA, 16 bp, M. musculus
tgcttgtagaagaatg

SEQ ID NO: 443509 - DNA, 16 bp, M. musculus
tgcttgtagacaggag

SEQ ID NO: 443510 - DNA, 16 bp, M. musculus
tgcttgtctagcatgc

SEQ ID NO: 443511 - DNA, 16 bp, M. musculus
tgcttgtgtatctgtg

SEQ ID NO: 443512 - DNA, 16 bp, M. musculus
tgcttgtgtcaagttg

SEQ ID NO: 443513 - DNA, 16 bp, M. musculus
tgcttgtgtgtatatg

SEQ ID NO: 443514 - DNA, 16 bp, M. musculus
tgcttgtgtgtgctct

SEQ ID NO: 443515 - DNA, 16 bp, M. musculus
tgcttgtgtgtgtata

SEQ ID NO: 443516 - DNA, 16 bp, M. musculus
tgcttgtttgtttatc

SEQ ID NO: 443517 - DNA, 16 bp, M. musculus
tgctttaaaaaataaa

SEQ ID NO: 443518 - DNA, 16 bp, M. musculus
tgctttaaaaacattt

SEQ ID NO: 443519 - DNA, 16 bp, M. musculus
tgctttaaaataaaaa

SEQ ID NO: 443520 - DNA, 16 bp, M. musculus
tgctttaaagaaaatt

SEQ ID NO: 443521 - DNA, 16 bp, M. musculus
tgctttaaattttaat

SEQ ID NO: 443522 - DNA, 16 bp, M. musculus
tgctttaagtggggct

SEQ ID NO: 443523 - DNA, 16 bp, M. musculus
tgctttaagtttttct

SEQ ID NO: 443524 - DNA, 16 bp, M. musculus
tgctttaccactgagc

SEQ ID NO: 443525 - DNA, 16 bp, M. musculus
tgctttacccactgag

SEQ ID NO: 443526 - DNA, 16 bp, M. musculus
tgctttcaagagtgtg

SEQ ID NO: 443527 - DNA, 16 bp, M. musculus
tgctttcagcaaatga

SEQ ID NO: 443528 - DNA, 16 bp, M. musculus
tgctttcagcattcct

SEQ ID NO: 443529 - DNA, 16 bp, M. musculus
tgctttcattgttttc

SEQ ID NO: 443530 - DNA, 16 bp, M. musculus
tgctttcatttctctt

SEQ ID NO: 443531 - DNA, 16 bp, M. musculus
tgctttcattttttaa

SEQ ID NO: 443532 - DNA, 16 bp, M. musculus
tgctttcccaaagttg

SEQ ID NO: 443533 - DNA, 18 bp, M. musculus
tgctttcccaaggttgta

SEQ ID NO: 443534 - DNA, 16 bp, M. musculus
tgctttcctgctttcc

SEQ ID NO: 443535 - DNA, 16 bp, M. musculus
tgctttcctgtatttc

SEQ ID NO: 443536 - DNA, 16 bp, M. musculus
tgctttctaacctgct

SEQ ID NO: 443537 - DNA, 16 bp, M. musculus
tgctttctatttctgt

SEQ ID NO: 443538 - DNA, 16 bp, M. musculus
tgctttctcagcttct

SEQ ID NO: 443539 - DNA, 16 bp, M. musculus
tgctttctcttcatct

SEQ ID NO: 443540 - DNA, 16 bp, M. musculus
tgctttctgacctcct

SEQ ID NO: 443541 - DNA, 16 bp, M. musculus
tgctttctgagacagg

SEQ ID NO: 443542 - DNA, 16 bp, M. musculus
tgctttctgccatgac

SEQ ID NO: 443543 - DNA, 16 bp, M. musculus
tgctttctgccatgat

SEQ ID NO: 443544 - DNA, 16 bp, M. musculus
tgctttctgcttcagt

SEQ ID NO: 443545 - DNA, 16 bp, M. musculus
tgctttctgcttcctg

SEQ ID NO: 443546 - DNA, 16 bp, M. musculus
tgctttcttaaagaat

SEQ ID NO: 443547 - DNA, 16 bp, M. musculus
tgctttcttaactccc

SEQ ID NO: 443548 - DNA, 16 bp, M. musculus
tgctttcttacagaac

SEQ ID NO: 443549 - DNA, 16 bp, M. musculus
tgctttcttatatcat

SEQ ID NO: 443550 - DNA, 16 bp, M. musculus
tgctttcttctagaac

SEQ ID NO: 443551 - DNA, 16 bp, M. musculus
tgctttcttctccatc

SEQ ID NO: 443552 - DNA, 16 bp, M. musculus
tgctttcttctgcctc

SEQ ID NO: 443553 - DNA, 16 bp, M. musculus
tgctttcttctggtct

SEQ ID NO: 443554 - DNA, 16 bp, M. musculus
tgctttcttttacaaa

SEQ ID NO: 443555 - DNA, 16 bp, M. musculus
tgctttcttttcattg

SEQ ID NO: 443556 - DNA, 16 bp, M. musculus
tgctttgaaaaacaaa

SEQ ID NO: 443557 - DNA, 16 bp, M. musculus
tgctttgaaagtttgg

SEQ ID NO: 443558 - DNA, 16 bp, M. musculus
tgctttgaacatagtt

SEQ ID NO: 443559 - DNA, 16 bp, M. musculus
tgctttgacatcagcc

SEQ ID NO: 443560 - DNA, 16 bp, M. musculus
tgctttgacttcttcc

SEQ ID NO: 443561 - DNA, 16 bp, M. musculus
tgctttgagctttaca

SEQ ID NO: 443562 - DNA, 16 bp, M. musculus
tgctttgagctttact

SEQ ID NO: 443563 - DNA, 16 bp, M. musculus
tgctttgagttcctgt

SEQ ID NO: 443564 - DNA, 16 bp, M. musculus
tgctttgagttttagt

SEQ ID NO: 443565 - DNA, 16 bp, M. musculus
tgctttgatgaaacac

SEQ ID NO: 443566 - DNA, 16 bp, M. musculus
tgctttgattgtgtcc

SEQ ID NO: 443567 - DNA, 16 bp, M. musculus
tgctttgcagaaactt

SEQ ID NO: 443568 - DNA, 16 bp, M. musculus
tgctttgcctgcatgt

SEQ ID NO: 443569 - DNA, 17 bp, M. musculus
tgctttgctgaccaaat

SEQ ID NO: 443570 - DNA, 16 bp, M. musculus
tgctttgctgagaaca

SEQ ID NO: 443571 - DNA, 16 bp, M. musculus
tgctttgcttggcatg

SEQ ID NO: 443572 - DNA, 16 bp, M. musculus
tgctttggaaaaaaaa

SEQ ID NO: 443573 - DNA, 16 bp, M. musculus
tgctttggagcatggt

SEQ ID NO: 443574 - DNA, 16 bp, M. musculus
tgctttgggtaagatg

SEQ ID NO: 443575 - DNA, 16 bp, M. musculus
tgctttggtcttggtg

SEQ ID NO: 443576 - DNA, 16 bp, M. musculus
tgctttgtagaccatg

SEQ ID NO: 443577 - DNA, 16 bp, M. musculus
tgctttgtgcttgtgg

SEQ ID NO: 443578 - DNA, 16 bp, M. musculus
tgcttttaaaaataat

SEQ ID NO: 443579 - DNA, 16 bp, M. musculus
tgcttttaaatatttt

SEQ ID NO: 443580 - DNA, 16 bp, M. musculus
tgcttttaaattcggg

SEQ ID NO: 443581 - DNA, 16 bp, M. musculus
tgcttttaaccattga

SEQ ID NO: 443582 - DNA, 16 bp, M. musculus
tgcttttaactgctga

SEQ ID NO: 443583 - DNA, 16 bp, M. musculus
tgcttttaatcccagc

SEQ ID NO: 443584 - DNA, 16 bp, M. musculus
tgcttttacagaagac

SEQ ID NO: 443585 - DNA, 16 bp, M. musculus
tgcttttacattttaa

SEQ ID NO: 443586 - DNA, 16 bp, M. musculus
tgcttttacctgctga

SEQ ID NO: 443587 - DNA, 16 bp, M. musculus
tgcttttagtcagtgt

SEQ ID NO: 443588 - DNA, 16 bp, M. musculus
tgcttttatttggaag

SEQ ID NO: 443589 - DNA, 16 bp, M. musculus
tgcttttcagcccttt

SEQ ID NO: 443590 - DNA, 16 bp, M. musculus
tgcttttccagaggac

SEQ ID NO: 443591 - DNA, 16 bp, M. musculus
tgcttttccagaggtt

SEQ ID NO: 443592 - DNA, 16 bp, M. musculus
tgcttttccctgatga

SEQ ID NO: 443593 - DNA, 16 bp, M. musculus
tgcttttcctgtgccc

SEQ ID NO: 443594 - DNA, 16 bp, M. musculus
tgcttttcctgtgtgt

SEQ ID NO: 443595 - DNA, 16 bp, M. musculus
tgcttttctttatatg

SEQ ID NO: 443596 - DNA, 16 bp, M. musculus
tgcttttctttctaag

SEQ ID NO: 443597 - DNA, 16 bp, M. musculus
tgcttttctttctcca

SEQ ID NO: 443598 - DNA, 16 bp, M. musculus
tgcttttctttttaaa

SEQ ID NO: 443599 - DNA, 16 bp, M. musculus
tgcttttgaagaggac

SEQ ID NO: 443600 - DNA, 16 bp, M. musculus
tgcttttgagggggaa

SEQ ID NO: 443601 - DNA, 16 bp, M. musculus
tgcttttgcaaaggac

SEQ ID NO: 443602 - DNA, 16 bp, M. musculus
tgcttttgcaggggac

SEQ ID NO: 443603 - DNA, 16 bp, M. musculus
tgcttttgctctggat

SEQ ID NO: 443604 - DNA, 16 bp, M. musculus
tgcttttggagaataa

SEQ ID NO: 443605 - DNA, 16 bp, M. musculus
tgcttttgggatcctt

SEQ ID NO: 443606 - DNA, 16 bp, M. musculus
tgcttttggtcagggt

SEQ ID NO: 443607 - DNA, 16 bp, M. musculus
tgcttttggtcatagt

SEQ ID NO: 443608 - DNA, 16 bp, M. musculus
tgcttttggtcatggt

SEQ ID NO: 443609 - DNA, 16 bp, M. musculus
tgcttttggtcattgt

SEQ ID NO: 443610 - DNA, 16 bp, M. musculus
tgcttttggttagagt

SEQ ID NO: 443611 - DNA, 17 bp, M. musculus
tgcttttgttaccctct

SEQ ID NO: 443612 - DNA, 16 bp, M. musculus
tgcttttgtttgaaag

SEQ ID NO: 443613 - DNA, 16 bp, M. musculus
tgctttttaaaaaaat

SEQ ID NO: 443614 - DNA, 16 bp, M. musculus
tgctttttaaaaattg

SEQ ID NO: 443615 - DNA, 16 bp, M. musculus
tgctttttaaaattga

SEQ ID NO: 443616 - DNA, 16 bp, M. musculus
tgctttttaaagaaac

SEQ ID NO: 443617 - DNA, 16 bp, M. musculus
tgctttttaaataaaa

SEQ ID NO: 443618 - DNA, 16 bp, M. musculus
tgctttttattctatg

SEQ ID NO: 443619 - DNA, 16 bp, M. musculus
tgctttttatttaaaa

SEQ ID NO: 443620 - DNA, 16 bp, M. musculus
tgctttttattttaaa

SEQ ID NO: 443621 - DNA, 16 bp, M. musculus
tgctttttctaggtca

SEQ ID NO: 443622 - DNA, 16 bp, M. musculus
tgctttttgagacagg

SEQ ID NO: 443623 - DNA, 16 bp, M. musculus
tgctttttttaaaaaa

SEQ ID NO: 443624 - DNA, 16 bp, M. musculus
tggaaaaaaaaaactg

SEQ ID NO: 443625 - DNA, 16 bp, M. musculus
tggaaaaaaaaaatct

SEQ ID NO: 443626 - DNA, 16 bp, M. musculus
tggaaaaaaaaacatt

SEQ ID NO: 443627 - DNA, 16 bp, M. musculus
tggaaaaaaaaagtca

SEQ ID NO: 443628 - DNA, 16 bp, M. musculus
tggaaaaaaaaatcct

SEQ ID NO: 443629 - DNA, 16 bp, M. musculus
tggaaaaaaaatcatt

SEQ ID NO: 443630 - DNA, 16 bp, M. musculus
tggaaaaaaatcttca

SEQ ID NO: 443631 - DNA, 16 bp, M. musculus
tggaaaaaaatgtatt

SEQ ID NO: 443632 - DNA, 16 bp, M. musculus
tggaaaaaaatttcca

SEQ ID NO: 443633 - DNA, 16 bp, M. musculus
tggaaaaaagacaaca

SEQ ID NO: 443634 - DNA, 16 bp, M. musculus
tggaaaaaataaagca

SEQ ID NO: 443635 - DNA, 16 bp, M. musculus
tggaaaaacaaaagca

SEQ ID NO: 443636 - DNA, 16 bp, M. musculus
tggaaaaaccaaaata

SEQ ID NO: 443637 - DNA, 16 bp, M. musculus
tggaaaaaccaaacca

SEQ ID NO: 443638 - DNA, 16 bp, M. musculus
tggaaaaagaggagca

SEQ ID NO: 443639 - DNA, 16 bp, M. musculus
tggaaaaaggacagca

SEQ ID NO: 443640 - DNA, 16 bp, M. musculus
tggaaaaataaagttg

SEQ ID NO: 443641 - DNA, 16 bp, M. musculus
tggaaaaatattttcc

SEQ ID NO: 443642 - DNA, 16 bp, M. musculus
tggaaaaatattttct

SEQ ID NO: 443643 - DNA, 16 bp, M. musculus
tggaaaacaattttac

SEQ ID NO: 443644 - DNA, 16 bp, M. musculus
tggaaaacaggggatc

SEQ ID NO: 443645 - DNA, 16 bp, M. musculus
tggaaaacatggatga

SEQ ID NO: 443646 - DNA, 16 bp, M. musculus
tggaaaactaaaatat

SEQ ID NO: 443647 - DNA, 16 bp, M. musculus
tggaaaactggagacc

SEQ ID NO: 443648 - DNA, 24 bp, M. musculus
tggaaaacttacccatgctgcatc

SEQ ID NO: 443649 - DNA, 16 bp, M. musculus
tggaaaagaaaaagtc

SEQ ID NO: 443650 - DNA, 16 bp, M. musculus
tggaaaagaagctgag

SEQ ID NO: 443651 - DNA, 16 bp, M. musculus
tggaaaagaattttcc

SEQ ID NO: 443652 - DNA, 16 bp, M. musculus
tggaaaagagaaagca

SEQ ID NO: 443653 - DNA, 16 bp, M. musculus
tggaaaagagactgag

SEQ ID NO: 443654 - DNA, 16 bp, M. musculus
tggaaaagaggaagct

SEQ ID NO: 443655 - DNA, 16 bp, M. musculus
tggaaaagcaaaacaa

SEQ ID NO: 443656 - DNA, 16 bp, M. musculus
tggaaaagcaaacaaa

SEQ ID NO: 443657 - DNA, 16 bp, M. musculus
tggaaaagcaaaggaa

SEQ ID NO: 443658 - DNA, 16 bp, M. musculus
tggaaaagcaagattt

SEQ ID NO: 443659 - DNA, 16 bp, M. musculus
tggaaaaggagccagt

SEQ ID NO: 443660 - DNA, 16 bp, M. musculus
tggaaaaggcaggcag

SEQ ID NO: 443661 - DNA, 16 bp, M. musculus
tggaaaaggccttaca

SEQ ID NO: 443662 - DNA, 16 bp, M. musculus
tggaaaaggtcttttg

SEQ ID NO: 443663 - DNA, 16 bp, M. musculus
tggaaaagtaaatgaa

SEQ ID NO: 443664 - DNA, 16 bp, M. musculus
tggaaaagtgtgtgtg

SEQ ID NO: 443665 - DNA, 16 bp, M. musculus
tggaaaataatttcta

SEQ ID NO: 443666 - DNA, 16 bp, M. musculus
tggaaaatactgaaaa

SEQ ID NO: 443667 - DNA, 16 bp, M. musculus
tggaaaatctaggaaa

SEQ ID NO: 443668 - DNA, 16 bp, M. musculus
tggaaaatctggatga

SEQ ID NO: 443669 - DNA, 16 bp, M. musculus
tggaaaatgaaaaaca

SEQ ID NO: 443670 - DNA, 16 bp, M. musculus
tggaaaatgcaaaaaa

SEQ ID NO: 443671 - DNA, 16 bp, M. musculus
tggaaaattatttttc

SEQ ID NO: 443672 - DNA, 16 bp, M. musculus
tggaaaattccagaaa

SEQ ID NO: 443673 - DNA, 16 bp, M. musculus
tggaaaattcttttcc

SEQ ID NO: 443674 - DNA, 16 bp, M. musculus
tggaaacaacccagat

SEQ ID NO: 443675 - DNA, 16 bp, M. musculus
tggaaacaacctagat

SEQ ID NO: 443676 - DNA, 16 bp, M. musculus
tggaaacaagccagat

SEQ ID NO: 443677 - DNA, 16 bp, M. musculus
tggaaacagaaacaat

SEQ ID NO: 443678 - DNA, 16 bp, M. musculus
tggaaacagaaagaaa

SEQ ID NO: 443679 - DNA, 16 bp, M. musculus
tggaaacagaactaaa

SEQ ID NO: 443680 - DNA, 16 bp, M. musculus
tggaaacagatgaaga

SEQ ID NO: 443681 - DNA, 16 bp, M. musculus
tggaaacagggtttct

SEQ ID NO: 443682 - DNA, 16 bp, M. musculus
tggaaacagtcaacct

SEQ ID NO: 443683 - DNA, 16 bp, M. musculus
tggaaacagtttcatg

SEQ ID NO: 443684 - DNA, 16 bp, M. musculus
tggaaacataagccaa

SEQ ID NO: 443685 - DNA, 16 bp, M. musculus
tggaaacatcctcaca

SEQ ID NO: 443686 - DNA, 16 bp, M. musculus
tggaaacatcttcaca

SEQ ID NO: 443687 - DNA, 16 bp, M. musculus
tggaaacattttctca

SEQ ID NO: 443688 - DNA, 16 bp, M. musculus
tggaaaccaaaccctg

SEQ ID NO: 443689 - DNA, 16 bp, M. musculus
tggaaaccaaacctag

SEQ ID NO: 443690 - DNA, 16 bp, M. musculus
tggaaaccctaacaaa

SEQ ID NO: 443691 - DNA, 16 bp, M. musculus
tggaaacctggaagag

SEQ ID NO: 443692 - DNA, 16 bp, M. musculus
tggaaactaaactcag

SEQ ID NO: 443693 - DNA, 16 bp, M. musculus
tggaaactcagggttg

SEQ ID NO: 443694 - DNA, 16 bp, M. musculus
tggaaactgaacaact

SEQ ID NO: 443695 - DNA, 16 bp, M. musculus
tggaaactgaactcag

SEQ ID NO: 443696 - DNA, 16 bp, M. musculus
tggaaactggtctcct

SEQ ID NO: 443697 - DNA, 16 bp, M. musculus
tggaaacttgagggtt

SEQ ID NO: 443698 - DNA, 16 bp, M. musculus
tggaaacttgatgccc

SEQ ID NO: 443699 - DNA, 16 bp, M. musculus
tggaaactttaggagg

SEQ ID NO: 443700 - DNA, 16 bp, M. musculus
tggaaacttttttttt

SEQ ID NO: 443701 - DNA, 16 bp, M. musculus
tggaaagaaaaagaac

SEQ ID NO: 443702 - DNA, 30 bp, M. musculus
tggaaagaacccagatgcccctcaacagat

SEQ ID NO: 443703 - DNA, 16 bp, M. musculus
tggaaagaagaaagca

SEQ ID NO: 443704 - DNA, 16 bp, M. musculus
tggaaagaagaagaac

SEQ ID NO: 443705 - DNA, 16 bp, M. musculus
tggaaagaagtcaaaa

SEQ ID NO: 443706 - DNA, 16 bp, M. musculus
tggaaagaatcccagc

SEQ ID NO: 443707 - DNA, 16 bp, M. musculus
tggaaagaatgatgaa

SEQ ID NO: 443708 - DNA, 16 bp, M. musculus
tggaaagagaactgac

SEQ ID NO: 443709 - DNA, 16 bp, M. musculus
tggaaagagacaggag

SEQ ID NO: 443710 - DNA, 16 bp, M. musculus
tggaaagagagagcca

SEQ ID NO: 443711 - DNA, 16 bp, M. musculus
tggaaagagaggctca

SEQ ID NO: 443712 - DNA, 16 bp, M. musculus
tggaaagagcccagat

SEQ ID NO: 443713 - DNA, 16 bp, M. musculus
tggaaagagtataagt

SEQ ID NO: 443714 - DNA, 16 bp, M. musculus
tggaaagataaggaat

SEQ ID NO: 443715 - DNA, 17 bp, M. musculus
tggaaagataaggaatt

SEQ ID NO: 443716 - DNA, 16 bp, M. musculus
tggaaagatactgtgt

SEQ ID NO: 443717 - DNA, 16 bp, M. musculus
tggaaagatcaagaag

SEQ ID NO: 443718 - DNA, 16 bp, M. musculus
tggaaagatggctcag

SEQ ID NO: 443719 - DNA, 16 bp, M. musculus
tggaaagattgtaaga

SEQ ID NO: 443720 - DNA, 16 bp, M. musculus
tggaaagatttctcat

SEQ ID NO: 443721 - DNA, 16 bp, M. musculus
tggaaagcaaaacaaa

SEQ ID NO: 443722 - DNA, 16 bp, M. musculus
tggaaagcacccagat

SEQ ID NO: 443723 - DNA, 16 bp, M. musculus
tggaaagctgaggcaa

SEQ ID NO: 443724 - DNA, 16 bp, M. musculus
tggaaagctgctgtgg

SEQ ID NO: 443725 - DNA, 16 bp, M. musculus
tggaaaggaagaaatc

SEQ ID NO: 443726 - DNA, 16 bp, M. musculus
tggaaaggaagaagtg

SEQ ID NO: 443727 - DNA, 16 bp, M. musculus
tggaaaggacccagat

SEQ ID NO: 443728 - DNA, 17 bp, M. musculus
tggaaaggaggaagtca

SEQ ID NO: 443729 - DNA, 16 bp, M. musculus
tggaaaggtggctcag

SEQ ID NO: 443730 - DNA, 16 bp, M. musculus
tggaaaggtttttttt

SEQ ID NO: 443731 - DNA, 16 bp, M. musculus
tggaaagtacaatgct

SEQ ID NO: 443732 - DNA, 17 bp, M. musculus
tggaaagtacccagatg

SEQ ID NO: 443733 - DNA, 16 bp, M. musculus
tggaaagtggaggcag

SEQ ID NO: 443734 - DNA, 16 bp, M. musculus
tggaaagttctggaaa

SEQ ID NO: 443735 - DNA, 16 bp, M. musculus
tggaaataaaattaac

SEQ ID NO: 443736 - DNA, 16 bp, M. musculus
tggaaataactcagat

SEQ ID NO: 443737 - DNA, 17 bp, M. musculus
tggaaatagaaactaaa

SEQ ID NO: 443738 - DNA, 16 bp, M. musculus
tggaaatataagccaa

SEQ ID NO: 443739 - DNA, 16 bp, M. musculus
tggaaatatgcaacct

SEQ ID NO: 443740 - DNA, 16 bp, M. musculus
tggaaatatttctacc

SEQ ID NO: 443741 - DNA, 16 bp, M. musculus
tggaaatatttgtaat

SEQ ID NO: 443742 - DNA, 16 bp, M. musculus
tggaaatcaaaggaca

SEQ ID NO: 443743 - DNA, 16 bp, M. musculus
tggaaatcaatctgac

SEQ ID NO: 443744 - DNA, 16 bp, M. musculus
tggaaatcaccaccca

SEQ ID NO: 443745 - DNA, 16 bp, M. musculus
tggaaatcagtctgga

SEQ ID NO: 443746 - DNA, 16 bp, M. musculus
tggaaatctatttggt

SEQ ID NO: 443747 - DNA, 16 bp, M. musculus
tggaaatcttcattct

SEQ ID NO: 443748 - DNA, 16 bp, M. musculus
tggaaatctttttttt

SEQ ID NO: 443749 - DNA, 16 bp, M. musculus
tggaaatgaaaatgaa

SEQ ID NO: 443750 - DNA, 16 bp, M. musculus
tggaaatgaataaaat

SEQ ID NO: 443751 - DNA, 16 bp, M. musculus
tggaaatgaggaaaat

SEQ ID NO: 443752 - DNA, 16 bp, M. musculus
tggaaatgctttcatt

SEQ ID NO: 443753 - DNA, 16 bp, M. musculus
tggaaatggaacccag

SEQ ID NO: 443754 - DNA, 16 bp, M. musculus
tggaaatggagaagaa

SEQ ID NO: 443755 - DNA, 16 bp, M. musculus
tggaaatggagaagat

SEQ ID NO: 443756 - DNA, 16 bp, M. musculus
tggaaatggagaggaa

SEQ ID NO: 443757 - DNA, 16 bp, M. musculus
tggaaatggagttata

SEQ ID NO: 443758 - DNA, 16 bp, M. musculus
tggaaatgtaattgtg

SEQ ID NO: 443759 - DNA, 16 bp, M. musculus
tggaaattagcccaga

SEQ ID NO: 443760 - DNA, 16 bp, M. musculus
tggaaattttccttct

SEQ ID NO: 443761 - DNA, 16 bp, M. musculus
tggaaattttctttat

SEQ ID NO: 443762 - DNA, 17 bp, M. musculus
tggaacaaaacacccat

SEQ ID NO: 443763 - DNA, 16 bp, M. musculus
tggaacaacaacaaca

SEQ ID NO: 443764 - DNA, 16 bp, M. musculus
tggaacaacaagaaag

SEQ ID NO: 443765 - DNA, 16 bp, M. musculus
tggaacaacaatgtga

SEQ ID NO: 443766 - DNA, 16 bp, M. musculus
tggaacaacattatga

SEQ ID NO: 443767 - DNA, 16 bp, M. musculus
tggaacaagaaaatat

SEQ ID NO: 443768 - DNA, 17 bp, M. musculus
tggaacaataaattcct

SEQ ID NO: 443769 - DNA, 16 bp, M. musculus
tggaacacagcatctg

SEQ ID NO: 443770 - DNA, 16 bp, M. musculus
tggaacacagcttttt

SEQ ID NO: 443771 - DNA, 16 bp, M. musculus
tggaacacagggcttc

SEQ ID NO: 443772 - DNA, 16 bp, M. musculus
tggaacacagggtctc

SEQ ID NO: 443773 - DNA, 16 bp, M. musculus
tggaacacagtgcccc

SEQ ID NO: 443774 - DNA, 16 bp, M. musculus
tggaacacatgctcct

SEQ ID NO: 443775 - DNA, 16 bp, M. musculus
tggaacactgggcccc

SEQ ID NO: 443776 - DNA, 18 bp, M. musculus
tggaacagaagttgtgtt

SEQ ID NO: 443777 - DNA, 16 bp, M. musculus
tggaacagagaatgaa

SEQ ID NO: 443778 - DNA, 16 bp, M. musculus
tggaacagcaatggct

SEQ ID NO: 443779 - DNA, 16 bp, M. musculus
tggaacaggctggcct

SEQ ID NO: 443780 - DNA, 16 bp, M. musculus
tggaacagggtcactg

SEQ ID NO: 443781 - DNA, 16 bp, M. musculus
tggaacagggtctcac

SEQ ID NO: 443782 - DNA, 16 bp, M. musculus
tggaacaggtgcccct

SEQ ID NO: 443783 - DNA, 16 bp, M. musculus
tggaacatgcctttaa

SEQ ID NO: 443784 - DNA, 16 bp, M. musculus
tggaacatggccctct

SEQ ID NO: 443785 - DNA, 16 bp, M. musculus
tggaacatggtatttg

SEQ ID NO: 443786 - DNA, 16 bp, M. musculus
tggaaccaaggtggct

SEQ ID NO: 443787 - DNA, 16 bp, M. musculus
tggaaccagaaaatat

SEQ ID NO: 443788 - DNA, 16 bp, M. musculus
tggaaccatctctcca

SEQ ID NO: 443789 - DNA, 16 bp, M. musculus
tggaacccagagcttc

SEQ ID NO: 443790 - DNA, 16 bp, M. musculus
tggaacccaggacttc

SEQ ID NO: 443791 - DNA, 16 bp, M. musculus
tggaacccagggcctt

SEQ ID NO: 443792 - DNA, 16 bp, M. musculus
tggaaccctggctcct

SEQ ID NO: 443793 - DNA, 16 bp, M. musculus
tggaacctctggaaga

SEQ ID NO: 443794 - DNA, 16 bp, M. musculus
tggaacctgctgcttt

SEQ ID NO: 443795 - DNA, 16 bp, M. musculus
tggaacctgtccttcc

SEQ ID NO: 443796 - DNA, 16 bp, M. musculus
tggaacctttaagagg

SEQ ID NO: 443797 - DNA, 16 bp, M. musculus
tggaactaagatgaaa

SEQ ID NO: 443798 - DNA, 16 bp, M. musculus
tggaactaagatgtct

SEQ ID NO: 443799 - DNA, 16 bp, M. musculus
tggaactaatttctta

SEQ ID NO: 443800 - DNA, 16 bp, M. musculus
tggaactagaaaagat

SEQ ID NO: 443801 - DNA, 16 bp, M. musculus
tggaactagaaagtat

SEQ ID NO: 443802 - DNA, 16 bp, M. musculus
tggaactagaagaaaa

SEQ ID NO: 443803 - DNA, 16 bp, M. musculus
tggaactagaattaca

SEQ ID NO: 443804 - DNA, 16 bp, M. musculus
tggaactagagagatg

SEQ ID NO: 443805 - DNA, 16 bp, M. musculus
tggaactagagttata

SEQ ID NO: 443806 - DNA, 16 bp, M. musculus
tggaactagagttcca

SEQ ID NO: 443807 - DNA, 16 bp, M. musculus
tggaactcaagcagtt

SEQ ID NO: 443808 - DNA, 16 bp, M. musculus
tggaactcaatatata

SEQ ID NO: 443809 - DNA, 16 bp, M. musculus
tggaactcacagacat

SEQ ID NO: 443810 - DNA, 16 bp, M. musculus
tggaactcactgtata

SEQ ID NO: 443811 - DNA, 16 bp, M. musculus
tggaactcactttgtt

SEQ ID NO: 443812 - DNA, 16 bp, M. musculus
tggaactcagaggaca

SEQ ID NO: 443813 - DNA, 16 bp, M. musculus
tggaactcagggcctt

SEQ ID NO: 443814 - DNA, 16 bp, M. musculus
tggaactcagtatgta

SEQ ID NO: 443815 - DNA, 16 bp, M. musculus
tggaactcatggctct

SEQ ID NO: 443816 - DNA, 16 bp, M. musculus
tggaactcattatgca

SEQ ID NO: 443817 - DNA, 16 bp, M. musculus
tggaactgaaattata

SEQ ID NO: 443818 - DNA, 16 bp, M. musculus
tggaactgaggttaca

SEQ ID NO: 443819 - DNA, 16 bp, M. musculus
tggaactggaatgaca

SEQ ID NO: 443820 - DNA, 16 bp, M. musculus
tggaactggagctata

SEQ ID NO: 443821 - DNA, 16 bp, M. musculus
tggaactggagggcat

SEQ ID NO: 443822 - DNA, 16 bp, M. musculus
tggaactggagtcatg

SEQ ID NO: 443823 - DNA, 16 bp, M. musculus
tggaactggagttaga

SEQ ID NO: 443824 - DNA, 16 bp, M. musculus
tggaactggcttacag

SEQ ID NO: 443825 - DNA, 16 bp, M. musculus
tggaactgtttggcct

SEQ ID NO: 443826 - DNA, 16 bp, M. musculus
tggaacttactatata

SEQ ID NO: 443827 - DNA, 16 bp, M. musculus
tggaacttactatgta

SEQ ID NO: 443828 - DNA, 16 bp, M. musculus
tggaacttcctatgta

SEQ ID NO: 443829 - DNA, 16 bp, M. musculus
tggaacttcttttggg

SEQ ID NO: 443830 - DNA, 16 bp, M. musculus
tggaagaaaacaaaga

SEQ ID NO: 443831 - DNA, 16 bp, M. musculus
tggaagaaaagccagt

SEQ ID NO: 443832 - DNA, 16 bp, M. musculus
tggaagaaaatgaata

SEQ ID NO: 443833 - DNA, 16 bp, M. musculus
tggaagaaagaagatt

SEQ ID NO: 443834 - DNA, 16 bp, M. musculus
tggaagaaagacagca

SEQ ID NO: 443835 - DNA, 16 bp, M. musculus
tggaagaaagagagca

SEQ ID NO: 443836 - DNA, 16 bp, M. musculus
tggaagaaatgaacaa

SEQ ID NO: 443837 - DNA, 16 bp, M. musculus
tggaagaaatgacatg

SEQ ID NO: 443838 - DNA, 16 bp, M. musculus
tggaagaaatggacaa

SEQ ID NO: 443839 - DNA, 16 bp, M. musculus
tggaagaacaggaagt

SEQ ID NO: 443840 - DNA, 16 bp, M. musculus
tggaagaactgggttc

SEQ ID NO: 443841 - DNA, 16 bp, M. musculus
tggaagaagagaacca

SEQ ID NO: 443842 - DNA, 16 bp, M. musculus
tggaagaagagaattg

SEQ ID NO: 443843 - DNA, 16 bp, M. musculus
tggaagaagagacaga

SEQ ID NO: 443844 - DNA, 16 bp, M. musculus
tggaagaagctgagga

SEQ ID NO: 443845 - DNA, 16 bp, M. musculus
tggaagaagctgtgga

SEQ ID NO: 443846 - DNA, 16 bp, M. musculus
tggaagaaggaaatgg

SEQ ID NO: 443847 - DNA, 16 bp, M. musculus
tggaagaagtcaggac

SEQ ID NO: 443848 - DNA, 16 bp, M. musculus
tggaagaagttgagga

SEQ ID NO: 443849 - DNA, 16 bp, M. musculus
tggaagaatctcaggt

SEQ ID NO: 443850 - DNA, 16 bp, M. musculus
tggaagaatttctttt

SEQ ID NO: 443851 - DNA, 16 bp, M. musculus
tggaagacagaagaaa

SEQ ID NO: 443852 - DNA, 16 bp, M. musculus
tggaagacagaagaca

SEQ ID NO: 443853 - DNA, 16 bp, M. musculus
tggaagaccagctctc

SEQ ID NO: 443854 - DNA, 16 bp, M. musculus
tggaagactagctctc

SEQ ID NO: 443855 - DNA, 17 bp, M. musculus
tggaagactgacatcca

SEQ ID NO: 443856 - DNA, 16 bp, M. musculus
tggaagactgacttct

SEQ ID NO: 443857 - DNA, 16 bp, M. musculus
tggaagactggcttcc

SEQ ID NO: 443858 - DNA, 16 bp, M. musculus
tggaagagagacagca

SEQ ID NO: 443859 - DNA, 16 bp, M. musculus
tggaagagcagcaggt

SEQ ID NO: 443860 - DNA, 16 bp, M. musculus
tggaagagcagcctgt

SEQ ID NO: 443861 - DNA, 16 bp, M. musculus
tggaagagcagctaga

SEQ ID NO: 443862 - DNA, 16 bp, M. musculus
tggaagagcagtcagc

SEQ ID NO: 443863 - DNA, 16 bp, M. musculus
tggaagagcagtcagt

SEQ ID NO: 443864 - DNA, 16 bp, M. musculus
tggaagagcagtcggt

SEQ ID NO: 443865 - DNA, 16 bp, M. musculus
tggaagagcagtgtgt

SEQ ID NO: 443866 - DNA, 16 bp, M. musculus
tggaagagcagttggc

SEQ ID NO: 443867 - DNA, 16 bp, M. musculus
tggaagagccaagagt

SEQ ID NO: 443868 - DNA, 16 bp, M. musculus
tggaagagccagagga

SEQ ID NO: 443869 - DNA, 16 bp, M. musculus
tggaagagccatcagt

SEQ ID NO: 443870 - DNA, 16 bp, M. musculus
tggaagagctagagaa

SEQ ID NO: 443871 - DNA, 16 bp, M. musculus
tggaagagctggagga

SEQ ID NO: 443872 - DNA, 16 bp, M. musculus
tggaagaggagacaga

SEQ ID NO: 443873 - DNA, 16 bp, M. musculus
tggaagaggagagctt

SEQ ID NO: 443874 - DNA, 16 bp, M. musculus
tggaagaggaggcaga

SEQ ID NO: 443875 - DNA, 16 bp, M. musculus
tggaagaggaggtaga

SEQ ID NO: 443876 - DNA, 16 bp, M. musculus
tggaagagggagcaga

SEQ ID NO: 443877 - DNA, 16 bp, M. musculus
tggaagaggttttatt

SEQ ID NO: 443878 - DNA, 21 bp, M. musculus
tggaagagtaagctgaataaa

SEQ ID NO: 443879 - DNA, 16 bp, M. musculus
tggaagagtccagact

SEQ ID NO: 443880 - DNA, 16 bp, M. musculus
tggaagagtgctgctt

SEQ ID NO: 443881 - DNA, 16 bp, M. musculus
tggaagagttggagga

SEQ ID NO: 443882 - DNA, 16 bp, M. musculus
tggaagagtttgaaga

SEQ ID NO: 443883 - DNA, 16 bp, M. musculus
tggaagatacagcaat

SEQ ID NO: 443884 - DNA, 16 bp, M. musculus
tggaagatgcttcatc

SEQ ID NO: 443885 - DNA, 16 bp, M. musculus
tggaagattctggaag

SEQ ID NO: 443886 - DNA, 16 bp, M. musculus
tggaagcagagaacca

SEQ ID NO: 443887 - DNA, 16 bp, M. musculus
tggaagcaggaactaa

SEQ ID NO: 443888 - DNA, 16 bp, M. musculus
tggaagcagtttcatg

SEQ ID NO: 443889 - DNA, 16 bp, M. musculus
tggaagcatttttttt

SEQ ID NO: 443890 - DNA, 16 bp, M. musculus
tggaagccagagaaca

SEQ ID NO: 443891 - DNA, 16 bp, M. musculus
tggaagccagaggaag

SEQ ID NO: 443892 - DNA, 16 bp, M. musculus
tggaagccagaggctg

SEQ ID NO: 443893 - DNA, 16 bp, M. musculus
tggaagccagaggtta

SEQ ID NO: 443894 - DNA, 16 bp, M. musculus
tggaagccagaggttg

SEQ ID NO: 443895 - DNA, 16 bp, M. musculus
tggaagccagcctggt

SEQ ID NO: 443896 - DNA, 16 bp, M. musculus
tggaagccaggattct

SEQ ID NO: 443897 - DNA, 16 bp, M. musculus
tggaagccagtattct

SEQ ID NO: 443898 - DNA, 17 bp, M. musculus
tggaagcccaggtactt

SEQ ID NO: 443899 - DNA, 16 bp, M. musculus
tggaagcccaggttgt

SEQ ID NO: 443900 - DNA, 16 bp, M. musculus
tggaagcctggactat

SEQ ID NO: 443901 - DNA, 16 bp, M. musculus
tggaagctagtattct

SEQ ID NO: 443902 - DNA, 16 bp, M. musculus
tggaagctagtcttct

SEQ ID NO: 443903 - DNA, 16 bp, M. musculus
tggaagctatgttttt

SEQ ID NO: 443904 - DNA, 16 bp, M. musculus
tggaagctctgggtgg

SEQ ID NO: 443905 - DNA, 16 bp, M. musculus
tggaagctgaacaaca

SEQ ID NO: 443906 - DNA, 16 bp, M. musculus
tggaagctgaacaact

SEQ ID NO: 443907 - DNA, 16 bp, M. musculus
tggaagctgagacagg

SEQ ID NO: 443908 - DNA, 16 bp, M. musculus
tggaagctgaggcaga

SEQ ID NO: 443909 - DNA, 16 bp, M. musculus
tggaagctgattaagg

SEQ ID NO: 443910 - DNA, 16 bp, M. musculus
tggaagctgcctggtg

SEQ ID NO: 443911 - DNA, 16 bp, M. musculus
tggaagcttcatccct

SEQ ID NO: 443912 - DNA, 16 bp, M. musculus
tggaagcttctagcct

SEQ ID NO: 443913 - DNA, 16 bp, M. musculus
tggaaggaaagaacaa

SEQ ID NO: 443914 - DNA, 16 bp, M. musculus
tggaaggaaagaactg

SEQ ID NO: 443915 - DNA, 16 bp, M. musculus
tggaaggaaagggttt

SEQ ID NO: 443916 - DNA, 16 bp, M. musculus
tggaaggaagacagca

SEQ ID NO: 443917 - DNA, 16 bp, M. musculus
tggaaggaagcaggca

SEQ ID NO: 443918 - DNA, 16 bp, M. musculus
tggaaggactcatggc

SEQ ID NO: 443919 - DNA, 16 bp, M. musculus
tggaaggactttggaa

SEQ ID NO: 443920 - DNA, 16 bp, M. musculus
tggaaggagaaaatgg

SEQ ID NO: 443921 - DNA, 16 bp, M. musculus
tggaaggagaaagcca

SEQ ID NO: 443922 - DNA, 16 bp, M. musculus
tggaaggagagaaccg

SEQ ID NO: 443923 - DNA, 16 bp, M. musculus
tggaaggagagaataa

SEQ ID NO: 443924 - DNA, 16 bp, M. musculus
tggaaggagagaatca

SEQ ID NO: 443925 - DNA, 16 bp, M. musculus
tggaaggagagagcca

SEQ ID NO: 443926 - DNA, 16 bp, M. musculus
tggaaggagaggactg

SEQ ID NO: 443927 - DNA, 16 bp, M. musculus
tggaaggagaggcaga

SEQ ID NO: 443928 - DNA, 16 bp, M. musculus
tggaaggagaggccct

SEQ ID NO: 443929 - DNA, 16 bp, M. musculus
tggaaggagatacaga

SEQ ID NO: 443930 - DNA, 16 bp, M. musculus
tggaaggagggaactg

SEQ ID NO: 443931 - DNA, 16 bp, M. musculus
tggaaggaggtgcagg

SEQ ID NO: 443932 - DNA, 16 bp, M. musculus
tggaaggatcacaggg

SEQ ID NO: 443933 - DNA, 16 bp, M. musculus
tggaaggatctgatgg

SEQ ID NO: 443934 - DNA, 16 bp, M. musculus
tggaaggatggctcag

SEQ ID NO: 443935 - DNA, 16 bp, M. musculus
tggaaggatgttttaa

SEQ ID NO: 443936 - DNA, 16 bp, M. musculus
tggaaggcactcctca

SEQ ID NO: 443937 - DNA, 16 bp, M. musculus
tggaaggcagagacag

SEQ ID NO: 443938 - DNA, 16 bp, M. musculus
tggaaggcagatgcag

SEQ ID NO: 443939 - DNA, 16 bp, M. musculus
tggaaggcagggacag

SEQ ID NO: 443940 - DNA, 16 bp, M. musculus
tggaaggcagtattct

SEQ ID NO: 443941 - DNA, 16 bp, M. musculus
tggaaggcatttttca

SEQ ID NO: 443942 - DNA, 16 bp, M. musculus
tggaaggccacacatc

SEQ ID NO: 443943 - DNA, 16 bp, M. musculus
tggaaggctgaggtag

SEQ ID NO: 443944 - DNA, 16 bp, M. musculus
tggaagggaaagtgga

SEQ ID NO: 443945 - DNA, 16 bp, M. musculus
tggaaggtggagacag

SEQ ID NO: 443946 - DNA, 16 bp, M. musculus
tggaaggttctggaag

SEQ ID NO: 443947 - DNA, 17 bp, M. musculus
tggaaggttgtacaaag

SEQ ID NO: 443948 - DNA, 16 bp, M. musculus
tggaaggttttgttca

SEQ ID NO: 443949 - DNA, 16 bp, M. musculus
tggaagtaggagctga

SEQ ID NO: 443950 - DNA, 16 bp, M. musculus
tggaagtataaactga

SEQ ID NO: 443951 - DNA, 16 bp, M. musculus
tggaagtataagccaa

SEQ ID NO: 443952 - DNA, 16 bp, M. musculus
tggaagtcagaggaca

SEQ ID NO: 443953 - DNA, 16 bp, M. musculus
tggaagtcagaggacc

SEQ ID NO: 443954 - DNA, 16 bp, M. musculus
tggaagtcagaggcag

SEQ ID NO: 443955 - DNA, 16 bp, M. musculus
tggaagtcagtattct

SEQ ID NO: 443956 - DNA, 16 bp, M. musculus
tggaagtcagtgtgga

SEQ ID NO: 443957 - DNA, 16 bp, M. musculus
tggaagtcagttttct

SEQ ID NO: 443958 - DNA, 16 bp, M. musculus
tggaagtgaaagccaa

SEQ ID NO: 443959 - DNA, 16 bp, M. musculus
tggaagtggaggctgt

SEQ ID NO: 443960 - DNA, 16 bp, M. musculus
tggaagtttattttat

SEQ ID NO: 443961 - DNA, 16 bp, M. musculus
tggaataaaaccaact

SEQ ID NO: 443962 - DNA, 16 bp, M. musculus
tggaataaagaaagca

SEQ ID NO: 443963 - DNA, 16 bp, M. musculus
tggaataatatccact

SEQ ID NO: 443964 - DNA, 26 bp, M. musculus
tggaatactttggtttctccatctat

SEQ ID NO: 443965 - DNA, 16 bp, M. musculus
tggaatagatccccag

SEQ ID NO: 443966 - DNA, 16 bp, M. musculus
tggaatagtttgtgca

SEQ ID NO: 443967 - DNA, 16 bp, M. musculus
tggaatatatatatat

SEQ ID NO: 443968 - DNA, 16 bp, M. musculus
tggaatattttgagaa

SEQ ID NO: 443969 - DNA, 16 bp, M. musculus
tggaatcaaattaaag

SEQ ID NO: 443970 - DNA, 16 bp, M. musculus
tggaatccacaggcag

SEQ ID NO: 443971 - DNA, 16 bp, M. musculus
tggaatccagaagagg

SEQ ID NO: 443972 - DNA, 16 bp, M. musculus
tggaatccagcttctt

SEQ ID NO: 443973 - DNA, 16 bp, M. musculus
tggaatccagtctcct

SEQ ID NO: 443974 - DNA, 16 bp, M. musculus
tggaatcccagcactg

SEQ ID NO: 443975 - DNA, 16 bp, M. musculus
tggaatcccagggttg

SEQ ID NO: 443976 - DNA, 20 bp, M. musculus
tggaatccgatgccctcttc

SEQ ID NO: 443977 - DNA, 16 bp, M. musculus
tggaatcctgggatcc

SEQ ID NO: 443978 - DNA, 16 bp, M. musculus
tggaatctcagaattg

SEQ ID NO: 443979 - DNA, 16 bp, M. musculus
tggaatctgatgcctt

SEQ ID NO: 443980 - DNA, 17 bp, M. musculus
tggaatctggctgggaa

SEQ ID NO: 443981 - DNA, 16 bp, M. musculus
tggaatgaaatctact

SEQ ID NO: 443982 - DNA, 16 bp, M. musculus
tggaatgaactacaat

SEQ ID NO: 443983 - DNA, 16 bp, M. musculus
tggaatgaagcctact

SEQ ID NO: 443984 - DNA, 16 bp, M. musculus
tggaatgacaaaaaac

SEQ ID NO: 443985 - DNA, 17 bp, M. musculus
tggaatgcaacatctgt

SEQ ID NO: 443986 - DNA, 16 bp, M. musculus
tggaatgcagaggcag

SEQ ID NO: 443987 - DNA, 16 bp, M. musculus
tggaatgctttggttt

SEQ ID NO: 443988 - DNA, 16 bp, M. musculus
tggaatggaatggaat

SEQ ID NO: 443989 - DNA, 16 bp, M. musculus
tggaatggagagctct

SEQ ID NO: 443990 - DNA, 16 bp, M. musculus
tggaatggatccccaa

SEQ ID NO: 443991 - DNA, 17 bp, M. musculus
tggaatgggattgaaga

SEQ ID NO: 443992 - DNA, 16 bp, M. musculus
tggaatgtaaaataaa

SEQ ID NO: 443993 - DNA, 16 bp, M. musculus
tggaatgtggaacagt

SEQ ID NO: 443994 - DNA, 16 bp, M. musculus
tggaattaaactcagg

SEQ ID NO: 443995 - DNA, 16 bp, M. musculus
tggaattaaagacctg

SEQ ID NO: 443996 - DNA, 17 bp, M. musculus
tggaattaaaggcatga

SEQ ID NO: 443997 - DNA, 16 bp, M. musculus
tggaattaaaggtgtg

SEQ ID NO: 443998 - DNA, 16 bp, M. musculus
tggaattaaagtcatg

SEQ ID NO: 443999 - DNA, 16 bp, M. musculus
tggaattacagatgct

SEQ ID NO: 444000 - DNA, 16 bp, M. musculus
tggaattacagatggt

SEQ ID NO: 444001 - DNA, 16 bp, M. musculus
tggaattacaggtggg

SEQ ID NO: 444002 - DNA, 16 bp, M. musculus
tggaattatgcttgtg

SEQ ID NO: 444003 - DNA, 16 bp, M. musculus
tggaattatttttgct

SEQ ID NO: 444004 - DNA, 16 bp, M. musculus
tggaattcagagatct

SEQ ID NO: 444005 - DNA, 16 bp, M. musculus
tggaattcagcatagc

SEQ ID NO: 444006 - DNA, 16 bp, M. musculus
tggaattccacactgg

SEQ ID NO: 444007 - DNA, 16 bp, M. musculus
tggaattcgattttat

SEQ ID NO: 444008 - DNA, 16 bp, M. musculus
tggaattctactcagc

SEQ ID NO: 444009 - DNA, 17 bp, M. musculus
tggaattctgttcatgt

SEQ ID NO: 444010 - DNA, 16 bp, M. musculus
tggaattgagtccatt

SEQ ID NO: 444011 - DNA, 16 bp, M. musculus
tggaattgtaaatgaa

SEQ ID NO: 444012 - DNA, 16 bp, M. musculus
tggaatttaataaaac

SEQ ID NO: 444013 - DNA, 16 bp, M. musculus
tggaatttaatgaaaa

SEQ ID NO: 444014 - DNA, 16 bp, M. musculus
tggaatttatgttctc

SEQ ID NO: 444015 - DNA, 16 bp, M. musculus
tggaatttgaattcag

SEQ ID NO: 444016 - DNA, 16 bp, M. musculus
tggaatttgattttat

SEQ ID NO: 444017 - DNA, 16 bp, M. musculus
tggaattttattcaac

SEQ ID NO: 444018 - DNA, 16 bp, M. musculus
tggaattttcaaagaa

SEQ ID NO: 444019 - DNA, 16 bp, M. musculus
tggaattttccaaagg

SEQ ID NO: 444020 - DNA, 16 bp, M. musculus
tggaattttcctttga

SEQ ID NO: 444021 - DNA, 16 bp, M. musculus
tggaattttcctttta

SEQ ID NO: 444022 - DNA, 17 bp, M. musculus
tggaatttttgaggtca

SEQ ID NO: 444023 - DNA, 16 bp, M. musculus
tggaattttttttcaa

SEQ ID NO: 444024 - DNA, 16 bp, M. musculus
tggacaaaagctgctg

SEQ ID NO: 444025 - DNA, 16 bp, M. musculus
tggacaaactgaagca

SEQ ID NO: 444026 - DNA, 16 bp, M. musculus
tggacaaagggcagcc

SEQ ID NO: 444027 - DNA, 16 bp, M. musculus
tggacaaattcctaga

SEQ ID NO: 444028 - DNA, 16 bp, M. musculus
tggacaacttcccaga

SEQ ID NO: 444029 - DNA, 16 bp, M. musculus
tggacaagaaaagaaa

SEQ ID NO: 444030 - DNA, 16 bp, M. musculus
tggacaagaaagagat

SEQ ID NO: 444031 - DNA, 16 bp, M. musculus
tggacaagatctatga

SEQ ID NO: 444032 - DNA, 16 bp, M. musculus
tggacaaggagtcagc

SEQ ID NO: 444033 - DNA, 16 bp, M. musculus
tggacaaggggcagtc

SEQ ID NO: 444034 - DNA, 16 bp, M. musculus
tggacaatattttcta

SEQ ID NO: 444035 - DNA, 16 bp, M. musculus
tggacaatgccagcat

SEQ ID NO: 444036 - DNA, 16 bp, M. musculus
tggacaattttctaga

SEQ ID NO: 444037 - DNA, 16 bp, M. musculus
tggacactattgtgga

SEQ ID NO: 444038 - DNA, 17 bp, M. musculus
tggacactttacccttt

SEQ ID NO: 444039 - DNA, 16 bp, M. musculus
tggacactttgccctt

SEQ ID NO: 444040 - DNA, 16 bp, M. musculus
tggacagaaacatttc

SEQ ID NO: 444041 - DNA, 16 bp, M. musculus
tggacagaagagacat

SEQ ID NO: 444042 - DNA, 16 bp, M. musculus
tggacagaagctggag

SEQ ID NO: 444043 - DNA, 16 bp, M. musculus
tggacagagcacagag

SEQ ID NO: 444044 - DNA, 16 bp, M. musculus
tggacagaggagaaaa

SEQ ID NO: 444045 - DNA, 16 bp, M. musculus
tggacagatacaaggt

SEQ ID NO: 444046 - DNA, 16 bp, M. musculus
tggacagatattatac

SEQ ID NO: 444047 - DNA, 16 bp, M. musculus
tggacagatttttttt

SEQ ID NO: 444048 - DNA, 16 bp, M. musculus
tggacagcctttcctt

SEQ ID NO: 444049 - DNA, 16 bp, M. musculus
tggacagctcctgagg

SEQ ID NO: 444050 - DNA, 16 bp, M. musculus
tggacagctttgtctt

SEQ ID NO: 444051 - DNA, 16 bp, M. musculus
tggacaggtcctggaa

SEQ ID NO: 444052 - DNA, 16 bp, M. musculus
tggacagtattatgtc

SEQ ID NO: 444053 - DNA, 16 bp, M. musculus
tggacagttttattca

SEQ ID NO: 444054 - DNA, 16 bp, M. musculus
tggacatatcaaaatc

SEQ ID NO: 444055 - DNA, 16 bp, M. musculus
tggacatcaggatagc

SEQ ID NO: 444056 - DNA, 16 bp, M. musculus
tggacatcagtgggaa

SEQ ID NO: 444057 - DNA, 16 bp, M. musculus
tggacatccaggcacc

SEQ ID NO: 444058 - DNA, 16 bp, M. musculus
tggacatcctggatga

SEQ ID NO: 444059 - DNA, 16 bp, M. musculus
tggacatggacatgga

SEQ ID NO: 444060 - DNA, 16 bp, M. musculus
tggacatggagggcat

SEQ ID NO: 444061 - DNA, 16 bp, M. musculus
tggacatggtggcaca

SEQ ID NO: 444062 - DNA, 16 bp, M. musculus
tggacatggtggctca

SEQ ID NO: 444063 - DNA, 16 bp, M. musculus
tggaccaagatggcga

SEQ ID NO: 444064 - DNA, 16 bp, M. musculus
tggaccacagggtccc

SEQ ID NO: 444065 - DNA, 16 bp, M. musculus
tggaccaccacaccca

SEQ ID NO: 444066 - DNA, 16 bp, M. musculus
tggaccaccactgccc

SEQ ID NO: 444067 - DNA, 16 bp, M. musculus
tggaccagaaaaagaa

SEQ ID NO: 444068 - DNA, 16 bp, M. musculus
tggaccagagcaagca

SEQ ID NO: 444069 - DNA, 16 bp, M. musculus
tggaccagcctttgtt

SEQ ID NO: 444070 - DNA, 16 bp, M. musculus
tggaccagctagtgta

SEQ ID NO: 444071 - DNA, 16 bp, M. musculus
tggaccaggatatgga

SEQ ID NO: 444072 - DNA, 16 bp, M. musculus
tggaccaggctggcct

SEQ ID NO: 444073 - DNA, 16 bp, M. musculus
tggaccatccagacac

SEQ ID NO: 444074 - DNA, 16 bp, M. musculus
tggaccatcctttcat

SEQ ID NO: 444075 - DNA, 16 bp, M. musculus
tggaccatcttctggg

SEQ ID NO: 444076 - DNA, 16 bp, M. musculus
tggaccatgcctgcct

SEQ ID NO: 444077 - DNA, 16 bp, M. musculus
tggaccattccatctt

SEQ ID NO: 444078 - DNA, 17 bp, M. musculus
tggacccacacacctat

SEQ ID NO: 444079 - DNA, 16 bp, M. musculus
tggacccagtggccag

SEQ ID NO: 444080 - DNA, 16 bp, M. musculus
tggaccccagggtggg

SEQ ID NO: 444081 - DNA, 16 bp, M. musculus
tggacccccaggatct

SEQ ID NO: 444082 - DNA, 16 bp, M. musculus
tggacccctgggtggg

SEQ ID NO: 444083 - DNA, 16 bp, M. musculus
tggaccctcccaccct

SEQ ID NO: 444084 - DNA, 16 bp, M. musculus
tggacctgaagggcat

SEQ ID NO: 444085 - DNA, 16 bp, M. musculus
tggacctggagggcaa

SEQ ID NO: 444086 - DNA, 16 bp, M. musculus
tggacctggagggcct

SEQ ID NO: 444087 - DNA, 16 bp, M. musculus
tggacctggatggcat

SEQ ID NO: 444088 - DNA, 16 bp, M. musculus
tggacctgggtcccac

SEQ ID NO: 444089 - DNA, 16 bp, M. musculus
tggacgagaaaagaaa

SEQ ID NO: 444090 - DNA, 16 bp, M. musculus
tggactaaacctctga

SEQ ID NO: 444091 - DNA, 16 bp, M. musculus
tggactaaagctgatc

SEQ ID NO: 444092 - DNA, 16 bp, M. musculus
tggactaattaatgac

SEQ ID NO: 444093 - DNA, 16 bp, M. musculus
tggactacagaaccta

SEQ ID NO: 444094 - DNA, 16 bp, M. musculus
tggactacagaagcta

SEQ ID NO: 444095 - DNA, 16 bp, M. musculus
tggactacagaggcta

SEQ ID NO: 444096 - DNA, 16 bp, M. musculus
tggactacatagagag

SEQ ID NO: 444097 - DNA, 16 bp, M. musculus
tggactcaaactcaga

SEQ ID NO: 444098 - DNA, 16 bp, M. musculus
tggactccacccccac

SEQ ID NO: 444099 - DNA, 16 bp, M. musculus
tggactccatcattat

SEQ ID NO: 444100 - DNA, 16 bp, M. musculus
tggactcctccaaggg

SEQ ID NO: 444101 - DNA, 16 bp, M. musculus
tggactgaacctctaa

SEQ ID NO: 444102 - DNA, 17 bp, M. musculus
tggactgaacctctgaa

SEQ ID NO: 444103 - DNA, 16 bp, M. musculus
tggactgaacctgtga

SEQ ID NO: 444104 - DNA, 16 bp, M. musculus
tggactgaagctgctg

SEQ ID NO: 444105 - DNA, 16 bp, M. musculus
tggactgaatctcaga

SEQ ID NO: 444106 - DNA, 16 bp, M. musculus
tggactgcagaagcaa

SEQ ID NO: 444107 - DNA, 16 bp, M. musculus
tggactgccttgtctg

SEQ ID NO: 444108 - DNA, 16 bp, M. musculus
tggactgctgctgctg

SEQ ID NO: 444109 - DNA, 16 bp, M. musculus
tggactgggccctccc

SEQ ID NO: 444110 - DNA, 17 bp, M. musculus
tggactgggtgttaggt

SEQ ID NO: 444111 - DNA, 16 bp, M. musculus
tggactggtggtcatc

SEQ ID NO: 444112 - DNA, 16 bp, M. musculus
tggactggtggttctg

SEQ ID NO: 444113 - DNA, 16 bp, M. musculus
tggactgtaatgtgga

SEQ ID NO: 444114 - DNA, 16 bp, M. musculus
tggactgtagctgctg

SEQ ID NO: 444115 - DNA, 16 bp, M. musculus
tggactgtataagaaa

SEQ ID NO: 444116 - DNA, 16 bp, M. musculus
tggactgtatcttggg

SEQ ID NO: 444117 - DNA, 16 bp, M. musculus
tggacttaaaagatgc

SEQ ID NO: 444118 - DNA, 16 bp, M. musculus
tggacttcagttttgt

SEQ ID NO: 444119 - DNA, 16 bp, M. musculus
tggacttcctcctggc

SEQ ID NO: 444120 - DNA, 16 bp, M. musculus
tggacttgacttttgt

SEQ ID NO: 444121 - DNA, 16 bp, M. musculus
tggacttgagctttct

SEQ ID NO: 444122 - DNA, 16 bp, M. musculus
tggacttgcaaacttt

SEQ ID NO: 444123 - DNA, 16 bp, M. musculus
tggacttgcccagttc

SEQ ID NO: 444124 - DNA, 16 bp, M. musculus
tggacttggtggcctg

SEQ ID NO: 444125 - DNA, 16 bp, M. musculus
tggacttgtaaacttt

SEQ ID NO: 444126 - DNA, 16 bp, M. musculus
tggactttgagatttc

SEQ ID NO: 444127 - DNA, 16 bp, M. musculus
tggactttggactttt

SEQ ID NO: 444128 - DNA, 16 bp, M. musculus
tggactttggagaaga

SEQ ID NO: 444129 - DNA, 16 bp, M. musculus
tggacttttaaaaaat

SEQ ID NO: 444130 - DNA, 16 bp, M. musculus
tggacttttaaaacct

SEQ ID NO: 444131 - DNA, 16 bp, M. musculus
tggactttttgttgtt

SEQ ID NO: 444132 - DNA, 16 bp, M. musculus
tggagaaaagaaaaca

SEQ ID NO: 444133 - DNA, 16 bp, M. musculus
tggagaaaagacagaa

SEQ ID NO: 444134 - DNA, 16 bp, M. musculus
tggagaaaataagata

SEQ ID NO: 444135 - DNA, 16 bp, M. musculus
tggagaaaatgaaaat

SEQ ID NO: 444136 - DNA, 16 bp, M. musculus
tggagaaaatgtgtca

SEQ ID NO: 444137 - DNA, 16 bp, M. musculus
tggagaaaattaattt

SEQ ID NO: 444138 - DNA, 16 bp, M. musculus
tggagaaacaggaaca

SEQ ID NO: 444139 - DNA, 16 bp, M. musculus
tggagaaaccaaagca

SEQ ID NO: 444140 - DNA, 16 bp, M. musculus
tggagaaaccaagaaa

SEQ ID NO: 444141 - DNA, 16 bp, M. musculus
tggagaaactgaggca

SEQ ID NO: 444142 - DNA, 16 bp, M. musculus
tggagaaagaaacact

SEQ ID NO: 444143 - DNA, 16 bp, M. musculus
tggagaaagaaattaa

SEQ ID NO: 444144 - DNA, 16 bp, M. musculus
tggagaaagaaattga

SEQ ID NO: 444145 - DNA, 16 bp, M. musculus
tggagaaagaagaaac

SEQ ID NO: 444146 - DNA, 16 bp, M. musculus
tggagaaagaagaact

SEQ ID NO: 444147 - DNA, 16 bp, M. musculus
tggagaaagaagagca

SEQ ID NO: 444148 - DNA, 16 bp, M. musculus
tggagaaagagacaga

SEQ ID NO: 444149 - DNA, 16 bp, M. musculus
tggagaaagagcaaca

SEQ ID NO: 444150 - DNA, 16 bp, M. musculus
tggagaaagagctcag

SEQ ID NO: 444151 - DNA, 16 bp, M. musculus
tggagaaagaggatca

SEQ ID NO: 444152 - DNA, 18 bp, M. musculus
tggagaaagcaaagtatt

SEQ ID NO: 444153 - DNA, 16 bp, M. musculus
tggagaaagtgaactg

SEQ ID NO: 444154 - DNA, 16 bp, M. musculus
tggagaaagtggaaca

SEQ ID NO: 444155 - DNA, 16 bp, M. musculus
tggagaaagtgtgtca

SEQ ID NO: 444156 - DNA, 16 bp, M. musculus
tggagaaatatcagga

SEQ ID NO: 444157 - DNA, 16 bp, M. musculus
tggagaaatgaatgaa

SEQ ID NO: 444158 - DNA, 16 bp, M. musculus
tggagaaatgctgctt

SEQ ID NO: 444159 - DNA, 16 bp, M. musculus
tggagaaatggaaaga

SEQ ID NO: 444160 - DNA, 16 bp, M. musculus
tggagaaatggctcag

SEQ ID NO: 444161 - DNA, 16 bp, M. musculus
tggagaaatggcttgg

SEQ ID NO: 444162 - DNA, 16 bp, M. musculus
tggagaaatgttcttt

SEQ ID NO: 444163 - DNA, 16 bp, M. musculus
tggagaaattagagaa

SEQ ID NO: 444164 - DNA, 16 bp, M. musculus
tggagaaattgagctg

SEQ ID NO: 444165 - DNA, 16 bp, M. musculus
tggagaacctggatga

SEQ ID NO: 444166 - DNA, 16 bp, M. musculus
tggagaagaaactgaa

SEQ ID NO: 444167 - DNA, 16 bp, M. musculus
tggagaagaatttcag

SEQ ID NO: 444168 - DNA, 16 bp, M. musculus
tggagaagagactggg

SEQ ID NO: 444169 - DNA, 16 bp, M. musculus
tggagaagagcaggca

SEQ ID NO: 444170 - DNA, 16 bp, M. musculus
tggagaagagcctgag

SEQ ID NO: 444171 - DNA, 16 bp, M. musculus
tggagaagagtttgag

SEQ ID NO: 444172 - DNA, 16 bp, M. musculus
tggagaagatagagaa

SEQ ID NO: 444173 - DNA, 16 bp, M. musculus
tggagaagatcctgag

SEQ ID NO: 444174 - DNA, 16 bp, M. musculus
tggagaagatgtggag

SEQ ID NO: 444175 - DNA, 16 bp, M. musculus
tggagaagcagctgag

SEQ ID NO: 444176 - DNA, 16 bp, M. musculus
tggagaagccagagaa

SEQ ID NO: 444177 - DNA, 16 bp, M. musculus
tggagaagccattcta

SEQ ID NO: 444178 - DNA, 17 bp, M. musculus
tggagaagccctgctag

SEQ ID NO: 444179 - DNA, 16 bp, M. musculus
tggagaagctaaagaa

SEQ ID NO: 444180 - DNA, 16 bp, M. musculus
tggagaagctagagaa

SEQ ID NO: 444181 - DNA, 16 bp, M. musculus
tggagaagctagagag

SEQ ID NO: 444182 - DNA, 16 bp, M. musculus
tggagaagctgagaac

SEQ ID NO: 444183 - DNA, 16 bp, M. musculus
tggagaagctgagagt

SEQ ID NO: 444184 - DNA, 17 bp, M. musculus
tggagaaggacctgatt

SEQ ID NO: 444185 - DNA, 16 bp, M. musculus
tggagaaggagaaaca

SEQ ID NO: 444186 - DNA, 16 bp, M. musculus
tggagaaggagctgaa

SEQ ID NO: 444187 - DNA, 16 bp, M. musculus
tggagaaggagctgag

SEQ ID NO: 444188 - DNA, 16 bp, M. musculus
tggagaaggagctggg

SEQ ID NO: 444189 - DNA, 16 bp, M. musculus
tggagaaggagctgtg

SEQ ID NO: 444190 - DNA, 16 bp, M. musculus
tggagaaggcacagtg

SEQ ID NO: 444191 - DNA, 16 bp, M. musculus
tggagaaggcctttgc

SEQ ID NO: 444192 - DNA, 16 bp, M. musculus
tggagaaggtagagaa

SEQ ID NO: 444193 - DNA, 16 bp, M. musculus
tggagaaggtgctgag

SEQ ID NO: 444194 - DNA, 16 bp, M. musculus
tggagaagtgactcaa

SEQ ID NO: 444195 - DNA, 16 bp, M. musculus
tggagaagttagagaa

SEQ ID NO: 444196 - DNA, 16 bp, M. musculus
tggagaatctagagaa

SEQ ID NO: 444197 - DNA, 16 bp, M. musculus
tggagacaaagtgtgg

SEQ ID NO: 444198 - DNA, 16 bp, M. musculus
tggagacaaggtcttt

SEQ ID NO: 444199 - DNA, 16 bp, M. musculus
tggagacagaacccag

SEQ ID NO: 444200 - DNA, 16 bp, M. musculus
tggagacagacccact

SEQ ID NO: 444201 - DNA, 16 bp, M. musculus
tggagacagaggaaca

SEQ ID NO: 444202 - DNA, 16 bp, M. musculus
tggagacagagtctct

SEQ ID NO: 444203 - DNA, 16 bp, M. musculus
tggagacagagtttct

SEQ ID NO: 444204 - DNA, 16 bp, M. musculus
tggagacagctcagtg

SEQ ID NO: 444205 - DNA, 16 bp, M. musculus
tggagacaggaactga

SEQ ID NO: 444206 - DNA, 16 bp, M. musculus
tggagacaggagacag

SEQ ID NO: 444207 - DNA, 16 bp, M. musculus
tggagacaggatctct

SEQ ID NO: 444208 - DNA, 16 bp, M. musculus
tggagacagggagagg

SEQ ID NO: 444209 - DNA, 16 bp, M. musculus
tggagacagggcctct

SEQ ID NO: 444210 - DNA, 16 bp, M. musculus
tggagacagggtctca

SEQ ID NO: 444211 - DNA, 16 bp, M. musculus
tggagacaggtggatt

SEQ ID NO: 444212 - DNA, 16 bp, M. musculus
tggagacatacttgaa

SEQ ID NO: 444213 - DNA, 16 bp, M. musculus
tggagacatttcccca

SEQ ID NO: 444214 - DNA, 16 bp, M. musculus
tggagacattttctta

SEQ ID NO: 444215 - DNA, 16 bp, M. musculus
tggagaccaagtcctt

SEQ ID NO: 444216 - DNA, 16 bp, M. musculus
tggagaccagaggaag

SEQ ID NO: 444217 - DNA, 16 bp, M. musculus
tggagaccagaggaca

SEQ ID NO: 444218 - DNA, 16 bp, M. musculus
tggagaccagaggcca

SEQ ID NO: 444219 - DNA, 16 bp, M. musculus
tggagacgaagatggc

SEQ ID NO: 444220 - DNA, 16 bp, M. musculus
tggagacgtggctcag

SEQ ID NO: 444221 - DNA, 16 bp, M. musculus
tggagactagctctct

SEQ ID NO: 444222 - DNA, 16 bp, M. musculus
tggagactcaagggta

SEQ ID NO: 444223 - DNA, 16 bp, M. musculus
tggagactcagttgtg

SEQ ID NO: 444224 - DNA, 16 bp, M. musculus
tggagactctgactca

SEQ ID NO: 444225 - DNA, 16 bp, M. musculus
tggagactgaacccag

SEQ ID NO: 444226 - DNA, 16 bp, M. musculus
tggagagaaaagggtt

SEQ ID NO: 444227 - DNA, 16 bp, M. musculus
tggagagaaacataaa

SEQ ID NO: 444228 - DNA, 16 bp, M. musculus
tggagagaaactgaaa

SEQ ID NO: 444229 - DNA, 16 bp, M. musculus
tggagagaaagctcaa

SEQ ID NO: 444230 - DNA, 16 bp, M. musculus
tggagagaaagttgaa

SEQ ID NO: 444231 - DNA, 16 bp, M. musculus
tggagagaagctagaa

SEQ ID NO: 444232 - DNA, 16 bp, M. musculus
tggagagaatcttgaa

SEQ ID NO: 444233 - DNA, 16 bp, M. musculus
tggagagacagctcaa

SEQ ID NO: 444234 - DNA, 16 bp, M. musculus
tggagagacatctcag

SEQ ID NO: 444235 - DNA, 16 bp, M. musculus
tggagagacgactcag

SEQ ID NO: 444236 - DNA, 16 bp, M. musculus
tggagagacggctcag

SEQ ID NO: 444237 - DNA, 16 bp, M. musculus
tggagagacggcttag

SEQ ID NO: 444238 - DNA, 16 bp, M. musculus
tggagagagagcccag

SEQ ID NO: 444239 - DNA, 16 bp, M. musculus
tggagagagcacatac

SEQ ID NO: 444240 - DNA, 16 bp, M. musculus
tggagagagcagaggt

SEQ ID NO: 444241 - DNA, 16 bp, M. musculus
tggagagatacctcag

SEQ ID NO: 444242 - DNA, 16 bp, M. musculus
tggagagatagctcaa

SEQ ID NO: 444243 - DNA, 16 bp, M. musculus
tggagagatagctcag

SEQ ID NO: 444244 - DNA, 16 bp, M. musculus
tggagagatagctccg

SEQ ID NO: 444245 - DNA, 16 bp, M. musculus
tggagagatgactcag

SEQ ID NO: 444246 - DNA, 16 bp, M. musculus
tggagagatgagatgg

SEQ ID NO: 444247 - DNA, 16 bp, M. musculus
tggagagatgcctcag

SEQ ID NO: 444248 - DNA, 16 bp, M. musculus
tggagagatggcccag

SEQ ID NO: 444249 - DNA, 16 bp, M. musculus
tggagagatggcccgg

SEQ ID NO: 444250 - DNA, 16 bp, M. musculus
tggagagatggctaag

SEQ ID NO: 444251 - DNA, 16 bp, M. musculus
tggagagatggctatg

SEQ ID NO: 444252 - DNA, 16 bp, M. musculus
tggagagatggctcaa

SEQ ID NO: 444253 - DNA, 16 bp, M. musculus
tggagagatggctcag

SEQ ID NO: 444254 - DNA, 16 bp, M. musculus
tggagagatggctcat

SEQ ID NO: 444255 - DNA, 16 bp, M. musculus
tggagagatggctgtg

SEQ ID NO: 444256 - DNA, 16 bp, M. musculus
tggagagatgggtcag

SEQ ID NO: 444257 - DNA, 16 bp, M. musculus
tggagagatggttcag

SEQ ID NO: 444258 - DNA, 16 bp, M. musculus
tggagagatggttgag

SEQ ID NO: 444259 - DNA, 16 bp, M. musculus
tggagagatgtctcag

SEQ ID NO: 444260 - DNA, 16 bp, M. musculus
tggagagattgtggag

SEQ ID NO: 444261 - DNA, 16 bp, M. musculus
tggagagattgttcag

SEQ ID NO: 444262 - DNA, 16 bp, M. musculus
tggagagcaaccaata

SEQ ID NO: 444263 - DNA, 16 bp, M. musculus
tggagagcactctgga

SEQ ID NO: 444264 - DNA, 16 bp, M. musculus
tggagagccgtgcagc

SEQ ID NO: 444265 - DNA, 16 bp, M. musculus
tggagagccttttggg

SEQ ID NO: 444266 - DNA, 16 bp, M. musculus
tggagagctcaccctg

SEQ ID NO: 444267 - DNA, 16 bp, M. musculus
tggagagctggctcag

SEQ ID NO: 444268 - DNA, 16 bp, M. musculus
tggagagctgtgagca

SEQ ID NO: 444269 - DNA, 16 bp, M. musculus
tggagaggaaaccagg

SEQ ID NO: 444270 - DNA, 16 bp, M. musculus
tggagaggaaatgagg

SEQ ID NO: 444271 - DNA, 16 bp, M. musculus
tggagaggaacctgag

SEQ ID NO: 444272 - DNA, 16 bp, M. musculus
tggagaggaagctgag

SEQ ID NO: 444273 - DNA, 16 bp, M. musculus
tggagaggagagggtt

SEQ ID NO: 444274 - DNA, 16 bp, M. musculus
tggagaggagcctggg

SEQ ID NO: 444275 - DNA, 16 bp, M. musculus
tggagaggagtagcct

SEQ ID NO: 444276 - DNA, 16 bp, M. musculus
tggagaggatatggag

SEQ ID NO: 444277 - DNA, 16 bp, M. musculus
tggagaggatgtggag

SEQ ID NO: 444278 - DNA, 16 bp, M. musculus
tggagaggcacagccc

SEQ ID NO: 444279 - DNA, 16 bp, M. musculus
tggagaggcagaggca

SEQ ID NO: 444280 - DNA, 16 bp, M. musculus
tggagaggtagctcag

SEQ ID NO: 444281 - DNA, 16 bp, M. musculus
tggagaggtggctcaa

SEQ ID NO: 444282 - DNA, 16 bp, M. musculus
tggagaggtggctcag

SEQ ID NO: 444283 - DNA, 16 bp, M. musculus
tggagagtcctctggg

SEQ ID NO: 444284 - DNA, 16 bp, M. musculus
tggagagtcctgtgag

SEQ ID NO: 444285 - DNA, 16 bp, M. musculus
tggagagtcttctggg

SEQ ID NO: 444286 - DNA, 24 bp, M. musculus
tggagatagaaacactaggaaaga

SEQ ID NO: 444287 - DNA, 16 bp, M. musculus
tggagatagaaagcct

SEQ ID NO: 444288 - DNA, 16 bp, M. musculus
tggagatagaagtttg

SEQ ID NO: 444289 - DNA, 16 bp, M. musculus
tggagatcaaaagaca

SEQ ID NO: 444290 - DNA, 16 bp, M. musculus
tggagatcaaacccag

SEQ ID NO: 444291 - DNA, 16 bp, M. musculus
tggagatcaaactcag

SEQ ID NO: 444292 - DNA, 16 bp, M. musculus
tggagatcagaggaca

SEQ ID NO: 444293 - DNA, 24 bp, M. musculus
tggagatcatccagggaactgtgg

SEQ ID NO: 444294 - DNA, 16 bp, M. musculus
tggagatcctacagct

SEQ ID NO: 444295 - DNA, 16 bp, M. musculus
tggagatcctgcagct

SEQ ID NO: 444296 - DNA, 16 bp, M. musculus
tggagatcctgcagtt

SEQ ID NO: 444297 - DNA, 16 bp, M. musculus
tggagatgagaagaca

SEQ ID NO: 444298 - DNA, 16 bp, M. musculus
tggagatgagaggaca

SEQ ID NO: 444299 - DNA, 16 bp, M. musculus
tggagatgcaggggga

SEQ ID NO: 444300 - DNA, 16 bp, M. musculus
tggagatgccagagcc

SEQ ID NO: 444301 - DNA, 16 bp, M. musculus
tggagatgccagagtc

SEQ ID NO: 444302 - DNA, 16 bp, M. musculus
tggagatgctgctgct

SEQ ID NO: 444303 - DNA, 16 bp, M. musculus
tggagatggaaaacct

SEQ ID NO: 444304 - DNA, 16 bp, M. musculus
tggagatggaatggtt

SEQ ID NO: 444305 - DNA, 16 bp, M. musculus
tggagatggaggcagg

SEQ ID NO: 444306 - DNA, 16 bp, M. musculus
tggagatggcccacca

SEQ ID NO: 444307 - DNA, 16 bp, M. musculus
tggagatgggctttga

SEQ ID NO: 444308 - DNA, 16 bp, M. musculus
tggagatgtggccttg

SEQ ID NO: 444309 - DNA, 16 bp, M. musculus
tggagattaaacccag

SEQ ID NO: 444310 - DNA, 16 bp, M. musculus
tggagattgaagccag

SEQ ID NO: 444311 - DNA, 16 bp, M. musculus
tggagattgtattgaa

SEQ ID NO: 444312 - DNA, 16 bp, M. musculus
tggagcaaagctctac

SEQ ID NO: 444313 - DNA, 16 bp, M. musculus
tggagcaagaagaaag

SEQ ID NO: 444314 - DNA, 16 bp, M. musculus
tggagcaagatgaggt

SEQ ID NO: 444315 - DNA, 16 bp, M. musculus
tggagcaatggctcag

SEQ ID NO: 444316 - DNA, 16 bp, M. musculus
tggagcacagactgaa

SEQ ID NO: 444317 - DNA, 16 bp, M. musculus
tggagcacagagtccc

SEQ ID NO: 444318 - DNA, 16 bp, M. musculus
tggagcacagggctcc

SEQ ID NO: 444319 - DNA, 16 bp, M. musculus
tggagcacttgcctag

SEQ ID NO: 444320 - DNA, 16 bp, M. musculus
tggagcagaaacagaa

SEQ ID NO: 444321 - DNA, 16 bp, M. musculus
tggagcagaaactgaa

SEQ ID NO: 444322 - DNA, 16 bp, M. musculus
tggagcagaagctgag

SEQ ID NO: 444323 - DNA, 17 bp, M. musculus
tggagcagaagctgtgt

SEQ ID NO: 444324 - DNA, 16 bp, M. musculus
tggagcagaagggact

SEQ ID NO: 444325 - DNA, 16 bp, M. musculus
tggagcagaaggtggg

SEQ ID NO: 444326 - DNA, 16 bp, M. musculus
tggagcagagaatgaa

SEQ ID NO: 444327 - DNA, 16 bp, M. musculus
tggagcagagaccaaa

SEQ ID NO: 444328 - DNA, 16 bp, M. musculus
tggagcagagaccatg

SEQ ID NO: 444329 - DNA, 16 bp, M. musculus
tggagcagagactcaa

SEQ ID NO: 444330 - DNA, 16 bp, M. musculus
tggagcagagactgaa

SEQ ID NO: 444331 - DNA, 16 bp, M. musculus
tggagcagagatattc

SEQ ID NO: 444332 - DNA, 16 bp, M. musculus
tggagcagagatggag

SEQ ID NO: 444333 - DNA, 16 bp, M. musculus
tggagcagatggaggg

SEQ ID NO: 444334 - DNA, 18 bp, M. musculus
tggagcagcagctgtgtt

SEQ ID NO: 444335 - DNA, 16 bp, M. musculus
tggagcagccattcta

SEQ ID NO: 444336 - DNA, 16 bp, M. musculus
tggagcaggaagctga

SEQ ID NO: 444337 - DNA, 16 bp, M. musculus
tggagcaggaggatca

SEQ ID NO: 444338 - DNA, 16 bp, M. musculus
tggagcagggcagggg

SEQ ID NO: 444339 - DNA, 16 bp, M. musculus
tggagcaggggttgtc

SEQ ID NO: 444340 - DNA, 16 bp, M. musculus
tggagcaggtcttcct

SEQ ID NO: 444341 - DNA, 16 bp, M. musculus
tggagcagtcagaggg

SEQ ID NO: 444342 - DNA, 16 bp, M. musculus
tggagcagtctctgga

SEQ ID NO: 444343 - DNA, 16 bp, M. musculus
tggagcatctgcagga

SEQ ID NO: 444344 - DNA, 16 bp, M. musculus
tggagcatcttctggg

SEQ ID NO: 444345 - DNA, 16 bp, M. musculus
tggagcatgtgtccat

SEQ ID NO: 444346 - DNA, 16 bp, M. musculus
tggagcatgtgtcctc

SEQ ID NO: 444347 - DNA, 16 bp, M. musculus
tggagcatgtgttgtt

SEQ ID NO: 444348 - DNA, 16 bp, M. musculus
tggagccagaggcagg

SEQ ID NO: 444349 - DNA, 16 bp, M. musculus
tggagccagcctggtc

SEQ ID NO: 444350 - DNA, 16 bp, M. musculus
tggagccagtgagatg

SEQ ID NO: 444351 - DNA, 16 bp, M. musculus
tggagccatgggtgcc

SEQ ID NO: 444352 - DNA, 16 bp, M. musculus
tggagcccccaactcc

SEQ ID NO: 444353 - DNA, 16 bp, M. musculus
tggagccctggctgtc

SEQ ID NO: 444354 - DNA, 16 bp, M. musculus
tggagcctagactaaa

SEQ ID NO: 444355 - DNA, 16 bp, M. musculus
tggagcctcctctgtg

SEQ ID NO: 444356 - DNA, 16 bp, M. musculus
tggagcctctcagagg

SEQ ID NO: 444357 - DNA, 16 bp, M. musculus
tggagcctgaggcaga

SEQ ID NO: 444358 - DNA, 16 bp, M. musculus
tggagcctgccaccct

SEQ ID NO: 444359 - DNA, 17 bp, M. musculus
tggagcctgtccttcct

SEQ ID NO: 444360 - DNA, 16 bp, M. musculus
tggagccttcccagga

SEQ ID NO: 444361 - DNA, 16 bp, M. musculus
tggagcgatggctcag

SEQ ID NO: 444362 - DNA, 16 bp, M. musculus
tggagctacagacagc

SEQ ID NO: 444363 - DNA, 16 bp, M. musculus
tggagctacagttaca

SEQ ID NO: 444364 - DNA, 16 bp, M. musculus
tggagctagagttaca

SEQ ID NO: 444365 - DNA, 16 bp, M. musculus
tggagctatggatggt

SEQ ID NO: 444366 - DNA, 16 bp, M. musculus
tggagctcacagagat

SEQ ID NO: 444367 - DNA, 16 bp, M. musculus
tggagctcaccaattc

SEQ ID NO: 444368 - DNA, 16 bp, M. musculus
tggagctcactggcta

SEQ ID NO: 444369 - DNA, 16 bp, M. musculus
tggagctcagaagagg

SEQ ID NO: 444370 - DNA, 16 bp, M. musculus
tggagctcagagctga

SEQ ID NO: 444371 - DNA, 16 bp, M. musculus
tggagctcagatccac

SEQ ID NO: 444372 - DNA, 16 bp, M. musculus
tggagctcagtggtag

SEQ ID NO: 444373 - DNA, 16 bp, M. musculus
tggagctccacagaaa

SEQ ID NO: 444374 - DNA, 16 bp, M. musculus
tggagctccacagcag

SEQ ID NO: 444375 - DNA, 29 bp, M. musculus
tggagctccacaggaaaggatcttcgtat

SEQ ID NO: 444376 - DNA, 16 bp, M. musculus
tggagctctgggagtt

SEQ ID NO: 444377 - DNA, 16 bp, M. musculus
tggagctctgtgagtt

SEQ ID NO: 444378 - DNA, 16 bp, M. musculus
tggagctgaagttaca

SEQ ID NO: 444379 - DNA, 16 bp, M. musculus
tggagctgagaaggaa

SEQ ID NO: 444380 - DNA, 16 bp, M. musculus
tggagctgaggcagga

SEQ ID NO: 444381 - DNA, 16 bp, M. musculus
tggagctgatgcagag

SEQ ID NO: 444382 - DNA, 16 bp, M. musculus
tggagctgatgttgtg

SEQ ID NO: 444383 - DNA, 16 bp, M. musculus
tggagctgcagttata

SEQ ID NO: 444384 - DNA, 16 bp, M. musculus
tggagctggaaagatg

SEQ ID NO: 444385 - DNA, 16 bp, M. musculus
tggagctggagataca

SEQ ID NO: 444386 - DNA, 16 bp, M. musculus
tggagctggagccatg

SEQ ID NO: 444387 - DNA, 16 bp, M. musculus
tggagctggagctata

SEQ ID NO: 444388 - DNA, 16 bp, M. musculus
tggagctggagctgag

SEQ ID NO: 444389 - DNA, 16 bp, M. musculus
tggagctggagctggg

SEQ ID NO: 444390 - DNA, 16 bp, M. musculus
tggagctggaggagct

SEQ ID NO: 444391 - DNA, 16 bp, M. musculus
tggagctggagttaca

SEQ ID NO: 444392 - DNA, 16 bp, M. musculus
tggagctggagttaga

SEQ ID NO: 444393 - DNA, 16 bp, M. musculus
tggagctggagttgga

SEQ ID NO: 444394 - DNA, 16 bp, M. musculus
tggagctggcttacag

SEQ ID NO: 444395 - DNA, 16 bp, M. musculus
tggagctggggagatg

SEQ ID NO: 444396 - DNA, 16 bp, M. musculus
tggagctgtcttcaga

SEQ ID NO: 444397 - DNA, 16 bp, M. musculus
tggagctgtgtcaaaa

SEQ ID NO: 444398 - DNA, 16 bp, M. musculus
tggagctgtttgggaa

SEQ ID NO: 444399 - DNA, 16 bp, M. musculus
tggagcttactatgta

SEQ ID NO: 444400 - DNA, 16 bp, M. musculus
tggagcttactggcca

SEQ ID NO: 444401 - DNA, 16 bp, M. musculus
tggagcttgccaagta

SEQ ID NO: 444402 - DNA, 16 bp, M. musculus
tggagcttgctatgta

SEQ ID NO: 444403 - DNA, 16 bp, M. musculus
tggaggaaagacagca

SEQ ID NO: 444404 - DNA, 16 bp, M. musculus
tggaggaaatacagag

SEQ ID NO: 444405 - DNA, 16 bp, M. musculus
tggaggaaatagagaa

SEQ ID NO: 444406 - DNA, 16 bp, M. musculus
tggaggaacactgttt

SEQ ID NO: 444407 - DNA, 16 bp, M. musculus
tggaggaacagagaga

SEQ ID NO: 444408 - DNA, 16 bp, M. musculus
tggaggaactagaaaa

SEQ ID NO: 444409 - DNA, 16 bp, M. musculus
tggaggaagaagaaca

SEQ ID NO: 444410 - DNA, 16 bp, M. musculus
tggaggaagaagaggt

SEQ ID NO: 444411 - DNA, 16 bp, M. musculus
tggaggaagagtgtca

SEQ ID NO: 444412 - DNA, 16 bp, M. musculus
tggaggaagctgagga

SEQ ID NO: 444413 - DNA, 16 bp, M. musculus
tggaggaaggacactt

SEQ ID NO: 444414 - DNA, 16 bp, M. musculus
tggaggaaggactgag

SEQ ID NO: 444415 - DNA, 16 bp, M. musculus
tggaggaaggagctga

SEQ ID NO: 444416 - DNA, 16 bp, M. musculus
tggaggaaggggaaac

SEQ ID NO: 444417 - DNA, 16 bp, M. musculus
tggaggaagtatgtca

SEQ ID NO: 444418 - DNA, 16 bp, M. musculus
tggaggaagtatttca

SEQ ID NO: 444419 - DNA, 16 bp, M. musculus
tggaggaagtggatca

SEQ ID NO: 444420 - DNA, 16 bp, M. musculus
tggaggaatgctgctt

SEQ ID NO: 444421 - DNA, 16 bp, M. musculus
tggaggaattgcagaa

SEQ ID NO: 444422 - DNA, 16 bp, M. musculus
tggaggaatttctttt

SEQ ID NO: 444423 - DNA, 16 bp, M. musculus
tggaggacacacctgt

SEQ ID NO: 444424 - DNA, 16 bp, M. musculus
tggaggacagagaaca

SEQ ID NO: 444425 - DNA, 16 bp, M. musculus
tggaggacagaggaca

SEQ ID NO: 444426 - DNA, 16 bp, M. musculus
tggaggacagcctggt

SEQ ID NO: 444427 - DNA, 16 bp, M. musculus
tggaggagaaagttta

SEQ ID NO: 444428 - DNA, 16 bp, M. musculus
tggaggagagaatctc

SEQ ID NO: 444429 - DNA, 16 bp, M. musculus
tggaggagagagtgtg

SEQ ID NO: 444430 - DNA, 16 bp, M. musculus
tggaggagatggagaa

SEQ ID NO: 444431 - DNA, 16 bp, M. musculus
tggaggagcaagagaa

SEQ ID NO: 444432 - DNA, 16 bp, M. musculus
tggaggagcagaagga

SEQ ID NO: 444433 - DNA, 17 bp, M. musculus
tggaggagctagagaat

SEQ ID NO: 444434 - DNA, 16 bp, M. musculus
tggaggagctagagag

SEQ ID NO: 444435 - DNA, 16 bp, M. musculus
tggaggagctagagga

SEQ ID NO: 444436 - DNA, 16 bp, M. musculus
tggaggagctgaaagt

SEQ ID NO: 444437 - DNA, 16 bp, M. musculus
tggaggagctggagaa

SEQ ID NO: 444438 - DNA, 16 bp, M. musculus
tggaggagctggagag

SEQ ID NO: 444439 - DNA, 17 bp, M. musculus
tggaggagctggaggag

SEQ ID NO: 444440 - DNA, 17 bp, M. musculus
tggaggaggaagcagct

SEQ ID NO: 444441 - DNA, 16 bp, M. musculus
tggaggaggagcactg

SEQ ID NO: 444442 - DNA, 16 bp, M. musculus
tggaggaggagctgag

SEQ ID NO: 444443 - DNA, 16 bp, M. musculus
tggaggaggcagaggc

SEQ ID NO: 444444 - DNA, 16 bp, M. musculus
tggaggaggtcagaag

SEQ ID NO: 444445 - DNA, 16 bp, M. musculus
tggaggaggtgtgcca

SEQ ID NO: 444446 - DNA, 16 bp, M. musculus
tggaggagtactgctt

SEQ ID NO: 444447 - DNA, 16 bp, M. musculus
tggaggagttacagaa

SEQ ID NO: 444448 - DNA, 16 bp, M. musculus
tggaggagttagggta

SEQ ID NO: 444449 - DNA, 16 bp, M. musculus
tggaggatctggttgg

SEQ ID NO: 444450 - DNA, 16 bp, M. musculus
tggaggatgctgggaa

SEQ ID NO: 444451 - DNA, 16 bp, M. musculus
tggaggatgctgggag

SEQ ID NO: 444452 - DNA, 16 bp, M. musculus
tggaggatgtggagaa

SEQ ID NO: 444453 - DNA, 16 bp, M. musculus
tggaggcaaaggcagg

SEQ ID NO: 444454 - DNA, 16 bp, M. musculus
tggaggcaaaggttaa

SEQ ID NO: 444455 - DNA, 16 bp, M. musculus
tggaggcaaggctgca

SEQ ID NO: 444456 - DNA, 16 bp, M. musculus
tggaggcaatttctca

SEQ ID NO: 444457 - DNA, 16 bp, M. musculus
tggaggcacaggcagg

SEQ ID NO: 444458 - DNA, 16 bp, M. musculus
tggaggcactcagaga

SEQ ID NO: 444459 - DNA, 25 bp, M. musculus
tggaggcactcagagctatgagttt

SEQ ID NO: 444460 - DNA, 16 bp, M. musculus
tggaggcactttccca

SEQ ID NO: 444461 - DNA, 16 bp, M. musculus
tggaggcactttctca

SEQ ID NO: 444462 - DNA, 16 bp, M. musculus
tggaggcagaagcagg

SEQ ID NO: 444463 - DNA, 16 bp, M. musculus
tggaggcagagaaaga

SEQ ID NO: 444464 - DNA, 16 bp, M. musculus
tggaggcagagagaga

SEQ ID NO: 444465 - DNA, 16 bp, M. musculus
tggaggcagaggcaga

SEQ ID NO: 444466 - DNA, 16 bp, M. musculus
tggaggcagaggcagg

SEQ ID NO: 444467 - DNA, 16 bp, M. musculus
tggaggcagaggctgg

SEQ ID NO: 444468 - DNA, 16 bp, M. musculus
tggaggcagagggatc

SEQ ID NO: 444469 - DNA, 16 bp, M. musculus
tggaggcagaggtagg

SEQ ID NO: 444470 - DNA, 16 bp, M. musculus
tggaggcagatgtgaa

SEQ ID NO: 444471 - DNA, 16 bp, M. musculus
tggaggcaggagaatt

SEQ ID NO: 444472 - DNA, 16 bp, M. musculus
tggaggcaggagccaa

SEQ ID NO: 444473 - DNA, 16 bp, M. musculus
tggaggcaggagccga

SEQ ID NO: 444474 - DNA, 16 bp, M. musculus
tggaggcaggagctga

SEQ ID NO: 444475 - DNA, 16 bp, M. musculus
tggaggcaggaggagt

SEQ ID NO: 444476 - DNA, 16 bp, M. musculus
tggaggcaggaggatg

SEQ ID NO: 444477 - DNA, 16 bp, M. musculus
tggaggcattcagagc

SEQ ID NO: 444478 - DNA, 16 bp, M. musculus
tggaggcatttactca

SEQ ID NO: 444479 - DNA, 16 bp, M. musculus
tggaggcattttccca

SEQ ID NO: 444480 - DNA, 16 bp, M. musculus
tggaggcattttctca

SEQ ID NO: 444481 - DNA, 16 bp, M. musculus
tggaggccaaaagaga

SEQ ID NO: 444482 - DNA, 16 bp, M. musculus
tggaggccaaaagagg

SEQ ID NO: 444483 - DNA, 16 bp, M. musculus
tggaggccaaggcagg

SEQ ID NO: 444484 - DNA, 16 bp, M. musculus
tggaggccacagggag

SEQ ID NO: 444485 - DNA, 16 bp, M. musculus
tggaggccagaagaca

SEQ ID NO: 444486 - DNA, 16 bp, M. musculus
tggaggccagaagagg

SEQ ID NO: 444487 - DNA, 16 bp, M. musculus
tggaggccagaagtca

SEQ ID NO: 444488 - DNA, 16 bp, M. musculus
tggaggccagactggt

SEQ ID NO: 444489 - DNA, 16 bp, M. musculus
tggaggccagcttggg

SEQ ID NO: 444490 - DNA, 16 bp, M. musculus
tggaggccaggctggc

SEQ ID NO: 444491 - DNA, 16 bp, M. musculus
tggaggccagtctggg

SEQ ID NO: 444492 - DNA, 16 bp, M. musculus
tggaggcccaaggttg

SEQ ID NO: 444493 - DNA, 16 bp, M. musculus
tggaggcccacaccct

SEQ ID NO: 444494 - DNA, 16 bp, M. musculus
tggaggccccaaggag

SEQ ID NO: 444495 - DNA, 16 bp, M. musculus
tggaggccccagagag

SEQ ID NO: 444496 - DNA, 16 bp, M. musculus
tggaggccccagtgag

SEQ ID NO: 444497 - DNA, 16 bp, M. musculus
tggaggcccttcccca

SEQ ID NO: 444498 - DNA, 16 bp, M. musculus
tggaggcgtggtgtgg

SEQ ID NO: 444499 - DNA, 16 bp, M. musculus
tggaggctgaggcagg

SEQ ID NO: 444500 - DNA, 16 bp, M. musculus
tggaggctggaaagat

SEQ ID NO: 444501 - DNA, 16 bp, M. musculus
tggaggctggaagaag

SEQ ID NO: 444502 - DNA, 16 bp, M. musculus
tggaggctggaggctg

SEQ ID NO: 444503 - DNA, 16 bp, M. musculus
tggagggaaaaccagg

SEQ ID NO: 444504 - DNA, 16 bp, M. musculus
tggagggaagccaagg

SEQ ID NO: 444505 - DNA, 16 bp, M. musculus
tggagggaccatggct

SEQ ID NO: 444506 - DNA, 16 bp, M. musculus
tggagggacccacacc

SEQ ID NO: 444507 - DNA, 16 bp, M. musculus
tggagggacccagagg

SEQ ID NO: 444508 - DNA, 16 bp, M. musculus
tggagggaggagctga

SEQ ID NO: 444509 - DNA, 16 bp, M. musculus
tggagggatggctcag

SEQ ID NO: 444510 - DNA, 16 bp, M. musculus
tggagggcgtcatcct

SEQ ID NO: 444511 - DNA, 16 bp, M. musculus
tggagggcttcatcct

SEQ ID NO: 444512 - DNA, 16 bp, M. musculus
tggaggggtaacctgg

SEQ ID NO: 444513 - DNA, 16 bp, M. musculus
tggaggggtgatgctt

SEQ ID NO: 444514 - DNA, 16 bp, M. musculus
tggaggggtgctactt

SEQ ID NO: 444515 - DNA, 16 bp, M. musculus
tggaggggtgctgctt

SEQ ID NO: 444516 - DNA, 16 bp, M. musculus
tggagggtcttggaca

SEQ ID NO: 444517 - DNA, 16 bp, M. musculus
tggagggtggacaggg

SEQ ID NO: 444518 - DNA, 16 bp, M. musculus
tggaggtaaagctgaa

SEQ ID NO: 444519 - DNA, 16 bp, M. musculus
tggaggtcagaagaga

SEQ ID NO: 444520 - DNA, 16 bp, M. musculus
tggaggtcagaagagg

SEQ ID NO: 444521 - DNA, 16 bp, M. musculus
tggaggtcagagaaca

SEQ ID NO: 444522 - DNA, 16 bp, M. musculus
tggaggtcagagccct

SEQ ID NO: 444523 - DNA, 16 bp, M. musculus
tggaggtcagaggaca

SEQ ID NO: 444524 - DNA, 16 bp, M. musculus
tggaggtcagaggtca

SEQ ID NO: 444525 - DNA, 16 bp, M. musculus
tggaggtcagcagagg

SEQ ID NO: 444526 - DNA, 16 bp, M. musculus
tggaggtcaggtgggg

SEQ ID NO: 444527 - DNA, 16 bp, M. musculus
tggaggtcctgcagct

SEQ ID NO: 444528 - DNA, 16 bp, M. musculus
tggaggtctggtttgt

SEQ ID NO: 444529 - DNA, 16 bp, M. musculus
tggaggtgggctttaa

SEQ ID NO: 444530 - DNA, 16 bp, M. musculus
tggaggtgtggccttg

SEQ ID NO: 444531 - DNA, 16 bp, M. musculus
tggaggttatgcttgg

SEQ ID NO: 444532 - DNA, 17 bp, M. musculus
tggaggttcctcagaaa

SEQ ID NO: 444533 - DNA, 16 bp, M. musculus
tggaggttcttcagaa

SEQ ID NO: 444534 - DNA, 16 bp, M. musculus
tggaggttggaggaca

SEQ ID NO: 444535 - DNA, 16 bp, M. musculus
tggagtaaagactgaa

SEQ ID NO: 444536 - DNA, 16 bp, M. musculus
tggagtacctggactt

SEQ ID NO: 444537 - DNA, 16 bp, M. musculus
tggagtactacacagt

SEQ ID NO: 444538 - DNA, 16 bp, M. musculus
tggagtattattcagc

SEQ ID NO: 444539 - DNA, 16 bp, M. musculus
tggagtcaggaggatc

SEQ ID NO: 444540 - DNA, 17 bp, M. musculus
tggagtcagtgactaat

SEQ ID NO: 444541 - DNA, 16 bp, M. musculus
tggagtcatttctctc

SEQ ID NO: 444542 - DNA, 16 bp, M. musculus
tggagtccaagtttga

SEQ ID NO: 444543 - DNA, 16 bp, M. musculus
tggagtccagaagaga

SEQ ID NO: 444544 - DNA, 16 bp, M. musculus
tggagtccagacagaa

SEQ ID NO: 444545 - DNA, 16 bp, M. musculus
tggagtccctgtcctc

SEQ ID NO: 444546 - DNA, 16 bp, M. musculus
tggagtcctgacaaat

SEQ ID NO: 444547 - DNA, 16 bp, M. musculus
tggagtctcactgggt

SEQ ID NO: 444548 - DNA, 17 bp, M. musculus
tggagtctcagggttgt

SEQ ID NO: 444549 - DNA, 16 bp, M. musculus
tggagtctgaacttaa

SEQ ID NO: 444550 - DNA, 16 bp, M. musculus
tggagtctgaggcagg

SEQ ID NO: 444551 - DNA, 16 bp, M. musculus
tggagtctgcctcttt

SEQ ID NO: 444552 - DNA, 16 bp, M. musculus
tggagtctgtggacac

SEQ ID NO: 444553 - DNA, 16 bp, M. musculus
tggagtcttggagtct

SEQ ID NO: 444554 - DNA, 16 bp, M. musculus
tggagtgatagagaca

SEQ ID NO: 444555 - DNA, 16 bp, M. musculus
tggagtgctcagctct

SEQ ID NO: 444556 - DNA, 16 bp, M. musculus
tggagtggaaaccagg

SEQ ID NO: 444557 - DNA, 16 bp, M. musculus
tggagtggaaggggct

SEQ ID NO: 444558 - DNA, 16 bp, M. musculus
tggagtgggcatagca

SEQ ID NO: 444559 - DNA, 16 bp, M. musculus
tggagtgggctttaag

SEQ ID NO: 444560 - DNA, 16 bp, M. musculus
tggagtgtcagaagac

SEQ ID NO: 444561 - DNA, 16 bp, M. musculus
tggagtgtctgaaggc

SEQ ID NO: 444562 - DNA, 16 bp, M. musculus
tggagtgtctggagac

SEQ ID NO: 444563 - DNA, 16 bp, M. musculus
tggagtgtgaaaaata

SEQ ID NO: 444564 - DNA, 16 bp, M. musculus
tggagtgtgacctgag

SEQ ID NO: 444565 - DNA, 16 bp, M. musculus
tggagtgtggttgata

SEQ ID NO: 444566 - DNA, 16 bp, M. musculus
tggagttacagacatg

SEQ ID NO: 444567 - DNA, 16 bp, M. musculus
tggagttacagatgtg

SEQ ID NO: 444568 - DNA, 16 bp, M. musculus
tggagttacagctggt

SEQ ID NO: 444569 - DNA, 16 bp, M. musculus
tggagttataggtggt

SEQ ID NO: 444570 - DNA, 19 bp, M. musculus
tggagttatcacagagaag

SEQ ID NO: 444571 - DNA, 16 bp, M. musculus
tggagttcattgatcc

SEQ ID NO: 444572 - DNA, 16 bp, M. musculus
tggagttccagacagt

SEQ ID NO: 444573 - DNA, 16 bp, M. musculus
tggagttccaggtggt

SEQ ID NO: 444574 - DNA, 16 bp, M. musculus
tggagttcctatcctc

SEQ ID NO: 444575 - DNA, 16 bp, M. musculus
tggagttcctgccctg

SEQ ID NO: 444576 - DNA, 16 bp, M. musculus
tggagttcctgcctgg

SEQ ID NO: 444577 - DNA, 16 bp, M. musculus
tggagttctgaaggct

SEQ ID NO: 444578 - DNA, 16 bp, M. musculus
tggagttctttgttct

SEQ ID NO: 444579 - DNA, 16 bp, M. musculus
tggagttgactggagc

SEQ ID NO: 444580 - DNA, 16 bp, M. musculus
tggagttgcaggtggt

SEQ ID NO: 444581 - DNA, 16 bp, M. musculus
tggagttggagttaga

SEQ ID NO: 444582 - DNA, 16 bp, M. musculus
tggagtttcctctggg

SEQ ID NO: 444583 - DNA, 16 bp, M. musculus
tggagtttcttcaaaa

SEQ ID NO: 444584 - DNA, 16 bp, M. musculus
tggagtttgaggccag

SEQ ID NO: 444585 - DNA, 16 bp, M. musculus
tggagttttccttcaa

SEQ ID NO: 444586 - DNA, 19 bp, M. musculus
tggagttttgatggggatt

SEQ ID NO: 444587 - DNA, 16 bp, M. musculus
tggagttttggatttc

SEQ ID NO: 444588 - DNA, 16 bp, M. musculus
tggataaagaaaatgt

SEQ ID NO: 444589 - DNA, 16 bp, M. musculus
tggataacctggatga

SEQ ID NO: 444590 - DNA, 16 bp, M. musculus
tggataataaagatga

SEQ ID NO: 444591 - DNA, 16 bp, M. musculus
tggataataaagatgg

SEQ ID NO: 444592 - DNA, 16 bp, M. musculus
tggatacagtttctaa

SEQ ID NO: 444593 - DNA, 16 bp, M. musculus
tggatacccttgcatt

SEQ ID NO: 444594 - DNA, 16 bp, M. musculus
tggatactttgttctt

SEQ ID NO: 444595 - DNA, 16 bp, M. musculus
tggatagaacccagat

SEQ ID NO: 444596 - DNA, 16 bp, M. musculus
tggatagagagagaga

SEQ ID NO: 444597 - DNA, 16 bp, M. musculus
tggatagatcctggaa

SEQ ID NO: 444598 - DNA, 16 bp, M. musculus
tggatagatggctcag

SEQ ID NO: 444599 - DNA, 16 bp, M. musculus
tggatagcctttcctt

SEQ ID NO: 444600 - DNA, 16 bp, M. musculus
tggatagtgtgtgtgt

SEQ ID NO: 444601 - DNA, 16 bp, M. musculus
tggatataaaattagc

SEQ ID NO: 444602 - DNA, 16 bp, M. musculus
tggatatcaatgcaaa

SEQ ID NO: 444603 - DNA, 16 bp, M. musculus
tggatatcctggaact

SEQ ID NO: 444604 - DNA, 16 bp, M. musculus
tggatattaggatggc

SEQ ID NO: 444605 - DNA, 16 bp, M. musculus
tggatattttaaagaa

SEQ ID NO: 444606 - DNA, 16 bp, M. musculus
tggatattttattctg

SEQ ID NO: 444607 - DNA, 16 bp, M. musculus
tggatcaaagacctct

SEQ ID NO: 444608 - DNA, 16 bp, M. musculus
tggatcaaagacttca

SEQ ID NO: 444609 - DNA, 16 bp, M. musculus
tggatcaagatataaa

SEQ ID NO: 444610 - DNA, 16 bp, M. musculus
tggatcacaacttctg

SEQ ID NO: 444611 - DNA, 16 bp, M. musculus
tggatcacagagctcc

SEQ ID NO: 444612 - DNA, 16 bp, M. musculus
tggatcacagggatcc

SEQ ID NO: 444613 - DNA, 16 bp, M. musculus
tggatcactccatgtg

SEQ ID NO: 444614 - DNA, 17 bp, M. musculus
tggatcagagggccccc

SEQ ID NO: 444615 - DNA, 16 bp, M. musculus
tggatcagttctcatt

SEQ ID NO: 444616 - DNA, 16 bp, M. musculus
tggatcatacttctca

SEQ ID NO: 444617 - DNA, 16 bp, M. musculus
tggatcatcctgcaca

SEQ ID NO: 444618 - DNA, 16 bp, M. musculus
tggatcatggcaaaag

SEQ ID NO: 444619 - DNA, 16 bp, M. musculus
tggatcatttgaggtg

SEQ ID NO: 444620 - DNA, 16 bp, M. musculus
tggatccatggatccc

SEQ ID NO: 444621 - DNA, 16 bp, M. musculus
tggatcccagacattg

SEQ ID NO: 444622 - DNA, 17 bp, M. musculus
tggatcccattacagat

SEQ ID NO: 444623 - DNA, 16 bp, M. musculus
tggatccccaagtgag

SEQ ID NO: 444624 - DNA, 16 bp, M. musculus
tggatccccaggagct

SEQ ID NO: 444625 - DNA, 16 bp, M. musculus
tggatcccctggcact

SEQ ID NO: 444626 - DNA, 16 bp, M. musculus
tggatccctatgagtt

SEQ ID NO: 444627 - DNA, 16 bp, M. musculus
tggatcctactttggg

SEQ ID NO: 444628 - DNA, 16 bp, M. musculus
tggatcctctggaact

SEQ ID NO: 444629 - DNA, 16 bp, M. musculus
tggatcctggcttggc

SEQ ID NO: 444630 - DNA, 16 bp, M. musculus
tggatctcagctctgc

SEQ ID NO: 444631 - DNA, 16 bp, M. musculus
tggatctctataaatt

SEQ ID NO: 444632 - DNA, 16 bp, M. musculus
tggatctctgagttag

SEQ ID NO: 444633 - DNA, 16 bp, M. musculus
tggatctctgagttcg

SEQ ID NO: 444634 - DNA, 16 bp, M. musculus
tggatctctgagtttg

SEQ ID NO: 444635 - DNA, 16 bp, M. musculus
tggatctctgcatttg

SEQ ID NO: 444636 - DNA, 16 bp, M. musculus
tggatctctgtgaatt

SEQ ID NO: 444637 - DNA, 16 bp, M. musculus
tggatctctgtgagat

SEQ ID NO: 444638 - DNA, 16 bp, M. musculus
tggatctctgtgagtt

SEQ ID NO: 444639 - DNA, 16 bp, M. musculus
tggatctctgtgttaa

SEQ ID NO: 444640 - DNA, 16 bp, M. musculus
tggatctcttgagttc

SEQ ID NO: 444641 - DNA, 20 bp, M. musculus
tggatctcttggaggcattt

SEQ ID NO: 444642 - DNA, 16 bp, M. musculus
tggatctcttggatgc

SEQ ID NO: 444643 - DNA, 16 bp, M. musculus
tggatctgaaggatat

SEQ ID NO: 444644 - DNA, 16 bp, M. musculus
tggatctgacctgaaa

SEQ ID NO: 444645 - DNA, 16 bp, M. musculus
tggatctgagcctggg

SEQ ID NO: 444646 - DNA, 16 bp, M. musculus
tggatctggaacttgc

SEQ ID NO: 444647 - DNA, 16 bp, M. musculus
tggatctggacccttc

SEQ ID NO: 444648 - DNA, 16 bp, M. musculus
tggatctggagggtat

SEQ ID NO: 444649 - DNA, 16 bp, M. musculus
tggatctggatggaag

SEQ ID NO: 444650 - DNA, 16 bp, M. musculus
tggatctggatgggag

SEQ ID NO: 444651 - DNA, 16 bp, M. musculus
tggatctgtttagaaa

SEQ ID NO: 444652 - DNA, 16 bp, M. musculus
tggatcttcaagccca

SEQ ID NO: 444653 - DNA, 16 bp, M. musculus
tggatcttcctctggg

SEQ ID NO: 444654 - DNA, 16 bp, M. musculus
tggatcttctgatagt

SEQ ID NO: 444655 - DNA, 16 bp, M. musculus
tggatcttggaggaga

SEQ ID NO: 444656 - DNA, 17 bp, M. musculus
tggatcttgtttgtgta

SEQ ID NO: 444657 - DNA, 16 bp, M. musculus
tggatctttctgtggt

SEQ ID NO: 444658 - DNA, 16 bp, M. musculus
tggatctttgtgtgct

SEQ ID NO: 444659 - DNA, 16 bp, M. musculus
tggatgaaatggaaaa

SEQ ID NO: 444660 - DNA, 16 bp, M. musculus
tggatgaaatggacaa

SEQ ID NO: 444661 - DNA, 16 bp, M. musculus
tggatgaaatggacat

SEQ ID NO: 444662 - DNA, 16 bp, M. musculus
tggatgaaatggagaa

SEQ ID NO: 444663 - DNA, 16 bp, M. musculus
tggatgaagacacaga

SEQ ID NO: 444664 - DNA, 16 bp, M. musculus
tggatgaagacatgga

SEQ ID NO: 444665 - DNA, 16 bp, M. musculus
tggatgaagatgaaga

SEQ ID NO: 444666 - DNA, 16 bp, M. musculus
tggatgaagatgtaaa

SEQ ID NO: 444667 - DNA, 16 bp, M. musculus
tggatgaagatttaga

SEQ ID NO: 444668 - DNA, 16 bp, M. musculus
tggatgaataaatgaa

SEQ ID NO: 444669 - DNA, 16 bp, M. musculus
tggatgaatgaagaaa

SEQ ID NO: 444670 - DNA, 16 bp, M. musculus
tggatgaatggaagga

SEQ ID NO: 444671 - DNA, 16 bp, M. musculus
tggatgacctgtccat

SEQ ID NO: 444672 - DNA, 16 bp, M. musculus
tggatgactgtgagca

SEQ ID NO: 444673 - DNA, 16 bp, M. musculus
tggatgagaactgaga

SEQ ID NO: 444674 - DNA, 16 bp, M. musculus
tggatgatgccatgct

SEQ ID NO: 444675 - DNA, 16 bp, M. musculus
tggatgatggatggat

SEQ ID NO: 444676 - DNA, 16 bp, M. musculus
tggatgcacatgtgtg

SEQ ID NO: 444677 - DNA, 16 bp, M. musculus
tggatgccaagaagag

SEQ ID NO: 444678 - DNA, 16 bp, M. musculus
tggatgccacagaaga

SEQ ID NO: 444679 - DNA, 16 bp, M. musculus
tggatgccagaaagtg

SEQ ID NO: 444680 - DNA, 16 bp, M. musculus
tggatgcccccaccct

SEQ ID NO: 444681 - DNA, 16 bp, M. musculus
tggatgcccccacctc

SEQ ID NO: 444682 - DNA, 16 bp, M. musculus
tggatgccctggaatt

SEQ ID NO: 444683 - DNA, 16 bp, M. musculus
tggatgctaagaaatg

SEQ ID NO: 444684 - DNA, 16 bp, M. musculus
tggatgctcacagcca

SEQ ID NO: 444685 - DNA, 16 bp, M. musculus
tggatgctcacagcct

SEQ ID NO: 444686 - DNA, 16 bp, M. musculus
tggatgctgattgtgg

SEQ ID NO: 444687 - DNA, 16 bp, M. musculus
tggatgctgccatgct

SEQ ID NO: 444688 - DNA, 16 bp, M. musculus
tggatgctggaaactg

SEQ ID NO: 444689 - DNA, 16 bp, M. musculus
tggatgcttcagtcct

SEQ ID NO: 444690 - DNA, 16 bp, M. musculus
tggatggaactagata

SEQ ID NO: 444691 - DNA, 16 bp, M. musculus
tggatggaactgaaaa

SEQ ID NO: 444692 - DNA, 16 bp, M. musculus
tggatggaatggatgg

SEQ ID NO: 444693 - DNA, 16 bp, M. musculus
tggatggacagacgga

SEQ ID NO: 444694 - DNA, 16 bp, M. musculus
tggatggacagatgga

SEQ ID NO: 444695 - DNA, 16 bp, M. musculus
tggatggagcccaggg

SEQ ID NO: 444696 - DNA, 16 bp, M. musculus
tggatggaggtcaggg

SEQ ID NO: 444697 - DNA, 17 bp, M. musculus
tggatggatcacagggc

SEQ ID NO: 444698 - DNA, 16 bp, M. musculus
tggatggatggaagaa

SEQ ID NO: 444699 - DNA, 17 bp, M. musculus
tggatggatggatggat

SEQ ID NO: 444700 - DNA, 16 bp, M. musculus
tggatggatgggtgga

SEQ ID NO: 444701 - DNA, 16 bp, M. musculus
tggatggatttggagg

SEQ ID NO: 444702 - DNA, 16 bp, M. musculus
tggatggcacctgagg

SEQ ID NO: 444703 - DNA, 16 bp, M. musculus
tggatggccaggaact

SEQ ID NO: 444704 - DNA, 16 bp, M. musculus
tggatggccatttctt

SEQ ID NO: 444705 - DNA, 16 bp, M. musculus
tggatggcctagaact

SEQ ID NO: 444706 - DNA, 16 bp, M. musculus
tggatggcctttccct

SEQ ID NO: 444707 - DNA, 16 bp, M. musculus
tggatggctcctgagg

SEQ ID NO: 444708 - DNA, 16 bp, M. musculus
tggatggctggttcaa

SEQ ID NO: 444709 - DNA, 16 bp, M. musculus
tggatggctttgagca

SEQ ID NO: 444710 - DNA, 21 bp, M. musculus
tggatgggaactgagagtata

SEQ ID NO: 444711 - DNA, 16 bp, M. musculus
tggatgggcagacaga

SEQ ID NO: 444712 - DNA, 16 bp, M. musculus
tggatggggcagagcc

SEQ ID NO: 444713 - DNA, 16 bp, M. musculus
tggatgggtctggagg

SEQ ID NO: 444714 - DNA, 16 bp, M. musculus
tggatgggtggataga

SEQ ID NO: 444715 - DNA, 23 bp, M. musculus
tggatggttgtgagccaccatgt

SEQ ID NO: 444716 - DNA, 16 bp, M. musculus
tggatggttttagctt

SEQ ID NO: 444717 - DNA, 16 bp, M. musculus
tggatggttttatctc

SEQ ID NO: 444718 - DNA, 16 bp, M. musculus
tggatgtaccagtttg

SEQ ID NO: 444719 - DNA, 16 bp, M. musculus
tggatgtagctcagtg

SEQ ID NO: 444720 - DNA, 16 bp, M. musculus
tggatgtatctggatg

SEQ ID NO: 444721 - DNA, 16 bp, M. musculus
tggatgtcaggaagag

SEQ ID NO: 444722 - DNA, 16 bp, M. musculus
tggatgtcataggtta

SEQ ID NO: 444723 - DNA, 16 bp, M. musculus
tggatgtcctagaact

SEQ ID NO: 444724 - DNA, 16 bp, M. musculus
tggatgtcctggaact

SEQ ID NO: 444725 - DNA, 16 bp, M. musculus
tggatgtctgtgagca

SEQ ID NO: 444726 - DNA, 16 bp, M. musculus
tggatgtgaaatgtcc

SEQ ID NO: 444727 - DNA, 16 bp, M. musculus
tggatgtgctttcctg

SEQ ID NO: 444728 - DNA, 22 bp, M. musculus
tggatgtgcttttctgcttccc

SEQ ID NO: 444729 - DNA, 16 bp, M. musculus
tggatgtgtatgcatg

SEQ ID NO: 444730 - DNA, 16 bp, M. musculus
tggatgtgtgcatgtg

SEQ ID NO: 444731 - DNA, 16 bp, M. musculus
tggatgttccatcctt

SEQ ID NO: 444732 - DNA, 16 bp, M. musculus
tggatgttttgcctgc

SEQ ID NO: 444733 - DNA, 16 bp, M. musculus
tggatgttttgtgtca

SEQ ID NO: 444734 - DNA, 16 bp, M. musculus
tggattaaaggtgtgt

SEQ ID NO: 444735 - DNA, 16 bp, M. musculus
tggattaggtctttgt

SEQ ID NO: 444736 - DNA, 16 bp, M. musculus
tggattatgttgatgt

SEQ ID NO: 444737 - DNA, 16 bp, M. musculus
tggattcaactcccca

SEQ ID NO: 444738 - DNA, 16 bp, M. musculus
tggattcaaggccagc

SEQ ID NO: 444739 - DNA, 16 bp, M. musculus
tggattcaagggaagc

SEQ ID NO: 444740 - DNA, 16 bp, M. musculus
tggattcaatttccca

SEQ ID NO: 444741 - DNA, 21 bp, M. musculus
tggattcaccggtatcctggt

SEQ ID NO: 444742 - DNA, 72 bp, M. musculus
tggattcacctgtatcctggtacacctgcgcagcactcaagatgtttgtgtcttatatgaggaagtcaggtg

SEQ ID NO: 444743 - DNA, 16 bp, M. musculus
tggattcagaaaatat

SEQ ID NO: 444744 - DNA, 16 bp, M. musculus
tggattcagaaaatgt

SEQ ID NO: 444745 - DNA, 16 bp, M. musculus
tggattcagtgagaga

SEQ ID NO: 444746 - DNA, 16 bp, M. musculus
tggattcagtttgcaa

SEQ ID NO: 444747 - DNA, 16 bp, M. musculus
tggattccagaagatt

SEQ ID NO: 444748 - DNA, 16 bp, M. musculus
tggattccattacaga

SEQ ID NO: 444749 - DNA, 16 bp, M. musculus
tggattccctggagct

SEQ ID NO: 444750 - DNA, 16 bp, M. musculus
tggattcttcattcct

SEQ ID NO: 444751 - DNA, 16 bp, M. musculus
tggattcttttctcat

SEQ ID NO: 444752 - DNA, 16 bp, M. musculus
tggattgaatcagtca

SEQ ID NO: 444753 - DNA, 16 bp, M. musculus
tggattgatggatgga

SEQ ID NO: 444754 - DNA, 16 bp, M. musculus
tggattgcctttcctt

SEQ ID NO: 444755 - DNA, 16 bp, M. musculus
tggattggattggatt

SEQ ID NO: 444756 - DNA, 16 bp, M. musculus
tggattggtggaaaga

SEQ ID NO: 444757 - DNA, 16 bp, M. musculus
tggattgtaaaaaaag

SEQ ID NO: 444758 - DNA, 16 bp, M. musculus
tggattgtaatgtaaa

SEQ ID NO: 444759 - DNA, 16 bp, M. musculus
tggatttaaaacaaaa

SEQ ID NO: 444760 - DNA, 16 bp, M. musculus
tggatttaacagaaat

SEQ ID NO: 444761 - DNA, 16 bp, M. musculus
tggatttatgtctgtg

SEQ ID NO: 444762 - DNA, 16 bp, M. musculus
tggatttattttcatt

SEQ ID NO: 444763 - DNA, 16 bp, M. musculus
tggatttcagagttcg

SEQ ID NO: 444764 - DNA, 16 bp, M. musculus
tggatttcctggaagt

SEQ ID NO: 444765 - DNA, 16 bp, M. musculus
tggatttcctggacat

SEQ ID NO: 444766 - DNA, 16 bp, M. musculus
tggatttctaagtttg

SEQ ID NO: 444767 - DNA, 16 bp, M. musculus
tggatttctctgagtt

SEQ ID NO: 444768 - DNA, 16 bp, M. musculus
tggatttctgaatttg

SEQ ID NO: 444769 - DNA, 16 bp, M. musculus
tggatttctgagttcg

SEQ ID NO: 444770 - DNA, 16 bp, M. musculus
tggatttctgagttgg

SEQ ID NO: 444771 - DNA, 16 bp, M. musculus
tggatttctgagtttg

SEQ ID NO: 444772 - DNA, 16 bp, M. musculus
tggatttctgatttca

SEQ ID NO: 444773 - DNA, 16 bp, M. musculus
tggatttctgtatgtt

SEQ ID NO: 444774 - DNA, 16 bp, M. musculus
tggatttctgtgactt

SEQ ID NO: 444775 - DNA, 16 bp, M. musculus
tggatttgaagacaca

SEQ ID NO: 444776 - DNA, 16 bp, M. musculus
tggatttgaggaaaga

SEQ ID NO: 444777 - DNA, 16 bp, M. musculus
tggatttgatccccaa

SEQ ID NO: 444778 - DNA, 16 bp, M. musculus
tggatttgatccccag

SEQ ID NO: 444779 - DNA, 16 bp, M. musculus
tggatttgcaaacttt

SEQ ID NO: 444780 - DNA, 18 bp, M. musculus
tggatttgcaggattaat

SEQ ID NO: 444781 - DNA, 16 bp, M. musculus
tggatttggtgtctgt

SEQ ID NO: 444782 - DNA, 16 bp, M. musculus
tggattttaaaaaata

SEQ ID NO: 444783 - DNA, 16 bp, M. musculus
tggattttaaaagaga

SEQ ID NO: 444784 - DNA, 16 bp, M. musculus
tggattttagagtctc

SEQ ID NO: 444785 - DNA, 16 bp, M. musculus
tggattttctggatat

SEQ ID NO: 444786 - DNA, 16 bp, M. musculus
tggattttgccaaatg

SEQ ID NO: 444787 - DNA, 17 bp, M. musculus
tggattttgggactttg

SEQ ID NO: 444788 - DNA, 16 bp, M. musculus
tggatttttaaaaata

SEQ ID NO: 444789 - DNA, 16 bp, M. musculus
tggatttttaaagaaa

SEQ ID NO: 444790 - DNA, 16 bp, M. musculus
tggatttttttcccct

SEQ ID NO: 444791 - DNA, 16 bp, M. musculus
tggattttttttccca

SEQ ID NO: 444792 - DNA, 16 bp, M. musculus
tggatttttttttcaa

SEQ ID NO: 444793 - DNA, 16 bp, M. musculus
tggcaaaaaacaaaac

SEQ ID NO: 444794 - DNA, 16 bp, M. musculus
tggcaaaaacatgttt

SEQ ID NO: 444795 - DNA, 16 bp, M. musculus
tggcaaaaatgtggag

SEQ ID NO: 444796 - DNA, 16 bp, M. musculus
tggcaaaaatttccta

SEQ ID NO: 444797 - DNA, 16 bp, M. musculus
tggcaaaaggcaaagg

SEQ ID NO: 444798 - DNA, 16 bp, M. musculus
tggcaaacacagaagt

SEQ ID NO: 444799 - DNA, 16 bp, M. musculus
tggcaaacactttacc

SEQ ID NO: 444800 - DNA, 16 bp, M. musculus
tggcaaacatggctct

SEQ ID NO: 444801 - DNA, 16 bp, M. musculus
tggcaaactgttttaa

SEQ ID NO: 444802 - DNA, 16 bp, M. musculus
tggcaaagataaaaaa

SEQ ID NO: 444803 - DNA, 16 bp, M. musculus
tggcaaagcacttgcc

SEQ ID NO: 444804 - DNA, 16 bp, M. musculus
tggcaaagcctcacat

SEQ ID NO: 444805 - DNA, 16 bp, M. musculus
tggcaaagccttcctt

SEQ ID NO: 444806 - DNA, 16 bp, M. musculus
tggcaaataaataaat

SEQ ID NO: 444807 - DNA, 16 bp, M. musculus
tggcaaattgatgtca

SEQ ID NO: 444808 - DNA, 16 bp, M. musculus
tggcaacaacaaggta

SEQ ID NO: 444809 - DNA, 16 bp, M. musculus
tggcaacacatgttgg

SEQ ID NO: 444810 - DNA, 16 bp, M. musculus
tggcaacaggtctgca

SEQ ID NO: 444811 - DNA, 16 bp, M. musculus
tggcaagaaaaaacat

SEQ ID NO: 444812 - DNA, 16 bp, M. musculus
tggcaagaagctgcag

SEQ ID NO: 444813 - DNA, 16 bp, M. musculus
tggcaagatggctcag

SEQ ID NO: 444814 - DNA, 16 bp, M. musculus
tggcaagcactttatc

SEQ ID NO: 444815 - DNA, 16 bp, M. musculus
tggcaagctgccacag

SEQ ID NO: 444816 - DNA, 16 bp, M. musculus
tggcaaggaagacaca

SEQ ID NO: 444817 - DNA, 16 bp, M. musculus
tggcaaggatgaggag

SEQ ID NO: 444818 - DNA, 16 bp, M. musculus
tggcaaggatgtggtg

SEQ ID NO: 444819 - DNA, 16 bp, M. musculus
tggcaaggggcagggc

SEQ ID NO: 444820 - DNA, 16 bp, M. musculus
tggcaaggtaccccag

SEQ ID NO: 444821 - DNA, 16 bp, M. musculus
tggcaaggtggctcag

SEQ ID NO: 444822 - DNA, 16 bp, M. musculus
tggcaagtgcctttcc

SEQ ID NO: 444823 - DNA, 16 bp, M. musculus
tggcaagtgctgttct

SEQ ID NO: 444824 - DNA, 16 bp, M. musculus
tggcaagtgctttatt

SEQ ID NO: 444825 - DNA, 16 bp, M. musculus
tggcaagtgcttttat

SEQ ID NO: 444826 - DNA, 16 bp, M. musculus
tggcaatatgttctaa

SEQ ID NO: 444827 - DNA, 16 bp, M. musculus
tggcaatcctggaact

SEQ ID NO: 444828 - DNA, 16 bp, M. musculus
tggcaatgatgtggag

SEQ ID NO: 444829 - DNA, 16 bp, M. musculus
tggcaattcctcagaa

SEQ ID NO: 444830 - DNA, 16 bp, M. musculus
tggcacaactggcaat

SEQ ID NO: 444831 - DNA, 16 bp, M. musculus
tggcacaacttgtggt

SEQ ID NO: 444832 - DNA, 16 bp, M. musculus
tggcacacacacatac

SEQ ID NO: 444833 - DNA, 16 bp, M. musculus
tggcacacacctttat

SEQ ID NO: 444834 - DNA, 16 bp, M. musculus
tggcacacacctttca

SEQ ID NO: 444835 - DNA, 16 bp, M. musculus
tggcacacaggcaggc

SEQ ID NO: 444836 - DNA, 16 bp, M. musculus
tggcacacagtctcct

SEQ ID NO: 444837 - DNA, 17 bp, M. musculus
tggcacactcctttaat

SEQ ID NO: 444838 - DNA, 16 bp, M. musculus
tggcacagacctttaa

SEQ ID NO: 444839 - DNA, 16 bp, M. musculus
tggcacagacttggtg

SEQ ID NO: 444840 - DNA, 16 bp, M. musculus
tggcacagggtcagct

SEQ ID NO: 444841 - DNA, 17 bp, M. musculus
tggcacatgcctttaac

SEQ ID NO: 444842 - DNA, 16 bp, M. musculus
tggcacatgcctttga

SEQ ID NO: 444843 - DNA, 16 bp, M. musculus
tggcacatgtctttaa

SEQ ID NO: 444844 - DNA, 16 bp, M. musculus
tggcacatgtgcacac

SEQ ID NO: 444845 - DNA, 16 bp, M. musculus
tggcaccaacccctcc

SEQ ID NO: 444846 - DNA, 16 bp, M. musculus
tggcaccaacttctgt

SEQ ID NO: 444847 - DNA, 16 bp, M. musculus
tggcaccatccacaat

SEQ ID NO: 444848 - DNA, 16 bp, M. musculus
tggcaccatgcctgcc

SEQ ID NO: 444849 - DNA, 16 bp, M. musculus
tggcacctgagttttt

SEQ ID NO: 444850 - DNA, 16 bp, M. musculus
tggcactatttggagg

SEQ ID NO: 444851 - DNA, 16 bp, M. musculus
tggcactcacaataat

SEQ ID NO: 444852 - DNA, 16 bp, M. musculus
tggcactgaccggaag

SEQ ID NO: 444853 - DNA, 16 bp, M. musculus
tggcactgactggaag

SEQ ID NO: 444854 - DNA, 16 bp, M. musculus
tggcactggagcagca

SEQ ID NO: 444855 - DNA, 16 bp, M. musculus
tggcactggcagagcc

SEQ ID NO: 444856 - DNA, 16 bp, M. musculus
tggcactggtgttccc

SEQ ID NO: 444857 - DNA, 16 bp, M. musculus
tggcactgtgaagaga

SEQ ID NO: 444858 - DNA, 16 bp, M. musculus
tggcacttcctcagaa

SEQ ID NO: 444859 - DNA, 16 bp, M. musculus
tggcagaaaagcacct

SEQ ID NO: 444860 - DNA, 16 bp, M. musculus
tggcagaaagagaagg

SEQ ID NO: 444861 - DNA, 16 bp, M. musculus
tggcagaaagagagaa

SEQ ID NO: 444862 - DNA, 16 bp, M. musculus
tggcagaacctcccaa

SEQ ID NO: 444863 - DNA, 16 bp, M. musculus
tggcagaagatggcct

SEQ ID NO: 444864 - DNA, 16 bp, M. musculus
tggcagaagcatggca

SEQ ID NO: 444865 - DNA, 16 bp, M. musculus
tggcagaaggagagaa

SEQ ID NO: 444866 - DNA, 16 bp, M. musculus
tggcagaagggacaaa

SEQ ID NO: 444867 - DNA, 16 bp, M. musculus
tggcagaagtgtggat

SEQ ID NO: 444868 - DNA, 16 bp, M. musculus
tggcagaagttttgtt

SEQ ID NO: 444869 - DNA, 18 bp, M. musculus
tggcagaatgggccattg

SEQ ID NO: 444870 - DNA, 16 bp, M. musculus
tggcagaatgtaaaag

SEQ ID NO: 444871 - DNA, 16 bp, M. musculus
tggcagacaggagcct

SEQ ID NO: 444872 - DNA, 16 bp, M. musculus
tggcagagattctcag

SEQ ID NO: 444873 - DNA, 16 bp, M. musculus
tggcagagcacttgtc

SEQ ID NO: 444874 - DNA, 16 bp, M. musculus
tggcagagcagctggg

SEQ ID NO: 444875 - DNA, 16 bp, M. musculus
tggcagagcctctcag

SEQ ID NO: 444876 - DNA, 16 bp, M. musculus
tggcagagctctgggc

SEQ ID NO: 444877 - DNA, 16 bp, M. musculus
tggcagagctctgggt

SEQ ID NO: 444878 - DNA, 16 bp, M. musculus
tggcagaggagctgag

SEQ ID NO: 444879 - DNA, 16 bp, M. musculus
tggcagaggcagacag

SEQ ID NO: 444880 - DNA, 16 bp, M. musculus
tggcagaggcaggggg

SEQ ID NO: 444881 - DNA, 16 bp, M. musculus
tggcagaggcccctta

SEQ ID NO: 444882 - DNA, 16 bp, M. musculus
tggcagatcctgtgtg

SEQ ID NO: 444883 - DNA, 16 bp, M. musculus
tggcagcaaacacctt

SEQ ID NO: 444884 - DNA, 16 bp, M. musculus
tggcagcaagcacctt

SEQ ID NO: 444885 - DNA, 16 bp, M. musculus
tggcagcaagcatctt

SEQ ID NO: 444886 - DNA, 16 bp, M. musculus
tggcagcacacacctt

SEQ ID NO: 444887 - DNA, 16 bp, M. musculus
tggcagcacacaggca

SEQ ID NO: 444888 - DNA, 16 bp, M. musculus
tggcagcagacacctt

SEQ ID NO: 444889 - DNA, 16 bp, M. musculus
tggcagcagcagcaac

SEQ ID NO: 444890 - DNA, 16 bp, M. musculus
tggcagcagcagcagc

SEQ ID NO: 444891 - DNA, 16 bp, M. musculus
tggcagcagctgctgc

SEQ ID NO: 444892 - DNA, 16 bp, M. musculus
tggcagcaggaacatg

SEQ ID NO: 444893 - DNA, 16 bp, M. musculus
tggcagcaggaggagg

SEQ ID NO: 444894 - DNA, 16 bp, M. musculus
tggcagccagagtcag

SEQ ID NO: 444895 - DNA, 16 bp, M. musculus
tggcagccccatccct

SEQ ID NO: 444896 - DNA, 16 bp, M. musculus
tggcagccctctgcta

SEQ ID NO: 444897 - DNA, 16 bp, M. musculus
tggcagcctgtggtcc

SEQ ID NO: 444898 - DNA, 16 bp, M. musculus
tggcagccttatttat

SEQ ID NO: 444899 - DNA, 16 bp, M. musculus
tggcagccttggaagc

SEQ ID NO: 444900 - DNA, 16 bp, M. musculus
tggcagctcacaacta

SEQ ID NO: 444901 - DNA, 16 bp, M. musculus
tggcagctcacacctg

SEQ ID NO: 444902 - DNA, 16 bp, M. musculus
tggcagctcttccaga

SEQ ID NO: 444903 - DNA, 16 bp, M. musculus
tggcagctgagatctg

SEQ ID NO: 444904 - DNA, 16 bp, M. musculus
tggcagcttagaactg

SEQ ID NO: 444905 - DNA, 16 bp, M. musculus
tggcagctttggccac

SEQ ID NO: 444906 - DNA, 16 bp, M. musculus
tggcagctttggccat

SEQ ID NO: 444907 - DNA, 16 bp, M. musculus
tggcaggaacagctga

SEQ ID NO: 444908 - DNA, 16 bp, M. musculus
tggcaggaagagagga

SEQ ID NO: 444909 - DNA, 16 bp, M. musculus
tggcaggaagcctggc

SEQ ID NO: 444910 - DNA, 16 bp, M. musculus
tggcaggagcttgaag

SEQ ID NO: 444911 - DNA, 16 bp, M. musculus
tggcaggctgaccagc

SEQ ID NO: 444912 - DNA, 16 bp, M. musculus
tggcaggctgaggcag

SEQ ID NO: 444913 - DNA, 16 bp, M. musculus
tggcagggaatgtgcc

SEQ ID NO: 444914 - DNA, 16 bp, M. musculus
tggcagggcctctcag

SEQ ID NO: 444915 - DNA, 16 bp, M. musculus
tggcagggctggccac

SEQ ID NO: 444916 - DNA, 16 bp, M. musculus
tggcagtaagcacctt

SEQ ID NO: 444917 - DNA, 16 bp, M. musculus
tggcagtatccaagca

SEQ ID NO: 444918 - DNA, 16 bp, M. musculus
tggcagtatccaggta

SEQ ID NO: 444919 - DNA, 16 bp, M. musculus
tggcagtcctgaaact

SEQ ID NO: 444920 - DNA, 16 bp, M. musculus
tggcagtccttctgcc

SEQ ID NO: 444921 - DNA, 16 bp, M. musculus
tggcagtgatggcatg

SEQ ID NO: 444922 - DNA, 16 bp, M. musculus
tggcagtgggcaggca

SEQ ID NO: 444923 - DNA, 16 bp, M. musculus
tggcagtggtggcaca

SEQ ID NO: 444924 - DNA, 16 bp, M. musculus
tggcagtgtcctttgc

SEQ ID NO: 444925 - DNA, 16 bp, M. musculus
tggcagtgtttcttct

SEQ ID NO: 444926 - DNA, 16 bp, M. musculus
tggcagttcctgggga

SEQ ID NO: 444927 - DNA, 16 bp, M. musculus
tggcagtttccaggca

SEQ ID NO: 444928 - DNA, 16 bp, M. musculus
tggcagtttctcagaa

SEQ ID NO: 444929 - DNA, 16 bp, M. musculus
tggcatacacctttaa

SEQ ID NO: 444930 - DNA, 16 bp, M. musculus
tggcatatgcctgtaa

SEQ ID NO: 444931 - DNA, 16 bp, M. musculus
tggcatatgcctttaa

SEQ ID NO: 444932 - DNA, 16 bp, M. musculus
tggcatcaatggaagg

SEQ ID NO: 444933 - DNA, 16 bp, M. musculus
tggcatcaggacctct

SEQ ID NO: 444934 - DNA, 16 bp, M. musculus
tggcatcataagaacc

SEQ ID NO: 444935 - DNA, 16 bp, M. musculus
tggcatcattttcatt

SEQ ID NO: 444936 - DNA, 16 bp, M. musculus
tggcatccagctatgg

SEQ ID NO: 444937 - DNA, 16 bp, M. musculus
tggcatctctctggct

SEQ ID NO: 444938 - DNA, 16 bp, M. musculus
tggcatcttgtaaatt

SEQ ID NO: 444939 - DNA, 16 bp, M. musculus
tggcatctttattgat

SEQ ID NO: 444940 - DNA, 16 bp, M. musculus
tggcatgatcaacatt

SEQ ID NO: 444941 - DNA, 16 bp, M. musculus
tggcatgcaggtgtac

SEQ ID NO: 444942 - DNA, 16 bp, M. musculus
tggcatggctgccctc

SEQ ID NO: 444943 - DNA, 16 bp, M. musculus
tggcatgtggcatgtg

SEQ ID NO: 444944 - DNA, 16 bp, M. musculus
tggcattacagatgtg

SEQ ID NO: 444945 - DNA, 16 bp, M. musculus
tggcattcacaatagt

SEQ ID NO: 444946 - DNA, 16 bp, M. musculus
tggcattcagacttgc

SEQ ID NO: 444947 - DNA, 16 bp, M. musculus
tggcattcccatgtac

SEQ ID NO: 444948 - DNA, 16 bp, M. musculus
tggcattcccctgtat

SEQ ID NO: 444949 - DNA, 16 bp, M. musculus
tggcattctattattt

SEQ ID NO: 444950 - DNA, 16 bp, M. musculus
tggcattggcataaaa

SEQ ID NO: 444951 - DNA, 16 bp, M. musculus
tggcattgtctgcatc

SEQ ID NO: 444952 - DNA, 16 bp, M. musculus
tggcattgttgaagga

SEQ ID NO: 444953 - DNA, 16 bp, M. musculus
tggcatttaaaaaaaa

SEQ ID NO: 444954 - DNA, 16 bp, M. musculus
tggcatttctttcttt

SEQ ID NO: 444955 - DNA, 16 bp, M. musculus
tggcatttcttttctt

SEQ ID NO: 444956 - DNA, 16 bp, M. musculus
tggcatttgcgttctc

SEQ ID NO: 444957 - DNA, 16 bp, M. musculus
tggcatttttttaaaa

SEQ ID NO: 444958 - DNA, 16 bp, M. musculus
tggccaaagctgccaa

SEQ ID NO: 444959 - DNA, 16 bp, M. musculus
tggccaaaggggtctc

SEQ ID NO: 444960 - DNA, 16 bp, M. musculus
tggccaacaactcagt

SEQ ID NO: 444961 - DNA, 17 bp, M. musculus
tggccaacaaggccatc

SEQ ID NO: 444962 - DNA, 16 bp, M. musculus
tggccaacaccccaac

SEQ ID NO: 444963 - DNA, 16 bp, M. musculus
tggccaactaggtcat

SEQ ID NO: 444964 - DNA, 16 bp, M. musculus
tggccaacttggccat

SEQ ID NO: 444965 - DNA, 16 bp, M. musculus
tggccaagaagatcct

SEQ ID NO: 444966 - DNA, 16 bp, M. musculus
tggccaagaagtactt

SEQ ID NO: 444967 - DNA, 18 bp, M. musculus
tggccaagacctctctgg

SEQ ID NO: 444968 - DNA, 16 bp, M. musculus
tggccaaggacaagga

SEQ ID NO: 444969 - DNA, 17 bp, M. musculus
tggccaaggacaaggaa

SEQ ID NO: 444970 - DNA, 16 bp, M. musculus
tggccaagggagtggc

SEQ ID NO: 444971 - DNA, 16 bp, M. musculus
tggccaagtccaagaa

SEQ ID NO: 444972 - DNA, 16 bp, M. musculus
tggccaagtgttcctg

SEQ ID NO: 444973 - DNA, 16 bp, M. musculus
tggccaatgagctcca

SEQ ID NO: 444974 - DNA, 16 bp, M. musculus
tggccaatgagctgag

SEQ ID NO: 444975 - DNA, 29 bp, M. musculus
tggccaatgccttgactctattcctcact

SEQ ID NO: 444976 - DNA, 16 bp, M. musculus
tggccacagccatgtg

SEQ ID NO: 444977 - DNA, 16 bp, M. musculus
tggccacattgaataa

SEQ ID NO: 444978 - DNA, 16 bp, M. musculus
tggccaccaagccagg

SEQ ID NO: 444979 - DNA, 16 bp, M. musculus
tggccactgtgcctca

SEQ ID NO: 444980 - DNA, 16 bp, M. musculus
tggccacttccctgac

SEQ ID NO: 444981 - DNA, 16 bp, M. musculus
tggccacttccttctc

SEQ ID NO: 444982 - DNA, 16 bp, M. musculus
tggccacttcttcctc

SEQ ID NO: 444983 - DNA, 16 bp, M. musculus
tggccagagatttaaa

SEQ ID NO: 444984 - DNA, 16 bp, M. musculus
tggccagcaagcccca

SEQ ID NO: 444985 - DNA, 16 bp, M. musculus
tggccagcaccccaat

SEQ ID NO: 444986 - DNA, 16 bp, M. musculus
tggccagcagaccaca

SEQ ID NO: 444987 - DNA, 16 bp, M. musculus
tggccagcagggggca

SEQ ID NO: 444988 - DNA, 16 bp, M. musculus
tggccagccagcctac

SEQ ID NO: 444989 - DNA, 16 bp, M. musculus
tggccagccagcctca

SEQ ID NO: 444990 - DNA, 16 bp, M. musculus
tggccagccagcctgg

SEQ ID NO: 444991 - DNA, 16 bp, M. musculus
tggccagcctctctct

SEQ ID NO: 444992 - DNA, 16 bp, M. musculus
tggccagcctgatcta

SEQ ID NO: 444993 - DNA, 16 bp, M. musculus
tggccagcctgggcta

SEQ ID NO: 444994 - DNA, 16 bp, M. musculus
tggccagcctggtcta

SEQ ID NO: 444995 - DNA, 16 bp, M. musculus
tggccagctgtctgtg

SEQ ID NO: 444996 - DNA, 16 bp, M. musculus
tggccaggaagcctgg

SEQ ID NO: 444997 - DNA, 16 bp, M. musculus
tggccaggaaggtggc

SEQ ID NO: 444998 - DNA, 16 bp, M. musculus
tggccaggatgtggag

SEQ ID NO: 444999 - DNA, 16 bp, M. musculus
tggccaggcactggca

SEQ ID NO: 445000 - DNA, 16 bp, M. musculus
tggccaggctgcccca

SEQ ID NO: 445001 - DNA, 16 bp, M. musculus
tggccagggctacaca

SEQ ID NO: 445002 - DNA, 16 bp, M. musculus
tggccagtgagcctca

SEQ ID NO: 445003 - DNA, 17 bp, M. musculus
tggccagtgcagaaaac

SEQ ID NO: 445004 - DNA, 16 bp, M. musculus
tggccagttgggcgca

SEQ ID NO: 445005 - DNA, 16 bp, M. musculus
tggccatcactgggaa

SEQ ID NO: 445006 - DNA, 16 bp, M. musculus
tggccatcctggaact

SEQ ID NO: 445007 - DNA, 17 bp, M. musculus
tggccatcctggaactt

SEQ ID NO: 445008 - DNA, 16 bp, M. musculus
tggccatcttgctgaa

SEQ ID NO: 445009 - DNA, 16 bp, M. musculus
tggccatcttggaact

SEQ ID NO: 445010 - DNA, 16 bp, M. musculus
tggccatgaaaatgaa

SEQ ID NO: 445011 - DNA, 16 bp, M. musculus
tggccatgcctcctgg

SEQ ID NO: 445012 - DNA, 16 bp, M. musculus
tggccatgcctctctg

SEQ ID NO: 445013 - DNA, 16 bp, M. musculus
tggccatggcattccc

SEQ ID NO: 445014 - DNA, 16 bp, M. musculus
tggccatggccaagag

SEQ ID NO: 445015 - DNA, 16 bp, M. musculus
tggccatggctgacct

SEQ ID NO: 445016 - DNA, 16 bp, M. musculus
tggccatggctgccct

SEQ ID NO: 445017 - DNA, 16 bp, M. musculus
tggccatggctgtcct

SEQ ID NO: 445018 - DNA, 16 bp, M. musculus
tggccatggtggtaca

SEQ ID NO: 445019 - DNA, 16 bp, M. musculus
tggccatgtctgtgag

SEQ ID NO: 445020 - DNA, 16 bp, M. musculus
tggccatgtgtgtgtg

SEQ ID NO: 445021 - DNA, 16 bp, M. musculus
tggccatgttggagga

SEQ ID NO: 445022 - DNA, 16 bp, M. musculus
tggccattctcattca

SEQ ID NO: 445023 - DNA, 16 bp, M. musculus
tggccattctggaact

SEQ ID NO: 445024 - DNA, 16 bp, M. musculus
tggccattgcccacca

SEQ ID NO: 445025 - DNA, 16 bp, M. musculus
tggccatttgagtttc

SEQ ID NO: 445026 - DNA, 16 bp, M. musculus
tggccattttaccaaa

SEQ ID NO: 445027 - DNA, 17 bp, M. musculus
tggcccaaagatttatt

SEQ ID NO: 445028 - DNA, 16 bp, M. musculus
tggcccaccccaaaat

SEQ ID NO: 445029 - DNA, 16 bp, M. musculus
tggcccagaaagtggc

SEQ ID NO: 445030 - DNA, 16 bp, M. musculus
tggcccagagggctgc

SEQ ID NO: 445031 - DNA, 16 bp, M. musculus
tggcccagattaaagg

SEQ ID NO: 445032 - DNA, 16 bp, M. musculus
tggcccaggaagtggc

SEQ ID NO: 445033 - DNA, 16 bp, M. musculus
tggcccaggagggctt

SEQ ID NO: 445034 - DNA, 16 bp, M. musculus
tggcccaggctggcct

SEQ ID NO: 445035 - DNA, 16 bp, M. musculus
tggcccagggggtggc

SEQ ID NO: 445036 - DNA, 16 bp, M. musculus
tggcccagtggtagag

SEQ ID NO: 445037 - DNA, 16 bp, M. musculus
tggcccagtggttaaa

SEQ ID NO: 445038 - DNA, 16 bp, M. musculus
tggcccatcccaacat

SEQ ID NO: 445039 - DNA, 16 bp, M. musculus
tggcccatgagcttcc

SEQ ID NO: 445040 - DNA, 16 bp, M. musculus
tggccccacaggctca

SEQ ID NO: 445041 - DNA, 16 bp, M. musculus
tggccccacccacaag

SEQ ID NO: 445042 - DNA, 16 bp, M. musculus
tggccccacctacaat

SEQ ID NO: 445043 - DNA, 16 bp, M. musculus
tggcccccaacactga

SEQ ID NO: 445044 - DNA, 16 bp, M. musculus
tggcccccacaggctc

SEQ ID NO: 445045 - DNA, 16 bp, M. musculus
tggcccccagggcttc

SEQ ID NO: 445046 - DNA, 16 bp, M. musculus
tggcccccatagactc

SEQ ID NO: 445047 - DNA, 16 bp, M. musculus
tggcccctcctcactc

SEQ ID NO: 445048 - DNA, 16 bp, M. musculus
tggcccctgtgggcac

SEQ ID NO: 445049 - DNA, 16 bp, M. musculus
tggccctgagggcatg

SEQ ID NO: 445050 - DNA, 16 bp, M. musculus
tggccctgatggtgaa

SEQ ID NO: 445051 - DNA, 16 bp, M. musculus
tggccctgcccacagt

SEQ ID NO: 445052 - DNA, 16 bp, M. musculus
tggccctgcctcagtg

SEQ ID NO: 445053 - DNA, 16 bp, M. musculus
tggccctggagcagta

SEQ ID NO: 445054 - DNA, 16 bp, M. musculus
tggccctggcagttcc

SEQ ID NO: 445055 - DNA, 18 bp, M. musculus
tggccctggcattcccct

SEQ ID NO: 445056 - DNA, 17 bp, M. musculus
tggccctggcattccct

SEQ ID NO: 445057 - DNA, 16 bp, M. musculus
tggccctggccctgcc

SEQ ID NO: 445058 - DNA, 16 bp, M. musculus
tggccctggccctggc

SEQ ID NO: 445059 - DNA, 16 bp, M. musculus
tggccctggcggtccc

SEQ ID NO: 445060 - DNA, 16 bp, M. musculus
tggccctggctgacct

SEQ ID NO: 445061 - DNA, 16 bp, M. musculus
tggccctggctggcct

SEQ ID NO: 445062 - DNA, 16 bp, M. musculus
tggccctggctgtcct

SEQ ID NO: 445063 - DNA, 16 bp, M. musculus
tggccctggcttcccc

SEQ ID NO: 445064 - DNA, 16 bp, M. musculus
tggccctgggattccc

SEQ ID NO: 445065 - DNA, 16 bp, M. musculus
tggccctgggctcttt

SEQ ID NO: 445066 - DNA, 16 bp, M. musculus
tggccctgggctttta

SEQ ID NO: 445067 - DNA, 16 bp, M. musculus
tggccctggggccccc

SEQ ID NO: 445068 - DNA, 21 bp, M. musculus
tggccctggtattcccctgta

SEQ ID NO: 445069 - DNA, 16 bp, M. musculus
tggccctggtgatccc

SEQ ID NO: 445070 - DNA, 16 bp, M. musculus
tggccctggtgctgtt

SEQ ID NO: 445071 - DNA, 16 bp, M. musculus
tggccctggtggcagg

SEQ ID NO: 445072 - DNA, 16 bp, M. musculus
tggccctggtggcatg

SEQ ID NO: 445073 - DNA, 16 bp, M. musculus
tggccctgtgttccat

SEQ ID NO: 445074 - DNA, 16 bp, M. musculus
tggccctgttgaagta

SEQ ID NO: 445075 - DNA, 16 bp, M. musculus
tggccctttaagctga

SEQ ID NO: 445076 - DNA, 16 bp, M. musculus
tggccctttaatacag

SEQ ID NO: 445077 - DNA, 16 bp, M. musculus
tggccggccatgcact

SEQ ID NO: 445078 - DNA, 16 bp, M. musculus
tggccgtcctggaact

SEQ ID NO: 445079 - DNA, 17 bp, M. musculus
tggccgtcctggaactt

SEQ ID NO: 445080 - DNA, 16 bp, M. musculus
tggccgtgtgtgtgtg

SEQ ID NO: 445081 - DNA, 16 bp, M. musculus
tggcctaaaactcaca

SEQ ID NO: 445082 - DNA, 17 bp, M. musculus
tggcctacagagtgagt

SEQ ID NO: 445083 - DNA, 16 bp, M. musculus
tggcctacatgaaccg

SEQ ID NO: 445084 - DNA, 16 bp, M. musculus
tggcctagaacttgct

SEQ ID NO: 445085 - DNA, 16 bp, M. musculus
tggcctagaagttttg

SEQ ID NO: 445086 - DNA, 16 bp, M. musculus
tggcctagtcaggcat

SEQ ID NO: 445087 - DNA, 16 bp, M. musculus
tggcctatctagtctc

SEQ ID NO: 445088 - DNA, 16 bp, M. musculus
tggcctatggccatgt

SEQ ID NO: 445089 - DNA, 16 bp, M. musculus
tggcctcaaaactcac

SEQ ID NO: 445090 - DNA, 16 bp, M. musculus
tggcctcaaactaaca

SEQ ID NO: 445091 - DNA, 16 bp, M. musculus
tggcctcaaactcatg

SEQ ID NO: 445092 - DNA, 16 bp, M. musculus
tggcctcaaactccag

SEQ ID NO: 445093 - DNA, 16 bp, M. musculus
tggcctcaaactctcc

SEQ ID NO: 445094 - DNA, 16 bp, M. musculus
tggcctcaaacttact

SEQ ID NO: 445095 - DNA, 16 bp, M. musculus
tggcctcaaacttaga

SEQ ID NO: 445096 - DNA, 16 bp, M. musculus
tggcctcaaacttgtg

SEQ ID NO: 445097 - DNA, 16 bp, M. musculus
tggcctcaaagtcact

SEQ ID NO: 445098 - DNA, 16 bp, M. musculus
tggcctcaaattaact

SEQ ID NO: 445099 - DNA, 16 bp, M. musculus
tggcctcaaattcact

SEQ ID NO: 445100 - DNA, 16 bp, M. musculus
tggcctcaagctcaga

SEQ ID NO: 445101 - DNA, 16 bp, M. musculus
tggcctcaagtctctt

SEQ ID NO: 445102 - DNA, 16 bp, M. musculus
tggcctcacagagatc

SEQ ID NO: 445103 - DNA, 16 bp, M. musculus
tggcctcagactcaca

SEQ ID NO: 445104 - DNA, 16 bp, M. musculus
tggcctcagactcagt

SEQ ID NO: 445105 - DNA, 16 bp, M. musculus
tggcctcagacttaca

SEQ ID NO: 445106 - DNA, 16 bp, M. musculus
tggcctcagcatcagc

SEQ ID NO: 445107 - DNA, 16 bp, M. musculus
tggcctcaggtgacag

SEQ ID NO: 445108 - DNA, 16 bp, M. musculus
tggcctcaggtggcag

SEQ ID NO: 445109 - DNA, 16 bp, M. musculus
tggcctcagtgagaga

SEQ ID NO: 445110 - DNA, 16 bp, M. musculus
tggcctcagtggaaga

SEQ ID NO: 445111 - DNA, 16 bp, M. musculus
tggcctcagtgggaaa

SEQ ID NO: 445112 - DNA, 16 bp, M. musculus
tggcctcattcttttc

SEQ ID NO: 445113 - DNA, 16 bp, M. musculus
tggcctcattggagga

SEQ ID NO: 445114 - DNA, 16 bp, M. musculus
tggcctccaaggacac

SEQ ID NO: 445115 - DNA, 16 bp, M. musculus
tggcctccacaggctc

SEQ ID NO: 445116 - DNA, 16 bp, M. musculus
tggcctccacgggcac

SEQ ID NO: 445117 - DNA, 17 bp, M. musculus
tggcctccaggtccatc

SEQ ID NO: 445118 - DNA, 16 bp, M. musculus
tggcctccataggcac

SEQ ID NO: 445119 - DNA, 16 bp, M. musculus
tggcctccatgaggcc

SEQ ID NO: 445120 - DNA, 16 bp, M. musculus
tggcctcctctggcct

SEQ ID NO: 445121 - DNA, 16 bp, M. musculus
tggcctcctggcctcc

SEQ ID NO: 445122 - DNA, 16 bp, M. musculus
tggcctccttgggtac

SEQ ID NO: 445123 - DNA, 22 bp, M. musculus
tggcctcgaactcagaaatcct

SEQ ID NO: 445124 - DNA, 18 bp, M. musculus
tggcctcgaactcagaac

SEQ ID NO: 445125 - DNA, 16 bp, M. musculus
tggcctcggtgggaga

SEQ ID NO: 445126 - DNA, 16 bp, M. musculus
tggcctctataggcat

SEQ ID NO: 445127 - DNA, 16 bp, M. musculus
tggcctctcagagtgc

SEQ ID NO: 445128 - DNA, 16 bp, M. musculus
tggcctctcctcccac

SEQ ID NO: 445129 - DNA, 16 bp, M. musculus
tggcctctcctggcct

SEQ ID NO: 445130 - DNA, 16 bp, M. musculus
tggcctctccttcagt

SEQ ID NO: 445131 - DNA, 16 bp, M. musculus
tggcctctctcagtgc

SEQ ID NO: 445132 - DNA, 17 bp, M. musculus
tggcctctgaatcagct

SEQ ID NO: 445133 - DNA, 16 bp, M. musculus
tggcctctgacctcca

SEQ ID NO: 445134 - DNA, 16 bp, M. musculus
tggcctctgagggcac

SEQ ID NO: 445135 - DNA, 16 bp, M. musculus
tggcctctgcagcagc

SEQ ID NO: 445136 - DNA, 16 bp, M. musculus
tggcctctgcaggcat

SEQ ID NO: 445137 - DNA, 16 bp, M. musculus
tggcctctgcaggtac

SEQ ID NO: 445138 - DNA, 16 bp, M. musculus
tggcctctgcatcagc

SEQ ID NO: 445139 - DNA, 16 bp, M. musculus
tggcctctgcctcagc

SEQ ID NO: 445140 - DNA, 16 bp, M. musculus
tggcctctgcctccct

SEQ ID NO: 445141 - DNA, 16 bp, M. musculus
tggcctctgcctcctg

SEQ ID NO: 445142 - DNA, 16 bp, M. musculus
tggcctctgcgggcac

SEQ ID NO: 445143 - DNA, 16 bp, M. musculus
tggcctctgcttcact

SEQ ID NO: 445144 - DNA, 16 bp, M. musculus
tggcctctggtctcca

SEQ ID NO: 445145 - DNA, 16 bp, M. musculus
tggcctctgtgaggcc

SEQ ID NO: 445146 - DNA, 16 bp, M. musculus
tggcctctgtggcacc

SEQ ID NO: 445147 - DNA, 16 bp, M. musculus
tggcctctgtgggcac

SEQ ID NO: 445148 - DNA, 16 bp, M. musculus
tggcctctgtggtcac

SEQ ID NO: 445149 - DNA, 16 bp, M. musculus
tggcctctgtgtgcac

SEQ ID NO: 445150 - DNA, 16 bp, M. musculus
tggcctctgtttcttt

SEQ ID NO: 445151 - DNA, 16 bp, M. musculus
tggcctcttacagtgc

SEQ ID NO: 445152 - DNA, 16 bp, M. musculus
tggcctcttctggcct

SEQ ID NO: 445153 - DNA, 16 bp, M. musculus
tggcctgcatgctgag

SEQ ID NO: 445154 - DNA, 16 bp, M. musculus
tggcctgctcagcctg

SEQ ID NO: 445155 - DNA, 35 bp, M. musculus
tggcctgctgtgcgtggatgggaactgagagtata

SEQ ID NO: 445156 - DNA, 16 bp, M. musculus
tggcctggaacccaca

SEQ ID NO: 445157 - DNA, 16 bp, M. musculus
tggcctggaactcatt

SEQ ID NO: 445158 - DNA, 16 bp, M. musculus
tggcctggaactcccc

SEQ ID NO: 445159 - DNA, 16 bp, M. musculus
tggcctggaactctct

SEQ ID NO: 445160 - DNA, 16 bp, M. musculus
tggcctggcctggcct

SEQ ID NO: 445161 - DNA, 16 bp, M. musculus
tggcctgggaacacag

SEQ ID NO: 445162 - DNA, 16 bp, M. musculus
tggcctgggactcaca

SEQ ID NO: 445163 - DNA, 16 bp, M. musculus
tggcctggtgggagcc

SEQ ID NO: 445164 - DNA, 16 bp, M. musculus
tggcctgtctctacac

SEQ ID NO: 445165 - DNA, 16 bp, M. musculus
tggcctgtggcctgtg

SEQ ID NO: 445166 - DNA, 16 bp, M. musculus
tggccttaaacttact

SEQ ID NO: 445167 - DNA, 16 bp, M. musculus
tggccttatttgtgat

SEQ ID NO: 445168 - DNA, 16 bp, M. musculus
tggccttcaagggcac

SEQ ID NO: 445169 - DNA, 16 bp, M. musculus
tggccttcacatgcat

SEQ ID NO: 445170 - DNA, 16 bp, M. musculus
tggccttcagatgaag

SEQ ID NO: 445171 - DNA, 16 bp, M. musculus
tggccttcatcttcag

SEQ ID NO: 445172 - DNA, 16 bp, M. musculus
tggccttccactggag

SEQ ID NO: 445173 - DNA, 16 bp, M. musculus
tggccttcctctacac

SEQ ID NO: 445174 - DNA, 16 bp, M. musculus
tggccttcctggaact

SEQ ID NO: 445175 - DNA, 16 bp, M. musculus
tggccttcctggagga

SEQ ID NO: 445176 - DNA, 16 bp, M. musculus
tggccttctggcagga

SEQ ID NO: 445177 - DNA, 16 bp, M. musculus
tggccttcttagagga

SEQ ID NO: 445178 - DNA, 16 bp, M. musculus
tggccttgaaatcatg

SEQ ID NO: 445179 - DNA, 16 bp, M. musculus
tggccttgaactcaaa

SEQ ID NO: 445180 - DNA, 16 bp, M. musculus
tggccttgaactcaca

SEQ ID NO: 445181 - DNA, 17 bp, M. musculus
tggccttgaactcacaa

SEQ ID NO: 445182 - DNA, 21 bp, M. musculus
tggccttgaactcagaaatcc

SEQ ID NO: 445183 - DNA, 16 bp, M. musculus
tggccttgaactcagg

SEQ ID NO: 445184 - DNA, 16 bp, M. musculus
tggccttgaactcatt

SEQ ID NO: 445185 - DNA, 16 bp, M. musculus
tggccttgaactccta

SEQ ID NO: 445186 - DNA, 16 bp, M. musculus
tggccttgaacttaga

SEQ ID NO: 445187 - DNA, 16 bp, M. musculus
tggccttgaacttctg

SEQ ID NO: 445188 - DNA, 16 bp, M. musculus
tggccttgaacttgtg

SEQ ID NO: 445189 - DNA, 16 bp, M. musculus
tggccttgaactttca

SEQ ID NO: 445190 - DNA, 16 bp, M. musculus
tggccttgaactttgt

SEQ ID NO: 445191 - DNA, 16 bp, M. musculus
tggccttgaattcact

SEQ ID NO: 445192 - DNA, 16 bp, M. musculus
tggccttgacctcctg

SEQ ID NO: 445193 - DNA, 16 bp, M. musculus
tggccttgagctcatg

SEQ ID NO: 445194 - DNA, 16 bp, M. musculus
tggccttgagcttgct

SEQ ID NO: 445195 - DNA, 16 bp, M. musculus
tggccttgcactcaga

SEQ ID NO: 445196 - DNA, 16 bp, M. musculus
tggccttgcagaaggg

SEQ ID NO: 445197 - DNA, 16 bp, M. musculus
tggccttgctgaaaga

SEQ ID NO: 445198 - DNA, 16 bp, M. musculus
tggccttgctggaaga

SEQ ID NO: 445199 - DNA, 16 bp, M. musculus
tggccttggtgggaga

SEQ ID NO: 445200 - DNA, 16 bp, M. musculus
tggccttgttagagta

SEQ ID NO: 445201 - DNA, 16 bp, M. musculus
tggccttgttggaata

SEQ ID NO: 445202 - DNA, 16 bp, M. musculus
tggccttgttggagaa

SEQ ID NO: 445203 - DNA, 16 bp, M. musculus
tggccttgttggatga

SEQ ID NO: 445204 - DNA, 16 bp, M. musculus
tggccttgttggccat

SEQ ID NO: 445205 - DNA, 16 bp, M. musculus
tggccttgttggggga

SEQ ID NO: 445206 - DNA, 16 bp, M. musculus
tggcctttcattcagt

SEQ ID NO: 445207 - DNA, 16 bp, M. musculus
tggcctttctctactc

SEQ ID NO: 445208 - DNA, 16 bp, M. musculus
tggcctttgactgata

SEQ ID NO: 445209 - DNA, 16 bp, M. musculus
tggcctttggtggtaa

SEQ ID NO: 445210 - DNA, 16 bp, M. musculus
tggccttttcattgtg

SEQ ID NO: 445211 - DNA, 16 bp, M. musculus
tggccttttctaaaca

SEQ ID NO: 445212 - DNA, 16 bp, M. musculus
tggcctttttcctcct

SEQ ID NO: 445213 - DNA, 16 bp, M. musculus
tggcgagatggctcaa

SEQ ID NO: 445214 - DNA, 16 bp, M. musculus
tggcgaggaggtggag

SEQ ID NO: 445215 - DNA, 16 bp, M. musculus
tggcgagggtgtggag

SEQ ID NO: 445216 - DNA, 17 bp, M. musculus
tggcgcacgcctttaac

SEQ ID NO: 445217 - DNA, 17 bp, M. musculus
tggcgcccgaacaggga

SEQ ID NO: 445218 - DNA, 16 bp, M. musculus
tggcgccctcttctgg

SEQ ID NO: 445219 - DNA, 18 bp, M. musculus
tggcgcctgaacagggac

SEQ ID NO: 445220 - DNA, 16 bp, M. musculus
tggcgctctctctctc

SEQ ID NO: 445221 - DNA, 16 bp, M. musculus
tggcggcagcagcagc

SEQ ID NO: 445222 - DNA, 18 bp, M. musculus
tggcggctcctcagaaaa

SEQ ID NO: 445223 - DNA, 16 bp, M. musculus
tggcgtcttccttgct

SEQ ID NO: 445224 - DNA, 16 bp, M. musculus
tggcgtgcacccaaga

SEQ ID NO: 445225 - DNA, 16 bp, M. musculus
tggctaagagcattgg

SEQ ID NO: 445226 - DNA, 16 bp, M. musculus
tggctaagataaaaaa

SEQ ID NO: 445227 - DNA, 16 bp, M. musculus
tggctaagatcaaacc

SEQ ID NO: 445228 - DNA, 16 bp, M. musculus
tggctaaggatgctga

SEQ ID NO: 445229 - DNA, 16 bp, M. musculus
tggctaaggtcaccca

SEQ ID NO: 445230 - DNA, 16 bp, M. musculus
tggctaatatccactt

SEQ ID NO: 445231 - DNA, 16 bp, M. musculus
tggctaatggcagcca

SEQ ID NO: 445232 - DNA, 17 bp, M. musculus
tggctacacaagcagga

SEQ ID NO: 445233 - DNA, 16 bp, M. musculus
tggctacaggaggtga

SEQ ID NO: 445234 - DNA, 16 bp, M. musculus
tggctaccctgaaact

SEQ ID NO: 445235 - DNA, 16 bp, M. musculus
tggctacttcataact

SEQ ID NO: 445236 - DNA, 16 bp, M. musculus
tggctagactagctgg

SEQ ID NO: 445237 - DNA, 16 bp, M. musculus
tggctagactggctgc

SEQ ID NO: 445238 - DNA, 16 bp, M. musculus
tggctagcctggaact

SEQ ID NO: 445239 - DNA, 16 bp, M. musculus
tggctataataaataa

SEQ ID NO: 445240 - DNA, 17 bp, M. musculus
tggctatacaaacagga

SEQ ID NO: 445241 - DNA, 16 bp, M. musculus
tggctatccccagttc

SEQ ID NO: 445242 - DNA, 16 bp, M. musculus
tggctatcctctgaga

SEQ ID NO: 445243 - DNA, 16 bp, M. musculus
tggctatcctggaaca

SEQ ID NO: 445244 - DNA, 16 bp, M. musculus
tggctatcctggaact

SEQ ID NO: 445245 - DNA, 16 bp, M. musculus
tggctatcctggagct

SEQ ID NO: 445246 - DNA, 16 bp, M. musculus
tggctatcctggatct

SEQ ID NO: 445247 - DNA, 16 bp, M. musculus
tggctatcttgaggga

SEQ ID NO: 445248 - DNA, 16 bp, M. musculus
tggctatcttggaact

SEQ ID NO: 445249 - DNA, 16 bp, M. musculus
tggctatcttttttta

SEQ ID NO: 445250 - DNA, 16 bp, M. musculus
tggctatgacagtcct

SEQ ID NO: 445251 - DNA, 16 bp, M. musculus
tggctatgagactata

SEQ ID NO: 445252 - DNA, 16 bp, M. musculus
tggctatggctatggc

SEQ ID NO: 445253 - DNA, 16 bp, M. musculus
tggctatgggaagcca

SEQ ID NO: 445254 - DNA, 16 bp, M. musculus
tggctattctagaact

SEQ ID NO: 445255 - DNA, 16 bp, M. musculus
tggctattctggaact

SEQ ID NO: 445256 - DNA, 16 bp, M. musculus
tggctattcttccaaa

SEQ ID NO: 445257 - DNA, 16 bp, M. musculus
tggctattggcttgtt

SEQ ID NO: 445258 - DNA, 16 bp, M. musculus
tggctattgtaaatag

SEQ ID NO: 445259 - DNA, 16 bp, M. musculus
tggctattttctttat

SEQ ID NO: 445260 - DNA, 16 bp, M. musculus
tggctcaatggttaaa

SEQ ID NO: 445261 - DNA, 16 bp, M. musculus
tggctcacaaacacct

SEQ ID NO: 445262 - DNA, 16 bp, M. musculus
tggctcacaaacatcc

SEQ ID NO: 445263 - DNA, 16 bp, M. musculus
tggctcacaactaact

SEQ ID NO: 445264 - DNA, 16 bp, M. musculus
tggctcacacccatcc

SEQ ID NO: 445265 - DNA, 16 bp, M. musculus
tggctcacagaggccc

SEQ ID NO: 445266 - DNA, 16 bp, M. musculus
tggctcacagtctcag

SEQ ID NO: 445267 - DNA, 16 bp, M. musculus
tggctcacagtttgga

SEQ ID NO: 445268 - DNA, 16 bp, M. musculus
tggctcacccacaccc

SEQ ID NO: 445269 - DNA, 18 bp, M. musculus
tggctcacgcctttaatc

SEQ ID NO: 445270 - DNA, 16 bp, M. musculus
tggctcacggtttgag

SEQ ID NO: 445271 - DNA, 16 bp, M. musculus
tggctcactggataaa

SEQ ID NO: 445272 - DNA, 16 bp, M. musculus
tggctcagagggtaaa

SEQ ID NO: 445273 - DNA, 16 bp, M. musculus
tggctcagaggtgaag

SEQ ID NO: 445274 - DNA, 16 bp, M. musculus
tggctcagaggttaaa

SEQ ID NO: 445275 - DNA, 16 bp, M. musculus
tggctcagcagatgag

SEQ ID NO: 445276 - DNA, 16 bp, M. musculus
tggctcagcagcagag

SEQ ID NO: 445277 - DNA, 16 bp, M. musculus
tggctcagcagttaag

SEQ ID NO: 445278 - DNA, 16 bp, M. musculus
tggctcagccaataaa

SEQ ID NO: 445279 - DNA, 16 bp, M. musculus
tggctcagccattaaa

SEQ ID NO: 445280 - DNA, 16 bp, M. musculus
tggctcagcctgctct

SEQ ID NO: 445281 - DNA, 16 bp, M. musculus
tggctcagcgggtaag

SEQ ID NO: 445282 - DNA, 16 bp, M. musculus
tggctcagcggtaaag

SEQ ID NO: 445283 - DNA, 18 bp, M. musculus
tggctcagcggttaagaa

SEQ ID NO: 445284 - DNA, 16 bp, M. musculus
tggctcagctctagca

SEQ ID NO: 445285 - DNA, 16 bp, M. musculus
tggctcagctggtgaa

SEQ ID NO: 445286 - DNA, 16 bp, M. musculus
tggctcagctgttaaa

SEQ ID NO: 445287 - DNA, 16 bp, M. musculus
tggctcaggggtggag

SEQ ID NO: 445288 - DNA, 16 bp, M. musculus
tggctcagtagctaaa

SEQ ID NO: 445289 - DNA, 16 bp, M. musculus
tggctcagtcagtaaa

SEQ ID NO: 445290 - DNA, 16 bp, M. musculus
tggctcagtcagtcaa

SEQ ID NO: 445291 - DNA, 16 bp, M. musculus
tggctcagtctctgag

SEQ ID NO: 445292 - DNA, 16 bp, M. musculus
tggctcagtctctggg

SEQ ID NO: 445293 - DNA, 16 bp, M. musculus
tggctcagtgcctaag

SEQ ID NO: 445294 - DNA, 16 bp, M. musculus
tggctcagtgggcaga

SEQ ID NO: 445295 - DNA, 16 bp, M. musculus
tggctcagtggggaaa

SEQ ID NO: 445296 - DNA, 16 bp, M. musculus
tggctcagtgggtaaa

SEQ ID NO: 445297 - DNA, 22 bp, M. musculus
tggctcagtgggtaagagcact

SEQ ID NO: 445298 - DNA, 16 bp, M. musculus
tggctcagtgggtaga

SEQ ID NO: 445299 - DNA, 16 bp, M. musculus
tggctcagtggtagag

SEQ ID NO: 445300 - DNA, 23 bp, M. musculus
tggctcagtggttaagagcactt

SEQ ID NO: 445301 - DNA, 16 bp, M. musculus
tggctcagttggcaga

SEQ ID NO: 445302 - DNA, 16 bp, M. musculus
tggctcagttggtaaa

SEQ ID NO: 445303 - DNA, 16 bp, M. musculus
tggctcataaccttct

SEQ ID NO: 445304 - DNA, 16 bp, M. musculus
tggctcataactgtct

SEQ ID NO: 445305 - DNA, 16 bp, M. musculus
tggctcatgcctgcaa

SEQ ID NO: 445306 - DNA, 16 bp, M. musculus
tggctcatgcctgtaa

SEQ ID NO: 445307 - DNA, 16 bp, M. musculus
tggctcatgctttaag

SEQ ID NO: 445308 - DNA, 16 bp, M. musculus
tggctcatggtttctg

SEQ ID NO: 445309 - DNA, 16 bp, M. musculus
tggctcatggtttgag

SEQ ID NO: 445310 - DNA, 16 bp, M. musculus
tggctcattctctctt

SEQ ID NO: 445311 - DNA, 16 bp, M. musculus
tggctccaaaaagaaa

SEQ ID NO: 445312 - DNA, 16 bp, M. musculus
tggctccaaactttgt

SEQ ID NO: 445313 - DNA, 16 bp, M. musculus
tggctccacctccatc

SEQ ID NO: 445314 - DNA, 16 bp, M. musculus
tggctccagccacatg

SEQ ID NO: 445315 - DNA, 16 bp, M. musculus
tggctccagctccagg

SEQ ID NO: 445316 - DNA, 16 bp, M. musculus
tggctccagctgcaaa

SEQ ID NO: 445317 - DNA, 16 bp, M. musculus
tggctccagctgcaca

SEQ ID NO: 445318 - DNA, 16 bp, M. musculus
tggctccagctgcaga

SEQ ID NO: 445319 - DNA, 16 bp, M. musculus
tggctccaggactcca

SEQ ID NO: 445320 - DNA, 16 bp, M. musculus
tggctcccgccggagc

SEQ ID NO: 445321 - DNA, 16 bp, M. musculus
tggctccgcctgtccc

SEQ ID NO: 445322 - DNA, 16 bp, M. musculus
tggctccgtggttaaa

SEQ ID NO: 445323 - DNA, 16 bp, M. musculus
tggctcctccagcatc

SEQ ID NO: 445324 - DNA, 16 bp, M. musculus
tggctcctcttccaga

SEQ ID NO: 445325 - DNA, 17 bp, M. musculus
tggctcctgacttcttt

SEQ ID NO: 445326 - DNA, 16 bp, M. musculus
tggctcctggctcctg

SEQ ID NO: 445327 - DNA, 16 bp, M. musculus
tggctcctgtcacagc

SEQ ID NO: 445328 - DNA, 16 bp, M. musculus
tggctcctgtgctctc

SEQ ID NO: 445329 - DNA, 16 bp, M. musculus
tggctcctgtgtgtgt

SEQ ID NO: 445330 - DNA, 16 bp, M. musculus
tggctctcacaatctt

SEQ ID NO: 445331 - DNA, 16 bp, M. musculus
tggctctcctagaact

SEQ ID NO: 445332 - DNA, 16 bp, M. musculus
tggctctcctggaact

SEQ ID NO: 445333 - DNA, 16 bp, M. musculus
tggctctctgggcttc

SEQ ID NO: 445334 - DNA, 16 bp, M. musculus
tggctctctgtccttt

SEQ ID NO: 445335 - DNA, 16 bp, M. musculus
tggctctgaacagcaa

SEQ ID NO: 445336 - DNA, 16 bp, M. musculus
tggctctgaagagact

SEQ ID NO: 445337 - DNA, 16 bp, M. musculus
tggctctgagccacca

SEQ ID NO: 445338 - DNA, 16 bp, M. musculus
tggctctgaggtcatg

SEQ ID NO: 445339 - DNA, 16 bp, M. musculus
tggctctgatgtagaa

SEQ ID NO: 445340 - DNA, 16 bp, M. musculus
tggctctggctgtcct

SEQ ID NO: 445341 - DNA, 16 bp, M. musculus
tggctctgtgctggtg

SEQ ID NO: 445342 - DNA, 16 bp, M. musculus
tggctctgtggctctg

SEQ ID NO: 445343 - DNA, 16 bp, M. musculus
tggctctgttggtaaa

SEQ ID NO: 445344 - DNA, 16 bp, M. musculus
tggctcttacactctt

SEQ ID NO: 445345 - DNA, 16 bp, M. musculus
tggctcttatagtctt

SEQ ID NO: 445346 - DNA, 16 bp, M. musculus
tggctcttctagctca

SEQ ID NO: 445347 - DNA, 16 bp, M. musculus
tggctcttgctgcata

SEQ ID NO: 445348 - DNA, 16 bp, M. musculus
tggctcttgcttctgc

SEQ ID NO: 445349 - DNA, 16 bp, M. musculus
tggctctttctcattc

SEQ ID NO: 445350 - DNA, 16 bp, M. musculus
tggctctttctgtctt

SEQ ID NO: 445351 - DNA, 16 bp, M. musculus
tggctctttctgtggt

SEQ ID NO: 445352 - DNA, 19 bp, M. musculus
tggctgaaaggaccctgat

SEQ ID NO: 445353 - DNA, 16 bp, M. musculus
tggctgaagcacgtgg

SEQ ID NO: 445354 - DNA, 16 bp, M. musculus
tggctgaagccatggg

SEQ ID NO: 445355 - DNA, 16 bp, M. musculus
tggctgaagctgcatg

SEQ ID NO: 445356 - DNA, 16 bp, M. musculus
tggctgaatatttgat

SEQ ID NO: 445357 - DNA, 16 bp, M. musculus
tggctgaccagcaaac

SEQ ID NO: 445358 - DNA, 16 bp, M. musculus
tggctgacctagaact

SEQ ID NO: 445359 - DNA, 16 bp, M. musculus
tggctgacctagaatt

SEQ ID NO: 445360 - DNA, 16 bp, M. musculus
tggctgacctggaaat

SEQ ID NO: 445361 - DNA, 16 bp, M. musculus
tggctgacctggaact

SEQ ID NO: 445362 - DNA, 16 bp, M. musculus
tggctgaccttgaact

SEQ ID NO: 445363 - DNA, 16 bp, M. musculus
tggctgactatgccat

SEQ ID NO: 445364 - DNA, 16 bp, M. musculus
tggctgactttgaact

SEQ ID NO: 445365 - DNA, 16 bp, M. musculus
tggctgagaaacaact

SEQ ID NO: 445366 - DNA, 16 bp, M. musculus
tggctgagaaacacct

SEQ ID NO: 445367 - DNA, 16 bp, M. musculus
tggctgagaaatacct

SEQ ID NO: 445368 - DNA, 16 bp, M. musculus
tggctgagaagaactt

SEQ ID NO: 445369 - DNA, 16 bp, M. musculus
tggctgagaagcacca

SEQ ID NO: 445370 - DNA, 16 bp, M. musculus
tggctgagaagcacct

SEQ ID NO: 445371 - DNA, 16 bp, M. musculus
tggctgagaagcccct

SEQ ID NO: 445372 - DNA, 16 bp, M. musculus
tggctgagaagctcct

SEQ ID NO: 445373 - DNA, 16 bp, M. musculus
tggctgagaaggaact

SEQ ID NO: 445374 - DNA, 16 bp, M. musculus
tggctgagaatgaagg

SEQ ID NO: 445375 - DNA, 16 bp, M. musculus
tggctgagagcatcaa

SEQ ID NO: 445376 - DNA, 16 bp, M. musculus
tggctgagatcatcca

SEQ ID NO: 445377 - DNA, 16 bp, M. musculus
tggctgagatgggagt

SEQ ID NO: 445378 - DNA, 16 bp, M. musculus
tggctgagcagcacct

SEQ ID NO: 445379 - DNA, 16 bp, M. musculus
tggctgagctgtctct

SEQ ID NO: 445380 - DNA, 16 bp, M. musculus
tggctgaggaagaaaa

SEQ ID NO: 445381 - DNA, 16 bp, M. musculus
tggctgaggctgaggc

SEQ ID NO: 445382 - DNA, 16 bp, M. musculus
tggctgatcttccaga

SEQ ID NO: 445383 - DNA, 16 bp, M. musculus
tggctgatgtgactct

SEQ ID NO: 445384 - DNA, 16 bp, M. musculus
tggctgcaaacaagga

SEQ ID NO: 445385 - DNA, 16 bp, M. musculus
tggctgcagaggccag

SEQ ID NO: 445386 - DNA, 16 bp, M. musculus
tggctgcagcactcag

SEQ ID NO: 445387 - DNA, 16 bp, M. musculus
tggctgcaggaggtgg

SEQ ID NO: 445388 - DNA, 16 bp, M. musculus
tggctgcaggcaggca

SEQ ID NO: 445389 - DNA, 16 bp, M. musculus
tggctgcataaacaag

SEQ ID NO: 445390 - DNA, 16 bp, M. musculus
tggctgcatatggaat

SEQ ID NO: 445391 - DNA, 17 bp, M. musculus
tggctgccattgcattt

SEQ ID NO: 445392 - DNA, 16 bp, M. musculus
tggctgccctagaact

SEQ ID NO: 445393 - DNA, 16 bp, M. musculus
tggctgccctctgaga

SEQ ID NO: 445394 - DNA, 16 bp, M. musculus
tggctgccctggaact

SEQ ID NO: 445395 - DNA, 16 bp, M. musculus
tggctgcccttgcctt

SEQ ID NO: 445396 - DNA, 16 bp, M. musculus
tggctgcctctgcctc

SEQ ID NO: 445397 - DNA, 16 bp, M. musculus
tggctgcctctgctca

SEQ ID NO: 445398 - DNA, 16 bp, M. musculus
tggctgcctggctgcc

SEQ ID NO: 445399 - DNA, 16 bp, M. musculus
tggctgcctggctggc

SEQ ID NO: 445400 - DNA, 16 bp, M. musculus
tggctgctcctgcaga

SEQ ID NO: 445401 - DNA, 16 bp, M. musculus
tggctgctccttcaga

SEQ ID NO: 445402 - DNA, 16 bp, M. musculus
tggctgctctccctga

SEQ ID NO: 445403 - DNA, 16 bp, M. musculus
tggctgctctggaccc

SEQ ID NO: 445404 - DNA, 16 bp, M. musculus
tggctgctcttacaaa

SEQ ID NO: 445405 - DNA, 16 bp, M. musculus
tggctgctcttagtat

SEQ ID NO: 445406 - DNA, 16 bp, M. musculus
tggctgctcttccagc

SEQ ID NO: 445407 - DNA, 16 bp, M. musculus
tggctgctcttcccaa

SEQ ID NO: 445408 - DNA, 16 bp, M. musculus
tggctgctcttctgga

SEQ ID NO: 445409 - DNA, 16 bp, M. musculus
tggctgctcttgcaga

SEQ ID NO: 445410 - DNA, 16 bp, M. musculus
tggctgctgaggaggc

SEQ ID NO: 445411 - DNA, 16 bp, M. musculus
tggctgctgagggagg

SEQ ID NO: 445412 - DNA, 16 bp, M. musculus
tggctgctgccttgca

SEQ ID NO: 445413 - DNA, 16 bp, M. musculus
tggctgctgctgctgt

SEQ ID NO: 445414 - DNA, 16 bp, M. musculus
tggctgctggaggagg

SEQ ID NO: 445415 - DNA, 16 bp, M. musculus
tggctgctgggacttg

SEQ ID NO: 445416 - DNA, 16 bp, M. musculus
tggctgctgtgtcaca

SEQ ID NO: 445417 - DNA, 16 bp, M. musculus
tggctgcttctccttc

SEQ ID NO: 445418 - DNA, 16 bp, M. musculus
tggctgcttctgatag

SEQ ID NO: 445419 - DNA, 16 bp, M. musculus
tggctgcttgctcttc

SEQ ID NO: 445420 - DNA, 16 bp, M. musculus
tggctggaacacagga

SEQ ID NO: 445421 - DNA, 16 bp, M. musculus
tggctggagagatgac

SEQ ID NO: 445422 - DNA, 16 bp, M. musculus
tggctggagaggtggc

SEQ ID NO: 445423 - DNA, 16 bp, M. musculus
tggctggcattgtctg

SEQ ID NO: 445424 - DNA, 16 bp, M. musculus
tggctggccagaaagc

SEQ ID NO: 445425 - DNA, 16 bp, M. musculus
tggctggccaggaact

SEQ ID NO: 445426 - DNA, 16 bp, M. musculus
tggctggccagtctag

SEQ ID NO: 445427 - DNA, 16 bp, M. musculus
tggctggccagtgagt

SEQ ID NO: 445428 - DNA, 16 bp, M. musculus
tggctggcctagaact

SEQ ID NO: 445429 - DNA, 16 bp, M. musculus
tggctggcctagagct

SEQ ID NO: 445430 - DNA, 16 bp, M. musculus
tggctggcctcaaact

SEQ ID NO: 445431 - DNA, 16 bp, M. musculus
tggctggcctctactt

SEQ ID NO: 445432 - DNA, 16 bp, M. musculus
tggctggcctgcaact

SEQ ID NO: 445433 - DNA, 16 bp, M. musculus
tggctggcctggaact

SEQ ID NO: 445434 - DNA, 17 bp, M. musculus
tggctggcctggaacta

SEQ ID NO: 445435 - DNA, 17 bp, M. musculus
tggctggcctggaactt

SEQ ID NO: 445436 - DNA, 16 bp, M. musculus
tggctggcctggacct

SEQ ID NO: 445437 - DNA, 17 bp, M. musculus
tggctggcctggagctt

SEQ ID NO: 445438 - DNA, 16 bp, M. musculus
tggctggctaatgagc

SEQ ID NO: 445439 - DNA, 16 bp, M. musculus
tggctggctccttttt

SEQ ID NO: 445440 - DNA, 16 bp, M. musculus
tggctggctggctctg

SEQ ID NO: 445441 - DNA, 16 bp, M. musculus
tggctggctggctgaa

SEQ ID NO: 445442 - DNA, 16 bp, M. musculus
tggctggctggcttgc

SEQ ID NO: 445443 - DNA, 16 bp, M. musculus
tggctggctgtgagca

SEQ ID NO: 445444 - DNA, 16 bp, M. musculus
tggctggcttggaact

SEQ ID NO: 445445 - DNA, 16 bp, M. musculus
tggctggctttgaact

SEQ ID NO: 445446 - DNA, 16 bp, M. musculus
tggctgggaagatggc

SEQ ID NO: 445447 - DNA, 16 bp, M. musculus
tggctgggaggatgag

SEQ ID NO: 445448 - DNA, 16 bp, M. musculus
tggctgggagggtgtg

SEQ ID NO: 445449 - DNA, 16 bp, M. musculus
tggctgggcagcagat

SEQ ID NO: 445450 - DNA, 16 bp, M. musculus
tggctgggcagggaga

SEQ ID NO: 445451 - DNA, 16 bp, M. musculus
tggctgggcagggcag

SEQ ID NO: 445452 - DNA, 16 bp, M. musculus
tggctggggctgaggt

SEQ ID NO: 445453 - DNA, 16 bp, M. musculus
tggctggtcaactcag

SEQ ID NO: 445454 - DNA, 16 bp, M. musculus
tggctggtcagcaagc

SEQ ID NO: 445455 - DNA, 16 bp, M. musculus
tggctggtctggaact

SEQ ID NO: 445456 - DNA, 16 bp, M. musculus
tggctggtcttgaact

SEQ ID NO: 445457 - DNA, 16 bp, M. musculus
tggctggtgctgagag

SEQ ID NO: 445458 - DNA, 16 bp, M. musculus
tggctggtgctgggag

SEQ ID NO: 445459 - DNA, 16 bp, M. musculus
tggctggttacctctc

SEQ ID NO: 445460 - DNA, 16 bp, M. musculus
tggctggttggttggc

SEQ ID NO: 445461 - DNA, 16 bp, M. musculus
tggctgtaatgaagat

SEQ ID NO: 445462 - DNA, 16 bp, M. musculus
tggctgtcatgaaact

SEQ ID NO: 445463 - DNA, 16 bp, M. musculus
tggctgtccaggaact

SEQ ID NO: 445464 - DNA, 16 bp, M. musculus
tggctgtcccggaact

SEQ ID NO: 445465 - DNA, 16 bp, M. musculus
tggctgtccgggaact

SEQ ID NO: 445466 - DNA, 16 bp, M. musculus
tggctgtcctaaaact

SEQ ID NO: 445467 - DNA, 16 bp, M. musculus
tggctgtcctagaact

SEQ ID NO: 445468 - DNA, 16 bp, M. musculus
tggctgtcctagaagt

SEQ ID NO: 445469 - DNA, 16 bp, M. musculus
tggctgtcctagaatt

SEQ ID NO: 445470 - DNA, 16 bp, M. musculus
tggctgtcctaggact

SEQ ID NO: 445471 - DNA, 16 bp, M. musculus
tggctgtcctcttaga

SEQ ID NO: 445472 - DNA, 16 bp, M. musculus
tggctgtcctgaaact

SEQ ID NO: 445473 - DNA, 16 bp, M. musculus
tggctgtcctgaactt

SEQ ID NO: 445474 - DNA, 16 bp, M. musculus
tggctgtcctgcaact

SEQ ID NO: 445475 - DNA, 16 bp, M. musculus
tggctgtcctggaaca

SEQ ID NO: 445476 - DNA, 16 bp, M. musculus
tggctgtcctggaacc

SEQ ID NO: 445477 - DNA, 16 bp, M. musculus
tggctgtcctggaact

SEQ ID NO: 445478 - DNA, 20 bp, M. musculus
tggctgtcctggaactcact

SEQ ID NO: 445479 - DNA, 16 bp, M. musculus
tggctgtcctggaatg

SEQ ID NO: 445480 - DNA, 16 bp, M. musculus
tggctgtcctggaatt

SEQ ID NO: 445481 - DNA, 16 bp, M. musculus
tggctgtcctggactc

SEQ ID NO: 445482 - DNA, 16 bp, M. musculus
tggctgtcctggatct

SEQ ID NO: 445483 - DNA, 16 bp, M. musculus
tggctgtcctggattc

SEQ ID NO: 445484 - DNA, 16 bp, M. musculus
tggctgtcctggcact

SEQ ID NO: 445485 - DNA, 16 bp, M. musculus
tggctgtcctggctgt

SEQ ID NO: 445486 - DNA, 16 bp, M. musculus
tggctgtcctgggact

SEQ ID NO: 445487 - DNA, 16 bp, M. musculus
tggctgtcctggtatt

SEQ ID NO: 445488 - DNA, 16 bp, M. musculus
tggctgtcgtggaact

SEQ ID NO: 445489 - DNA, 16 bp, M. musculus
tggctgtctaaacaag

SEQ ID NO: 445490 - DNA, 16 bp, M. musculus
tggctgtctcctgaga

SEQ ID NO: 445491 - DNA, 16 bp, M. musculus
tggctgtcttctgaga

SEQ ID NO: 445492 - DNA, 16 bp, M. musculus
tggctgtcttggaact

SEQ ID NO: 445493 - DNA, 16 bp, M. musculus
tggctgtcttggaagt

SEQ ID NO: 445494 - DNA, 16 bp, M. musculus
tggctgtcttggacct

SEQ ID NO: 445495 - DNA, 16 bp, M. musculus
tggctgtcttggcact

SEQ ID NO: 445496 - DNA, 16 bp, M. musculus
tggctgtgagcaacca

SEQ ID NO: 445497 - DNA, 16 bp, M. musculus
tggctgtgagcagcca

SEQ ID NO: 445498 - DNA, 16 bp, M. musculus
tggctgtgagcatcag

SEQ ID NO: 445499 - DNA, 16 bp, M. musculus
tggctgtgagcatcca

SEQ ID NO: 445500 - DNA, 16 bp, M. musculus
tggctgtgagcatctg

SEQ ID NO: 445501 - DNA, 16 bp, M. musculus
tggctgtgagctacca

SEQ ID NO: 445502 - DNA, 16 bp, M. musculus
tggctgtgagcttcca

SEQ ID NO: 445503 - DNA, 16 bp, M. musculus
tggctgtgcaggcttg

SEQ ID NO: 445504 - DNA, 16 bp, M. musculus
tggctgtgcctctctc

SEQ ID NO: 445505 - DNA, 16 bp, M. musculus
tggctgtgctggaact

SEQ ID NO: 445506 - DNA, 16 bp, M. musculus
tggctgtggatgtctg

SEQ ID NO: 445507 - DNA, 16 bp, M. musculus
tggctgtggctatggc

SEQ ID NO: 445508 - DNA, 16 bp, M. musculus
tggctgtggctgtcct

SEQ ID NO: 445509 - DNA, 16 bp, M. musculus
tggctgtgggtctctg

SEQ ID NO: 445510 - DNA, 16 bp, M. musculus
tggctgtggttgctgg

SEQ ID NO: 445511 - DNA, 16 bp, M. musculus
tggctgtgtgaagcta

SEQ ID NO: 445512 - DNA, 16 bp, M. musculus
tggctgtgtgactgtg

SEQ ID NO: 445513 - DNA, 16 bp, M. musculus
tggctgttccagaact

SEQ ID NO: 445514 - DNA, 16 bp, M. musculus
tggctgttctagaact

SEQ ID NO: 445515 - DNA, 16 bp, M. musculus
tggctgttctggaact

SEQ ID NO: 445516 - DNA, 16 bp, M. musculus
tggctgttcttccaga

SEQ ID NO: 445517 - DNA, 16 bp, M. musculus
tggctgttctttgaga

SEQ ID NO: 445518 - DNA, 16 bp, M. musculus
tggctgttgtggaact

SEQ ID NO: 445519 - DNA, 16 bp, M. musculus
tggcttaattggtaaa

SEQ ID NO: 445520 - DNA, 16 bp, M. musculus
tggcttacaaccatca

SEQ ID NO: 445521 - DNA, 16 bp, M. musculus
tggcttacaaccattt

SEQ ID NO: 445522 - DNA, 16 bp, M. musculus
tggcttacagacaatt

SEQ ID NO: 445523 - DNA, 16 bp, M. musculus
tggcttacagttacag

SEQ ID NO: 445524 - DNA, 16 bp, M. musculus
tggcttacatttccat

SEQ ID NO: 445525 - DNA, 16 bp, M. musculus
tggcttagtgggcaaa

SEQ ID NO: 445526 - DNA, 16 bp, M. musculus
tggcttatatccactt

SEQ ID NO: 445527 - DNA, 16 bp, M. musculus
tggcttcaaactcaga

SEQ ID NO: 445528 - DNA, 16 bp, M. musculus
tggcttcaaacttgca

SEQ ID NO: 445529 - DNA, 16 bp, M. musculus
tggcttcaaagaatga

SEQ ID NO: 445530 - DNA, 16 bp, M. musculus
tggcttcaagctcaca

SEQ ID NO: 445531 - DNA, 16 bp, M. musculus
tggcttcaatgggaga

SEQ ID NO: 445532 - DNA, 16 bp, M. musculus
tggcttcagagggaga

SEQ ID NO: 445533 - DNA, 16 bp, M. musculus
tggcttcagctacata

SEQ ID NO: 445534 - DNA, 16 bp, M. musculus
tggcttcagtgagaga

SEQ ID NO: 445535 - DNA, 16 bp, M. musculus
tggcttcatggaatga

SEQ ID NO: 445536 - DNA, 16 bp, M. musculus
tggcttcattttaatt

SEQ ID NO: 445537 - DNA, 16 bp, M. musculus
tggcttcattttcttt

SEQ ID NO: 445538 - DNA, 16 bp, M. musculus
tggcttccagacagct

SEQ ID NO: 445539 - DNA, 16 bp, M. musculus
tggcttccaggcagct

SEQ ID NO: 445540 - DNA, 16 bp, M. musculus
tggcttccataggctc

SEQ ID NO: 445541 - DNA, 16 bp, M. musculus
tggcttccatgcagct

SEQ ID NO: 445542 - DNA, 16 bp, M. musculus
tggcttcccacagcca

SEQ ID NO: 445543 - DNA, 16 bp, M. musculus
tggcttccctcagtgg

SEQ ID NO: 445544 - DNA, 16 bp, M. musculus
tggcttcccttggtga

SEQ ID NO: 445545 - DNA, 16 bp, M. musculus
tggcttcgaattcaga

SEQ ID NO: 445546 - DNA, 16 bp, M. musculus
tggcttctcactgaat

SEQ ID NO: 445547 - DNA, 16 bp, M. musculus
tggcttctctctcagc

SEQ ID NO: 445548 - DNA, 16 bp, M. musculus
tggcttctctctctct

SEQ ID NO: 445549 - DNA, 16 bp, M. musculus
tggcttctctggcaag

SEQ ID NO: 445550 - DNA, 16 bp, M. musculus
tggcttctgcagacac

SEQ ID NO: 445551 - DNA, 16 bp, M. musculus
tggcttctgcatcaac

SEQ ID NO: 445552 - DNA, 17 bp, M. musculus
tggcttctgcatcagcc

SEQ ID NO: 445553 - DNA, 16 bp, M. musculus
tggcttctgcatctgc

SEQ ID NO: 445554 - DNA, 16 bp, M. musculus
tggcttctgcatgcac

SEQ ID NO: 445555 - DNA, 16 bp, M. musculus
tggcttctgcctccca

SEQ ID NO: 445556 - DNA, 16 bp, M. musculus
tggcttctgctgctct

SEQ ID NO: 445557 - DNA, 16 bp, M. musculus
tggcttctgctggcac

SEQ ID NO: 445558 - DNA, 16 bp, M. musculus
tggcttctggctatta

SEQ ID NO: 445559 - DNA, 16 bp, M. musculus
tggcttctgggcagct

SEQ ID NO: 445560 - DNA, 16 bp, M. musculus
tggcttctgtgagcca

SEQ ID NO: 445561 - DNA, 16 bp, M. musculus
tggcttctgtggacac

SEQ ID NO: 445562 - DNA, 16 bp, M. musculus
tggcttctgtgggcac

SEQ ID NO: 445563 - DNA, 16 bp, M. musculus
tggcttctgtgttctt

SEQ ID NO: 445564 - DNA, 16 bp, M. musculus
tggcttcttacctggg

SEQ ID NO: 445565 - DNA, 16 bp, M. musculus
tggcttctttatttaa

SEQ ID NO: 445566 - DNA, 16 bp, M. musculus
tggcttctttgtaaaa

SEQ ID NO: 445567 - DNA, 16 bp, M. musculus
tggcttgaacatctga

SEQ ID NO: 445568 - DNA, 16 bp, M. musculus
tggcttgattcccctg

SEQ ID NO: 445569 - DNA, 16 bp, M. musculus
tggcttgcctggaact

SEQ ID NO: 445570 - DNA, 18 bp, M. musculus
tggcttgctcagcctgct

SEQ ID NO: 445571 - DNA, 16 bp, M. musculus
tggcttgctccttgtg

SEQ ID NO: 445572 - DNA, 16 bp, M. musculus
tggcttgctgagcctg

SEQ ID NO: 445573 - DNA, 16 bp, M. musculus
tggcttggaaaaaaaa

SEQ ID NO: 445574 - DNA, 16 bp, M. musculus
tggcttggttttattt

SEQ ID NO: 445575 - DNA, 16 bp, M. musculus
tggcttgtgaaattcc

SEQ ID NO: 445576 - DNA, 16 bp, M. musculus
tggcttgtgctggaag

SEQ ID NO: 445577 - DNA, 16 bp, M. musculus
tggcttgttcagcctg

SEQ ID NO: 445578 - DNA, 16 bp, M. musculus
tggcttgtttcactta

SEQ ID NO: 445579 - DNA, 16 bp, M. musculus
tggctttaaaaaaatg

SEQ ID NO: 445580 - DNA, 16 bp, M. musculus
tggctttatcatggaa

SEQ ID NO: 445581 - DNA, 16 bp, M. musculus
tggctttcaaccatct

SEQ ID NO: 445582 - DNA, 16 bp, M. musculus
tggctttcctggaact

SEQ ID NO: 445583 - DNA, 16 bp, M. musculus
tggctttcctgtaagc

SEQ ID NO: 445584 - DNA, 16 bp, M. musculus
tggctttctccttcca

SEQ ID NO: 445585 - DNA, 16 bp, M. musculus
tggctttctgattttg

SEQ ID NO: 445586 - DNA, 16 bp, M. musculus
tggctttcttagtctc

SEQ ID NO: 445587 - DNA, 16 bp, M. musculus
tggctttgaactcaga

SEQ ID NO: 445588 - DNA, 16 bp, M. musculus
tggctttgaacttgct

SEQ ID NO: 445589 - DNA, 16 bp, M. musculus
tggctttgaactttct

SEQ ID NO: 445590 - DNA, 16 bp, M. musculus
tggctttgagcatcca

SEQ ID NO: 445591 - DNA, 16 bp, M. musculus
tggctttgagccacca

SEQ ID NO: 445592 - DNA, 16 bp, M. musculus
tggctttgctttctct

SEQ ID NO: 445593 - DNA, 16 bp, M. musculus
tggctttgttggagaa

SEQ ID NO: 445594 - DNA, 16 bp, M. musculus
tggcttttatgtggat

SEQ ID NO: 445595 - DNA, 16 bp, M. musculus
tggcttttcacccttg

SEQ ID NO: 445596 - DNA, 16 bp, M. musculus
tggcttttccttcagt

SEQ ID NO: 445597 - DNA, 16 bp, M. musculus
tggctttttaaaaaga

SEQ ID NO: 445598 - DNA, 16 bp, M. musculus
tggctttttacatgag

SEQ ID NO: 445599 - DNA, 16 bp, M. musculus
tgggaaaaaaaatcca

SEQ ID NO: 445600 - DNA, 16 bp, M. musculus
tgggaaaaaaatgttt

SEQ ID NO: 445601 - DNA, 16 bp, M. musculus
tgggaaaaaggtgtgc

SEQ ID NO: 445602 - DNA, 16 bp, M. musculus
tgggaaaaatcctgtt

SEQ ID NO: 445603 - DNA, 16 bp, M. musculus
tgggaaaactgaggcc

SEQ ID NO: 445604 - DNA, 16 bp, M. musculus
tgggaaaagggaacct

SEQ ID NO: 445605 - DNA, 16 bp, M. musculus
tgggaaacaagccagt

SEQ ID NO: 445606 - DNA, 16 bp, M. musculus
tgggaaacacagaagt

SEQ ID NO: 445607 - DNA, 16 bp, M. musculus
tgggaaacagaggcag

SEQ ID NO: 445608 - DNA, 16 bp, M. musculus
tgggaaacctggatga

SEQ ID NO: 445609 - DNA, 16 bp, M. musculus
tgggaaactgtgaaag

SEQ ID NO: 445610 - DNA, 16 bp, M. musculus
tgggaaagagcctcaa

SEQ ID NO: 445611 - DNA, 16 bp, M. musculus
tgggaaagagctttga

SEQ ID NO: 445612 - DNA, 16 bp, M. musculus
tgggaaagcagaggca

SEQ ID NO: 445613 - DNA, 16 bp, M. musculus
tgggaaaggctttagc

SEQ ID NO: 445614 - DNA, 16 bp, M. musculus
tgggaaagtctctaaa

SEQ ID NO: 445615 - DNA, 16 bp, M. musculus
tgggaaatctttccaa

SEQ ID NO: 445616 - DNA, 16 bp, M. musculus
tgggaaatctttctat

SEQ ID NO: 445617 - DNA, 16 bp, M. musculus
tgggaaatcttttcat

SEQ ID NO: 445618 - DNA, 16 bp, M. musculus
tgggaaatttcaacac

SEQ ID NO: 445619 - DNA, 16 bp, M. musculus
tgggaacaaaacaccc

SEQ ID NO: 445620 - DNA, 16 bp, M. musculus
tgggaacaaaaccacc

SEQ ID NO: 445621 - DNA, 16 bp, M. musculus
tgggaacaagacaccc

SEQ ID NO: 445622 - DNA, 16 bp, M. musculus
tgggaacatccttgtg

SEQ ID NO: 445623 - DNA, 16 bp, M. musculus
tgggaacatgaacttg

SEQ ID NO: 445624 - DNA, 16 bp, M. musculus
tgggaacccagggagg

SEQ ID NO: 445625 - DNA, 16 bp, M. musculus
tgggaacccaggtcct

SEQ ID NO: 445626 - DNA, 16 bp, M. musculus
tgggaacctcttccct

SEQ ID NO: 445627 - DNA, 16 bp, M. musculus
tgggaactaaaccctg

SEQ ID NO: 445628 - DNA, 16 bp, M. musculus
tgggaactcactctgt

SEQ ID NO: 445629 - DNA, 16 bp, M. musculus
tgggaactctgcaagc

SEQ ID NO: 445630 - DNA, 16 bp, M. musculus
tgggaactctggaggg

SEQ ID NO: 445631 - DNA, 16 bp, M. musculus
tgggaactgaagctgg

SEQ ID NO: 445632 - DNA, 16 bp, M. musculus
tgggaactgaagtcag

SEQ ID NO: 445633 - DNA, 16 bp, M. musculus
tgggaactggagagat

SEQ ID NO: 445634 - DNA, 16 bp, M. musculus
tgggaagaagaaagca

SEQ ID NO: 445635 - DNA, 16 bp, M. musculus
tgggaagaagaaatct

SEQ ID NO: 445636 - DNA, 16 bp, M. musculus
tgggaagacctgccca

SEQ ID NO: 445637 - DNA, 16 bp, M. musculus
tgggaagagaaaacct

SEQ ID NO: 445638 - DNA, 16 bp, M. musculus
tgggaagagacaagag

SEQ ID NO: 445639 - DNA, 16 bp, M. musculus
tgggaagagaggcagg

SEQ ID NO: 445640 - DNA, 17 bp, M. musculus
tgggaagagaggcccct

SEQ ID NO: 445641 - DNA, 16 bp, M. musculus
tgggaagagagggcag

SEQ ID NO: 445642 - DNA, 16 bp, M. musculus
tgggaagagagttctt

SEQ ID NO: 445643 - DNA, 16 bp, M. musculus
tgggaagagcagccag

SEQ ID NO: 445644 - DNA, 16 bp, M. musculus
tgggaagaggaaacct

SEQ ID NO: 445645 - DNA, 16 bp, M. musculus
tgggaagagggaagct

SEQ ID NO: 445646 - DNA, 16 bp, M. musculus
tgggaagaggggacct

SEQ ID NO: 445647 - DNA, 16 bp, M. musculus
tgggaagatggcttag

SEQ ID NO: 445648 - DNA, 16 bp, M. musculus
tgggaagatgggagtg

SEQ ID NO: 445649 - DNA, 16 bp, M. musculus
tgggaagatgtctcag

SEQ ID NO: 445650 - DNA, 16 bp, M. musculus
tgggaagcagagaaag

SEQ ID NO: 445651 - DNA, 16 bp, M. musculus
tgggaagcagaggcca

SEQ ID NO: 445652 - DNA, 16 bp, M. musculus
tgggaagccaactcca

SEQ ID NO: 445653 - DNA, 16 bp, M. musculus
tgggaagccctgcagc

SEQ ID NO: 445654 - DNA, 16 bp, M. musculus
tgggaagcctggcagc

SEQ ID NO: 445655 - DNA, 16 bp, M. musculus
tgggaagctgaagcag

SEQ ID NO: 445656 - DNA, 16 bp, M. musculus
tgggaagctgagacag

SEQ ID NO: 445657 - DNA, 16 bp, M. musculus
tgggaagctgaggaag

SEQ ID NO: 445658 - DNA, 16 bp, M. musculus
tgggaagctgtgaaag

SEQ ID NO: 445659 - DNA, 16 bp, M. musculus
tgggaaggaactggaa

SEQ ID NO: 445660 - DNA, 16 bp, M. musculus
tgggaaggaagcagag

SEQ ID NO: 445661 - DNA, 16 bp, M. musculus
tgggaaggaaggggtt

SEQ ID NO: 445662 - DNA, 16 bp, M. musculus
tgggaaggagaaatag

SEQ ID NO: 445663 - DNA, 16 bp, M. musculus
tgggaaggagagacag

SEQ ID NO: 445664 - DNA, 16 bp, M. musculus
tgggaaggcaacccca

SEQ ID NO: 445665 - DNA, 16 bp, M. musculus
tgggaaggcagagaca

SEQ ID NO: 445666 - DNA, 16 bp, M. musculus
tgggaaggtagagaca

SEQ ID NO: 445667 - DNA, 16 bp, M. musculus
tgggaaggtgaggcag

SEQ ID NO: 445668 - DNA, 16 bp, M. musculus
tgggaaggttctatgc

SEQ ID NO: 445669 - DNA, 16 bp, M. musculus
tgggaagtacttgctg

SEQ ID NO: 445670 - DNA, 16 bp, M. musculus
tgggaagtcaggcagg

SEQ ID NO: 445671 - DNA, 32 bp, M. musculus
tgggaagtgcttaatgaggagggaaacattgt

SEQ ID NO: 445672 - DNA, 16 bp, M. musculus
tgggaatacagatgtg

SEQ ID NO: 445673 - DNA, 16 bp, M. musculus
tgggaatagaacctgg

SEQ ID NO: 445674 - DNA, 16 bp, M. musculus
tgggaatatttttatt

SEQ ID NO: 445675 - DNA, 16 bp, M. musculus
tgggaatcaaacccag

SEQ ID NO: 445676 - DNA, 16 bp, M. musculus
tgggaatcgaactcag

SEQ ID NO: 445677 - DNA, 16 bp, M. musculus
tgggaatctcccacct

SEQ ID NO: 445678 - DNA, 16 bp, M. musculus
tgggaatctttgctct

SEQ ID NO: 445679 - DNA, 16 bp, M. musculus
tgggaatctttgtcca

SEQ ID NO: 445680 - DNA, 16 bp, M. musculus
tgggaatgaataagaa

SEQ ID NO: 445681 - DNA, 16 bp, M. musculus
tgggaatgccagggcc

SEQ ID NO: 445682 - DNA, 16 bp, M. musculus
tgggaatggaacttgg

SEQ ID NO: 445683 - DNA, 16 bp, M. musculus
tgggaattaaactcag

SEQ ID NO: 445684 - DNA, 16 bp, M. musculus
tgggaattaccaccac

SEQ ID NO: 445685 - DNA, 16 bp, M. musculus
tgggaattctctgttt

SEQ ID NO: 445686 - DNA, 16 bp, M. musculus
tgggaattgaactcag

SEQ ID NO: 445687 - DNA, 16 bp, M. musculus
tgggacaaatggctga

SEQ ID NO: 445688 - DNA, 18 bp, M. musculus
tgggacacaatgaaagca

SEQ ID NO: 445689 - DNA, 16 bp, M. musculus
tgggacacaatgagag

SEQ ID NO: 445690 - DNA, 16 bp, M. musculus
tgggacacactgaaag

SEQ ID NO: 445691 - DNA, 16 bp, M. musculus
tgggacactgtcccac

SEQ ID NO: 445692 - DNA, 16 bp, M. musculus
tgggacagaaggagtt

SEQ ID NO: 445693 - DNA, 16 bp, M. musculus
tgggacaggcagaagt

SEQ ID NO: 445694 - DNA, 16 bp, M. musculus
tgggacagtcattggt

SEQ ID NO: 445695 - DNA, 16 bp, M. musculus
tgggacagttgatgct

SEQ ID NO: 445696 - DNA, 16 bp, M. musculus
tgggacatagaacctt

SEQ ID NO: 445697 - DNA, 16 bp, M. musculus
tgggacatcaatggga

SEQ ID NO: 445698 - DNA, 16 bp, M. musculus
tgggacatccagcaga

SEQ ID NO: 445699 - DNA, 16 bp, M. musculus
tgggaccaaaaccaga

SEQ ID NO: 445700 - DNA, 16 bp, M. musculus
tgggaccaaaggtgtg

SEQ ID NO: 445701 - DNA, 16 bp, M. musculus
tgggaccagaccagga

SEQ ID NO: 445702 - DNA, 16 bp, M. musculus
tgggaccatctcaggg

SEQ ID NO: 445703 - DNA, 16 bp, M. musculus
tgggacccagaagtcc

SEQ ID NO: 445704 - DNA, 16 bp, M. musculus
tgggaccctgtccaag

SEQ ID NO: 445705 - DNA, 41 bp, M. musculus
tgggacctaatcacggtaaaacgaggtagtggctatgataa

SEQ ID NO: 445706 - DNA, 16 bp, M. musculus
tgggacctcctcttga

SEQ ID NO: 445707 - DNA, 16 bp, M. musculus
tgggacctgaggaaac

SEQ ID NO: 445708 - DNA, 16 bp, M. musculus
tgggaccttttttttt

SEQ ID NO: 445709 - DNA, 17 bp, M. musculus
tgggactaaaggtgtgc

SEQ ID NO: 445710 - DNA, 16 bp, M. musculus
tgggactcactatgta

SEQ ID NO: 445711 - DNA, 16 bp, M. musculus
tgggactcagtttccc

SEQ ID NO: 445712 - DNA, 16 bp, M. musculus
tgggactcatggctgt

SEQ ID NO: 445713 - DNA, 16 bp, M. musculus
tgggactccacagaga

SEQ ID NO: 445714 - DNA, 16 bp, M. musculus
tgggactcctaaagca

SEQ ID NO: 445715 - DNA, 16 bp, M. musculus
tgggactctaacccac

SEQ ID NO: 445716 - DNA, 16 bp, M. musculus
tgggactctctctctc

SEQ ID NO: 445717 - DNA, 16 bp, M. musculus
tgggactctgcatctg

SEQ ID NO: 445718 - DNA, 16 bp, M. musculus
tgggactcttcacctt

SEQ ID NO: 445719 - DNA, 16 bp, M. musculus
tgggactgcaggcttg

SEQ ID NO: 445720 - DNA, 16 bp, M. musculus
tgggactggagaaatg

SEQ ID NO: 445721 - DNA, 16 bp, M. musculus
tgggactggagagaga

SEQ ID NO: 445722 - DNA, 16 bp, M. musculus
tgggactggagagctg

SEQ ID NO: 445723 - DNA, 16 bp, M. musculus
tgggactggtgagatg

SEQ ID NO: 445724 - DNA, 16 bp, M. musculus
tgggactgtttagata

SEQ ID NO: 445725 - DNA, 16 bp, M. musculus
tgggacttctgggtcc

SEQ ID NO: 445726 - DNA, 16 bp, M. musculus
tgggagaaactgtacc

SEQ ID NO: 445727 - DNA, 16 bp, M. musculus
tgggagaaagaagcag

SEQ ID NO: 445728 - DNA, 16 bp, M. musculus
tgggagaacctggagg

SEQ ID NO: 445729 - DNA, 16 bp, M. musculus
tgggagaagactggct

SEQ ID NO: 445730 - DNA, 16 bp, M. musculus
tgggagaagagaactg

SEQ ID NO: 445731 - DNA, 16 bp, M. musculus
tgggagaagaggacct

SEQ ID NO: 445732 - DNA, 16 bp, M. musculus
tgggagaagaggcagg

SEQ ID NO: 445733 - DNA, 16 bp, M. musculus
tgggagaagatgcact

SEQ ID NO: 445734 - DNA, 16 bp, M. musculus
tgggagaagccagcag

SEQ ID NO: 445735 - DNA, 16 bp, M. musculus
tgggagacagaagaag

SEQ ID NO: 445736 - DNA, 16 bp, M. musculus
tgggagacagaggaag

SEQ ID NO: 445737 - DNA, 16 bp, M. musculus
tgggagacatcttggt

SEQ ID NO: 445738 - DNA, 16 bp, M. musculus
tgggagacctttggga

SEQ ID NO: 445739 - DNA, 16 bp, M. musculus
tgggagacttcaagac

SEQ ID NO: 445740 - DNA, 16 bp, M. musculus
tgggagacttcaatgc

SEQ ID NO: 445741 - DNA, 16 bp, M. musculus
tgggagagacagctca

SEQ ID NO: 445742 - DNA, 16 bp, M. musculus
tgggagagagcacggc

SEQ ID NO: 445743 - DNA, 16 bp, M. musculus
tgggagagcagccagt

SEQ ID NO: 445744 - DNA, 16 bp, M. musculus
tgggagaggagtttga

SEQ ID NO: 445745 - DNA, 16 bp, M. musculus
tgggagagggaggcag

SEQ ID NO: 445746 - DNA, 16 bp, M. musculus
tgggagatggaagcag

SEQ ID NO: 445747 - DNA, 16 bp, M. musculus
tgggagatgggagatg

SEQ ID NO: 445748 - DNA, 16 bp, M. musculus
tgggagatgggggcag

SEQ ID NO: 445749 - DNA, 16 bp, M. musculus
tgggagcaaaacaccc

SEQ ID NO: 445750 - DNA, 16 bp, M. musculus
tgggagcacaaagaag

SEQ ID NO: 445751 - DNA, 16 bp, M. musculus
tgggagcagaagcagg

SEQ ID NO: 445752 - DNA, 16 bp, M. musculus
tgggagcagagactga

SEQ ID NO: 445753 - DNA, 16 bp, M. musculus
tgggagcagaggccct

SEQ ID NO: 445754 - DNA, 16 bp, M. musculus
tgggagcagatgcaga

SEQ ID NO: 445755 - DNA, 16 bp, M. musculus
tgggagcaggaagctg

SEQ ID NO: 445756 - DNA, 17 bp, M. musculus
tgggagcatcagcaaca

SEQ ID NO: 445757 - DNA, 16 bp, M. musculus
tgggagcattttgcct

SEQ ID NO: 445758 - DNA, 16 bp, M. musculus
tgggagccaggagagc

SEQ ID NO: 445759 - DNA, 16 bp, M. musculus
tgggagccagttttct

SEQ ID NO: 445760 - DNA, 16 bp, M. musculus
tgggagcctgggctgg

SEQ ID NO: 445761 - DNA, 16 bp, M. musculus
tgggagctctgagtgg

SEQ ID NO: 445762 - DNA, 16 bp, M. musculus
tgggagctctgggaat

SEQ ID NO: 445763 - DNA, 16 bp, M. musculus
tgggagctctggggag

SEQ ID NO: 445764 - DNA, 16 bp, M. musculus
tgggagctctggggct

SEQ ID NO: 445765 - DNA, 16 bp, M. musculus
tgggagctctggggga

SEQ ID NO: 445766 - DNA, 16 bp, M. musculus
tgggagctctgggtgg

SEQ ID NO: 445767 - DNA, 16 bp, M. musculus
tgggagctctggtggg

SEQ ID NO: 445768 - DNA, 16 bp, M. musculus
tgggagctctggttgg

SEQ ID NO: 445769 - DNA, 16 bp, M. musculus
tgggagctgaacctgg

SEQ ID NO: 445770 - DNA, 16 bp, M. musculus
tgggagctgaactcag

SEQ ID NO: 445771 - DNA, 16 bp, M. musculus
tgggagctgccatgtg

SEQ ID NO: 445772 - DNA, 16 bp, M. musculus
tgggagctggagagat

SEQ ID NO: 445773 - DNA, 16 bp, M. musculus
tgggagctgggagctg

SEQ ID NO: 445774 - DNA, 16 bp, M. musculus
tgggagctttgggggt

SEQ ID NO: 445775 - DNA, 16 bp, M. musculus
tgggaggaaaagacag

SEQ ID NO: 445776 - DNA, 16 bp, M. musculus
tgggaggaaaggcctt

SEQ ID NO: 445777 - DNA, 16 bp, M. musculus
tgggaggaagagacag

SEQ ID NO: 445778 - DNA, 16 bp, M. musculus
tgggaggaagaggcag

SEQ ID NO: 445779 - DNA, 16 bp, M. musculus
tgggaggaagcctact

SEQ ID NO: 445780 - DNA, 16 bp, M. musculus
tgggaggaaggggcag

SEQ ID NO: 445781 - DNA, 16 bp, M. musculus
tgggaggaattggagg

SEQ ID NO: 445782 - DNA, 19 bp, M. musculus
tgggaggaatttcttttct

SEQ ID NO: 445783 - DNA, 16 bp, M. musculus
tgggaggactgccaga

SEQ ID NO: 445784 - DNA, 16 bp, M. musculus
tgggaggacttggcac

SEQ ID NO: 445785 - DNA, 16 bp, M. musculus
tgggaggagactgggg

SEQ ID NO: 445786 - DNA, 16 bp, M. musculus
tgggaggagagaacca

SEQ ID NO: 445787 - DNA, 16 bp, M. musculus
tgggaggagagcccct

SEQ ID NO: 445788 - DNA, 16 bp, M. musculus
tgggaggagaggctgt

SEQ ID NO: 445789 - DNA, 16 bp, M. musculus
tgggaggagcagaggg

SEQ ID NO: 445790 - DNA, 16 bp, M. musculus
tgggaggagcctgagg

SEQ ID NO: 445791 - DNA, 16 bp, M. musculus
tgggaggagctggaga

SEQ ID NO: 445792 - DNA, 16 bp, M. musculus
tgggaggaggaggcag

SEQ ID NO: 445793 - DNA, 16 bp, M. musculus
tgggaggaggaggctg

SEQ ID NO: 445794 - DNA, 16 bp, M. musculus
tgggaggagggaatct

SEQ ID NO: 445795 - DNA, 16 bp, M. musculus
tgggaggagggatttg

SEQ ID NO: 445796 - DNA, 16 bp, M. musculus
tgggaggagtggccct

SEQ ID NO: 445797 - DNA, 16 bp, M. musculus
tgggaggatgaggcag

SEQ ID NO: 445798 - DNA, 16 bp, M. musculus
tgggaggatttggagg

SEQ ID NO: 445799 - DNA, 16 bp, M. musculus
tgggaggcaaagacag

SEQ ID NO: 445800 - DNA, 16 bp, M. musculus
tgggaggcaaaggcag

SEQ ID NO: 445801 - DNA, 16 bp, M. musculus
tgggaggcagaagcag

SEQ ID NO: 445802 - DNA, 16 bp, M. musculus
tgggaggcagagaaga

SEQ ID NO: 445803 - DNA, 16 bp, M. musculus
tgggaggcagagacag

SEQ ID NO: 445804 - DNA, 16 bp, M. musculus
tgggaggcagagacat

SEQ ID NO: 445805 - DNA, 16 bp, M. musculus
tgggaggcagagctgg

SEQ ID NO: 445806 - DNA, 16 bp, M. musculus
tgggaggcagagggga

SEQ ID NO: 445807 - DNA, 16 bp, M. musculus
tgggaggcaggaggag

SEQ ID NO: 445808 - DNA, 16 bp, M. musculus
tgggaggcagggacag

SEQ ID NO: 445809 - DNA, 16 bp, M. musculus
tgggaggccagaagag

SEQ ID NO: 445810 - DNA, 16 bp, M. musculus
tgggaggccgaggcag

SEQ ID NO: 445811 - DNA, 16 bp, M. musculus
tgggaggcctgtgatc

SEQ ID NO: 445812 - DNA, 16 bp, M. musculus
tgggaggctaaagcag

SEQ ID NO: 445813 - DNA, 16 bp, M. musculus
tgggaggctcaggcag

SEQ ID NO: 445814 - DNA, 16 bp, M. musculus
tgggaggctctgccag

SEQ ID NO: 445815 - DNA, 16 bp, M. musculus
tgggaggctgaagcag

SEQ ID NO: 445816 - DNA, 16 bp, M. musculus
tgggaggctgaggctg

SEQ ID NO: 445817 - DNA, 16 bp, M. musculus
tgggagggaaaatgga

SEQ ID NO: 445818 - DNA, 16 bp, M. musculus
tgggagggcagagagg

SEQ ID NO: 445819 - DNA, 16 bp, M. musculus
tgggaggggaggctct

SEQ ID NO: 445820 - DNA, 16 bp, M. musculus
tgggagggggaactgg

SEQ ID NO: 445821 - DNA, 16 bp, M. musculus
tgggaggtgaaggcag

SEQ ID NO: 445822 - DNA, 16 bp, M. musculus
tgggaggtgagggact

SEQ ID NO: 445823 - DNA, 16 bp, M. musculus
tgggaggtggagatag

SEQ ID NO: 445824 - DNA, 16 bp, M. musculus
tgggaggtggaggcag

SEQ ID NO: 445825 - DNA, 16 bp, M. musculus
tgggaggtggcctcag

SEQ ID NO: 445826 - DNA, 16 bp, M. musculus
tgggagtagcagctgg

SEQ ID NO: 445827 - DNA, 16 bp, M. musculus
tgggagtatgtgtgtg

SEQ ID NO: 445828 - DNA, 16 bp, M. musculus
tgggagtcaggaagag

SEQ ID NO: 445829 - DNA, 16 bp, M. musculus
tgggagtcagtgcagt

SEQ ID NO: 445830 - DNA, 22 bp, M. musculus
tgggagtccaaactctgcctac

SEQ ID NO: 445831 - DNA, 16 bp, M. musculus
tgggagtctctcacat

SEQ ID NO: 445832 - DNA, 16 bp, M. musculus
tgggagtgcaaatttg

SEQ ID NO: 445833 - DNA, 16 bp, M. musculus
tgggagtggaggctgt

SEQ ID NO: 445834 - DNA, 16 bp, M. musculus
tgggagtggcactatt

SEQ ID NO: 445835 - DNA, 16 bp, M. musculus
tgggagtgggctttga

SEQ ID NO: 445836 - DNA, 16 bp, M. musculus
tgggagttcttttgtg

SEQ ID NO: 445837 - DNA, 16 bp, M. musculus
tgggagttgaaccctg

SEQ ID NO: 445838 - DNA, 16 bp, M. musculus
tgggataatattcact

SEQ ID NO: 445839 - DNA, 16 bp, M. musculus
tgggatacatgagacc

SEQ ID NO: 445840 - DNA, 16 bp, M. musculus
tgggataggatcagag

SEQ ID NO: 445841 - DNA, 16 bp, M. musculus
tgggatatatacctgg

SEQ ID NO: 445842 - DNA, 16 bp, M. musculus
tgggatcaaactcagg

SEQ ID NO: 445843 - DNA, 17 bp, M. musculus
tgggatcaaaggtgtgc

SEQ ID NO: 445844 - DNA, 17 bp, M. musculus
tgggatcaaaggtgtgt

SEQ ID NO: 445845 - DNA, 16 bp, M. musculus
tgggatccacagacag

SEQ ID NO: 445846 - DNA, 16 bp, M. musculus
tgggatccttctcatg

SEQ ID NO: 445847 - DNA, 16 bp, M. musculus
tgggatcgaaggtgtg

SEQ ID NO: 445848 - DNA, 16 bp, M. musculus
tgggatctctggaaga

SEQ ID NO: 445849 - DNA, 16 bp, M. musculus
tgggatctgatgatgc

SEQ ID NO: 445850 - DNA, 16 bp, M. musculus
tgggatgaaaggcatg

SEQ ID NO: 445851 - DNA, 16 bp, M. musculus
tgggatgaactagaaa

SEQ ID NO: 445852 - DNA, 16 bp, M. musculus
tgggatgagaaaaccc

SEQ ID NO: 445853 - DNA, 16 bp, M. musculus
tgggatgagaggccct

SEQ ID NO: 445854 - DNA, 16 bp, M. musculus
tgggatgcctcaggat

SEQ ID NO: 445855 - DNA, 16 bp, M. musculus
tgggatggacctccag

SEQ ID NO: 445856 - DNA, 16 bp, M. musculus
tgggatggatcccaaa

SEQ ID NO: 445857 - DNA, 16 bp, M. musculus
tgggatggatcccagg

SEQ ID NO: 445858 - DNA, 16 bp, M. musculus
tgggatggatccctag

SEQ ID NO: 445859 - DNA, 16 bp, M. musculus
tgggatggattccctg

SEQ ID NO: 445860 - DNA, 16 bp, M. musculus
tgggatgggtccctgg

SEQ ID NO: 445861 - DNA, 16 bp, M. musculus
tgggatgtaaattaat

SEQ ID NO: 445862 - DNA, 16 bp, M. musculus
tgggatgtaagagctg

SEQ ID NO: 445863 - DNA, 16 bp, M. musculus
tgggatgtggaagagt

SEQ ID NO: 445864 - DNA, 16 bp, M. musculus
tgggattaaaaacgtg

SEQ ID NO: 445865 - DNA, 17 bp, M. musculus
tgggattaaaagcatgt

SEQ ID NO: 445866 - DNA, 16 bp, M. musculus
tgggattaaaagcatt

SEQ ID NO: 445867 - DNA, 16 bp, M. musculus
tgggattaaacatgtg

SEQ ID NO: 445868 - DNA, 16 bp, M. musculus
tgggattaaaggcagc

SEQ ID NO: 445869 - DNA, 17 bp, M. musculus
tgggattaaaggcatgg

SEQ ID NO: 445870 - DNA, 17 bp, M. musculus
tgggattaaaggcctgt

SEQ ID NO: 445871 - DNA, 17 bp, M. musculus
tgggattaaaggtgtgg

SEQ ID NO: 445872 - DNA, 16 bp, M. musculus
tgggattacaagcttg

SEQ ID NO: 445873 - DNA, 16 bp, M. musculus
tgggattacagatgtg

SEQ ID NO: 445874 - DNA, 16 bp, M. musculus
tgggattagaggcatg

SEQ ID NO: 445875 - DNA, 16 bp, M. musculus
tgggattaggacagaa

SEQ ID NO: 445876 - DNA, 16 bp, M. musculus
tgggattcctcagttg

SEQ ID NO: 445877 - DNA, 16 bp, M. musculus
tgggattcctctgggt

SEQ ID NO: 445878 - DNA, 16 bp, M. musculus
tgggattctgggatcc

SEQ ID NO: 445879 - DNA, 16 bp, M. musculus
tgggattctgggtgtg

SEQ ID NO: 445880 - DNA, 16 bp, M. musculus
tgggattgaagacatg

SEQ ID NO: 445881 - DNA, 16 bp, M. musculus
tgggattgcaacctgg

SEQ ID NO: 445882 - DNA, 16 bp, M. musculus
tgggattgcagacatg

SEQ ID NO: 445883 - DNA, 16 bp, M. musculus
tgggattgcaggtgtg

SEQ ID NO: 445884 - DNA, 16 bp, M. musculus
tgggattgcttccacc

SEQ ID NO: 445885 - DNA, 16 bp, M. musculus
tgggattgcttccagt

SEQ ID NO: 445886 - DNA, 16 bp, M. musculus
tgggattggagttaca

SEQ ID NO: 445887 - DNA, 16 bp, M. musculus
tgggattggtcagtct

SEQ ID NO: 445888 - DNA, 16 bp, M. musculus
tgggatttgaactcac

SEQ ID NO: 445889 - DNA, 16 bp, M. musculus
tgggattttaggcatg

SEQ ID NO: 445890 - DNA, 16 bp, M. musculus
tgggcaaagtgcttgc

SEQ ID NO: 445891 - DNA, 16 bp, M. musculus
tgggcaaatatccact

SEQ ID NO: 445892 - DNA, 49 bp, M. musculus
tgggcaaccactgcagtccatcccctctggacttggtggcctgatctca

SEQ ID NO: 445893 - DNA, 16 bp, M. musculus
tgggcaagatggctca

SEQ ID NO: 445894 - DNA, 16 bp, M. musculus
tgggcaagggagagat

SEQ ID NO: 445895 - DNA, 16 bp, M. musculus
tgggcacacacataca

SEQ ID NO: 445896 - DNA, 16 bp, M. musculus
tgggcacaggtgtggg

SEQ ID NO: 445897 - DNA, 16 bp, M. musculus
tgggcacatctgtggg

SEQ ID NO: 445898 - DNA, 16 bp, M. musculus
tgggcaccaggcatgc

SEQ ID NO: 445899 - DNA, 16 bp, M. musculus
tgggcaccaggcatgt

SEQ ID NO: 445900 - DNA, 16 bp, M. musculus
tgggcactgcatgcat

SEQ ID NO: 445901 - DNA, 16 bp, M. musculus
tgggcactgggaatca

SEQ ID NO: 445902 - DNA, 16 bp, M. musculus
tgggcactgggcactg

SEQ ID NO: 445903 - DNA, 16 bp, M. musculus
tgggcactggggaaaa

SEQ ID NO: 445904 - DNA, 16 bp, M. musculus
tgggcagaacttcagg

SEQ ID NO: 445905 - DNA, 16 bp, M. musculus
tgggcagagcctagag

SEQ ID NO: 445906 - DNA, 16 bp, M. musculus
tgggcagcaagcactt

SEQ ID NO: 445907 - DNA, 16 bp, M. musculus
tgggcagcacagtaga

SEQ ID NO: 445908 - DNA, 16 bp, M. musculus
tgggcagcagaggcag

SEQ ID NO: 445909 - DNA, 16 bp, M. musculus
tgggcagcaggcacac

SEQ ID NO: 445910 - DNA, 16 bp, M. musculus
tgggcagccagcctag

SEQ ID NO: 445911 - DNA, 16 bp, M. musculus
tgggcagccctcaggg

SEQ ID NO: 445912 - DNA, 16 bp, M. musculus
tgggcagccttgccta

SEQ ID NO: 445913 - DNA, 16 bp, M. musculus
tgggcagggagatgga

SEQ ID NO: 445914 - DNA, 16 bp, M. musculus
tgggcagggcagggca

SEQ ID NO: 445915 - DNA, 16 bp, M. musculus
tgggcagtggccagtg

SEQ ID NO: 445916 - DNA, 16 bp, M. musculus
tgggcagtggtggcgc

SEQ ID NO: 445917 - DNA, 16 bp, M. musculus
tgggcagtggtggtgc

SEQ ID NO: 445918 - DNA, 17 bp, M. musculus
tgggcagtggtggtgca

SEQ ID NO: 445919 - DNA, 16 bp, M. musculus
tgggcagtggtggtgt

SEQ ID NO: 445920 - DNA, 16 bp, M. musculus
tgggcatatatatcca

SEQ ID NO: 445921 - DNA, 16 bp, M. musculus
tgggcatatctgtgag

SEQ ID NO: 445922 - DNA, 16 bp, M. musculus
tgggcatcactctgca

SEQ ID NO: 445923 - DNA, 16 bp, M. musculus
tgggcatcactttctt

SEQ ID NO: 445924 - DNA, 16 bp, M. musculus
tgggcatccttttctt

SEQ ID NO: 445925 - DNA, 16 bp, M. musculus
tgggcatctctgtctt

SEQ ID NO: 445926 - DNA, 16 bp, M. musculus
tgggcatcttccctgc

SEQ ID NO: 445927 - DNA, 16 bp, M. musculus
tgggcatcttctggat

SEQ ID NO: 445928 - DNA, 16 bp, M. musculus
tgggcatgaaagccct

SEQ ID NO: 445929 - DNA, 16 bp, M. musculus
tgggcatgcctgtggg

SEQ ID NO: 445930 - DNA, 16 bp, M. musculus
tgggcatgggctttaa

SEQ ID NO: 445931 - DNA, 16 bp, M. musculus
tgggcatggtagcaca

SEQ ID NO: 445932 - DNA, 16 bp, M. musculus
tgggcatggtggtgcc

SEQ ID NO: 445933 - DNA, 16 bp, M. musculus
tgggcatgtgcacatg

SEQ ID NO: 445934 - DNA, 16 bp, M. musculus
tgggcatgtgtgcaca

SEQ ID NO: 445935 - DNA, 16 bp, M. musculus
tgggcatttcacctaa

SEQ ID NO: 445936 - DNA, 16 bp, M. musculus
tgggccaagatggcgc

SEQ ID NO: 445937 - DNA, 16 bp, M. musculus
tgggccacagaagcaa

SEQ ID NO: 445938 - DNA, 16 bp, M. musculus
tgggccagcaagatgg

SEQ ID NO: 445939 - DNA, 16 bp, M. musculus
tgggccagccagggct

SEQ ID NO: 445940 - DNA, 16 bp, M. musculus
tgggccagctctcctg

SEQ ID NO: 445941 - DNA, 16 bp, M. musculus
tgggccaggcagtgac

SEQ ID NO: 445942 - DNA, 16 bp, M. musculus
tgggccaggcatggtg

SEQ ID NO: 445943 - DNA, 16 bp, M. musculus
tgggccagtcactgaa

SEQ ID NO: 445944 - DNA, 16 bp, M. musculus
tgggccatcaactaca

SEQ ID NO: 445945 - DNA, 19 bp, M. musculus
tgggcccaacacacaactt

SEQ ID NO: 445946 - DNA, 16 bp, M. musculus
tgggcccacgtgggcc

SEQ ID NO: 445947 - DNA, 16 bp, M. musculus
tgggcccctccatgtg

SEQ ID NO: 445948 - DNA, 38 bp, M. musculus
tgggcccgagagcgctcttgaataaaaatcctcttgca

SEQ ID NO: 445949 - DNA, 16 bp, M. musculus
tgggccctcccacacc

SEQ ID NO: 445950 - DNA, 16 bp, M. musculus
tgggccctcccatcct

SEQ ID NO: 445951 - DNA, 16 bp, M. musculus
tgggcccttcagcttg

SEQ ID NO: 445952 - DNA, 16 bp, M. musculus
tgggcccttccccatc

SEQ ID NO: 445953 - DNA, 16 bp, M. musculus
tgggccgggcatggtg

SEQ ID NO: 445954 - DNA, 18 bp, M. musculus
tgggcctatctggctctg

SEQ ID NO: 445955 - DNA, 16 bp, M. musculus
tgggcctcagtttccc

SEQ ID NO: 445956 - DNA, 16 bp, M. musculus
tgggcctcctcctggc

SEQ ID NO: 445957 - DNA, 16 bp, M. musculus
tgggcctctctcctgt

SEQ ID NO: 445958 - DNA, 22 bp, M. musculus
tgggcctgagagcgctcttgaa

SEQ ID NO: 445959 - DNA, 16 bp, M. musculus
tgggcctggagggcat

SEQ ID NO: 445960 - DNA, 16 bp, M. musculus
tgggcctggggagatg

SEQ ID NO: 445961 - DNA, 16 bp, M. musculus
tgggcctgtcgctgga

SEQ ID NO: 445962 - DNA, 16 bp, M. musculus
tgggcctgtgaaggct

SEQ ID NO: 445963 - DNA, 16 bp, M. musculus
tgggccttgcattcct

SEQ ID NO: 445964 - DNA, 16 bp, M. musculus
tgggcggtggccagtg

SEQ ID NO: 445965 - DNA, 16 bp, M. musculus
tgggcgtgcaggagaa

SEQ ID NO: 445966 - DNA, 17 bp, M. musculus
tgggcgtggcagaacaa

SEQ ID NO: 445967 - DNA, 16 bp, M. musculus
tgggcgtggtggcaca

SEQ ID NO: 445968 - DNA, 16 bp, M. musculus
tgggctacacaagact

SEQ ID NO: 445969 - DNA, 16 bp, M. musculus
tgggctacacagtgac

SEQ ID NO: 445970 - DNA, 17 bp, M. musculus
tgggctacacagtgaga

SEQ ID NO: 445971 - DNA, 16 bp, M. musculus
tgggctacagaacaag

SEQ ID NO: 445972 - DNA, 16 bp, M. musculus
tgggctacagtgtgag

SEQ ID NO: 445973 - DNA, 16 bp, M. musculus
tgggctacatgaaatc

SEQ ID NO: 445974 - DNA, 16 bp, M. musculus
tgggctaccatgtggt

SEQ ID NO: 445975 - DNA, 16 bp, M. musculus
tgggctagcctcagac

SEQ ID NO: 445976 - DNA, 16 bp, M. musculus
tgggctatagaatgag

SEQ ID NO: 445977 - DNA, 16 bp, M. musculus
tgggctatccaggact

SEQ ID NO: 445978 - DNA, 16 bp, M. musculus
tgggctattgctgtga

SEQ ID NO: 445979 - DNA, 16 bp, M. musculus
tgggctcagagctaaa

SEQ ID NO: 445980 - DNA, 16 bp, M. musculus
tgggctcagtccccag

SEQ ID NO: 445981 - DNA, 16 bp, M. musculus
tgggctccacagtgag

SEQ ID NO: 445982 - DNA, 18 bp, M. musculus
tgggctccatagtttctt

SEQ ID NO: 445983 - DNA, 16 bp, M. musculus
tgggctccattcagag

SEQ ID NO: 445984 - DNA, 16 bp, M. musculus
tgggctctagtggaga

SEQ ID NO: 445985 - DNA, 16 bp, M. musculus
tgggctctctttccac

SEQ ID NO: 445986 - DNA, 16 bp, M. musculus
tgggctctggggactg

SEQ ID NO: 445987 - DNA, 16 bp, M. musculus
tgggctctgtggtgtc

SEQ ID NO: 445988 - DNA, 16 bp, M. musculus
tgggctctttttcttc

SEQ ID NO: 445989 - DNA, 16 bp, M. musculus
tgggctgaaaaagaaa

SEQ ID NO: 445990 - DNA, 16 bp, M. musculus
tgggctgacatctgtg

SEQ ID NO: 445991 - DNA, 16 bp, M. musculus
tgggctgcagagtgag

SEQ ID NO: 445992 - DNA, 16 bp, M. musculus
tgggctgcagtttgtg

SEQ ID NO: 445993 - DNA, 16 bp, M. musculus
tgggctgcccttcccc

SEQ ID NO: 445994 - DNA, 16 bp, M. musculus
tgggctgccgggcagc

SEQ ID NO: 445995 - DNA, 16 bp, M. musculus
tgggctgccttgtcca

SEQ ID NO: 445996 - DNA, 16 bp, M. musculus
tgggctggaaagttca

SEQ ID NO: 445997 - DNA, 16 bp, M. musculus
tgggctggaccctccc

SEQ ID NO: 445998 - DNA, 16 bp, M. musculus
tgggctggagagatgg

SEQ ID NO: 445999 - DNA, 16 bp, M. musculus
tgggctggagaggtgg

SEQ ID NO: 446000 - DNA, 16 bp, M. musculus
tgggctggagtgatgg

SEQ ID NO: 446001 - DNA, 16 bp, M. musculus
tgggctggatcttccc

SEQ ID NO: 446002 - DNA, 16 bp, M. musculus
tgggctggcacttgtg

SEQ ID NO: 446003 - DNA, 16 bp, M. musculus
tgggctggcatttgtg

SEQ ID NO: 446004 - DNA, 16 bp, M. musculus
tgggctggcccctccc

SEQ ID NO: 446005 - DNA, 16 bp, M. musculus
tgggctggctggctgg

SEQ ID NO: 446006 - DNA, 16 bp, M. musculus
tgggctgggagatggc

SEQ ID NO: 446007 - DNA, 16 bp, M. musculus
tgggctgggccttcct

SEQ ID NO: 446008 - DNA, 16 bp, M. musculus
tgggctgggctctctc

SEQ ID NO: 446009 - DNA, 16 bp, M. musculus
tgggctggggagatag

SEQ ID NO: 446010 - DNA, 16 bp, M. musculus
tgggctggggagatgg

SEQ ID NO: 446011 - DNA, 16 bp, M. musculus
tgggctggggatgtag

SEQ ID NO: 446012 - DNA, 16 bp, M. musculus
tgggctgggtccttcc

SEQ ID NO: 446013 - DNA, 16 bp, M. musculus
tgggctggtccctctt

SEQ ID NO: 446014 - DNA, 16 bp, M. musculus
tgggctggtgatcctg

SEQ ID NO: 446015 - DNA, 16 bp, M. musculus
tgggctggtggccctg

SEQ ID NO: 446016 - DNA, 16 bp, M. musculus
tgggctggtggtcctg

SEQ ID NO: 446017 - DNA, 16 bp, M. musculus
tgggctgtataagaaa

SEQ ID NO: 446018 - DNA, 16 bp, M. musculus
tgggctgtggcaaagg

SEQ ID NO: 446019 - DNA, 16 bp, M. musculus
tgggcttcctctcatg

SEQ ID NO: 446020 - DNA, 16 bp, M. musculus
tgggcttgcctggact

SEQ ID NO: 446021 - DNA, 16 bp, M. musculus
tgggcttggcagcaag

SEQ ID NO: 446022 - DNA, 16 bp, M. musculus
tgggcttggtggctca

SEQ ID NO: 446023 - DNA, 16 bp, M. musculus
tgggcttggtggtgca

SEQ ID NO: 446024 - DNA, 16 bp, M. musculus
tgggcttgtaacctgg

SEQ ID NO: 446025 - DNA, 16 bp, M. musculus
tgggctttaacaccct

SEQ ID NO: 446026 - DNA, 16 bp, M. musculus
tgggctttaagacctt

SEQ ID NO: 446027 - DNA, 16 bp, M. musculus
tgggctttaagagcct

SEQ ID NO: 446028 - DNA, 16 bp, M. musculus
tgggctttaaggtttc

SEQ ID NO: 446029 - DNA, 16 bp, M. musculus
tgggctttaataccct

SEQ ID NO: 446030 - DNA, 16 bp, M. musculus
tgggctttgagacctt

SEQ ID NO: 446031 - DNA, 16 bp, M. musculus
tgggctttgagctttc

SEQ ID NO: 446032 - DNA, 16 bp, M. musculus
tgggctttgaggattc

SEQ ID NO: 446033 - DNA, 16 bp, M. musculus
tgggctttgaggtcct

SEQ ID NO: 446034 - DNA, 16 bp, M. musculus
tgggctttgaggtttc

SEQ ID NO: 446035 - DNA, 16 bp, M. musculus
tgggcttttcagtgat

SEQ ID NO: 446036 - DNA, 16 bp, M. musculus
tgggcttttgaaacct

SEQ ID NO: 446037 - DNA, 16 bp, M. musculus
tgggcttttggaacct

SEQ ID NO: 446038 - DNA, 16 bp, M. musculus
tggggaaactgaggca

SEQ ID NO: 446039 - DNA, 16 bp, M. musculus
tggggaaactgagtca

SEQ ID NO: 446040 - DNA, 16 bp, M. musculus
tggggaaagcctcaaa

SEQ ID NO: 446041 - DNA, 16 bp, M. musculus
tggggaaaggattgaa

SEQ ID NO: 446042 - DNA, 16 bp, M. musculus
tggggaaatgactcca

SEQ ID NO: 446043 - DNA, 16 bp, M. musculus
tggggaacaaagtacc

SEQ ID NO: 446044 - DNA, 16 bp, M. musculus
tggggaacagagctaa

SEQ ID NO: 446045 - DNA, 16 bp, M. musculus
tggggaacaggatctt

SEQ ID NO: 446046 - DNA, 16 bp, M. musculus
tggggaacagggagag

SEQ ID NO: 446047 - DNA, 16 bp, M. musculus
tggggaagagcctcca

SEQ ID NO: 446048 - DNA, 16 bp, M. musculus
tggggaagggagcagg

SEQ ID NO: 446049 - DNA, 16 bp, M. musculus
tggggaagtcagagca

SEQ ID NO: 446050 - DNA, 16 bp, M. musculus
tggggaatggattcca

SEQ ID NO: 446051 - DNA, 16 bp, M. musculus
tggggaattctgtgtg

SEQ ID NO: 446052 - DNA, 16 bp, M. musculus
tggggacactgacaag

SEQ ID NO: 446053 - DNA, 16 bp, M. musculus
tggggacagagctcag

SEQ ID NO: 446054 - DNA, 16 bp, M. musculus
tggggacagggaccct

SEQ ID NO: 446055 - DNA, 16 bp, M. musculus
tggggacaggggacag

SEQ ID NO: 446056 - DNA, 16 bp, M. musculus
tggggacagtagtttg

SEQ ID NO: 446057 - DNA, 16 bp, M. musculus
tggggacatccacgtg

SEQ ID NO: 446058 - DNA, 16 bp, M. musculus
tggggacatgaaggcc

SEQ ID NO: 446059 - DNA, 16 bp, M. musculus
tggggacatggctcag

SEQ ID NO: 446060 - DNA, 16 bp, M. musculus
tggggacatggggaca

SEQ ID NO: 446061 - DNA, 16 bp, M. musculus
tggggacattctcttg

SEQ ID NO: 446062 - DNA, 16 bp, M. musculus
tggggaccaaacctgg

SEQ ID NO: 446063 - DNA, 16 bp, M. musculus
tggggaccaaattcag

SEQ ID NO: 446064 - DNA, 16 bp, M. musculus
tggggaccacaatgga

SEQ ID NO: 446065 - DNA, 16 bp, M. musculus
tggggaccattcctat

SEQ ID NO: 446066 - DNA, 16 bp, M. musculus
tggggaccccacgctc

SEQ ID NO: 446067 - DNA, 16 bp, M. musculus
tggggaccctgtgcac

SEQ ID NO: 446068 - DNA, 16 bp, M. musculus
tggggaccctgtgccc

SEQ ID NO: 446069 - DNA, 16 bp, M. musculus
tggggaccgtgtgacc

SEQ ID NO: 446070 - DNA, 16 bp, M. musculus
tggggacctcagactg

SEQ ID NO: 446071 - DNA, 16 bp, M. musculus
tggggactctggagag

SEQ ID NO: 446072 - DNA, 16 bp, M. musculus
tggggactgaacccag

SEQ ID NO: 446073 - DNA, 16 bp, M. musculus
tggggactgaactctg

SEQ ID NO: 446074 - DNA, 16 bp, M. musculus
tggggactgagctcag

SEQ ID NO: 446075 - DNA, 16 bp, M. musculus
tggggactgtgggggc

SEQ ID NO: 446076 - DNA, 16 bp, M. musculus
tggggacttgcttaca

SEQ ID NO: 446077 - DNA, 16 bp, M. musculus
tggggagaaaagggct

SEQ ID NO: 446078 - DNA, 16 bp, M. musculus
tggggagaagagggtt

SEQ ID NO: 446079 - DNA, 16 bp, M. musculus
tggggagaagggcagg

SEQ ID NO: 446080 - DNA, 16 bp, M. musculus
tggggagagggaactt

SEQ ID NO: 446081 - DNA, 16 bp, M. musculus
tggggagagtgggcat

SEQ ID NO: 446082 - DNA, 16 bp, M. musculus
tggggagatgagcagg

SEQ ID NO: 446083 - DNA, 16 bp, M. musculus
tggggagatgcctcag

SEQ ID NO: 446084 - DNA, 16 bp, M. musculus
tggggagatggctcag

SEQ ID NO: 446085 - DNA, 16 bp, M. musculus
tggggagatgtctcag

SEQ ID NO: 446086 - DNA, 16 bp, M. musculus
tggggagcaaagggtt

SEQ ID NO: 446087 - DNA, 16 bp, M. musculus
tggggagcaagtcagt

SEQ ID NO: 446088 - DNA, 16 bp, M. musculus
tggggagcagagggag

SEQ ID NO: 446089 - DNA, 16 bp, M. musculus
tggggagcagggcaag

SEQ ID NO: 446090 - DNA, 16 bp, M. musculus
tggggagcagtgggag

SEQ ID NO: 446091 - DNA, 16 bp, M. musculus
tggggagcctgtgctc

SEQ ID NO: 446092 - DNA, 16 bp, M. musculus
tggggagctggagaca

SEQ ID NO: 446093 - DNA, 16 bp, M. musculus
tggggaggaaagcatt

SEQ ID NO: 446094 - DNA, 16 bp, M. musculus
tggggaggaaaggctt

SEQ ID NO: 446095 - DNA, 16 bp, M. musculus
tggggaggaactggaa

SEQ ID NO: 446096 - DNA, 16 bp, M. musculus
tggggaggacagacag

SEQ ID NO: 446097 - DNA, 16 bp, M. musculus
tggggaggactgtgga

SEQ ID NO: 446098 - DNA, 16 bp, M. musculus
tggggaggagagggct

SEQ ID NO: 446099 - DNA, 16 bp, M. musculus
tggggaggatgtagag

SEQ ID NO: 446100 - DNA, 16 bp, M. musculus
tggggaggcacaggca

SEQ ID NO: 446101 - DNA, 16 bp, M. musculus
tggggaggcagaagtg

SEQ ID NO: 446102 - DNA, 16 bp, M. musculus
tggggaggcgaggcag

SEQ ID NO: 446103 - DNA, 16 bp, M. musculus
tggggaggctggagag

SEQ ID NO: 446104 - DNA, 16 bp, M. musculus
tggggaggggacagag

SEQ ID NO: 446105 - DNA, 16 bp, M. musculus
tggggaggtagctcag

SEQ ID NO: 446106 - DNA, 16 bp, M. musculus
tggggaggtggagaca

SEQ ID NO: 446107 - DNA, 16 bp, M. musculus
tggggagtcctgtgtg

SEQ ID NO: 446108 - DNA, 16 bp, M. musculus
tggggataaatgtcat

SEQ ID NO: 446109 - DNA, 16 bp, M. musculus
tggggatcaaaatcag

SEQ ID NO: 446110 - DNA, 16 bp, M. musculus
tggggatcaaacacag

SEQ ID NO: 446111 - DNA, 16 bp, M. musculus
tggggatcaaacccag

SEQ ID NO: 446112 - DNA, 16 bp, M. musculus
tggggatcaaatccag

SEQ ID NO: 446113 - DNA, 16 bp, M. musculus
tggggatcaagcccag

SEQ ID NO: 446114 - DNA, 17 bp, M. musculus
tggggatccatcccata

SEQ ID NO: 446115 - DNA, 17 bp, M. musculus
tggggatccatcccatt

SEQ ID NO: 446116 - DNA, 16 bp, M. musculus
tggggatcgaacccag

SEQ ID NO: 446117 - DNA, 16 bp, M. musculus
tggggatctaactcag

SEQ ID NO: 446118 - DNA, 16 bp, M. musculus
tggggatgctggggat

SEQ ID NO: 446119 - DNA, 16 bp, M. musculus
tggggatggaacccag

SEQ ID NO: 446120 - DNA, 16 bp, M. musculus
tggggatggaattcag

SEQ ID NO: 446121 - DNA, 16 bp, M. musculus
tggggatggagcccag

SEQ ID NO: 446122 - DNA, 16 bp, M. musculus
tggggatggagcctgg

SEQ ID NO: 446123 - DNA, 16 bp, M. musculus
tggggatggcattagc

SEQ ID NO: 446124 - DNA, 16 bp, M. musculus
tggggatggctcagtg

SEQ ID NO: 446125 - DNA, 16 bp, M. musculus
tggggatgggagcagg

SEQ ID NO: 446126 - DNA, 16 bp, M. musculus
tggggatgtaactcag

SEQ ID NO: 446127 - DNA, 16 bp, M. musculus
tggggatgtagctcag

SEQ ID NO: 446128 - DNA, 16 bp, M. musculus
tggggatgtagcttag

SEQ ID NO: 446129 - DNA, 16 bp, M. musculus
tggggatgtatctcag

SEQ ID NO: 446130 - DNA, 16 bp, M. musculus
tggggatgtggctcag

SEQ ID NO: 446131 - DNA, 16 bp, M. musculus
tggggatgtggcttag

SEQ ID NO: 446132 - DNA, 16 bp, M. musculus
tggggattaaaggtgt

SEQ ID NO: 446133 - DNA, 16 bp, M. musculus
tggggatttgaactca

SEQ ID NO: 446134 - DNA, 16 bp, M. musculus
tggggatttgagtcca

SEQ ID NO: 446135 - DNA, 16 bp, M. musculus
tggggattttcttttt

SEQ ID NO: 446136 - DNA, 16 bp, M. musculus
tggggcaatggctcag

SEQ ID NO: 446137 - DNA, 16 bp, M. musculus
tggggcagaggaaatg

SEQ ID NO: 446138 - DNA, 16 bp, M. musculus
tggggcagcatgcaca

SEQ ID NO: 446139 - DNA, 16 bp, M. musculus
tggggcagtagctgag

SEQ ID NO: 446140 - DNA, 16 bp, M. musculus
tggggcagtttctaga

SEQ ID NO: 446141 - DNA, 16 bp, M. musculus
tggggcagtttctgga

SEQ ID NO: 446142 - DNA, 16 bp, M. musculus
tggggcatcaagcttt

SEQ ID NO: 446143 - DNA, 16 bp, M. musculus
tggggcattttcttga

SEQ ID NO: 446144 - DNA, 16 bp, M. musculus
tggggccaagcagccc

SEQ ID NO: 446145 - DNA, 16 bp, M. musculus
tggggccagcctggga

SEQ ID NO: 446146 - DNA, 16 bp, M. musculus
tggggccagctcacct

SEQ ID NO: 446147 - DNA, 16 bp, M. musculus
tggggccatctcagga

SEQ ID NO: 446148 - DNA, 16 bp, M. musculus
tggggccattctcatt

SEQ ID NO: 446149 - DNA, 16 bp, M. musculus
tggggccattttcatt

SEQ ID NO: 446150 - DNA, 16 bp, M. musculus
tggggcccccagtctc

SEQ ID NO: 446151 - DNA, 16 bp, M. musculus
tggggcctccagactc

SEQ ID NO: 446152 - DNA, 16 bp, M. musculus
tggggcctccaggctc

SEQ ID NO: 446153 - DNA, 16 bp, M. musculus
tggggcctccagtgtc

SEQ ID NO: 446154 - DNA, 16 bp, M. musculus
tggggctaaagaatca

SEQ ID NO: 446155 - DNA, 16 bp, M. musculus
tggggctagcctgggc

SEQ ID NO: 446156 - DNA, 16 bp, M. musculus
tggggctcagtgctga

SEQ ID NO: 446157 - DNA, 16 bp, M. musculus
tggggctcatggctct

SEQ ID NO: 446158 - DNA, 16 bp, M. musculus
tggggctcgctggcca

SEQ ID NO: 446159 - DNA, 16 bp, M. musculus
tggggctctgagctga

SEQ ID NO: 446160 - DNA, 16 bp, M. musculus
tggggctgagaggaag

SEQ ID NO: 446161 - DNA, 16 bp, M. musculus
tggggctgagggtact

SEQ ID NO: 446162 - DNA, 16 bp, M. musculus
tggggctgcaaacttc

SEQ ID NO: 446163 - DNA, 16 bp, M. musculus
tggggctgcagacccc

SEQ ID NO: 446164 - DNA, 17 bp, M. musculus
tggggctgcccagagcc

SEQ ID NO: 446165 - DNA, 16 bp, M. musculus
tggggctggaaagatg

SEQ ID NO: 446166 - DNA, 16 bp, M. musculus
tggggctggaaggaag

SEQ ID NO: 446167 - DNA, 16 bp, M. musculus
tggggctggagaaatg

SEQ ID NO: 446168 - DNA, 16 bp, M. musculus
tggggctggagagctg

SEQ ID NO: 446169 - DNA, 16 bp, M. musculus
tggggctggagccatg

SEQ ID NO: 446170 - DNA, 16 bp, M. musculus
tggggctggagctcag

SEQ ID NO: 446171 - DNA, 16 bp, M. musculus
tggggctggaggagga

SEQ ID NO: 446172 - DNA, 16 bp, M. musculus
tggggctggattacag

SEQ ID NO: 446173 - DNA, 16 bp, M. musculus
tggggctggccctgac

SEQ ID NO: 446174 - DNA, 19 bp, M. musculus
tggggctggcgagatggct

SEQ ID NO: 446175 - DNA, 16 bp, M. musculus
tggggctggctggcca

SEQ ID NO: 446176 - DNA, 16 bp, M. musculus
tggggctggctgtgga

SEQ ID NO: 446177 - DNA, 16 bp, M. musculus
tggggctggcttacag

SEQ ID NO: 446178 - DNA, 16 bp, M. musculus
tggggctggcttattg

SEQ ID NO: 446179 - DNA, 16 bp, M. musculus
tggggctgggaggaaa

SEQ ID NO: 446180 - DNA, 16 bp, M. musculus
tggggctggggatgta

SEQ ID NO: 446181 - DNA, 16 bp, M. musculus
tggggctggtgaaatg

SEQ ID NO: 446182 - DNA, 16 bp, M. musculus
tggggctgtgagtgag

SEQ ID NO: 446183 - DNA, 16 bp, M. musculus
tggggctttcaaagtt

SEQ ID NO: 446184 - DNA, 16 bp, M. musculus
tgggggaaaaaaatct

SEQ ID NO: 446185 - DNA, 16 bp, M. musculus
tgggggaagggggtac

SEQ ID NO: 446186 - DNA, 16 bp, M. musculus
tgggggaatttttgaa

SEQ ID NO: 446187 - DNA, 16 bp, M. musculus
tgggggacagaggcag

SEQ ID NO: 446188 - DNA, 16 bp, M. musculus
tgggggagcagcctca

SEQ ID NO: 446189 - DNA, 16 bp, M. musculus
tgggggagcctgtggg

SEQ ID NO: 446190 - DNA, 16 bp, M. musculus
tgggggaggggagacc

SEQ ID NO: 446191 - DNA, 16 bp, M. musculus
tgggggagtctctgga

SEQ ID NO: 446192 - DNA, 16 bp, M. musculus
tgggggatctggttgg

SEQ ID NO: 446193 - DNA, 16 bp, M. musculus
tgggggatggggaaat

SEQ ID NO: 446194 - DNA, 18 bp, M. musculus
tgggggattctaggcagg

SEQ ID NO: 446195 - DNA, 16 bp, M. musculus
tgggggcagggagcag

SEQ ID NO: 446196 - DNA, 16 bp, M. musculus
tgggggccccagggag

SEQ ID NO: 446197 - DNA, 16 bp, M. musculus
tgggggccctgggttc

SEQ ID NO: 446198 - DNA, 16 bp, M. musculus
tgggggctctgtgttc

SEQ ID NO: 446199 - DNA, 16 bp, M. musculus
tgggggctggaaactt

SEQ ID NO: 446200 - DNA, 16 bp, M. musculus
tgggggctgggaattg

SEQ ID NO: 446201 - DNA, 17 bp, M. musculus
tgggggcttggtcagta

SEQ ID NO: 446202 - DNA, 16 bp, M. musculus
tggggggaaaaaagca

SEQ ID NO: 446203 - DNA, 16 bp, M. musculus
tggggggagacagaga

SEQ ID NO: 446204 - DNA, 16 bp, M. musculus
tggggggcagaggcag

SEQ ID NO: 446205 - DNA, 17 bp, M. musculus
tggggggctggtgagat

SEQ ID NO: 446206 - DNA, 16 bp, M. musculus
tggggggtcaccacaa

SEQ ID NO: 446207 - DNA, 16 bp, M. musculus
tgggggtgaatatgat

SEQ ID NO: 446208 - DNA, 16 bp, M. musculus
tgggggtggactttga

SEQ ID NO: 446209 - DNA, 16 bp, M. musculus
tgggggtggagacagg

SEQ ID NO: 446210 - DNA, 16 bp, M. musculus
tgggggtggagggaca

SEQ ID NO: 446211 - DNA, 16 bp, M. musculus
tgggggtggggacatt

SEQ ID NO: 446212 - DNA, 16 bp, M. musculus
tgggggtggggagcac

SEQ ID NO: 446213 - DNA, 16 bp, M. musculus
tgggggtggggataaa

SEQ ID NO: 446214 - DNA, 16 bp, M. musculus
tgggggtggggcacag

SEQ ID NO: 446215 - DNA, 16 bp, M. musculus
tgggggtggggctcag

SEQ ID NO: 446216 - DNA, 16 bp, M. musculus
tgggggtggggcttga

SEQ ID NO: 446217 - DNA, 16 bp, M. musculus
tgggggtgggggtcac

SEQ ID NO: 446218 - DNA, 16 bp, M. musculus
tgggggtgtggctcag

SEQ ID NO: 446219 - DNA, 18 bp, M. musculus
tggggtacaaaagggaaa

SEQ ID NO: 446220 - DNA, 16 bp, M. musculus
tggggtacagagtgag

SEQ ID NO: 446221 - DNA, 17 bp, M. musculus
tggggtagtctctggat

SEQ ID NO: 446222 - DNA, 16 bp, M. musculus
tggggtatataatctt

SEQ ID NO: 446223 - DNA, 16 bp, M. musculus
tggggtatgccagcca

SEQ ID NO: 446224 - DNA, 16 bp, M. musculus
tggggtcaaaggcgtg

SEQ ID NO: 446225 - DNA, 16 bp, M. musculus
tggggtcagagccctc

SEQ ID NO: 446226 - DNA, 16 bp, M. musculus
tggggtcccagtgctg

SEQ ID NO: 446227 - DNA, 16 bp, M. musculus
tggggtccccaatgga

SEQ ID NO: 446228 - DNA, 16 bp, M. musculus
tggggtccccggggtg

SEQ ID NO: 446229 - DNA, 16 bp, M. musculus
tggggtctggggagat

SEQ ID NO: 446230 - DNA, 16 bp, M. musculus
tggggtcttctgcaag

SEQ ID NO: 446231 - DNA, 17 bp, M. musculus
tggggtcttctgctgca

SEQ ID NO: 446232 - DNA, 16 bp, M. musculus
tggggtgaaaccagga

SEQ ID NO: 446233 - DNA, 16 bp, M. musculus
tggggtgaaagcctgc

SEQ ID NO: 446234 - DNA, 16 bp, M. musculus
tggggtgaagaattcc

SEQ ID NO: 446235 - DNA, 16 bp, M. musculus
tggggtgcagacagag

SEQ ID NO: 446236 - DNA, 16 bp, M. musculus
tggggtgcctggggac

SEQ ID NO: 446237 - DNA, 16 bp, M. musculus
tggggtggaaccctgg

SEQ ID NO: 446238 - DNA, 16 bp, M. musculus
tggggtggactttgag

SEQ ID NO: 446239 - DNA, 16 bp, M. musculus
tggggtggatcccagg

SEQ ID NO: 446240 - DNA, 16 bp, M. musculus
tggggtggtttgaata

SEQ ID NO: 446241 - DNA, 16 bp, M. musculus
tggggtgtataagaaa

SEQ ID NO: 446242 - DNA, 16 bp, M. musculus
tggggtgtcatggtta

SEQ ID NO: 446243 - DNA, 17 bp, M. musculus
tggggttaaaggtgtgc

SEQ ID NO: 446244 - DNA, 16 bp, M. musculus
tggggttacctcactc

SEQ ID NO: 446245 - DNA, 16 bp, M. musculus
tggggttataggcata

SEQ ID NO: 446246 - DNA, 16 bp, M. musculus
tggggttcactggcca

SEQ ID NO: 446247 - DNA, 16 bp, M. musculus
tggggttgaacccagg

SEQ ID NO: 446248 - DNA, 16 bp, M. musculus
tggggtttgaacctag

SEQ ID NO: 446249 - DNA, 17 bp, M. musculus
tggggtttgcattgaat

SEQ ID NO: 446250 - DNA, 16 bp, M. musculus
tggggttttcccagtc

SEQ ID NO: 446251 - DNA, 16 bp, M. musculus
tggggtttttttcccc

SEQ ID NO: 446252 - DNA, 16 bp, M. musculus
tgggtaaaagcctgtg

SEQ ID NO: 446253 - DNA, 16 bp, M. musculus
tgggtaaactgaggca

SEQ ID NO: 446254 - DNA, 16 bp, M. musculus
tgggtaaaggggaaaa

SEQ ID NO: 446255 - DNA, 16 bp, M. musculus
tgggtaagggtgcttg

SEQ ID NO: 446256 - DNA, 16 bp, M. musculus
tgggtaccaccccacc

SEQ ID NO: 446257 - DNA, 16 bp, M. musculus
tgggtaccaggcatgc

SEQ ID NO: 446258 - DNA, 16 bp, M. musculus
tgggtaccttgtggct

SEQ ID NO: 446259 - DNA, 17 bp, M. musculus
tgggtactttgtggctt

SEQ ID NO: 446260 - DNA, 16 bp, M. musculus
tgggtaggagaacagg

SEQ ID NO: 446261 - DNA, 16 bp, M. musculus
tgggtaggggaccagg

SEQ ID NO: 446262 - DNA, 16 bp, M. musculus
tgggtagtgccattct

SEQ ID NO: 446263 - DNA, 16 bp, M. musculus
tgggtatatgttaaga

SEQ ID NO: 446264 - DNA, 16 bp, M. musculus
tgggtatatttgcttc

SEQ ID NO: 446265 - DNA, 16 bp, M. musculus
tgggtatggtggctca

SEQ ID NO: 446266 - DNA, 16 bp, M. musculus
tgggtatgttgttgct

SEQ ID NO: 446267 - DNA, 16 bp, M. musculus
tgggtattctgtaatt

SEQ ID NO: 446268 - DNA, 16 bp, M. musculus
tgggtattctgtatgg

SEQ ID NO: 446269 - DNA, 16 bp, M. musculus
tgggtattgaacctgg

SEQ ID NO: 446270 - DNA, 16 bp, M. musculus
tgggtatttttttaaa

SEQ ID NO: 446271 - DNA, 16 bp, M. musculus
tgggtcaagacccctt

SEQ ID NO: 446272 - DNA, 16 bp, M. musculus
tgggtcacaacccctg

SEQ ID NO: 446273 - DNA, 16 bp, M. musculus
tgggtcacttctccag

SEQ ID NO: 446274 - DNA, 16 bp, M. musculus
tgggtcacttcttcag

SEQ ID NO: 446275 - DNA, 16 bp, M. musculus
tgggtcagaagttttg

SEQ ID NO: 446276 - DNA, 16 bp, M. musculus
tgggtcagcctgggct

SEQ ID NO: 446277 - DNA, 16 bp, M. musculus
tgggtcatgtttgtgt

SEQ ID NO: 446278 - DNA, 16 bp, M. musculus
tgggtcattttcttga

SEQ ID NO: 446279 - DNA, 16 bp, M. musculus
tgggtccagagcagcc

SEQ ID NO: 446280 - DNA, 16 bp, M. musculus
tgggtccagggcagcc

SEQ ID NO: 446281 - DNA, 16 bp, M. musculus
tgggtcccactggtcc

SEQ ID NO: 446282 - DNA, 16 bp, M. musculus
tgggtcccagggacca

SEQ ID NO: 446283 - DNA, 16 bp, M. musculus
tgggtcccagggatgg

SEQ ID NO: 446284 - DNA, 16 bp, M. musculus
tgggtccccagaaccc

SEQ ID NO: 446285 - DNA, 16 bp, M. musculus
tgggtcccctgaagct

SEQ ID NO: 446286 - DNA, 16 bp, M. musculus
tgggtcccctggaact

SEQ ID NO: 446287 - DNA, 16 bp, M. musculus
tgggtccctccaggtg

SEQ ID NO: 446288 - DNA, 16 bp, M. musculus
tgggtccctggatatg

SEQ ID NO: 446289 - DNA, 16 bp, M. musculus
tgggtccctggctcct

SEQ ID NO: 446290 - DNA, 16 bp, M. musculus
tgggtcctcaggcagt

SEQ ID NO: 446291 - DNA, 16 bp, M. musculus
tgggtcctccggaaga

SEQ ID NO: 446292 - DNA, 16 bp, M. musculus
tgggtcctctagaaaa

SEQ ID NO: 446293 - DNA, 16 bp, M. musculus
tgggtcctctgcaaga

SEQ ID NO: 446294 - DNA, 16 bp, M. musculus
tgggtcctctgccaga

SEQ ID NO: 446295 - DNA, 16 bp, M. musculus
tgggtcctctggaaga

SEQ ID NO: 446296 - DNA, 16 bp, M. musculus
tgggtcctgaataact

SEQ ID NO: 446297 - DNA, 16 bp, M. musculus
tgggtcctgagaactg

SEQ ID NO: 446298 - DNA, 16 bp, M. musculus
tgggtcctgggaacct

SEQ ID NO: 446299 - DNA, 16 bp, M. musculus
tgggtcctgggaactt

SEQ ID NO: 446300 - DNA, 16 bp, M. musculus
tgggtcctgggatcct

SEQ ID NO: 446301 - DNA, 16 bp, M. musculus
tgggtcctttgcaaga

SEQ ID NO: 446302 - DNA, 16 bp, M. musculus
tgggtctacaaagtga

SEQ ID NO: 446303 - DNA, 16 bp, M. musculus
tgggtctatttttatt

SEQ ID NO: 446304 - DNA, 16 bp, M. musculus
tgggtctcaagtcttc

SEQ ID NO: 446305 - DNA, 16 bp, M. musculus
tgggtctcagccttcc

SEQ ID NO: 446306 - DNA, 16 bp, M. musculus
tgggtctctgagttca

SEQ ID NO: 446307 - DNA, 16 bp, M. musculus
tgggtctctgcatctg

SEQ ID NO: 446308 - DNA, 16 bp, M. musculus
tgggtctgaggccagc

SEQ ID NO: 446309 - DNA, 16 bp, M. musculus
tgggtctggcttatag

SEQ ID NO: 446310 - DNA, 16 bp, M. musculus
tgggtctgtctgtctg

SEQ ID NO: 446311 - DNA, 16 bp, M. musculus
tgggtctgtggattgt

SEQ ID NO: 446312 - DNA, 16 bp, M. musculus
tgggtcttcccacctc

SEQ ID NO: 446313 - DNA, 16 bp, M. musculus
tgggtcttcccacctt

SEQ ID NO: 446314 - DNA, 16 bp, M. musculus
tgggtcttcctgtggt

SEQ ID NO: 446315 - DNA, 16 bp, M. musculus
tgggtcttctggaaga

SEQ ID NO: 446316 - DNA, 16 bp, M. musculus
tgggtctttctgtggt

SEQ ID NO: 446317 - DNA, 16 bp, M. musculus
tgggtgaagtgcttgc

SEQ ID NO: 446318 - DNA, 16 bp, M. musculus
tgggtgacaatgtcac

SEQ ID NO: 446319 - DNA, 16 bp, M. musculus
tgggtgacagctcaca

SEQ ID NO: 446320 - DNA, 16 bp, M. musculus
tgggtgacctggaact

SEQ ID NO: 446321 - DNA, 16 bp, M. musculus
tgggtgactctgtctg

SEQ ID NO: 446322 - DNA, 16 bp, M. musculus
tgggtgagagtccttg

SEQ ID NO: 446323 - DNA, 16 bp, M. musculus
tgggtgattgaggcca

SEQ ID NO: 446324 - DNA, 16 bp, M. musculus
tgggtgcagagccagc

SEQ ID NO: 446325 - DNA, 16 bp, M. musculus
tgggtgctaggagctg

SEQ ID NO: 446326 - DNA, 16 bp, M. musculus
tgggtgctggagactg

SEQ ID NO: 446327 - DNA, 16 bp, M. musculus
tgggtgctgggacctg

SEQ ID NO: 446328 - DNA, 16 bp, M. musculus
tgggtgctgggatctg

SEQ ID NO: 446329 - DNA, 16 bp, M. musculus
tgggtgctgtcccgag

SEQ ID NO: 446330 - DNA, 16 bp, M. musculus
tgggtgctgtgggact

SEQ ID NO: 446331 - DNA, 16 bp, M. musculus
tgggtggagacaggag

SEQ ID NO: 446332 - DNA, 16 bp, M. musculus
tgggtggagccatctc

SEQ ID NO: 446333 - DNA, 16 bp, M. musculus
tgggtggagcttgagc

SEQ ID NO: 446334 - DNA, 16 bp, M. musculus
tgggtggaggagcact

SEQ ID NO: 446335 - DNA, 16 bp, M. musculus
tgggtggagtctctca

SEQ ID NO: 446336 - DNA, 16 bp, M. musculus
tgggtggataaatgga

SEQ ID NO: 446337 - DNA, 16 bp, M. musculus
tgggtggcaccattcc

SEQ ID NO: 446338 - DNA, 16 bp, M. musculus
tgggtggctccatccc

SEQ ID NO: 446339 - DNA, 16 bp, M. musculus
tgggtggctgtgagca

SEQ ID NO: 446340 - DNA, 16 bp, M. musculus
tgggtgggcagggcag

SEQ ID NO: 446341 - DNA, 16 bp, M. musculus
tgggtgggtgcaggag

SEQ ID NO: 446342 - DNA, 16 bp, M. musculus
tgggtgggtgcatgtg

SEQ ID NO: 446343 - DNA, 16 bp, M. musculus
tgggtgggtggcagag

SEQ ID NO: 446344 - DNA, 16 bp, M. musculus
tgggtggtaccattct

SEQ ID NO: 446345 - DNA, 16 bp, M. musculus
tgggtggtcttgaact

SEQ ID NO: 446346 - DNA, 16 bp, M. musculus
tgggtggtggaggcag

SEQ ID NO: 446347 - DNA, 16 bp, M. musculus
tgggtggtgggctaga

SEQ ID NO: 446348 - DNA, 16 bp, M. musculus
tgggtggtgggctgga

SEQ ID NO: 446349 - DNA, 16 bp, M. musculus
tgggtgtactggctgg

SEQ ID NO: 446350 - DNA, 16 bp, M. musculus
tgggtgtactgggttc

SEQ ID NO: 446351 - DNA, 16 bp, M. musculus
tgggtgtagtggcaca

SEQ ID NO: 446352 - DNA, 16 bp, M. musculus
tgggtgtagtggtgca

SEQ ID NO: 446353 - DNA, 16 bp, M. musculus
tgggtgtattccaggg

SEQ ID NO: 446354 - DNA, 16 bp, M. musculus
tgggtgtccgcagact

SEQ ID NO: 446355 - DNA, 16 bp, M. musculus
tgggtgtctggctgtg

SEQ ID NO: 446356 - DNA, 16 bp, M. musculus
tgggtgtgaggtggaa

SEQ ID NO: 446357 - DNA, 16 bp, M. musculus
tgggtgtgatggctca

SEQ ID NO: 446358 - DNA, 16 bp, M. musculus
tgggtgtgatggtgca

SEQ ID NO: 446359 - DNA, 16 bp, M. musculus
tgggtgtgcatgtgca

SEQ ID NO: 446360 - DNA, 16 bp, M. musculus
tgggtgtgcatgtgtg

SEQ ID NO: 446361 - DNA, 16 bp, M. musculus
tgggtgtggcagcaca

SEQ ID NO: 446362 - DNA, 16 bp, M. musculus
tgggtgtggccttctt

SEQ ID NO: 446363 - DNA, 16 bp, M. musculus
tgggtgtggtagcaca

SEQ ID NO: 446364 - DNA, 16 bp, M. musculus
tgggtgtggtagtgca

SEQ ID NO: 446365 - DNA, 16 bp, M. musculus
tgggtgtggtgataca

SEQ ID NO: 446366 - DNA, 16 bp, M. musculus
tgggtgtggtgctgca

SEQ ID NO: 446367 - DNA, 16 bp, M. musculus
tgggtgtggtggctta

SEQ ID NO: 446368 - DNA, 16 bp, M. musculus
tgggtgtggtggttca

SEQ ID NO: 446369 - DNA, 16 bp, M. musculus
tgggtgtgtcagaact

SEQ ID NO: 446370 - DNA, 16 bp, M. musculus
tgggtgtgtctgtctg

SEQ ID NO: 446371 - DNA, 16 bp, M. musculus
tgggtgtgtggctcag

SEQ ID NO: 446372 - DNA, 16 bp, M. musculus
tgggtgttctgcctgc

SEQ ID NO: 446373 - DNA, 16 bp, M. musculus
tgggtgttgggaatta

SEQ ID NO: 446374 - DNA, 16 bp, M. musculus
tgggtgttggtggcac

SEQ ID NO: 446375 - DNA, 16 bp, M. musculus
tgggttaaaggtgtgt

SEQ ID NO: 446376 - DNA, 16 bp, M. musculus
tgggttaaatgtacac

SEQ ID NO: 446377 - DNA, 16 bp, M. musculus
tgggttacatagtaag

SEQ ID NO: 446378 - DNA, 16 bp, M. musculus
tgggttacatcactca

SEQ ID NO: 446379 - DNA, 16 bp, M. musculus
tgggttacctcactca

SEQ ID NO: 446380 - DNA, 16 bp, M. musculus
tgggttcaaatcctga

SEQ ID NO: 446381 - DNA, 16 bp, M. musculus
tgggttcaatccccag

SEQ ID NO: 446382 - DNA, 16 bp, M. musculus
tgggttcaattgccag

SEQ ID NO: 446383 - DNA, 16 bp, M. musculus
tgggttcagtcctcag

SEQ ID NO: 446384 - DNA, 16 bp, M. musculus
tgggttcattccagct

SEQ ID NO: 446385 - DNA, 16 bp, M. musculus
tgggttccattcccag

SEQ ID NO: 446386 - DNA, 16 bp, M. musculus
tgggttccattctcag

SEQ ID NO: 446387 - DNA, 16 bp, M. musculus
tgggttccatttccag

SEQ ID NO: 446388 - DNA, 16 bp, M. musculus
tgggttccctctcatg

SEQ ID NO: 446389 - DNA, 16 bp, M. musculus
tgggttcctagcactc

SEQ ID NO: 446390 - DNA, 45 bp, M. musculus
tgggttctagcctggaaaggcattttggaaacctggaagagaaga

SEQ ID NO: 446391 - DNA, 16 bp, M. musculus
tgggttctattgactg

SEQ ID NO: 446392 - DNA, 16 bp, M. musculus
tgggttctctgtaaga

SEQ ID NO: 446393 - DNA, 16 bp, M. musculus
tgggttctgatgatgt

SEQ ID NO: 446394 - DNA, 16 bp, M. musculus
tgggttctgggaacag

SEQ ID NO: 446395 - DNA, 16 bp, M. musculus
tgggttctgggaatct

SEQ ID NO: 446396 - DNA, 16 bp, M. musculus
tgggttctgggacctg

SEQ ID NO: 446397 - DNA, 16 bp, M. musculus
tgggttctgggagctg

SEQ ID NO: 446398 - DNA, 16 bp, M. musculus
tgggttcttgggaata

SEQ ID NO: 446399 - DNA, 16 bp, M. musculus
tgggttgaatccccag

SEQ ID NO: 446400 - DNA, 16 bp, M. musculus
tgggttggaagtggat

SEQ ID NO: 446401 - DNA, 16 bp, M. musculus
tgggttggtgagcatg

SEQ ID NO: 446402 - DNA, 16 bp, M. musculus
tgggttggtgttccaa

SEQ ID NO: 446403 - DNA, 16 bp, M. musculus
tgggttgtttctggct

SEQ ID NO: 446404 - DNA, 16 bp, M. musculus
tgggtttagtgtctgt

SEQ ID NO: 446405 - DNA, 17 bp, M. musculus
tgggtttcacggggcct

SEQ ID NO: 446406 - DNA, 16 bp, M. musculus
tgggtttcctgtagct

SEQ ID NO: 446407 - DNA, 16 bp, M. musculus
tgggtttcctgtgtgc

SEQ ID NO: 446408 - DNA, 16 bp, M. musculus
tgggtttctccatgtg

SEQ ID NO: 446409 - DNA, 16 bp, M. musculus
tgggtttctctgtata

SEQ ID NO: 446410 - DNA, 16 bp, M. musculus
tgggtttctctgtgta

SEQ ID NO: 446411 - DNA, 16 bp, M. musculus
tgggtttctgagttca

SEQ ID NO: 446412 - DNA, 16 bp, M. musculus
tgggtttctgagttcg

SEQ ID NO: 446413 - DNA, 16 bp, M. musculus
tgggtttgaatcccag

SEQ ID NO: 446414 - DNA, 16 bp, M. musculus
tgggtttgatctctag

SEQ ID NO: 446415 - DNA, 16 bp, M. musculus
tgggtttgatggctgt

SEQ ID NO: 446416 - DNA, 16 bp, M. musculus
tgggtttgatttccag

SEQ ID NO: 446417 - DNA, 16 bp, M. musculus
tgggtttgtcagagtt

SEQ ID NO: 446418 - DNA, 16 bp, M. musculus
tgggttttaaaaaaaa

SEQ ID NO: 446419 - DNA, 16 bp, M. musculus
tgggttttaaaagaaa

SEQ ID NO: 446420 - DNA, 16 bp, M. musculus
tgggtttttcctttga

SEQ ID NO: 446421 - DNA, 16 bp, M. musculus
tgggtttttcttttaa

SEQ ID NO: 446422 - DNA, 16 bp, M. musculus
tgggtttttttcccca

SEQ ID NO: 446423 - DNA, 16 bp, M. musculus
tggtaaaacaccatga

SEQ ID NO: 446424 - DNA, 16 bp, M. musculus
tggtaaaatggaagga

SEQ ID NO: 446425 - DNA, 16 bp, M. musculus
tggtaaacactgggac

SEQ ID NO: 446426 - DNA, 16 bp, M. musculus
tggtaaacctaaattt

SEQ ID NO: 446427 - DNA, 16 bp, M. musculus
tggtaaagagacagac

SEQ ID NO: 446428 - DNA, 17 bp, M. musculus
tggtaaagcctttgcag

SEQ ID NO: 446429 - DNA, 16 bp, M. musculus
tggtaaagtgcttgcc

SEQ ID NO: 446430 - DNA, 16 bp, M. musculus
tggtaaatgatcattt

SEQ ID NO: 446431 - DNA, 16 bp, M. musculus
tggtaacccagaccca

SEQ ID NO: 446432 - DNA, 16 bp, M. musculus
tggtaagaagctggaa

SEQ ID NO: 446433 - DNA, 16 bp, M. musculus
tggtaagaatgtggag

SEQ ID NO: 446434 - DNA, 16 bp, M. musculus
tggtaagcctcaaccc

SEQ ID NO: 446435 - DNA, 16 bp, M. musculus
tggtaataaagacaca

SEQ ID NO: 446436 - DNA, 16 bp, M. musculus
tggtaatactatgtcc

SEQ ID NO: 446437 - DNA, 16 bp, M. musculus
tggtaatctctggcgt

SEQ ID NO: 446438 - DNA, 16 bp, M. musculus
tggtaatgatggtgat

SEQ ID NO: 446439 - DNA, 16 bp, M. musculus
tggtacacacctgtaa

SEQ ID NO: 446440 - DNA, 16 bp, M. musculus
tggtacacagacatgc

SEQ ID NO: 446441 - DNA, 16 bp, M. musculus
tggtacacatctttaa

SEQ ID NO: 446442 - DNA, 16 bp, M. musculus
tggtacagacctttaa

SEQ ID NO: 446443 - DNA, 17 bp, M. musculus
tggtacagcaacagaca

SEQ ID NO: 446444 - DNA, 16 bp, M. musculus
tggtacaggaaacaag

SEQ ID NO: 446445 - DNA, 16 bp, M. musculus
tggtacatacctttag

SEQ ID NO: 446446 - DNA, 16 bp, M. musculus
tggtacatgcctataa

SEQ ID NO: 446447 - DNA, 16 bp, M. musculus
tggtacattctggaag

SEQ ID NO: 446448 - DNA, 16 bp, M. musculus
tggtacattctggaga

SEQ ID NO: 446449 - DNA, 16 bp, M. musculus
tggtaccaatttgttt

SEQ ID NO: 446450 - DNA, 16 bp, M. musculus
tggtaccacccacaat

SEQ ID NO: 446451 - DNA, 16 bp, M. musculus
tggtaccagggagtgg

SEQ ID NO: 446452 - DNA, 16 bp, M. musculus
tggtacctcttcacag

SEQ ID NO: 446453 - DNA, 16 bp, M. musculus
tggtactccttaagca

SEQ ID NO: 446454 - DNA, 20 bp, M. musculus
tggtactccttttccctgaa

SEQ ID NO: 446455 - DNA, 16 bp, M. musculus
tggtactgcccacagt

SEQ ID NO: 446456 - DNA, 16 bp, M. musculus
tggtactggaattaca

SEQ ID NO: 446457 - DNA, 16 bp, M. musculus
tggtactggtggtggt

SEQ ID NO: 446458 - DNA, 16 bp, M. musculus
tggtactggttttgaa

SEQ ID NO: 446459 - DNA, 16 bp, M. musculus
tggtagaaatctttat

SEQ ID NO: 446460 - DNA, 16 bp, M. musculus
tggtagaaatcttttt

SEQ ID NO: 446461 - DNA, 17 bp, M. musculus
tggtagaagcaaaattt

SEQ ID NO: 446462 - DNA, 16 bp, M. musculus
tggtagaagcggggca

SEQ ID NO: 446463 - DNA, 16 bp, M. musculus
tggtagaaggaaagaa

SEQ ID NO: 446464 - DNA, 16 bp, M. musculus
tggtagaaggagagaa

SEQ ID NO: 446465 - DNA, 16 bp, M. musculus
tggtagaaggagagga

SEQ ID NO: 446466 - DNA, 16 bp, M. musculus
tggtagaatttctggg

SEQ ID NO: 446467 - DNA, 16 bp, M. musculus
tggtagaccaggctgg

SEQ ID NO: 446468 - DNA, 16 bp, M. musculus
tggtagagcatctttt

SEQ ID NO: 446469 - DNA, 16 bp, M. musculus
tggtagagcatttgct

SEQ ID NO: 446470 - DNA, 16 bp, M. musculus
tggtagagggagacac

SEQ ID NO: 446471 - DNA, 16 bp, M. musculus
tggtagagggagagaa

SEQ ID NO: 446472 - DNA, 16 bp, M. musculus
tggtagagtacttgcc

SEQ ID NO: 446473 - DNA, 16 bp, M. musculus
tggtagagtccctgcc

SEQ ID NO: 446474 - DNA, 16 bp, M. musculus
tggtagagtgcttgcc

SEQ ID NO: 446475 - DNA, 16 bp, M. musculus
tggtagatattgttgt

SEQ ID NO: 446476 - DNA, 16 bp, M. musculus
tggtagattatattga

SEQ ID NO: 446477 - DNA, 16 bp, M. musculus
tggtagatttttactt

SEQ ID NO: 446478 - DNA, 16 bp, M. musculus
tggtagcacaggcctt

SEQ ID NO: 446479 - DNA, 16 bp, M. musculus
tggtaggaggagagaa

SEQ ID NO: 446480 - DNA, 16 bp, M. musculus
tggtaggatgcttgcc

SEQ ID NO: 446481 - DNA, 16 bp, M. musculus
tggtaggatggctcag

SEQ ID NO: 446482 - DNA, 16 bp, M. musculus
tggtagggcttgggct

SEQ ID NO: 446483 - DNA, 16 bp, M. musculus
tggtagtacatacctt

SEQ ID NO: 446484 - DNA, 16 bp, M. musculus
tggtagtatacttaag

SEQ ID NO: 446485 - DNA, 16 bp, M. musculus
tggtagtgcaagcctt

SEQ ID NO: 446486 - DNA, 16 bp, M. musculus
tggtagtggtagtggt

SEQ ID NO: 446487 - DNA, 16 bp, M. musculus
tggtagttatgagaat

SEQ ID NO: 446488 - DNA, 16 bp, M. musculus
tggtataaaaattggt

SEQ ID NO: 446489 - DNA, 16 bp, M. musculus
tggtatagccacagac

SEQ ID NO: 446490 - DNA, 16 bp, M. musculus
tggtatatatgtgtat

SEQ ID NO: 446491 - DNA, 16 bp, M. musculus
tggtatattcagggct

SEQ ID NO: 446492 - DNA, 16 bp, M. musculus
tggtatctgcagatgg

SEQ ID NO: 446493 - DNA, 16 bp, M. musculus
tggtatctttattgat

SEQ ID NO: 446494 - DNA, 16 bp, M. musculus
tggtatgggaggactt

SEQ ID NO: 446495 - DNA, 16 bp, M. musculus
tggtatggtatggtat

SEQ ID NO: 446496 - DNA, 16 bp, M. musculus
tggtattataactgta

SEQ ID NO: 446497 - DNA, 16 bp, M. musculus
tggtattcctcaggta

SEQ ID NO: 446498 - DNA, 16 bp, M. musculus
tggtattgctgggtct

SEQ ID NO: 446499 - DNA, 16 bp, M. musculus
tggtattttgatgggg

SEQ ID NO: 446500 - DNA, 16 bp, M. musculus
tggtcaaatctatttg

SEQ ID NO: 446501 - DNA, 16 bp, M. musculus
tggtcaaggaagatat

SEQ ID NO: 446502 - DNA, 16 bp, M. musculus
tggtcaatgaagaaat

SEQ ID NO: 446503 - DNA, 16 bp, M. musculus
tggtcaattttggaaa

SEQ ID NO: 446504 - DNA, 16 bp, M. musculus
tggtcacaggagctgg

SEQ ID NO: 446505 - DNA, 16 bp, M. musculus
tggtcaccagggagtg

SEQ ID NO: 446506 - DNA, 16 bp, M. musculus
tggtcaccatggcaac

SEQ ID NO: 446507 - DNA, 16 bp, M. musculus
tggtcactggacctcc

SEQ ID NO: 446508 - DNA, 16 bp, M. musculus
tggtcagagacaggat

SEQ ID NO: 446509 - DNA, 16 bp, M. musculus
tggtcagaggacaact

SEQ ID NO: 446510 - DNA, 16 bp, M. musculus
tggtcagatttttttt

SEQ ID NO: 446511 - DNA, 16 bp, M. musculus
tggtcagcatggatga

SEQ ID NO: 446512 - DNA, 16 bp, M. musculus
tggtcagctgcttctg

SEQ ID NO: 446513 - DNA, 16 bp, M. musculus
tggtcaggcactggca

SEQ ID NO: 446514 - DNA, 16 bp, M. musculus
tggtcagtttggagaa

SEQ ID NO: 446515 - DNA, 16 bp, M. musculus
tggtcatcaggcttgg

SEQ ID NO: 446516 - DNA, 16 bp, M. musculus
tggtcatctcatggtc

SEQ ID NO: 446517 - DNA, 16 bp, M. musculus
tggtcatgatattttg

SEQ ID NO: 446518 - DNA, 16 bp, M. musculus
tggtcatggtgtttct

SEQ ID NO: 446519 - DNA, 16 bp, M. musculus
tggtcatttcctcagt

SEQ ID NO: 446520 - DNA, 32 bp, M. musculus
tggtccacagataacagacaataacactgact

SEQ ID NO: 446521 - DNA, 16 bp, M. musculus
tggtccagaaaagaaa

SEQ ID NO: 446522 - DNA, 16 bp, M. musculus
tggtccagctctggca

SEQ ID NO: 446523 - DNA, 16 bp, M. musculus
tggtccagtatttgaa

SEQ ID NO: 446524 - DNA, 16 bp, M. musculus
tggtccagtccctggg

SEQ ID NO: 446525 - DNA, 16 bp, M. musculus
tggtccatagagtgag

SEQ ID NO: 446526 - DNA, 16 bp, M. musculus
tggtccatcctttttg

SEQ ID NO: 446527 - DNA, 16 bp, M. musculus
tggtccccaacccacc

SEQ ID NO: 446528 - DNA, 16 bp, M. musculus
tggtccccataggctc

SEQ ID NO: 446529 - DNA, 16 bp, M. musculus
tggtcccctggaagag

SEQ ID NO: 446530 - DNA, 16 bp, M. musculus
tggtcccttttgccaa

SEQ ID NO: 446531 - DNA, 16 bp, M. musculus
tggtcctcagccttcc

SEQ ID NO: 446532 - DNA, 16 bp, M. musculus
tggtcctcctgcctct

SEQ ID NO: 446533 - DNA, 16 bp, M. musculus
tggtcctctccttcca

SEQ ID NO: 446534 - DNA, 16 bp, M. musculus
tggtcctctggctctt

SEQ ID NO: 446535 - DNA, 16 bp, M. musculus
tggtcctgagaaagct

SEQ ID NO: 446536 - DNA, 16 bp, M. musculus
tggtcctgagttatat

SEQ ID NO: 446537 - DNA, 16 bp, M. musculus
tggtcctgagttcaat

SEQ ID NO: 446538 - DNA, 16 bp, M. musculus
tggtcctgagttctat

SEQ ID NO: 446539 - DNA, 16 bp, M. musculus
tggtcctggagaagga

SEQ ID NO: 446540 - DNA, 16 bp, M. musculus
tggtcctgggattttt

SEQ ID NO: 446541 - DNA, 16 bp, M. musculus
tggtcctgggcatttt

SEQ ID NO: 446542 - DNA, 16 bp, M. musculus
tggtcctgggttgtgt

SEQ ID NO: 446543 - DNA, 16 bp, M. musculus
tggtcctgtgaaggat

SEQ ID NO: 446544 - DNA, 16 bp, M. musculus
tggtcctgtgagggct

SEQ ID NO: 446545 - DNA, 16 bp, M. musculus
tggtcctgtggaagag

SEQ ID NO: 446546 - DNA, 16 bp, M. musculus
tggtcctttgatttga

SEQ ID NO: 446547 - DNA, 16 bp, M. musculus
tggtcctttggaagaa

SEQ ID NO: 446548 - DNA, 16 bp, M. musculus
tggtcctttgtaagag

SEQ ID NO: 446549 - DNA, 16 bp, M. musculus
tggtcgggatggtggc

SEQ ID NO: 446550 - DNA, 16 bp, M. musculus
tggtcgtgagctacca

SEQ ID NO: 446551 - DNA, 16 bp, M. musculus
tggtcgtgcagacttt

SEQ ID NO: 446552 - DNA, 16 bp, M. musculus
tggtctacaaagagag

SEQ ID NO: 446553 - DNA, 16 bp, M. musculus
tggtctacacagtgaa

SEQ ID NO: 446554 - DNA, 16 bp, M. musculus
tggtctacagagcaaa

SEQ ID NO: 446555 - DNA, 16 bp, M. musculus
tggtctacagattaag

SEQ ID NO: 446556 - DNA, 16 bp, M. musculus
tggtctacatactgag

SEQ ID NO: 446557 - DNA, 16 bp, M. musculus
tggtctacatagtgaa

SEQ ID NO: 446558 - DNA, 16 bp, M. musculus
tggtctcactatgtag

SEQ ID NO: 446559 - DNA, 16 bp, M. musculus
tggtctcagactcaga

SEQ ID NO: 446560 - DNA, 16 bp, M. musculus
tggtctccacacacac

SEQ ID NO: 446561 - DNA, 16 bp, M. musculus
tggtctcccttcttct

SEQ ID NO: 446562 - DNA, 16 bp, M. musculus
tggtctcctgctttct

SEQ ID NO: 446563 - DNA, 16 bp, M. musculus
tggtctctacaggtac

SEQ ID NO: 446564 - DNA, 17 bp, M. musculus
tggtctctacaggttct

SEQ ID NO: 446565 - DNA, 16 bp, M. musculus
tggtctctagttggtg

SEQ ID NO: 446566 - DNA, 16 bp, M. musculus
tggtctctcaggagtg

SEQ ID NO: 446567 - DNA, 16 bp, M. musculus
tggtctctctgtctga

SEQ ID NO: 446568 - DNA, 16 bp, M. musculus
tggtctctgagagact

SEQ ID NO: 446569 - DNA, 16 bp, M. musculus
tggtctctgagggaca

SEQ ID NO: 446570 - DNA, 16 bp, M. musculus
tggtctctggcctcca

SEQ ID NO: 446571 - DNA, 16 bp, M. musculus
tggtctcttcaggcac

SEQ ID NO: 446572 - DNA, 16 bp, M. musculus
tggtctctttcctagg

SEQ ID NO: 446573 - DNA, 16 bp, M. musculus
tggtctgagaaagaaa

SEQ ID NO: 446574 - DNA, 16 bp, M. musculus
tggtctgctcccctga

SEQ ID NO: 446575 - DNA, 16 bp, M. musculus
tggtctggaacttgct

SEQ ID NO: 446576 - DNA, 16 bp, M. musculus
tggtctggctctggca

SEQ ID NO: 446577 - DNA, 16 bp, M. musculus
tggtctgggattattt

SEQ ID NO: 446578 - DNA, 16 bp, M. musculus
tggtctgggtgactct

SEQ ID NO: 446579 - DNA, 16 bp, M. musculus
tggtctggtctggtct

SEQ ID NO: 446580 - DNA, 16 bp, M. musculus
tggtctggtgctgctg

SEQ ID NO: 446581 - DNA, 16 bp, M. musculus
tggtctgtaaacttaa

SEQ ID NO: 446582 - DNA, 16 bp, M. musculus
tggtctgtaggttgta

SEQ ID NO: 446583 - DNA, 16 bp, M. musculus
tggtctgtgaattttt

SEQ ID NO: 446584 - DNA, 16 bp, M. musculus
tggtctgtgctgctgc

SEQ ID NO: 446585 - DNA, 16 bp, M. musculus
tggtcttaatattagc

SEQ ID NO: 446586 - DNA, 16 bp, M. musculus
tggtcttaggtgaccc

SEQ ID NO: 446587 - DNA, 17 bp, M. musculus
tggtcttcaattctatt

SEQ ID NO: 446588 - DNA, 16 bp, M. musculus
tggtcttcagtctaca

SEQ ID NO: 446589 - DNA, 16 bp, M. musculus
tggtcttcatagtgag

SEQ ID NO: 446590 - DNA, 16 bp, M. musculus
tggtcttcattctctt

SEQ ID NO: 446591 - DNA, 16 bp, M. musculus
tggtcttcattctttt

SEQ ID NO: 446592 - DNA, 16 bp, M. musculus
tggtcttcccatgggg

SEQ ID NO: 446593 - DNA, 16 bp, M. musculus
tggtcttccttgttct

SEQ ID NO: 446594 - DNA, 16 bp, M. musculus
tggtcttcctttgggg

SEQ ID NO: 446595 - DNA, 16 bp, M. musculus
tggtcttctgcaagag

SEQ ID NO: 446596 - DNA, 16 bp, M. musculus
tggtcttctttattct

SEQ ID NO: 446597 - DNA, 16 bp, M. musculus
tggtcttgaactcaga

SEQ ID NO: 446598 - DNA, 16 bp, M. musculus
tggtcttgaactcagt

SEQ ID NO: 446599 - DNA, 16 bp, M. musculus
tggtcttgaacttaca

SEQ ID NO: 446600 - DNA, 16 bp, M. musculus
tggtcttgctgtctct

SEQ ID NO: 446601 - DNA, 16 bp, M. musculus
tggtcttgctttctct

SEQ ID NO: 446602 - DNA, 16 bp, M. musculus
tggtcttggtgtctgt

SEQ ID NO: 446603 - DNA, 16 bp, M. musculus
tggtcttgttttcctg

SEQ ID NO: 446604 - DNA, 16 bp, M. musculus
tggtctttatcacagc

SEQ ID NO: 446605 - DNA, 16 bp, M. musculus
tggtctttccttccat

SEQ ID NO: 446606 - DNA, 16 bp, M. musculus
tggtctttcctttagt

SEQ ID NO: 446607 - DNA, 16 bp, M. musculus
tggtctttctcctccc

SEQ ID NO: 446608 - DNA, 16 bp, M. musculus
tggtcttttcataatg

SEQ ID NO: 446609 - DNA, 16 bp, M. musculus
tggtcttttctcttta

SEQ ID NO: 446610 - DNA, 16 bp, M. musculus
tggtgaaaggaaagaa

SEQ ID NO: 446611 - DNA, 16 bp, M. musculus
tggtgaaaggacccag

SEQ ID NO: 446612 - DNA, 16 bp, M. musculus
tggtgaagaatgtggc

SEQ ID NO: 446613 - DNA, 16 bp, M. musculus
tggtgaagagcactga

SEQ ID NO: 446614 - DNA, 16 bp, M. musculus
tggtgaagatgcagcc

SEQ ID NO: 446615 - DNA, 16 bp, M. musculus
tggtgaagcttagttg

SEQ ID NO: 446616 - DNA, 17 bp, M. musculus
tggtgaaggattacttt

SEQ ID NO: 446617 - DNA, 16 bp, M. musculus
tggtgaaggtgtagcc

SEQ ID NO: 446618 - DNA, 16 bp, M. musculus
tggtgaagtgggagtg

SEQ ID NO: 446619 - DNA, 16 bp, M. musculus
tggtgacaaacagaaa

SEQ ID NO: 446620 - DNA, 16 bp, M. musculus
tggtgacagagctgtg

SEQ ID NO: 446621 - DNA, 16 bp, M. musculus
tggtgacatggctcag

SEQ ID NO: 446622 - DNA, 16 bp, M. musculus
tggtgaccccagccat

SEQ ID NO: 446623 - DNA, 16 bp, M. musculus
tggtgacccccccccc

SEQ ID NO: 446624 - DNA, 16 bp, M. musculus
tggtgacctcagagca

SEQ ID NO: 446625 - DNA, 16 bp, M. musculus
tggtgactggaacaca

SEQ ID NO: 446626 - DNA, 16 bp, M. musculus
tggtgactgtacatgg

SEQ ID NO: 446627 - DNA, 16 bp, M. musculus
tggtgagaaggctcag

SEQ ID NO: 446628 - DNA, 16 bp, M. musculus
tggtgagaatgtggaa

SEQ ID NO: 446629 - DNA, 16 bp, M. musculus
tggtgagacagctcag

SEQ ID NO: 446630 - DNA, 16 bp, M. musculus
tggtgagaccctatct

SEQ ID NO: 446631 - DNA, 18 bp, M. musculus
tggtgagatggctcagtt

SEQ ID NO: 446632 - DNA, 16 bp, M. musculus
tggtgagcaggaggaa

SEQ ID NO: 446633 - DNA, 16 bp, M. musculus
tggtgagcaggcagag

SEQ ID NO: 446634 - DNA, 16 bp, M. musculus
tggtgagcagggagag

SEQ ID NO: 446635 - DNA, 16 bp, M. musculus
tggtgaggaaaacacc

SEQ ID NO: 446636 - DNA, 16 bp, M. musculus
tggtgaggatgtaaag

SEQ ID NO: 446637 - DNA, 16 bp, M. musculus
tggtgaggtggctcag

SEQ ID NO: 446638 - DNA, 16 bp, M. musculus
tggtgagtgagtgagt

SEQ ID NO: 446639 - DNA, 16 bp, M. musculus
tggtgagtggtcttag

SEQ ID NO: 446640 - DNA, 16 bp, M. musculus
tggtgatcactggaaa

SEQ ID NO: 446641 - DNA, 16 bp, M. musculus
tggtgatccccaacca

SEQ ID NO: 446642 - DNA, 16 bp, M. musculus
tggtgatgaaaagcag

SEQ ID NO: 446643 - DNA, 16 bp, M. musculus
tggtgatgaacagcca

SEQ ID NO: 446644 - DNA, 16 bp, M. musculus
tggtgatgaagatgat

SEQ ID NO: 446645 - DNA, 16 bp, M. musculus
tggtgatgacgatgat

SEQ ID NO: 446646 - DNA, 16 bp, M. musculus
tggtgatgactatgat

SEQ ID NO: 446647 - DNA, 16 bp, M. musculus
tggtgatgatgatgtg

SEQ ID NO: 446648 - DNA, 16 bp, M. musculus
tggtgatgatgctgat

SEQ ID NO: 446649 - DNA, 16 bp, M. musculus
tggtgatgatggtgat

SEQ ID NO: 446650 - DNA, 16 bp, M. musculus
tggtgatgatggtggt

SEQ ID NO: 446651 - DNA, 16 bp, M. musculus
tggtgatgatgttgat

SEQ ID NO: 446652 - DNA, 16 bp, M. musculus
tggtgatgcacacctg

SEQ ID NO: 446653 - DNA, 16 bp, M. musculus
tggtgatggcacacac

SEQ ID NO: 446654 - DNA, 16 bp, M. musculus
tggtgatggtaatgat

SEQ ID NO: 446655 - DNA, 16 bp, M. musculus
tggtgatggtgatgat

SEQ ID NO: 446656 - DNA, 16 bp, M. musculus
tggtgattcagactct

SEQ ID NO: 446657 - DNA, 16 bp, M. musculus
tggtgattccaccaaa

SEQ ID NO: 446658 - DNA, 16 bp, M. musculus
tggtgattcctcctga

SEQ ID NO: 446659 - DNA, 16 bp, M. musculus
tggtgattctgttagc

SEQ ID NO: 446660 - DNA, 16 bp, M. musculus
tggtgatttgaatatg

SEQ ID NO: 446661 - DNA, 16 bp, M. musculus
tggtgcaaaagctaga

SEQ ID NO: 446662 - DNA, 16 bp, M. musculus
tggtgcacacctgtaa

SEQ ID NO: 446663 - DNA, 16 bp, M. musculus
tggtgcacagacagac

SEQ ID NO: 446664 - DNA, 16 bp, M. musculus
tggtgcacaggcatac

SEQ ID NO: 446665 - DNA, 16 bp, M. musculus
tggtgcacatacatac

SEQ ID NO: 446666 - DNA, 16 bp, M. musculus
tggtgcacatatgaac

SEQ ID NO: 446667 - DNA, 16 bp, M. musculus
tggtgcacatctgcaa

SEQ ID NO: 446668 - DNA, 16 bp, M. musculus
tggtgcaggaggaact

SEQ ID NO: 446669 - DNA, 18 bp, M. musculus
tggtgcaggaggagctga

SEQ ID NO: 446670 - DNA, 16 bp, M. musculus
tggtgcaggcagaact

SEQ ID NO: 446671 - DNA, 16 bp, M. musculus
tggtgcagtctctgga

SEQ ID NO: 446672 - DNA, 17 bp, M. musculus
tggtgcatagatattca

SEQ ID NO: 446673 - DNA, 16 bp, M. musculus
tggtgcatataaagtt

SEQ ID NO: 446674 - DNA, 16 bp, M. musculus
tggtgcatgcatttaa

SEQ ID NO: 446675 - DNA, 16 bp, M. musculus
tggtgcatgcctgtca

SEQ ID NO: 446676 - DNA, 16 bp, M. musculus
tggtgcatgctttaat

SEQ ID NO: 446677 - DNA, 16 bp, M. musculus
tggtgcatggcctgct

SEQ ID NO: 446678 - DNA, 18 bp, M. musculus
tggtgccaaaacccggga

SEQ ID NO: 446679 - DNA, 16 bp, M. musculus
tggtgccactcctggg

SEQ ID NO: 446680 - DNA, 16 bp, M. musculus
tggtgccgcccacagt

SEQ ID NO: 446681 - DNA, 16 bp, M. musculus
tggtgcctcacaacca

SEQ ID NO: 446682 - DNA, 16 bp, M. musculus
tggtgcctgtgtgtgt

SEQ ID NO: 446683 - DNA, 16 bp, M. musculus
tggtgctagagcagta

SEQ ID NO: 446684 - DNA, 16 bp, M. musculus
tggtgctcagcttgct

SEQ ID NO: 446685 - DNA, 16 bp, M. musculus
tggtgctctgttcagg

SEQ ID NO: 446686 - DNA, 19 bp, M. musculus
tggtgctcttaaccactga

SEQ ID NO: 446687 - DNA, 16 bp, M. musculus
tggtgctcttgcagaa

SEQ ID NO: 446688 - DNA, 16 bp, M. musculus
tggtgctgaagaagga

SEQ ID NO: 446689 - DNA, 16 bp, M. musculus
tggtgctgaaggagct

SEQ ID NO: 446690 - DNA, 16 bp, M. musculus
tggtgctgacatcctg

SEQ ID NO: 446691 - DNA, 16 bp, M. musculus
tggtgctgatgctggt

SEQ ID NO: 446692 - DNA, 16 bp, M. musculus
tggtgctgcacacctt

SEQ ID NO: 446693 - DNA, 16 bp, M. musculus
tggtgctgcagaagga

SEQ ID NO: 446694 - DNA, 16 bp, M. musculus
tggtgctgcatgcctg

SEQ ID NO: 446695 - DNA, 16 bp, M. musculus
tggtgctggagaaaga

SEQ ID NO: 446696 - DNA, 16 bp, M. musculus
tggtgctggagaagta

SEQ ID NO: 446697 - DNA, 16 bp, M. musculus
tggtgctggagagatg

SEQ ID NO: 446698 - DNA, 16 bp, M. musculus
tggtgctggagcagga

SEQ ID NO: 446699 - DNA, 16 bp, M. musculus
tggtgctggaggagga

SEQ ID NO: 446700 - DNA, 18 bp, M. musculus
tggtgctggcacaactgg

SEQ ID NO: 446701 - DNA, 16 bp, M. musculus
tggtgctggcacaagt

SEQ ID NO: 446702 - DNA, 17 bp, M. musculus
tggtgctggcacacctg

SEQ ID NO: 446703 - DNA, 16 bp, M. musculus
tggtgctggcaccaac

SEQ ID NO: 446704 - DNA, 16 bp, M. musculus
tggtgctggcttacag

SEQ ID NO: 446705 - DNA, 16 bp, M. musculus
tggtgctgggattgca

SEQ ID NO: 446706 - DNA, 16 bp, M. musculus
tggtgctgggatttga

SEQ ID NO: 446707 - DNA, 16 bp, M. musculus
tggtgctggggaagga

SEQ ID NO: 446708 - DNA, 16 bp, M. musculus
tggtgctggggaagta

SEQ ID NO: 446709 - DNA, 16 bp, M. musculus
tggtgctggggacaga

SEQ ID NO: 446710 - DNA, 16 bp, M. musculus
tggtgctgtctgaaga

SEQ ID NO: 446711 - DNA, 16 bp, M. musculus
tggtgctgtgaaggct

SEQ ID NO: 446712 - DNA, 16 bp, M. musculus
tggtgctgtttgagga

SEQ ID NO: 446713 - DNA, 16 bp, M. musculus
tggtgcttatcacagc

SEQ ID NO: 446714 - DNA, 16 bp, M. musculus
tggtgcttttctctct

SEQ ID NO: 446715 - DNA, 16 bp, M. musculus
tggtggaaggaaagaa

SEQ ID NO: 446716 - DNA, 16 bp, M. musculus
tggtggaaggaacagg

SEQ ID NO: 446717 - DNA, 16 bp, M. musculus
tggtggaaggaaggaa

SEQ ID NO: 446718 - DNA, 16 bp, M. musculus
tggtggaaggagaaaa

SEQ ID NO: 446719 - DNA, 16 bp, M. musculus
tggtggacaggaagca

SEQ ID NO: 446720 - DNA, 16 bp, M. musculus
tggtggactcaggacc

SEQ ID NO: 446721 - DNA, 16 bp, M. musculus
tggtggagcaggcctt

SEQ ID NO: 446722 - DNA, 16 bp, M. musculus
tggtggagcatgcctt

SEQ ID NO: 446723 - DNA, 16 bp, M. musculus
tggtggagcctctcca

SEQ ID NO: 446724 - DNA, 16 bp, M. musculus
tggtggagcctctctg

SEQ ID NO: 446725 - DNA, 16 bp, M. musculus
tggtggagctggtaca

SEQ ID NO: 446726 - DNA, 16 bp, M. musculus
tggtggaggagaaagt

SEQ ID NO: 446727 - DNA, 16 bp, M. musculus
tggtggaggagaaggt

SEQ ID NO: 446728 - DNA, 16 bp, M. musculus
tggtggagttccttat

SEQ ID NO: 446729 - DNA, 16 bp, M. musculus
tggtggatctgtcagg

SEQ ID NO: 446730 - DNA, 16 bp, M. musculus
tggtggatgatgtctt

SEQ ID NO: 446731 - DNA, 16 bp, M. musculus
tggtggatgctgggaa

SEQ ID NO: 446732 - DNA, 16 bp, M. musculus
tggtggcaagcgcctt

SEQ ID NO: 446733 - DNA, 16 bp, M. musculus
tggtggcaagtgcctt

SEQ ID NO: 446734 - DNA, 16 bp, M. musculus
tggtggcacaactggt

SEQ ID NO: 446735 - DNA, 17 bp, M. musculus
tggtggcacacacgttt

SEQ ID NO: 446736 - DNA, 16 bp, M. musculus
tggtggcacacacttt

SEQ ID NO: 446737 - DNA, 22 bp, M. musculus
tggtggcacacgcctttaatcc

SEQ ID NO: 446738 - DNA, 16 bp, M. musculus
tggtggcacccacctt

SEQ ID NO: 446739 - DNA, 16 bp, M. musculus
tggtggcagatgcctt

SEQ ID NO: 446740 - DNA, 16 bp, M. musculus
tggtggcagcctatat

SEQ ID NO: 446741 - DNA, 16 bp, M. musculus
tggtggcaggaacagc

SEQ ID NO: 446742 - DNA, 16 bp, M. musculus
tggtggcaggaacagg

SEQ ID NO: 446743 - DNA, 16 bp, M. musculus
tggtggcaggaacatg

SEQ ID NO: 446744 - DNA, 16 bp, M. musculus
tggtggcaggagctga

SEQ ID NO: 446745 - DNA, 16 bp, M. musculus
tggtggcagtggtggc

SEQ ID NO: 446746 - DNA, 17 bp, M. musculus
tggtggcagtggtggtg

SEQ ID NO: 446747 - DNA, 16 bp, M. musculus
tggtggcatgtacctt

SEQ ID NO: 446748 - DNA, 16 bp, M. musculus
tggtggccaaagctgt

SEQ ID NO: 446749 - DNA, 28 bp, M. musculus
tggtggccagcagtagtcagtgccactc

SEQ ID NO: 446750 - DNA, 16 bp, M. musculus
tggtggccatgccttt

SEQ ID NO: 446751 - DNA, 16 bp, M. musculus
tggtggcccacaacca

SEQ ID NO: 446752 - DNA, 16 bp, M. musculus
tggtggcccacacctg

SEQ ID NO: 446753 - DNA, 16 bp, M. musculus
tggtggcccacagcca

SEQ ID NO: 446754 - DNA, 16 bp, M. musculus
tggtggcctgcttctt

SEQ ID NO: 446755 - DNA, 16 bp, M. musculus
tggtggcctgtgcctt

SEQ ID NO: 446756 - DNA, 16 bp, M. musculus
tggtggcgctgtttgg

SEQ ID NO: 446757 - DNA, 16 bp, M. musculus
tggtggctcaaaacca

SEQ ID NO: 446758 - DNA, 16 bp, M. musculus
tggtggctcacaacaa

SEQ ID NO: 446759 - DNA, 16 bp, M. musculus
tggtggctcacaacta

SEQ ID NO: 446760 - DNA, 16 bp, M. musculus
tggtggctcacaactg

SEQ ID NO: 446761 - DNA, 16 bp, M. musculus
tggtggctcacacctg

SEQ ID NO: 446762 - DNA, 16 bp, M. musculus
tggtggctcacagctg

SEQ ID NO: 446763 - DNA, 16 bp, M. musculus
tggtggctcagtctct

SEQ ID NO: 446764 - DNA, 16 bp, M. musculus
tggtggctcagtttct

SEQ ID NO: 446765 - DNA, 16 bp, M. musculus
tggtggctctagctgc

SEQ ID NO: 446766 - DNA, 16 bp, M. musculus
tggtggctgctgctgc

SEQ ID NO: 446767 - DNA, 16 bp, M. musculus
tggtggctgcttatgg

SEQ ID NO: 446768 - DNA, 16 bp, M. musculus
tggtggcttagtgtct

SEQ ID NO: 446769 - DNA, 16 bp, M. musculus
tggtggcttcctcctc

SEQ ID NO: 446770 - DNA, 16 bp, M. musculus
tggtgggaaaggcatg

SEQ ID NO: 446771 - DNA, 16 bp, M. musculus
tggtgggaagcatggt

SEQ ID NO: 446772 - DNA, 16 bp, M. musculus
tggtgggaaggatggc

SEQ ID NO: 446773 - DNA, 16 bp, M. musculus
tggtgggaatgtaaat

SEQ ID NO: 446774 - DNA, 16 bp, M. musculus
tggtgggagaaatggg

SEQ ID NO: 446775 - DNA, 16 bp, M. musculus
tggtgggagcatggca

SEQ ID NO: 446776 - DNA, 16 bp, M. musculus
tggtgggatggctcag

SEQ ID NO: 446777 - DNA, 17 bp, M. musculus
tggtgggattgcaagct

SEQ ID NO: 446778 - DNA, 16 bp, M. musculus
tggtgggattgtaggc

SEQ ID NO: 446779 - DNA, 16 bp, M. musculus
tggtgggccgcagaca

SEQ ID NO: 446780 - DNA, 16 bp, M. musculus
tggtgggctacaaggg

SEQ ID NO: 446781 - DNA, 16 bp, M. musculus
tggtggggaaggcatg

SEQ ID NO: 446782 - DNA, 16 bp, M. musculus
tggtggggacagaatg

SEQ ID NO: 446783 - DNA, 16 bp, M. musculus
tggtggggcagtttct

SEQ ID NO: 446784 - DNA, 16 bp, M. musculus
tggtggggccagctct

SEQ ID NO: 446785 - DNA, 16 bp, M. musculus
tggtggggctggcccc

SEQ ID NO: 446786 - DNA, 16 bp, M. musculus
tggtgggggatgggcc

SEQ ID NO: 446787 - DNA, 16 bp, M. musculus
tggtgggggatgggct

SEQ ID NO: 446788 - DNA, 16 bp, M. musculus
tggtgggggctcctgg

SEQ ID NO: 446789 - DNA, 16 bp, M. musculus
tggtggtaacagaccc

SEQ ID NO: 446790 - DNA, 16 bp, M. musculus
tggtggtacatgccta

SEQ ID NO: 446791 - DNA, 17 bp, M. musculus
tggtggtacatgccttt

SEQ ID NO: 446792 - DNA, 16 bp, M. musculus
tggtggtagtgatggt

SEQ ID NO: 446793 - DNA, 16 bp, M. musculus
tggtggtatagctcca

SEQ ID NO: 446794 - DNA, 16 bp, M. musculus
tggtggtatatgcctt

SEQ ID NO: 446795 - DNA, 16 bp, M. musculus
tggtggtcagagccct

SEQ ID NO: 446796 - DNA, 16 bp, M. musculus
tggtggtcagaggaca

SEQ ID NO: 446797 - DNA, 16 bp, M. musculus
tggtggtcagcctcag

SEQ ID NO: 446798 - DNA, 16 bp, M. musculus
tggtggtcctgggttt

SEQ ID NO: 446799 - DNA, 16 bp, M. musculus
tggtggtccttggttc

SEQ ID NO: 446800 - DNA, 16 bp, M. musculus
tggtggtgaacagcag

SEQ ID NO: 446801 - DNA, 16 bp, M. musculus
tggtggtgaacgcctt

SEQ ID NO: 446802 - DNA, 16 bp, M. musculus
tggtggtgatgatgat

SEQ ID NO: 446803 - DNA, 16 bp, M. musculus
tggtggtgatggtgat

SEQ ID NO: 446804 - DNA, 16 bp, M. musculus
tggtggtgatggtggc

SEQ ID NO: 446805 - DNA, 16 bp, M. musculus
tggtggtgcacacctt

SEQ ID NO: 446806 - DNA, 16 bp, M. musculus
tggtggtgctgctggt

SEQ ID NO: 446807 - DNA, 16 bp, M. musculus
tggtggtggagaagga

SEQ ID NO: 446808 - DNA, 16 bp, M. musculus
tggtggtggcacactc

SEQ ID NO: 446809 - DNA, 16 bp, M. musculus
tggtggtggccttttt

SEQ ID NO: 446810 - DNA, 16 bp, M. musculus
tggtggtggcgcatgc

SEQ ID NO: 446811 - DNA, 16 bp, M. musculus
tggtggtggtagtgct

SEQ ID NO: 446812 - DNA, 16 bp, M. musculus
tggtggtggtcctggt

SEQ ID NO: 446813 - DNA, 16 bp, M. musculus
tggtggtggtgatgat

SEQ ID NO: 446814 - DNA, 16 bp, M. musculus
tggtggtggtggcagc

SEQ ID NO: 446815 - DNA, 16 bp, M. musculus
tggtggtggtggggca

SEQ ID NO: 446816 - DNA, 16 bp, M. musculus
tggtggtgtgaatgag

SEQ ID NO: 446817 - DNA, 16 bp, M. musculus
tggtggttaagagcac

SEQ ID NO: 446818 - DNA, 16 bp, M. musculus
tggtggttcaaaacca

SEQ ID NO: 446819 - DNA, 16 bp, M. musculus
tggtggttcaatctct

SEQ ID NO: 446820 - DNA, 16 bp, M. musculus
tggtggttcagtgtct

SEQ ID NO: 446821 - DNA, 18 bp, M. musculus
tggtggttcctcagaaaa

SEQ ID NO: 446822 - DNA, 16 bp, M. musculus
tggtggttcctgagaa

SEQ ID NO: 446823 - DNA, 16 bp, M. musculus
tggtggtttctcaaaa

SEQ ID NO: 446824 - DNA, 16 bp, M. musculus
tggtggtttgaatata

SEQ ID NO: 446825 - DNA, 16 bp, M. musculus
tggtggttttggcaga

SEQ ID NO: 446826 - DNA, 16 bp, M. musculus
tggtgtaattctggta

SEQ ID NO: 446827 - DNA, 20 bp, M. musculus
tggtgtagaggagaatcgac

SEQ ID NO: 446828 - DNA, 16 bp, M. musculus
tggtgtaggtgtggcc

SEQ ID NO: 446829 - DNA, 16 bp, M. musculus
tggtgtatgcctgtaa

SEQ ID NO: 446830 - DNA, 16 bp, M. musculus
tggtgtatgtgtgagt

SEQ ID NO: 446831 - DNA, 16 bp, M. musculus
tggtgtcacccacagt

SEQ ID NO: 446832 - DNA, 16 bp, M. musculus
tggtgtcaccgtttgg

SEQ ID NO: 446833 - DNA, 16 bp, M. musculus
tggtgtcacttctcca

SEQ ID NO: 446834 - DNA, 16 bp, M. musculus
tggtgtcatctttgtt

SEQ ID NO: 446835 - DNA, 16 bp, M. musculus
tggtgtccagtgcaca

SEQ ID NO: 446836 - DNA, 16 bp, M. musculus
tggtgtccccctccct

SEQ ID NO: 446837 - DNA, 16 bp, M. musculus
tggtgtccctgctggt

SEQ ID NO: 446838 - DNA, 16 bp, M. musculus
tggtgtccttgacccc

SEQ ID NO: 446839 - DNA, 16 bp, M. musculus
tggtgtccttgacctc

SEQ ID NO: 446840 - DNA, 16 bp, M. musculus
tggtgtctctagctgc

SEQ ID NO: 446841 - DNA, 16 bp, M. musculus
tggtgtctctgaagag

SEQ ID NO: 446842 - DNA, 16 bp, M. musculus
tggtgtctctttatag

SEQ ID NO: 446843 - DNA, 16 bp, M. musculus
tggtgtctgcagatgt

SEQ ID NO: 446844 - DNA, 16 bp, M. musculus
tggtgtctgggaccct

SEQ ID NO: 446845 - DNA, 16 bp, M. musculus
tggtgtctgtagatgg

SEQ ID NO: 446846 - DNA, 16 bp, M. musculus
tggtgtcttatcacag

SEQ ID NO: 446847 - DNA, 16 bp, M. musculus
tggtgtcttcactgga

SEQ ID NO: 446848 - DNA, 16 bp, M. musculus
tggtgtcttcctcagt

SEQ ID NO: 446849 - DNA, 16 bp, M. musculus
tggtgtcttctgcacc

SEQ ID NO: 446850 - DNA, 16 bp, M. musculus
tggtgtcttcttcaat

SEQ ID NO: 446851 - DNA, 16 bp, M. musculus
tggtgtgaatgtgtgt

SEQ ID NO: 446852 - DNA, 16 bp, M. musculus
tggtgtgatggctcag

SEQ ID NO: 446853 - DNA, 16 bp, M. musculus
tggtgtgctgcagttt

SEQ ID NO: 446854 - DNA, 16 bp, M. musculus
tggtgtggaccagaag

SEQ ID NO: 446855 - DNA, 16 bp, M. musculus
tggtgtggactggaag

SEQ ID NO: 446856 - DNA, 16 bp, M. musculus
tggtgtggagagtact

SEQ ID NO: 446857 - DNA, 16 bp, M. musculus
tggtgtggctgaagac

SEQ ID NO: 446858 - DNA, 16 bp, M. musculus
tggtgtgggaggagct

SEQ ID NO: 446859 - DNA, 17 bp, M. musculus
tggtgtgtctaaagaca

SEQ ID NO: 446860 - DNA, 16 bp, M. musculus
tggtgtgtgctctctc

SEQ ID NO: 446861 - DNA, 16 bp, M. musculus
tggtgttaataaagaa

SEQ ID NO: 446862 - DNA, 17 bp, M. musculus
tggtgttacaagagaaa

SEQ ID NO: 446863 - DNA, 16 bp, M. musculus
tggtgttcctgctggt

SEQ ID NO: 446864 - DNA, 16 bp, M. musculus
tggtgttgcacgcctt

SEQ ID NO: 446865 - DNA, 16 bp, M. musculus
tggtgttgctgctgct

SEQ ID NO: 446866 - DNA, 16 bp, M. musculus
tggtgttggatctgaa

SEQ ID NO: 446867 - DNA, 16 bp, M. musculus
tggtgtttatatttct

SEQ ID NO: 446868 - DNA, 16 bp, M. musculus
tggtgtttatcacagc

SEQ ID NO: 446869 - DNA, 16 bp, M. musculus
tggtgtttgctagtgg

SEQ ID NO: 446870 - DNA, 16 bp, M. musculus
tggtgttttccatcca

SEQ ID NO: 446871 - DNA, 16 bp, M. musculus
tggtgttttgagacag

SEQ ID NO: 446872 - DNA, 16 bp, M. musculus
tggtgttttgctgagg

SEQ ID NO: 446873 - DNA, 16 bp, M. musculus
tggttaaataaaactg

SEQ ID NO: 446874 - DNA, 16 bp, M. musculus
tggttaagaacactag

SEQ ID NO: 446875 - DNA, 18 bp, M. musculus
tggttaagagcaccaact

SEQ ID NO: 446876 - DNA, 16 bp, M. musculus
tggttaagagcactgg

SEQ ID NO: 446877 - DNA, 16 bp, M. musculus
tggttaagagcactgt

SEQ ID NO: 446878 - DNA, 22 bp, M. musculus
tggttaaggcagggcggattct

SEQ ID NO: 446879 - DNA, 16 bp, M. musculus
tggttaatggtttagt

SEQ ID NO: 446880 - DNA, 16 bp, M. musculus
tggttacaggaggtgg

SEQ ID NO: 446881 - DNA, 16 bp, M. musculus
tggttaccctccagaa

SEQ ID NO: 446882 - DNA, 16 bp, M. musculus
tggttagcaagaactt

SEQ ID NO: 446883 - DNA, 16 bp, M. musculus
tggttaggaacactga

SEQ ID NO: 446884 - DNA, 16 bp, M. musculus
tggttaggagcactga

SEQ ID NO: 446885 - DNA, 16 bp, M. musculus
tggttagttggttagt

SEQ ID NO: 446886 - DNA, 16 bp, M. musculus
tggttatagtagcctg

SEQ ID NO: 446887 - DNA, 16 bp, M. musculus
tggttatcatttactt

SEQ ID NO: 446888 - DNA, 16 bp, M. musculus
tggttatgagccacca

SEQ ID NO: 446889 - DNA, 16 bp, M. musculus
tggttatgtctccctt

SEQ ID NO: 446890 - DNA, 16 bp, M. musculus
tggttattatgtgaca

SEQ ID NO: 446891 - DNA, 16 bp, M. musculus
tggttcaaacaccaga

SEQ ID NO: 446892 - DNA, 16 bp, M. musculus
tggttcaaagaagaaa

SEQ ID NO: 446893 - DNA, 16 bp, M. musculus
tggttcaagtcccagc

SEQ ID NO: 446894 - DNA, 16 bp, M. musculus
tggttcaatctatttg

SEQ ID NO: 446895 - DNA, 16 bp, M. musculus
tggttcaatctctgag

SEQ ID NO: 446896 - DNA, 16 bp, M. musculus
tggttcaattcccagc

SEQ ID NO: 446897 - DNA, 16 bp, M. musculus
tggttcacagggcccc

SEQ ID NO: 446898 - DNA, 16 bp, M. musculus
tggttcaggctggcct

SEQ ID NO: 446899 - DNA, 16 bp, M. musculus
tggttcagttcctagc

SEQ ID NO: 446900 - DNA, 16 bp, M. musculus
tggttccaagcaccca

SEQ ID NO: 446901 - DNA, 16 bp, M. musculus
tggttccagagggaga

SEQ ID NO: 446902 - DNA, 16 bp, M. musculus
tggttccaggacagcc

SEQ ID NO: 446903 - DNA, 16 bp, M. musculus
tggttcccagcactca

SEQ ID NO: 446904 - DNA, 16 bp, M. musculus
tggttcccagctccca

SEQ ID NO: 446905 - DNA, 16 bp, M. musculus
tggttcccaggaccca

SEQ ID NO: 446906 - DNA, 16 bp, M. musculus
tggttcccagtgccca

SEQ ID NO: 446907 - DNA, 16 bp, M. musculus
tggttcctattagtag

SEQ ID NO: 446908 - DNA, 16 bp, M. musculus
tggttcctgacatgtt

SEQ ID NO: 446909 - DNA, 16 bp, M. musculus
tggttcctgatttctt

SEQ ID NO: 446910 - DNA, 18 bp, M. musculus
tggttcctgccagtcctt

SEQ ID NO: 446911 - DNA, 16 bp, M. musculus
tggttcctgccagtct

SEQ ID NO: 446912 - DNA, 16 bp, M. musculus
tggttcctgctgctgc

SEQ ID NO: 446913 - DNA, 16 bp, M. musculus
tggttctcagcctgta

SEQ ID NO: 446914 - DNA, 16 bp, M. musculus
tggttctctccttcca

SEQ ID NO: 446915 - DNA, 16 bp, M. musculus
tggttctctccttcta

SEQ ID NO: 446916 - DNA, 16 bp, M. musculus
tggttctctggggtct

SEQ ID NO: 446917 - DNA, 16 bp, M. musculus
tggttctgcttggagg

SEQ ID NO: 446918 - DNA, 16 bp, M. musculus
tggttctggtctaact

SEQ ID NO: 446919 - DNA, 16 bp, M. musculus
tggttctgtggttaag

SEQ ID NO: 446920 - DNA, 16 bp, M. musculus
tggttcttcctcccag

SEQ ID NO: 446921 - DNA, 16 bp, M. musculus
tggttctttgaaaaat

SEQ ID NO: 446922 - DNA, 16 bp, M. musculus
tggttctttgagaaga

SEQ ID NO: 446923 - DNA, 16 bp, M. musculus
tggttgaaggagaaaa

SEQ ID NO: 446924 - DNA, 16 bp, M. musculus
tggttgaaggagagaa

SEQ ID NO: 446925 - DNA, 16 bp, M. musculus
tggttgagtgcatatt

SEQ ID NO: 446926 - DNA, 16 bp, M. musculus
tggttgatggctcagt

SEQ ID NO: 446927 - DNA, 16 bp, M. musculus
tggttgccatggaaac

SEQ ID NO: 446928 - DNA, 16 bp, M. musculus
tggttgccatggcaac

SEQ ID NO: 446929 - DNA, 16 bp, M. musculus
tggttgcctcccagaa

SEQ ID NO: 446930 - DNA, 16 bp, M. musculus
tggttgctatggaaac

SEQ ID NO: 446931 - DNA, 16 bp, M. musculus
tggttgctcacagcca

SEQ ID NO: 446932 - DNA, 17 bp, M. musculus
tggttgctggaattgaa

SEQ ID NO: 446933 - DNA, 16 bp, M. musculus
tggttgctgggaattt

SEQ ID NO: 446934 - DNA, 16 bp, M. musculus
tggttgctgggatgtg

SEQ ID NO: 446935 - DNA, 22 bp, M. musculus
tggttgctgggatttgaactca

SEQ ID NO: 446936 - DNA, 16 bp, M. musculus
tggttgctggggagat

SEQ ID NO: 446937 - DNA, 16 bp, M. musculus
tggttgctggttgctg

SEQ ID NO: 446938 - DNA, 16 bp, M. musculus
tggttgctgttggtca

SEQ ID NO: 446939 - DNA, 16 bp, M. musculus
tggttggaaaaaaaaa

SEQ ID NO: 446940 - DNA, 16 bp, M. musculus
tggttggacctagagg

SEQ ID NO: 446941 - DNA, 16 bp, M. musculus
tggttggaggaagtgt

SEQ ID NO: 446942 - DNA, 16 bp, M. musculus
tggttggctattcctt

SEQ ID NO: 446943 - DNA, 16 bp, M. musculus
tggttggctgtgagct

SEQ ID NO: 446944 - DNA, 16 bp, M. musculus
tggttggctgtgatca

SEQ ID NO: 446945 - DNA, 16 bp, M. musculus
tggttggcttggaact

SEQ ID NO: 446946 - DNA, 16 bp, M. musculus
tggttgggagactctt

SEQ ID NO: 446947 - DNA, 16 bp, M. musculus
tggttgggggtcagca

SEQ ID NO: 446948 - DNA, 16 bp, M. musculus
tggttgggggtcatca

SEQ ID NO: 446949 - DNA, 16 bp, M. musculus
tggttggggttcacca

SEQ ID NO: 446950 - DNA, 16 bp, M. musculus
tggttgtacctgtttg

SEQ ID NO: 446951 - DNA, 16 bp, M. musculus
tggttgtcatggcaac

SEQ ID NO: 446952 - DNA, 16 bp, M. musculus
tggttgtcctagaact

SEQ ID NO: 446953 - DNA, 16 bp, M. musculus
tggttgtcctggaact

SEQ ID NO: 446954 - DNA, 16 bp, M. musculus
tggttgtgagcagcca

SEQ ID NO: 446955 - DNA, 17 bp, M. musculus
tggttgtgagccaccac

SEQ ID NO: 446956 - DNA, 30 bp, M. musculus
tggttgtgagccaccatgtggttgctggga

SEQ ID NO: 446957 - DNA, 21 bp, M. musculus
tggttgtgagccaccatgtgt

SEQ ID NO: 446958 - DNA, 16 bp, M. musculus
tggttgtgagctgcca

SEQ ID NO: 446959 - DNA, 16 bp, M. musculus
tggttgtgagctggga

SEQ ID NO: 446960 - DNA, 16 bp, M. musculus
tggttgtgggtcacca

SEQ ID NO: 446961 - DNA, 16 bp, M. musculus
tggttgttctggaact

SEQ ID NO: 446962 - DNA, 18 bp, M. musculus
tggttgttggaaattgaa

SEQ ID NO: 446963 - DNA, 16 bp, M. musculus
tggttgtttttcccaa

SEQ ID NO: 446964 - DNA, 16 bp, M. musculus
tggtttaaaaaaaaag

SEQ ID NO: 446965 - DNA, 16 bp, M. musculus
tggtttaaatgagaaa

SEQ ID NO: 446966 - DNA, 16 bp, M. musculus
tggtttacatagcaag

SEQ ID NO: 446967 - DNA, 17 bp, M. musculus
tggtttagttcctggga

SEQ ID NO: 446968 - DNA, 16 bp, M. musculus
tggtttcacatgattg

SEQ ID NO: 446969 - DNA, 16 bp, M. musculus
tggtttcagttcccag

SEQ ID NO: 446970 - DNA, 16 bp, M. musculus
tggtttcatccctggg

SEQ ID NO: 446971 - DNA, 16 bp, M. musculus
tggtttcattaacctt

SEQ ID NO: 446972 - DNA, 16 bp, M. musculus
tggtttccagcaccca

SEQ ID NO: 446973 - DNA, 16 bp, M. musculus
tggtttccatgacaac

SEQ ID NO: 446974 - DNA, 16 bp, M. musculus
tggtttccatggagat

SEQ ID NO: 446975 - DNA, 16 bp, M. musculus
tggtttcccctctgga

SEQ ID NO: 446976 - DNA, 16 bp, M. musculus
tggtttccctccttgt

SEQ ID NO: 446977 - DNA, 16 bp, M. musculus
tggtttctctgtgtag

SEQ ID NO: 446978 - DNA, 16 bp, M. musculus
tggtttctgctggatt

SEQ ID NO: 446979 - DNA, 16 bp, M. musculus
tggtttctgcttcagg

SEQ ID NO: 446980 - DNA, 16 bp, M. musculus
tggtttctgtggtgct

SEQ ID NO: 446981 - DNA, 16 bp, M. musculus
tggtttctgttagtaa

SEQ ID NO: 446982 - DNA, 17 bp, M. musculus
tggtttcttcttaatca

SEQ ID NO: 446983 - DNA, 16 bp, M. musculus
tggtttctttaaaaca

SEQ ID NO: 446984 - DNA, 16 bp, M. musculus
tggtttctttttaaaa

SEQ ID NO: 446985 - DNA, 16 bp, M. musculus
tggtttgaaaaagaat

SEQ ID NO: 446986 - DNA, 16 bp, M. musculus
tggtttgaataagtat

SEQ ID NO: 446987 - DNA, 16 bp, M. musculus
tggtttgaataggttt

SEQ ID NO: 446988 - DNA, 16 bp, M. musculus
tggtttgaatgaaaat

SEQ ID NO: 446989 - DNA, 16 bp, M. musculus
tggtttgaatgagaat

SEQ ID NO: 446990 - DNA, 16 bp, M. musculus
tggtttgacaagctgc

SEQ ID NO: 446991 - DNA, 16 bp, M. musculus
tggtttgagtatgcct

SEQ ID NO: 446992 - DNA, 16 bp, M. musculus
tggtttgatttttaaa

SEQ ID NO: 446993 - DNA, 16 bp, M. musculus
tggtttgcagagtgag

SEQ ID NO: 446994 - DNA, 16 bp, M. musculus
tggtttgcatagggtg

SEQ ID NO: 446995 - DNA, 16 bp, M. musculus
tggtttgcatttccct

SEQ ID NO: 446996 - DNA, 16 bp, M. musculus
tggtttgctatgtatt

SEQ ID NO: 446997 - DNA, 16 bp, M. musculus
tggtttgctcagcttg

SEQ ID NO: 446998 - DNA, 16 bp, M. musculus
tggtttgctcagtctg

SEQ ID NO: 446999 - DNA, 16 bp, M. musculus
tggtttgctctagatt

SEQ ID NO: 447000 - DNA, 16 bp, M. musculus
tggtttgctgtggatt

SEQ ID NO: 447001 - DNA, 16 bp, M. musculus
tggtttggatgattct

SEQ ID NO: 447002 - DNA, 18 bp, M. musculus
tggtttgggccttgagga

SEQ ID NO: 447003 - DNA, 16 bp, M. musculus
tggtttggttttatca

SEQ ID NO: 447004 - DNA, 16 bp, M. musculus
tggtttggttttgaaa

SEQ ID NO: 447005 - DNA, 16 bp, M. musculus
tggtttggtttttaaa

SEQ ID NO: 447006 - DNA, 16 bp, M. musculus
tggtttgtatgtgctt

SEQ ID NO: 447007 - DNA, 16 bp, M. musculus
tggtttgtatttgctt

SEQ ID NO: 447008 - DNA, 16 bp, M. musculus
tggtttgtctgaagac

SEQ ID NO: 447009 - DNA, 16 bp, M. musculus
tggtttgtggttcagt

SEQ ID NO: 447010 - DNA, 17 bp, M. musculus
tggtttgttcataatgt

SEQ ID NO: 447011 - DNA, 16 bp, M. musculus
tggtttgtttttaaaa

SEQ ID NO: 447012 - DNA, 16 bp, M. musculus
tggttttacagttctg

SEQ ID NO: 447013 - DNA, 18 bp, M. musculus
tggttttagagctttatt

SEQ ID NO: 447014 - DNA, 16 bp, M. musculus
tggttttagtctttga

SEQ ID NO: 447015 - DNA, 16 bp, M. musculus
tggttttataaaacag

SEQ ID NO: 447016 - DNA, 16 bp, M. musculus
tggttttataagaaag

SEQ ID NO: 447017 - DNA, 16 bp, M. musculus
tggttttatcatgaaa

SEQ ID NO: 447018 - DNA, 16 bp, M. musculus
tggttttattttgaaa

SEQ ID NO: 447019 - DNA, 16 bp, M. musculus
tggttttcaacctccc

SEQ ID NO: 447020 - DNA, 16 bp, M. musculus
tggttttcagagacag

SEQ ID NO: 447021 - DNA, 16 bp, M. musculus
tggttttctcctttca

SEQ ID NO: 447022 - DNA, 16 bp, M. musculus
tggttttgaagtcatg

SEQ ID NO: 447023 - DNA, 16 bp, M. musculus
tggttttgaggtttca

SEQ ID NO: 447024 - DNA, 16 bp, M. musculus
tggttttgcctgcatg

SEQ ID NO: 447025 - DNA, 16 bp, M. musculus
tggttttggagacaga

SEQ ID NO: 447026 - DNA, 16 bp, M. musculus
tggttttgttgtggaa

SEQ ID NO: 447027 - DNA, 16 bp, M. musculus
tggtttttaaaaatat

SEQ ID NO: 447028 - DNA, 16 bp, M. musculus
tggtttttattttcaa

SEQ ID NO: 447029 - DNA, 16 bp, M. musculus
tggtttttcaagacaa

SEQ ID NO: 447030 - DNA, 16 bp, M. musculus
tggtttttccttcagt

SEQ ID NO: 447031 - DNA, 16 bp, M. musculus
tggtttttcgaggcag

SEQ ID NO: 447032 - DNA, 16 bp, M. musculus
tggtttttctctcaaa

SEQ ID NO: 447033 - DNA, 16 bp, M. musculus
tggtttttctgcatct

SEQ ID NO: 447034 - DNA, 16 bp, M. musculus
tggtttttgaaaaaaa

SEQ ID NO: 447035 - DNA, 16 bp, M. musculus
tggtttttgtctttaa

SEQ ID NO: 447036 - DNA, 16 bp, M. musculus
tggttttttaaaaaat

SEQ ID NO: 447037 - DNA, 17 bp, M. musculus
tggtttttttcaagaca

SEQ ID NO: 447038 - DNA, 16 bp, M. musculus
tgtaaaaacaagagga

SEQ ID NO: 447039 - DNA, 16 bp, M. musculus
tgtaaaaacacaatca

SEQ ID NO: 447040 - DNA, 16 bp, M. musculus
tgtaaaaatggaaata

SEQ ID NO: 447041 - DNA, 16 bp, M. musculus
tgtaaaaatgttttct

SEQ ID NO: 447042 - DNA, 16 bp, M. musculus
tgtaaaacaattaact

SEQ ID NO: 447043 - DNA, 16 bp, M. musculus
tgtaaaagcagccagt

SEQ ID NO: 447044 - DNA, 16 bp, M. musculus
tgtaaaagccagagaa

SEQ ID NO: 447045 - DNA, 16 bp, M. musculus
tgtaaaagctaaatta

SEQ ID NO: 447046 - DNA, 16 bp, M. musculus
tgtaaaaggctttgga

SEQ ID NO: 447047 - DNA, 16 bp, M. musculus
tgtaaaagtgactttt

SEQ ID NO: 447048 - DNA, 16 bp, M. musculus
tgtaaaatatgtacct

SEQ ID NO: 447049 - DNA, 16 bp, M. musculus
tgtaaaatatgtatat

SEQ ID NO: 447050 - DNA, 16 bp, M. musculus
tgtaaaatgaatacat

SEQ ID NO: 447051 - DNA, 16 bp, M. musculus
tgtaaacaaaatgatt

SEQ ID NO: 447052 - DNA, 16 bp, M. musculus
tgtaaacaaacaaaca

SEQ ID NO: 447053 - DNA, 16 bp, M. musculus
tgtaaacacacacaca

SEQ ID NO: 447054 - DNA, 16 bp, M. musculus
tgtaaacatgtgtgtg

SEQ ID NO: 447055 - DNA, 16 bp, M. musculus
tgtaaacattgcctgg

SEQ ID NO: 447056 - DNA, 16 bp, M. musculus
tgtaaaccagccctaa

SEQ ID NO: 447057 - DNA, 16 bp, M. musculus
tgtaaaccaggctggc

SEQ ID NO: 447058 - DNA, 16 bp, M. musculus
tgtaaacttgtacttt

SEQ ID NO: 447059 - DNA, 16 bp, M. musculus
tgtaaagaaatatttt

SEQ ID NO: 447060 - DNA, 16 bp, M. musculus
tgtaaagactgtggga

SEQ ID NO: 447061 - DNA, 16 bp, M. musculus
tgtaaagagtgtgatg

SEQ ID NO: 447062 - DNA, 16 bp, M. musculus
tgtaaagctgaggcta

SEQ ID NO: 447063 - DNA, 16 bp, M. musculus
tgtaaagcttctataa

SEQ ID NO: 447064 - DNA, 16 bp, M. musculus
tgtaaaggaattttaa

SEQ ID NO: 447065 - DNA, 16 bp, M. musculus
tgtaaagggctgcaat

SEQ ID NO: 447066 - DNA, 16 bp, M. musculus
tgtaaaggttgtcttt

SEQ ID NO: 447067 - DNA, 16 bp, M. musculus
tgtaaagttctttttg

SEQ ID NO: 447068 - DNA, 16 bp, M. musculus
tgtaaataaaaatatc

SEQ ID NO: 447069 - DNA, 16 bp, M. musculus
tgtaaataaaatatgt

SEQ ID NO: 447070 - DNA, 16 bp, M. musculus
tgtaaataaagagaat

SEQ ID NO: 447071 - DNA, 16 bp, M. musculus
tgtaaataaatgtacc

SEQ ID NO: 447072 - DNA, 16 bp, M. musculus
tgtaaataaggaaaat

SEQ ID NO: 447073 - DNA, 16 bp, M. musculus
tgtaaataattgtgtt

SEQ ID NO: 447074 - DNA, 16 bp, M. musculus
tgtaaatacacacaca

SEQ ID NO: 447075 - DNA, 16 bp, M. musculus
tgtaaatatctgtggt

SEQ ID NO: 447076 - DNA, 16 bp, M. musculus
tgtaaatatgtacata

SEQ ID NO: 447077 - DNA, 16 bp, M. musculus
tgtaaatatgtgtgtg

SEQ ID NO: 447078 - DNA, 16 bp, M. musculus
tgtaaatcaggctggc

SEQ ID NO: 447079 - DNA, 16 bp, M. musculus
tgtaaatgaagaaaat

SEQ ID NO: 447080 - DNA, 16 bp, M. musculus
tgtaaatgtagaaaat

SEQ ID NO: 447081 - DNA, 16 bp, M. musculus
tgtaaatgtattcatt

SEQ ID NO: 447082 - DNA, 16 bp, M. musculus
tgtaaatgtctgtgtt

SEQ ID NO: 447083 - DNA, 16 bp, M. musculus
tgtaaatgtctgtttt

SEQ ID NO: 447084 - DNA, 16 bp, M. musculus
tgtaaatgtgagaatt

SEQ ID NO: 447085 - DNA, 16 bp, M. musculus
tgtaaatgtgtatata

SEQ ID NO: 447086 - DNA, 16 bp, M. musculus
tgtaaatgtgtgtgtg

SEQ ID NO: 447087 - DNA, 16 bp, M. musculus
tgtaaatgttgctttt

SEQ ID NO: 447088 - DNA, 40 bp, M. musculus
tgtaaattggcatggaaatttaaagcaggttcttgttggt

SEQ ID NO: 447089 - DNA, 16 bp, M. musculus
tgtaaatttgcttttg

SEQ ID NO: 447090 - DNA, 16 bp, M. musculus
tgtaacaaaaattaat

SEQ ID NO: 447091 - DNA, 16 bp, M. musculus
tgtaacaaaatacctg

SEQ ID NO: 447092 - DNA, 16 bp, M. musculus
tgtaacaaccctggct

SEQ ID NO: 447093 - DNA, 16 bp, M. musculus
tgtaacaaggacacat

SEQ ID NO: 447094 - DNA, 16 bp, M. musculus
tgtaacacattttctg

SEQ ID NO: 447095 - DNA, 16 bp, M. musculus
tgtaacacattttctt

SEQ ID NO: 447096 - DNA, 16 bp, M. musculus
tgtaacagccctggct

SEQ ID NO: 447097 - DNA, 16 bp, M. musculus
tgtaacaggagtagaa

SEQ ID NO: 447098 - DNA, 16 bp, M. musculus
tgtaacatcaagaatt

SEQ ID NO: 447099 - DNA, 16 bp, M. musculus
tgtaacattaaaaaaa

SEQ ID NO: 447100 - DNA, 16 bp, M. musculus
tgtaacccagattaaa

SEQ ID NO: 447101 - DNA, 16 bp, M. musculus
tgtaacccaggctggc

SEQ ID NO: 447102 - DNA, 16 bp, M. musculus
tgtaaccctggctttc

SEQ ID NO: 447103 - DNA, 16 bp, M. musculus
tgtaacctggaggtgc

SEQ ID NO: 447104 - DNA, 16 bp, M. musculus
tgtaactacagctcca

SEQ ID NO: 447105 - DNA, 16 bp, M. musculus
tgtaactatttttaaa

SEQ ID NO: 447106 - DNA, 16 bp, M. musculus
tgtaactcacagagat

SEQ ID NO: 447107 - DNA, 16 bp, M. musculus
tgtaactccagctcca

SEQ ID NO: 447108 - DNA, 16 bp, M. musculus
tgtaactccagctcta

SEQ ID NO: 447109 - DNA, 16 bp, M. musculus
tgtaactccagctctg

SEQ ID NO: 447110 - DNA, 16 bp, M. musculus
tgtaactccaggtcca

SEQ ID NO: 447111 - DNA, 16 bp, M. musculus
tgtaactccagtccca

SEQ ID NO: 447112 - DNA, 16 bp, M. musculus
tgtaactccagttcca

SEQ ID NO: 447113 - DNA, 16 bp, M. musculus
tgtaactccagttcct

SEQ ID NO: 447114 - DNA, 16 bp, M. musculus
tgtaactccagtttca

SEQ ID NO: 447115 - DNA, 16 bp, M. musculus
tgtaactccattccca

SEQ ID NO: 447116 - DNA, 16 bp, M. musculus
tgtaactccatttcca

SEQ ID NO: 447117 - DNA, 16 bp, M. musculus
tgtaactcctccatgg

SEQ ID NO: 447118 - DNA, 16 bp, M. musculus
tgtaactccttcattg

SEQ ID NO: 447119 - DNA, 16 bp, M. musculus
tgtaactctaaccaaa

SEQ ID NO: 447120 - DNA, 16 bp, M. musculus
tgtaactctagtttca

SEQ ID NO: 447121 - DNA, 16 bp, M. musculus
tgtaactctggctgtc

SEQ ID NO: 447122 - DNA, 16 bp, M. musculus
tgtaactctggttcca

SEQ ID NO: 447123 - DNA, 18 bp, M. musculus
tgtaactctttagcagtg

SEQ ID NO: 447124 - DNA, 16 bp, M. musculus
tgtaactctttagcat

SEQ ID NO: 447125 - DNA, 16 bp, M. musculus
tgtaactgaggatgac

SEQ ID NO: 447126 - DNA, 16 bp, M. musculus
tgtaacttcagcttca

SEQ ID NO: 447127 - DNA, 16 bp, M. musculus
tgtaacttcagttcca

SEQ ID NO: 447128 - DNA, 16 bp, M. musculus
tgtaagaaataaagct

SEQ ID NO: 447129 - DNA, 16 bp, M. musculus
tgtaagaccaagaatc

SEQ ID NO: 447130 - DNA, 16 bp, M. musculus
tgtaagactccaggga

SEQ ID NO: 447131 - DNA, 16 bp, M. musculus
tgtaagagacctgctt

SEQ ID NO: 447132 - DNA, 16 bp, M. musculus
tgtaagccaaatgaac

SEQ ID NO: 447133 - DNA, 16 bp, M. musculus
tgtaagccaacctcaa

SEQ ID NO: 447134 - DNA, 16 bp, M. musculus
tgtaagccagccccaa

SEQ ID NO: 447135 - DNA, 16 bp, M. musculus
tgtaagccagcctcag

SEQ ID NO: 447136 - DNA, 16 bp, M. musculus
tgtaagccttattaaa

SEQ ID NO: 447137 - DNA, 16 bp, M. musculus
tgtaagctctgagata

SEQ ID NO: 447138 - DNA, 16 bp, M. musculus
tgtaagctgaaataaa

SEQ ID NO: 447139 - DNA, 16 bp, M. musculus
tgtaaggattaaatga

SEQ ID NO: 447140 - DNA, 16 bp, M. musculus
tgtaaggcagaccaat

SEQ ID NO: 447141 - DNA, 16 bp, M. musculus
tgtaaggctctgacag

SEQ ID NO: 447142 - DNA, 16 bp, M. musculus
tgtaaggctttggcag

SEQ ID NO: 447143 - DNA, 16 bp, M. musculus
tgtaagtacacacaca

SEQ ID NO: 447144 - DNA, 16 bp, M. musculus
tgtaagtcaaaagaca

SEQ ID NO: 447145 - DNA, 16 bp, M. musculus
tgtaagtcagccccag

SEQ ID NO: 447146 - DNA, 16 bp, M. musculus
tgtaagtgcatgtgtg

SEQ ID NO: 447147 - DNA, 16 bp, M. musculus
tgtaagttctgtgact

SEQ ID NO: 447148 - DNA, 16 bp, M. musculus
tgtaagttgaaataaa

SEQ ID NO: 447149 - DNA, 16 bp, M. musculus
tgtaagtttaaagatg

SEQ ID NO: 447150 - DNA, 16 bp, M. musculus
tgtaataaaataccct

SEQ ID NO: 447151 - DNA, 16 bp, M. musculus
tgtaataaagctttag

SEQ ID NO: 447152 - DNA, 16 bp, M. musculus
tgtaataataatctgt

SEQ ID NO: 447153 - DNA, 16 bp, M. musculus
tgtaataatgacacat

SEQ ID NO: 447154 - DNA, 16 bp, M. musculus
tgtaatagataccatt

SEQ ID NO: 447155 - DNA, 16 bp, M. musculus
tgtaatagctctcatt

SEQ ID NO: 447156 - DNA, 16 bp, M. musculus
tgtaataggatctgat

SEQ ID NO: 447157 - DNA, 16 bp, M. musculus
tgtaatatacacatat

SEQ ID NO: 447158 - DNA, 16 bp, M. musculus
tgtaatatatgtaaat

SEQ ID NO: 447159 - DNA, 16 bp, M. musculus
tgtaatatatgtaata

SEQ ID NO: 447160 - DNA, 16 bp, M. musculus
tgtaatatatgtatat

SEQ ID NO: 447161 - DNA, 16 bp, M. musculus
tgtaatatcaaataaa

SEQ ID NO: 447162 - DNA, 16 bp, M. musculus
tgtaatcactggaaaa

SEQ ID NO: 447163 - DNA, 16 bp, M. musculus
tgtaatcccagtacta

SEQ ID NO: 447164 - DNA, 16 bp, M. musculus
tgtaatcccagtactc

SEQ ID NO: 447165 - DNA, 16 bp, M. musculus
tgtaatctcagagctg

SEQ ID NO: 447166 - DNA, 16 bp, M. musculus
tgtaatctcagcactc

SEQ ID NO: 447167 - DNA, 16 bp, M. musculus
tgtaatctcagcactt

SEQ ID NO: 447168 - DNA, 16 bp, M. musculus
tgtaatctcagctact

SEQ ID NO: 447169 - DNA, 16 bp, M. musculus
tgtaatctcaggactc

SEQ ID NO: 447170 - DNA, 16 bp, M. musculus
tgtaatctcagtactg

SEQ ID NO: 447171 - DNA, 16 bp, M. musculus
tgtaatcttagcactg

SEQ ID NO: 447172 - DNA, 16 bp, M. musculus
tgtaatgctaagtgct

SEQ ID NO: 447173 - DNA, 16 bp, M. musculus
tgtaatgtaaataaat

SEQ ID NO: 447174 - DNA, 16 bp, M. musculus
tgtaatgtgtgctttg

SEQ ID NO: 447175 - DNA, 16 bp, M. musculus
tgtaattccagtattt

SEQ ID NO: 447176 - DNA, 16 bp, M. musculus
tgtaattccatttcca

SEQ ID NO: 447177 - DNA, 16 bp, M. musculus
tgtaattctaatagac

SEQ ID NO: 447178 - DNA, 16 bp, M. musculus
tgtaattctagcattt

SEQ ID NO: 447179 - DNA, 16 bp, M. musculus
tgtaatttcagtttca

SEQ ID NO: 447180 - DNA, 16 bp, M. musculus
tgtaatttctgtcctt

SEQ ID NO: 447181 - DNA, 16 bp, M. musculus
tgtaatttcttccatg

SEQ ID NO: 447182 - DNA, 16 bp, M. musculus
tgtaattttagcactt

SEQ ID NO: 447183 - DNA, 16 bp, M. musculus
tgtaattttgatagtt

SEQ ID NO: 447184 - DNA, 16 bp, M. musculus
tgtaattttgttacta

SEQ ID NO: 447185 - DNA, 16 bp, M. musculus
tgtaatttttaaaggg

SEQ ID NO: 447186 - DNA, 16 bp, M. musculus
tgtacaaacacatgca

SEQ ID NO: 447187 - DNA, 16 bp, M. musculus
tgtacaaagaactcaa

SEQ ID NO: 447188 - DNA, 16 bp, M. musculus
tgtacaaagtgacaaa

SEQ ID NO: 447189 - DNA, 16 bp, M. musculus
tgtacaaatgtcactt

SEQ ID NO: 447190 - DNA, 16 bp, M. musculus
tgtacaaatgtgtgtg

SEQ ID NO: 447191 - DNA, 17 bp, M. musculus
tgtacaacattttctgt

SEQ ID NO: 447192 - DNA, 16 bp, M. musculus
tgtacaaccagagatg

SEQ ID NO: 447193 - DNA, 16 bp, M. musculus
tgtacaagtgcacaca

SEQ ID NO: 447194 - DNA, 17 bp, M. musculus
tgtacacaaagaataaa

SEQ ID NO: 447195 - DNA, 16 bp, M. musculus
tgtacacacacataca

SEQ ID NO: 447196 - DNA, 16 bp, M. musculus
tgtacacacagaaaca

SEQ ID NO: 447197 - DNA, 16 bp, M. musculus
tgtacacacatacata

SEQ ID NO: 447198 - DNA, 16 bp, M. musculus
tgtacacactgtgggc

SEQ ID NO: 447199 - DNA, 16 bp, M. musculus
tgtacacagacacaga

SEQ ID NO: 447200 - DNA, 16 bp, M. musculus
tgtacacagtgttctg

SEQ ID NO: 447201 - DNA, 16 bp, M. musculus
tgtacacatacacact

SEQ ID NO: 447202 - DNA, 16 bp, M. musculus
tgtacacatgtatggg

SEQ ID NO: 447203 - DNA, 16 bp, M. musculus
tgtacacatgtgcaca

SEQ ID NO: 447204 - DNA, 16 bp, M. musculus
tgtacacatgtgtaca

SEQ ID NO: 447205 - DNA, 16 bp, M. musculus
tgtacacatgtgtctg

SEQ ID NO: 447206 - DNA, 16 bp, M. musculus
tgtacacatttttaaa

SEQ ID NO: 447207 - DNA, 16 bp, M. musculus
tgtacaccaccatgcc

SEQ ID NO: 447208 - DNA, 16 bp, M. musculus
tgtacaccaggctggc

SEQ ID NO: 447209 - DNA, 16 bp, M. musculus
tgtacacctttaatct

SEQ ID NO: 447210 - DNA, 16 bp, M. musculus
tgtacagagacaggtt

SEQ ID NO: 447211 - DNA, 16 bp, M. musculus
tgtacagatgtttgtg

SEQ ID NO: 447212 - DNA, 16 bp, M. musculus
tgtacaggtgtatgtg

SEQ ID NO: 447213 - DNA, 16 bp, M. musculus
tgtacagtgtatgtgt

SEQ ID NO: 447214 - DNA, 16 bp, M. musculus
tgtacataatttattt

SEQ ID NO: 447215 - DNA, 16 bp, M. musculus
tgtacatacaaacaca

SEQ ID NO: 447216 - DNA, 16 bp, M. musculus
tgtacatacatgtaca

SEQ ID NO: 447217 - DNA, 16 bp, M. musculus
tgtacatacatgtgca

SEQ ID NO: 447218 - DNA, 16 bp, M. musculus
tgtacatacatgtgtg

SEQ ID NO: 447219 - DNA, 16 bp, M. musculus
tgtacatagtactact

SEQ ID NO: 447220 - DNA, 16 bp, M. musculus
tgtacatatacacaca

SEQ ID NO: 447221 - DNA, 16 bp, M. musculus
tgtacatatatatata

SEQ ID NO: 447222 - DNA, 16 bp, M. musculus
tgtacatatatgtaca

SEQ ID NO: 447223 - DNA, 16 bp, M. musculus
tgtacatatgtataaa

SEQ ID NO: 447224 - DNA, 16 bp, M. musculus
tgtacatatgtatata

SEQ ID NO: 447225 - DNA, 16 bp, M. musculus
tgtacatatgtatgca

SEQ ID NO: 447226 - DNA, 16 bp, M. musculus
tgtacatatgtattta

SEQ ID NO: 447227 - DNA, 16 bp, M. musculus
tgtacatatgtgaata

SEQ ID NO: 447228 - DNA, 16 bp, M. musculus
tgtacatatgtgtatg

SEQ ID NO: 447229 - DNA, 16 bp, M. musculus
tgtacatattttagaa

SEQ ID NO: 447230 - DNA, 16 bp, M. musculus
tgtacatattttattt

SEQ ID NO: 447231 - DNA, 16 bp, M. musculus
tgtacatatttttaaa

SEQ ID NO: 447232 - DNA, 16 bp, M. musculus
tgtacatgataactgc

SEQ ID NO: 447233 - DNA, 16 bp, M. musculus
tgtacatgcagacaaa

SEQ ID NO: 447234 - DNA, 16 bp, M. musculus
tgtacatgcagagaga

SEQ ID NO: 447235 - DNA, 16 bp, M. musculus
tgtacatgtatgtgta

SEQ ID NO: 447236 - DNA, 16 bp, M. musculus
tgtacatgtatgtgtg

SEQ ID NO: 447237 - DNA, 16 bp, M. musculus
tgtacatgtgaacaca

SEQ ID NO: 447238 - DNA, 16 bp, M. musculus
tgtacatgtgagtgca

SEQ ID NO: 447239 - DNA, 16 bp, M. musculus
tgtacatgtgtacctg

SEQ ID NO: 447240 - DNA, 16 bp, M. musculus
tgtacatgtgtataca

SEQ ID NO: 447241 - DNA, 16 bp, M. musculus
tgtacatgtgtatgtg

SEQ ID NO: 447242 - DNA, 16 bp, M. musculus
tgtacatgtgtgcatg

SEQ ID NO: 447243 - DNA, 16 bp, M. musculus
tgtacatgtgtgtgat

SEQ ID NO: 447244 - DNA, 16 bp, M. musculus
tgtacatgtgtgtgca

SEQ ID NO: 447245 - DNA, 16 bp, M. musculus
tgtacatgtgtgtgga

SEQ ID NO: 447246 - DNA, 16 bp, M. musculus
tgtacatgtttgtata

SEQ ID NO: 447247 - DNA, 16 bp, M. musculus
tgtacattcattttca

SEQ ID NO: 447248 - DNA, 16 bp, M. musculus
tgtacattgtgtgtgt

SEQ ID NO: 447249 - DNA, 16 bp, M. musculus
tgtacatttacaaaat

SEQ ID NO: 447250 - DNA, 16 bp, M. musculus
tgtacatttgtacatt

SEQ ID NO: 447251 - DNA, 16 bp, M. musculus
tgtacattttaaaata

SEQ ID NO: 447252 - DNA, 16 bp, M. musculus
tgtaccacatctctgt

SEQ ID NO: 447253 - DNA, 16 bp, M. musculus
tgtaccacatgcatgc

SEQ ID NO: 447254 - DNA, 16 bp, M. musculus
tgtaccacatgtgtgt

SEQ ID NO: 447255 - DNA, 16 bp, M. musculus
tgtaccacattttcta

SEQ ID NO: 447256 - DNA, 16 bp, M. musculus
tgtaccaccaagccca

SEQ ID NO: 447257 - DNA, 16 bp, M. musculus
tgtaccaccacacctg

SEQ ID NO: 447258 - DNA, 16 bp, M. musculus
tgtaccaccaccacct

SEQ ID NO: 447259 - DNA, 16 bp, M. musculus
tgtaccaccactgccc

SEQ ID NO: 447260 - DNA, 16 bp, M. musculus
tgtaccaccactgctc

SEQ ID NO: 447261 - DNA, 16 bp, M. musculus
tgtaccaccataccta

SEQ ID NO: 447262 - DNA, 16 bp, M. musculus
tgtaccaccatacctg

SEQ ID NO: 447263 - DNA, 16 bp, M. musculus
tgtaccaccatgccca

SEQ ID NO: 447264 - DNA, 16 bp, M. musculus
tgtaccaccatgcctg

SEQ ID NO: 447265 - DNA, 16 bp, M. musculus
tgtaccaccatgtcca

SEQ ID NO: 447266 - DNA, 16 bp, M. musculus
tgtaccactgtgccca

SEQ ID NO: 447267 - DNA, 16 bp, M. musculus
tgtaccagcttgctat

SEQ ID NO: 447268 - DNA, 16 bp, M. musculus
tgtaccagtatcatgc

SEQ ID NO: 447269 - DNA, 16 bp, M. musculus
tgtaccatcacaccca

SEQ ID NO: 447270 - DNA, 16 bp, M. musculus
tgtaccatcacacctg

SEQ ID NO: 447271 - DNA, 16 bp, M. musculus
tgtaccatgtatgtgc

SEQ ID NO: 447272 - DNA, 16 bp, M. musculus
tgtacccacacacatg

SEQ ID NO: 447273 - DNA, 16 bp, M. musculus
tgtaccccaggctggc

SEQ ID NO: 447274 - DNA, 16 bp, M. musculus
tgtacctccagtttca

SEQ ID NO: 447275 - DNA, 16 bp, M. musculus
tgtacctgtacacaca

SEQ ID NO: 447276 - DNA, 16 bp, M. musculus
tgtacctgtgtctgtg

SEQ ID NO: 447277 - DNA, 16 bp, M. musculus
tgtacctgtgtgtgtc

SEQ ID NO: 447278 - DNA, 16 bp, M. musculus
tgtacctgtttagttt

SEQ ID NO: 447279 - DNA, 16 bp, M. musculus
tgtaccttctcagcca

SEQ ID NO: 447280 - DNA, 16 bp, M. musculus
tgtacgcacacacaca

SEQ ID NO: 447281 - DNA, 16 bp, M. musculus
tgtacgtgtacatgta

SEQ ID NO: 447282 - DNA, 16 bp, M. musculus
tgtactaaatccatct

SEQ ID NO: 447283 - DNA, 16 bp, M. musculus
tgtactacaaagcaat

SEQ ID NO: 447284 - DNA, 16 bp, M. musculus
tgtactatgcctgcct

SEQ ID NO: 447285 - DNA, 16 bp, M. musculus
tgtactatgtgcatgc

SEQ ID NO: 447286 - DNA, 16 bp, M. musculus
tgtactcagtccaatg

SEQ ID NO: 447287 - DNA, 16 bp, M. musculus
tgtactcatataaata

SEQ ID NO: 447288 - DNA, 16 bp, M. musculus
tgtactcatataaatt

SEQ ID NO: 447289 - DNA, 16 bp, M. musculus
tgtactcatatgcatt

SEQ ID NO: 447290 - DNA, 16 bp, M. musculus
tgtactccacttttta

SEQ ID NO: 447291 - DNA, 16 bp, M. musculus
tgtactcctggctgtc

SEQ ID NO: 447292 - DNA, 18 bp, M. musculus
tgtactctgccttccccg

SEQ ID NO: 447293 - DNA, 16 bp, M. musculus
tgtactctgccttcct

SEQ ID NO: 447294 - DNA, 16 bp, M. musculus
tgtactgcccgaagtt

SEQ ID NO: 447295 - DNA, 16 bp, M. musculus
tgtactggctggtttt

SEQ ID NO: 447296 - DNA, 16 bp, M. musculus
tgtactgtactgtact

SEQ ID NO: 447297 - DNA, 16 bp, M. musculus
tgtactgtgtactgtg

SEQ ID NO: 447298 - DNA, 16 bp, M. musculus
tgtactgtgttcctgt

SEQ ID NO: 447299 - DNA, 16 bp, M. musculus
tgtactgtgttgtact

SEQ ID NO: 447300 - DNA, 16 bp, M. musculus
tgtacttaacatataa

SEQ ID NO: 447301 - DNA, 16 bp, M. musculus
tgtacttatataaata

SEQ ID NO: 447302 - DNA, 16 bp, M. musculus
tgtacttgagttttgt

SEQ ID NO: 447303 - DNA, 16 bp, M. musculus
tgtacttggctcccag

SEQ ID NO: 447304 - DNA, 16 bp, M. musculus
tgtactttgctcatat

SEQ ID NO: 447305 - DNA, 16 bp, M. musculus
tgtactttggtctgtt

SEQ ID NO: 447306 - DNA, 16 bp, M. musculus
tgtactttttaaaata

SEQ ID NO: 447307 - DNA, 16 bp, M. musculus
tgtagaaaaatgagaa

SEQ ID NO: 447308 - DNA, 16 bp, M. musculus
tgtagaaaaatgtgaa

SEQ ID NO: 447309 - DNA, 16 bp, M. musculus
tgtagaaaaggaaaac

SEQ ID NO: 447310 - DNA, 16 bp, M. musculus
tgtagaaagaatatct

SEQ ID NO: 447311 - DNA, 16 bp, M. musculus
tgtagaaaggcagaga

SEQ ID NO: 447312 - DNA, 16 bp, M. musculus
tgtagaacaagctggc

SEQ ID NO: 447313 - DNA, 16 bp, M. musculus
tgtagaagaaagcagc

SEQ ID NO: 447314 - DNA, 16 bp, M. musculus
tgtagaagaatgcaaa

SEQ ID NO: 447315 - DNA, 16 bp, M. musculus
tgtagaagatggtagt

SEQ ID NO: 447316 - DNA, 16 bp, M. musculus
tgtagaagatgtgcag

SEQ ID NO: 447317 - DNA, 16 bp, M. musculus
tgtagaagattccata

SEQ ID NO: 447318 - DNA, 16 bp, M. musculus
tgtagaaggatcttat

SEQ ID NO: 447319 - DNA, 16 bp, M. musculus
tgtagaagtgtgtgtg

SEQ ID NO: 447320 - DNA, 17 bp, M. musculus
tgtagaatccaaaataa

SEQ ID NO: 447321 - DNA, 16 bp, M. musculus
tgtagaattataagtc

SEQ ID NO: 447322 - DNA, 16 bp, M. musculus
tgtagacaaggatggc

SEQ ID NO: 447323 - DNA, 16 bp, M. musculus
tgtagaccaagctgtc

SEQ ID NO: 447324 - DNA, 17 bp, M. musculus
tgtagaccagctggcct

SEQ ID NO: 447325 - DNA, 16 bp, M. musculus
tgtagaccaggatggc

SEQ ID NO: 447326 - DNA, 16 bp, M. musculus
tgtagaccaggcaggc

SEQ ID NO: 447327 - DNA, 16 bp, M. musculus
tgtagaccaggctagg

SEQ ID NO: 447328 - DNA, 16 bp, M. musculus
tgtagaccaggctagt

SEQ ID NO: 447329 - DNA, 16 bp, M. musculus
tgtagaccaggctgac

SEQ ID NO: 447330 - DNA, 16 bp, M. musculus
tgtagaccaggctgat

SEQ ID NO: 447331 - DNA, 16 bp, M. musculus
tgtagaccaggctgcc

SEQ ID NO: 447332 - DNA, 16 bp, M. musculus
tgtagaccaggctgga

SEQ ID NO: 447333 - DNA, 17 bp, M. musculus
tgtagaccaggctggca

SEQ ID NO: 447334 - DNA, 18 bp, M. musculus
tgtagaccaggctggcct

SEQ ID NO: 447335 - DNA, 17 bp, M. musculus
tgtagaccaggctggct

SEQ ID NO: 447336 - DNA, 16 bp, M. musculus
tgtagaccaggctggg

SEQ ID NO: 447337 - DNA, 16 bp, M. musculus
tgtagaccaggctgtc

SEQ ID NO: 447338 - DNA, 16 bp, M. musculus
tgtagaccatgctgac

SEQ ID NO: 447339 - DNA, 16 bp, M. musculus
tgtagagaaagaggaa

SEQ ID NO: 447340 - DNA, 16 bp, M. musculus
tgtagagatcaaagga

SEQ ID NO: 447341 - DNA, 16 bp, M. musculus
tgtagagatggctcag

SEQ ID NO: 447342 - DNA, 16 bp, M. musculus
tgtagagcagactggc

SEQ ID NO: 447343 - DNA, 16 bp, M. musculus
tgtagagcatgctggc

SEQ ID NO: 447344 - DNA, 16 bp, M. musculus
tgtagagttggttctc

SEQ ID NO: 447345 - DNA, 16 bp, M. musculus
tgtagatagatactgt

SEQ ID NO: 447346 - DNA, 16 bp, M. musculus
tgtagatatatgtata

SEQ ID NO: 447347 - DNA, 16 bp, M. musculus
tgtagatcaagctggc

SEQ ID NO: 447348 - DNA, 16 bp, M. musculus
tgtagatcaggctgga

SEQ ID NO: 447349 - DNA, 16 bp, M. musculus
tgtagatccagatgta

SEQ ID NO: 447350 - DNA, 16 bp, M. musculus
tgtagatgctggggat

SEQ ID NO: 447351 - DNA, 16 bp, M. musculus
tgtagatgcttgtcta

SEQ ID NO: 447352 - DNA, 16 bp, M. musculus
tgtagattgctctttc

SEQ ID NO: 447353 - DNA, 16 bp, M. musculus
tgtagcacaagatggc

SEQ ID NO: 447354 - DNA, 16 bp, M. musculus
tgtagcacacagcttg

SEQ ID NO: 447355 - DNA, 16 bp, M. musculus
tgtagcagaagccaga

SEQ ID NO: 447356 - DNA, 16 bp, M. musculus
tgtagcagaaggtggc

SEQ ID NO: 447357 - DNA, 16 bp, M. musculus
tgtagcagaatgccag

SEQ ID NO: 447358 - DNA, 16 bp, M. musculus
tgtagcagagggtggt

SEQ ID NO: 447359 - DNA, 16 bp, M. musculus
tgtagcagatgtgcag

SEQ ID NO: 447360 - DNA, 16 bp, M. musculus
tgtagcagcagcagca

SEQ ID NO: 447361 - DNA, 16 bp, M. musculus
tgtagcagccctggct

SEQ ID NO: 447362 - DNA, 16 bp, M. musculus
tgtagcagtggatggc

SEQ ID NO: 447363 - DNA, 16 bp, M. musculus
tgtagccaaactcctc

SEQ ID NO: 447364 - DNA, 16 bp, M. musculus
tgtagccaaagatggc

SEQ ID NO: 447365 - DNA, 16 bp, M. musculus
tgtagccaacaagatt

SEQ ID NO: 447366 - DNA, 16 bp, M. musculus
tgtagccaagatcttc

SEQ ID NO: 447367 - DNA, 16 bp, M. musculus
tgtagccaaggatggc

SEQ ID NO: 447368 - DNA, 16 bp, M. musculus
tgtagccactgtcttt

SEQ ID NO: 447369 - DNA, 16 bp, M. musculus
tgtagcccaggatagc

SEQ ID NO: 447370 - DNA, 16 bp, M. musculus
tgtagcccaggcagac

SEQ ID NO: 447371 - DNA, 16 bp, M. musculus
tgtagcccaggctacc

SEQ ID NO: 447372 - DNA, 16 bp, M. musculus
tgtagcccaggctaga

SEQ ID NO: 447373 - DNA, 16 bp, M. musculus
tgtagcccaggctgcc

SEQ ID NO: 447374 - DNA, 16 bp, M. musculus
tgtagcccaggctggc

SEQ ID NO: 447375 - DNA, 16 bp, M. musculus
tgtagcccagggtggc

SEQ ID NO: 447376 - DNA, 16 bp, M. musculus
tgtagcccatgctggc

SEQ ID NO: 447377 - DNA, 16 bp, M. musculus
tgtagccctagatgtc

SEQ ID NO: 447378 - DNA, 16 bp, M. musculus
tgtagccctgactatc

SEQ ID NO: 447379 - DNA, 16 bp, M. musculus
tgtagccctggatgac

SEQ ID NO: 447380 - DNA, 16 bp, M. musculus
tgtagccctggctacc

SEQ ID NO: 447381 - DNA, 16 bp, M. musculus
tgtagccctggctagt

SEQ ID NO: 447382 - DNA, 16 bp, M. musculus
tgtagccctggctggc

SEQ ID NO: 447383 - DNA, 16 bp, M. musculus
tgtagccctggctgtt

SEQ ID NO: 447384 - DNA, 16 bp, M. musculus
tgtagcctaggctggc

SEQ ID NO: 447385 - DNA, 16 bp, M. musculus
tgtagcctaggttagc

SEQ ID NO: 447386 - DNA, 16 bp, M. musculus
tgtagccttgcctgtc

SEQ ID NO: 447387 - DNA, 16 bp, M. musculus
tgtagccttggatgtc

SEQ ID NO: 447388 - DNA, 16 bp, M. musculus
tgtagccttggctctc

SEQ ID NO: 447389 - DNA, 16 bp, M. musculus
tgtagctcaggatggc

SEQ ID NO: 447390 - DNA, 16 bp, M. musculus
tgtagctcaggttagc

SEQ ID NO: 447391 - DNA, 16 bp, M. musculus
tgtagctcagtagtaa

SEQ ID NO: 447392 - DNA, 16 bp, M. musculus
tgtagctcagtgataa

SEQ ID NO: 447393 - DNA, 16 bp, M. musculus
tgtagctcagtgggag

SEQ ID NO: 447394 - DNA, 16 bp, M. musculus
tgtagctcagtggtaa

SEQ ID NO: 447395 - DNA, 16 bp, M. musculus
tgtagctccagctcca

SEQ ID NO: 447396 - DNA, 16 bp, M. musculus
tgtagctctgactgac

SEQ ID NO: 447397 - DNA, 16 bp, M. musculus
tgtagctctggccatc

SEQ ID NO: 447398 - DNA, 16 bp, M. musculus
tgtagctctggctgga

SEQ ID NO: 447399 - DNA, 16 bp, M. musculus
tgtagctgactacttg

SEQ ID NO: 447400 - DNA, 16 bp, M. musculus
tgtagctgagaataac

SEQ ID NO: 447401 - DNA, 16 bp, M. musculus
tgtagctgagactggc

SEQ ID NO: 447402 - DNA, 17 bp, M. musculus
tgtagctgccaaaagaa

SEQ ID NO: 447403 - DNA, 16 bp, M. musculus
tgtagctgggcagaag

SEQ ID NO: 447404 - DNA, 16 bp, M. musculus
tgtagctgggttggtg

SEQ ID NO: 447405 - DNA, 28 bp, M. musculus
tgtagctgtcttcagacactccagaaga

SEQ ID NO: 447406 - DNA, 26 bp, M. musculus
tgtagctgttttcagacactccagaa

SEQ ID NO: 447407 - DNA, 16 bp, M. musculus
tgtagcttagtggtag

SEQ ID NO: 447408 - DNA, 16 bp, M. musculus
tgtagcttcagctcca

SEQ ID NO: 447409 - DNA, 16 bp, M. musculus
tgtaggaaacaaaggc

SEQ ID NO: 447410 - DNA, 16 bp, M. musculus
tgtaggaagagctgag

SEQ ID NO: 447411 - DNA, 16 bp, M. musculus
tgtaggacattttctt

SEQ ID NO: 447412 - DNA, 16 bp, M. musculus
tgtaggagctagaaaa

SEQ ID NO: 447413 - DNA, 16 bp, M. musculus
tgtaggagctggagag

SEQ ID NO: 447414 - DNA, 16 bp, M. musculus
tgtaggagggccagca

SEQ ID NO: 447415 - DNA, 16 bp, M. musculus
tgtaggccaggctggg

SEQ ID NO: 447416 - DNA, 16 bp, M. musculus
tgtagggagccattcc

SEQ ID NO: 447417 - DNA, 16 bp, M. musculus
tgtagggcatttcatc

SEQ ID NO: 447418 - DNA, 16 bp, M. musculus
tgtagggctgggttgg

SEQ ID NO: 447419 - DNA, 16 bp, M. musculus
tgtaggggctggagag

SEQ ID NO: 447420 - DNA, 16 bp, M. musculus
tgtaggtaccctcctt

SEQ ID NO: 447421 - DNA, 16 bp, M. musculus
tgtaggtcagaggtca

SEQ ID NO: 447422 - DNA, 16 bp, M. musculus
tgtaggtcagtggtag

SEQ ID NO: 447423 - DNA, 16 bp, M. musculus
tgtaggtcccagggat

SEQ ID NO: 447424 - DNA, 16 bp, M. musculus
tgtaggtctctgtatt

SEQ ID NO: 447425 - DNA, 16 bp, M. musculus
tgtaggtgctagaaac

SEQ ID NO: 447426 - DNA, 16 bp, M. musculus
tgtaggtgctaggaat

SEQ ID NO: 447427 - DNA, 16 bp, M. musculus
tgtaggtgctggggat

SEQ ID NO: 447428 - DNA, 16 bp, M. musculus
tgtagtcagtctatta

SEQ ID NO: 447429 - DNA, 16 bp, M. musculus
tgtagtccaggatggc

SEQ ID NO: 447430 - DNA, 16 bp, M. musculus
tgtagtcctggctaac

SEQ ID NO: 447431 - DNA, 16 bp, M. musculus
tgtagtcctggctatt

SEQ ID NO: 447432 - DNA, 16 bp, M. musculus
tgtagtcctggctgcc

SEQ ID NO: 447433 - DNA, 16 bp, M. musculus
tgtagtgacaattttg

SEQ ID NO: 447434 - DNA, 16 bp, M. musculus
tgtagtgagtttcagg

SEQ ID NO: 447435 - DNA, 16 bp, M. musculus
tgtagtgctgggatta

SEQ ID NO: 447436 - DNA, 31 bp, M. musculus
tgtagtggctattcctggttgtcaacttgac

SEQ ID NO: 447437 - DNA, 16 bp, M. musculus
tgtagttcaggctggc

SEQ ID NO: 447438 - DNA, 16 bp, M. musculus
tgtagttcaggctgtc

SEQ ID NO: 447439 - DNA, 16 bp, M. musculus
tgtagttcagtggtag

SEQ ID NO: 447440 - DNA, 16 bp, M. musculus
tgtagttctggctggc

SEQ ID NO: 447441 - DNA, 16 bp, M. musculus
tgtagttgaagatgac

SEQ ID NO: 447442 - DNA, 16 bp, M. musculus
tgtagttgaggaaaat

SEQ ID NO: 447443 - DNA, 16 bp, M. musculus
tgtagtttccatcctt

SEQ ID NO: 447444 - DNA, 16 bp, M. musculus
tgtagtttggtcttca

SEQ ID NO: 447445 - DNA, 16 bp, M. musculus
tgtataaaaatgtatt

SEQ ID NO: 447446 - DNA, 16 bp, M. musculus
tgtataaaatctcaga

SEQ ID NO: 447447 - DNA, 16 bp, M. musculus
tgtataaatatcaata

SEQ ID NO: 447448 - DNA, 16 bp, M. musculus
tgtataaatgtataaa

SEQ ID NO: 447449 - DNA, 16 bp, M. musculus
tgtataagaaatcagg

SEQ ID NO: 447450 - DNA, 16 bp, M. musculus
tgtataagtatgtata

SEQ ID NO: 447451 - DNA, 16 bp, M. musculus
tgtatacacacacaca

SEQ ID NO: 447452 - DNA, 16 bp, M. musculus
tgtatacacaccacac

SEQ ID NO: 447453 - DNA, 16 bp, M. musculus
tgtatacacaggcaca

SEQ ID NO: 447454 - DNA, 16 bp, M. musculus
tgtatacacatacaca

SEQ ID NO: 447455 - DNA, 16 bp, M. musculus
tgtatacacatatgaa

SEQ ID NO: 447456 - DNA, 16 bp, M. musculus
tgtatacacatgtgca

SEQ ID NO: 447457 - DNA, 16 bp, M. musculus
tgtatacataataaat

SEQ ID NO: 447458 - DNA, 17 bp, M. musculus
tgtatacatatatatat

SEQ ID NO: 447459 - DNA, 16 bp, M. musculus
tgtatacatatgtatg

SEQ ID NO: 447460 - DNA, 16 bp, M. musculus
tgtatacatatttata

SEQ ID NO: 447461 - DNA, 16 bp, M. musculus
tgtatacatgcacatg

SEQ ID NO: 447462 - DNA, 16 bp, M. musculus
tgtatacatgcatgaa

SEQ ID NO: 447463 - DNA, 16 bp, M. musculus
tgtataccatgtacat

SEQ ID NO: 447464 - DNA, 16 bp, M. musculus
tgtatacttgtgtgtg

SEQ ID NO: 447465 - DNA, 16 bp, M. musculus
tgtatactttctctag

SEQ ID NO: 447466 - DNA, 16 bp, M. musculus
tgtatagaccaggcta

SEQ ID NO: 447467 - DNA, 16 bp, M. musculus
tgtatagaggtcagag

SEQ ID NO: 447468 - DNA, 16 bp, M. musculus
tgtatagatatgtata

SEQ ID NO: 447469 - DNA, 16 bp, M. musculus
tgtatagatgtatata

SEQ ID NO: 447470 - DNA, 16 bp, M. musculus
tgtatagcctaggctg

SEQ ID NO: 447471 - DNA, 16 bp, M. musculus
tgtatagtgtatgtat

SEQ ID NO: 447472 - DNA, 16 bp, M. musculus
tgtatagttcttttag

SEQ ID NO: 447473 - DNA, 16 bp, M. musculus
tgtatataaaatgtgt

SEQ ID NO: 447474 - DNA, 16 bp, M. musculus
tgtatataaacccagt

SEQ ID NO: 447475 - DNA, 16 bp, M. musculus
tgtatataaagataat

SEQ ID NO: 447476 - DNA, 16 bp, M. musculus
tgtatataaatgtaca

SEQ ID NO: 447477 - DNA, 16 bp, M. musculus
tgtatataacatatat

SEQ ID NO: 447478 - DNA, 16 bp, M. musculus
tgtatataatgtgtat

SEQ ID NO: 447479 - DNA, 16 bp, M. musculus
tgtatatacatatatg

SEQ ID NO: 447480 - DNA, 16 bp, M. musculus
tgtatatacatatgtg

SEQ ID NO: 447481 - DNA, 16 bp, M. musculus
tgtatatacgtatata

SEQ ID NO: 447482 - DNA, 16 bp, M. musculus
tgtatatactgtatat

SEQ ID NO: 447483 - DNA, 16 bp, M. musculus
tgtatatacttgtgtg

SEQ ID NO: 447484 - DNA, 16 bp, M. musculus
tgtatatagatatata

SEQ ID NO: 447485 - DNA, 16 bp, M. musculus
tgtatatagtatatgt

SEQ ID NO: 447486 - DNA, 16 bp, M. musculus
tgtatatataaatatg

SEQ ID NO: 447487 - DNA, 16 bp, M. musculus
tgtatatataacatgt

SEQ ID NO: 447488 - DNA, 16 bp, M. musculus
tgtatatataatacat

SEQ ID NO: 447489 - DNA, 16 bp, M. musculus
tgtatatatacagtat

SEQ ID NO: 447490 - DNA, 16 bp, M. musculus
tgtatatatatgcata

SEQ ID NO: 447491 - DNA, 16 bp, M. musculus
tgtatatatattttca

SEQ ID NO: 447492 - DNA, 16 bp, M. musculus
tgtatatatctatgca

SEQ ID NO: 447493 - DNA, 16 bp, M. musculus
tgtatatatgatatat

SEQ ID NO: 447494 - DNA, 16 bp, M. musculus
tgtatatatgtgaata

SEQ ID NO: 447495 - DNA, 16 bp, M. musculus
tgtatatatgtgtgtg

SEQ ID NO: 447496 - DNA, 16 bp, M. musculus
tgtatatatgtttatg

SEQ ID NO: 447497 - DNA, 16 bp, M. musculus
tgtatatatgtttgtg

SEQ ID NO: 447498 - DNA, 16 bp, M. musculus
tgtatatattagatat

SEQ ID NO: 447499 - DNA, 16 bp, M. musculus
tgtatatattatgtgt

SEQ ID NO: 447500 - DNA, 16 bp, M. musculus
tgtatatattcatatt

SEQ ID NO: 447501 - DNA, 16 bp, M. musculus
tgtatatattggaaat

SEQ ID NO: 447502 - DNA, 16 bp, M. musculus
tgtatatattgtgtat

SEQ ID NO: 447503 - DNA, 16 bp, M. musculus
tgtatatatttacata

SEQ ID NO: 447504 - DNA, 16 bp, M. musculus
tgtatatatttatgca

SEQ ID NO: 447505 - DNA, 16 bp, M. musculus
tgtatatctgcatata

SEQ ID NO: 447506 - DNA, 16 bp, M. musculus
tgtatatctgtgcacc

SEQ ID NO: 447507 - DNA, 16 bp, M. musculus
tgtatatgagcacact

SEQ ID NO: 447508 - DNA, 16 bp, M. musculus
tgtatatgagtacatc

SEQ ID NO: 447509 - DNA, 16 bp, M. musculus
tgtatatgagtgtgtc

SEQ ID NO: 447510 - DNA, 16 bp, M. musculus
tgtatatgcagctaga

SEQ ID NO: 447511 - DNA, 16 bp, M. musculus
tgtatatgcatgtgca

SEQ ID NO: 447512 - DNA, 16 bp, M. musculus
tgtatatgtaaatgta

SEQ ID NO: 447513 - DNA, 16 bp, M. musculus
tgtatatgtaatatat

SEQ ID NO: 447514 - DNA, 16 bp, M. musculus
tgtatatgtaatatgt

SEQ ID NO: 447515 - DNA, 16 bp, M. musculus
tgtatatgtacatgta

SEQ ID NO: 447516 - DNA, 16 bp, M. musculus
tgtatatgtatataca

SEQ ID NO: 447517 - DNA, 16 bp, M. musculus
tgtatatgtatatata

SEQ ID NO: 447518 - DNA, 16 bp, M. musculus
tgtatatgtatatctg

SEQ ID NO: 447519 - DNA, 16 bp, M. musculus
tgtatatgtatgtgta

SEQ ID NO: 447520 - DNA, 16 bp, M. musculus
tgtatatgtatgtgtg

SEQ ID NO: 447521 - DNA, 16 bp, M. musculus
tgtatatgtatttgtg

SEQ ID NO: 447522 - DNA, 16 bp, M. musculus
tgtatatgtgagagag

SEQ ID NO: 447523 - DNA, 16 bp, M. musculus
tgtatatgtgcttatg

SEQ ID NO: 447524 - DNA, 16 bp, M. musculus
tgtatatgtgtaaata

SEQ ID NO: 447525 - DNA, 16 bp, M. musculus
tgtatatgtgtgtatg

SEQ ID NO: 447526 - DNA, 16 bp, M. musculus
tgtatatgtgtgtgca

SEQ ID NO: 447527 - DNA, 16 bp, M. musculus
tgtatatgtgtgtgct

SEQ ID NO: 447528 - DNA, 16 bp, M. musculus
tgtatatgtgtgtgga

SEQ ID NO: 447529 - DNA, 16 bp, M. musculus
tgtatatgtgtgtgtg

SEQ ID NO: 447530 - DNA, 16 bp, M. musculus
tgtatatgtgttgggg

SEQ ID NO: 447531 - DNA, 16 bp, M. musculus
tgtatatgttatgtgt

SEQ ID NO: 447532 - DNA, 16 bp, M. musculus
tgtatattaaaccatc

SEQ ID NO: 447533 - DNA, 16 bp, M. musculus
tgtatattattcatta

SEQ ID NO: 447534 - DNA, 16 bp, M. musculus
tgtatattgtttctta

SEQ ID NO: 447535 - DNA, 16 bp, M. musculus
tgtatattgtttttac

SEQ ID NO: 447536 - DNA, 16 bp, M. musculus
tgtatatttatataca

SEQ ID NO: 447537 - DNA, 16 bp, M. musculus
tgtatatttatatgtg

SEQ ID NO: 447538 - DNA, 16 bp, M. musculus
tgtatatttatttcta

SEQ ID NO: 447539 - DNA, 16 bp, M. musculus
tgtatatttgtgtata

SEQ ID NO: 447540 - DNA, 16 bp, M. musculus
tgtatatttgtgtatg

SEQ ID NO: 447541 - DNA, 16 bp, M. musculus
tgtatatttgttttcc

SEQ ID NO: 447542 - DNA, 16 bp, M. musculus
tgtatatttttgactt

SEQ ID NO: 447543 - DNA, 16 bp, M. musculus
tgtatatttttggcat

SEQ ID NO: 447544 - DNA, 16 bp, M. musculus
tgtatcaaaaaagaaa

SEQ ID NO: 447545 - DNA, 16 bp, M. musculus
tgtatcaattcttctg

SEQ ID NO: 447546 - DNA, 16 bp, M. musculus
tgtatcacattttctt

SEQ ID NO: 447547 - DNA, 16 bp, M. musculus
tgtatcaccacaccca

SEQ ID NO: 447548 - DNA, 16 bp, M. musculus
tgtatcagaagatgac

SEQ ID NO: 447549 - DNA, 16 bp, M. musculus
tgtatcagaagatggt

SEQ ID NO: 447550 - DNA, 16 bp, M. musculus
tgtatcagtttcttct

SEQ ID NO: 447551 - DNA, 17 bp, M. musculus
tgtatcataggagagaa

SEQ ID NO: 447552 - DNA, 16 bp, M. musculus
tgtatccagtctttta

SEQ ID NO: 447553 - DNA, 16 bp, M. musculus
tgtatccatgtatgta

SEQ ID NO: 447554 - DNA, 29 bp, M. musculus
tgtatccattcctctgttgaggggcatct

SEQ ID NO: 447555 - DNA, 16 bp, M. musculus
tgtatccattgagact

SEQ ID NO: 447556 - DNA, 16 bp, M. musculus
tgtatcccaggctagc

SEQ ID NO: 447557 - DNA, 16 bp, M. musculus
tgtatccccctgatct

SEQ ID NO: 447558 - DNA, 16 bp, M. musculus
tgtatccccttaatct

SEQ ID NO: 447559 - DNA, 16 bp, M. musculus
tgtatccccttggtct

SEQ ID NO: 447560 - DNA, 16 bp, M. musculus
tgtatccctttgactt

SEQ ID NO: 447561 - DNA, 17 bp, M. musculus
tgtatcctaggtattct

SEQ ID NO: 447562 - DNA, 16 bp, M. musculus
tgtatcctttcctctg

SEQ ID NO: 447563 - DNA, 16 bp, M. musculus
tgtatctatataaaat

SEQ ID NO: 447564 - DNA, 17 bp, M. musculus
tgtatctatctatctat

SEQ ID NO: 447565 - DNA, 16 bp, M. musculus
tgtatctatgtatgta

SEQ ID NO: 447566 - DNA, 16 bp, M. musculus
tgtatctatgtgtcta

SEQ ID NO: 447567 - DNA, 16 bp, M. musculus
tgtatctctctgtgtg

SEQ ID NO: 447568 - DNA, 16 bp, M. musculus
tgtatctctttctctc

SEQ ID NO: 447569 - DNA, 16 bp, M. musculus
tgtatctgaagatgac

SEQ ID NO: 447570 - DNA, 17 bp, M. musculus
tgtatctgaaggcagag

SEQ ID NO: 447571 - DNA, 16 bp, M. musculus
tgtatctgaggatgac

SEQ ID NO: 447572 - DNA, 16 bp, M. musculus
tgtatctgccctctgc

SEQ ID NO: 447573 - DNA, 16 bp, M. musculus
tgtatctggttttata

SEQ ID NO: 447574 - DNA, 16 bp, M. musculus
tgtatcttaaacagat

SEQ ID NO: 447575 - DNA, 16 bp, M. musculus
tgtatcttatattttg

SEQ ID NO: 447576 - DNA, 16 bp, M. musculus
tgtatcttctacacct

SEQ ID NO: 447577 - DNA, 16 bp, M. musculus
tgtatcttctctgaat

SEQ ID NO: 447578 - DNA, 16 bp, M. musculus
tgtatcttgggtattc

SEQ ID NO: 447579 - DNA, 16 bp, M. musculus
tgtatcttgggttttc

SEQ ID NO: 447580 - DNA, 16 bp, M. musculus
tgtatctttaaatgat

SEQ ID NO: 447581 - DNA, 16 bp, M. musculus
tgtatctttaaatttt

SEQ ID NO: 447582 - DNA, 16 bp, M. musculus
tgtatctttttttaaa

SEQ ID NO: 447583 - DNA, 16 bp, M. musculus
tgtatgaaattatcaa

SEQ ID NO: 447584 - DNA, 16 bp, M. musculus
tgtatgaaattgtcaa

SEQ ID NO: 447585 - DNA, 16 bp, M. musculus
tgtatgaagaagagtc

SEQ ID NO: 447586 - DNA, 16 bp, M. musculus
tgtatgaatgtatgaa

SEQ ID NO: 447587 - DNA, 16 bp, M. musculus
tgtatgaatgtatgta

SEQ ID NO: 447588 - DNA, 17 bp, M. musculus
tgtatgacaagatcttc

SEQ ID NO: 447589 - DNA, 16 bp, M. musculus
tgtatgactttaccca

SEQ ID NO: 447590 - DNA, 16 bp, M. musculus
tgtatgaggctatgcc

SEQ ID NO: 447591 - DNA, 16 bp, M. musculus
tgtatgagggtgtgtg

SEQ ID NO: 447592 - DNA, 16 bp, M. musculus
tgtatgagtgtgcatg

SEQ ID NO: 447593 - DNA, 16 bp, M. musculus
tgtatgagtgtgtgta

SEQ ID NO: 447594 - DNA, 16 bp, M. musculus
tgtatgatacaaactt

SEQ ID NO: 447595 - DNA, 16 bp, M. musculus
tgtatgatgcctggtt

SEQ ID NO: 447596 - DNA, 16 bp, M. musculus
tgtatgattaaaaact

SEQ ID NO: 447597 - DNA, 16 bp, M. musculus
tgtatgcacatgtgct

SEQ ID NO: 447598 - DNA, 16 bp, M. musculus
tgtatgcagtgtgtgt

SEQ ID NO: 447599 - DNA, 16 bp, M. musculus
tgtatgcatacacaca

SEQ ID NO: 447600 - DNA, 16 bp, M. musculus
tgtatgcatatatgca

SEQ ID NO: 447601 - DNA, 16 bp, M. musculus
tgtatgcatatatttt

SEQ ID NO: 447602 - DNA, 16 bp, M. musculus
tgtatgcatatgtgca

SEQ ID NO: 447603 - DNA, 16 bp, M. musculus
tgtatgcatatgtgta

SEQ ID NO: 447604 - DNA, 16 bp, M. musculus
tgtatgcatgtatata

SEQ ID NO: 447605 - DNA, 16 bp, M. musculus
tgtatgcatgtatgtg

SEQ ID NO: 447606 - DNA, 16 bp, M. musculus
tgtatgcatgtgcata

SEQ ID NO: 447607 - DNA, 16 bp, M. musculus
tgtatgcatgtgtata

SEQ ID NO: 447608 - DNA, 16 bp, M. musculus
tgtatgcatgtgtgat

SEQ ID NO: 447609 - DNA, 16 bp, M. musculus
tgtatgcatgtgtgca

SEQ ID NO: 447610 - DNA, 16 bp, M. musculus
tgtatgcatgtttgta

SEQ ID NO: 447611 - DNA, 16 bp, M. musculus
tgtatgcattttcttt

SEQ ID NO: 447612 - DNA, 16 bp, M. musculus
tgtatgccagaagagg

SEQ ID NO: 447613 - DNA, 16 bp, M. musculus
tgtatgcctgtgtata

SEQ ID NO: 447614 - DNA, 16 bp, M. musculus
tgtatgcctgtgtgtg

SEQ ID NO: 447615 - DNA, 16 bp, M. musculus
tgtatgcgtgtgcaca

SEQ ID NO: 447616 - DNA, 16 bp, M. musculus
tgtatgctctttgctt

SEQ ID NO: 447617 - DNA, 16 bp, M. musculus
tgtatgctctttggct

SEQ ID NO: 447618 - DNA, 16 bp, M. musculus
tgtatgctgcctggtt

SEQ ID NO: 447619 - DNA, 16 bp, M. musculus
tgtatggctgtatggc

SEQ ID NO: 447620 - DNA, 16 bp, M. musculus
tgtatgggtattttac

SEQ ID NO: 447621 - DNA, 16 bp, M. musculus
tgtatgggtctgtgtg

SEQ ID NO: 447622 - DNA, 16 bp, M. musculus
tgtatgggtgctttgc

SEQ ID NO: 447623 - DNA, 16 bp, M. musculus
tgtatgggtgttttga

SEQ ID NO: 447624 - DNA, 16 bp, M. musculus
tgtatggtggctcaca

SEQ ID NO: 447625 - DNA, 16 bp, M. musculus
tgtatggtgtgcatgt

SEQ ID NO: 447626 - DNA, 16 bp, M. musculus
tgtatgtaaatatgtg

SEQ ID NO: 447627 - DNA, 16 bp, M. musculus
tgtatgtaaatgtgta

SEQ ID NO: 447628 - DNA, 16 bp, M. musculus
tgtatgtacacacata

SEQ ID NO: 447629 - DNA, 16 bp, M. musculus
tgtatgtagtatgtgt

SEQ ID NO: 447630 - DNA, 16 bp, M. musculus
tgtatgtatacatata

SEQ ID NO: 447631 - DNA, 16 bp, M. musculus
tgtatgtatatagtgt

SEQ ID NO: 447632 - DNA, 16 bp, M. musculus
tgtatgtatatatagt

SEQ ID NO: 447633 - DNA, 16 bp, M. musculus
tgtatgtatatattca

SEQ ID NO: 447634 - DNA, 16 bp, M. musculus
tgtatgtatatgagta

SEQ ID NO: 447635 - DNA, 16 bp, M. musculus
tgtatgtatatgtata

SEQ ID NO: 447636 - DNA, 16 bp, M. musculus
tgtatgtatatgtgtg

SEQ ID NO: 447637 - DNA, 16 bp, M. musculus
tgtatgtatatgttat

SEQ ID NO: 447638 - DNA, 16 bp, M. musculus
tgtatgtatattacat

SEQ ID NO: 447639 - DNA, 16 bp, M. musculus
tgtatgtatatttatg

SEQ ID NO: 447640 - DNA, 16 bp, M. musculus
tgtatgtatctgtatg

SEQ ID NO: 447641 - DNA, 16 bp, M. musculus
tgtatgtatctgtgtg

SEQ ID NO: 447642 - DNA, 16 bp, M. musculus
tgtatgtatgagtgtg

SEQ ID NO: 447643 - DNA, 16 bp, M. musculus
tgtatgtatgcacaaa

SEQ ID NO: 447644 - DNA, 16 bp, M. musculus
tgtatgtatggtatat

SEQ ID NO: 447645 - DNA, 16 bp, M. musculus
tgtatgtatgtacagt

SEQ ID NO: 447646 - DNA, 16 bp, M. musculus
tgtatgtatgtaggta

SEQ ID NO: 447647 - DNA, 17 bp, M. musculus
tgtatgtatgtatgtaa

SEQ ID NO: 447648 - DNA, 17 bp, M. musculus
tgtatgtatgtatgtat

SEQ ID NO: 447649 - DNA, 16 bp, M. musculus
tgtatgtatgtatgtc

SEQ ID NO: 447650 - DNA, 22 bp, M. musculus
tgtatgtatgtatgtgtgtgtg

SEQ ID NO: 447651 - DNA, 16 bp, M. musculus
tgtatgtatgtatgtt

SEQ ID NO: 447652 - DNA, 16 bp, M. musculus
tgtatgtatgtcatgt

SEQ ID NO: 447653 - DNA, 16 bp, M. musculus
tgtatgtatgtgaatg

SEQ ID NO: 447654 - DNA, 16 bp, M. musculus
tgtatgtatgtgcaga

SEQ ID NO: 447655 - DNA, 16 bp, M. musculus
tgtatgtatgtgtatt

SEQ ID NO: 447656 - DNA, 16 bp, M. musculus
tgtatgtatgtgtctg

SEQ ID NO: 447657 - DNA, 16 bp, M. musculus
tgtatgtatgtgtgca

SEQ ID NO: 447658 - DNA, 16 bp, M. musculus
tgtatgtatgttgtat

SEQ ID NO: 447659 - DNA, 16 bp, M. musculus
tgtatgtatgttttct

SEQ ID NO: 447660 - DNA, 16 bp, M. musculus
tgtatgtattatgcat

SEQ ID NO: 447661 - DNA, 16 bp, M. musculus
tgtatgtattcactta

SEQ ID NO: 447662 - DNA, 16 bp, M. musculus
tgtatgtctctgtgtg

SEQ ID NO: 447663 - DNA, 16 bp, M. musculus
tgtatgtctgtgtatg

SEQ ID NO: 447664 - DNA, 16 bp, M. musculus
tgtatgtctgtgtgtc

SEQ ID NO: 447665 - DNA, 16 bp, M. musculus
tgtatgtgaatatgtg

SEQ ID NO: 447666 - DNA, 16 bp, M. musculus
tgtatgtgactatgtg

SEQ ID NO: 447667 - DNA, 16 bp, M. musculus
tgtatgtgagcatgtg

SEQ ID NO: 447668 - DNA, 16 bp, M. musculus
tgtatgtgagtatata

SEQ ID NO: 447669 - DNA, 16 bp, M. musculus
tgtatgtgagtgtgca

SEQ ID NO: 447670 - DNA, 16 bp, M. musculus
tgtatgtgatatgtat

SEQ ID NO: 447671 - DNA, 16 bp, M. musculus
tgtatgtgatgtgtgt

SEQ ID NO: 447672 - DNA, 16 bp, M. musculus
tgtatgtgcacactca

SEQ ID NO: 447673 - DNA, 16 bp, M. musculus
tgtatgtgcacatgca

SEQ ID NO: 447674 - DNA, 16 bp, M. musculus
tgtatgtgcaccatat

SEQ ID NO: 447675 - DNA, 16 bp, M. musculus
tgtatgtgcattcatg

SEQ ID NO: 447676 - DNA, 16 bp, M. musculus
tgtatgtgcgcacatg

SEQ ID NO: 447677 - DNA, 16 bp, M. musculus
tgtatgtggatatgta

SEQ ID NO: 447678 - DNA, 16 bp, M. musculus
tgtatgtggatgtgtg

SEQ ID NO: 447679 - DNA, 16 bp, M. musculus
tgtatgtgggcacaca

SEQ ID NO: 447680 - DNA, 16 bp, M. musculus
tgtatgtgggcatgtg

SEQ ID NO: 447681 - DNA, 16 bp, M. musculus
tgtatgtgggtatgtg

SEQ ID NO: 447682 - DNA, 16 bp, M. musculus
tgtatgtgggtgtgca

SEQ ID NO: 447683 - DNA, 16 bp, M. musculus
tgtatgtggtatgtgt

SEQ ID NO: 447684 - DNA, 16 bp, M. musculus
tgtatgtggtgcatgt

SEQ ID NO: 447685 - DNA, 16 bp, M. musculus
tgtatgtgtacatata

SEQ ID NO: 447686 - DNA, 16 bp, M. musculus
tgtatgtgtacatgtg

SEQ ID NO: 447687 - DNA, 16 bp, M. musculus
tgtatgtgtatataca

SEQ ID NO: 447688 - DNA, 16 bp, M. musculus
tgtatgtgtatctttg

SEQ ID NO: 447689 - DNA, 16 bp, M. musculus
tgtatgtgtatgagtg

SEQ ID NO: 447690 - DNA, 16 bp, M. musculus
tgtatgtgtatgtatt

SEQ ID NO: 447691 - DNA, 17 bp, M. musculus
tgtatgtgtatgtgtat

SEQ ID NO: 447692 - DNA, 16 bp, M. musculus
tgtatgtgtgaaagag

SEQ ID NO: 447693 - DNA, 16 bp, M. musculus
tgtatgtgtgcaggca

SEQ ID NO: 447694 - DNA, 16 bp, M. musculus
tgtatgtgtgcctctg

SEQ ID NO: 447695 - DNA, 16 bp, M. musculus
tgtatgtgtgcctgtg

SEQ ID NO: 447696 - DNA, 16 bp, M. musculus
tgtatgtgtgctgtgt

SEQ ID NO: 447697 - DNA, 16 bp, M. musculus
tgtatgtgtgtaaatg

SEQ ID NO: 447698 - DNA, 16 bp, M. musculus
tgtatgtgtgtacaca

SEQ ID NO: 447699 - DNA, 16 bp, M. musculus
tgtatgtgtgtatatg

SEQ ID NO: 447700 - DNA, 16 bp, M. musculus
tgtatgtgtgtattat

SEQ ID NO: 447701 - DNA, 16 bp, M. musculus
tgtatgtgtgtgaaca

SEQ ID NO: 447702 - DNA, 16 bp, M. musculus
tgtatgtgtgtgggca

SEQ ID NO: 447703 - DNA, 16 bp, M. musculus
tgtatgtgtgtgggga

SEQ ID NO: 447704 - DNA, 16 bp, M. musculus
tgtatgtgtgtggtat

SEQ ID NO: 447705 - DNA, 16 bp, M. musculus
tgtatgtgtgtgtaca

SEQ ID NO: 447706 - DNA, 16 bp, M. musculus
tgtatgtgtgtttctc

SEQ ID NO: 447707 - DNA, 16 bp, M. musculus
tgtatgtgtgttttct

SEQ ID NO: 447708 - DNA, 16 bp, M. musculus
tgtatgtgtttgaatg

SEQ ID NO: 447709 - DNA, 16 bp, M. musculus
tgtatgtgttttgctt

SEQ ID NO: 447710 - DNA, 16 bp, M. musculus
tgtatgttaaaccatc

SEQ ID NO: 447711 - DNA, 16 bp, M. musculus
tgtatgttcttttgtg

SEQ ID NO: 447712 - DNA, 16 bp, M. musculus
tgtatgttggaaacat

SEQ ID NO: 447713 - DNA, 16 bp, M. musculus
tgtatgttgtatgtat

SEQ ID NO: 447714 - DNA, 16 bp, M. musculus
tgtatgtttataagca

SEQ ID NO: 447715 - DNA, 16 bp, M. musculus
tgtatgtttatgtatg

SEQ ID NO: 447716 - DNA, 16 bp, M. musculus
tgtatgtttgtatatg

SEQ ID NO: 447717 - DNA, 16 bp, M. musculus
tgtatgtttgtgtgaa

SEQ ID NO: 447718 - DNA, 16 bp, M. musculus
tgtatgttttaaaaaa

SEQ ID NO: 447719 - DNA, 16 bp, M. musculus
tgtatgttttgcctgt

SEQ ID NO: 447720 - DNA, 16 bp, M. musculus
tgtattaaatatgtaa

SEQ ID NO: 447721 - DNA, 16 bp, M. musculus
tgtattaagttgacaa

SEQ ID NO: 447722 - DNA, 16 bp, M. musculus
tgtattacatttattt

SEQ ID NO: 447723 - DNA, 16 bp, M. musculus
tgtattagctactttt

SEQ ID NO: 447724 - DNA, 23 bp, M. musculus
tgtattagtcagggttctctaga

SEQ ID NO: 447725 - DNA, 16 bp, M. musculus
tgtattagttactgtt

SEQ ID NO: 447726 - DNA, 16 bp, M. musculus
tgtattatatacatat

SEQ ID NO: 447727 - DNA, 16 bp, M. musculus
tgtattatatgtacat

SEQ ID NO: 447728 - DNA, 16 bp, M. musculus
tgtattatgtatatgt

SEQ ID NO: 447729 - DNA, 16 bp, M. musculus
tgtattattttctaaa

SEQ ID NO: 447730 - DNA, 16 bp, M. musculus
tgtattcaaatgctaa

SEQ ID NO: 447731 - DNA, 16 bp, M. musculus
tgtattcacatataca

SEQ ID NO: 447732 - DNA, 16 bp, M. musculus
tgtattcatatacaca

SEQ ID NO: 447733 - DNA, 16 bp, M. musculus
tgtattcatatacatg

SEQ ID NO: 447734 - DNA, 16 bp, M. musculus
tgtattcatatatgta

SEQ ID NO: 447735 - DNA, 16 bp, M. musculus
tgtattcatgtgcaca

SEQ ID NO: 447736 - DNA, 16 bp, M. musculus
tgtattccatccaata

SEQ ID NO: 447737 - DNA, 16 bp, M. musculus
tgtattcctaaataca

SEQ ID NO: 447738 - DNA, 16 bp, M. musculus
tgtattctatcagatc

SEQ ID NO: 447739 - DNA, 16 bp, M. musculus
tgtattctgcagctct

SEQ ID NO: 447740 - DNA, 16 bp, M. musculus
tgtattctgtggctga

SEQ ID NO: 447741 - DNA, 21 bp, M. musculus
tgtattctgttgctgatgctt

SEQ ID NO: 447742 - DNA, 16 bp, M. musculus
tgtattctttccagct

SEQ ID NO: 447743 - DNA, 16 bp, M. musculus
tgtattgacacttgtt

SEQ ID NO: 447744 - DNA, 16 bp, M. musculus
tgtattgatttatatg

SEQ ID NO: 447745 - DNA, 17 bp, M. musculus
tgtattgcttcttttct

SEQ ID NO: 447746 - DNA, 16 bp, M. musculus
tgtattggtaaggctc

SEQ ID NO: 447747 - DNA, 16 bp, M. musculus
tgtattggtgttttgc

SEQ ID NO: 447748 - DNA, 16 bp, M. musculus
tgtattggttactttt

SEQ ID NO: 447749 - DNA, 16 bp, M. musculus
tgtattgtaatgctaa

SEQ ID NO: 447750 - DNA, 16 bp, M. musculus
tgtattgtatggatgc

SEQ ID NO: 447751 - DNA, 16 bp, M. musculus
tgtattgtattgtact

SEQ ID NO: 447752 - DNA, 16 bp, M. musculus
tgtatttacttttaaa

SEQ ID NO: 447753 - DNA, 16 bp, M. musculus
tgtatttatgaaattc

SEQ ID NO: 447754 - DNA, 16 bp, M. musculus
tgtatttatgtgtata

SEQ ID NO: 447755 - DNA, 16 bp, M. musculus
tgtatttcagctaatg

SEQ ID NO: 447756 - DNA, 16 bp, M. musculus
tgtatttctttacctt

SEQ ID NO: 447757 - DNA, 16 bp, M. musculus
tgtatttctttctctc

SEQ ID NO: 447758 - DNA, 16 bp, M. musculus
tgtatttcttttagac

SEQ ID NO: 447759 - DNA, 16 bp, M. musculus
tgtatttgaaagaaaa

SEQ ID NO: 447760 - DNA, 16 bp, M. musculus
tgtatttgctaggcac

SEQ ID NO: 447761 - DNA, 17 bp, M. musculus
tgtatttgtcaggctct

SEQ ID NO: 447762 - DNA, 16 bp, M. musculus
tgtatttgtctctgtg

SEQ ID NO: 447763 - DNA, 16 bp, M. musculus
tgtatttgtgtgcctg

SEQ ID NO: 447764 - DNA, 16 bp, M. musculus
tgtatttgtttaagtg

SEQ ID NO: 447765 - DNA, 16 bp, M. musculus
tgtattttaaaagtaa

SEQ ID NO: 447766 - DNA, 16 bp, M. musculus
tgtattttaaaatgaa

SEQ ID NO: 447767 - DNA, 16 bp, M. musculus
tgtattttaaaattca

SEQ ID NO: 447768 - DNA, 16 bp, M. musculus
tgtattttataaaaag

SEQ ID NO: 447769 - DNA, 16 bp, M. musculus
tgtattttcctcagtt

SEQ ID NO: 447770 - DNA, 16 bp, M. musculus
tgtattttctaattgt

SEQ ID NO: 447771 - DNA, 16 bp, M. musculus
tgtattttctggatgt

SEQ ID NO: 447772 - DNA, 16 bp, M. musculus
tgtattttctttaatg

SEQ ID NO: 447773 - DNA, 16 bp, M. musculus
tgtattttgatcatgt

SEQ ID NO: 447774 - DNA, 16 bp, M. musculus
tgtattttgcattttg

SEQ ID NO: 447775 - DNA, 16 bp, M. musculus
tgtattttggtcatat

SEQ ID NO: 447776 - DNA, 16 bp, M. musculus
tgtatttttaaaagat

SEQ ID NO: 447777 - DNA, 16 bp, M. musculus
tgtatttttatacatt

SEQ ID NO: 447778 - DNA, 16 bp, M. musculus
tgtatttttcaaatca

SEQ ID NO: 447779 - DNA, 16 bp, M. musculus
tgtatttttcctttga

SEQ ID NO: 447780 - DNA, 16 bp, M. musculus
tgtattttttggctaa

SEQ ID NO: 447781 - DNA, 16 bp, M. musculus
tgtcaaaaggacaaaa

SEQ ID NO: 447782 - DNA, 16 bp, M. musculus
tgtcaaactgacaaaa

SEQ ID NO: 447783 - DNA, 16 bp, M. musculus
tgtcaaagaacaaaat

SEQ ID NO: 447784 - DNA, 16 bp, M. musculus
tgtcaaatattaaaat

SEQ ID NO: 447785 - DNA, 27 bp, M. musculus
tgtcaaatatttagctactgtgaaaat

SEQ ID NO: 447786 - DNA, 16 bp, M. musculus
tgtcaaattgacaata

SEQ ID NO: 447787 - DNA, 16 bp, M. musculus
tgtcaacatttggagg

SEQ ID NO: 447788 - DNA, 16 bp, M. musculus
tgtcaaccagccagac

SEQ ID NO: 447789 - DNA, 16 bp, M. musculus
tgtcaacctgactgga

SEQ ID NO: 447790 - DNA, 17 bp, M. musculus
tgtcaacctgctagtgt

SEQ ID NO: 447791 - DNA, 16 bp, M. musculus
tgtcaactggacacaa

SEQ ID NO: 447792 - DNA, 16 bp, M. musculus
tgtcaacttgacaaaa

SEQ ID NO: 447793 - DNA, 16 bp, M. musculus
tgtcaacttgacaagg

SEQ ID NO: 447794 - DNA, 16 bp, M. musculus
tgtcaacttgacagaa

SEQ ID NO: 447795 - DNA, 16 bp, M. musculus
tgtcaacttgacataa

SEQ ID NO: 447796 - DNA, 16 bp, M. musculus
tgtcaacttgacccaa

SEQ ID NO: 447797 - DNA, 16 bp, M. musculus
tgtcaacttgactgaa

SEQ ID NO: 447798 - DNA, 16 bp, M. musculus
tgtcaacttgatacaa

SEQ ID NO: 447799 - DNA, 16 bp, M. musculus
tgtcaactttacacaa

SEQ ID NO: 447800 - DNA, 16 bp, M. musculus
tgtcaagatggccatt

SEQ ID NO: 447801 - DNA, 16 bp, M. musculus
tgtcaagcctgacaac

SEQ ID NO: 447802 - DNA, 16 bp, M. musculus
tgtcaagctgacaaag

SEQ ID NO: 447803 - DNA, 16 bp, M. musculus
tgtcaagctgctggtg

SEQ ID NO: 447804 - DNA, 16 bp, M. musculus
tgtcaataaaaagctg

SEQ ID NO: 447805 - DNA, 16 bp, M. musculus
tgtcaataaagaaaat

SEQ ID NO: 447806 - DNA, 16 bp, M. musculus
tgtcaataaagaaggc

SEQ ID NO: 447807 - DNA, 16 bp, M. musculus
tgtcaatactcctggg

SEQ ID NO: 447808 - DNA, 16 bp, M. musculus
tgtcaatcaaatgttt

SEQ ID NO: 447809 - DNA, 16 bp, M. musculus
tgtcaatcctccatca

SEQ ID NO: 447810 - DNA, 16 bp, M. musculus
tgtcaatcttttctat

SEQ ID NO: 447811 - DNA, 16 bp, M. musculus
tgtcaatggctgctgt

SEQ ID NO: 447812 - DNA, 16 bp, M. musculus
tgtcaatgtgttcaag

SEQ ID NO: 447813 - DNA, 16 bp, M. musculus
tgtcaatgttttctat

SEQ ID NO: 447814 - DNA, 16 bp, M. musculus
tgtcaatttgacacaa

SEQ ID NO: 447815 - DNA, 16 bp, M. musculus
tgtcaatttggcacaa

SEQ ID NO: 447816 - DNA, 16 bp, M. musculus
tgtcacaatgtcaaaa

SEQ ID NO: 447817 - DNA, 16 bp, M. musculus
tgtcacacctactcca

SEQ ID NO: 447818 - DNA, 16 bp, M. musculus
tgtcacagaagacatg

SEQ ID NO: 447819 - DNA, 16 bp, M. musculus
tgtcacagaagccaga

SEQ ID NO: 447820 - DNA, 16 bp, M. musculus
tgtcacagagtcatga

SEQ ID NO: 447821 - DNA, 16 bp, M. musculus
tgtcacagatgggcat

SEQ ID NO: 447822 - DNA, 16 bp, M. musculus
tgtcacagcaagagaa

SEQ ID NO: 447823 - DNA, 16 bp, M. musculus
tgtcacagtgacagaa

SEQ ID NO: 447824 - DNA, 16 bp, M. musculus
tgtcacatcaaaggaa

SEQ ID NO: 447825 - DNA, 16 bp, M. musculus
tgtcacatgaggtttt

SEQ ID NO: 447826 - DNA, 16 bp, M. musculus
tgtcacatgcctttaa

SEQ ID NO: 447827 - DNA, 16 bp, M. musculus
tgtcacattctgtgga

SEQ ID NO: 447828 - DNA, 16 bp, M. musculus
tgtcacattttatttt

SEQ ID NO: 447829 - DNA, 16 bp, M. musculus
tgtcaccaaacacaaa

SEQ ID NO: 447830 - DNA, 16 bp, M. musculus
tgtcaccacacccagc

SEQ ID NO: 447831 - DNA, 16 bp, M. musculus
tgtcaccagaattttt

SEQ ID NO: 447832 - DNA, 16 bp, M. musculus
tgtcaccagttaattg

SEQ ID NO: 447833 - DNA, 16 bp, M. musculus
tgtcaccatcatcatc

SEQ ID NO: 447834 - DNA, 16 bp, M. musculus
tgtcaccatgccaggc

SEQ ID NO: 447835 - DNA, 16 bp, M. musculus
tgtcaccatgcccagc

SEQ ID NO: 447836 - DNA, 16 bp, M. musculus
tgtcaccccagggccc

SEQ ID NO: 447837 - DNA, 16 bp, M. musculus
tgtcacccctgggcag

SEQ ID NO: 447838 - DNA, 16 bp, M. musculus
tgtcacctgagttttc

SEQ ID NO: 447839 - DNA, 17 bp, M. musculus
tgtcactatgcatcctg

SEQ ID NO: 447840 - DNA, 16 bp, M. musculus
tgtcactccagctcca

SEQ ID NO: 447841 - DNA, 16 bp, M. musculus
tgtcactctcttcaga

SEQ ID NO: 447842 - DNA, 16 bp, M. musculus
tgtcactctgtcccca

SEQ ID NO: 447843 - DNA, 16 bp, M. musculus
tgtcactgctgttgct

SEQ ID NO: 447844 - DNA, 16 bp, M. musculus
tgtcactgtcactgtg

SEQ ID NO: 447845 - DNA, 16 bp, M. musculus
tgtcactgtctctctc

SEQ ID NO: 447846 - DNA, 16 bp, M. musculus
tgtcactgtggacgtg

SEQ ID NO: 447847 - DNA, 16 bp, M. musculus
tgtcactgtggagaca

SEQ ID NO: 447848 - DNA, 16 bp, M. musculus
tgtcactgtggaggtg

SEQ ID NO: 447849 - DNA, 16 bp, M. musculus
tgtcactgtggatgtg

SEQ ID NO: 447850 - DNA, 16 bp, M. musculus
tgtcactgtgggagtg

SEQ ID NO: 447851 - DNA, 16 bp, M. musculus
tgtcactgtgtgggtg

SEQ ID NO: 447852 - DNA, 16 bp, M. musculus
tgtcactgtttttaat

SEQ ID NO: 447853 - DNA, 16 bp, M. musculus
tgtcacttgtgttatt

SEQ ID NO: 447854 - DNA, 16 bp, M. musculus
tgtcacttgttttatt

SEQ ID NO: 447855 - DNA, 16 bp, M. musculus
tgtcacttgttttttg

SEQ ID NO: 447856 - DNA, 16 bp, M. musculus
tgtcagaaaccctgga

SEQ ID NO: 447857 - DNA, 16 bp, M. musculus
tgtcagaaagagattt

SEQ ID NO: 447858 - DNA, 16 bp, M. musculus
tgtcagaagacaactt

SEQ ID NO: 447859 - DNA, 16 bp, M. musculus
tgtcagaagccatcta

SEQ ID NO: 447860 - DNA, 16 bp, M. musculus
tgtcagacagctcaca

SEQ ID NO: 447861 - DNA, 16 bp, M. musculus
tgtcagacatggtgat

SEQ ID NO: 447862 - DNA, 16 bp, M. musculus
tgtcagagaagcacct

SEQ ID NO: 447863 - DNA, 25 bp, M. musculus
tgtcagagaccatcccgtgagaaag

SEQ ID NO: 447864 - DNA, 16 bp, M. musculus
tgtcagagcccctgga

SEQ ID NO: 447865 - DNA, 16 bp, M. musculus
tgtcagagctcctgga

SEQ ID NO: 447866 - DNA, 16 bp, M. musculus
tgtcagagtccctgga

SEQ ID NO: 447867 - DNA, 16 bp, M. musculus
tgtcagagtgtgcctg

SEQ ID NO: 447868 - DNA, 16 bp, M. musculus
tgtcagagttctgtga

SEQ ID NO: 447869 - DNA, 16 bp, M. musculus
tgtcagagttcttggt

SEQ ID NO: 447870 - DNA, 16 bp, M. musculus
tgtcagatattctggg

SEQ ID NO: 447871 - DNA, 16 bp, M. musculus
tgtcagatctcttgga

SEQ ID NO: 447872 - DNA, 16 bp, M. musculus
tgtcagatgtcattac

SEQ ID NO: 447873 - DNA, 16 bp, M. musculus
tgtcagattccctgga

SEQ ID NO: 447874 - DNA, 16 bp, M. musculus
tgtcagcaaagcccaa

SEQ ID NO: 447875 - DNA, 16 bp, M. musculus
tgtcagcaagcacctg

SEQ ID NO: 447876 - DNA, 16 bp, M. musculus
tgtcagcaagtatttc

SEQ ID NO: 447877 - DNA, 16 bp, M. musculus
tgtcagcactcctgtg

SEQ ID NO: 447878 - DNA, 16 bp, M. musculus
tgtcagcaggctctta

SEQ ID NO: 447879 - DNA, 16 bp, M. musculus
tgtcagcatttagaag

SEQ ID NO: 447880 - DNA, 16 bp, M. musculus
tgtcagccaccatgtg

SEQ ID NO: 447881 - DNA, 16 bp, M. musculus
tgtcagcgccatcttg

SEQ ID NO: 447882 - DNA, 16 bp, M. musculus
tgtcagctccaaactt

SEQ ID NO: 447883 - DNA, 16 bp, M. musculus
tgtcagctgagacagg

SEQ ID NO: 447884 - DNA, 16 bp, M. musculus
tgtcaggaagccctta

SEQ ID NO: 447885 - DNA, 16 bp, M. musculus
tgtcaggagcagacat

SEQ ID NO: 447886 - DNA, 16 bp, M. musculus
tgtcaggagtgggctc

SEQ ID NO: 447887 - DNA, 16 bp, M. musculus
tgtcaggcagtggtgg

SEQ ID NO: 447888 - DNA, 16 bp, M. musculus
tgtcaggcatgggaga

SEQ ID NO: 447889 - DNA, 16 bp, M. musculus
tgtcaggcttagcagc

SEQ ID NO: 447890 - DNA, 16 bp, M. musculus
tgtcagggcctctcag

SEQ ID NO: 447891 - DNA, 16 bp, M. musculus
tgtcagggtgggcttt

SEQ ID NO: 447892 - DNA, 16 bp, M. musculus
tgtcaggtctgtgttc

SEQ ID NO: 447893 - DNA, 16 bp, M. musculus
tgtcaggttgacataa

SEQ ID NO: 447894 - DNA, 16 bp, M. musculus
tgtcaggttgctagtg

SEQ ID NO: 447895 - DNA, 16 bp, M. musculus
tgtcagtactcctggg

SEQ ID NO: 447896 - DNA, 16 bp, M. musculus
tgtcagtcagctgctg

SEQ ID NO: 447897 - DNA, 16 bp, M. musculus
tgtcagtgctggtgtc

SEQ ID NO: 447898 - DNA, 16 bp, M. musculus
tgtcagtgtgtcccac

SEQ ID NO: 447899 - DNA, 16 bp, M. musculus
tgtcagtgtgtgtgtg

SEQ ID NO: 447900 - DNA, 16 bp, M. musculus
tgtcagttcagtctct

SEQ ID NO: 447901 - DNA, 16 bp, M. musculus
tgtcagtttgacacaa

SEQ ID NO: 447902 - DNA, 16 bp, M. musculus
tgtcatacagattttt

SEQ ID NO: 447903 - DNA, 16 bp, M. musculus
tgtcatagagatcctg

SEQ ID NO: 447904 - DNA, 16 bp, M. musculus
tgtcatagagatcttt

SEQ ID NO: 447905 - DNA, 16 bp, M. musculus
tgtcatatgtatgtgt

SEQ ID NO: 447906 - DNA, 16 bp, M. musculus
tgtcatcatcatcatc

SEQ ID NO: 447907 - DNA, 16 bp, M. musculus
tgtcatcatggtggga

SEQ ID NO: 447908 - DNA, 16 bp, M. musculus
tgtcatcgtcatcatc

SEQ ID NO: 447909 - DNA, 16 bp, M. musculus
tgtcatctgaccttca

SEQ ID NO: 447910 - DNA, 16 bp, M. musculus
tgtcatcttagaggct

SEQ ID NO: 447911 - DNA, 16 bp, M. musculus
tgtcatgaaaaaaaaa

SEQ ID NO: 447912 - DNA, 16 bp, M. musculus
tgtcatgcaagcatga

SEQ ID NO: 447913 - DNA, 16 bp, M. musculus
tgtcatgcccagaaga

SEQ ID NO: 447914 - DNA, 16 bp, M. musculus
tgtcatgcttgcagac

SEQ ID NO: 447915 - DNA, 16 bp, M. musculus
tgtcatggaactcact

SEQ ID NO: 447916 - DNA, 16 bp, M. musculus
tgtcatgggacatcta

SEQ ID NO: 447917 - DNA, 16 bp, M. musculus
tgtcattaaaaaaaaa

SEQ ID NO: 447918 - DNA, 16 bp, M. musculus
tgtcattaaaaagaaa

SEQ ID NO: 447919 - DNA, 16 bp, M. musculus
tgtcattaatcccagc

SEQ ID NO: 447920 - DNA, 16 bp, M. musculus
tgtcattgactctgtg

SEQ ID NO: 447921 - DNA, 16 bp, M. musculus
tgtcattgtgggcgtg

SEQ ID NO: 447922 - DNA, 16 bp, M. musculus
tgtcattgtgggggtg

SEQ ID NO: 447923 - DNA, 16 bp, M. musculus
tgtcattttaaaaagt

SEQ ID NO: 447924 - DNA, 16 bp, M. musculus
tgtcattttaagggat

SEQ ID NO: 447925 - DNA, 16 bp, M. musculus
tgtccaagaagctctg

SEQ ID NO: 447926 - DNA, 17 bp, M. musculus
tgtccaagaatttcata

SEQ ID NO: 447927 - DNA, 16 bp, M. musculus
tgtccaataagctctg

SEQ ID NO: 447928 - DNA, 16 bp, M. musculus
tgtccaatggatggct

SEQ ID NO: 447929 - DNA, 46 bp, M. musculus
tgtccaatgggcctctctttccagtgatggccgactaggccatctt

SEQ ID NO: 447930 - DNA, 20 bp, M. musculus
tgtccacagaacgggtcatc

SEQ ID NO: 447931 - DNA, 16 bp, M. musculus
tgtccacagactccac

SEQ ID NO: 447932 - DNA, 16 bp, M. musculus
tgtccacagctattct

SEQ ID NO: 447933 - DNA, 16 bp, M. musculus
tgtccacagtcaggaa

SEQ ID NO: 447934 - DNA, 16 bp, M. musculus
tgtccacatgtgtgtg

SEQ ID NO: 447935 - DNA, 16 bp, M. musculus
tgtccactctggactc

SEQ ID NO: 447936 - DNA, 16 bp, M. musculus
tgtccactgtgggtgg

SEQ ID NO: 447937 - DNA, 16 bp, M. musculus
tgtccacttcagcaaa

SEQ ID NO: 447938 - DNA, 16 bp, M. musculus
tgtccacttgacacaa

SEQ ID NO: 447939 - DNA, 16 bp, M. musculus
tgtccacttttctgag

SEQ ID NO: 447940 - DNA, 16 bp, M. musculus
tgtccagaaaattgtc

SEQ ID NO: 447941 - DNA, 16 bp, M. musculus
tgtccagaagacagca

SEQ ID NO: 447942 - DNA, 16 bp, M. musculus
tgtccagcaaggccat

SEQ ID NO: 447943 - DNA, 16 bp, M. musculus
tgtccaggatctcctg

SEQ ID NO: 447944 - DNA, 16 bp, M. musculus
tgtccagggatccatc

SEQ ID NO: 447945 - DNA, 16 bp, M. musculus
tgtccagtgcagccat

SEQ ID NO: 447946 - DNA, 16 bp, M. musculus
tgtccagttagttgat

SEQ ID NO: 447947 - DNA, 16 bp, M. musculus
tgtccatccgtccatc

SEQ ID NO: 447948 - DNA, 16 bp, M. musculus
tgtccatctgtccatc

SEQ ID NO: 447949 - DNA, 16 bp, M. musculus
tgtccatctgtctgcc

SEQ ID NO: 447950 - DNA, 16 bp, M. musculus
tgtccatctgtttgtc

SEQ ID NO: 447951 - DNA, 16 bp, M. musculus
tgtccatcttgttttt

SEQ ID NO: 447952 - DNA, 16 bp, M. musculus
tgtccatgtgtttgtg

SEQ ID NO: 447953 - DNA, 16 bp, M. musculus
tgtccatgtttagttt

SEQ ID NO: 447954 - DNA, 16 bp, M. musculus
tgtccatgtttctctt

SEQ ID NO: 447955 - DNA, 16 bp, M. musculus
tgtccatttcatcaag

SEQ ID NO: 447956 - DNA, 16 bp, M. musculus
tgtccattttgtccag

SEQ ID NO: 447957 - DNA, 17 bp, M. musculus
tgtcccaaatgtttggg

SEQ ID NO: 447958 - DNA, 16 bp, M. musculus
tgtcccacagacatgc

SEQ ID NO: 447959 - DNA, 16 bp, M. musculus
tgtcccacagtatatc

SEQ ID NO: 447960 - DNA, 16 bp, M. musculus
tgtcccaccatgcctg

SEQ ID NO: 447961 - DNA, 16 bp, M. musculus
tgtcccaccatgtgtt

SEQ ID NO: 447962 - DNA, 16 bp, M. musculus
tgtcccagaatctgtg

SEQ ID NO: 447963 - DNA, 16 bp, M. musculus
tgtcccagcctctctc

SEQ ID NO: 447964 - DNA, 16 bp, M. musculus
tgtcccagtagtccct

SEQ ID NO: 447965 - DNA, 16 bp, M. musculus
tgtcccagtttgcttt

SEQ ID NO: 447966 - DNA, 16 bp, M. musculus
tgtcccataagtttgg

SEQ ID NO: 447967 - DNA, 16 bp, M. musculus
tgtcccatgtatcctg

SEQ ID NO: 447968 - DNA, 16 bp, M. musculus
tgtccccaaaccagga

SEQ ID NO: 447969 - DNA, 16 bp, M. musculus
tgtccccaccatccta

SEQ ID NO: 447970 - DNA, 16 bp, M. musculus
tgtccccaccccacac

SEQ ID NO: 447971 - DNA, 16 bp, M. musculus
tgtccccagagctctg

SEQ ID NO: 447972 - DNA, 16 bp, M. musculus
tgtccccaggagggag

SEQ ID NO: 447973 - DNA, 16 bp, M. musculus
tgtccccaggcacccc

SEQ ID NO: 447974 - DNA, 16 bp, M. musculus
tgtccccatgtcccca

SEQ ID NO: 447975 - DNA, 16 bp, M. musculus
tgtcccccaaaggctc

SEQ ID NO: 447976 - DNA, 16 bp, M. musculus
tgtcccccattctctc

SEQ ID NO: 447977 - DNA, 16 bp, M. musculus
tgtcccctgagaggct

SEQ ID NO: 447978 - DNA, 16 bp, M. musculus
tgtcccctgatctcca

SEQ ID NO: 447979 - DNA, 16 bp, M. musculus
tgtccctccccatcca

SEQ ID NO: 447980 - DNA, 16 bp, M. musculus
tgtccctcctgctgac

SEQ ID NO: 447981 - DNA, 16 bp, M. musculus
tgtccctcctggggat

SEQ ID NO: 447982 - DNA, 16 bp, M. musculus
tgtccctctctctgtg

SEQ ID NO: 447983 - DNA, 16 bp, M. musculus
tgtccctctctgtgtg

SEQ ID NO: 447984 - DNA, 16 bp, M. musculus
tgtccctgattttaat

SEQ ID NO: 447985 - DNA, 16 bp, M. musculus
tgtccctgcagctctt

SEQ ID NO: 447986 - DNA, 16 bp, M. musculus
tgtccctgtccctcac

SEQ ID NO: 447987 - DNA, 16 bp, M. musculus
tgtccctgtccttcct

SEQ ID NO: 447988 - DNA, 16 bp, M. musculus
tgtccctgtctctgtt

SEQ ID NO: 447989 - DNA, 16 bp, M. musculus
tgtccctgtgacctct

SEQ ID NO: 447990 - DNA, 16 bp, M. musculus
tgtccctgtgccccct

SEQ ID NO: 447991 - DNA, 16 bp, M. musculus
tgtccctgtgccctct

SEQ ID NO: 447992 - DNA, 16 bp, M. musculus
tgtccctgtgctcagt

SEQ ID NO: 447993 - DNA, 16 bp, M. musculus
tgtccctgttcttcct

SEQ ID NO: 447994 - DNA, 16 bp, M. musculus
tgtcccttcacagcaa

SEQ ID NO: 447995 - DNA, 16 bp, M. musculus
tgtcccttctgcccag

SEQ ID NO: 447996 - DNA, 16 bp, M. musculus
tgtcccttgggagaat

SEQ ID NO: 447997 - DNA, 16 bp, M. musculus
tgtccctttgccctct

SEQ ID NO: 447998 - DNA, 16 bp, M. musculus
tgtccgcagactccac

SEQ ID NO: 447999 - DNA, 16 bp, M. musculus
tgtccgggaactcact

SEQ ID NO: 448000 - DNA, 16 bp, M. musculus
tgtcctagaactcaga

SEQ ID NO: 448001 - DNA, 17 bp, M. musculus
tgtcctagaacttgctt

SEQ ID NO: 448002 - DNA, 16 bp, M. musculus
tgtcctagaagctctg

SEQ ID NO: 448003 - DNA, 16 bp, M. musculus
tgtcctagaattcact

SEQ ID NO: 448004 - DNA, 16 bp, M. musculus
tgtcctagccagagca

SEQ ID NO: 448005 - DNA, 16 bp, M. musculus
tgtcctataagtttgg

SEQ ID NO: 448006 - DNA, 16 bp, M. musculus
tgtcctatcttcctgc

SEQ ID NO: 448007 - DNA, 16 bp, M. musculus
tgtcctatgccttaca

SEQ ID NO: 448008 - DNA, 16 bp, M. musculus
tgtcctcaacccctct

SEQ ID NO: 448009 - DNA, 16 bp, M. musculus
tgtcctcaaggcccaa

SEQ ID NO: 448010 - DNA, 16 bp, M. musculus
tgtcctcacacccaca

SEQ ID NO: 448011 - DNA, 17 bp, M. musculus
tgtcctcagacacacca

SEQ ID NO: 448012 - DNA, 16 bp, M. musculus
tgtcctcagacctcca

SEQ ID NO: 448013 - DNA, 16 bp, M. musculus
tgtcctcagcacagga

SEQ ID NO: 448014 - DNA, 16 bp, M. musculus
tgtcctcaggcagcta

SEQ ID NO: 448015 - DNA, 16 bp, M. musculus
tgtcctcagtgggaaa

SEQ ID NO: 448016 - DNA, 16 bp, M. musculus
tgtcctcatctgtaaa

SEQ ID NO: 448017 - DNA, 16 bp, M. musculus
tgtcctccatcccctc

SEQ ID NO: 448018 - DNA, 16 bp, M. musculus
tgtcctcctcctcagc

SEQ ID NO: 448019 - DNA, 16 bp, M. musculus
tgtcctcctctgacct

SEQ ID NO: 448020 - DNA, 21 bp, M. musculus
tgtcctcgcccagacagcaca

SEQ ID NO: 448021 - DNA, 16 bp, M. musculus
tgtcctctaacctcca

SEQ ID NO: 448022 - DNA, 16 bp, M. musculus
tgtcctctcacctcca

SEQ ID NO: 448023 - DNA, 16 bp, M. musculus
tgtcctctcctgtcct

SEQ ID NO: 448024 - DNA, 16 bp, M. musculus
tgtcctctgacatcta

SEQ ID NO: 448025 - DNA, 16 bp, M. musculus
tgtcctctgacctcaa

SEQ ID NO: 448026 - DNA, 16 bp, M. musculus
tgtcctctgacctcca

SEQ ID NO: 448027 - DNA, 16 bp, M. musculus
tgtcctctgacctcta

SEQ ID NO: 448028 - DNA, 16 bp, M. musculus
tgtcctctgaccttca

SEQ ID NO: 448029 - DNA, 16 bp, M. musculus
tgtcctctgactgcca

SEQ ID NO: 448030 - DNA, 16 bp, M. musculus
tgtcctctgacttcca

SEQ ID NO: 448031 - DNA, 16 bp, M. musculus
tgtcctctgatctcca

SEQ ID NO: 448032 - DNA, 16 bp, M. musculus
tgtcctctgatcttca

SEQ ID NO: 448033 - DNA, 16 bp, M. musculus
tgtcctctgatttcca

SEQ ID NO: 448034 - DNA, 16 bp, M. musculus
tgtcctctggcctcca

SEQ ID NO: 448035 - DNA, 16 bp, M. musculus
tgtcctctggtctcca

SEQ ID NO: 448036 - DNA, 16 bp, M. musculus
tgtcctctgtcttcca

SEQ ID NO: 448037 - DNA, 16 bp, M. musculus
tgtcctctgtgaggct

SEQ ID NO: 448038 - DNA, 16 bp, M. musculus
tgtcctcttacctcca

SEQ ID NO: 448039 - DNA, 16 bp, M. musculus
tgtcctcttctggcat

SEQ ID NO: 448040 - DNA, 16 bp, M. musculus
tgtcctcttctggtgc

SEQ ID NO: 448041 - DNA, 16 bp, M. musculus
tgtcctcttctgtcct

SEQ ID NO: 448042 - DNA, 16 bp, M. musculus
tgtcctcttggtggat

SEQ ID NO: 448043 - DNA, 16 bp, M. musculus
tgtcctgaaggtccca

SEQ ID NO: 448044 - DNA, 16 bp, M. musculus
tgtcctgaattccttt

SEQ ID NO: 448045 - DNA, 16 bp, M. musculus
tgtcctgactggatcc

SEQ ID NO: 448046 - DNA, 16 bp, M. musculus
tgtcctgacttctttc

SEQ ID NO: 448047 - DNA, 16 bp, M. musculus
tgtcctgaggacttca

SEQ ID NO: 448048 - DNA, 18 bp, M. musculus
tgtcctgagttcaaatcc

SEQ ID NO: 448049 - DNA, 16 bp, M. musculus
tgtcctgcctgcagag

SEQ ID NO: 448050 - DNA, 17 bp, M. musculus
tgtcctggaaatcactc

SEQ ID NO: 448051 - DNA, 16 bp, M. musculus
tgtcctggaactcatg

SEQ ID NO: 448052 - DNA, 16 bp, M. musculus
tgtcctggaacttggt

SEQ ID NO: 448053 - DNA, 16 bp, M. musculus
tgtcctggaattcacc

SEQ ID NO: 448054 - DNA, 17 bp, M. musculus
tgtcctggaattcactc

SEQ ID NO: 448055 - DNA, 16 bp, M. musculus
tgtcctggaatttgtt

SEQ ID NO: 448056 - DNA, 16 bp, M. musculus
tgtcctggaattttct

SEQ ID NO: 448057 - DNA, 16 bp, M. musculus
tgtcctggagcacatg

SEQ ID NO: 448058 - DNA, 16 bp, M. musculus
tgtcctggagctcagt

SEQ ID NO: 448059 - DNA, 16 bp, M. musculus
tgtcctggagctcatt

SEQ ID NO: 448060 - DNA, 16 bp, M. musculus
tgtcctggagctctct

SEQ ID NO: 448061 - DNA, 16 bp, M. musculus
tgtcctggagctggag

SEQ ID NO: 448062 - DNA, 16 bp, M. musculus
tgtcctggagcttact

SEQ ID NO: 448063 - DNA, 16 bp, M. musculus
tgtcctggagcttgct

SEQ ID NO: 448064 - DNA, 16 bp, M. musculus
tgtcctggatatcctg

SEQ ID NO: 448065 - DNA, 18 bp, M. musculus
tgtcctggatttcctggt

SEQ ID NO: 448066 - DNA, 16 bp, M. musculus
tgtcctggcacttact

SEQ ID NO: 448067 - DNA, 16 bp, M. musculus
tgtcctggcctgttct

SEQ ID NO: 448068 - DNA, 16 bp, M. musculus
tgtcctggctggtttt

SEQ ID NO: 448069 - DNA, 16 bp, M. musculus
tgtcctggcttccttt

SEQ ID NO: 448070 - DNA, 16 bp, M. musculus
tgtcctgggactcaca

SEQ ID NO: 448071 - DNA, 16 bp, M. musculus
tgtcctgggctttttt

SEQ ID NO: 448072 - DNA, 16 bp, M. musculus
tgtcctgtaactcact

SEQ ID NO: 448073 - DNA, 16 bp, M. musculus
tgtcctgtcacagaag

SEQ ID NO: 448074 - DNA, 16 bp, M. musculus
tgtcctgtccagaaga

SEQ ID NO: 448075 - DNA, 16 bp, M. musculus
tgtcctgtcctgttct

SEQ ID NO: 448076 - DNA, 16 bp, M. musculus
tgtcctgtctctgtct

SEQ ID NO: 448077 - DNA, 16 bp, M. musculus
tgtcctgtctgcaaaa

SEQ ID NO: 448078 - DNA, 16 bp, M. musculus
tgtcctgtctgtcctg

SEQ ID NO: 448079 - DNA, 16 bp, M. musculus
tgtcctgtgtcctgtg

SEQ ID NO: 448080 - DNA, 16 bp, M. musculus
tgtccttaaaatcctc

SEQ ID NO: 448081 - DNA, 16 bp, M. musculus
tgtccttataagagtg

SEQ ID NO: 448082 - DNA, 16 bp, M. musculus
tgtccttattacacat

SEQ ID NO: 448083 - DNA, 16 bp, M. musculus
tgtccttccccatctc

SEQ ID NO: 448084 - DNA, 16 bp, M. musculus
tgtccttccctgtctc

SEQ ID NO: 448085 - DNA, 16 bp, M. musculus
tgtccttcctataatc

SEQ ID NO: 448086 - DNA, 16 bp, M. musculus
tgtccttcctcatcac

SEQ ID NO: 448087 - DNA, 16 bp, M. musculus
tgtccttcctcatctc

SEQ ID NO: 448088 - DNA, 16 bp, M. musculus
tgtccttgaactcatt

SEQ ID NO: 448089 - DNA, 16 bp, M. musculus
tgtccttgacacctct

SEQ ID NO: 448090 - DNA, 16 bp, M. musculus
tgtccttgaccactct

SEQ ID NO: 448091 - DNA, 16 bp, M. musculus
tgtccttggaggtcag

SEQ ID NO: 448092 - DNA, 16 bp, M. musculus
tgtccttgtctgaaga

SEQ ID NO: 448093 - DNA, 16 bp, M. musculus
tgtccttgttggagga

SEQ ID NO: 448094 - DNA, 16 bp, M. musculus
tgtcctttataagatt

SEQ ID NO: 448095 - DNA, 16 bp, M. musculus
tgtcctttgacctcca

SEQ ID NO: 448096 - DNA, 16 bp, M. musculus
tgtcctttgcaagagc

SEQ ID NO: 448097 - DNA, 16 bp, M. musculus
tgtccttttctgacct

SEQ ID NO: 448098 - DNA, 16 bp, M. musculus
tgtccttttggatctg

SEQ ID NO: 448099 - DNA, 16 bp, M. musculus
tgtcctttttaaaaaa

SEQ ID NO: 448100 - DNA, 16 bp, M. musculus
tgtcggcccggagctc

SEQ ID NO: 448101 - DNA, 16 bp, M. musculus
tgtcggtctgtctgtc

SEQ ID NO: 448102 - DNA, 16 bp, M. musculus
tgtcgtcacagggaag

SEQ ID NO: 448103 - DNA, 16 bp, M. musculus
tgtcgtcatcatcatc

SEQ ID NO: 448104 - DNA, 17 bp, M. musculus
tgtcgtcattctcagcc

SEQ ID NO: 448105 - DNA, 16 bp, M. musculus
tgtcgtggtgaccccc

SEQ ID NO: 448106 - DNA, 16 bp, M. musculus
tgtctaaaaataaata

SEQ ID NO: 448107 - DNA, 16 bp, M. musculus
tgtctaaaggaaatgt

SEQ ID NO: 448108 - DNA, 16 bp, M. musculus
tgtctaacaggctgaa

SEQ ID NO: 448109 - DNA, 16 bp, M. musculus
tgtctaactcagatat

SEQ ID NO: 448110 - DNA, 16 bp, M. musculus
tgtctaagatcaagtg

SEQ ID NO: 448111 - DNA, 16 bp, M. musculus
tgtctaatatccaaaa

SEQ ID NO: 448112 - DNA, 17 bp, M. musculus
tgtctaattgagtggca

SEQ ID NO: 448113 - DNA, 16 bp, M. musculus
tgtctacaaaattgtc

SEQ ID NO: 448114 - DNA, 16 bp, M. musculus
tgtctacaagatgtgc

SEQ ID NO: 448115 - DNA, 16 bp, M. musculus
tgtctacagaggccag

SEQ ID NO: 448116 - DNA, 16 bp, M. musculus
tgtctacctgcctgcc

SEQ ID NO: 448117 - DNA, 16 bp, M. musculus
tgtctacttgctctgg

SEQ ID NO: 448118 - DNA, 16 bp, M. musculus
tgtctagaaatttgcc

SEQ ID NO: 448119 - DNA, 16 bp, M. musculus
tgtctagaagacactg

SEQ ID NO: 448120 - DNA, 16 bp, M. musculus
tgtctagcttgttctc

SEQ ID NO: 448121 - DNA, 16 bp, M. musculus
tgtctataactctagt

SEQ ID NO: 448122 - DNA, 16 bp, M. musculus
tgtctatacatataca

SEQ ID NO: 448123 - DNA, 16 bp, M. musculus
tgtctatctactggag

SEQ ID NO: 448124 - DNA, 16 bp, M. musculus
tgtctatgactccagt

SEQ ID NO: 448125 - DNA, 16 bp, M. musculus
tgtctatgagtgtttt

SEQ ID NO: 448126 - DNA, 16 bp, M. musculus
tgtctatgagtttgtt

SEQ ID NO: 448127 - DNA, 16 bp, M. musculus
tgtctatgtgtgcatg

SEQ ID NO: 448128 - DNA, 16 bp, M. musculus
tgtctatgtgtgggta

SEQ ID NO: 448129 - DNA, 16 bp, M. musculus
tgtctattattattat

SEQ ID NO: 448130 - DNA, 16 bp, M. musculus
tgtctattctctatct

SEQ ID NO: 448131 - DNA, 16 bp, M. musculus
tgtctcaaaaaaaaaa

SEQ ID NO: 448132 - DNA, 16 bp, M. musculus
tgtctcaaaaaaaaat

SEQ ID NO: 448133 - DNA, 16 bp, M. musculus
tgtctcaaaaaaataa

SEQ ID NO: 448134 - DNA, 16 bp, M. musculus
tgtctcaaaaaaatgt

SEQ ID NO: 448135 - DNA, 16 bp, M. musculus
tgtctcaaaaaacccc

SEQ ID NO: 448136 - DNA, 16 bp, M. musculus
tgtctcaaaaaataat

SEQ ID NO: 448137 - DNA, 16 bp, M. musculus
tgtctcaaaaactcaa

SEQ ID NO: 448138 - DNA, 16 bp, M. musculus
tgtctcaaaaagacaa

SEQ ID NO: 448139 - DNA, 16 bp, M. musculus
tgtctcaaaaagtaag

SEQ ID NO: 448140 - DNA, 16 bp, M. musculus
tgtctcaaaacaaaat

SEQ ID NO: 448141 - DNA, 16 bp, M. musculus
tgtctcaaaagaagaa

SEQ ID NO: 448142 - DNA, 16 bp, M. musculus
tgtctcaaaagacaag

SEQ ID NO: 448143 - DNA, 16 bp, M. musculus
tgtctcaaaatgaaaa

SEQ ID NO: 448144 - DNA, 16 bp, M. musculus
tgtctcaaacaaacag

SEQ ID NO: 448145 - DNA, 16 bp, M. musculus
tgtctcaaacaacaac

SEQ ID NO: 448146 - DNA, 16 bp, M. musculus
tgtctcaaagaaaaca

SEQ ID NO: 448147 - DNA, 16 bp, M. musculus
tgtctcaaagtaaaag

SEQ ID NO: 448148 - DNA, 16 bp, M. musculus
tgtctcaaataaggtg

SEQ ID NO: 448149 - DNA, 16 bp, M. musculus
tgtctcaagcaaggtg

SEQ ID NO: 448150 - DNA, 16 bp, M. musculus
tgtctcaataaacaaa

SEQ ID NO: 448151 - DNA, 16 bp, M. musculus
tgtctcaataaacaag

SEQ ID NO: 448152 - DNA, 16 bp, M. musculus
tgtctcactgaacctg

SEQ ID NO: 448153 - DNA, 16 bp, M. musculus
tgtctcagaaaaagaa

SEQ ID NO: 448154 - DNA, 16 bp, M. musculus
tgtctcagaaagaaaa

SEQ ID NO: 448155 - DNA, 16 bp, M. musculus
tgtctcagcctcctgg

SEQ ID NO: 448156 - DNA, 16 bp, M. musculus
tgtctcagccttccca

SEQ ID NO: 448157 - DNA, 16 bp, M. musculus
tgtctcagctgatctt

SEQ ID NO: 448158 - DNA, 16 bp, M. musculus
tgtctcagctgctctg

SEQ ID NO: 448159 - DNA, 16 bp, M. musculus
tgtctcagctggtctt

SEQ ID NO: 448160 - DNA, 16 bp, M. musculus
tgtctcaggaaaagaa

SEQ ID NO: 448161 - DNA, 16 bp, M. musculus
tgtctcagtcactgtt

SEQ ID NO: 448162 - DNA, 16 bp, M. musculus
tgtctcagtcagctac

SEQ ID NO: 448163 - DNA, 16 bp, M. musculus
tgtctcagtctctgtc

SEQ ID NO: 448164 - DNA, 16 bp, M. musculus
tgtctcagtctctgtg

SEQ ID NO: 448165 - DNA, 16 bp, M. musculus
tgtctcagtgggattt

SEQ ID NO: 448166 - DNA, 16 bp, M. musculus
tgtctcagtgggtaag

SEQ ID NO: 448167 - DNA, 16 bp, M. musculus
tgtctcagttagggtt

SEQ ID NO: 448168 - DNA, 16 bp, M. musculus
tgtctcataaaacaaa

SEQ ID NO: 448169 - DNA, 16 bp, M. musculus
tgtctcattgctctag

SEQ ID NO: 448170 - DNA, 16 bp, M. musculus
tgtctcatttagggct

SEQ ID NO: 448171 - DNA, 16 bp, M. musculus
tgtctccaagagggtg

SEQ ID NO: 448172 - DNA, 17 bp, M. musculus
tgtctccacctctttaa

SEQ ID NO: 448173 - DNA, 16 bp, M. musculus
tgtctccacttcccaa

SEQ ID NO: 448174 - DNA, 30 bp, M. musculus
tgtctccagaatccaaatagacccactaaa

SEQ ID NO: 448175 - DNA, 16 bp, M. musculus
tgtctccagcagaagg

SEQ ID NO: 448176 - DNA, 16 bp, M. musculus
tgtctccagccctgag

SEQ ID NO: 448177 - DNA, 16 bp, M. musculus
tgtctccaggatcctg

SEQ ID NO: 448178 - DNA, 16 bp, M. musculus
tgtctccaggttattc

SEQ ID NO: 448179 - DNA, 16 bp, M. musculus
tgtctccatctctgtc

SEQ ID NO: 448180 - DNA, 16 bp, M. musculus
tgtctccatcttcctg

SEQ ID NO: 448181 - DNA, 16 bp, M. musculus
tgtctccatggtgatt

SEQ ID NO: 448182 - DNA, 16 bp, M. musculus
tgtctcccaagagctg

SEQ ID NO: 448183 - DNA, 16 bp, M. musculus
tgtctcccaagaggct

SEQ ID NO: 448184 - DNA, 16 bp, M. musculus
tgtctccccaccccca

SEQ ID NO: 448185 - DNA, 16 bp, M. musculus
tgtctccccagcccca

SEQ ID NO: 448186 - DNA, 16 bp, M. musculus
tgtctccccatcatct

SEQ ID NO: 448187 - DNA, 16 bp, M. musculus
tgtctccctctgtctt

SEQ ID NO: 448188 - DNA, 16 bp, M. musculus
tgtctccctctgtgat

SEQ ID NO: 448189 - DNA, 16 bp, M. musculus
tgtctccctgcccagc

SEQ ID NO: 448190 - DNA, 16 bp, M. musculus
tgtctcccttttcact

SEQ ID NO: 448191 - DNA, 16 bp, M. musculus
tgtctcctacaatcct

SEQ ID NO: 448192 - DNA, 16 bp, M. musculus
tgtctcctagtaacat

SEQ ID NO: 448193 - DNA, 16 bp, M. musculus
tgtctcctcacagcaa

SEQ ID NO: 448194 - DNA, 16 bp, M. musculus
tgtctcctctgaggac

SEQ ID NO: 448195 - DNA, 16 bp, M. musculus
tgtctcctcttggcca

SEQ ID NO: 448196 - DNA, 16 bp, M. musculus
tgtctcctgacaggct

SEQ ID NO: 448197 - DNA, 16 bp, M. musculus
tgtctcctgagaagtt

SEQ ID NO: 448198 - DNA, 16 bp, M. musculus
tgtctcctggcagaag

SEQ ID NO: 448199 - DNA, 17 bp, M. musculus
tgtctcctggctgaaga

SEQ ID NO: 448200 - DNA, 16 bp, M. musculus
tgtctcctgggtgatt

SEQ ID NO: 448201 - DNA, 16 bp, M. musculus
tgtctcctgtctctgt

SEQ ID NO: 448202 - DNA, 16 bp, M. musculus
tgtctcctgtgagact

SEQ ID NO: 448203 - DNA, 16 bp, M. musculus
tgtctcctgtgaggct

SEQ ID NO: 448204 - DNA, 16 bp, M. musculus
tgtctcctgtgagtct

SEQ ID NO: 448205 - DNA, 16 bp, M. musculus
tgtctcctgtgtgaga

SEQ ID NO: 448206 - DNA, 16 bp, M. musculus
tgtctccttatttcct

SEQ ID NO: 448207 - DNA, 16 bp, M. musculus
tgtctcctttgccagg

SEQ ID NO: 448208 - DNA, 16 bp, M. musculus
tgtctcgaagaaccaa

SEQ ID NO: 448209 - DNA, 16 bp, M. musculus
tgtctctaatcccagc

SEQ ID NO: 448210 - DNA, 16 bp, M. musculus
tgtctctataacttct

SEQ ID NO: 448211 - DNA, 16 bp, M. musculus
tgtctctatatattaa

SEQ ID NO: 448212 - DNA, 16 bp, M. musculus
tgtctctatctcctga

SEQ ID NO: 448213 - DNA, 16 bp, M. musculus
tgtctctcattctctg

SEQ ID NO: 448214 - DNA, 16 bp, M. musculus
tgtctctccagccctt

SEQ ID NO: 448215 - DNA, 16 bp, M. musculus
tgtctctccctctctg

SEQ ID NO: 448216 - DNA, 16 bp, M. musculus
tgtctctccctgtctc

SEQ ID NO: 448217 - DNA, 16 bp, M. musculus
tgtctctctcacacac

SEQ ID NO: 448218 - DNA, 16 bp, M. musculus
tgtctctctcagggaa

SEQ ID NO: 448219 - DNA, 16 bp, M. musculus
tgtctctctctctctg

SEQ ID NO: 448220 - DNA, 16 bp, M. musculus
tgtctctctgactctg

SEQ ID NO: 448221 - DNA, 16 bp, M. musculus
tgtctctctgactttt

SEQ ID NO: 448222 - DNA, 16 bp, M. musculus
tgtctctctgccttct

SEQ ID NO: 448223 - DNA, 16 bp, M. musculus
tgtctctctgcctttc

SEQ ID NO: 448224 - DNA, 16 bp, M. musculus
tgtctctctgggtctg

SEQ ID NO: 448225 - DNA, 16 bp, M. musculus
tgtctctctgtatgtg

SEQ ID NO: 448226 - DNA, 17 bp, M. musculus
tgtctctctgtctctct

SEQ ID NO: 448227 - DNA, 17 bp, M. musculus
tgtctctctgtctctgt

SEQ ID NO: 448228 - DNA, 16 bp, M. musculus
tgtctctgaagaaaga

SEQ ID NO: 448229 - DNA, 16 bp, M. musculus
tgtctctgaagagagc

SEQ ID NO: 448230 - DNA, 16 bp, M. musculus
tgtctctgactctgtg

SEQ ID NO: 448231 - DNA, 16 bp, M. musculus
tgtctctgactggagc

SEQ ID NO: 448232 - DNA, 16 bp, M. musculus
tgtctctgagagggtg

SEQ ID NO: 448233 - DNA, 16 bp, M. musculus
tgtctctgcctcacca

SEQ ID NO: 448234 - DNA, 16 bp, M. musculus
tgtctctgcctcccca

SEQ ID NO: 448235 - DNA, 16 bp, M. musculus
tgtctctgcctcctgg

SEQ ID NO: 448236 - DNA, 16 bp, M. musculus
tgtctctgcctctcta

SEQ ID NO: 448237 - DNA, 16 bp, M. musculus
tgtctctgcctctctc

SEQ ID NO: 448238 - DNA, 16 bp, M. musculus
tgtctctgcctctggc

SEQ ID NO: 448239 - DNA, 16 bp, M. musculus
tgtctctgccttccca

SEQ ID NO: 448240 - DNA, 16 bp, M. musculus
tgtctctgccttctct

SEQ ID NO: 448241 - DNA, 16 bp, M. musculus
tgtctctgctccccag

SEQ ID NO: 448242 - DNA, 16 bp, M. musculus
tgtctctgctctcatt

SEQ ID NO: 448243 - DNA, 16 bp, M. musculus
tgtctctggaactcct

SEQ ID NO: 448244 - DNA, 16 bp, M. musculus
tgtctctggatttatg

SEQ ID NO: 448245 - DNA, 16 bp, M. musculus
tgtctctggcctccac

SEQ ID NO: 448246 - DNA, 16 bp, M. musculus
tgtctctgggaatgtg

SEQ ID NO: 448247 - DNA, 16 bp, M. musculus
tgtctctgggaccctg

SEQ ID NO: 448248 - DNA, 16 bp, M. musculus
tgtctctgggtgtgtt

SEQ ID NO: 448249 - DNA, 16 bp, M. musculus
tgtctctgtaaataac

SEQ ID NO: 448250 - DNA, 16 bp, M. musculus
tgtctctgtatttctg

SEQ ID NO: 448251 - DNA, 16 bp, M. musculus
tgtctctgtcactcca

SEQ ID NO: 448252 - DNA, 16 bp, M. musculus
tgtctctgtcactgag

SEQ ID NO: 448253 - DNA, 16 bp, M. musculus
tgtctctgtctcccaa

SEQ ID NO: 448254 - DNA, 16 bp, M. musculus
tgtctctgtctcctaa

SEQ ID NO: 448255 - DNA, 16 bp, M. musculus
tgtctctgtctctcaa

SEQ ID NO: 448256 - DNA, 16 bp, M. musculus
tgtctctgtctctcat

SEQ ID NO: 448257 - DNA, 16 bp, M. musculus
tgtctctgtctctctc

SEQ ID NO: 448258 - DNA, 16 bp, M. musculus
tgtctctgtcttccaa

SEQ ID NO: 448259 - DNA, 16 bp, M. musculus
tgtctctgtgaccctg

SEQ ID NO: 448260 - DNA, 16 bp, M. musculus
tgtctctgtgccttct

SEQ ID NO: 448261 - DNA, 16 bp, M. musculus
tgtctctgtgtagccc

SEQ ID NO: 448262 - DNA, 16 bp, M. musculus
tgtctctgtgtccctg

SEQ ID NO: 448263 - DNA, 16 bp, M. musculus
tgtctctgtgtttctc

SEQ ID NO: 448264 - DNA, 16 bp, M. musculus
tgtctctgttctgagt

SEQ ID NO: 448265 - DNA, 16 bp, M. musculus
tgtctcttcacagtca

SEQ ID NO: 448266 - DNA, 16 bp, M. musculus
tgtctcttcatagcaa

SEQ ID NO: 448267 - DNA, 16 bp, M. musculus
tgtctcttccaggagg

SEQ ID NO: 448268 - DNA, 16 bp, M. musculus
tgtctcttccatctct

SEQ ID NO: 448269 - DNA, 16 bp, M. musculus
tgtctcttccttccca

SEQ ID NO: 448270 - DNA, 16 bp, M. musculus
tgtctcttgtgtgact

SEQ ID NO: 448271 - DNA, 16 bp, M. musculus
tgtctctttacaacaa

SEQ ID NO: 448272 - DNA, 16 bp, M. musculus
tgtctctttatagcaa

SEQ ID NO: 448273 - DNA, 16 bp, M. musculus
tgtctctttgccctct

SEQ ID NO: 448274 - DNA, 16 bp, M. musculus
tgtctgaaaagagcaa

SEQ ID NO: 448275 - DNA, 16 bp, M. musculus
tgtctgaaagaactga

SEQ ID NO: 448276 - DNA, 16 bp, M. musculus
tgtctgaagacagcat

SEQ ID NO: 448277 - DNA, 16 bp, M. musculus
tgtctgaagacagctt

SEQ ID NO: 448278 - DNA, 16 bp, M. musculus
tgtctgaagacagtaa

SEQ ID NO: 448279 - DNA, 16 bp, M. musculus
tgtctgaagatagcaa

SEQ ID NO: 448280 - DNA, 16 bp, M. musculus
tgtctgaagatgaagg

SEQ ID NO: 448281 - DNA, 16 bp, M. musculus
tgtctgaatacagcaa

SEQ ID NO: 448282 - DNA, 16 bp, M. musculus
tgtctgacatcaatga

SEQ ID NO: 448283 - DNA, 16 bp, M. musculus
tgtctgactgaaacaa

SEQ ID NO: 448284 - DNA, 16 bp, M. musculus
tgtctgagaagggaag

SEQ ID NO: 448285 - DNA, 16 bp, M. musculus
tgtctgagagaactca

SEQ ID NO: 448286 - DNA, 16 bp, M. musculus
tgtctgaggacagcaa

SEQ ID NO: 448287 - DNA, 16 bp, M. musculus
tgtctgaggaggtcag

SEQ ID NO: 448288 - DNA, 16 bp, M. musculus
tgtctgagtctgtgtt

SEQ ID NO: 448289 - DNA, 16 bp, M. musculus
tgtctgagttcctgcc

SEQ ID NO: 448290 - DNA, 16 bp, M. musculus
tgtctgagtttggtgg

SEQ ID NO: 448291 - DNA, 16 bp, M. musculus
tgtctgatgtcaaagt

SEQ ID NO: 448292 - DNA, 16 bp, M. musculus
tgtctgatttctttca

SEQ ID NO: 448293 - DNA, 16 bp, M. musculus
tgtctgcaaaatcttg

SEQ ID NO: 448294 - DNA, 16 bp, M. musculus
tgtctgcagagaccag

SEQ ID NO: 448295 - DNA, 16 bp, M. musculus
tgtctgcagatgatgg

SEQ ID NO: 448296 - DNA, 16 bp, M. musculus
tgtctgcataacatct

SEQ ID NO: 448297 - DNA, 16 bp, M. musculus
tgtctgcatgtgtctg

SEQ ID NO: 448298 - DNA, 16 bp, M. musculus
tgtctgcatttctctc

SEQ ID NO: 448299 - DNA, 16 bp, M. musculus
tgtctgccattaaaaa

SEQ ID NO: 448300 - DNA, 16 bp, M. musculus
tgtctgccattggatc

SEQ ID NO: 448301 - DNA, 16 bp, M. musculus
tgtctgccatttcccc

SEQ ID NO: 448302 - DNA, 16 bp, M. musculus
tgtctgcccagcctgg

SEQ ID NO: 448303 - DNA, 16 bp, M. musculus
tgtctgcccaggaggg

SEQ ID NO: 448304 - DNA, 16 bp, M. musculus
tgtctgcctctgcctc

SEQ ID NO: 448305 - DNA, 16 bp, M. musculus
tgtctgcctgcaggct

SEQ ID NO: 448306 - DNA, 16 bp, M. musculus
tgtctgcctgcctcta

SEQ ID NO: 448307 - DNA, 16 bp, M. musculus
tgtctgcctgctgcca

SEQ ID NO: 448308 - DNA, 16 bp, M. musculus
tgtctgcctgtctaca

SEQ ID NO: 448309 - DNA, 16 bp, M. musculus
tgtctgcctgtgcctc

SEQ ID NO: 448310 - DNA, 16 bp, M. musculus
tgtctgcctgtgtgtc

SEQ ID NO: 448311 - DNA, 16 bp, M. musculus
tgtctgcctttggaac

SEQ ID NO: 448312 - DNA, 16 bp, M. musculus
tgtctgctgcagatgc

SEQ ID NO: 448313 - DNA, 16 bp, M. musculus
tgtctgctgtctgtct

SEQ ID NO: 448314 - DNA, 16 bp, M. musculus
tgtctgcttcaggaaa

SEQ ID NO: 448315 - DNA, 16 bp, M. musculus
tgtctgctttagcaag

SEQ ID NO: 448316 - DNA, 16 bp, M. musculus
tgtctggaaaaataaa

SEQ ID NO: 448317 - DNA, 16 bp, M. musculus
tgtctggaacccgaaa

SEQ ID NO: 448318 - DNA, 16 bp, M. musculus
tgtctggaatccaact

SEQ ID NO: 448319 - DNA, 16 bp, M. musculus
tgtctggactctaccc

SEQ ID NO: 448320 - DNA, 16 bp, M. musculus
tgtctggccacagtgg

SEQ ID NO: 448321 - DNA, 16 bp, M. musculus
tgtctggctgtgagtc

SEQ ID NO: 448322 - DNA, 16 bp, M. musculus
tgtctggcttgatctt

SEQ ID NO: 448323 - DNA, 16 bp, M. musculus
tgtctgggaaggagag

SEQ ID NO: 448324 - DNA, 16 bp, M. musculus
tgtctgggatccacac

SEQ ID NO: 448325 - DNA, 16 bp, M. musculus
tgtctgggttacctca

SEQ ID NO: 448326 - DNA, 16 bp, M. musculus
tgtctggtcctgtgga

SEQ ID NO: 448327 - DNA, 16 bp, M. musculus
tgtctggtggctcaca

SEQ ID NO: 448328 - DNA, 16 bp, M. musculus
tgtctggtgtgtctga

SEQ ID NO: 448329 - DNA, 16 bp, M. musculus
tgtctggtgttttcca

SEQ ID NO: 448330 - DNA, 16 bp, M. musculus
tgtctgtaaaaaaaaa

SEQ ID NO: 448331 - DNA, 16 bp, M. musculus
tgtctgtaaaaggaaa

SEQ ID NO: 448332 - DNA, 16 bp, M. musculus
tgtctgtaacaccagt

SEQ ID NO: 448333 - DNA, 16 bp, M. musculus
tgtctgtaaccccagt

SEQ ID NO: 448334 - DNA, 16 bp, M. musculus
tgtctgtaactctagg

SEQ ID NO: 448335 - DNA, 16 bp, M. musculus
tgtctgtaagcacaac

SEQ ID NO: 448336 - DNA, 16 bp, M. musculus
tgtctgtaatcccaga

SEQ ID NO: 448337 - DNA, 16 bp, M. musculus
tgtctgtagatgaaat

SEQ ID NO: 448338 - DNA, 16 bp, M. musculus
tgtctgtatacacaca

SEQ ID NO: 448339 - DNA, 16 bp, M. musculus
tgtctgtatatatgta

SEQ ID NO: 448340 - DNA, 16 bp, M. musculus
tgtctgtatatgtgtg

SEQ ID NO: 448341 - DNA, 16 bp, M. musculus
tgtctgtatctctgtg

SEQ ID NO: 448342 - DNA, 16 bp, M. musculus
tgtctgtatgtgtgtg

SEQ ID NO: 448343 - DNA, 16 bp, M. musculus
tgtctgtcacagcaat

SEQ ID NO: 448344 - DNA, 16 bp, M. musculus
tgtctgtcactgaacc

SEQ ID NO: 448345 - DNA, 16 bp, M. musculus
tgtctgtcatcaatgg

SEQ ID NO: 448346 - DNA, 16 bp, M. musculus
tgtctgtccatgtgtg

SEQ ID NO: 448347 - DNA, 16 bp, M. musculus
tgtctgtccgtctatc

SEQ ID NO: 448348 - DNA, 16 bp, M. musculus
tgtctgtcctgaaact

SEQ ID NO: 448349 - DNA, 16 bp, M. musculus
tgtctgtccttccctc

SEQ ID NO: 448350 - DNA, 16 bp, M. musculus
tgtctgtccttctgcc

SEQ ID NO: 448351 - DNA, 16 bp, M. musculus
tgtctgtctatatgta

SEQ ID NO: 448352 - DNA, 16 bp, M. musculus
tgtctgtctatctgtt

SEQ ID NO: 448353 - DNA, 16 bp, M. musculus
tgtctgtctccccagc

SEQ ID NO: 448354 - DNA, 16 bp, M. musculus
tgtctgtctctatcta

SEQ ID NO: 448355 - DNA, 16 bp, M. musculus
tgtctgtctctctctg

SEQ ID NO: 448356 - DNA, 16 bp, M. musculus
tgtctgtctctgtcct

SEQ ID NO: 448357 - DNA, 20 bp, M. musculus
tgtctgtctctgtctctctc

SEQ ID NO: 448358 - DNA, 16 bp, M. musculus
tgtctgtctctgtctt

SEQ ID NO: 448359 - DNA, 16 bp, M. musculus
tgtctgtctgactgtc

SEQ ID NO: 448360 - DNA, 16 bp, M. musculus
tgtctgtctgagtcag

SEQ ID NO: 448361 - DNA, 16 bp, M. musculus
tgtctgtctgcttcct

SEQ ID NO: 448362 - DNA, 16 bp, M. musculus
tgtctgtctgcttgtt

SEQ ID NO: 448363 - DNA, 16 bp, M. musculus
tgtctgtctgtacatc

SEQ ID NO: 448364 - DNA, 16 bp, M. musculus
tgtctgtctgtatgta

SEQ ID NO: 448365 - DNA, 16 bp, M. musculus
tgtctgtctgtccatc

SEQ ID NO: 448366 - DNA, 16 bp, M. musculus
tgtctgtctgtccttc

SEQ ID NO: 448367 - DNA, 16 bp, M. musculus
tgtctgtctgtcggtc

SEQ ID NO: 448368 - DNA, 16 bp, M. musculus
tgtctgtctgtctatt

SEQ ID NO: 448369 - DNA, 16 bp, M. musculus
tgtctgtctgtctcta

SEQ ID NO: 448370 - DNA, 16 bp, M. musculus
tgtctgtctgtctctg

SEQ ID NO: 448371 - DNA, 16 bp, M. musculus
tgtctgtctgtctctt

SEQ ID NO: 448372 - DNA, 16 bp, M. musculus
tgtctgtctgtctggt

SEQ ID NO: 448373 - DNA, 17 bp, M. musculus
tgtctgtctgtctgtct

SEQ ID NO: 448374 - DNA, 16 bp, M. musculus
tgtctgtctgtctgtg

SEQ ID NO: 448375 - DNA, 17 bp, M. musculus
tgtctgtctgtctgttt

SEQ ID NO: 448376 - DNA, 16 bp, M. musculus
tgtctgtctgtcttag

SEQ ID NO: 448377 - DNA, 16 bp, M. musculus
tgtctgtctgtctttc

SEQ ID NO: 448378 - DNA, 16 bp, M. musculus
tgtctgtctgtctttg

SEQ ID NO: 448379 - DNA, 16 bp, M. musculus
tgtctgtctgtgcacc

SEQ ID NO: 448380 - DNA, 16 bp, M. musculus
tgtctgtctgtgcctg

SEQ ID NO: 448381 - DNA, 17 bp, M. musculus
tgtctgtctgtgtgtgt

SEQ ID NO: 448382 - DNA, 16 bp, M. musculus
tgtctgtctgtttgtc

SEQ ID NO: 448383 - DNA, 16 bp, M. musculus
tgtctgtcttctttta

SEQ ID NO: 448384 - DNA, 16 bp, M. musculus
tgtctgtgactgtgac

SEQ ID NO: 448385 - DNA, 16 bp, M. musculus
tgtctgtgactgtgtg

SEQ ID NO: 448386 - DNA, 16 bp, M. musculus
tgtctgtgagcatcca

SEQ ID NO: 448387 - DNA, 16 bp, M. musculus
tgtctgtgagggattt

SEQ ID NO: 448388 - DNA, 16 bp, M. musculus
tgtctgtgagtttgtt

SEQ ID NO: 448389 - DNA, 16 bp, M. musculus
tgtctgtgcaacatgt

SEQ ID NO: 448390 - DNA, 16 bp, M. musculus
tgtctgtgcatcacat

SEQ ID NO: 448391 - DNA, 16 bp, M. musculus
tgtctgtggctcctgg

SEQ ID NO: 448392 - DNA, 16 bp, M. musculus
tgtctgtggggatgtc

SEQ ID NO: 448393 - DNA, 16 bp, M. musculus
tgtctgtgtatgtctg

SEQ ID NO: 448394 - DNA, 16 bp, M. musculus
tgtctgtgtatgtgcc

SEQ ID NO: 448395 - DNA, 16 bp, M. musculus
tgtctgtgtctatgtg

SEQ ID NO: 448396 - DNA, 17 bp, M. musculus
tgtctgtgtctctgtct

SEQ ID NO: 448397 - DNA, 16 bp, M. musculus
tgtctgtgtctgagtc

SEQ ID NO: 448398 - DNA, 16 bp, M. musculus
tgtctgtgtctgtgta

SEQ ID NO: 448399 - DNA, 16 bp, M. musculus
tgtctgtgtgaaggtg

SEQ ID NO: 448400 - DNA, 16 bp, M. musculus
tgtctgtgtgaggata

SEQ ID NO: 448401 - DNA, 16 bp, M. musculus
tgtctgtgtgagggtg

SEQ ID NO: 448402 - DNA, 16 bp, M. musculus
tgtctgtgtgcagagg

SEQ ID NO: 448403 - DNA, 16 bp, M. musculus
tgtctgtgtgccacat

SEQ ID NO: 448404 - DNA, 16 bp, M. musculus
tgtctgtgtgtacaca

SEQ ID NO: 448405 - DNA, 16 bp, M. musculus
tgtctgtgtgtatgct

SEQ ID NO: 448406 - DNA, 16 bp, M. musculus
tgtctgtgtgtatgtc

SEQ ID NO: 448407 - DNA, 16 bp, M. musculus
tgtctgtgtgtatgtg

SEQ ID NO: 448408 - DNA, 16 bp, M. musculus
tgtctgtgtgtccatg

SEQ ID NO: 448409 - DNA, 16 bp, M. musculus
tgtctgtgtgtctatg

SEQ ID NO: 448410 - DNA, 16 bp, M. musculus
tgtctgtgtgtctctg

SEQ ID NO: 448411 - DNA, 21 bp, M. musculus
tgtctgtgtgtctgtgtgtct

SEQ ID NO: 448412 - DNA, 16 bp, M. musculus
tgtctgtgtgtgagag

SEQ ID NO: 448413 - DNA, 16 bp, M. musculus
tgtctgtgtgtgagtt

SEQ ID NO: 448414 - DNA, 16 bp, M. musculus
tgtctgtgtgtgtccc

SEQ ID NO: 448415 - DNA, 16 bp, M. musculus
tgtctgtgtgtgtgac

SEQ ID NO: 448416 - DNA, 16 bp, M. musculus
tgtctgtgtgtgtgca

SEQ ID NO: 448417 - DNA, 16 bp, M. musculus
tgtctgtgtttggtga

SEQ ID NO: 448418 - DNA, 16 bp, M. musculus
tgtctgttcacagcaa

SEQ ID NO: 448419 - DNA, 16 bp, M. musculus
tgtctgttctcagcaa

SEQ ID NO: 448420 - DNA, 16 bp, M. musculus
tgtctgttgagacttg

SEQ ID NO: 448421 - DNA, 16 bp, M. musculus
tgtctgtttgtcaccc

SEQ ID NO: 448422 - DNA, 16 bp, M. musculus
tgtcttaaaaaacaga

SEQ ID NO: 448423 - DNA, 16 bp, M. musculus
tgtcttaaaaagcaaa

SEQ ID NO: 448424 - DNA, 16 bp, M. musculus
tgtcttaaaaattaaa

SEQ ID NO: 448425 - DNA, 16 bp, M. musculus
tgtcttaaaattttaa

SEQ ID NO: 448426 - DNA, 16 bp, M. musculus
tgtcttacagaagctt

SEQ ID NO: 448427 - DNA, 16 bp, M. musculus
tgtcttacagaatctt

SEQ ID NO: 448428 - DNA, 16 bp, M. musculus
tgtcttagaactcact

SEQ ID NO: 448429 - DNA, 16 bp, M. musculus
tgtcttagagtttgtt

SEQ ID NO: 448430 - DNA, 16 bp, M. musculus
tgtcttagccagggtt

SEQ ID NO: 448431 - DNA, 16 bp, M. musculus
tgtcttagtaagggtt

SEQ ID NO: 448432 - DNA, 16 bp, M. musculus
tgtcttagtcacggtt

SEQ ID NO: 448433 - DNA, 16 bp, M. musculus
tgtcttagtcactgtt

SEQ ID NO: 448434 - DNA, 23 bp, M. musculus
tgtcttagtcagggtttctattc

SEQ ID NO: 448435 - DNA, 16 bp, M. musculus
tgtcttagtcagtgtt

SEQ ID NO: 448436 - DNA, 16 bp, M. musculus
tgtcttagtgactttt

SEQ ID NO: 448437 - DNA, 16 bp, M. musculus
tgtcttagttaaggtt

SEQ ID NO: 448438 - DNA, 16 bp, M. musculus
tgtcttagttaggatt

SEQ ID NO: 448439 - DNA, 16 bp, M. musculus
tgtcttagttagggtt

SEQ ID NO: 448440 - DNA, 16 bp, M. musculus
tgtcttagttatgttt

SEQ ID NO: 448441 - DNA, 16 bp, M. musculus
tgtcttagtttgggtt

SEQ ID NO: 448442 - DNA, 16 bp, M. musculus
tgtcttatcttattgt

SEQ ID NO: 448443 - DNA, 16 bp, M. musculus
tgtcttcaaaaagaaa

SEQ ID NO: 448444 - DNA, 29 bp, M. musculus
tgtcttcagacacaccagaagagggcatt

SEQ ID NO: 448445 - DNA, 16 bp, M. musculus
tgtcttcagacacttc

SEQ ID NO: 448446 - DNA, 16 bp, M. musculus
tgtcttcagatgcaca

SEQ ID NO: 448447 - DNA, 16 bp, M. musculus
tgtcttcagcaatagg

SEQ ID NO: 448448 - DNA, 16 bp, M. musculus
tgtcttcagcaatgga

SEQ ID NO: 448449 - DNA, 16 bp, M. musculus
tgtcttcatatttcct

SEQ ID NO: 448450 - DNA, 16 bp, M. musculus
tgtcttcatcatagag

SEQ ID NO: 448451 - DNA, 16 bp, M. musculus
tgtcttcatgtatgta

SEQ ID NO: 448452 - DNA, 16 bp, M. musculus
tgtcttcatttaattt

SEQ ID NO: 448453 - DNA, 16 bp, M. musculus
tgtcttcctcagttgc

SEQ ID NO: 448454 - DNA, 16 bp, M. musculus
tgtcttcctctattgc

SEQ ID NO: 448455 - DNA, 16 bp, M. musculus
tgtcttcctctgtctc

SEQ ID NO: 448456 - DNA, 16 bp, M. musculus
tgtcttcctgttggag

SEQ ID NO: 448457 - DNA, 16 bp, M. musculus
tgtcttcctttgggtt

SEQ ID NO: 448458 - DNA, 16 bp, M. musculus
tgtcttctaaaatgtc

SEQ ID NO: 448459 - DNA, 16 bp, M. musculus
tgtcttctcatctcca

SEQ ID NO: 448460 - DNA, 16 bp, M. musculus
tgtcttctcattttct

SEQ ID NO: 448461 - DNA, 16 bp, M. musculus
tgtcttctctcactga

SEQ ID NO: 448462 - DNA, 16 bp, M. musculus
tgtcttctgacctcca

SEQ ID NO: 448463 - DNA, 16 bp, M. musculus
tgtcttctgcaggcag

SEQ ID NO: 448464 - DNA, 16 bp, M. musculus
tgtcttctggacatga

SEQ ID NO: 448465 - DNA, 16 bp, M. musculus
tgtcttctgtataaaa

SEQ ID NO: 448466 - DNA, 16 bp, M. musculus
tgtcttctgtcttcca

SEQ ID NO: 448467 - DNA, 16 bp, M. musculus
tgtcttctttttaaaa

SEQ ID NO: 448468 - DNA, 16 bp, M. musculus
tgtcttgaaaaacaaa

SEQ ID NO: 448469 - DNA, 16 bp, M. musculus
tgtcttgaaaaatcaa

SEQ ID NO: 448470 - DNA, 16 bp, M. musculus
tgtcttgaaagaccaa

SEQ ID NO: 448471 - DNA, 16 bp, M. musculus
tgtcttgaagaaccaa

SEQ ID NO: 448472 - DNA, 16 bp, M. musculus
tgtcttggaaaagaaa

SEQ ID NO: 448473 - DNA, 16 bp, M. musculus
tgtcttggaaatcact

SEQ ID NO: 448474 - DNA, 16 bp, M. musculus
tgtcttggaactcact

SEQ ID NO: 448475 - DNA, 16 bp, M. musculus
tgtcttggaagaaaaa

SEQ ID NO: 448476 - DNA, 16 bp, M. musculus
tgtcttggagaagagc

SEQ ID NO: 448477 - DNA, 16 bp, M. musculus
tgtcttggcagagatt

SEQ ID NO: 448478 - DNA, 16 bp, M. musculus
tgtcttggctccattt

SEQ ID NO: 448479 - DNA, 16 bp, M. musculus
tgtcttggtcagtgtt

SEQ ID NO: 448480 - DNA, 16 bp, M. musculus
tgtcttggtcatcctg

SEQ ID NO: 448481 - DNA, 16 bp, M. musculus
tgtcttggtttttcat

SEQ ID NO: 448482 - DNA, 16 bp, M. musculus
tgtcttgtattctgtt

SEQ ID NO: 448483 - DNA, 16 bp, M. musculus
tgtctttaaaaataaa

SEQ ID NO: 448484 - DNA, 16 bp, M. musculus
tgtctttaaaataaaa

SEQ ID NO: 448485 - DNA, 16 bp, M. musculus
tgtctttacattttat

SEQ ID NO: 448486 - DNA, 16 bp, M. musculus
tgtctttaccagctga

SEQ ID NO: 448487 - DNA, 16 bp, M. musculus
tgtctttccagtgatg

SEQ ID NO: 448488 - DNA, 16 bp, M. musculus
tgtctttccttatcct

SEQ ID NO: 448489 - DNA, 16 bp, M. musculus
tgtctttctgctggaa

SEQ ID NO: 448490 - DNA, 16 bp, M. musculus
tgtctttctggctctg

SEQ ID NO: 448491 - DNA, 16 bp, M. musculus
tgtctttctgtctctg

SEQ ID NO: 448492 - DNA, 16 bp, M. musculus
tgtctttctttgggga

SEQ ID NO: 448493 - DNA, 16 bp, M. musculus
tgtctttgagattgtt

SEQ ID NO: 448494 - DNA, 16 bp, M. musculus
tgtctttgaggctttt

SEQ ID NO: 448495 - DNA, 16 bp, M. musculus
tgtctttgagtcactt

SEQ ID NO: 448496 - DNA, 16 bp, M. musculus
tgtctttgagtctgtt

SEQ ID NO: 448497 - DNA, 16 bp, M. musculus
tgtctttgcctcccca

SEQ ID NO: 448498 - DNA, 16 bp, M. musculus
tgtctttgcctctgtc

SEQ ID NO: 448499 - DNA, 16 bp, M. musculus
tgtctttgggttggaa

SEQ ID NO: 448500 - DNA, 17 bp, M. musculus
tgtctttggttttatgt

SEQ ID NO: 448501 - DNA, 16 bp, M. musculus
tgtctttgtcatggtg

SEQ ID NO: 448502 - DNA, 16 bp, M. musculus
tgtctttgtccctgag

SEQ ID NO: 448503 - DNA, 16 bp, M. musculus
tgtctttgtctcccaa

SEQ ID NO: 448504 - DNA, 16 bp, M. musculus
tgtctttgtctctgag

SEQ ID NO: 448505 - DNA, 16 bp, M. musculus
tgtctttgtctctgcc

SEQ ID NO: 448506 - DNA, 16 bp, M. musculus
tgtctttgtggtagga

SEQ ID NO: 448507 - DNA, 16 bp, M. musculus
tgtctttgtgtctctg

SEQ ID NO: 448508 - DNA, 16 bp, M. musculus
tgtctttgtgtgtata

SEQ ID NO: 448509 - DNA, 16 bp, M. musculus
tgtctttgttttaaaa

SEQ ID NO: 448510 - DNA, 16 bp, M. musculus
tgtcttttatttggga

SEQ ID NO: 448511 - DNA, 16 bp, M. musculus
tgtcttttattttaca

SEQ ID NO: 448512 - DNA, 16 bp, M. musculus
tgtcttttcacagaaa

SEQ ID NO: 448513 - DNA, 16 bp, M. musculus
tgtcttttccctgaga

SEQ ID NO: 448514 - DNA, 16 bp, M. musculus
tgtcttttctaagaat

SEQ ID NO: 448515 - DNA, 16 bp, M. musculus
tgtcttttgccataca

SEQ ID NO: 448516 - DNA, 16 bp, M. musculus
tgtcttttgtggtacc

SEQ ID NO: 448517 - DNA, 16 bp, M. musculus
tgtctttttattgggg

SEQ ID NO: 448518 - DNA, 16 bp, M. musculus
tgtcttttttattaga

SEQ ID NO: 448519 - DNA, 16 bp, M. musculus
tgtctttttttaaaaa

SEQ ID NO: 448520 - DNA, 16 bp, M. musculus
tgtgaaaatcatatgc

SEQ ID NO: 448521 - DNA, 16 bp, M. musculus
tgtgaaacattttctt

SEQ ID NO: 448522 - DNA, 16 bp, M. musculus
tgtgaaagaaaactgg

SEQ ID NO: 448523 - DNA, 16 bp, M. musculus
tgtgaaagaaattagg

SEQ ID NO: 448524 - DNA, 16 bp, M. musculus
tgtgaaagccagaaga

SEQ ID NO: 448525 - DNA, 16 bp, M. musculus
tgtgaaagccagagga

SEQ ID NO: 448526 - DNA, 16 bp, M. musculus
tgtgaaaggcagcctg

SEQ ID NO: 448527 - DNA, 16 bp, M. musculus
tgtgaaagtataagct

SEQ ID NO: 448528 - DNA, 16 bp, M. musculus
tgtgaaataaaatact

SEQ ID NO: 448529 - DNA, 16 bp, M. musculus
tgtgaaatattttgaa

SEQ ID NO: 448530 - DNA, 16 bp, M. musculus
tgtgaaatgatttctg

SEQ ID NO: 448531 - DNA, 16 bp, M. musculus
tgtgaaatttcaaagg

SEQ ID NO: 448532 - DNA, 16 bp, M. musculus
tgtgaacacacacaca

SEQ ID NO: 448533 - DNA, 16 bp, M. musculus
tgtgaacatacaccat

SEQ ID NO: 448534 - DNA, 16 bp, M. musculus
tgtgaacatagtggaa

SEQ ID NO: 448535 - DNA, 16 bp, M. musculus
tgtgaaccaccatgtg

SEQ ID NO: 448536 - DNA, 16 bp, M. musculus
tgtgaactgccctgtg

SEQ ID NO: 448537 - DNA, 16 bp, M. musculus
tgtgaactgcctgatg

SEQ ID NO: 448538 - DNA, 16 bp, M. musculus
tgtgaactgtcatgtg

SEQ ID NO: 448539 - DNA, 16 bp, M. musculus
tgtgaagaaaaacaaa

SEQ ID NO: 448540 - DNA, 16 bp, M. musculus
tgtgaagaaacctggg

SEQ ID NO: 448541 - DNA, 16 bp, M. musculus
tgtgaagaaatactgg

SEQ ID NO: 448542 - DNA, 16 bp, M. musculus
tgtgaagacagctaca

SEQ ID NO: 448543 - DNA, 16 bp, M. musculus
tgtgaagaccaaacct

SEQ ID NO: 448544 - DNA, 16 bp, M. musculus
tgtgaagagaaggcag

SEQ ID NO: 448545 - DNA, 16 bp, M. musculus
tgtgaagagatatcat

SEQ ID NO: 448546 - DNA, 16 bp, M. musculus
tgtgaagatgtgtctc

SEQ ID NO: 448547 - DNA, 16 bp, M. musculus
tgtgaagattctatgc

SEQ ID NO: 448548 - DNA, 16 bp, M. musculus
tgtgaagattttcctt

SEQ ID NO: 448549 - DNA, 16 bp, M. musculus
tgtgaagcagagacag

SEQ ID NO: 448550 - DNA, 16 bp, M. musculus
tgtgaagctgaagttg

SEQ ID NO: 448551 - DNA, 16 bp, M. musculus
tgtgaagctgtgaaag

SEQ ID NO: 448552 - DNA, 16 bp, M. musculus
tgtgaaggaatgaagg

SEQ ID NO: 448553 - DNA, 16 bp, M. musculus
tgtgaaggatgtcatt

SEQ ID NO: 448554 - DNA, 16 bp, M. musculus
tgtgaaggctctgtgc

SEQ ID NO: 448555 - DNA, 16 bp, M. musculus
tgtgaaggctggatgc

SEQ ID NO: 448556 - DNA, 16 bp, M. musculus
tgtgaagtagcaatga

SEQ ID NO: 448557 - DNA, 16 bp, M. musculus
tgtgaagtcagttctc

SEQ ID NO: 448558 - DNA, 16 bp, M. musculus
tgtgaagtcctgggtt

SEQ ID NO: 448559 - DNA, 16 bp, M. musculus
tgtgaataacctttta

SEQ ID NO: 448560 - DNA, 16 bp, M. musculus
tgtgaatctggttttg

SEQ ID NO: 448561 - DNA, 16 bp, M. musculus
tgtgaatgagtgtgag

SEQ ID NO: 448562 - DNA, 16 bp, M. musculus
tgtgaatgcatgcatg

SEQ ID NO: 448563 - DNA, 16 bp, M. musculus
tgtgaatgcatgtgta

SEQ ID NO: 448564 - DNA, 16 bp, M. musculus
tgtgaatgccaagaag

SEQ ID NO: 448565 - DNA, 16 bp, M. musculus
tgtgaatggatgtttt

SEQ ID NO: 448566 - DNA, 16 bp, M. musculus
tgtgaatgtgagtatg

SEQ ID NO: 448567 - DNA, 16 bp, M. musculus
tgtgaatgtgggtgtg

SEQ ID NO: 448568 - DNA, 16 bp, M. musculus
tgtgaatgtgtgtgca

SEQ ID NO: 448569 - DNA, 16 bp, M. musculus
tgtgaatgtgtgtgtg

SEQ ID NO: 448570 - DNA, 16 bp, M. musculus
tgtgaattcaagacca

SEQ ID NO: 448571 - DNA, 16 bp, M. musculus
tgtgaattcaaggcta

SEQ ID NO: 448572 - DNA, 16 bp, M. musculus
tgtgaattcagaactc

SEQ ID NO: 448573 - DNA, 16 bp, M. musculus
tgtgaattgccatgtg

SEQ ID NO: 448574 - DNA, 16 bp, M. musculus
tgtgaattgtttcttg

SEQ ID NO: 448575 - DNA, 16 bp, M. musculus
tgtgaatttgaagcta

SEQ ID NO: 448576 - DNA, 16 bp, M. musculus
tgtgaatttgaagtca

SEQ ID NO: 448577 - DNA, 16 bp, M. musculus
tgtgaatttggctttg

SEQ ID NO: 448578 - DNA, 16 bp, M. musculus
tgtgaatttggtttta

SEQ ID NO: 448579 - DNA, 16 bp, M. musculus
tgtgaattttctgttt

SEQ ID NO: 448580 - DNA, 16 bp, M. musculus
tgtgaattttcttttg

SEQ ID NO: 448581 - DNA, 16 bp, M. musculus
tgtgacaagtacttta

SEQ ID NO: 448582 - DNA, 16 bp, M. musculus
tgtgacacacacagct

SEQ ID NO: 448583 - DNA, 16 bp, M. musculus
tgtgacacagcagcca

SEQ ID NO: 448584 - DNA, 16 bp, M. musculus
tgtgacacatgccttt

SEQ ID NO: 448585 - DNA, 16 bp, M. musculus
tgtgacaccatcaata

SEQ ID NO: 448586 - DNA, 16 bp, M. musculus
tgtgacacctgtgact

SEQ ID NO: 448587 - DNA, 16 bp, M. musculus
tgtgacactattcctg

SEQ ID NO: 448588 - DNA, 16 bp, M. musculus
tgtgacagacttttcc

SEQ ID NO: 448589 - DNA, 16 bp, M. musculus
tgtgacaggagccagg

SEQ ID NO: 448590 - DNA, 16 bp, M. musculus
tgtgacatccatttgt

SEQ ID NO: 448591 - DNA, 16 bp, M. musculus
tgtgacatgtcagctc

SEQ ID NO: 448592 - DNA, 16 bp, M. musculus
tgtgaccaaacaccat

SEQ ID NO: 448593 - DNA, 16 bp, M. musculus
tgtgaccaagatcctg

SEQ ID NO: 448594 - DNA, 16 bp, M. musculus
tgtgaccaaggtcctg

SEQ ID NO: 448595 - DNA, 16 bp, M. musculus
tgtgaccaagttcctg

SEQ ID NO: 448596 - DNA, 16 bp, M. musculus
tgtgaccagctgcctc

SEQ ID NO: 448597 - DNA, 16 bp, M. musculus
tgtgacccacaggttg

SEQ ID NO: 448598 - DNA, 16 bp, M. musculus
tgtgaccccagtgctg

SEQ ID NO: 448599 - DNA, 16 bp, M. musculus
tgtgaccctaactaag

SEQ ID NO: 448600 - DNA, 17 bp, M. musculus
tgtgaccctggtcagtc

SEQ ID NO: 448601 - DNA, 16 bp, M. musculus
tgtgacctagttggaa

SEQ ID NO: 448602 - DNA, 16 bp, M. musculus
tgtgaccttgagcaag

SEQ ID NO: 448603 - DNA, 16 bp, M. musculus
tgtgaccttgggtaag

SEQ ID NO: 448604 - DNA, 22 bp, M. musculus
tgtgactagggtgtgaaatcct

SEQ ID NO: 448605 - DNA, 16 bp, M. musculus
tgtgactatgggatgg

SEQ ID NO: 448606 - DNA, 16 bp, M. musculus
tgtgactattttaaag

SEQ ID NO: 448607 - DNA, 16 bp, M. musculus
tgtgactattttgaag

SEQ ID NO: 448608 - DNA, 16 bp, M. musculus
tgtgactccagttcca

SEQ ID NO: 448609 - DNA, 16 bp, M. musculus
tgtgactgggttacat

SEQ ID NO: 448610 - DNA, 16 bp, M. musculus
tgtgactgtgcatgtg

SEQ ID NO: 448611 - DNA, 16 bp, M. musculus
tgtgactgtggctgtg

SEQ ID NO: 448612 - DNA, 16 bp, M. musculus
tgtgactgtgggatag

SEQ ID NO: 448613 - DNA, 16 bp, M. musculus
tgtgactgtgggtgtg

SEQ ID NO: 448614 - DNA, 16 bp, M. musculus
tgtgactgtgtgactg

SEQ ID NO: 448615 - DNA, 16 bp, M. musculus
tgtgactgtgtgagtg

SEQ ID NO: 448616 - DNA, 16 bp, M. musculus
tgtgacttcttccttt

SEQ ID NO: 448617 - DNA, 16 bp, M. musculus
tgtgactttggggaaa

SEQ ID NO: 448618 - DNA, 16 bp, M. musculus
tgtgactttggttttg

SEQ ID NO: 448619 - DNA, 29 bp, M. musculus
tgtgactttgtacttccttgtgactctta

SEQ ID NO: 448620 - DNA, 16 bp, M. musculus
tgtgactttgtttccc

SEQ ID NO: 448621 - DNA, 16 bp, M. musculus
tgtgacttttgtgaag

SEQ ID NO: 448622 - DNA, 16 bp, M. musculus
tgtgagaaaaaaatct

SEQ ID NO: 448623 - DNA, 16 bp, M. musculus
tgtgagaacacacaca

SEQ ID NO: 448624 - DNA, 17 bp, M. musculus
tgtgagaacatgaactt

SEQ ID NO: 448625 - DNA, 16 bp, M. musculus
tgtgagaactccagct

SEQ ID NO: 448626 - DNA, 16 bp, M. musculus
tgtgagacagccattg

SEQ ID NO: 448627 - DNA, 17 bp, M. musculus
tgtgagaccccgactta

SEQ ID NO: 448628 - DNA, 16 bp, M. musculus
tgtgagagaatgtgtg

SEQ ID NO: 448629 - DNA, 16 bp, M. musculus
tgtgagagagaaaaag

SEQ ID NO: 448630 - DNA, 16 bp, M. musculus
tgtgagagagagaatg

SEQ ID NO: 448631 - DNA, 16 bp, M. musculus
tgtgagaggctatgga

SEQ ID NO: 448632 - DNA, 16 bp, M. musculus
tgtgagagtcagagga

SEQ ID NO: 448633 - DNA, 16 bp, M. musculus
tgtgagagttggttct

SEQ ID NO: 448634 - DNA, 16 bp, M. musculus
tgtgagatcctgtctc

SEQ ID NO: 448635 - DNA, 16 bp, M. musculus
tgtgagatctttccat

SEQ ID NO: 448636 - DNA, 16 bp, M. musculus
tgtgagcaagtgtgtg

SEQ ID NO: 448637 - DNA, 16 bp, M. musculus
tgtgagcaatgtgctg

SEQ ID NO: 448638 - DNA, 16 bp, M. musculus
tgtgagcacactgttg

SEQ ID NO: 448639 - DNA, 16 bp, M. musculus
tgtgagcagaggccag

SEQ ID NO: 448640 - DNA, 16 bp, M. musculus
tgtgagcagtcatgtg

SEQ ID NO: 448641 - DNA, 16 bp, M. musculus
tgtgagcatgagtgtg

SEQ ID NO: 448642 - DNA, 16 bp, M. musculus
tgtgagcatgtatgtg

SEQ ID NO: 448643 - DNA, 16 bp, M. musculus
tgtgagccacagtgtg

SEQ ID NO: 448644 - DNA, 17 bp, M. musculus
tgtgagccaccacacct

SEQ ID NO: 448645 - DNA, 16 bp, M. musculus
tgtgagccaccacatc

SEQ ID NO: 448646 - DNA, 16 bp, M. musculus
tgtgagccaccatgaa

SEQ ID NO: 448647 - DNA, 20 bp, M. musculus
tgtgagccaccatgtggttc

SEQ ID NO: 448648 - DNA, 36 bp, M. musculus
tgtgagccaccatgtggttgctgggatttgaacttc

SEQ ID NO: 448649 - DNA, 20 bp, M. musculus
tgtgagccaccatgtggttt

SEQ ID NO: 448650 - DNA, 16 bp, M. musculus
tgtgagccaccatgtt

SEQ ID NO: 448651 - DNA, 16 bp, M. musculus
tgtgagccacccacca

SEQ ID NO: 448652 - DNA, 16 bp, M. musculus
tgtgagccaccctgtg

SEQ ID NO: 448653 - DNA, 16 bp, M. musculus
tgtgagccacctgtgg

SEQ ID NO: 448654 - DNA, 16 bp, M. musculus
tgtgagccactatgtg

SEQ ID NO: 448655 - DNA, 16 bp, M. musculus
tgtgagccatcatgtg

SEQ ID NO: 448656 - DNA, 16 bp, M. musculus
tgtgagccatctgaca

SEQ ID NO: 448657 - DNA, 16 bp, M. musculus
tgtgagccccagggat

SEQ ID NO: 448658 - DNA, 16 bp, M. musculus
tgtgagcctctgtgtg

SEQ ID NO: 448659 - DNA, 16 bp, M. musculus
tgtgagcctgtgtgtg

SEQ ID NO: 448660 - DNA, 16 bp, M. musculus
tgtgagctaccatgtg

SEQ ID NO: 448661 - DNA, 16 bp, M. musculus
tgtgagctaccgtgtg

SEQ ID NO: 448662 - DNA, 16 bp, M. musculus
tgtgagctacctgatg

SEQ ID NO: 448663 - DNA, 16 bp, M. musculus
tgtgagctccagggat

SEQ ID NO: 448664 - DNA, 16 bp, M. musculus
tgtgagctctcaccca

SEQ ID NO: 448665 - DNA, 16 bp, M. musculus
tgtgagctctcagctg

SEQ ID NO: 448666 - DNA, 16 bp, M. musculus
tgtgagctgaataaac

SEQ ID NO: 448667 - DNA, 16 bp, M. musculus
tgtgagctgccagaca

SEQ ID NO: 448668 - DNA, 16 bp, M. musculus
tgtgagctgccatgta

SEQ ID NO: 448669 - DNA, 16 bp, M. musculus
tgtgagctgccatgtg

SEQ ID NO: 448670 - DNA, 16 bp, M. musculus
tgtgagctgcccaatg

SEQ ID NO: 448671 - DNA, 16 bp, M. musculus
tgtgagctgcctaaca

SEQ ID NO: 448672 - DNA, 16 bp, M. musculus
tgtgagctgctggcca

SEQ ID NO: 448673 - DNA, 16 bp, M. musculus
tgtgagcttccatgtg

SEQ ID NO: 448674 - DNA, 16 bp, M. musculus
tgtgagcttgtgtgtg

SEQ ID NO: 448675 - DNA, 16 bp, M. musculus
tgtgaggacctgagct

SEQ ID NO: 448676 - DNA, 18 bp, M. musculus
tgtgaggagcgggtgtgg

SEQ ID NO: 448677 - DNA, 16 bp, M. musculus
tgtgaggatgaagaag

SEQ ID NO: 448678 - DNA, 16 bp, M. musculus
tgtgaggatgtcagat

SEQ ID NO: 448679 - DNA, 16 bp, M. musculus
tgtgaggatgtgtgtg

SEQ ID NO: 448680 - DNA, 16 bp, M. musculus
tgtgaggcagaggcag

SEQ ID NO: 448681 - DNA, 16 bp, M. musculus
tgtgaggccagcctgg

SEQ ID NO: 448682 - DNA, 16 bp, M. musculus
tgtgaggccctgagtt

SEQ ID NO: 448683 - DNA, 16 bp, M. musculus
tgtgaggctgtgccag

SEQ ID NO: 448684 - DNA, 16 bp, M. musculus
tgtgagggtgtatgtg

SEQ ID NO: 448685 - DNA, 16 bp, M. musculus
tgtgaggtagaatctc

SEQ ID NO: 448686 - DNA, 16 bp, M. musculus
tgtgaggtctcaggag

SEQ ID NO: 448687 - DNA, 17 bp, M. musculus
tgtgaggtggattctca

SEQ ID NO: 448688 - DNA, 16 bp, M. musculus
tgtgaggttttatttc

SEQ ID NO: 448689 - DNA, 16 bp, M. musculus
tgtgagtcccaggaat

SEQ ID NO: 448690 - DNA, 16 bp, M. musculus
tgtgagtcctggggat

SEQ ID NO: 448691 - DNA, 17 bp, M. musculus
tgtgagtgagggtcttt

SEQ ID NO: 448692 - DNA, 19 bp, M. musculus
tgtgagtgagtgtgtgtgt

SEQ ID NO: 448693 - DNA, 16 bp, M. musculus
tgtgagtgcacatgtg

SEQ ID NO: 448694 - DNA, 16 bp, M. musculus
tgtgagtgcaggtagg

SEQ ID NO: 448695 - DNA, 16 bp, M. musculus
tgtgagtgcatatgtg

SEQ ID NO: 448696 - DNA, 16 bp, M. musculus
tgtgagtgcctgtgtg

SEQ ID NO: 448697 - DNA, 16 bp, M. musculus
tgtgagtgctgggacc

SEQ ID NO: 448698 - DNA, 16 bp, M. musculus
tgtgagtgtaagtgtg

SEQ ID NO: 448699 - DNA, 16 bp, M. musculus
tgtgagtgtaggtgcc

SEQ ID NO: 448700 - DNA, 16 bp, M. musculus
tgtgagtgtatgtgtt

SEQ ID NO: 448701 - DNA, 16 bp, M. musculus
tgtgagtgtccatgtg

SEQ ID NO: 448702 - DNA, 16 bp, M. musculus
tgtgagtgtctatgtg

SEQ ID NO: 448703 - DNA, 16 bp, M. musculus
tgtgagtgtctgtatg

SEQ ID NO: 448704 - DNA, 16 bp, M. musculus
tgtgagtgtgagtgag

SEQ ID NO: 448705 - DNA, 16 bp, M. musculus
tgtgagtgtgcgtgtg

SEQ ID NO: 448706 - DNA, 16 bp, M. musculus
tgtgagtgtgtgagca

SEQ ID NO: 448707 - DNA, 16 bp, M. musculus
tgtgagtgtgtgatgt

SEQ ID NO: 448708 - DNA, 16 bp, M. musculus
tgtgagtgtgtgcgtg

SEQ ID NO: 448709 - DNA, 16 bp, M. musculus
tgtgagtgtgtgtatg

SEQ ID NO: 448710 - DNA, 16 bp, M. musculus
tgtgagtgtgtgtgac

SEQ ID NO: 448711 - DNA, 16 bp, M. musculus
tgtgagtgtgtgtgag

SEQ ID NO: 448712 - DNA, 16 bp, M. musculus
tgtgagtgtttgtgta

SEQ ID NO: 448713 - DNA, 16 bp, M. musculus
tgtgagttcaagccag

SEQ ID NO: 448714 - DNA, 22 bp, M. musculus
tgtgagttcaaggccagcctga

SEQ ID NO: 448715 - DNA, 16 bp, M. musculus
tgtgagttcaagtcca

SEQ ID NO: 448716 - DNA, 16 bp, M. musculus
tgtgagttcaatgcca

SEQ ID NO: 448717 - DNA, 16 bp, M. musculus
tgtgagttccaggaca

SEQ ID NO: 448718 - DNA, 16 bp, M. musculus
tgtgagttcctttgtg

SEQ ID NO: 448719 - DNA, 16 bp, M. musculus
tgtgagttctaggaca

SEQ ID NO: 448720 - DNA, 16 bp, M. musculus
tgtgagttggttctct

SEQ ID NO: 448721 - DNA, 16 bp, M. musculus
tgtgagtttgaagtca

SEQ ID NO: 448722 - DNA, 16 bp, M. musculus
tgtgagtttgagtgtg

SEQ ID NO: 448723 - DNA, 16 bp, M. musculus
tgtgagtttggggcta

SEQ ID NO: 448724 - DNA, 16 bp, M. musculus
tgtgagttttctatta

SEQ ID NO: 448725 - DNA, 16 bp, M. musculus
tgtgataaaacaccaa

SEQ ID NO: 448726 - DNA, 16 bp, M. musculus
tgtgataaacaccagg

SEQ ID NO: 448727 - DNA, 16 bp, M. musculus
tgtgataagacaccac

SEQ ID NO: 448728 - DNA, 16 bp, M. musculus
tgtgataagcctgacc

SEQ ID NO: 448729 - DNA, 16 bp, M. musculus
tgtgatatatatatat

SEQ ID NO: 448730 - DNA, 16 bp, M. musculus
tgtgatatttggagag

SEQ ID NO: 448731 - DNA, 16 bp, M. musculus
tgtgatcccagtgctg

SEQ ID NO: 448732 - DNA, 16 bp, M. musculus
tgtgatcctcctacct

SEQ ID NO: 448733 - DNA, 16 bp, M. musculus
tgtgatctctctgctt

SEQ ID NO: 448734 - DNA, 16 bp, M. musculus
tgtgatctgctttttg

SEQ ID NO: 448735 - DNA, 16 bp, M. musculus
tgtgatcttcctgctt

SEQ ID NO: 448736 - DNA, 17 bp, M. musculus
tgtgatgaaacaccatg

SEQ ID NO: 448737 - DNA, 16 bp, M. musculus
tgtgatgaaggattct

SEQ ID NO: 448738 - DNA, 16 bp, M. musculus
tgtgatgacaactggg

SEQ ID NO: 448739 - DNA, 16 bp, M. musculus
tgtgatgaccccccaa

SEQ ID NO: 448740 - DNA, 16 bp, M. musculus
tgtgatgagacaccat

SEQ ID NO: 448741 - DNA, 16 bp, M. musculus
tgtgatgcatgtgtgt

SEQ ID NO: 448742 - DNA, 16 bp, M. musculus
tgtgatgcttgcatct

SEQ ID NO: 448743 - DNA, 16 bp, M. musculus
tgtgatggaaatgaac

SEQ ID NO: 448744 - DNA, 16 bp, M. musculus
tgtgatgggcctgacc

SEQ ID NO: 448745 - DNA, 16 bp, M. musculus
tgtgatggggattgca

SEQ ID NO: 448746 - DNA, 16 bp, M. musculus
tgtgatggttagcttt

SEQ ID NO: 448747 - DNA, 16 bp, M. musculus
tgtgatggtttgaata

SEQ ID NO: 448748 - DNA, 16 bp, M. musculus
tgtgatggtttgcata

SEQ ID NO: 448749 - DNA, 17 bp, M. musculus
tgtgatggtttgtatat

SEQ ID NO: 448750 - DNA, 16 bp, M. musculus
tgtgatgtctgtgtgt

SEQ ID NO: 448751 - DNA, 17 bp, M. musculus
tgtgatgtgatgtgatg

SEQ ID NO: 448752 - DNA, 16 bp, M. musculus
tgtgatgtggtatgtg

SEQ ID NO: 448753 - DNA, 16 bp, M. musculus
tgtgattaaaggtatg

SEQ ID NO: 448754 - DNA, 16 bp, M. musculus
tgtgattacaagtgtg

SEQ ID NO: 448755 - DNA, 16 bp, M. musculus
tgtgattattttaaaa

SEQ ID NO: 448756 - DNA, 16 bp, M. musculus
tgtgattattttgctc

SEQ ID NO: 448757 - DNA, 16 bp, M. musculus
tgtgattctagagaac

SEQ ID NO: 448758 - DNA, 16 bp, M. musculus
tgtgattcttttaaga

SEQ ID NO: 448759 - DNA, 17 bp, M. musculus
tgtgattgattcagatg

SEQ ID NO: 448760 - DNA, 16 bp, M. musculus
tgtgattggaatggaa

SEQ ID NO: 448761 - DNA, 16 bp, M. musculus
tgtgattttaaatctg

SEQ ID NO: 448762 - DNA, 16 bp, M. musculus
tgtgatttttaaaaag

SEQ ID NO: 448763 - DNA, 16 bp, M. musculus
tgtgatttttctcaga

SEQ ID NO: 448764 - DNA, 16 bp, M. musculus
tgtgattttttccccc

SEQ ID NO: 448765 - DNA, 16 bp, M. musculus
tgtgcaaagaggccag

SEQ ID NO: 448766 - DNA, 16 bp, M. musculus
tgtgcaaagcaaaatt

SEQ ID NO: 448767 - DNA, 16 bp, M. musculus
tgtgcaaaggtcctga

SEQ ID NO: 448768 - DNA, 16 bp, M. musculus
tgtgcaaatgtgtgta

SEQ ID NO: 448769 - DNA, 16 bp, M. musculus
tgtgcaagacacagtg

SEQ ID NO: 448770 - DNA, 16 bp, M. musculus
tgtgcaagatgacaaa

SEQ ID NO: 448771 - DNA, 16 bp, M. musculus
tgtgcaagcatgagaa

SEQ ID NO: 448772 - DNA, 16 bp, M. musculus
tgtgcaagctcaagcc

SEQ ID NO: 448773 - DNA, 16 bp, M. musculus
tgtgcaaggccctgga

SEQ ID NO: 448774 - DNA, 16 bp, M. musculus
tgtgcacacaagtgtg

SEQ ID NO: 448775 - DNA, 16 bp, M. musculus
tgtgcacacacacaaa

SEQ ID NO: 448776 - DNA, 16 bp, M. musculus
tgtgcacacacacaca

SEQ ID NO: 448777 - DNA, 16 bp, M. musculus
tgtgcacacacacagc

SEQ ID NO: 448778 - DNA, 16 bp, M. musculus
tgtgcacacacagtgc

SEQ ID NO: 448779 - DNA, 16 bp, M. musculus
tgtgcacacacatgca

SEQ ID NO: 448780 - DNA, 16 bp, M. musculus
tgtgcacacacatgtg

SEQ ID NO: 448781 - DNA, 16 bp, M. musculus
tgtgcacacacattca

SEQ ID NO: 448782 - DNA, 16 bp, M. musculus
tgtgcacacagacaca

SEQ ID NO: 448783 - DNA, 16 bp, M. musculus
tgtgcacacatatatg

SEQ ID NO: 448784 - DNA, 16 bp, M. musculus
tgtgcacacatgtgtg

SEQ ID NO: 448785 - DNA, 16 bp, M. musculus
tgtgcacacctgtgtg

SEQ ID NO: 448786 - DNA, 16 bp, M. musculus
tgtgcacacgtgtgtg

SEQ ID NO: 448787 - DNA, 16 bp, M. musculus
tgtgcacactctcacc

SEQ ID NO: 448788 - DNA, 16 bp, M. musculus
tgtgcacagacacaca

SEQ ID NO: 448789 - DNA, 16 bp, M. musculus
tgtgcacagcagtgtg

SEQ ID NO: 448790 - DNA, 53 bp, M. musculus
tgtgcacaggaaatacaccactgttgcctctcatccctaataaccatggctgt

SEQ ID NO: 448791 - DNA, 16 bp, M. musculus
tgtgcacaggtacaca

SEQ ID NO: 448792 - DNA, 16 bp, M. musculus
tgtgcacaggtgcaca

SEQ ID NO: 448793 - DNA, 16 bp, M. musculus
tgtgcacatacacata

SEQ ID NO: 448794 - DNA, 16 bp, M. musculus
tgtgcacatatgtgtg

SEQ ID NO: 448795 - DNA, 16 bp, M. musculus
tgtgcacatctgtgca

SEQ ID NO: 448796 - DNA, 16 bp, M. musculus
tgtgcacatgaatgca

SEQ ID NO: 448797 - DNA, 16 bp, M. musculus
tgtgcacatgagcaca

SEQ ID NO: 448798 - DNA, 16 bp, M. musculus
tgtgcacatgagtaca

SEQ ID NO: 448799 - DNA, 16 bp, M. musculus
tgtgcacatgcaaaca

SEQ ID NO: 448800 - DNA, 16 bp, M. musculus
tgtgcacatgcgtgtg

SEQ ID NO: 448801 - DNA, 16 bp, M. musculus
tgtgcacatggacaca

SEQ ID NO: 448802 - DNA, 16 bp, M. musculus
tgtgcacatgtacata

SEQ ID NO: 448803 - DNA, 16 bp, M. musculus
tgtgcacatgtatgca

SEQ ID NO: 448804 - DNA, 16 bp, M. musculus
tgtgcacatgtatgtg

SEQ ID NO: 448805 - DNA, 16 bp, M. musculus
tgtgcacatgtgtacc

SEQ ID NO: 448806 - DNA, 16 bp, M. musculus
tgtgcacatgtgtgca

SEQ ID NO: 448807 - DNA, 16 bp, M. musculus
tgtgcacatgtgtgtt

SEQ ID NO: 448808 - DNA, 16 bp, M. musculus
tgtgcacatttgtgtg

SEQ ID NO: 448809 - DNA, 16 bp, M. musculus
tgtgcaccacacacat

SEQ ID NO: 448810 - DNA, 16 bp, M. musculus
tgtgcaccacatacat

SEQ ID NO: 448811 - DNA, 16 bp, M. musculus
tgtgcaccaccacact

SEQ ID NO: 448812 - DNA, 16 bp, M. musculus
tgtgcaccaccacagc

SEQ ID NO: 448813 - DNA, 16 bp, M. musculus
tgtgcaccaccactgc

SEQ ID NO: 448814 - DNA, 16 bp, M. musculus
tgtgcaccaccatgcc

SEQ ID NO: 448815 - DNA, 16 bp, M. musculus
tgtgcaccacgtgtgt

SEQ ID NO: 448816 - DNA, 16 bp, M. musculus
tgtgcaccactgcctg

SEQ ID NO: 448817 - DNA, 16 bp, M. musculus
tgtgcaccaggctgtg

SEQ ID NO: 448818 - DNA, 16 bp, M. musculus
tgtgcaccatgtacat

SEQ ID NO: 448819 - DNA, 16 bp, M. musculus
tgtgcaccgtgtgtgt

SEQ ID NO: 448820 - DNA, 16 bp, M. musculus
tgtgcacctgtgtgtg

SEQ ID NO: 448821 - DNA, 16 bp, M. musculus
tgtgcacgcacacatg

SEQ ID NO: 448822 - DNA, 16 bp, M. musculus
tgtgcacgcacacgca

SEQ ID NO: 448823 - DNA, 16 bp, M. musculus
tgtgcacgcgcacatg

SEQ ID NO: 448824 - DNA, 16 bp, M. musculus
tgtgcacgtacacaca

SEQ ID NO: 448825 - DNA, 16 bp, M. musculus
tgtgcacgtgtgcatg

SEQ ID NO: 448826 - DNA, 16 bp, M. musculus
tgtgcactgccacacc

SEQ ID NO: 448827 - DNA, 16 bp, M. musculus
tgtgcagaaaatgtcc

SEQ ID NO: 448828 - DNA, 16 bp, M. musculus
tgtgcagaaatagaaa

SEQ ID NO: 448829 - DNA, 16 bp, M. musculus
tgtgcagaaggatcct

SEQ ID NO: 448830 - DNA, 16 bp, M. musculus
tgtgcagaagtcagag

SEQ ID NO: 448831 - DNA, 16 bp, M. musculus
tgtgcagacaaaacac

SEQ ID NO: 448832 - DNA, 16 bp, M. musculus
tgtgcagacagacatg

SEQ ID NO: 448833 - DNA, 16 bp, M. musculus
tgtgcagacatacatg

SEQ ID NO: 448834 - DNA, 16 bp, M. musculus
tgtgcagactagtctt

SEQ ID NO: 448835 - DNA, 16 bp, M. musculus
tgtgcagagaatgaga

SEQ ID NO: 448836 - DNA, 16 bp, M. musculus
tgtgcagagagtaaga

SEQ ID NO: 448837 - DNA, 16 bp, M. musculus
tgtgcagagatcagag

SEQ ID NO: 448838 - DNA, 16 bp, M. musculus
tgtgcagaggccagag

SEQ ID NO: 448839 - DNA, 20 bp, M. musculus
tgtgcagatggcagctacta

SEQ ID NO: 448840 - DNA, 16 bp, M. musculus
tgtgcagatgtgtgtg

SEQ ID NO: 448841 - DNA, 16 bp, M. musculus
tgtgcagcactggctg

SEQ ID NO: 448842 - DNA, 16 bp, M. musculus
tgtgcagctacagtgt

SEQ ID NO: 448843 - DNA, 16 bp, M. musculus
tgtgcagctcagtctt

SEQ ID NO: 448844 - DNA, 16 bp, M. musculus
tgtgcagcttgttctt

SEQ ID NO: 448845 - DNA, 16 bp, M. musculus
tgtgcaggaagccaca

SEQ ID NO: 448846 - DNA, 16 bp, M. musculus
tgtgcagggcagggga

SEQ ID NO: 448847 - DNA, 16 bp, M. musculus
tgtgcaggtaaaggag

SEQ ID NO: 448848 - DNA, 16 bp, M. musculus
tgtgcaggtgcctgag

SEQ ID NO: 448849 - DNA, 16 bp, M. musculus
tgtgcaggtgtatgtg

SEQ ID NO: 448850 - DNA, 16 bp, M. musculus
tgtgcaggtgtgcatg

SEQ ID NO: 448851 - DNA, 16 bp, M. musculus
tgtgcaggtgtgtgtg

SEQ ID NO: 448852 - DNA, 16 bp, M. musculus
tgtgcagtcttggctg

SEQ ID NO: 448853 - DNA, 16 bp, M. musculus
tgtgcagtgcccatga

SEQ ID NO: 448854 - DNA, 16 bp, M. musculus
tgtgcagtgcctgtgg

SEQ ID NO: 448855 - DNA, 16 bp, M. musculus
tgtgcagtgctgtgct

SEQ ID NO: 448856 - DNA, 16 bp, M. musculus
tgtgcagtgtgtgcca

SEQ ID NO: 448857 - DNA, 16 bp, M. musculus
tgtgcatacacacaaa

SEQ ID NO: 448858 - DNA, 16 bp, M. musculus
tgtgcatacatgtgga

SEQ ID NO: 448859 - DNA, 16 bp, M. musculus
tgtgcatactaggcaa

SEQ ID NO: 448860 - DNA, 16 bp, M. musculus
tgtgcatatacacaca

SEQ ID NO: 448861 - DNA, 16 bp, M. musculus
tgtgcatatacatgtg

SEQ ID NO: 448862 - DNA, 16 bp, M. musculus
tgtgcatatctgtgtg

SEQ ID NO: 448863 - DNA, 16 bp, M. musculus
tgtgcatatgcatatt

SEQ ID NO: 448864 - DNA, 16 bp, M. musculus
tgtgcatatgtgagtg

SEQ ID NO: 448865 - DNA, 16 bp, M. musculus
tgtgcatatgtgtgag

SEQ ID NO: 448866 - DNA, 16 bp, M. musculus
tgtgcatatgtgtgta

SEQ ID NO: 448867 - DNA, 16 bp, M. musculus
tgtgcatatgtgttca

SEQ ID NO: 448868 - DNA, 16 bp, M. musculus
tgtgcatcaccatgcc

SEQ ID NO: 448869 - DNA, 16 bp, M. musculus
tgtgcatcaccatgtc

SEQ ID NO: 448870 - DNA, 16 bp, M. musculus
tgtgcatcatgtgcat

SEQ ID NO: 448871 - DNA, 16 bp, M. musculus
tgtgcatctgagtgtg

SEQ ID NO: 448872 - DNA, 16 bp, M. musculus
tgtgcatgagtgtttt

SEQ ID NO: 448873 - DNA, 16 bp, M. musculus
tgtgcatgcaaatgtg

SEQ ID NO: 448874 - DNA, 16 bp, M. musculus
tgtgcatgcacatgtg

SEQ ID NO: 448875 - DNA, 16 bp, M. musculus
tgtgcatgcagataga

SEQ ID NO: 448876 - DNA, 16 bp, M. musculus
tgtgcatgcagtgccc

SEQ ID NO: 448877 - DNA, 16 bp, M. musculus
tgtgcatgcatgcctg

SEQ ID NO: 448878 - DNA, 16 bp, M. musculus
tgtgcatgccacagtg

SEQ ID NO: 448879 - DNA, 16 bp, M. musculus
tgtgcatgccaggcaa

SEQ ID NO: 448880 - DNA, 16 bp, M. musculus
tgtgcatgcctgtgtg

SEQ ID NO: 448881 - DNA, 16 bp, M. musculus
tgtgcatgcgtgtgtg

SEQ ID NO: 448882 - DNA, 16 bp, M. musculus
tgtgcatgctaccaca

SEQ ID NO: 448883 - DNA, 16 bp, M. musculus
tgtgcatgctaggaaa

SEQ ID NO: 448884 - DNA, 16 bp, M. musculus
tgtgcatgctgctaca

SEQ ID NO: 448885 - DNA, 16 bp, M. musculus
tgtgcatgcttgtgtg

SEQ ID NO: 448886 - DNA, 16 bp, M. musculus
tgtgcatgggcacaca

SEQ ID NO: 448887 - DNA, 16 bp, M. musculus
tgtgcatggtgtgtgt

SEQ ID NO: 448888 - DNA, 16 bp, M. musculus
tgtgcatgtatgcatt

SEQ ID NO: 448889 - DNA, 16 bp, M. musculus
tgtgcatgtatgtgag

SEQ ID NO: 448890 - DNA, 16 bp, M. musculus
tgtgcatgtatgtgca

SEQ ID NO: 448891 - DNA, 16 bp, M. musculus
tgtgcatgtgagtgca

SEQ ID NO: 448892 - DNA, 16 bp, M. musculus
tgtgcatgtgcacgca

SEQ ID NO: 448893 - DNA, 16 bp, M. musculus
tgtgcatgtgcataag

SEQ ID NO: 448894 - DNA, 16 bp, M. musculus
tgtgcatgtgcatctg

SEQ ID NO: 448895 - DNA, 16 bp, M. musculus
tgtgcatgtgcatgta

SEQ ID NO: 448896 - DNA, 16 bp, M. musculus
tgtgcatgtgctgtgg

SEQ ID NO: 448897 - DNA, 16 bp, M. musculus
tgtgcatgtgtctgtg

SEQ ID NO: 448898 - DNA, 16 bp, M. musculus
tgtgcatgtgtgccct

SEQ ID NO: 448899 - DNA, 16 bp, M. musculus
tgtgcatgtgtgcctg

SEQ ID NO: 448900 - DNA, 16 bp, M. musculus
tgtgcatgtgtgtact

SEQ ID NO: 448901 - DNA, 16 bp, M. musculus
tgtgcatgtgtgtata

SEQ ID NO: 448902 - DNA, 16 bp, M. musculus
tgtgcatgtgtgtccc

SEQ ID NO: 448903 - DNA, 16 bp, M. musculus
tgtgcatgtgtgtgca

SEQ ID NO: 448904 - DNA, 16 bp, M. musculus
tgtgcatgtgtgtgct

SEQ ID NO: 448905 - DNA, 16 bp, M. musculus
tgtgcatgtgtgtggg

SEQ ID NO: 448906 - DNA, 16 bp, M. musculus
tgtgcatgtgtgtgta

SEQ ID NO: 448907 - DNA, 16 bp, M. musculus
tgtgcatgttaggcaa

SEQ ID NO: 448908 - DNA, 16 bp, M. musculus
tgtgcatgttgtgtgt

SEQ ID NO: 448909 - DNA, 16 bp, M. musculus
tgtgcatgtttgtttg

SEQ ID NO: 448910 - DNA, 16 bp, M. musculus
tgtgcattcaataaac

SEQ ID NO: 448911 - DNA, 16 bp, M. musculus
tgtgcattcatgcatg

SEQ ID NO: 448912 - DNA, 16 bp, M. musculus
tgtgcattcatgtgtg

SEQ ID NO: 448913 - DNA, 16 bp, M. musculus
tgtgcatttgtttgtg

SEQ ID NO: 448914 - DNA, 16 bp, M. musculus
tgtgccaacacaccca

SEQ ID NO: 448915 - DNA, 16 bp, M. musculus
tgtgccaacactgcct

SEQ ID NO: 448916 - DNA, 16 bp, M. musculus
tgtgccaaggacacag

SEQ ID NO: 448917 - DNA, 16 bp, M. musculus
tgtgccacacccactc

SEQ ID NO: 448918 - DNA, 16 bp, M. musculus
tgtgccacagcgctcc

SEQ ID NO: 448919 - DNA, 16 bp, M. musculus
tgtgccaccacaccca

SEQ ID NO: 448920 - DNA, 16 bp, M. musculus
tgtgccaccacaccct

SEQ ID NO: 448921 - DNA, 16 bp, M. musculus
tgtgccaccacacctg

SEQ ID NO: 448922 - DNA, 16 bp, M. musculus
tgtgccaccaccacct

SEQ ID NO: 448923 - DNA, 16 bp, M. musculus
tgtgccaccaccactg

SEQ ID NO: 448924 - DNA, 16 bp, M. musculus
tgtgccaccacccctg

SEQ ID NO: 448925 - DNA, 16 bp, M. musculus
tgtgccaccacctcct

SEQ ID NO: 448926 - DNA, 16 bp, M. musculus
tgtgccaccacgccca

SEQ ID NO: 448927 - DNA, 16 bp, M. musculus
tgtgccaccacgccgg

SEQ ID NO: 448928 - DNA, 16 bp, M. musculus
tgtgccaccactcctg

SEQ ID NO: 448929 - DNA, 16 bp, M. musculus
tgtgccaccactgccc

SEQ ID NO: 448930 - DNA, 21 bp, M. musculus
tgtgccaccactgcctggctt

SEQ ID NO: 448931 - DNA, 16 bp, M. musculus
tgtgccaccactgtcc

SEQ ID NO: 448932 - DNA, 16 bp, M. musculus
tgtgccaccagtgccc

SEQ ID NO: 448933 - DNA, 16 bp, M. musculus
tgtgccaccataccca

SEQ ID NO: 448934 - DNA, 16 bp, M. musculus
tgtgccaccatacctg

SEQ ID NO: 448935 - DNA, 16 bp, M. musculus
tgtgccaccatcacct

SEQ ID NO: 448936 - DNA, 16 bp, M. musculus
tgtgccaccatgctca

SEQ ID NO: 448937 - DNA, 16 bp, M. musculus
tgtgccacccccaccc

SEQ ID NO: 448938 - DNA, 16 bp, M. musculus
tgtgccacctctgccc

SEQ ID NO: 448939 - DNA, 16 bp, M. musculus
tgtgccacctctgcct

SEQ ID NO: 448940 - DNA, 16 bp, M. musculus
tgtgccactatgcctg

SEQ ID NO: 448941 - DNA, 16 bp, M. musculus
tgtgccactatgtctg

SEQ ID NO: 448942 - DNA, 16 bp, M. musculus
tgtgccactggaggtg

SEQ ID NO: 448943 - DNA, 16 bp, M. musculus
tgtgccactgtgccca

SEQ ID NO: 448944 - DNA, 16 bp, M. musculus
tgtgccactgtgggca

SEQ ID NO: 448945 - DNA, 16 bp, M. musculus
tgtgccagaagagggt

SEQ ID NO: 448946 - DNA, 16 bp, M. musculus
tgtgccaggcactggc

SEQ ID NO: 448947 - DNA, 16 bp, M. musculus
tgtgccagggtggggt

SEQ ID NO: 448948 - DNA, 16 bp, M. musculus
tgtgccaggtgtggtg

SEQ ID NO: 448949 - DNA, 16 bp, M. musculus
tgtgccatcacaccca

SEQ ID NO: 448950 - DNA, 16 bp, M. musculus
tgtgccatggcacaca

SEQ ID NO: 448951 - DNA, 16 bp, M. musculus
tgtgccatggtgcaca

SEQ ID NO: 448952 - DNA, 18 bp, M. musculus
tgtgcccatatctttgag

SEQ ID NO: 448953 - DNA, 16 bp, M. musculus
tgtgcccatgtatgtg

SEQ ID NO: 448954 - DNA, 16 bp, M. musculus
tgtgcccatgtgtttg

SEQ ID NO: 448955 - DNA, 16 bp, M. musculus
tgtgccccaccacacc

SEQ ID NO: 448956 - DNA, 16 bp, M. musculus
tgtgcccccaccccca

SEQ ID NO: 448957 - DNA, 17 bp, M. musculus
tgtgcccctggtcaggc

SEQ ID NO: 448958 - DNA, 16 bp, M. musculus
tgtgccctcagctgtg

SEQ ID NO: 448959 - DNA, 16 bp, M. musculus
tgtgccctgatatttt

SEQ ID NO: 448960 - DNA, 16 bp, M. musculus
tgtgccctgtgccctg

SEQ ID NO: 448961 - DNA, 16 bp, M. musculus
tgtgccgggcatggtg

SEQ ID NO: 448962 - DNA, 21 bp, M. musculus
tgtgcctaactagtaaacaag

SEQ ID NO: 448963 - DNA, 16 bp, M. musculus
tgtgcctagtcttact

SEQ ID NO: 448964 - DNA, 16 bp, M. musculus
tgtgcctatatcttcg

SEQ ID NO: 448965 - DNA, 16 bp, M. musculus
tgtgcctatgtatgtg

SEQ ID NO: 448966 - DNA, 16 bp, M. musculus
tgtgcctcaggccccg

SEQ ID NO: 448967 - DNA, 16 bp, M. musculus
tgtgcctccttcctgg

SEQ ID NO: 448968 - DNA, 16 bp, M. musculus
tgtgcctctgcctcct

SEQ ID NO: 448969 - DNA, 16 bp, M. musculus
tgtgcctgacttcctc

SEQ ID NO: 448970 - DNA, 16 bp, M. musculus
tgtgcctgcagagctc

SEQ ID NO: 448971 - DNA, 16 bp, M. musculus
tgtgcctgcctctgcc

SEQ ID NO: 448972 - DNA, 16 bp, M. musculus
tgtgcctgcctgtgtg

SEQ ID NO: 448973 - DNA, 16 bp, M. musculus
tgtgcctggcttattt

SEQ ID NO: 448974 - DNA, 16 bp, M. musculus
tgtgcctgtgcctgtc

SEQ ID NO: 448975 - DNA, 16 bp, M. musculus
tgtgcctgtgcttgtg

SEQ ID NO: 448976 - DNA, 16 bp, M. musculus
tgtgcctgtggaggcc

SEQ ID NO: 448977 - DNA, 16 bp, M. musculus
tgtgccttcaggacct

SEQ ID NO: 448978 - DNA, 16 bp, M. musculus
tgtgccttccagatat

SEQ ID NO: 448979 - DNA, 16 bp, M. musculus
tgtgccttccatttct

SEQ ID NO: 448980 - DNA, 16 bp, M. musculus
tgtgcgcacacacaca

SEQ ID NO: 448981 - DNA, 16 bp, M. musculus
tgtgcgcacatgcatg

SEQ ID NO: 448982 - DNA, 16 bp, M. musculus
tgtgcgcacgcacaca

SEQ ID NO: 448983 - DNA, 16 bp, M. musculus
tgtgcgcatgcgtgtg

SEQ ID NO: 448984 - DNA, 16 bp, M. musculus
tgtgcgcatgtgtatg

SEQ ID NO: 448985 - DNA, 16 bp, M. musculus
tgtgcgcatgtgtgca

SEQ ID NO: 448986 - DNA, 16 bp, M. musculus
tgtgcgcgcacgcgtg

SEQ ID NO: 448987 - DNA, 16 bp, M. musculus
tgtgcgcgcgcgcgcc

SEQ ID NO: 448988 - DNA, 16 bp, M. musculus
tgtgcgcgcgcgtgtg

SEQ ID NO: 448989 - DNA, 16 bp, M. musculus
tgtgcgcgcgtgtgtg

SEQ ID NO: 448990 - DNA, 16 bp, M. musculus
tgtgcgtatgtgtata

SEQ ID NO: 448991 - DNA, 16 bp, M. musculus
tgtgcgtgagtgtgtg

SEQ ID NO: 448992 - DNA, 16 bp, M. musculus
tgtgcgtgctaggcaa

SEQ ID NO: 448993 - DNA, 16 bp, M. musculus
tgtgcgtgtatgcgtg

SEQ ID NO: 448994 - DNA, 16 bp, M. musculus
tgtgcgtgtgcgtgtg

SEQ ID NO: 448995 - DNA, 16 bp, M. musculus
tgtgcgtgtgtgcaca

SEQ ID NO: 448996 - DNA, 16 bp, M. musculus
tgtgcgtgtgtgtctg

SEQ ID NO: 448997 - DNA, 16 bp, M. musculus
tgtgcgtgtgtgtgta

SEQ ID NO: 448998 - DNA, 16 bp, M. musculus
tgtgctacaaaatgag

SEQ ID NO: 448999 - DNA, 16 bp, M. musculus
tgtgctacaaaggaca

SEQ ID NO: 449000 - DNA, 20 bp, M. musculus
tgtgctacaggtacagctgt

SEQ ID NO: 449001 - DNA, 20 bp, M. musculus
tgtgctacagttacagctgt

SEQ ID NO: 449002 - DNA, 16 bp, M. musculus
tgtgctaccacaccca

SEQ ID NO: 449003 - DNA, 16 bp, M. musculus
tgtgctaccatgcctg

SEQ ID NO: 449004 - DNA, 16 bp, M. musculus
tgtgctactatgccca

SEQ ID NO: 449005 - DNA, 16 bp, M. musculus
tgtgctactgtgcctg

SEQ ID NO: 449006 - DNA, 18 bp, M. musculus
tgtgctatccatgccaaa

SEQ ID NO: 449007 - DNA, 16 bp, M. musculus
tgtgctcacagagaag

SEQ ID NO: 449008 - DNA, 16 bp, M. musculus
tgtgctcacctgtgtg

SEQ ID NO: 449009 - DNA, 16 bp, M. musculus
tgtgctcactcctgct

SEQ ID NO: 449010 - DNA, 16 bp, M. musculus
tgtgctcagtccaagg

SEQ ID NO: 449011 - DNA, 16 bp, M. musculus
tgtgctcatggctggc

SEQ ID NO: 449012 - DNA, 16 bp, M. musculus
tgtgctcatgtgtgtg

SEQ ID NO: 449013 - DNA, 16 bp, M. musculus
tgtgctccaccacacc

SEQ ID NO: 449014 - DNA, 16 bp, M. musculus
tgtgctccaccatgtt

SEQ ID NO: 449015 - DNA, 16 bp, M. musculus
tgtgctccaggttccc

SEQ ID NO: 449016 - DNA, 16 bp, M. musculus
tgtgctccatccaata

SEQ ID NO: 449017 - DNA, 16 bp, M. musculus
tgtgctccttcttaga

SEQ ID NO: 449018 - DNA, 16 bp, M. musculus
tgtgctctcacacacc

SEQ ID NO: 449019 - DNA, 16 bp, M. musculus
tgtgctctgacctgga

SEQ ID NO: 449020 - DNA, 16 bp, M. musculus
tgtgctctgacttcca

SEQ ID NO: 449021 - DNA, 16 bp, M. musculus
tgtgctctgcatgttt

SEQ ID NO: 449022 - DNA, 21 bp, M. musculus
tgtgctctgccttccccgtga

SEQ ID NO: 449023 - DNA, 16 bp, M. musculus
tgtgctcttaactgct

SEQ ID NO: 449024 - DNA, 16 bp, M. musculus
tgtgctcttctggcct

SEQ ID NO: 449025 - DNA, 16 bp, M. musculus
tgtgctcttggattca

SEQ ID NO: 449026 - DNA, 16 bp, M. musculus
tgtgctgaagcaagac

SEQ ID NO: 449027 - DNA, 16 bp, M. musculus
tgtgctgaagcagaca

SEQ ID NO: 449028 - DNA, 16 bp, M. musculus
tgtgctgacagacagg

SEQ ID NO: 449029 - DNA, 16 bp, M. musculus
tgtgctgcagctggac

SEQ ID NO: 449030 - DNA, 16 bp, M. musculus
tgtgctgcagtttctt

SEQ ID NO: 449031 - DNA, 16 bp, M. musculus
tgtgctgccaccaccc

SEQ ID NO: 449032 - DNA, 23 bp, M. musculus
tgtgctgccctaaaagaagaatg

SEQ ID NO: 449033 - DNA, 23 bp, M. musculus
tgtgctgccttaaaagaagaatg

SEQ ID NO: 449034 - DNA, 16 bp, M. musculus
tgtgctgctgtctgtc

SEQ ID NO: 449035 - DNA, 16 bp, M. musculus
tgtgctggaaattgaa

SEQ ID NO: 449036 - DNA, 16 bp, M. musculus
tgtgctggaactcact

SEQ ID NO: 449037 - DNA, 16 bp, M. musculus
tgtgctggacagtttt

SEQ ID NO: 449038 - DNA, 16 bp, M. musculus
tgtgctggctagtctt

SEQ ID NO: 449039 - DNA, 16 bp, M. musculus
tgtgctggctagtttt

SEQ ID NO: 449040 - DNA, 16 bp, M. musculus
tgtgctgggattaaag

SEQ ID NO: 449041 - DNA, 16 bp, M. musculus
tgtgctgggcagtggt

SEQ ID NO: 449042 - DNA, 16 bp, M. musculus
tgtgctgggcatggtg

SEQ ID NO: 449043 - DNA, 16 bp, M. musculus
tgtgctgggctgggct

SEQ ID NO: 449044 - DNA, 21 bp, M. musculus
tgtgctggggtatttttccat

SEQ ID NO: 449045 - DNA, 16 bp, M. musculus
tgtgctggggttaaag

SEQ ID NO: 449046 - DNA, 16 bp, M. musculus
tgtgctgtcacaggga

SEQ ID NO: 449047 - DNA, 16 bp, M. musculus
tgtgctgtcacctgtg

SEQ ID NO: 449048 - DNA, 16 bp, M. musculus
tgtgctgtcatttgag

SEQ ID NO: 449049 - DNA, 16 bp, M. musculus
tgtgctgtccatatac

SEQ ID NO: 449050 - DNA, 16 bp, M. musculus
tgtgctgtgctctgct

SEQ ID NO: 449051 - DNA, 16 bp, M. musculus
tgtgctgtgctctgtg

SEQ ID NO: 449052 - DNA, 16 bp, M. musculus
tgtgctgtgctgggct

SEQ ID NO: 449053 - DNA, 17 bp, M. musculus
tgtgctgtgctgtgctg

SEQ ID NO: 449054 - DNA, 16 bp, M. musculus
tgtgctgtgcttaaat

SEQ ID NO: 449055 - DNA, 16 bp, M. musculus
tgtgctgtggatggtg

SEQ ID NO: 449056 - DNA, 16 bp, M. musculus
tgtgctgtggcatgtg

SEQ ID NO: 449057 - DNA, 16 bp, M. musculus
tgtgctgtgtgcctgt

SEQ ID NO: 449058 - DNA, 16 bp, M. musculus
tgtgctgtgtgctctg

SEQ ID NO: 449059 - DNA, 16 bp, M. musculus
tgtgctgtgtgctgtg

SEQ ID NO: 449060 - DNA, 16 bp, M. musculus
tgtgctgtgtgtgtct

SEQ ID NO: 449061 - DNA, 16 bp, M. musculus
tgtgcttacaaaggca

SEQ ID NO: 449062 - DNA, 16 bp, M. musculus
tgtgcttacagacatg

SEQ ID NO: 449063 - DNA, 16 bp, M. musculus
tgtgcttataaagtgg

SEQ ID NO: 449064 - DNA, 17 bp, M. musculus
tgtgcttataaagtggg

SEQ ID NO: 449065 - DNA, 16 bp, M. musculus
tgtgcttccccacccc

SEQ ID NO: 449066 - DNA, 16 bp, M. musculus
tgtgcttccttttgta

SEQ ID NO: 449067 - DNA, 16 bp, M. musculus
tgtgcttctgcctgtt

SEQ ID NO: 449068 - DNA, 16 bp, M. musculus
tgtgcttgaagtccta

SEQ ID NO: 449069 - DNA, 16 bp, M. musculus
tgtgcttgcacatgca

SEQ ID NO: 449070 - DNA, 16 bp, M. musculus
tgtgcttgctgtcttt

SEQ ID NO: 449071 - DNA, 16 bp, M. musculus
tgtgcttgtaatccca

SEQ ID NO: 449072 - DNA, 16 bp, M. musculus
tgtgcttgtatgcatg

SEQ ID NO: 449073 - DNA, 16 bp, M. musculus
tgtgcttgtgtatgtg

SEQ ID NO: 449074 - DNA, 16 bp, M. musculus
tgtgcttgtgtgtatg

SEQ ID NO: 449075 - DNA, 16 bp, M. musculus
tgtgcttgtgtgtgga

SEQ ID NO: 449076 - DNA, 16 bp, M. musculus
tgtgctttcagcttta

SEQ ID NO: 449077 - DNA, 16 bp, M. musculus
tgtgctttctgatagt

SEQ ID NO: 449078 - DNA, 16 bp, M. musculus
tgtgctttgaatttta

SEQ ID NO: 449079 - DNA, 16 bp, M. musculus
tgtgctttgctttgct

SEQ ID NO: 449080 - DNA, 16 bp, M. musculus
tgtgcttttaacttgg

SEQ ID NO: 449081 - DNA, 16 bp, M. musculus
tgtgcttttgaaacct

SEQ ID NO: 449082 - DNA, 16 bp, M. musculus
tgtgctttttctagag

SEQ ID NO: 449083 - DNA, 16 bp, M. musculus
tgtggaaaaaacagaa

SEQ ID NO: 449084 - DNA, 16 bp, M. musculus
tgtggaaaaacacata

SEQ ID NO: 449085 - DNA, 16 bp, M. musculus
tgtggaaactgaataa

SEQ ID NO: 449086 - DNA, 16 bp, M. musculus
tgtggaaatgtaaact

SEQ ID NO: 449087 - DNA, 16 bp, M. musculus
tgtggaacagccagag

SEQ ID NO: 449088 - DNA, 16 bp, M. musculus
tgtggaacagtttgaa

SEQ ID NO: 449089 - DNA, 16 bp, M. musculus
tgtggaacattttctt

SEQ ID NO: 449090 - DNA, 16 bp, M. musculus
tgtggaaccgccagac

SEQ ID NO: 449091 - DNA, 16 bp, M. musculus
tgtggaagaaatggaa

SEQ ID NO: 449092 - DNA, 16 bp, M. musculus
tgtggaagagtttgag

SEQ ID NO: 449093 - DNA, 16 bp, M. musculus
tgtggaagcacacaca

SEQ ID NO: 449094 - DNA, 16 bp, M. musculus
tgtggaagcattttct

SEQ ID NO: 449095 - DNA, 16 bp, M. musculus
tgtggaagcctggctc

SEQ ID NO: 449096 - DNA, 16 bp, M. musculus
tgtggaaggagagaac

SEQ ID NO: 449097 - DNA, 16 bp, M. musculus
tgtggaagggggtgac

SEQ ID NO: 449098 - DNA, 16 bp, M. musculus
tgtggaagtcagaaga

SEQ ID NO: 449099 - DNA, 16 bp, M. musculus
tgtggaagtcagatga

SEQ ID NO: 449100 - DNA, 16 bp, M. musculus
tgtggaagtcaggaca

SEQ ID NO: 449101 - DNA, 16 bp, M. musculus
tgtggaatagtttggt

SEQ ID NO: 449102 - DNA, 16 bp, M. musculus
tgtggaatatggctgg

SEQ ID NO: 449103 - DNA, 16 bp, M. musculus
tgtggaattaaaaaaa

SEQ ID NO: 449104 - DNA, 16 bp, M. musculus
tgtggaattcagagga

SEQ ID NO: 449105 - DNA, 16 bp, M. musculus
tgtggacaaagaggaa

SEQ ID NO: 449106 - DNA, 16 bp, M. musculus
tgtggacaagcaggac

SEQ ID NO: 449107 - DNA, 16 bp, M. musculus
tgtggacaagcctgtg

SEQ ID NO: 449108 - DNA, 16 bp, M. musculus
tgtggacaatctgaag

SEQ ID NO: 449109 - DNA, 16 bp, M. musculus
tgtggacactatggcc

SEQ ID NO: 449110 - DNA, 16 bp, M. musculus
tgtggacagagggata

SEQ ID NO: 449111 - DNA, 16 bp, M. musculus
tgtggacagtgccatc

SEQ ID NO: 449112 - DNA, 16 bp, M. musculus
tgtggacatgggcttt

SEQ ID NO: 449113 - DNA, 16 bp, M. musculus
tgtggacatgtgtgtg

SEQ ID NO: 449114 - DNA, 16 bp, M. musculus
tgtggacccagcaggg

SEQ ID NO: 449115 - DNA, 16 bp, M. musculus
tgtggaccctgtgctc

SEQ ID NO: 449116 - DNA, 16 bp, M. musculus
tgtggacctgagttca

SEQ ID NO: 449117 - DNA, 16 bp, M. musculus
tgtggactgaacaact

SEQ ID NO: 449118 - DNA, 16 bp, M. musculus
tgtggagaaagacaaa

SEQ ID NO: 449119 - DNA, 16 bp, M. musculus
tgtggagaaagaggag

SEQ ID NO: 449120 - DNA, 18 bp, M. musculus
tgtggagaaagatgaaca

SEQ ID NO: 449121 - DNA, 16 bp, M. musculus
tgtggagaaatagaaa

SEQ ID NO: 449122 - DNA, 16 bp, M. musculus
tgtggagaacaaccaa

SEQ ID NO: 449123 - DNA, 16 bp, M. musculus
tgtggagaacagagga

SEQ ID NO: 449124 - DNA, 16 bp, M. musculus
tgtggagaaggaggaa

SEQ ID NO: 449125 - DNA, 16 bp, M. musculus
tgtggagacagaggaa

SEQ ID NO: 449126 - DNA, 16 bp, M. musculus
tgtggagacagggttt

SEQ ID NO: 449127 - DNA, 16 bp, M. musculus
tgtggagaccagaaga

SEQ ID NO: 449128 - DNA, 16 bp, M. musculus
tgtggagagaagagaa

SEQ ID NO: 449129 - DNA, 16 bp, M. musculus
tgtggagagccggtac

SEQ ID NO: 449130 - DNA, 16 bp, M. musculus
tgtggagagccgtgag

SEQ ID NO: 449131 - DNA, 16 bp, M. musculus
tgtggagagccgtgcc

SEQ ID NO: 449132 - DNA, 16 bp, M. musculus
tgtggagagcttttgg

SEQ ID NO: 449133 - DNA, 16 bp, M. musculus
tgtggagatagctcag

SEQ ID NO: 449134 - DNA, 16 bp, M. musculus
tgtggagatcagagga

SEQ ID NO: 449135 - DNA, 16 bp, M. musculus
tgtggagatggcttag

SEQ ID NO: 449136 - DNA, 28 bp, M. musculus
tgtggagattgcaactgcaaagcaatgg

SEQ ID NO: 449137 - DNA, 16 bp, M. musculus
tgtggagcaagaggaa

SEQ ID NO: 449138 - DNA, 16 bp, M. musculus
tgtggagcagagacag

SEQ ID NO: 449139 - DNA, 16 bp, M. musculus
tgtggagcagaggctg

SEQ ID NO: 449140 - DNA, 16 bp, M. musculus
tgtggagcagggtggg

SEQ ID NO: 449141 - DNA, 16 bp, M. musculus
tgtggagcccaggctg

SEQ ID NO: 449142 - DNA, 16 bp, M. musculus
tgtggagctggagaga

SEQ ID NO: 449143 - DNA, 16 bp, M. musculus
tgtggagctgtgacag

SEQ ID NO: 449144 - DNA, 16 bp, M. musculus
tgtggaggaagagaaa

SEQ ID NO: 449145 - DNA, 16 bp, M. musculus
tgtggaggaagaggaa

SEQ ID NO: 449146 - DNA, 16 bp, M. musculus
tgtggaggagagggtt

SEQ ID NO: 449147 - DNA, 16 bp, M. musculus
tgtggaggcagaagca

SEQ ID NO: 449148 - DNA, 16 bp, M. musculus
tgtggaggccaacaag

SEQ ID NO: 449149 - DNA, 16 bp, M. musculus
tgtggaggccagaaga

SEQ ID NO: 449150 - DNA, 16 bp, M. musculus
tgtggaggccagagga

SEQ ID NO: 449151 - DNA, 16 bp, M. musculus
tgtggaggccatggag

SEQ ID NO: 449152 - DNA, 16 bp, M. musculus
tgtggaggcctttgat

SEQ ID NO: 449153 - DNA, 16 bp, M. musculus
tgtggaggctggagag

SEQ ID NO: 449154 - DNA, 16 bp, M. musculus
tgtggaggctggaggt

SEQ ID NO: 449155 - DNA, 16 bp, M. musculus
tgtggagggacaggga

SEQ ID NO: 449156 - DNA, 16 bp, M. musculus
tgtggaggtcaaaaga

SEQ ID NO: 449157 - DNA, 16 bp, M. musculus
tgtggaggtcagaaaa

SEQ ID NO: 449158 - DNA, 16 bp, M. musculus
tgtggaggtcagcaga

SEQ ID NO: 449159 - DNA, 16 bp, M. musculus
tgtggagtctgttctc

SEQ ID NO: 449160 - DNA, 16 bp, M. musculus
tgtggagttcagagga

SEQ ID NO: 449161 - DNA, 16 bp, M. musculus
tgtggagttcctttcc

SEQ ID NO: 449162 - DNA, 16 bp, M. musculus
tgtggagttctgagtc

SEQ ID NO: 449163 - DNA, 16 bp, M. musculus
tgtggagttctttgat

SEQ ID NO: 449164 - DNA, 16 bp, M. musculus
tgtggatactccattc

SEQ ID NO: 449165 - DNA, 16 bp, M. musculus
tgtggatactttgttt

SEQ ID NO: 449166 - DNA, 16 bp, M. musculus
tgtggatagccctggg

SEQ ID NO: 449167 - DNA, 16 bp, M. musculus
tgtggatagccctggt

SEQ ID NO: 449168 - DNA, 16 bp, M. musculus
tgtggatatgtatata

SEQ ID NO: 449169 - DNA, 16 bp, M. musculus
tgtggatatgtgcatg

SEQ ID NO: 449170 - DNA, 16 bp, M. musculus
tgtggatatgtgtgtg

SEQ ID NO: 449171 - DNA, 16 bp, M. musculus
tgtggatcccaaacaa

SEQ ID NO: 449172 - DNA, 16 bp, M. musculus
tgtggatcccagacat

SEQ ID NO: 449173 - DNA, 16 bp, M. musculus
tgtggatctgacatgc

SEQ ID NO: 449174 - DNA, 16 bp, M. musculus
tgtggatgaagatgta

SEQ ID NO: 449175 - DNA, 16 bp, M. musculus
tgtggatgagtgtgtg

SEQ ID NO: 449176 - DNA, 16 bp, M. musculus
tgtggatgatggtgtt

SEQ ID NO: 449177 - DNA, 16 bp, M. musculus
tgtggatgccagcaag

SEQ ID NO: 449178 - DNA, 16 bp, M. musculus
tgtggatgccatgaag

SEQ ID NO: 449179 - DNA, 16 bp, M. musculus
tgtggatgctaagaac

SEQ ID NO: 449180 - DNA, 16 bp, M. musculus
tgtggatgctaggaat

SEQ ID NO: 449181 - DNA, 16 bp, M. musculus
tgtggatgctgagaat

SEQ ID NO: 449182 - DNA, 16 bp, M. musculus
tgtggatgctggaaat

SEQ ID NO: 449183 - DNA, 16 bp, M. musculus
tgtggatgcttcagtc

SEQ ID NO: 449184 - DNA, 16 bp, M. musculus
tgtggatggagccatg

SEQ ID NO: 449185 - DNA, 16 bp, M. musculus
tgtggatggctctgtg

SEQ ID NO: 449186 - DNA, 16 bp, M. musculus
tgtggatggtgtcatc

SEQ ID NO: 449187 - DNA, 16 bp, M. musculus
tgtggatgtgatgtga

SEQ ID NO: 449188 - DNA, 16 bp, M. musculus
tgtggattccaggaat

SEQ ID NO: 449189 - DNA, 16 bp, M. musculus
tgtggattgaacccag

SEQ ID NO: 449190 - DNA, 16 bp, M. musculus
tgtggatttatttctg

SEQ ID NO: 449191 - DNA, 16 bp, M. musculus
tgtggcaaacacttta

SEQ ID NO: 449192 - DNA, 16 bp, M. musculus
tgtggcaaagctttta

SEQ ID NO: 449193 - DNA, 16 bp, M. musculus
tgtggcaaatacttta

SEQ ID NO: 449194 - DNA, 16 bp, M. musculus
tgtggcaaatgcttta

SEQ ID NO: 449195 - DNA, 16 bp, M. musculus
tgtggcaatcctcctg

SEQ ID NO: 449196 - DNA, 16 bp, M. musculus
tgtggcacacagcaag

SEQ ID NO: 449197 - DNA, 16 bp, M. musculus
tgtggcactattagaa

SEQ ID NO: 449198 - DNA, 16 bp, M. musculus
tgtggcagaggatggt

SEQ ID NO: 449199 - DNA, 16 bp, M. musculus
tgtggcagcacaggcc

SEQ ID NO: 449200 - DNA, 16 bp, M. musculus
tgtggcagcaggagca

SEQ ID NO: 449201 - DNA, 16 bp, M. musculus
tgtggcagctcacacc

SEQ ID NO: 449202 - DNA, 16 bp, M. musculus
tgtggcagctgtgggc

SEQ ID NO: 449203 - DNA, 16 bp, M. musculus
tgtggcaggaagcatg

SEQ ID NO: 449204 - DNA, 16 bp, M. musculus
tgtggcaggactcctg

SEQ ID NO: 449205 - DNA, 16 bp, M. musculus
tgtggcagtttgaata

SEQ ID NO: 449206 - DNA, 17 bp, M. musculus
tgtggcatggagagtcc

SEQ ID NO: 449207 - DNA, 16 bp, M. musculus
tgtggccaaaggaaca

SEQ ID NO: 449208 - DNA, 16 bp, M. musculus
tgtggccagcctgggc

SEQ ID NO: 449209 - DNA, 16 bp, M. musculus
tgtggccaggcagtgg

SEQ ID NO: 449210 - DNA, 16 bp, M. musculus
tgtggccatcagtcac

SEQ ID NO: 449211 - DNA, 16 bp, M. musculus
tgtggccatgcctggc

SEQ ID NO: 449212 - DNA, 16 bp, M. musculus
tgtggcccaacacaaa

SEQ ID NO: 449213 - DNA, 16 bp, M. musculus
tgtggcccaggctgac

SEQ ID NO: 449214 - DNA, 17 bp, M. musculus
tgtggcccagtggtaga

SEQ ID NO: 449215 - DNA, 16 bp, M. musculus
tgtggccctggctgcc

SEQ ID NO: 449216 - DNA, 16 bp, M. musculus
tgtggccctggctggc

SEQ ID NO: 449217 - DNA, 16 bp, M. musculus
tgtggccctgttggag

SEQ ID NO: 449218 - DNA, 16 bp, M. musculus
tgtggcccttgttttg

SEQ ID NO: 449219 - DNA, 16 bp, M. musculus
tgtggcctcctcacct

SEQ ID NO: 449220 - DNA, 16 bp, M. musculus
tgtggcctctgtgggc

SEQ ID NO: 449221 - DNA, 16 bp, M. musculus
tgtggcctgtggcctg

SEQ ID NO: 449222 - DNA, 16 bp, M. musculus
tgtggcctgttggagg

SEQ ID NO: 449223 - DNA, 16 bp, M. musculus
tgtggccttgctggag

SEQ ID NO: 449224 - DNA, 16 bp, M. musculus
tgtggccttgtcagag

SEQ ID NO: 449225 - DNA, 16 bp, M. musculus
tgtggccttgttagag

SEQ ID NO: 449226 - DNA, 16 bp, M. musculus
tgtggcctttttggaa

SEQ ID NO: 449227 - DNA, 16 bp, M. musculus
tgtggcgttccttgat

SEQ ID NO: 449228 - DNA, 16 bp, M. musculus
tgtggctacacacaca

SEQ ID NO: 449229 - DNA, 16 bp, M. musculus
tgtggctacatctctg

SEQ ID NO: 449230 - DNA, 16 bp, M. musculus
tgtggctatctgtaaa

SEQ ID NO: 449231 - DNA, 16 bp, M. musculus
tgtggctcacaaccat

SEQ ID NO: 449232 - DNA, 16 bp, M. musculus
tgtggctcacagtctc

SEQ ID NO: 449233 - DNA, 16 bp, M. musculus
tgtggctcagctctag

SEQ ID NO: 449234 - DNA, 16 bp, M. musculus
tgtggctctcacctgt

SEQ ID NO: 449235 - DNA, 16 bp, M. musculus
tgtggctcttgcctgt

SEQ ID NO: 449236 - DNA, 16 bp, M. musculus
tgtggctgaagccatg

SEQ ID NO: 449237 - DNA, 18 bp, M. musculus
tgtggctgaagttgaaaa

SEQ ID NO: 449238 - DNA, 16 bp, M. musculus
tgtggctgaggatgac

SEQ ID NO: 449239 - DNA, 16 bp, M. musculus
tgtggctgagggtgac

SEQ ID NO: 449240 - DNA, 16 bp, M. musculus
tgtggctgccctggca

SEQ ID NO: 449241 - DNA, 16 bp, M. musculus
tgtggctgcccttcca

SEQ ID NO: 449242 - DNA, 16 bp, M. musculus
tgtggctgcccttgaa

SEQ ID NO: 449243 - DNA, 16 bp, M. musculus
tgtggctgccctttca

SEQ ID NO: 449244 - DNA, 16 bp, M. musculus
tgtggctgctcttgta

SEQ ID NO: 449245 - DNA, 16 bp, M. musculus
tgtggctggcttacag

SEQ ID NO: 449246 - DNA, 16 bp, M. musculus
tgtggctggcttggtg

SEQ ID NO: 449247 - DNA, 16 bp, M. musculus
tgtggctgggagtgca

SEQ ID NO: 449248 - DNA, 16 bp, M. musculus
tgtggctggtattctg

SEQ ID NO: 449249 - DNA, 16 bp, M. musculus
tgtggctgtcttcaga

SEQ ID NO: 449250 - DNA, 16 bp, M. musculus
tgtggctgtgaagaga

SEQ ID NO: 449251 - DNA, 16 bp, M. musculus
tgtggctgtggctgtg

SEQ ID NO: 449252 - DNA, 16 bp, M. musculus
tgtggctgtgggcttt

SEQ ID NO: 449253 - DNA, 16 bp, M. musculus
tgtggctgtgtgcatg

SEQ ID NO: 449254 - DNA, 16 bp, M. musculus
tgtggctgtgtggctg

SEQ ID NO: 449255 - DNA, 16 bp, M. musculus
tgtggctgtgttggag

SEQ ID NO: 449256 - DNA, 16 bp, M. musculus
tgtggcttcagtttca

SEQ ID NO: 449257 - DNA, 16 bp, M. musculus
tgtggcttcccacaag

SEQ ID NO: 449258 - DNA, 16 bp, M. musculus
tgtggcttgattttca

SEQ ID NO: 449259 - DNA, 16 bp, M. musculus
tgtggcttgctcagtt

SEQ ID NO: 449260 - DNA, 16 bp, M. musculus
tgtggcttggttggta

SEQ ID NO: 449261 - DNA, 16 bp, M. musculus
tgtggcttgtccttcc

SEQ ID NO: 449262 - DNA, 16 bp, M. musculus
tgtggctttcagtctg

SEQ ID NO: 449263 - DNA, 16 bp, M. musculus
tgtggctttgcttccc

SEQ ID NO: 449264 - DNA, 16 bp, M. musculus
tgtggctttggtctga

SEQ ID NO: 449265 - DNA, 16 bp, M. musculus
tgtggctttggtggag

SEQ ID NO: 449266 - DNA, 16 bp, M. musculus
tgtgggaaagcctggg

SEQ ID NO: 449267 - DNA, 16 bp, M. musculus
tgtgggaaaggctttg

SEQ ID NO: 449268 - DNA, 16 bp, M. musculus
tgtgggaaatatttta

SEQ ID NO: 449269 - DNA, 16 bp, M. musculus
tgtgggaacctggaag

SEQ ID NO: 449270 - DNA, 16 bp, M. musculus
tgtgggaagacccatc

SEQ ID NO: 449271 - DNA, 16 bp, M. musculus
tgtgggaagcagaaat

SEQ ID NO: 449272 - DNA, 19 bp, M. musculus
tgtgggaagccacatgtgc

SEQ ID NO: 449273 - DNA, 16 bp, M. musculus
tgtgggaagccatgga

SEQ ID NO: 449274 - DNA, 16 bp, M. musculus
tgtgggaaggcagagc

SEQ ID NO: 449275 - DNA, 18 bp, M. musculus
tgtgggaatggattttaa

SEQ ID NO: 449276 - DNA, 16 bp, M. musculus
tgtgggacagagaaca

SEQ ID NO: 449277 - DNA, 16 bp, M. musculus
tgtgggaccgtgaaag

SEQ ID NO: 449278 - DNA, 16 bp, M. musculus
tgtgggacctgagaca

SEQ ID NO: 449279 - DNA, 16 bp, M. musculus
tgtgggagctgggaac

SEQ ID NO: 449280 - DNA, 16 bp, M. musculus
tgtgggagctgtgggg

SEQ ID NO: 449281 - DNA, 16 bp, M. musculus
tgtgggaggagacaga

SEQ ID NO: 449282 - DNA, 16 bp, M. musculus
tgtgggaggaggtgac

SEQ ID NO: 449283 - DNA, 16 bp, M. musculus
tgtgggagtggccaac

SEQ ID NO: 449284 - DNA, 18 bp, M. musculus
tgtgggatgcatgtcggt

SEQ ID NO: 449285 - DNA, 16 bp, M. musculus
tgtgggatggatcccc

SEQ ID NO: 449286 - DNA, 16 bp, M. musculus
tgtgggatgtggagca

SEQ ID NO: 449287 - DNA, 16 bp, M. musculus
tgtgggcaaggaaccc

SEQ ID NO: 449288 - DNA, 16 bp, M. musculus
tgtgggcacagcacac

SEQ ID NO: 449289 - DNA, 16 bp, M. musculus
tgtgggcacatgtgca

SEQ ID NO: 449290 - DNA, 16 bp, M. musculus
tgtgggcacatgtgtg

SEQ ID NO: 449291 - DNA, 16 bp, M. musculus
tgtgggcacctgcact

SEQ ID NO: 449292 - DNA, 16 bp, M. musculus
tgtgggcagcaccatc

SEQ ID NO: 449293 - DNA, 16 bp, M. musculus
tgtgggcagcaccatt

SEQ ID NO: 449294 - DNA, 16 bp, M. musculus
tgtgggcatgggcttt

SEQ ID NO: 449295 - DNA, 16 bp, M. musculus
tgtgggcatgtctgtg

SEQ ID NO: 449296 - DNA, 16 bp, M. musculus
tgtgggccagggacag

SEQ ID NO: 449297 - DNA, 16 bp, M. musculus
tgtgggccagtgagat

SEQ ID NO: 449298 - DNA, 16 bp, M. musculus
tgtgggcctgagtacc

SEQ ID NO: 449299 - DNA, 16 bp, M. musculus
tgtgggcctgggtacc

SEQ ID NO: 449300 - DNA, 16 bp, M. musculus
tgtgggcctgtgtgtg

SEQ ID NO: 449301 - DNA, 16 bp, M. musculus
tgtgggctctctccct

SEQ ID NO: 449302 - DNA, 16 bp, M. musculus
tgtgggctctgaggat

SEQ ID NO: 449303 - DNA, 16 bp, M. musculus
tgtgggctgagaatga

SEQ ID NO: 449304 - DNA, 16 bp, M. musculus
tgtgggctggagaaat

SEQ ID NO: 449305 - DNA, 16 bp, M. musculus
tgtgggcttgcttaca

SEQ ID NO: 449306 - DNA, 16 bp, M. musculus
tgtgggctttctcttg

SEQ ID NO: 449307 - DNA, 16 bp, M. musculus
tgtggggacattttct

SEQ ID NO: 449308 - DNA, 16 bp, M. musculus
tgtggggaggcaggag

SEQ ID NO: 449309 - DNA, 16 bp, M. musculus
tgtggggagggacagg

SEQ ID NO: 449310 - DNA, 16 bp, M. musculus
tgtggggcaatgggct

SEQ ID NO: 449311 - DNA, 16 bp, M. musculus
tgtggggcagagactg

SEQ ID NO: 449312 - DNA, 16 bp, M. musculus
tgtggggccatccact

SEQ ID NO: 449313 - DNA, 16 bp, M. musculus
tgtggggctggaaaga

SEQ ID NO: 449314 - DNA, 16 bp, M. musculus
tgtggggctggctgca

SEQ ID NO: 449315 - DNA, 16 bp, M. musculus
tgtgggggctgggaat

SEQ ID NO: 449316 - DNA, 16 bp, M. musculus
tgtggggtcagcagga

SEQ ID NO: 449317 - DNA, 16 bp, M. musculus
tgtggggtccccaata

SEQ ID NO: 449318 - DNA, 16 bp, M. musculus
tgtggggtggagagtc

SEQ ID NO: 449319 - DNA, 16 bp, M. musculus
tgtgggtactgggacc

SEQ ID NO: 449320 - DNA, 16 bp, M. musculus
tgtgggtaggggcagg

SEQ ID NO: 449321 - DNA, 16 bp, M. musculus
tgtgggtatgtctgtg

SEQ ID NO: 449322 - DNA, 16 bp, M. musculus
tgtgggtcacaacctc

SEQ ID NO: 449323 - DNA, 16 bp, M. musculus
tgtgggtcatgacccc

SEQ ID NO: 449324 - DNA, 16 bp, M. musculus
tgtgggtcccagaatg

SEQ ID NO: 449325 - DNA, 16 bp, M. musculus
tgtgggtcccaggaat

SEQ ID NO: 449326 - DNA, 16 bp, M. musculus
tgtgggtcccagggat

SEQ ID NO: 449327 - DNA, 16 bp, M. musculus
tgtgggtcctgggatc

SEQ ID NO: 449328 - DNA, 16 bp, M. musculus
tgtgggtcctgggcat

SEQ ID NO: 449329 - DNA, 16 bp, M. musculus
tgtgggtcctggggat

SEQ ID NO: 449330 - DNA, 16 bp, M. musculus
tgtgggtctcagggat

SEQ ID NO: 449331 - DNA, 16 bp, M. musculus
tgtgggtctttcaata

SEQ ID NO: 449332 - DNA, 16 bp, M. musculus
tgtgggtgagctggcc

SEQ ID NO: 449333 - DNA, 16 bp, M. musculus
tgtgggtgcaggagag

SEQ ID NO: 449334 - DNA, 16 bp, M. musculus
tgtgggtgccaggaat

SEQ ID NO: 449335 - DNA, 16 bp, M. musculus
tgtgggtgctaggagc

SEQ ID NO: 449336 - DNA, 16 bp, M. musculus
tgtgggtgctgagaac

SEQ ID NO: 449337 - DNA, 16 bp, M. musculus
tgtgggtgctggaatc

SEQ ID NO: 449338 - DNA, 16 bp, M. musculus
tgtgggtgctggggac

SEQ ID NO: 449339 - DNA, 16 bp, M. musculus
tgtgggtggcatggtg

SEQ ID NO: 449340 - DNA, 16 bp, M. musculus
tgtgggtggggccacc

SEQ ID NO: 449341 - DNA, 16 bp, M. musculus
tgtgggtggggccatc

SEQ ID NO: 449342 - DNA, 16 bp, M. musculus
tgtgggtggtaccatc

SEQ ID NO: 449343 - DNA, 16 bp, M. musculus
tgtgggtggtgccaac

SEQ ID NO: 449344 - DNA, 16 bp, M. musculus
tgtgggtggtgccatc

SEQ ID NO: 449345 - DNA, 16 bp, M. musculus
tgtgggtgtgggctta

SEQ ID NO: 449346 - DNA, 16 bp, M. musculus
tgtgggtgtgtgctca

SEQ ID NO: 449347 - DNA, 16 bp, M. musculus
tgtgggtgtttcagtc

SEQ ID NO: 449348 - DNA, 16 bp, M. musculus
tgtgggttctaggaac

SEQ ID NO: 449349 - DNA, 16 bp, M. musculus
tgtgggtttcagggat

SEQ ID NO: 449350 - DNA, 16 bp, M. musculus
tgtgggtttgtgcatg

SEQ ID NO: 449351 - DNA, 16 bp, M. musculus
tgtggtaaagactttg

SEQ ID NO: 449352 - DNA, 19 bp, M. musculus
tgtggtaaagcctttgcaa

SEQ ID NO: 449353 - DNA, 19 bp, M. musculus
tgtggtaaagcctttgcat

SEQ ID NO: 449354 - DNA, 16 bp, M. musculus
tgtggtaaagctttta

SEQ ID NO: 449355 - DNA, 16 bp, M. musculus
tgtggtagaattttta

SEQ ID NO: 449356 - DNA, 16 bp, M. musculus
tgtggtagaggatggc

SEQ ID NO: 449357 - DNA, 16 bp, M. musculus
tgtggtaggatctgat

SEQ ID NO: 449358 - DNA, 18 bp, M. musculus
tgtggtattgcattattc

SEQ ID NO: 449359 - DNA, 16 bp, M. musculus
tgtggtcacctgcagc

SEQ ID NO: 449360 - DNA, 16 bp, M. musculus
tgtggtcactatgccc

SEQ ID NO: 449361 - DNA, 16 bp, M. musculus
tgtggtcagataaaaa

SEQ ID NO: 449362 - DNA, 16 bp, M. musculus
tgtggtccctgtgctc

SEQ ID NO: 449363 - DNA, 16 bp, M. musculus
tgtggtctatgaattg

SEQ ID NO: 449364 - DNA, 16 bp, M. musculus
tgtggtctctgcctca

SEQ ID NO: 449365 - DNA, 16 bp, M. musculus
tgtggtgaaagaagaa

SEQ ID NO: 449366 - DNA, 16 bp, M. musculus
tgtggtgaaagaggaa

SEQ ID NO: 449367 - DNA, 16 bp, M. musculus
tgtggtgaacttttta

SEQ ID NO: 449368 - DNA, 16 bp, M. musculus
tgtggtgacccctccc

SEQ ID NO: 449369 - DNA, 16 bp, M. musculus
tgtggtgacctccagc

SEQ ID NO: 449370 - DNA, 16 bp, M. musculus
tgtggtgatctccaac

SEQ ID NO: 449371 - DNA, 16 bp, M. musculus
tgtggtgatgcatgcc

SEQ ID NO: 449372 - DNA, 16 bp, M. musculus
tgtggtgatttgaata

SEQ ID NO: 449373 - DNA, 16 bp, M. musculus
tgtggtgcagcccttc

SEQ ID NO: 449374 - DNA, 16 bp, M. musculus
tgtggtgcagtgtgtg

SEQ ID NO: 449375 - DNA, 16 bp, M. musculus
tgtggtgcatgtacat

SEQ ID NO: 449376 - DNA, 16 bp, M. musculus
tgtggtgctggagaga

SEQ ID NO: 449377 - DNA, 16 bp, M. musculus
tgtggtgctgggattt

SEQ ID NO: 449378 - DNA, 16 bp, M. musculus
tgtggtgctggggatc

SEQ ID NO: 449379 - DNA, 16 bp, M. musculus
tgtggtggcacacatc

SEQ ID NO: 449380 - DNA, 21 bp, M. musculus
tgtggtggcacatgcctttaa

SEQ ID NO: 449381 - DNA, 16 bp, M. musculus
tgtggtggcatgtgcc

SEQ ID NO: 449382 - DNA, 16 bp, M. musculus
tgtggtggctcaggcc

SEQ ID NO: 449383 - DNA, 16 bp, M. musculus
tgtggtggcttacaac

SEQ ID NO: 449384 - DNA, 17 bp, M. musculus
tgtggtgggaaccacca

SEQ ID NO: 449385 - DNA, 16 bp, M. musculus
tgtggtggtatacacc

SEQ ID NO: 449386 - DNA, 16 bp, M. musculus
tgtggtggtgcttgcc

SEQ ID NO: 449387 - DNA, 16 bp, M. musculus
tgtggtggtttgaata

SEQ ID NO: 449388 - DNA, 16 bp, M. musculus
tgtggtggtttgaatg

SEQ ID NO: 449389 - DNA, 16 bp, M. musculus
tgtggtggtttgagta

SEQ ID NO: 449390 - DNA, 16 bp, M. musculus
tgtggtggtttggata

SEQ ID NO: 449391 - DNA, 16 bp, M. musculus
tgtggtgtccttgacc

SEQ ID NO: 449392 - DNA, 16 bp, M. musculus
tgtggtgtctgaagac

SEQ ID NO: 449393 - DNA, 16 bp, M. musculus
tgtggtgtcttcaggg

SEQ ID NO: 449394 - DNA, 16 bp, M. musculus
tgtggtgtcttcagta

SEQ ID NO: 449395 - DNA, 16 bp, M. musculus
tgtggtgtgcacacac

SEQ ID NO: 449396 - DNA, 16 bp, M. musculus
tgtggtgtgcatgtat

SEQ ID NO: 449397 - DNA, 16 bp, M. musculus
tgtggtgtgcatgtgg

SEQ ID NO: 449398 - DNA, 16 bp, M. musculus
tgtggtgtgtctctgt

SEQ ID NO: 449399 - DNA, 16 bp, M. musculus
tgtggtgtgtctgtat

SEQ ID NO: 449400 - DNA, 16 bp, M. musculus
tgtggtgtgtgtgcat

SEQ ID NO: 449401 - DNA, 16 bp, M. musculus
tgtggtgtgttgaagt

SEQ ID NO: 449402 - DNA, 16 bp, M. musculus
tgtggtgttttccttc

SEQ ID NO: 449403 - DNA, 16 bp, M. musculus
tgtggttaagtgtctc

SEQ ID NO: 449404 - DNA, 16 bp, M. musculus
tgtggttattcttttg

SEQ ID NO: 449405 - DNA, 16 bp, M. musculus
tgtggttatttctcaa

SEQ ID NO: 449406 - DNA, 16 bp, M. musculus
tgtggttcataggtat

SEQ ID NO: 449407 - DNA, 16 bp, M. musculus
tgtggttgaattagaa

SEQ ID NO: 449408 - DNA, 16 bp, M. musculus
tgtggttgaattaggg

SEQ ID NO: 449409 - DNA, 16 bp, M. musculus
tgtggttgccaacaag

SEQ ID NO: 449410 - DNA, 17 bp, M. musculus
tgtggttgctgggaatg

SEQ ID NO: 449411 - DNA, 17 bp, M. musculus
tgtggttgctgggaatt

SEQ ID NO: 449412 - DNA, 16 bp, M. musculus
tgtggttgttgggaac

SEQ ID NO: 449413 - DNA, 16 bp, M. musculus
tgtggttgtttgaatg

SEQ ID NO: 449414 - DNA, 16 bp, M. musculus
tgtggtttaaatatca

SEQ ID NO: 449415 - DNA, 16 bp, M. musculus
tgtggtttaaggaaga

SEQ ID NO: 449416 - DNA, 16 bp, M. musculus
tgtggttttatttcta

SEQ ID NO: 449417 - DNA, 16 bp, M. musculus
tgtggttttatttctg

SEQ ID NO: 449418 - DNA, 16 bp, M. musculus
tgtggttttctgtaat

SEQ ID NO: 449419 - DNA, 16 bp, M. musculus
tgtggttttctgtgat

SEQ ID NO: 449420 - DNA, 16 bp, M. musculus
tgtgtaaaatatgcac

SEQ ID NO: 449421 - DNA, 16 bp, M. musculus
tgtgtaaacaattctt

SEQ ID NO: 449422 - DNA, 16 bp, M. musculus
tgtgtaaagagtcatt

SEQ ID NO: 449423 - DNA, 16 bp, M. musculus
tgtgtaaagatattgt

SEQ ID NO: 449424 - DNA, 16 bp, M. musculus
tgtgtaaatatgtata

SEQ ID NO: 449425 - DNA, 16 bp, M. musculus
tgtgtaaatgtacatt

SEQ ID NO: 449426 - DNA, 16 bp, M. musculus
tgtgtaaatgtaccac

SEQ ID NO: 449427 - DNA, 16 bp, M. musculus
tgtgtaaatgtgccat

SEQ ID NO: 449428 - DNA, 16 bp, M. musculus
tgtgtaacagccatgg

SEQ ID NO: 449429 - DNA, 16 bp, M. musculus
tgtgtaacagccctgg

SEQ ID NO: 449430 - DNA, 16 bp, M. musculus
tgtgtaacagtttcct

SEQ ID NO: 449431 - DNA, 16 bp, M. musculus
tgtgtaactccagttc

SEQ ID NO: 449432 - DNA, 16 bp, M. musculus
tgtgtaagaaagcaga

SEQ ID NO: 449433 - DNA, 16 bp, M. musculus
tgtgtaaggcagtgac

SEQ ID NO: 449434 - DNA, 16 bp, M. musculus
tgtgtaagtatgtaag

SEQ ID NO: 449435 - DNA, 16 bp, M. musculus
tgtgtaagtgtgtgta

SEQ ID NO: 449436 - DNA, 16 bp, M. musculus
tgtgtacaagtatgtg

SEQ ID NO: 449437 - DNA, 16 bp, M. musculus
tgtgtacacacactca

SEQ ID NO: 449438 - DNA, 16 bp, M. musculus
tgtgtacacacatatg

SEQ ID NO: 449439 - DNA, 16 bp, M. musculus
tgtgtacacatgaaca

SEQ ID NO: 449440 - DNA, 16 bp, M. musculus
tgtgtacacatgtgga

SEQ ID NO: 449441 - DNA, 16 bp, M. musculus
tgtgtacataataaat

SEQ ID NO: 449442 - DNA, 16 bp, M. musculus
tgtgtacatacacaca

SEQ ID NO: 449443 - DNA, 16 bp, M. musculus
tgtgtacatatatatg

SEQ ID NO: 449444 - DNA, 16 bp, M. musculus
tgtgtacatatatatt

SEQ ID NO: 449445 - DNA, 16 bp, M. musculus
tgtgtacatatgcaca

SEQ ID NO: 449446 - DNA, 16 bp, M. musculus
tgtgtacatatgcatg

SEQ ID NO: 449447 - DNA, 16 bp, M. musculus
tgtgtacatatgtgta

SEQ ID NO: 449448 - DNA, 16 bp, M. musculus
tgtgtacatgaacaca

SEQ ID NO: 449449 - DNA, 16 bp, M. musculus
tgtgtacatgcacatg

SEQ ID NO: 449450 - DNA, 16 bp, M. musculus
tgtgtacatgcctgtg

SEQ ID NO: 449451 - DNA, 16 bp, M. musculus
tgtgtacatgtatata

SEQ ID NO: 449452 - DNA, 16 bp, M. musculus
tgtgtacatgtgtaca

SEQ ID NO: 449453 - DNA, 16 bp, M. musculus
tgtgtacatgtgtacc

SEQ ID NO: 449454 - DNA, 16 bp, M. musculus
tgtgtacatgtgtggg

SEQ ID NO: 449455 - DNA, 16 bp, M. musculus
tgtgtacatgtgtgtt

SEQ ID NO: 449456 - DNA, 16 bp, M. musculus
tgtgtacatgtgtttg

SEQ ID NO: 449457 - DNA, 16 bp, M. musculus
tgtgtacattttcatg

SEQ ID NO: 449458 - DNA, 16 bp, M. musculus
tgtgtaccatatgtgt

SEQ ID NO: 449459 - DNA, 16 bp, M. musculus
tgtgtaccatgtacat

SEQ ID NO: 449460 - DNA, 16 bp, M. musculus
tgtgtacctggtgccc

SEQ ID NO: 449461 - DNA, 16 bp, M. musculus
tgtgtacctgtacaca

SEQ ID NO: 449462 - DNA, 16 bp, M. musculus
tgtgtacctgtatgtg

SEQ ID NO: 449463 - DNA, 16 bp, M. musculus
tgtgtacctgtgtgta

SEQ ID NO: 449464 - DNA, 16 bp, M. musculus
tgtgtacgtgtctgtg

SEQ ID NO: 449465 - DNA, 16 bp, M. musculus
tgtgtacgtgtgtaca

SEQ ID NO: 449466 - DNA, 16 bp, M. musculus
tgtgtactcatgtgtg

SEQ ID NO: 449467 - DNA, 16 bp, M. musculus
tgtgtactcctggctg

SEQ ID NO: 449468 - DNA, 16 bp, M. musculus
tgtgtactctgtgtgt

SEQ ID NO: 449469 - DNA, 16 bp, M. musculus
tgtgtactctttggtt

SEQ ID NO: 449470 - DNA, 16 bp, M. musculus
tgtgtagaccaggttg

SEQ ID NO: 449471 - DNA, 16 bp, M. musculus
tgtgtagatacacaca

SEQ ID NO: 449472 - DNA, 16 bp, M. musculus
tgtgtagatattgatg

SEQ ID NO: 449473 - DNA, 16 bp, M. musculus
tgtgtagattcatttc

SEQ ID NO: 449474 - DNA, 16 bp, M. musculus
tgtgtagcaagcactt

SEQ ID NO: 449475 - DNA, 16 bp, M. musculus
tgtgtagcatgtgcat

SEQ ID NO: 449476 - DNA, 16 bp, M. musculus
tgtgtagccaaagatg

SEQ ID NO: 449477 - DNA, 16 bp, M. musculus
tgtgtagccaagggtg

SEQ ID NO: 449478 - DNA, 16 bp, M. musculus
tgtgtagcccagactg

SEQ ID NO: 449479 - DNA, 16 bp, M. musculus
tgtgtagcccagcctg

SEQ ID NO: 449480 - DNA, 16 bp, M. musculus
tgtgtagcccaggctg

SEQ ID NO: 449481 - DNA, 16 bp, M. musculus
tgtgtagccctagctg

SEQ ID NO: 449482 - DNA, 16 bp, M. musculus
tgtgtagcctgggctg

SEQ ID NO: 449483 - DNA, 16 bp, M. musculus
tgtgtagctgtggctg

SEQ ID NO: 449484 - DNA, 17 bp, M. musculus
tgtgtagcttctgtagt

SEQ ID NO: 449485 - DNA, 16 bp, M. musculus
tgtgtaggaaaaagaa

SEQ ID NO: 449486 - DNA, 16 bp, M. musculus
tgtgtagtcatggctg

SEQ ID NO: 449487 - DNA, 16 bp, M. musculus
tgtgtagtgtgtatgt

SEQ ID NO: 449488 - DNA, 16 bp, M. musculus
tgtgtagttctgactg

SEQ ID NO: 449489 - DNA, 16 bp, M. musculus
tgtgtataagtgtgtg

SEQ ID NO: 449490 - DNA, 16 bp, M. musculus
tgtgtataatgtatat

SEQ ID NO: 449491 - DNA, 16 bp, M. musculus
tgtgtatacacatata

SEQ ID NO: 449492 - DNA, 16 bp, M. musculus
tgtgtatacatatata

SEQ ID NO: 449493 - DNA, 16 bp, M. musculus
tgtgtatacatgtgta

SEQ ID NO: 449494 - DNA, 16 bp, M. musculus
tgtgtatacattatat

SEQ ID NO: 449495 - DNA, 16 bp, M. musculus
tgtgtatacctggctg

SEQ ID NO: 449496 - DNA, 16 bp, M. musculus
tgtgtataggtatttt

SEQ ID NO: 449497 - DNA, 16 bp, M. musculus
tgtgtataggtcagag

SEQ ID NO: 449498 - DNA, 16 bp, M. musculus
tgtgtatagttgtgtg

SEQ ID NO: 449499 - DNA, 16 bp, M. musculus
tgtgtatatatacata

SEQ ID NO: 449500 - DNA, 17 bp, M. musculus
tgtgtatatatacatat

SEQ ID NO: 449501 - DNA, 16 bp, M. musculus
tgtgtatatatatata

SEQ ID NO: 449502 - DNA, 16 bp, M. musculus
tgtgtatatatctata

SEQ ID NO: 449503 - DNA, 16 bp, M. musculus
tgtgtatatatgcaca

SEQ ID NO: 449504 - DNA, 16 bp, M. musculus
tgtgtatatatgtata

SEQ ID NO: 449505 - DNA, 16 bp, M. musculus
tgtgtatatatgtttg

SEQ ID NO: 449506 - DNA, 16 bp, M. musculus
tgtgtatatgcaaaat

SEQ ID NO: 449507 - DNA, 16 bp, M. musculus
tgtgtatatgcacatg

SEQ ID NO: 449508 - DNA, 16 bp, M. musculus
tgtgtatatgtataca

SEQ ID NO: 449509 - DNA, 18 bp, M. musculus
tgtgtatatgtatatata

SEQ ID NO: 449510 - DNA, 16 bp, M. musculus
tgtgtatatgtgggtg

SEQ ID NO: 449511 - DNA, 16 bp, M. musculus
tgtgtatatgtggtgt

SEQ ID NO: 449512 - DNA, 16 bp, M. musculus
tgtgtatatgtgtgtg

SEQ ID NO: 449513 - DNA, 16 bp, M. musculus
tgtgtatattgtatgt

SEQ ID NO: 449514 - DNA, 16 bp, M. musculus
tgtgtatatttgtata

SEQ ID NO: 449515 - DNA, 16 bp, M. musculus
tgtgtatcatgtgtat

SEQ ID NO: 449516 - DNA, 16 bp, M. musculus
tgtgtatctgtatata

SEQ ID NO: 449517 - DNA, 16 bp, M. musculus
tgtgtatctgtctatg

SEQ ID NO: 449518 - DNA, 16 bp, M. musculus
tgtgtatctgtctgtg

SEQ ID NO: 449519 - DNA, 16 bp, M. musculus
tgtgtatctgtgcatg

SEQ ID NO: 449520 - DNA, 16 bp, M. musculus
tgtgtatgaatatgtg

SEQ ID NO: 449521 - DNA, 16 bp, M. musculus
tgtgtatgaatatttg

SEQ ID NO: 449522 - DNA, 16 bp, M. musculus
tgtgtatgaatgtgtg

SEQ ID NO: 449523 - DNA, 16 bp, M. musculus
tgtgtatgagaaagag

SEQ ID NO: 449524 - DNA, 16 bp, M. musculus
tgtgtatgaggtgtgt

SEQ ID NO: 449525 - DNA, 16 bp, M. musculus
tgtgtatgagtgcagg

SEQ ID NO: 449526 - DNA, 16 bp, M. musculus
tgtgtatgcacatgga

SEQ ID NO: 449527 - DNA, 16 bp, M. musculus
tgtgtatgcagatgtg

SEQ ID NO: 449528 - DNA, 16 bp, M. musculus
tgtgtatgcatacata

SEQ ID NO: 449529 - DNA, 16 bp, M. musculus
tgtgtatgcatacatg

SEQ ID NO: 449530 - DNA, 16 bp, M. musculus
tgtgtatgcatatgta

SEQ ID NO: 449531 - DNA, 16 bp, M. musculus
tgtgtatgcatgtgca

SEQ ID NO: 449532 - DNA, 16 bp, M. musculus
tgtgtatgcatgtgtg

SEQ ID NO: 449533 - DNA, 16 bp, M. musculus
tgtgtatgcatgtttt

SEQ ID NO: 449534 - DNA, 16 bp, M. musculus
tgtgtatgcatttatg

SEQ ID NO: 449535 - DNA, 16 bp, M. musculus
tgtgtatgccaagaag

SEQ ID NO: 449536 - DNA, 16 bp, M. musculus
tgtgtatgctctttga

SEQ ID NO: 449537 - DNA, 16 bp, M. musculus
tgtgtatgctgtgtgt

SEQ ID NO: 449538 - DNA, 16 bp, M. musculus
tgtgtatggacatgtg

SEQ ID NO: 449539 - DNA, 16 bp, M. musculus
tgtgtatggagagctg

SEQ ID NO: 449540 - DNA, 16 bp, M. musculus
tgtgtatggctgtttt

SEQ ID NO: 449541 - DNA, 16 bp, M. musculus
tgtgtatggtatgtat

SEQ ID NO: 449542 - DNA, 16 bp, M. musculus
tgtgtatgtacatgtg

SEQ ID NO: 449543 - DNA, 16 bp, M. musculus
tgtgtatgtatatctg

SEQ ID NO: 449544 - DNA, 16 bp, M. musculus
tgtgtatgtatatgtt

SEQ ID NO: 449545 - DNA, 16 bp, M. musculus
tgtgtatgtatgcata

SEQ ID NO: 449546 - DNA, 16 bp, M. musculus
tgtgtatgtatgtgca

SEQ ID NO: 449547 - DNA, 16 bp, M. musculus
tgtgtatgtcagagga

SEQ ID NO: 449548 - DNA, 16 bp, M. musculus
tgtgtatgtccctgtg

SEQ ID NO: 449549 - DNA, 16 bp, M. musculus
tgtgtatgtctataca

SEQ ID NO: 449550 - DNA, 16 bp, M. musculus
tgtgtatgtctgcatg

SEQ ID NO: 449551 - DNA, 16 bp, M. musculus
tgtgtatgtctgtctg

SEQ ID NO: 449552 - DNA, 16 bp, M. musculus
tgtgtatgtctgtggg

SEQ ID NO: 449553 - DNA, 16 bp, M. musculus
tgtgtatgtctgtgtg

SEQ ID NO: 449554 - DNA, 16 bp, M. musculus
tgtgtatgtgaaagtg

SEQ ID NO: 449555 - DNA, 16 bp, M. musculus
tgtgtatgtgagtgag

SEQ ID NO: 449556 - DNA, 16 bp, M. musculus
tgtgtatgtgcacatg

SEQ ID NO: 449557 - DNA, 16 bp, M. musculus
tgtgtatgtgcatgca

SEQ ID NO: 449558 - DNA, 16 bp, M. musculus
tgtgtatgtgcctgtg

SEQ ID NO: 449559 - DNA, 16 bp, M. musculus
tgtgtatgtgcgcgcg

SEQ ID NO: 449560 - DNA, 16 bp, M. musculus
tgtgtatgtgcgtgcg

SEQ ID NO: 449561 - DNA, 16 bp, M. musculus
tgtgtatgtgtacatg

SEQ ID NO: 449562 - DNA, 16 bp, M. musculus
tgtgtatgtgtagata

SEQ ID NO: 449563 - DNA, 16 bp, M. musculus
tgtgtatgtgtataaa

SEQ ID NO: 449564 - DNA, 16 bp, M. musculus
tgtgtatgtgtccatg

SEQ ID NO: 449565 - DNA, 16 bp, M. musculus
tgtgtatgtgtctgag

SEQ ID NO: 449566 - DNA, 16 bp, M. musculus
tgtgtatgtgtctgtg

SEQ ID NO: 449567 - DNA, 16 bp, M. musculus
tgtgtatgtgtgagaa

SEQ ID NO: 449568 - DNA, 16 bp, M. musculus
tgtgtatgtgtgtgag

SEQ ID NO: 449569 - DNA, 16 bp, M. musculus
tgtgtatgtgtgtgca

SEQ ID NO: 449570 - DNA, 16 bp, M. musculus
tgtgtatgtgtgtgga

SEQ ID NO: 449571 - DNA, 16 bp, M. musculus
tgtgtatgtgtgtgta

SEQ ID NO: 449572 - DNA, 16 bp, M. musculus
tgtgtatgtgtgtgtc

SEQ ID NO: 449573 - DNA, 16 bp, M. musculus
tgtgtatgtgtttaga

SEQ ID NO: 449574 - DNA, 16 bp, M. musculus
tgtgtatgtgtttgaa

SEQ ID NO: 449575 - DNA, 16 bp, M. musculus
tgtgtatgtgtttgca

SEQ ID NO: 449576 - DNA, 16 bp, M. musculus
tgtgtatgtttgtata

SEQ ID NO: 449577 - DNA, 16 bp, M. musculus
tgtgtattatgtgtat

SEQ ID NO: 449578 - DNA, 16 bp, M. musculus
tgtgtattctgtattt

SEQ ID NO: 449579 - DNA, 16 bp, M. musculus
tgtgtattcttgtgtg

SEQ ID NO: 449580 - DNA, 16 bp, M. musculus
tgtgtatttatataca

SEQ ID NO: 449581 - DNA, 16 bp, M. musculus
tgtgtatttatgtgta

SEQ ID NO: 449582 - DNA, 16 bp, M. musculus
tgtgtatttattttca

SEQ ID NO: 449583 - DNA, 17 bp, M. musculus
tgtgtcaacttgacaca

SEQ ID NO: 449584 - DNA, 16 bp, M. musculus
tgtgtcaacttgacat

SEQ ID NO: 449585 - DNA, 16 bp, M. musculus
tgtgtcaagctgacaa

SEQ ID NO: 449586 - DNA, 16 bp, M. musculus
tgtgtcaagttgacaa

SEQ ID NO: 449587 - DNA, 17 bp, M. musculus
tgtgtcaagttgacaca

SEQ ID NO: 449588 - DNA, 16 bp, M. musculus
tgtgtcaagttgacag

SEQ ID NO: 449589 - DNA, 16 bp, M. musculus
tgtgtcaagttgacat

SEQ ID NO: 449590 - DNA, 16 bp, M. musculus
tgtgtcaatctcttct

SEQ ID NO: 449591 - DNA, 16 bp, M. musculus
tgtgtcacagtgcaca

SEQ ID NO: 449592 - DNA, 16 bp, M. musculus
tgtgtcaccacatcca

SEQ ID NO: 449593 - DNA, 16 bp, M. musculus
tgtgtcaccacatctg

SEQ ID NO: 449594 - DNA, 16 bp, M. musculus
tgtgtcaccaccaccc

SEQ ID NO: 449595 - DNA, 16 bp, M. musculus
tgtgtcaccatacctg

SEQ ID NO: 449596 - DNA, 16 bp, M. musculus
tgtgtcactgcaggcc

SEQ ID NO: 449597 - DNA, 16 bp, M. musculus
tgtgtcactgggtgtg

SEQ ID NO: 449598 - DNA, 16 bp, M. musculus
tgtgtcagaagatagc

SEQ ID NO: 449599 - DNA, 16 bp, M. musculus
tgtgtcagagttcctg

SEQ ID NO: 449600 - DNA, 16 bp, M. musculus
tgtgtcagagtttttg

SEQ ID NO: 449601 - DNA, 16 bp, M. musculus
tgtgtccacttccctt

SEQ ID NO: 449602 - DNA, 16 bp, M. musculus
tgtgtccagaaaacac

SEQ ID NO: 449603 - DNA, 16 bp, M. musculus
tgtgtccatgcacaca

SEQ ID NO: 449604 - DNA, 16 bp, M. musculus
tgtgtccatgctttct

SEQ ID NO: 449605 - DNA, 16 bp, M. musculus
tgtgtccatgttcttt

SEQ ID NO: 449606 - DNA, 16 bp, M. musculus
tgtgtccattcttctg

SEQ ID NO: 449607 - DNA, 16 bp, M. musculus
tgtgtccatttctctg

SEQ ID NO: 449608 - DNA, 16 bp, M. musculus
tgtgtcccaccatgtg

SEQ ID NO: 449609 - DNA, 16 bp, M. musculus
tgtgtcccagatttcc

SEQ ID NO: 449610 - DNA, 16 bp, M. musculus
tgtgtcccaggctgac

SEQ ID NO: 449611 - DNA, 16 bp, M. musculus
tgtgtcccatgtgtgt

SEQ ID NO: 449612 - DNA, 16 bp, M. musculus
tgtgtccccacccaca

SEQ ID NO: 449613 - DNA, 16 bp, M. musculus
tgtgtcccccatggca

SEQ ID NO: 449614 - DNA, 16 bp, M. musculus
tgtgtccctggctgtc

SEQ ID NO: 449615 - DNA, 16 bp, M. musculus
tgtgtccctgtgtgtc

SEQ ID NO: 449616 - DNA, 16 bp, M. musculus
tgtgtccctgttaagt

SEQ ID NO: 449617 - DNA, 16 bp, M. musculus
tgtgtcctatatttcc

SEQ ID NO: 449618 - DNA, 17 bp, M. musculus
tgtgtcctggacttcct

SEQ ID NO: 449619 - DNA, 16 bp, M. musculus
tgtgtcctggagttcc

SEQ ID NO: 449620 - DNA, 17 bp, M. musculus
tgtgtcctggatttcct

SEQ ID NO: 449621 - DNA, 16 bp, M. musculus
tgtgtcctgtgtcctg

SEQ ID NO: 449622 - DNA, 16 bp, M. musculus
tgtgtcctgtttacat

SEQ ID NO: 449623 - DNA, 18 bp, M. musculus
tgtgtccttcataccggt

SEQ ID NO: 449624 - DNA, 16 bp, M. musculus
tgtgtccttgctatat

SEQ ID NO: 449625 - DNA, 16 bp, M. musculus
tgtgtccttgttttat

SEQ ID NO: 449626 - DNA, 16 bp, M. musculus
tgtgtcctttaaaaaa

SEQ ID NO: 449627 - DNA, 16 bp, M. musculus
tgtgtcctttgtcatc

SEQ ID NO: 449628 - DNA, 16 bp, M. musculus
tgtgtctactattatt

SEQ ID NO: 449629 - DNA, 16 bp, M. musculus
tgtgtctatatgtata

SEQ ID NO: 449630 - DNA, 16 bp, M. musculus
tgtgtctatgtgtatg

SEQ ID NO: 449631 - DNA, 16 bp, M. musculus
tgtgtctcattagaaa

SEQ ID NO: 449632 - DNA, 16 bp, M. musculus
tgtgtctcccagcctc

SEQ ID NO: 449633 - DNA, 17 bp, M. musculus
tgtgtctctctctgtct

SEQ ID NO: 449634 - DNA, 16 bp, M. musculus
tgtgtctctgcatcta

SEQ ID NO: 449635 - DNA, 16 bp, M. musculus
tgtgtctctgtctctg

SEQ ID NO: 449636 - DNA, 16 bp, M. musculus
tgtgtctctgtgtata

SEQ ID NO: 449637 - DNA, 16 bp, M. musculus
tgtgtctctgtgtggt

SEQ ID NO: 449638 - DNA, 16 bp, M. musculus
tgtgtctctgtttact

SEQ ID NO: 449639 - DNA, 16 bp, M. musculus
tgtgtctgaagaaagc

SEQ ID NO: 449640 - DNA, 16 bp, M. musculus
tgtgtctgaagacaaa

SEQ ID NO: 449641 - DNA, 17 bp, M. musculus
tgtgtctgaagacagca

SEQ ID NO: 449642 - DNA, 16 bp, M. musculus
tgtgtctgaagacagg

SEQ ID NO: 449643 - DNA, 16 bp, M. musculus
tgtgtctgaagacagt

SEQ ID NO: 449644 - DNA, 16 bp, M. musculus
tgtgtctgaagataac

SEQ ID NO: 449645 - DNA, 16 bp, M. musculus
tgtgtctgaagtgtgt

SEQ ID NO: 449646 - DNA, 16 bp, M. musculus
tgtgtctgagacagct

SEQ ID NO: 449647 - DNA, 17 bp, M. musculus
tgtgtctgaggacagct

SEQ ID NO: 449648 - DNA, 16 bp, M. musculus
tgtgtctgagtgtggg

SEQ ID NO: 449649 - DNA, 16 bp, M. musculus
tgtgtctgcatctgtg

SEQ ID NO: 449650 - DNA, 16 bp, M. musculus
tgtgtctgccaatgtt

SEQ ID NO: 449651 - DNA, 16 bp, M. musculus
tgtgtctgcttctgtg

SEQ ID NO: 449652 - DNA, 23 bp, M. musculus
tgtgtctggatctgttggtttct

SEQ ID NO: 449653 - DNA, 16 bp, M. musculus
tgtgtctggattacct

SEQ ID NO: 449654 - DNA, 16 bp, M. musculus
tgtgtctgggttacct

SEQ ID NO: 449655 - DNA, 16 bp, M. musculus
tgtgtctggtgtgtct

SEQ ID NO: 449656 - DNA, 16 bp, M. musculus
tgtgtctgtatgcaca

SEQ ID NO: 449657 - DNA, 16 bp, M. musculus
tgtgtctgtatgtctg

SEQ ID NO: 449658 - DNA, 16 bp, M. musculus
tgtgtctgtctcctca

SEQ ID NO: 449659 - DNA, 16 bp, M. musculus
tgtgtctgtctgcctg

SEQ ID NO: 449660 - DNA, 16 bp, M. musculus
tgtgtctgtctgtctt

SEQ ID NO: 449661 - DNA, 16 bp, M. musculus
tgtgtctgtgaatata

SEQ ID NO: 449662 - DNA, 16 bp, M. musculus
tgtgtctgtgagcatg

SEQ ID NO: 449663 - DNA, 16 bp, M. musculus
tgtgtctgtgcatcac

SEQ ID NO: 449664 - DNA, 16 bp, M. musculus
tgtgtctgtgcatgtg

SEQ ID NO: 449665 - DNA, 16 bp, M. musculus
tgtgtctgtgcctgtg

SEQ ID NO: 449666 - DNA, 16 bp, M. musculus
tgtgtctgtggtatat

SEQ ID NO: 449667 - DNA, 16 bp, M. musculus
tgtgtctgtgtaagta

SEQ ID NO: 449668 - DNA, 16 bp, M. musculus
tgtgtctgtgtatatg

SEQ ID NO: 449669 - DNA, 16 bp, M. musculus
tgtgtctgtgtatgcc

SEQ ID NO: 449670 - DNA, 16 bp, M. musculus
tgtgtctgtgtatgta

SEQ ID NO: 449671 - DNA, 16 bp, M. musculus
tgtgtctgtgtcagtg

SEQ ID NO: 449672 - DNA, 17 bp, M. musculus
tgtgtctgtgtctgtgt

SEQ ID NO: 449673 - DNA, 21 bp, M. musculus
tgtgtctgtgtctgtgtctgt

SEQ ID NO: 449674 - DNA, 16 bp, M. musculus
tgtgtctgtgtgcaca

SEQ ID NO: 449675 - DNA, 16 bp, M. musculus
tgtgtctgtgtgcatg

SEQ ID NO: 449676 - DNA, 16 bp, M. musculus
tgtgtctgtgtgtaca

SEQ ID NO: 449677 - DNA, 16 bp, M. musculus
tgtgtctgtgtgtata

SEQ ID NO: 449678 - DNA, 16 bp, M. musculus
tgtgtctgtgtgtcct

SEQ ID NO: 449679 - DNA, 16 bp, M. musculus
tgtgtctgtgtgtctc

SEQ ID NO: 449680 - DNA, 22 bp, M. musculus
tgtgtctgtgtgtctgtgtctg

SEQ ID NO: 449681 - DNA, 16 bp, M. musculus
tgtgtctgtgtgtgta

SEQ ID NO: 449682 - DNA, 16 bp, M. musculus
tgtgtctgtgttcatt

SEQ ID NO: 449683 - DNA, 16 bp, M. musculus
tgtgtctgtgtttgta

SEQ ID NO: 449684 - DNA, 16 bp, M. musculus
tgtgtctgttctcagc

SEQ ID NO: 449685 - DNA, 16 bp, M. musculus
tgtgtctgttgaggct

SEQ ID NO: 449686 - DNA, 16 bp, M. musculus
tgtgtctgttgtatgt

SEQ ID NO: 449687 - DNA, 28 bp, M. musculus
tgtgtcttagtcagggtttctattcctg

SEQ ID NO: 449688 - DNA, 16 bp, M. musculus
tgtgtcttgcctcagc

SEQ ID NO: 449689 - DNA, 16 bp, M. musculus
tgtgtcttgtctgtct

SEQ ID NO: 449690 - DNA, 16 bp, M. musculus
tgtgtcttgtgaggct

SEQ ID NO: 449691 - DNA, 16 bp, M. musculus
tgtgtctttaaaaata

SEQ ID NO: 449692 - DNA, 16 bp, M. musculus
tgtgtctttatgtggt

SEQ ID NO: 449693 - DNA, 16 bp, M. musculus
tgtgtctttattacca

SEQ ID NO: 449694 - DNA, 16 bp, M. musculus
tgtgtctttctctgtc

SEQ ID NO: 449695 - DNA, 16 bp, M. musculus
tgtgtcttttatccag

SEQ ID NO: 449696 - DNA, 16 bp, M. musculus
tgtgtctttttaaaat

SEQ ID NO: 449697 - DNA, 16 bp, M. musculus
tgtgtgaaaatgtgtg

SEQ ID NO: 449698 - DNA, 16 bp, M. musculus
tgtgtgaaagtgtgtg

SEQ ID NO: 449699 - DNA, 16 bp, M. musculus
tgtgtgaaattgtcaa

SEQ ID NO: 449700 - DNA, 16 bp, M. musculus
tgtgtgaacacacaca

SEQ ID NO: 449701 - DNA, 16 bp, M. musculus
tgtgtgaacacacatg

SEQ ID NO: 449702 - DNA, 16 bp, M. musculus
tgtgtgaagccctggg

SEQ ID NO: 449703 - DNA, 16 bp, M. musculus
tgtgtgaaggtcaaag

SEQ ID NO: 449704 - DNA, 16 bp, M. musculus
tgtgtgaatacacatg

SEQ ID NO: 449705 - DNA, 16 bp, M. musculus
tgtgtgaatatgtaca

SEQ ID NO: 449706 - DNA, 16 bp, M. musculus
tgtgtgaatatgtgtg

SEQ ID NO: 449707 - DNA, 16 bp, M. musculus
tgtgtgaatgtacatg

SEQ ID NO: 449708 - DNA, 16 bp, M. musculus
tgtgtgaatgtggagg

SEQ ID NO: 449709 - DNA, 16 bp, M. musculus
tgtgtgaattcctgtc

SEQ ID NO: 449710 - DNA, 16 bp, M. musculus
tgtgtgaatttggtct

SEQ ID NO: 449711 - DNA, 16 bp, M. musculus
tgtgtgacaagcattt

SEQ ID NO: 449712 - DNA, 16 bp, M. musculus
tgtgtgacagagagac

SEQ ID NO: 449713 - DNA, 16 bp, M. musculus
tgtgtgaccttggaca

SEQ ID NO: 449714 - DNA, 16 bp, M. musculus
tgtgtgaccttgggaa

SEQ ID NO: 449715 - DNA, 16 bp, M. musculus
tgtgtgacttcactga

SEQ ID NO: 449716 - DNA, 16 bp, M. musculus
tgtgtgacttttcctg

SEQ ID NO: 449717 - DNA, 16 bp, M. musculus
tgtgtgacttttggaa

SEQ ID NO: 449718 - DNA, 16 bp, M. musculus
tgtgtgagagagaggt

SEQ ID NO: 449719 - DNA, 16 bp, M. musculus
tgtgtgagagagagta

SEQ ID NO: 449720 - DNA, 16 bp, M. musculus
tgtgtgagagtgtgag

SEQ ID NO: 449721 - DNA, 16 bp, M. musculus
tgtgtgagcacacaca

SEQ ID NO: 449722 - DNA, 16 bp, M. musculus
tgtgtgagcatccact

SEQ ID NO: 449723 - DNA, 16 bp, M. musculus
tgtgtgagcatctgtg

SEQ ID NO: 449724 - DNA, 16 bp, M. musculus
tgtgtgagcgtgtgtg

SEQ ID NO: 449725 - DNA, 16 bp, M. musculus
tgtgtgaggacctgag

SEQ ID NO: 449726 - DNA, 16 bp, M. musculus
tgtgtgaggcaggggg

SEQ ID NO: 449727 - DNA, 16 bp, M. musculus
tgtgtgaggctctggg

SEQ ID NO: 449728 - DNA, 16 bp, M. musculus
tgtgtgagtatctgtg

SEQ ID NO: 449729 - DNA, 16 bp, M. musculus
tgtgtgagtatgtatg

SEQ ID NO: 449730 - DNA, 16 bp, M. musculus
tgtgtgagtctgtctg

SEQ ID NO: 449731 - DNA, 16 bp, M. musculus
tgtgtgagtgagtatg

SEQ ID NO: 449732 - DNA, 16 bp, M. musculus
tgtgtgagtgagtgat

SEQ ID NO: 449733 - DNA, 16 bp, M. musculus
tgtgtgagtgcatgca

SEQ ID NO: 449734 - DNA, 16 bp, M. musculus
tgtgtgagtgcgtgtg

SEQ ID NO: 449735 - DNA, 16 bp, M. musculus
tgtgtgagtgtgaata

SEQ ID NO: 449736 - DNA, 16 bp, M. musculus
tgtgtgagtgtgagca

SEQ ID NO: 449737 - DNA, 19 bp, M. musculus
tgtgtgagtgtgagtgtgt

SEQ ID NO: 449738 - DNA, 16 bp, M. musculus
tgtgtgagtgtgcatg

SEQ ID NO: 449739 - DNA, 16 bp, M. musculus
tgtgtgagtgtgtgcg

SEQ ID NO: 449740 - DNA, 16 bp, M. musculus
tgtgtgatcttgggca

SEQ ID NO: 449741 - DNA, 16 bp, M. musculus
tgtgtgatgctgggga

SEQ ID NO: 449742 - DNA, 16 bp, M. musculus
tgtgtgatggcaaccc

SEQ ID NO: 449743 - DNA, 16 bp, M. musculus
tgtgtgatggtttgaa

SEQ ID NO: 449744 - DNA, 16 bp, M. musculus
tgtgtgatgtgtggta

SEQ ID NO: 449745 - DNA, 16 bp, M. musculus
tgtgtgatgtgtgtgc

SEQ ID NO: 449746 - DNA, 16 bp, M. musculus
tgtgtgatgtttggaa

SEQ ID NO: 449747 - DNA, 16 bp, M. musculus
tgtgtgcaaatatgtg

SEQ ID NO: 449748 - DNA, 16 bp, M. musculus
tgtgtgcaagctttca

SEQ ID NO: 449749 - DNA, 16 bp, M. musculus
tgtgtgcaagtgtgca

SEQ ID NO: 449750 - DNA, 16 bp, M. musculus
tgtgtgcaagtgtgtg

SEQ ID NO: 449751 - DNA, 16 bp, M. musculus
tgtgtgcacacacata

SEQ ID NO: 449752 - DNA, 16 bp, M. musculus
tgtgtgcacacgcgcg

SEQ ID NO: 449753 - DNA, 16 bp, M. musculus
tgtgtgcacactcaca

SEQ ID NO: 449754 - DNA, 16 bp, M. musculus
tgtgtgcacaggcatg

SEQ ID NO: 449755 - DNA, 16 bp, M. musculus
tgtgtgcacaggtgtg

SEQ ID NO: 449756 - DNA, 16 bp, M. musculus
tgtgtgcacagtgtgt

SEQ ID NO: 449757 - DNA, 16 bp, M. musculus
tgtgtgcacatatgca

SEQ ID NO: 449758 - DNA, 16 bp, M. musculus
tgtgtgcacatatgtg

SEQ ID NO: 449759 - DNA, 16 bp, M. musculus
tgtgtgcacatgcata

SEQ ID NO: 449760 - DNA, 16 bp, M. musculus
tgtgtgcacatgtatg

SEQ ID NO: 449761 - DNA, 16 bp, M. musculus
tgtgtgcaccacatgc

SEQ ID NO: 449762 - DNA, 16 bp, M. musculus
tgtgtgcacctgtgca

SEQ ID NO: 449763 - DNA, 16 bp, M. musculus
tgtgtgcacgcgcgca

SEQ ID NO: 449764 - DNA, 16 bp, M. musculus
tgtgtgcacgtgtatg

SEQ ID NO: 449765 - DNA, 16 bp, M. musculus
tgtgtgcactcacaca

SEQ ID NO: 449766 - DNA, 16 bp, M. musculus
tgtgtgcacttgtgca

SEQ ID NO: 449767 - DNA, 16 bp, M. musculus
tgtgtgcagaggccag

SEQ ID NO: 449768 - DNA, 16 bp, M. musculus
tgtgtgcagctgtgtg

SEQ ID NO: 449769 - DNA, 16 bp, M. musculus
tgtgtgcagggctgtg

SEQ ID NO: 449770 - DNA, 16 bp, M. musculus
tgtgtgcagtgtatgt

SEQ ID NO: 449771 - DNA, 16 bp, M. musculus
tgtgtgcagtgtgtgt

SEQ ID NO: 449772 - DNA, 16 bp, M. musculus
tgtgtgcatacgtgca

SEQ ID NO: 449773 - DNA, 16 bp, M. musculus
tgtgtgcatataaatg

SEQ ID NO: 449774 - DNA, 16 bp, M. musculus
tgtgtgcatatcatgt

SEQ ID NO: 449775 - DNA, 16 bp, M. musculus
tgtgtgcatatgcgtg

SEQ ID NO: 449776 - DNA, 16 bp, M. musculus
tgtgtgcatatgtatg

SEQ ID NO: 449777 - DNA, 16 bp, M. musculus
tgtgtgcatatgtgca

SEQ ID NO: 449778 - DNA, 16 bp, M. musculus
tgtgtgcatatgtgtg

SEQ ID NO: 449779 - DNA, 16 bp, M. musculus
tgtgtgcatctctgtg

SEQ ID NO: 449780 - DNA, 16 bp, M. musculus
tgtgtgcatctgtgca

SEQ ID NO: 449781 - DNA, 16 bp, M. musculus
tgtgtgcatctgtgtg

SEQ ID NO: 449782 - DNA, 16 bp, M. musculus
tgtgtgcatgagaatg

SEQ ID NO: 449783 - DNA, 16 bp, M. musculus
tgtgtgcatgagagag

SEQ ID NO: 449784 - DNA, 16 bp, M. musculus
tgtgtgcatgcacaag

SEQ ID NO: 449785 - DNA, 16 bp, M. musculus
tgtgtgcatgcacaca

SEQ ID NO: 449786 - DNA, 16 bp, M. musculus
tgtgtgcatgcacacg

SEQ ID NO: 449787 - DNA, 16 bp, M. musculus
tgtgtgcatgcacatg

SEQ ID NO: 449788 - DNA, 16 bp, M. musculus
tgtgtgcatgcaggtg

SEQ ID NO: 449789 - DNA, 16 bp, M. musculus
tgtgtgcatgcatatg

SEQ ID NO: 449790 - DNA, 16 bp, M. musculus
tgtgtgcatgcctctg

SEQ ID NO: 449791 - DNA, 16 bp, M. musculus
tgtgtgcatgggcatg

SEQ ID NO: 449792 - DNA, 16 bp, M. musculus
tgtgtgcatgtaagca

SEQ ID NO: 449793 - DNA, 16 bp, M. musculus
tgtgtgcatgtacata

SEQ ID NO: 449794 - DNA, 16 bp, M. musculus
tgtgtgcatgtctgtg

SEQ ID NO: 449795 - DNA, 16 bp, M. musculus
tgtgtgcatgtgagag

SEQ ID NO: 449796 - DNA, 16 bp, M. musculus
tgtgtgcatgtgagca

SEQ ID NO: 449797 - DNA, 16 bp, M. musculus
tgtgtgcatgtgcatg

SEQ ID NO: 449798 - DNA, 16 bp, M. musculus
tgtgtgcatgtggata

SEQ ID NO: 449799 - DNA, 16 bp, M. musculus
tgtgtgcatgtgtaag

SEQ ID NO: 449800 - DNA, 16 bp, M. musculus
tgtgtgcatgtgtaca

SEQ ID NO: 449801 - DNA, 16 bp, M. musculus
tgtgtgcatgtgtata

SEQ ID NO: 449802 - DNA, 16 bp, M. musculus
tgtgtgcatgtgtatg

SEQ ID NO: 449803 - DNA, 16 bp, M. musculus
tgtgtgcatgtgtgca

SEQ ID NO: 449804 - DNA, 16 bp, M. musculus
tgtgtgcatgtgtgcc

SEQ ID NO: 449805 - DNA, 16 bp, M. musculus
tgtgtgcatgtgtgtc

SEQ ID NO: 449806 - DNA, 16 bp, M. musculus
tgtgtgcatgtgtgtg

SEQ ID NO: 449807 - DNA, 16 bp, M. musculus
tgtgtgcatgtgtgtt

SEQ ID NO: 449808 - DNA, 16 bp, M. musculus
tgtgtgcatgtttaca

SEQ ID NO: 449809 - DNA, 16 bp, M. musculus
tgtgtgcattcacaca

SEQ ID NO: 449810 - DNA, 16 bp, M. musculus
tgtgtgcattcctgtg

SEQ ID NO: 449811 - DNA, 16 bp, M. musculus
tgtgtgccaccacact

SEQ ID NO: 449812 - DNA, 16 bp, M. musculus
tgtgtgccaccacatc

SEQ ID NO: 449813 - DNA, 16 bp, M. musculus
tgtgtgccaccactgc

SEQ ID NO: 449814 - DNA, 16 bp, M. musculus
tgtgtgccaccatgct

SEQ ID NO: 449815 - DNA, 16 bp, M. musculus
tgtgtgccatcatgtc

SEQ ID NO: 449816 - DNA, 16 bp, M. musculus
tgtgtgccatgtgcat

SEQ ID NO: 449817 - DNA, 16 bp, M. musculus
tgtgtgccatgtgtgt

SEQ ID NO: 449818 - DNA, 16 bp, M. musculus
tgtgtgccctggtaca

SEQ ID NO: 449819 - DNA, 16 bp, M. musculus
tgtgtgcctcagtttc

SEQ ID NO: 449820 - DNA, 16 bp, M. musculus
tgtgtgcctgcctgcc

SEQ ID NO: 449821 - DNA, 16 bp, M. musculus
tgtgtgcctgctgccc

SEQ ID NO: 449822 - DNA, 16 bp, M. musculus
tgtgtgcctggtgccc

SEQ ID NO: 449823 - DNA, 16 bp, M. musculus
tgtgtgcctggtggct

SEQ ID NO: 449824 - DNA, 16 bp, M. musculus
tgtgtgcctggtgtct

SEQ ID NO: 449825 - DNA, 16 bp, M. musculus
tgtgtgcctggttcct

SEQ ID NO: 449826 - DNA, 16 bp, M. musculus
tgtgtgcctgtgcctg

SEQ ID NO: 449827 - DNA, 16 bp, M. musculus
tgtgtgcctgtgttta

SEQ ID NO: 449828 - DNA, 16 bp, M. musculus
tgtgtgccttgagctt

SEQ ID NO: 449829 - DNA, 16 bp, M. musculus
tgtgtgcgcacacgtg

SEQ ID NO: 449830 - DNA, 16 bp, M. musculus
tgtgtgcgcatgcatg

SEQ ID NO: 449831 - DNA, 16 bp, M. musculus
tgtgtgcgcatgtgca

SEQ ID NO: 449832 - DNA, 16 bp, M. musculus
tgtgtgcgcatgtgtg

SEQ ID NO: 449833 - DNA, 16 bp, M. musculus
tgtgtgcgcgcgcata

SEQ ID NO: 449834 - DNA, 16 bp, M. musculus
tgtgtgcgtgcataca

SEQ ID NO: 449835 - DNA, 16 bp, M. musculus
tgtgtgcgtgcgcgca

SEQ ID NO: 449836 - DNA, 16 bp, M. musculus
tgtgtgcgtgcgtgta

SEQ ID NO: 449837 - DNA, 16 bp, M. musculus
tgtgtgcgtgtgaatg

SEQ ID NO: 449838 - DNA, 16 bp, M. musculus
tgtgtgcgtgtgcatg

SEQ ID NO: 449839 - DNA, 16 bp, M. musculus
tgtgtgcgtgtgcctg

SEQ ID NO: 449840 - DNA, 16 bp, M. musculus
tgtgtgcgtgtgtgcg

SEQ ID NO: 449841 - DNA, 16 bp, M. musculus
tgtgtgcgtgtgtgta

SEQ ID NO: 449842 - DNA, 16 bp, M. musculus
tgtgtgctatgtgtat

SEQ ID NO: 449843 - DNA, 16 bp, M. musculus
tgtgtgctcacacaca

SEQ ID NO: 449844 - DNA, 16 bp, M. musculus
tgtgtgctcacctgca

SEQ ID NO: 449845 - DNA, 16 bp, M. musculus
tgtgtgctcatgtaca

SEQ ID NO: 449846 - DNA, 16 bp, M. musculus
tgtgtgctccagcaaa

SEQ ID NO: 449847 - DNA, 16 bp, M. musculus
tgtgtgctcctgtgtg

SEQ ID NO: 449848 - DNA, 16 bp, M. musculus
tgtgtgctccttggtt

SEQ ID NO: 449849 - DNA, 16 bp, M. musculus
tgtgtgctctgtgtgt

SEQ ID NO: 449850 - DNA, 16 bp, M. musculus
tgtgtgctgaagatgg

SEQ ID NO: 449851 - DNA, 16 bp, M. musculus
tgtgtgctgcagaggg

SEQ ID NO: 449852 - DNA, 16 bp, M. musculus
tgtgtgctgctgtgtg

SEQ ID NO: 449853 - DNA, 16 bp, M. musculus
tgtgtgctgggatctg

SEQ ID NO: 449854 - DNA, 16 bp, M. musculus
tgtgtgctgggctgtg

SEQ ID NO: 449855 - DNA, 16 bp, M. musculus
tgtgtgctggtgtgta

SEQ ID NO: 449856 - DNA, 16 bp, M. musculus
tgtgtgctgtgacatg

SEQ ID NO: 449857 - DNA, 16 bp, M. musculus
tgtgtgctgtgagtgt

SEQ ID NO: 449858 - DNA, 16 bp, M. musculus
tgtgtgctgtgtgtat

SEQ ID NO: 449859 - DNA, 16 bp, M. musculus
tgtgtgcttccatgtg

SEQ ID NO: 449860 - DNA, 16 bp, M. musculus
tgtgtgcttctctgtg

SEQ ID NO: 449861 - DNA, 16 bp, M. musculus
tgtgtgctttccgttg

SEQ ID NO: 449862 - DNA, 16 bp, M. musculus
tgtgtgctttgacctt

SEQ ID NO: 449863 - DNA, 17 bp, M. musculus
tgtgtgctttgagcttt

SEQ ID NO: 449864 - DNA, 16 bp, M. musculus
tgtgtgcttttgtatg

SEQ ID NO: 449865 - DNA, 16 bp, M. musculus
tgtgtggaagccagaa

SEQ ID NO: 449866 - DNA, 16 bp, M. musculus
tgtgtggaagtcagag

SEQ ID NO: 449867 - DNA, 16 bp, M. musculus
tgtgtggacagaaggg

SEQ ID NO: 449868 - DNA, 16 bp, M. musculus
tgtgtggacagaggaa

SEQ ID NO: 449869 - DNA, 16 bp, M. musculus
tgtgtggaccccagat

SEQ ID NO: 449870 - DNA, 16 bp, M. musculus
tgtgtggagagcagag

SEQ ID NO: 449871 - DNA, 16 bp, M. musculus
tgtgtggaggaatgct

SEQ ID NO: 449872 - DNA, 16 bp, M. musculus
tgtgtggaggcctgag

SEQ ID NO: 449873 - DNA, 16 bp, M. musculus
tgtgtggagttcagag

SEQ ID NO: 449874 - DNA, 16 bp, M. musculus
tgtgtggagttcctta

SEQ ID NO: 449875 - DNA, 16 bp, M. musculus
tgtgtggatgtatgtg

SEQ ID NO: 449876 - DNA, 16 bp, M. musculus
tgtgtggatgtggatg

SEQ ID NO: 449877 - DNA, 16 bp, M. musculus
tgtgtggcaaacactt

SEQ ID NO: 449878 - DNA, 16 bp, M. musculus
tgtgtggcaagaactt

SEQ ID NO: 449879 - DNA, 16 bp, M. musculus
tgtgtggcaagtactt

SEQ ID NO: 449880 - DNA, 16 bp, M. musculus
tgtgtggcagccagag

SEQ ID NO: 449881 - DNA, 16 bp, M. musculus
tgtgtggccctggctg

SEQ ID NO: 449882 - DNA, 16 bp, M. musculus
tgtgtggctacttgaa

SEQ ID NO: 449883 - DNA, 16 bp, M. musculus
tgtgtggctctgcagg

SEQ ID NO: 449884 - DNA, 16 bp, M. musculus
tgtgtggctgctggga

SEQ ID NO: 449885 - DNA, 16 bp, M. musculus
tgtgtggcttccacct

SEQ ID NO: 449886 - DNA, 17 bp, M. musculus
tgtgtgggaagaccatg

SEQ ID NO: 449887 - DNA, 16 bp, M. musculus
tgtgtgggacttttgg

SEQ ID NO: 449888 - DNA, 16 bp, M. musculus
tgtgtgggaggcagag

SEQ ID NO: 449889 - DNA, 16 bp, M. musculus
tgtgtgggggaaaaaa

SEQ ID NO: 449890 - DNA, 16 bp, M. musculus
tgtgtggggtcagcag

SEQ ID NO: 449891 - DNA, 16 bp, M. musculus
tgtgtgggtatgtatg

SEQ ID NO: 449892 - DNA, 16 bp, M. musculus
tgtgtgggtatgtgca

SEQ ID NO: 449893 - DNA, 16 bp, M. musculus
tgtgtgggtgctggga

SEQ ID NO: 449894 - DNA, 40 bp, M. musculus
tgtgtgggttcatttctgggtcttcaattctattccattg

SEQ ID NO: 449895 - DNA, 16 bp, M. musculus
tgtgtggtactggtat

SEQ ID NO: 449896 - DNA, 16 bp, M. musculus
tgtgtggtatgcatgt

SEQ ID NO: 449897 - DNA, 16 bp, M. musculus
tgtgtggtatggtatg

SEQ ID NO: 449898 - DNA, 16 bp, M. musculus
tgtgtggtctgtctgt

SEQ ID NO: 449899 - DNA, 16 bp, M. musculus
tgtgtggtgtatgagt

SEQ ID NO: 449900 - DNA, 16 bp, M. musculus
tgtgtggtgtctgcca

SEQ ID NO: 449901 - DNA, 16 bp, M. musculus
tgtgtggtgtgcatgt

SEQ ID NO: 449902 - DNA, 16 bp, M. musculus
tgtgtggtgtgtatgc

SEQ ID NO: 449903 - DNA, 16 bp, M. musculus
tgtgtggttcctgggc

SEQ ID NO: 449904 - DNA, 16 bp, M. musculus
tgtgtggttgctggaa

SEQ ID NO: 449905 - DNA, 16 bp, M. musculus
tgtgtggtttcatctc

SEQ ID NO: 449906 - DNA, 16 bp, M. musculus
tgtgtgtaaaagtgtg

SEQ ID NO: 449907 - DNA, 16 bp, M. musculus
tgtgtgtaaaataaaa

SEQ ID NO: 449908 - DNA, 16 bp, M. musculus
tgtgtgtaactgtgtg

SEQ ID NO: 449909 - DNA, 16 bp, M. musculus
tgtgtgtaagaaagag

SEQ ID NO: 449910 - DNA, 16 bp, M. musculus
tgtgtgtaagcatatg

SEQ ID NO: 449911 - DNA, 16 bp, M. musculus
tgtgtgtaagtgtgtg

SEQ ID NO: 449912 - DNA, 16 bp, M. musculus
tgtgtgtacaagtgtg

SEQ ID NO: 449913 - DNA, 16 bp, M. musculus
tgtgtgtacacacatg

SEQ ID NO: 449914 - DNA, 16 bp, M. musculus
tgtgtgtacacaggtg

SEQ ID NO: 449915 - DNA, 16 bp, M. musculus
tgtgtgtacacatgca

SEQ ID NO: 449916 - DNA, 16 bp, M. musculus
tgtgtgtacactgtgt

SEQ ID NO: 449917 - DNA, 16 bp, M. musculus
tgtgtgtacatacaaa

SEQ ID NO: 449918 - DNA, 16 bp, M. musculus
tgtgtgtacatatatc

SEQ ID NO: 449919 - DNA, 16 bp, M. musculus
tgtgtgtacatatatg

SEQ ID NO: 449920 - DNA, 16 bp, M. musculus
tgtgtgtacatatgta

SEQ ID NO: 449921 - DNA, 16 bp, M. musculus
tgtgtgtacatctatg

SEQ ID NO: 449922 - DNA, 16 bp, M. musculus
tgtgtgtacatgcatg

SEQ ID NO: 449923 - DNA, 16 bp, M. musculus
tgtgtgtacatgggtg

SEQ ID NO: 449924 - DNA, 16 bp, M. musculus
tgtgtgtacatgtgct

SEQ ID NO: 449925 - DNA, 16 bp, M. musculus
tgtgtgtacatgtgtg

SEQ ID NO: 449926 - DNA, 16 bp, M. musculus
tgtgtgtacatgtttg

SEQ ID NO: 449927 - DNA, 16 bp, M. musculus
tgtgtgtacattgtgt

SEQ ID NO: 449928 - DNA, 16 bp, M. musculus
tgtgtgtacattttca

SEQ ID NO: 449929 - DNA, 16 bp, M. musculus
tgtgtgtacattttta

SEQ ID NO: 449930 - DNA, 16 bp, M. musculus
tgtgtgtaccatgtgc

SEQ ID NO: 449931 - DNA, 16 bp, M. musculus
tgtgtgtacctgtatg

SEQ ID NO: 449932 - DNA, 16 bp, M. musculus
tgtgtgtacgtgcatg

SEQ ID NO: 449933 - DNA, 16 bp, M. musculus
tgtgtgtacgtgtgtg

SEQ ID NO: 449934 - DNA, 16 bp, M. musculus
tgtgtgtactctgtgt

SEQ ID NO: 449935 - DNA, 16 bp, M. musculus
tgtgtgtacttatgta

SEQ ID NO: 449936 - DNA, 16 bp, M. musculus
tgtgtgtacttgtgag

SEQ ID NO: 449937 - DNA, 16 bp, M. musculus
tgtgtgtacttgtgtg

SEQ ID NO: 449938 - DNA, 16 bp, M. musculus
tgtgtgtaggagagag

SEQ ID NO: 449939 - DNA, 16 bp, M. musculus
tgtgtgtagtatgcat

SEQ ID NO: 449940 - DNA, 16 bp, M. musculus
tgtgtgtagtgtatgt

SEQ ID NO: 449941 - DNA, 16 bp, M. musculus
tgtgtgtataatgtat

SEQ ID NO: 449942 - DNA, 16 bp, M. musculus
tgtgtgtatacacgtg

SEQ ID NO: 449943 - DNA, 16 bp, M. musculus
tgtgtgtatacagttt

SEQ ID NO: 449944 - DNA, 16 bp, M. musculus
tgtgtgtatataaata

SEQ ID NO: 449945 - DNA, 16 bp, M. musculus
tgtgtgtatatactgt

SEQ ID NO: 449946 - DNA, 17 bp, M. musculus
tgtgtgtatatatataa

SEQ ID NO: 449947 - DNA, 16 bp, M. musculus
tgtgtgtatatatatt

SEQ ID NO: 449948 - DNA, 16 bp, M. musculus
tgtgtgtatatatgca

SEQ ID NO: 449949 - DNA, 16 bp, M. musculus
tgtgtgtatatattta

SEQ ID NO: 449950 - DNA, 16 bp, M. musculus
tgtgtgtatatgtaca

SEQ ID NO: 449951 - DNA, 16 bp, M. musculus
tgtgtgtatatgtctg

SEQ ID NO: 449952 - DNA, 16 bp, M. musculus
tgtgtgtatatgtgca

SEQ ID NO: 449953 - DNA, 16 bp, M. musculus
tgtgtgtatatgtggt

SEQ ID NO: 449954 - DNA, 16 bp, M. musculus
tgtgtgtatatttata

SEQ ID NO: 449955 - DNA, 16 bp, M. musculus
tgtgtgtatcacatgt

SEQ ID NO: 449956 - DNA, 16 bp, M. musculus
tgtgtgtatctctctc

SEQ ID NO: 449957 - DNA, 16 bp, M. musculus
tgtgtgtatctgtata

SEQ ID NO: 449958 - DNA, 16 bp, M. musculus
tgtgtgtatctgtgat

SEQ ID NO: 449959 - DNA, 16 bp, M. musculus
tgtgtgtatctgtgta

SEQ ID NO: 449960 - DNA, 16 bp, M. musculus
tgtgtgtatgacatgt

SEQ ID NO: 449961 - DNA, 16 bp, M. musculus
tgtgtgtatgagggag

SEQ ID NO: 449962 - DNA, 16 bp, M. musculus
tgtgtgtatgcatatg

SEQ ID NO: 449963 - DNA, 16 bp, M. musculus
tgtgtgtatgcatgca

SEQ ID NO: 449964 - DNA, 16 bp, M. musculus
tgtgtgtatgcatggg

SEQ ID NO: 449965 - DNA, 16 bp, M. musculus
tgtgtgtatgcattgt

SEQ ID NO: 449966 - DNA, 16 bp, M. musculus
tgtgtgtatgcctgtg

SEQ ID NO: 449967 - DNA, 16 bp, M. musculus
tgtgtgtatgcgtgtg

SEQ ID NO: 449968 - DNA, 16 bp, M. musculus
tgtgtgtatgctgtat

SEQ ID NO: 449969 - DNA, 16 bp, M. musculus
tgtgtgtatggctgtg

SEQ ID NO: 449970 - DNA, 16 bp, M. musculus
tgtgtgtatgggtgca

SEQ ID NO: 449971 - DNA, 16 bp, M. musculus
tgtgtgtatgggtgct

SEQ ID NO: 449972 - DNA, 16 bp, M. musculus
tgtgtgtatgtaacaa

SEQ ID NO: 449973 - DNA, 16 bp, M. musculus
tgtgtgtatgtaagtg

SEQ ID NO: 449974 - DNA, 16 bp, M. musculus
tgtgtgtatgtacact

SEQ ID NO: 449975 - DNA, 16 bp, M. musculus
tgtgtgtatgtacata

SEQ ID NO: 449976 - DNA, 16 bp, M. musculus
tgtgtgtatgtacatg

SEQ ID NO: 449977 - DNA, 16 bp, M. musculus
tgtgtgtatgtagaca

SEQ ID NO: 449978 - DNA, 16 bp, M. musculus
tgtgtgtatgtataaa

SEQ ID NO: 449979 - DNA, 16 bp, M. musculus
tgtgtgtatgtatgct

SEQ ID NO: 449980 - DNA, 16 bp, M. musculus
tgtgtgtatgtatggg

SEQ ID NO: 449981 - DNA, 17 bp, M. musculus
tgtgtgtatgtatgtga

SEQ ID NO: 449982 - DNA, 16 bp, M. musculus
tgtgtgtatgtattta

SEQ ID NO: 449983 - DNA, 16 bp, M. musculus
tgtgtgtatgtcagtg

SEQ ID NO: 449984 - DNA, 16 bp, M. musculus
tgtgtgtatgtgaata

SEQ ID NO: 449985 - DNA, 16 bp, M. musculus
tgtgtgtatgtgagtt

SEQ ID NO: 449986 - DNA, 16 bp, M. musculus
tgtgtgtatgtgcgtg

SEQ ID NO: 449987 - DNA, 16 bp, M. musculus
tgtgtgtatgtggagg

SEQ ID NO: 449988 - DNA, 16 bp, M. musculus
tgtgtgtatgtgtatg

SEQ ID NO: 449989 - DNA, 16 bp, M. musculus
tgtgtgtatgtgtggc

SEQ ID NO: 449990 - DNA, 16 bp, M. musculus
tgtgtgtatgtgtgta

SEQ ID NO: 449991 - DNA, 16 bp, M. musculus
tgtgtgtatgtgttag

SEQ ID NO: 449992 - DNA, 16 bp, M. musculus
tgtgtgtatgtttaca

SEQ ID NO: 449993 - DNA, 16 bp, M. musculus
tgtgtgtatgtttata

SEQ ID NO: 449994 - DNA, 16 bp, M. musculus
tgtgtgtatgtttcct

SEQ ID NO: 449995 - DNA, 16 bp, M. musculus
tgtgtgtattatatgt

SEQ ID NO: 449996 - DNA, 16 bp, M. musculus
tgtgtgtattgtgtgc

SEQ ID NO: 449997 - DNA, 16 bp, M. musculus
tgtgtgtatttataca

SEQ ID NO: 449998 - DNA, 16 bp, M. musculus
tgtgtgtatttatgta

SEQ ID NO: 449999 - DNA, 16 bp, M. musculus
tgtgtgtattttctgt

SEQ ID NO: 450000 - DNA, 16 bp, M. musculus
tgtgtgtcacatgcat

SEQ ID NO: 450001 - DNA, 16 bp, M. musculus
tgtgtgtcaccatgcc

SEQ ID NO: 450002 - DNA, 16 bp, M. musculus
tgtgtgtcaggcactg

SEQ ID NO: 450003 - DNA, 16 bp, M. musculus
tgtgtgtcatgtgcat

SEQ ID NO: 450004 - DNA, 16 bp, M. musculus
tgtgtgtcctgtgtgt

SEQ ID NO: 450005 - DNA, 16 bp, M. musculus
tgtgtgtctatgtgag

SEQ ID NO: 450006 - DNA, 16 bp, M. musculus
tgtgtgtctatgtgtt

SEQ ID NO: 450007 - DNA, 16 bp, M. musculus
tgtgtgtctatgttgt

SEQ ID NO: 450008 - DNA, 16 bp, M. musculus
tgtgtgtctctgtgtg

SEQ ID NO: 450009 - DNA, 16 bp, M. musculus
tgtgtgtctctttctc

SEQ ID NO: 450010 - DNA, 16 bp, M. musculus
tgtgtgtctgagaatg

SEQ ID NO: 450011 - DNA, 16 bp, M. musculus
tgtgtgtctgcatata

SEQ ID NO: 450012 - DNA, 16 bp, M. musculus
tgtgtgtctgggtctg

SEQ ID NO: 450013 - DNA, 16 bp, M. musculus
tgtgtgtctgtatatg

SEQ ID NO: 450014 - DNA, 16 bp, M. musculus
tgtgtgtctgtcagtg

SEQ ID NO: 450015 - DNA, 16 bp, M. musculus
tgtgtgtctgtcatct

SEQ ID NO: 450016 - DNA, 16 bp, M. musculus
tgtgtgtctgtctctc

SEQ ID NO: 450017 - DNA, 16 bp, M. musculus
tgtgtgtctgtctgta

SEQ ID NO: 450018 - DNA, 16 bp, M. musculus
tgtgtgtctgtgcaca

SEQ ID NO: 450019 - DNA, 16 bp, M. musculus
tgtgtgtctgtgcgcg

SEQ ID NO: 450020 - DNA, 16 bp, M. musculus
tgtgtgtctgtgggag

SEQ ID NO: 450021 - DNA, 16 bp, M. musculus
tgtgtgtctgtgtatc

SEQ ID NO: 450022 - DNA, 16 bp, M. musculus
tgtgtgtctgtgtcag

SEQ ID NO: 450023 - DNA, 16 bp, M. musculus
tgtgtgtctgtgtgag

SEQ ID NO: 450024 - DNA, 16 bp, M. musculus
tgtgtgtctgtgtgta

SEQ ID NO: 450025 - DNA, 16 bp, M. musculus
tgtgtgtctttcattc

SEQ ID NO: 450026 - DNA, 16 bp, M. musculus
tgtgtgtgaaaagaaa

SEQ ID NO: 450027 - DNA, 16 bp, M. musculus
tgtgtgtgaaataaaa

SEQ ID NO: 450028 - DNA, 16 bp, M. musculus
tgtgtgtgaagacagc

SEQ ID NO: 450029 - DNA, 16 bp, M. musculus
tgtgtgtgaagagtgt

SEQ ID NO: 450030 - DNA, 16 bp, M. musculus
tgtgtgtgaaggagag

SEQ ID NO: 450031 - DNA, 16 bp, M. musculus
tgtgtgtgaagtcaga

SEQ ID NO: 450032 - DNA, 16 bp, M. musculus
tgtgtgtgaatgtgaa

SEQ ID NO: 450033 - DNA, 16 bp, M. musculus
tgtgtgtgaatgtgtg

SEQ ID NO: 450034 - DNA, 16 bp, M. musculus
tgtgtgtgaatttata

SEQ ID NO: 450035 - DNA, 16 bp, M. musculus
tgtgtgtgactatgtg

SEQ ID NO: 450036 - DNA, 16 bp, M. musculus
tgtgtgtgagagagaa

SEQ ID NO: 450037 - DNA, 16 bp, M. musculus
tgtgtgtgagagagat

SEQ ID NO: 450038 - DNA, 16 bp, M. musculus
tgtgtgtgagagagca

SEQ ID NO: 450039 - DNA, 16 bp, M. musculus
tgtgtgtgaggtatgt

SEQ ID NO: 450040 - DNA, 16 bp, M. musculus
tgtgtgtgagtgcaga

SEQ ID NO: 450041 - DNA, 16 bp, M. musculus
tgtgtgtgagtgcagt

SEQ ID NO: 450042 - DNA, 16 bp, M. musculus
tgtgtgtgagtgtgaa

SEQ ID NO: 450043 - DNA, 16 bp, M. musculus
tgtgtgtgatgtgagt

SEQ ID NO: 450044 - DNA, 16 bp, M. musculus
tgtgtgtgattgtatg

SEQ ID NO: 450045 - DNA, 16 bp, M. musculus
tgtgtgtgcaatgcct

SEQ ID NO: 450046 - DNA, 16 bp, M. musculus
tgtgtgtgcacacaca

SEQ ID NO: 450047 - DNA, 16 bp, M. musculus
tgtgtgtgcacagaca

SEQ ID NO: 450048 - DNA, 16 bp, M. musculus
tgtgtgtgcacagtgc

SEQ ID NO: 450049 - DNA, 16 bp, M. musculus
tgtgtgtgcacatgca

SEQ ID NO: 450050 - DNA, 16 bp, M. musculus
tgtgtgtgcacatgta

SEQ ID NO: 450051 - DNA, 16 bp, M. musculus
tgtgtgtgcacatgtg

SEQ ID NO: 450052 - DNA, 16 bp, M. musculus
tgtgtgtgcacgcctg

SEQ ID NO: 450053 - DNA, 16 bp, M. musculus
tgtgtgtgcacgtgcg

SEQ ID NO: 450054 - DNA, 16 bp, M. musculus
tgtgtgtgcacgtgtg

SEQ ID NO: 450055 - DNA, 16 bp, M. musculus
tgtgtgtgcactcata

SEQ ID NO: 450056 - DNA, 16 bp, M. musculus
tgtgtgtgcactcgtg

SEQ ID NO: 450057 - DNA, 16 bp, M. musculus
tgtgtgtgcatacctg

SEQ ID NO: 450058 - DNA, 16 bp, M. musculus
tgtgtgtgcatatgca

SEQ ID NO: 450059 - DNA, 16 bp, M. musculus
tgtgtgtgcatatgga

SEQ ID NO: 450060 - DNA, 16 bp, M. musculus
tgtgtgtgcatatgtt

SEQ ID NO: 450061 - DNA, 16 bp, M. musculus
tgtgtgtgcatctata

SEQ ID NO: 450062 - DNA, 16 bp, M. musculus
tgtgtgtgcatgaaca

SEQ ID NO: 450063 - DNA, 16 bp, M. musculus
tgtgtgtgcatgcatg

SEQ ID NO: 450064 - DNA, 16 bp, M. musculus
tgtgtgtgcatggtgt

SEQ ID NO: 450065 - DNA, 16 bp, M. musculus
tgtgtgtgcatgtaca

SEQ ID NO: 450066 - DNA, 16 bp, M. musculus
tgtgtgtgcatgtctg

SEQ ID NO: 450067 - DNA, 16 bp, M. musculus
tgtgtgtgcatgtgag

SEQ ID NO: 450068 - DNA, 16 bp, M. musculus
tgtgtgtgcatgtggg

SEQ ID NO: 450069 - DNA, 16 bp, M. musculus
tgtgtgtgcatgtgtg

SEQ ID NO: 450070 - DNA, 20 bp, M. musculus
tgtgtgtgcatgtgtgtgtg

SEQ ID NO: 450071 - DNA, 16 bp, M. musculus
tgtgtgtgcatttgtg

SEQ ID NO: 450072 - DNA, 16 bp, M. musculus
tgtgtgtgcatttttg

SEQ ID NO: 450073 - DNA, 16 bp, M. musculus
tgtgtgtgcccatgtg

SEQ ID NO: 450074 - DNA, 16 bp, M. musculus
tgtgtgtgcccgtgtg

SEQ ID NO: 450075 - DNA, 16 bp, M. musculus
tgtgtgtgcctgagtg

SEQ ID NO: 450076 - DNA, 16 bp, M. musculus
tgtgtgtgcctgcctg

SEQ ID NO: 450077 - DNA, 16 bp, M. musculus
tgtgtgtgcctgctca

SEQ ID NO: 450078 - DNA, 16 bp, M. musculus
tgtgtgtgcctggtgc

SEQ ID NO: 450079 - DNA, 16 bp, M. musculus
tgtgtgtgcctgtgag

SEQ ID NO: 450080 - DNA, 16 bp, M. musculus
tgtgtgtgcctgtgtg

SEQ ID NO: 450081 - DNA, 16 bp, M. musculus
tgtgtgtgcgcacaca

SEQ ID NO: 450082 - DNA, 16 bp, M. musculus
tgtgtgtgcgcatgct

SEQ ID NO: 450083 - DNA, 16 bp, M. musculus
tgtgtgtgcgcgcacg

SEQ ID NO: 450084 - DNA, 17 bp, M. musculus
tgtgtgtgcgcgcgcat

SEQ ID NO: 450085 - DNA, 19 bp, M. musculus
tgtgtgtgcgcgcgcgcgt

SEQ ID NO: 450086 - DNA, 16 bp, M. musculus
tgtgtgtgcgcgtgca

SEQ ID NO: 450087 - DNA, 16 bp, M. musculus
tgtgtgtgcgtgagtg

SEQ ID NO: 450088 - DNA, 16 bp, M. musculus
tgtgtgtgcgtgcatg

SEQ ID NO: 450089 - DNA, 17 bp, M. musculus
tgtgtgtgcgtgcgcgt

SEQ ID NO: 450090 - DNA, 16 bp, M. musculus
tgtgtgtgcgtgtgca

SEQ ID NO: 450091 - DNA, 16 bp, M. musculus
tgtgtgtgcgtgtgta

SEQ ID NO: 450092 - DNA, 16 bp, M. musculus
tgtgtgtgctcacagg

SEQ ID NO: 450093 - DNA, 16 bp, M. musculus
tgtgtgtgctcatgtg

SEQ ID NO: 450094 - DNA, 16 bp, M. musculus
tgtgtgtgctcgcatg

SEQ ID NO: 450095 - DNA, 16 bp, M. musculus
tgtgtgtgctctctct

SEQ ID NO: 450096 - DNA, 16 bp, M. musculus
tgtgtgtgctgtgtga

SEQ ID NO: 450097 - DNA, 16 bp, M. musculus
tgtgtgtgcttatgca

SEQ ID NO: 450098 - DNA, 16 bp, M. musculus
tgtgtgtgcttcagag

SEQ ID NO: 450099 - DNA, 16 bp, M. musculus
tgtgtgtgcttctgtg

SEQ ID NO: 450100 - DNA, 16 bp, M. musculus
tgtgtgtgcttgcatg

SEQ ID NO: 450101 - DNA, 16 bp, M. musculus
tgtgtgtgcttgcttg

SEQ ID NO: 450102 - DNA, 16 bp, M. musculus
tgtgtgtggagatgta

SEQ ID NO: 450103 - DNA, 16 bp, M. musculus
tgtgtgtggagcatca

SEQ ID NO: 450104 - DNA, 16 bp, M. musculus
tgtgtgtggaggacag

SEQ ID NO: 450105 - DNA, 16 bp, M. musculus
tgtgtgtggatgcaca

SEQ ID NO: 450106 - DNA, 16 bp, M. musculus
tgtgtgtggatgtata

SEQ ID NO: 450107 - DNA, 16 bp, M. musculus
tgtgtgtggcagtttt

SEQ ID NO: 450108 - DNA, 16 bp, M. musculus
tgtgtgtggctgcatg

SEQ ID NO: 450109 - DNA, 16 bp, M. musculus
tgtgtgtgggtgtctc

SEQ ID NO: 450110 - DNA, 16 bp, M. musculus
tgtgtgtggtatgcat

SEQ ID NO: 450111 - DNA, 16 bp, M. musculus
tgtgtgtggtgaatgt

SEQ ID NO: 450112 - DNA, 16 bp, M. musculus
tgtgtgtggtgcctgc

SEQ ID NO: 450113 - DNA, 16 bp, M. musculus
tgtgtgtggtggcaca

SEQ ID NO: 450114 - DNA, 16 bp, M. musculus
tgtgtgtggtggtcag

SEQ ID NO: 450115 - DNA, 16 bp, M. musculus
tgtgtgtggtgtatgc

SEQ ID NO: 450116 - DNA, 16 bp, M. musculus
tgtgtgtgtaaaagaa

SEQ ID NO: 450117 - DNA, 16 bp, M. musculus
tgtgtgtgtaaaatgc

SEQ ID NO: 450118 - DNA, 16 bp, M. musculus
tgtgtgtgtaaacaga

SEQ ID NO: 450119 - DNA, 16 bp, M. musculus
tgtgtgtgtaaacata

SEQ ID NO: 450120 - DNA, 16 bp, M. musculus
tgtgtgtgtaaatata

SEQ ID NO: 450121 - DNA, 16 bp, M. musculus
tgtgtgtgtaaattct

SEQ ID NO: 450122 - DNA, 16 bp, M. musculus
tgtgtgtgtaataaaa

SEQ ID NO: 450123 - DNA, 16 bp, M. musculus
tgtgtgtgtaataaca

SEQ ID NO: 450124 - DNA, 16 bp, M. musculus
tgtgtgtgtaatatac

SEQ ID NO: 450125 - DNA, 16 bp, M. musculus
tgtgtgtgtaatattt

SEQ ID NO: 450126 - DNA, 16 bp, M. musculus
tgtgtgtgtacaactt

SEQ ID NO: 450127 - DNA, 16 bp, M. musculus
tgtgtgtgtacacact

SEQ ID NO: 450128 - DNA, 16 bp, M. musculus
tgtgtgtgtacacctg

SEQ ID NO: 450129 - DNA, 16 bp, M. musculus
tgtgtgtgtacacgca

SEQ ID NO: 450130 - DNA, 16 bp, M. musculus
tgtgtgtgtacatacg

SEQ ID NO: 450131 - DNA, 16 bp, M. musculus
tgtgtgtgtacatatt

SEQ ID NO: 450132 - DNA, 16 bp, M. musculus
tgtgtgtgtacatcag

SEQ ID NO: 450133 - DNA, 16 bp, M. musculus
tgtgtgtgtacatgca

SEQ ID NO: 450134 - DNA, 16 bp, M. musculus
tgtgtgtgtacatgct

SEQ ID NO: 450135 - DNA, 16 bp, M. musculus
tgtgtgtgtacatgta

SEQ ID NO: 450136 - DNA, 16 bp, M. musculus
tgtgtgtgtacatgtt

SEQ ID NO: 450137 - DNA, 16 bp, M. musculus
tgtgtgtgtacgtgtg

SEQ ID NO: 450138 - DNA, 16 bp, M. musculus
tgtgtgtgtacttctg

SEQ ID NO: 450139 - DNA, 16 bp, M. musculus
tgtgtgtgtactttct

SEQ ID NO: 450140 - DNA, 16 bp, M. musculus
tgtgtgtgtaggggta

SEQ ID NO: 450141 - DNA, 16 bp, M. musculus
tgtgtgtgtatacaca

SEQ ID NO: 450142 - DNA, 16 bp, M. musculus
tgtgtgtgtatacatc

SEQ ID NO: 450143 - DNA, 16 bp, M. musculus
tgtgtgtgtatacctg

SEQ ID NO: 450144 - DNA, 16 bp, M. musculus
tgtgtgtgtatactgt

SEQ ID NO: 450145 - DNA, 16 bp, M. musculus
tgtgtgtgtatagatg

SEQ ID NO: 450146 - DNA, 16 bp, M. musculus
tgtgtgtgtatataca

SEQ ID NO: 450147 - DNA, 16 bp, M. musculus
tgtgtgtgtatctgtc

SEQ ID NO: 450148 - DNA, 16 bp, M. musculus
tgtgtgtgtatcttag

SEQ ID NO: 450149 - DNA, 16 bp, M. musculus
tgtgtgtgtatgaatg

SEQ ID NO: 450150 - DNA, 16 bp, M. musculus
tgtgtgtgtatgcaca

SEQ ID NO: 450151 - DNA, 16 bp, M. musculus
tgtgtgtgtatgccat

SEQ ID NO: 450152 - DNA, 16 bp, M. musculus
tgtgtgtgtatgctta

SEQ ID NO: 450153 - DNA, 16 bp, M. musculus
tgtgtgtgtatggatg

SEQ ID NO: 450154 - DNA, 16 bp, M. musculus
tgtgtgtgtatgtaca

SEQ ID NO: 450155 - DNA, 16 bp, M. musculus
tgtgtgtgtatgtata

SEQ ID NO: 450156 - DNA, 16 bp, M. musculus
tgtgtgtgtatgtgca

SEQ ID NO: 450157 - DNA, 16 bp, M. musculus
tgtgtgtgtattcctg

SEQ ID NO: 450158 - DNA, 16 bp, M. musculus
tgtgtgtgtattcctt

SEQ ID NO: 450159 - DNA, 16 bp, M. musculus
tgtgtgtgtattctgt

SEQ ID NO: 450160 - DNA, 16 bp, M. musculus
tgtgtgtgtattcttt

SEQ ID NO: 450161 - DNA, 16 bp, M. musculus
tgtgtgtgtattggta

SEQ ID NO: 450162 - DNA, 16 bp, M. musculus
tgtgtgtgtatttgag

SEQ ID NO: 450163 - DNA, 16 bp, M. musculus
tgtgtgtgtcaacttg

SEQ ID NO: 450164 - DNA, 16 bp, M. musculus
tgtgtgtgtcactggg

SEQ ID NO: 450165 - DNA, 16 bp, M. musculus
tgtgtgtgtcagggcc

SEQ ID NO: 450166 - DNA, 16 bp, M. musculus
tgtgtgtgtccctctg

SEQ ID NO: 450167 - DNA, 16 bp, M. musculus
tgtgtgtgtccctgta

SEQ ID NO: 450168 - DNA, 16 bp, M. musculus
tgtgtgtgtcccttcc

SEQ ID NO: 450169 - DNA, 16 bp, M. musculus
tgtgtgtgtcctctgt

SEQ ID NO: 450170 - DNA, 16 bp, M. musculus
tgtgtgtgtcctcttt

SEQ ID NO: 450171 - DNA, 16 bp, M. musculus
tgtgtgtgtctaagtg

SEQ ID NO: 450172 - DNA, 16 bp, M. musculus
tgtgtgtgtctccctc

SEQ ID NO: 450173 - DNA, 16 bp, M. musculus
tgtgtgtgtctctccc

SEQ ID NO: 450174 - DNA, 16 bp, M. musculus
tgtgtgtgtctgagag

SEQ ID NO: 450175 - DNA, 16 bp, M. musculus
tgtgtgtgtctgagga

SEQ ID NO: 450176 - DNA, 16 bp, M. musculus
tgtgtgtgtctgcttc

SEQ ID NO: 450177 - DNA, 16 bp, M. musculus
tgtgtgtgtctggtgc

SEQ ID NO: 450178 - DNA, 16 bp, M. musculus
tgtgtgtgtctgtgta

SEQ ID NO: 450179 - DNA, 16 bp, M. musculus
tgtgtgtgtctgttca

SEQ ID NO: 450180 - DNA, 16 bp, M. musculus
tgtgtgtgtgaaaaat

SEQ ID NO: 450181 - DNA, 16 bp, M. musculus
tgtgtgtgtgaaagag

SEQ ID NO: 450182 - DNA, 16 bp, M. musculus
tgtgtgtgtgaaatgt

SEQ ID NO: 450183 - DNA, 16 bp, M. musculus
tgtgtgtgtgaacctg

SEQ ID NO: 450184 - DNA, 16 bp, M. musculus
tgtgtgtgtgaactgt

SEQ ID NO: 450185 - DNA, 16 bp, M. musculus
tgtgtgtgtgaaggag

SEQ ID NO: 450186 - DNA, 16 bp, M. musculus
tgtgtgtgtgaagttc

SEQ ID NO: 450187 - DNA, 16 bp, M. musculus
tgtgtgtgtgaatgaa

SEQ ID NO: 450188 - DNA, 16 bp, M. musculus
tgtgtgtgtgaatgag

SEQ ID NO: 450189 - DNA, 16 bp, M. musculus
tgtgtgtgtgaatgta

SEQ ID NO: 450190 - DNA, 16 bp, M. musculus
tgtgtgtgtgaattat

SEQ ID NO: 450191 - DNA, 16 bp, M. musculus
tgtgtgtgtgacactg

SEQ ID NO: 450192 - DNA, 16 bp, M. musculus
tgtgtgtgtgactgag

SEQ ID NO: 450193 - DNA, 16 bp, M. musculus
tgtgtgtgtgactttg

SEQ ID NO: 450194 - DNA, 16 bp, M. musculus
tgtgtgtgtgagacaa

SEQ ID NO: 450195 - DNA, 16 bp, M. musculus
tgtgtgtgtgagacag

SEQ ID NO: 450196 - DNA, 16 bp, M. musculus
tgtgtgtgtgagatcc

SEQ ID NO: 450197 - DNA, 16 bp, M. musculus
tgtgtgtgtgagatgc

SEQ ID NO: 450198 - DNA, 16 bp, M. musculus
tgtgtgtgtgagtgca

SEQ ID NO: 450199 - DNA, 16 bp, M. musculus
tgtgtgtgtgatcatg

SEQ ID NO: 450200 - DNA, 16 bp, M. musculus
tgtgtgtgtgatctca

SEQ ID NO: 450201 - DNA, 16 bp, M. musculus
tgtgtgtgtgatgcta

SEQ ID NO: 450202 - DNA, 16 bp, M. musculus
tgtgtgtgtgcacata

SEQ ID NO: 450203 - DNA, 16 bp, M. musculus
tgtgtgtgtgcacgtg

SEQ ID NO: 450204 - DNA, 16 bp, M. musculus
tgtgtgtgtgcactga

SEQ ID NO: 450205 - DNA, 16 bp, M. musculus
tgtgtgtgtgcagatg

SEQ ID NO: 450206 - DNA, 16 bp, M. musculus
tgtgtgtgtgcagcac

SEQ ID NO: 450207 - DNA, 16 bp, M. musculus
tgtgtgtgtgcagctg

SEQ ID NO: 450208 - DNA, 16 bp, M. musculus
tgtgtgtgtgcagtga

SEQ ID NO: 450209 - DNA, 16 bp, M. musculus
tgtgtgtgtgcagtgt

SEQ ID NO: 450210 - DNA, 16 bp, M. musculus
tgtgtgtgtgcagttt

SEQ ID NO: 450211 - DNA, 16 bp, M. musculus
tgtgtgtgtgcatgag

SEQ ID NO: 450212 - DNA, 16 bp, M. musculus
tgtgtgtgtgcatgca

SEQ ID NO: 450213 - DNA, 16 bp, M. musculus
tgtgtgtgtgcatgcc

SEQ ID NO: 450214 - DNA, 16 bp, M. musculus
tgtgtgtgtgcatgcg

SEQ ID NO: 450215 - DNA, 16 bp, M. musculus
tgtgtgtgtgcatgtt

SEQ ID NO: 450216 - DNA, 16 bp, M. musculus
tgtgtgtgtgccctca

SEQ ID NO: 450217 - DNA, 16 bp, M. musculus
tgtgtgtgtgccttgt

SEQ ID NO: 450218 - DNA, 16 bp, M. musculus
tgtgtgtgtgcgcact

SEQ ID NO: 450219 - DNA, 23 bp, M. musculus
tgtgtgtgtgcgcgcgcgcgcgt

SEQ ID NO: 450220 - DNA, 24 bp, M. musculus
tgtgtgtgtgcgcgcgcgcgtgtg

SEQ ID NO: 450221 - DNA, 16 bp, M. musculus
tgtgtgtgtgcgcgtg

SEQ ID NO: 450222 - DNA, 16 bp, M. musculus
tgtgtgtgtgcgctca

SEQ ID NO: 450223 - DNA, 16 bp, M. musculus
tgtgtgtgtgcgtatg

SEQ ID NO: 450224 - DNA, 16 bp, M. musculus
tgtgtgtgtgcgtgcc

SEQ ID NO: 450225 - DNA, 16 bp, M. musculus
tgtgtgtgtgctggag

SEQ ID NO: 450226 - DNA, 16 bp, M. musculus
tgtgtgtgtggcaggg

SEQ ID NO: 450227 - DNA, 16 bp, M. musculus
tgtgtgtgtggcagtg

SEQ ID NO: 450228 - DNA, 16 bp, M. musculus
tgtgtgtgtggctttc

SEQ ID NO: 450229 - DNA, 16 bp, M. musculus
tgtgtgtgtgtaaaaa

SEQ ID NO: 450230 - DNA, 16 bp, M. musculus
tgtgtgtgtgtaaagt

SEQ ID NO: 450231 - DNA, 16 bp, M. musculus
tgtgtgtgtgtaaata

SEQ ID NO: 450232 - DNA, 16 bp, M. musculus
tgtgtgtgtgtaacct

SEQ ID NO: 450233 - DNA, 17 bp, M. musculus
tgtgtgtgtgtaagaga

SEQ ID NO: 450234 - DNA, 16 bp, M. musculus
tgtgtgtgtgtaaggg

SEQ ID NO: 450235 - DNA, 16 bp, M. musculus
tgtgtgtgtgtacaat

SEQ ID NO: 450236 - DNA, 16 bp, M. musculus
tgtgtgtgtgtacact

SEQ ID NO: 450237 - DNA, 21 bp, M. musculus
tgtgtgtgtgtacgcgcgcgc

SEQ ID NO: 450238 - DNA, 17 bp, M. musculus
tgtgtgtgtgtacgtac

SEQ ID NO: 450239 - DNA, 16 bp, M. musculus
tgtgtgtgtgtagcct

SEQ ID NO: 450240 - DNA, 16 bp, M. musculus
tgtgtgtgtgtaggca

SEQ ID NO: 450241 - DNA, 16 bp, M. musculus
tgtgtgtgtgtataag

SEQ ID NO: 450242 - DNA, 16 bp, M. musculus
tgtgtgtgtgtatacc

SEQ ID NO: 450243 - DNA, 16 bp, M. musculus
tgtgtgtgtgtataga

SEQ ID NO: 450244 - DNA, 17 bp, M. musculus
tgtgtgtgtgtatatac

SEQ ID NO: 450245 - DNA, 16 bp, M. musculus
tgtgtgtgtgtatatc

SEQ ID NO: 450246 - DNA, 16 bp, M. musculus
tgtgtgtgtgtatgat

SEQ ID NO: 450247 - DNA, 17 bp, M. musculus
tgtgtgtgtgtatgcag

SEQ ID NO: 450248 - DNA, 16 bp, M. musculus
tgtgtgtgtgtattag

SEQ ID NO: 450249 - DNA, 16 bp, M. musculus
tgtgtgtgtgtccctg

SEQ ID NO: 450250 - DNA, 16 bp, M. musculus
tgtgtgtgtgtctaca

SEQ ID NO: 450251 - DNA, 16 bp, M. musculus
tgtgtgtgtgtctata

SEQ ID NO: 450252 - DNA, 16 bp, M. musculus
tgtgtgtgtgtctatt

SEQ ID NO: 450253 - DNA, 16 bp, M. musculus
tgtgtgtgtgtctgag

SEQ ID NO: 450254 - DNA, 16 bp, M. musculus
tgtgtgtgtgtctgcc

SEQ ID NO: 450255 - DNA, 16 bp, M. musculus
tgtgtgtgtgtcttag

SEQ ID NO: 450256 - DNA, 16 bp, M. musculus
tgtgtgtgtgtcttta

SEQ ID NO: 450257 - DNA, 16 bp, M. musculus
tgtgtgtgtgtgaaac

SEQ ID NO: 450258 - DNA, 16 bp, M. musculus
tgtgtgtgtgtgaaga

SEQ ID NO: 450259 - DNA, 16 bp, M. musculus
tgtgtgtgtgtgaagc

SEQ ID NO: 450260 - DNA, 16 bp, M. musculus
tgtgtgtgtgtgacat

SEQ ID NO: 450261 - DNA, 16 bp, M. musculus
tgtgtgtgtgtgactg

SEQ ID NO: 450262 - DNA, 16 bp, M. musculus
tgtgtgtgtgtgagaa

SEQ ID NO: 450263 - DNA, 16 bp, M. musculus
tgtgtgtgtgtgataa

SEQ ID NO: 450264 - DNA, 16 bp, M. musculus
tgtgtgtgtgtgatag

SEQ ID NO: 450265 - DNA, 16 bp, M. musculus
tgtgtgtgtgtgatga

SEQ ID NO: 450266 - DNA, 16 bp, M. musculus
tgtgtgtgtgtgatta

SEQ ID NO: 450267 - DNA, 16 bp, M. musculus
tgtgtgtgtgtgcaca

SEQ ID NO: 450268 - DNA, 16 bp, M. musculus
tgtgtgtgtgtgcagg

SEQ ID NO: 450269 - DNA, 16 bp, M. musculus
tgtgtgtgtgtgcatc

SEQ ID NO: 450270 - DNA, 16 bp, M. musculus
tgtgtgtgtgtgcatg

SEQ ID NO: 450271 - DNA, 16 bp, M. musculus
tgtgtgtgtgtgccag

SEQ ID NO: 450272 - DNA, 16 bp, M. musculus
tgtgtgtgtgtgccca

SEQ ID NO: 450273 - DNA, 16 bp, M. musculus
tgtgtgtgtgtgcctg

SEQ ID NO: 450274 - DNA, 21 bp, M. musculus
tgtgtgtgtgtgcgcgcgcga

SEQ ID NO: 450275 - DNA, 16 bp, M. musculus
tgtgtgtgtgtgctca

SEQ ID NO: 450276 - DNA, 16 bp, M. musculus
tgtgtgtgtgtgctct

SEQ ID NO: 450277 - DNA, 16 bp, M. musculus
tgtgtgtgtgtgcttc

SEQ ID NO: 450278 - DNA, 16 bp, M. musculus
tgtgtgtgtgtggaga

SEQ ID NO: 450279 - DNA, 16 bp, M. musculus
tgtgtgtgtgtggcaa

SEQ ID NO: 450280 - DNA, 16 bp, M. musculus
tgtgtgtgtgtggtca

SEQ ID NO: 450281 - DNA, 16 bp, M. musculus
tgtgtgtgtgtgtaaa

SEQ ID NO: 450282 - DNA, 16 bp, M. musculus
tgtgtgtgtgtgtaca

SEQ ID NO: 450283 - DNA, 17 bp, M. musculus
tgtgtgtgtgtgtactc

SEQ ID NO: 450284 - DNA, 16 bp, M. musculus
tgtgtgtgtgtgtata

SEQ ID NO: 450285 - DNA, 17 bp, M. musculus
tgtgtgtgtgtgtatca

SEQ ID NO: 450286 - DNA, 16 bp, M. musculus
tgtgtgtgtgtgtctc

SEQ ID NO: 450287 - DNA, 17 bp, M. musculus
tgtgtgtgtgtgtgaac

SEQ ID NO: 450288 - DNA, 17 bp, M. musculus
tgtgtgtgtgtgtgaat

SEQ ID NO: 450289 - DNA, 17 bp, M. musculus
tgtgtgtgtgtgtgccc

SEQ ID NO: 450290 - DNA, 17 bp, M. musculus
tgtgtgtgtgtgttcca

SEQ ID NO: 450291 - DNA, 16 bp, M. musculus
tgtgtgtgtgttaaaa

SEQ ID NO: 450292 - DNA, 16 bp, M. musculus
tgtgtgtgtgttaata

SEQ ID NO: 450293 - DNA, 16 bp, M. musculus
tgtgtgtgtgttccat

SEQ ID NO: 450294 - DNA, 16 bp, M. musculus
tgtgtgtgtgttctca

SEQ ID NO: 450295 - DNA, 16 bp, M. musculus
tgtgtgtgtgttgaat

SEQ ID NO: 450296 - DNA, 16 bp, M. musculus
tgtgtgtgtgtttaca

SEQ ID NO: 450297 - DNA, 16 bp, M. musculus
tgtgtgtgtgtttacg

SEQ ID NO: 450298 - DNA, 16 bp, M. musculus
tgtgtgtgtgtttcat

SEQ ID NO: 450299 - DNA, 16 bp, M. musculus
tgtgtgtgtgtttcta

SEQ ID NO: 450300 - DNA, 16 bp, M. musculus
tgtgtgtgtgtttgaa

SEQ ID NO: 450301 - DNA, 16 bp, M. musculus
tgtgtgtgtgttttca

SEQ ID NO: 450302 - DNA, 16 bp, M. musculus
tgtgtgtgttatgtgc

SEQ ID NO: 450303 - DNA, 16 bp, M. musculus
tgtgtgtgttcaggca

SEQ ID NO: 450304 - DNA, 16 bp, M. musculus
tgtgtgtgttcatctc

SEQ ID NO: 450305 - DNA, 16 bp, M. musculus
tgtgtgtgttcatgtg

SEQ ID NO: 450306 - DNA, 16 bp, M. musculus
tgtgtgtgttcatttc

SEQ ID NO: 450307 - DNA, 16 bp, M. musculus
tgtgtgtgttcctgaa

SEQ ID NO: 450308 - DNA, 16 bp, M. musculus
tgtgtgtgttcctgtg

SEQ ID NO: 450309 - DNA, 16 bp, M. musculus
tgtgtgtgttctggaa

SEQ ID NO: 450310 - DNA, 16 bp, M. musculus
tgtgtgtgttgaatgt

SEQ ID NO: 450311 - DNA, 16 bp, M. musculus
tgtgtgtgttgaggat

SEQ ID NO: 450312 - DNA, 16 bp, M. musculus
tgtgtgtgttgcacac

SEQ ID NO: 450313 - DNA, 16 bp, M. musculus
tgtgtgtgttggaaga

SEQ ID NO: 450314 - DNA, 16 bp, M. musculus
tgtgtgtgttgtacac

SEQ ID NO: 450315 - DNA, 16 bp, M. musculus
tgtgtgtgtttaagaa

SEQ ID NO: 450316 - DNA, 16 bp, M. musculus
tgtgtgtgtttatcag

SEQ ID NO: 450317 - DNA, 16 bp, M. musculus
tgtgtgtgtttcaata

SEQ ID NO: 450318 - DNA, 16 bp, M. musculus
tgtgtgtgtttccata

SEQ ID NO: 450319 - DNA, 16 bp, M. musculus
tgtgtgtgtttctctc

SEQ ID NO: 450320 - DNA, 16 bp, M. musculus
tgtgtgtgtttctgta

SEQ ID NO: 450321 - DNA, 16 bp, M. musculus
tgtgtgtgtttgtaca

SEQ ID NO: 450322 - DNA, 16 bp, M. musculus
tgtgtgtgttttacaa

SEQ ID NO: 450323 - DNA, 16 bp, M. musculus
tgtgtgtgttttagaa

SEQ ID NO: 450324 - DNA, 16 bp, M. musculus
tgtgtgtgttttagga

SEQ ID NO: 450325 - DNA, 16 bp, M. musculus
tgtgtgtgttttattc

SEQ ID NO: 450326 - DNA, 16 bp, M. musculus
tgtgtgtgttttcaag

SEQ ID NO: 450327 - DNA, 16 bp, M. musculus
tgtgtgttagagagag

SEQ ID NO: 450328 - DNA, 16 bp, M. musculus
tgtgtgttatgtctgt

SEQ ID NO: 450329 - DNA, 16 bp, M. musculus
tgtgtgttcatacaca

SEQ ID NO: 450330 - DNA, 16 bp, M. musculus
tgtgtgttcatttttg

SEQ ID NO: 450331 - DNA, 16 bp, M. musculus
tgtgtgttcctggtgc

SEQ ID NO: 450332 - DNA, 16 bp, M. musculus
tgtgtgttctgtatgt

SEQ ID NO: 450333 - DNA, 16 bp, M. musculus
tgtgtgttcttttata

SEQ ID NO: 450334 - DNA, 16 bp, M. musculus
tgtgtgttcttttgag

SEQ ID NO: 450335 - DNA, 16 bp, M. musculus
tgtgtgttggggtcct

SEQ ID NO: 450336 - DNA, 16 bp, M. musculus
tgtgtgttgtgtatgc

SEQ ID NO: 450337 - DNA, 16 bp, M. musculus
tgtgtgttgtgtgcac

SEQ ID NO: 450338 - DNA, 16 bp, M. musculus
tgtgtgtttaacattt

SEQ ID NO: 450339 - DNA, 16 bp, M. musculus
tgtgtgtttacatgta

SEQ ID NO: 450340 - DNA, 16 bp, M. musculus
tgtgtgtttacctgtg

SEQ ID NO: 450341 - DNA, 16 bp, M. musculus
tgtgtgtttatatatg

SEQ ID NO: 450342 - DNA, 16 bp, M. musculus
tgtgtgtttatgtgca

SEQ ID NO: 450343 - DNA, 16 bp, M. musculus
tgtgtgtttatttctg

SEQ ID NO: 450344 - DNA, 16 bp, M. musculus
tgtgtgtttcctttat

SEQ ID NO: 450345 - DNA, 16 bp, M. musculus
tgtgtgtttctgcatc

SEQ ID NO: 450346 - DNA, 16 bp, M. musculus
tgtgtgtttctttcat

SEQ ID NO: 450347 - DNA, 16 bp, M. musculus
tgtgtgtttgcgtgca

SEQ ID NO: 450348 - DNA, 16 bp, M. musculus
tgtgtgtttgtaaata

SEQ ID NO: 450349 - DNA, 16 bp, M. musculus
tgtgtgtttgtgtgaa

SEQ ID NO: 450350 - DNA, 16 bp, M. musculus
tgtgtgttttaaaaat

SEQ ID NO: 450351 - DNA, 16 bp, M. musculus
tgtgtgttttaaataa

SEQ ID NO: 450352 - DNA, 16 bp, M. musculus
tgtgtgttttcacatg

SEQ ID NO: 450353 - DNA, 16 bp, M. musculus
tgtgtgttttcatgtt

SEQ ID NO: 450354 - DNA, 16 bp, M. musculus
tgtgttaagtgaaata

SEQ ID NO: 450355 - DNA, 16 bp, M. musculus
tgtgttactgtggagg

SEQ ID NO: 450356 - DNA, 16 bp, M. musculus
tgtgttagtcagggtt

SEQ ID NO: 450357 - DNA, 16 bp, M. musculus
tgtgttatatatgcat

SEQ ID NO: 450358 - DNA, 16 bp, M. musculus
tgtgttatatgtacat

SEQ ID NO: 450359 - DNA, 16 bp, M. musculus
tgtgttatatgttata

SEQ ID NO: 450360 - DNA, 16 bp, M. musculus
tgtgttcaacatcctt

SEQ ID NO: 450361 - DNA, 16 bp, M. musculus
tgtgttcaagagaatt

SEQ ID NO: 450362 - DNA, 16 bp, M. musculus
tgtgttcaaggccagt

SEQ ID NO: 450363 - DNA, 16 bp, M. musculus
tgtgttcaaggctttc

SEQ ID NO: 450364 - DNA, 16 bp, M. musculus
tgtgttcacacatgca

SEQ ID NO: 450365 - DNA, 16 bp, M. musculus
tgtgttcacatgtgtg

SEQ ID NO: 450366 - DNA, 16 bp, M. musculus
tgtgttcacctgtgtg

SEQ ID NO: 450367 - DNA, 16 bp, M. musculus
tgtgttcagtccccag

SEQ ID NO: 450368 - DNA, 16 bp, M. musculus
tgtgttcatagcagcc

SEQ ID NO: 450369 - DNA, 16 bp, M. musculus
tgtgttcatctgtgtg

SEQ ID NO: 450370 - DNA, 16 bp, M. musculus
tgtgttcatgtatgtg

SEQ ID NO: 450371 - DNA, 16 bp, M. musculus
tgtgttcattcaggga

SEQ ID NO: 450372 - DNA, 16 bp, M. musculus
tgtgttcatttgtttg

SEQ ID NO: 450373 - DNA, 17 bp, M. musculus
tgtgttccactcaccag

SEQ ID NO: 450374 - DNA, 16 bp, M. musculus
tgtgttccagaggcag

SEQ ID NO: 450375 - DNA, 17 bp, M. musculus
tgtgttccatccaatag

SEQ ID NO: 450376 - DNA, 16 bp, M. musculus
tgtgttccattttata

SEQ ID NO: 450377 - DNA, 16 bp, M. musculus
tgtgttcctgtgtgta

SEQ ID NO: 450378 - DNA, 16 bp, M. musculus
tgtgttctacctttct

SEQ ID NO: 450379 - DNA, 16 bp, M. musculus
tgtgttctaggagata

SEQ ID NO: 450380 - DNA, 16 bp, M. musculus
tgtgttctcatgctaa

SEQ ID NO: 450381 - DNA, 16 bp, M. musculus
tgtgttctctccctct

SEQ ID NO: 450382 - DNA, 16 bp, M. musculus
tgtgttctctctctag

SEQ ID NO: 450383 - DNA, 16 bp, M. musculus
tgtgttctctctctgt

SEQ ID NO: 450384 - DNA, 16 bp, M. musculus
tgtgttctctctgtgt

SEQ ID NO: 450385 - DNA, 16 bp, M. musculus
tgtgttctcttagggt

SEQ ID NO: 450386 - DNA, 16 bp, M. musculus
tgtgttctgatgtctg

SEQ ID NO: 450387 - DNA, 16 bp, M. musculus
tgtgttctgctctgct

SEQ ID NO: 450388 - DNA, 44 bp, M. musculus
tgtgttctgctttgacttgggaggccatatccttcagacccaca

SEQ ID NO: 450389 - DNA, 16 bp, M. musculus
tgtgttcttaactgct

SEQ ID NO: 450390 - DNA, 16 bp, M. musculus
tgtgttcttggacttg

SEQ ID NO: 450391 - DNA, 16 bp, M. musculus
tgtgttcttgttggag

SEQ ID NO: 450392 - DNA, 16 bp, M. musculus
tgtgttctttgcatgg

SEQ ID NO: 450393 - DNA, 16 bp, M. musculus
tgtgttgaatctgtag

SEQ ID NO: 450394 - DNA, 16 bp, M. musculus
tgtgttgcagtaaatc

SEQ ID NO: 450395 - DNA, 16 bp, M. musculus
tgtgttgcatccaata

SEQ ID NO: 450396 - DNA, 16 bp, M. musculus
tgtgttgccttggctg

SEQ ID NO: 450397 - DNA, 16 bp, M. musculus
tgtgttgctttgtcct

SEQ ID NO: 450398 - DNA, 16 bp, M. musculus
tgtgttggaaatttga

SEQ ID NO: 450399 - DNA, 16 bp, M. musculus
tgtgttggaatattga

SEQ ID NO: 450400 - DNA, 16 bp, M. musculus
tgtgttggggacctca

SEQ ID NO: 450401 - DNA, 21 bp, M. musculus
tgtgttggggtgcccaggact

SEQ ID NO: 450402 - DNA, 19 bp, M. musculus
tgtgttggggtgcccaggt

SEQ ID NO: 450403 - DNA, 16 bp, M. musculus
tgtgttgggtgcctca

SEQ ID NO: 450404 - DNA, 16 bp, M. musculus
tgtgttgtatgcatat

SEQ ID NO: 450405 - DNA, 16 bp, M. musculus
tgtgttgtatgtatat

SEQ ID NO: 450406 - DNA, 16 bp, M. musculus
tgtgttgtctggaaat

SEQ ID NO: 450407 - DNA, 16 bp, M. musculus
tgtgttgtgggaaata

SEQ ID NO: 450408 - DNA, 16 bp, M. musculus
tgtgttgtgttttcat

SEQ ID NO: 450409 - DNA, 16 bp, M. musculus
tgtgtttaaatttatg

SEQ ID NO: 450410 - DNA, 16 bp, M. musculus
tgtgtttaacaaatta

SEQ ID NO: 450411 - DNA, 16 bp, M. musculus
tgtgtttaatttaaaa

SEQ ID NO: 450412 - DNA, 17 bp, M. musculus
tgtgtttagcaaattat

SEQ ID NO: 450413 - DNA, 16 bp, M. musculus
tgtgtttatacataca

SEQ ID NO: 450414 - DNA, 16 bp, M. musculus
tgtgtttatatataca

SEQ ID NO: 450415 - DNA, 16 bp, M. musculus
tgtgtttatatgtgca

SEQ ID NO: 450416 - DNA, 16 bp, M. musculus
tgtgtttatatgtgta

SEQ ID NO: 450417 - DNA, 16 bp, M. musculus
tgtgtttatgtatgta

SEQ ID NO: 450418 - DNA, 16 bp, M. musculus
tgtgtttcagctatgt

SEQ ID NO: 450419 - DNA, 16 bp, M. musculus
tgtgtttcataacttc

SEQ ID NO: 450420 - DNA, 16 bp, M. musculus
tgtgtttcatgtgttt

SEQ ID NO: 450421 - DNA, 16 bp, M. musculus
tgtgtttccatgtgtg

SEQ ID NO: 450422 - DNA, 16 bp, M. musculus
tgtgtttccctggctg

SEQ ID NO: 450423 - DNA, 16 bp, M. musculus
tgtgtttcctctttta

SEQ ID NO: 450424 - DNA, 16 bp, M. musculus
tgtgtttctcagatag

SEQ ID NO: 450425 - DNA, 16 bp, M. musculus
tgtgtttctctctgtg

SEQ ID NO: 450426 - DNA, 16 bp, M. musculus
tgtgtttctctgtatg

SEQ ID NO: 450427 - DNA, 16 bp, M. musculus
tgtgtttctctgtctc

SEQ ID NO: 450428 - DNA, 16 bp, M. musculus
tgtgtttctgagtgtg

SEQ ID NO: 450429 - DNA, 16 bp, M. musculus
tgtgtttctgtatctg

SEQ ID NO: 450430 - DNA, 16 bp, M. musculus
tgtgtttctgtctgtc

SEQ ID NO: 450431 - DNA, 16 bp, M. musculus
tgtgtttctgtgtgca

SEQ ID NO: 450432 - DNA, 16 bp, M. musculus
tgtgtttctttaaaat

SEQ ID NO: 450433 - DNA, 16 bp, M. musculus
tgtgtttgaaaccaag

SEQ ID NO: 450434 - DNA, 16 bp, M. musculus
tgtgtttgaagacaac

SEQ ID NO: 450435 - DNA, 16 bp, M. musculus
tgtgtttgaatgcttg

SEQ ID NO: 450436 - DNA, 16 bp, M. musculus
tgtgtttgaatttgta

SEQ ID NO: 450437 - DNA, 16 bp, M. musculus
tgtgtttgagacagga

SEQ ID NO: 450438 - DNA, 16 bp, M. musculus
tgtgtttgcagcaaga

SEQ ID NO: 450439 - DNA, 16 bp, M. musculus
tgtgtttgcagttgaa

SEQ ID NO: 450440 - DNA, 16 bp, M. musculus
tgtgtttgcatgcatg

SEQ ID NO: 450441 - DNA, 16 bp, M. musculus
tgtgtttgctaggctc

SEQ ID NO: 450442 - DNA, 16 bp, M. musculus
tgtgtttgctatgccc

SEQ ID NO: 450443 - DNA, 16 bp, M. musculus
tgtgtttgctgggaat

SEQ ID NO: 450444 - DNA, 16 bp, M. musculus
tgtgtttggaggccag

SEQ ID NO: 450445 - DNA, 16 bp, M. musculus
tgtgtttggtgtctgc

SEQ ID NO: 450446 - DNA, 16 bp, M. musculus
tgtgtttgtaagtatg

SEQ ID NO: 450447 - DNA, 16 bp, M. musculus
tgtgtttgtatatatg

SEQ ID NO: 450448 - DNA, 16 bp, M. musculus
tgtgtttgtctgtgca

SEQ ID NO: 450449 - DNA, 16 bp, M. musculus
tgtgtttgtgcacatg

SEQ ID NO: 450450 - DNA, 16 bp, M. musculus
tgtgtttgtgcatatg

SEQ ID NO: 450451 - DNA, 16 bp, M. musculus
tgtgtttgtgcatgtg

SEQ ID NO: 450452 - DNA, 16 bp, M. musculus
tgtgtttgtgtctata

SEQ ID NO: 450453 - DNA, 16 bp, M. musculus
tgtgtttgtgtgcagg

SEQ ID NO: 450454 - DNA, 16 bp, M. musculus
tgtgtttgtgtgcatg

SEQ ID NO: 450455 - DNA, 16 bp, M. musculus
tgtgtttgtgtgtgaa

SEQ ID NO: 450456 - DNA, 16 bp, M. musculus
tgtgtttgtgtgtgca

SEQ ID NO: 450457 - DNA, 16 bp, M. musculus
tgtgtttgttcatttg

SEQ ID NO: 450458 - DNA, 16 bp, M. musculus
tgtgttttaaagaaac

SEQ ID NO: 450459 - DNA, 16 bp, M. musculus
tgtgttttaaagaaat

SEQ ID NO: 450460 - DNA, 16 bp, M. musculus
tgtgttttcattgcct

SEQ ID NO: 450461 - DNA, 16 bp, M. musculus
tgtgttttcatttaaa

SEQ ID NO: 450462 - DNA, 16 bp, M. musculus
tgtgttttcttcagtt

SEQ ID NO: 450463 - DNA, 16 bp, M. musculus
tgtgttttgcaaattg

SEQ ID NO: 450464 - DNA, 18 bp, M. musculus
tgtgttttgcaaattgta

SEQ ID NO: 450465 - DNA, 16 bp, M. musculus
tgtgttttgcctgtat

SEQ ID NO: 450466 - DNA, 16 bp, M. musculus
tgtgtttttaaaatgt

SEQ ID NO: 450467 - DNA, 16 bp, M. musculus
tgtgtttttcaaagaa

SEQ ID NO: 450468 - DNA, 16 bp, M. musculus
tgtgtttttccacaga

SEQ ID NO: 450469 - DNA, 16 bp, M. musculus
tgttaaaaaatgacat

SEQ ID NO: 450470 - DNA, 16 bp, M. musculus
tgttaaaatgcagatt

SEQ ID NO: 450471 - DNA, 16 bp, M. musculus
tgttaaacatttcttt

SEQ ID NO: 450472 - DNA, 16 bp, M. musculus
tgttaaagaagagggc

SEQ ID NO: 450473 - DNA, 16 bp, M. musculus
tgttaaagatatttgc

SEQ ID NO: 450474 - DNA, 16 bp, M. musculus
tgttaaagatgctgtc

SEQ ID NO: 450475 - DNA, 16 bp, M. musculus
tgttaaaggcttggtc

SEQ ID NO: 450476 - DNA, 32 bp, M. musculus
tgttaaatctcaaattgattcatctctttcaa

SEQ ID NO: 450477 - DNA, 16 bp, M. musculus
tgttaacaatgaattc

SEQ ID NO: 450478 - DNA, 16 bp, M. musculus
tgttaacagaaaaagt

SEQ ID NO: 450479 - DNA, 16 bp, M. musculus
tgttaacagctttcct

SEQ ID NO: 450480 - DNA, 16 bp, M. musculus
tgttaacattaatgag

SEQ ID NO: 450481 - DNA, 17 bp, M. musculus
tgttaactttcttcttt

SEQ ID NO: 450482 - DNA, 16 bp, M. musculus
tgttaagaaaaatgtg

SEQ ID NO: 450483 - DNA, 16 bp, M. musculus
tgttaagaatgagaga

SEQ ID NO: 450484 - DNA, 17 bp, M. musculus
tgttaagagcactgact

SEQ ID NO: 450485 - DNA, 16 bp, M. musculus
tgttaagagtgcttgc

SEQ ID NO: 450486 - DNA, 23 bp, M. musculus
tgttaaggaagggcagcgacttt

SEQ ID NO: 450487 - DNA, 16 bp, M. musculus
tgttaagtttcaaacc

SEQ ID NO: 450488 - DNA, 16 bp, M. musculus
tgttaataaaagaatt

SEQ ID NO: 450489 - DNA, 16 bp, M. musculus
tgttaataagaacaca

SEQ ID NO: 450490 - DNA, 16 bp, M. musculus
tgttaatattttaaag

SEQ ID NO: 450491 - DNA, 16 bp, M. musculus
tgttaatcaagaaaat

SEQ ID NO: 450492 - DNA, 16 bp, M. musculus
tgttaatcctttgtgt

SEQ ID NO: 450493 - DNA, 16 bp, M. musculus
tgttaatctgtgtctt

SEQ ID NO: 450494 - DNA, 16 bp, M. musculus
tgttaattgccatcta

SEQ ID NO: 450495 - DNA, 16 bp, M. musculus
tgttacaagagaaatt

SEQ ID NO: 450496 - DNA, 16 bp, M. musculus
tgttacaatgccatct

SEQ ID NO: 450497 - DNA, 16 bp, M. musculus
tgttacagagagaaac

SEQ ID NO: 450498 - DNA, 18 bp, M. musculus
tgttacagatggttgtga

SEQ ID NO: 450499 - DNA, 16 bp, M. musculus
tgttacagcaatagaa

SEQ ID NO: 450500 - DNA, 16 bp, M. musculus
tgttacagtgcctgga

SEQ ID NO: 450501 - DNA, 16 bp, M. musculus
tgttacatatgtatat

SEQ ID NO: 450502 - DNA, 16 bp, M. musculus
tgttacatatgtatct

SEQ ID NO: 450503 - DNA, 16 bp, M. musculus
tgttacattttaaaaa

SEQ ID NO: 450504 - DNA, 16 bp, M. musculus
tgttacatttttaaaa

SEQ ID NO: 450505 - DNA, 16 bp, M. musculus
tgttaccatctctcag

SEQ ID NO: 450506 - DNA, 16 bp, M. musculus
tgttacctcttagaag

SEQ ID NO: 450507 - DNA, 16 bp, M. musculus
tgttactgtgataaaa

SEQ ID NO: 450508 - DNA, 16 bp, M. musculus
tgttacttccttacct

SEQ ID NO: 450509 - DNA, 16 bp, M. musculus
tgttacttggcatttt

SEQ ID NO: 450510 - DNA, 16 bp, M. musculus
tgttacttttctgttg

SEQ ID NO: 450511 - DNA, 16 bp, M. musculus
tgttactttttaaatt

SEQ ID NO: 450512 - DNA, 16 bp, M. musculus
tgttagaaaaacaaaa

SEQ ID NO: 450513 - DNA, 16 bp, M. musculus
tgttagagctcctggg

SEQ ID NO: 450514 - DNA, 16 bp, M. musculus
tgttagaggaaatgtg

SEQ ID NO: 450515 - DNA, 16 bp, M. musculus
tgttagagtagatgtg

SEQ ID NO: 450516 - DNA, 16 bp, M. musculus
tgttagagtaggtgtg

SEQ ID NO: 450517 - DNA, 16 bp, M. musculus
tgttagatcccctgga

SEQ ID NO: 450518 - DNA, 16 bp, M. musculus
tgttagatctcattac

SEQ ID NO: 450519 - DNA, 16 bp, M. musculus
tgttagatttttcctt

SEQ ID NO: 450520 - DNA, 33 bp, M. musculus
tgttagcagaactagcttcactgatttagaaaa

SEQ ID NO: 450521 - DNA, 16 bp, M. musculus
tgttagcagcttttct

SEQ ID NO: 450522 - DNA, 16 bp, M. musculus
tgttagcatgtctgtt

SEQ ID NO: 450523 - DNA, 16 bp, M. musculus
tgttagcattctttct

SEQ ID NO: 450524 - DNA, 18 bp, M. musculus
tgttagcctctatcagca

SEQ ID NO: 450525 - DNA, 16 bp, M. musculus
tgttaggcaagcactc

SEQ ID NO: 450526 - DNA, 16 bp, M. musculus
tgttaggtgatatcaa

SEQ ID NO: 450527 - DNA, 16 bp, M. musculus
tgttagtctatatctt

SEQ ID NO: 450528 - DNA, 16 bp, M. musculus
tgttagtctctatcag

SEQ ID NO: 450529 - DNA, 16 bp, M. musculus
tgttagtgtccatgtg

SEQ ID NO: 450530 - DNA, 16 bp, M. musculus
tgttagtgttttccat

SEQ ID NO: 450531 - DNA, 16 bp, M. musculus
tgttatatatgtgtgt

SEQ ID NO: 450532 - DNA, 16 bp, M. musculus
tgttatatttaggaat

SEQ ID NO: 450533 - DNA, 16 bp, M. musculus
tgttatcccagcactt

SEQ ID NO: 450534 - DNA, 16 bp, M. musculus
tgttatccctcttccc

SEQ ID NO: 450535 - DNA, 16 bp, M. musculus
tgttatcctttgtagg

SEQ ID NO: 450536 - DNA, 16 bp, M. musculus
tgttatcttactgttg

SEQ ID NO: 450537 - DNA, 16 bp, M. musculus
tgttatgaaatataat

SEQ ID NO: 450538 - DNA, 16 bp, M. musculus
tgttatgaatcataat

SEQ ID NO: 450539 - DNA, 16 bp, M. musculus
tgttatgatgtgctta

SEQ ID NO: 450540 - DNA, 16 bp, M. musculus
tgttatgccatgttca

SEQ ID NO: 450541 - DNA, 16 bp, M. musculus
tgttatggaagatcag

SEQ ID NO: 450542 - DNA, 16 bp, M. musculus
tgttatggaatacttt

SEQ ID NO: 450543 - DNA, 16 bp, M. musculus
tgttatggtttgtata

SEQ ID NO: 450544 - DNA, 16 bp, M. musculus
tgttattaaagtatat

SEQ ID NO: 450545 - DNA, 22 bp, M. musculus
tgttattagacgcgttctcacg

SEQ ID NO: 450546 - DNA, 16 bp, M. musculus
tgttattcccaatgaa

SEQ ID NO: 450547 - DNA, 16 bp, M. musculus
tgttattccctttccc

SEQ ID NO: 450548 - DNA, 16 bp, M. musculus
tgttattccctttcct

SEQ ID NO: 450549 - DNA, 16 bp, M. musculus
tgttattgaagagcag

SEQ ID NO: 450550 - DNA, 16 bp, M. musculus
tgttattgttactgtt

SEQ ID NO: 450551 - DNA, 16 bp, M. musculus
tgttatttattgaaaa

SEQ ID NO: 450552 - DNA, 16 bp, M. musculus
tgttatttgacttctt

SEQ ID NO: 450553 - DNA, 16 bp, M. musculus
tgttcaacatttttaa

SEQ ID NO: 450554 - DNA, 16 bp, M. musculus
tgttcaagaaaaaaaa

SEQ ID NO: 450555 - DNA, 16 bp, M. musculus
tgttcaaggccagcct

SEQ ID NO: 450556 - DNA, 16 bp, M. musculus
tgttcaattcttttac

SEQ ID NO: 450557 - DNA, 16 bp, M. musculus
tgttcacacacacaca

SEQ ID NO: 450558 - DNA, 16 bp, M. musculus
tgttcacacatcttca

SEQ ID NO: 450559 - DNA, 16 bp, M. musculus
tgttcacagcagcctt

SEQ ID NO: 450560 - DNA, 17 bp, M. musculus
tgttcacagcagtaaag

SEQ ID NO: 450561 - DNA, 16 bp, M. musculus
tgttcaccaccaccac

SEQ ID NO: 450562 - DNA, 16 bp, M. musculus
tgttcacctgatttta

SEQ ID NO: 450563 - DNA, 16 bp, M. musculus
tgttcacctgtatttc

SEQ ID NO: 450564 - DNA, 16 bp, M. musculus
tgttcactcagagatg

SEQ ID NO: 450565 - DNA, 16 bp, M. musculus
tgttcactttttaaaa

SEQ ID NO: 450566 - DNA, 16 bp, M. musculus
tgttcagagagagaga

SEQ ID NO: 450567 - DNA, 16 bp, M. musculus
tgttcagagcagcctt

SEQ ID NO: 450568 - DNA, 16 bp, M. musculus
tgttcagcccccacct

SEQ ID NO: 450569 - DNA, 16 bp, M. musculus
tgttcagctctgagca

SEQ ID NO: 450570 - DNA, 16 bp, M. musculus
tgttcaggaatatttt

SEQ ID NO: 450571 - DNA, 16 bp, M. musculus
tgttcaggctcttctg

SEQ ID NO: 450572 - DNA, 16 bp, M. musculus
tgttcagtattgtttt

SEQ ID NO: 450573 - DNA, 16 bp, M. musculus
tgttcagtccccaggt

SEQ ID NO: 450574 - DNA, 16 bp, M. musculus
tgttcagtgacattca

SEQ ID NO: 450575 - DNA, 16 bp, M. musculus
tgttcagttcccagca

SEQ ID NO: 450576 - DNA, 16 bp, M. musculus
tgttcagttttcacat

SEQ ID NO: 450577 - DNA, 16 bp, M. musculus
tgttcatagcagcgtt

SEQ ID NO: 450578 - DNA, 16 bp, M. musculus
tgttcatagcagctat

SEQ ID NO: 450579 - DNA, 16 bp, M. musculus
tgttcatagtggcttt

SEQ ID NO: 450580 - DNA, 16 bp, M. musculus
tgttcatagtggtctt

SEQ ID NO: 450581 - DNA, 16 bp, M. musculus
tgttcatcacagcctt

SEQ ID NO: 450582 - DNA, 16 bp, M. musculus
tgttcatcatcaagga

SEQ ID NO: 450583 - DNA, 16 bp, M. musculus
tgttcatcctagcttg

SEQ ID NO: 450584 - DNA, 16 bp, M. musculus
tgttcatcttcctgtg

SEQ ID NO: 450585 - DNA, 16 bp, M. musculus
tgttcatgcacatatg

SEQ ID NO: 450586 - DNA, 16 bp, M. musculus
tgttcatgtatgtatg

SEQ ID NO: 450587 - DNA, 16 bp, M. musculus
tgttcatgtggctgtc

SEQ ID NO: 450588 - DNA, 17 bp, M. musculus
tgttcattaccaaagga

SEQ ID NO: 450589 - DNA, 16 bp, M. musculus
tgttcattcagaggtg

SEQ ID NO: 450590 - DNA, 16 bp, M. musculus
tgttcattgctgcttt

SEQ ID NO: 450591 - DNA, 16 bp, M. musculus
tgttcatttagcaaaa

SEQ ID NO: 450592 - DNA, 16 bp, M. musculus
tgttcattttctcaaa

SEQ ID NO: 450593 - DNA, 16 bp, M. musculus
tgttcattttcttcac

SEQ ID NO: 450594 - DNA, 18 bp, M. musculus
tgttccaactggtaagaa

SEQ ID NO: 450595 - DNA, 16 bp, M. musculus
tgttccaagaacattt

SEQ ID NO: 450596 - DNA, 16 bp, M. musculus
tgttccaagtggcagc

SEQ ID NO: 450597 - DNA, 16 bp, M. musculus
tgttccacactttgtt

SEQ ID NO: 450598 - DNA, 16 bp, M. musculus
tgttccacctatagga

SEQ ID NO: 450599 - DNA, 16 bp, M. musculus
tgttccagaaaaaaaa

SEQ ID NO: 450600 - DNA, 16 bp, M. musculus
tgttccagagacagcc

SEQ ID NO: 450601 - DNA, 16 bp, M. musculus
tgttccagaggatctg

SEQ ID NO: 450602 - DNA, 16 bp, M. musculus
tgttccagccctgggt

SEQ ID NO: 450603 - DNA, 16 bp, M. musculus
tgttccaggacagcca

SEQ ID NO: 450604 - DNA, 19 bp, M. musculus
tgttccaggacagccaggg

SEQ ID NO: 450605 - DNA, 16 bp, M. musculus
tgttccagtatgactc

SEQ ID NO: 450606 - DNA, 16 bp, M. musculus
tgttccatccaagaga

SEQ ID NO: 450607 - DNA, 16 bp, M. musculus
tgttccatgtatccta

SEQ ID NO: 450608 - DNA, 16 bp, M. musculus
tgttccattgatcttc

SEQ ID NO: 450609 - DNA, 16 bp, M. musculus
tgttccatttttatcc

SEQ ID NO: 450610 - DNA, 16 bp, M. musculus
tgttcccatgatctgt

SEQ ID NO: 450611 - DNA, 16 bp, M. musculus
tgttcccatttctcct

SEQ ID NO: 450612 - DNA, 16 bp, M. musculus
tgttcccccacccatc

SEQ ID NO: 450613 - DNA, 16 bp, M. musculus
tgttcccccaccccca

SEQ ID NO: 450614 - DNA, 16 bp, M. musculus
tgttcccctgtactga

SEQ ID NO: 450615 - DNA, 16 bp, M. musculus
tgttccctaatttctt

SEQ ID NO: 450616 - DNA, 16 bp, M. musculus
tgttccctgcaggctg

SEQ ID NO: 450617 - DNA, 16 bp, M. musculus
tgttccctgcctgttc

SEQ ID NO: 450618 - DNA, 16 bp, M. musculus
tgttcccttcctggca

SEQ ID NO: 450619 - DNA, 16 bp, M. musculus
tgttccctttcctggt

SEQ ID NO: 450620 - DNA, 16 bp, M. musculus
tgttcctaaccactga

SEQ ID NO: 450621 - DNA, 18 bp, M. musculus
tgttcctacccccaatgt

SEQ ID NO: 450622 - DNA, 16 bp, M. musculus
tgttcctactctttct

SEQ ID NO: 450623 - DNA, 16 bp, M. musculus
tgttcctcaggagcca

SEQ ID NO: 450624 - DNA, 16 bp, M. musculus
tgttcctcctatagag

SEQ ID NO: 450625 - DNA, 16 bp, M. musculus
tgttcctcctataggg

SEQ ID NO: 450626 - DNA, 16 bp, M. musculus
tgttcctcctatgaga

SEQ ID NO: 450627 - DNA, 16 bp, M. musculus
tgttcctcctcctgct

SEQ ID NO: 450628 - DNA, 16 bp, M. musculus
tgttcctcctgtaatt

SEQ ID NO: 450629 - DNA, 16 bp, M. musculus
tgttcctcttcctcca

SEQ ID NO: 450630 - DNA, 16 bp, M. musculus
tgttcctgcatgtgtg

SEQ ID NO: 450631 - DNA, 16 bp, M. musculus
tgttcctgcctcagcc

SEQ ID NO: 450632 - DNA, 16 bp, M. musculus
tgttcctgcctgctat

SEQ ID NO: 450633 - DNA, 16 bp, M. musculus
tgttcctgccttgagg

SEQ ID NO: 450634 - DNA, 16 bp, M. musculus
tgttcctgctgccatg

SEQ ID NO: 450635 - DNA, 16 bp, M. musculus
tgttcctgctgctgct

SEQ ID NO: 450636 - DNA, 16 bp, M. musculus
tgttcctggaactctg

SEQ ID NO: 450637 - DNA, 16 bp, M. musculus
tgttcctgggaacagg

SEQ ID NO: 450638 - DNA, 16 bp, M. musculus
tgttcctgtgccctgt

SEQ ID NO: 450639 - DNA, 16 bp, M. musculus
tgttcctgtggctggg

SEQ ID NO: 450640 - DNA, 16 bp, M. musculus
tgttccttctgccttc

SEQ ID NO: 450641 - DNA, 16 bp, M. musculus
tgttcctttggccaca

SEQ ID NO: 450642 - DNA, 16 bp, M. musculus
tgttcctttgtccctg

SEQ ID NO: 450643 - DNA, 16 bp, M. musculus
tgttccttttgcaata

SEQ ID NO: 450644 - DNA, 16 bp, M. musculus
tgttctaagtcatgag

SEQ ID NO: 450645 - DNA, 16 bp, M. musculus
tgttctacagaatgag

SEQ ID NO: 450646 - DNA, 16 bp, M. musculus
tgttctacatcttgat

SEQ ID NO: 450647 - DNA, 16 bp, M. musculus
tgttctaccactgagc

SEQ ID NO: 450648 - DNA, 16 bp, M. musculus
tgttctagtttccttt

SEQ ID NO: 450649 - DNA, 16 bp, M. musculus
tgttctatttaattga

SEQ ID NO: 450650 - DNA, 16 bp, M. musculus
tgttctatttttaaaa

SEQ ID NO: 450651 - DNA, 16 bp, M. musculus
tgttctcagacacacc

SEQ ID NO: 450652 - DNA, 16 bp, M. musculus
tgttctcagccaacca

SEQ ID NO: 450653 - DNA, 16 bp, M. musculus
tgttctcagcctcagg

SEQ ID NO: 450654 - DNA, 16 bp, M. musculus
tgttctcagctcctcc

SEQ ID NO: 450655 - DNA, 16 bp, M. musculus
tgttctcatatacata

SEQ ID NO: 450656 - DNA, 16 bp, M. musculus
tgttctcatgtgagtt

SEQ ID NO: 450657 - DNA, 16 bp, M. musculus
tgttctcctgaatttc

SEQ ID NO: 450658 - DNA, 16 bp, M. musculus
tgttctcctgtactga

SEQ ID NO: 450659 - DNA, 22 bp, M. musculus
tgttctcctgtatttctttaag

SEQ ID NO: 450660 - DNA, 16 bp, M. musculus
tgttctcctgtgagtg

SEQ ID NO: 450661 - DNA, 16 bp, M. musculus
tgttctccttataaga

SEQ ID NO: 450662 - DNA, 16 bp, M. musculus
tgttctccttgctcca

SEQ ID NO: 450663 - DNA, 16 bp, M. musculus
tgttctctctctgtgt

SEQ ID NO: 450664 - DNA, 16 bp, M. musculus
tgttctctctgtgtgt

SEQ ID NO: 450665 - DNA, 16 bp, M. musculus
tgttctctgaaagagc

SEQ ID NO: 450666 - DNA, 16 bp, M. musculus
tgttctctgacctcca

SEQ ID NO: 450667 - DNA, 16 bp, M. musculus
tgttctctgacttcca

SEQ ID NO: 450668 - DNA, 16 bp, M. musculus
tgttctctgatcttca

SEQ ID NO: 450669 - DNA, 16 bp, M. musculus
tgttctctgtcccaca

SEQ ID NO: 450670 - DNA, 17 bp, M. musculus
tgttctctgtggaatct

SEQ ID NO: 450671 - DNA, 16 bp, M. musculus
tgttctcttagggtct

SEQ ID NO: 450672 - DNA, 16 bp, M. musculus
tgttctcttagtatct

SEQ ID NO: 450673 - DNA, 16 bp, M. musculus
tgttctcttgctgtga

SEQ ID NO: 450674 - DNA, 16 bp, M. musculus
tgttctcttggtgtct

SEQ ID NO: 450675 - DNA, 16 bp, M. musculus
tgttctctttaaaata

SEQ ID NO: 450676 - DNA, 16 bp, M. musculus
tgttctcttttttaaa

SEQ ID NO: 450677 - DNA, 16 bp, M. musculus
tgttctgaaaaacaaa

SEQ ID NO: 450678 - DNA, 16 bp, M. musculus
tgttctgaaaatattt

SEQ ID NO: 450679 - DNA, 16 bp, M. musculus
tgttctgaagccatca

SEQ ID NO: 450680 - DNA, 63 bp, M. musculus
tgttctgattattatgtgtcgggaggaatttcttttctggtccagtctatttggagttctgta

SEQ ID NO: 450681 - DNA, 16 bp, M. musculus
tgttctgatttttaaa

SEQ ID NO: 450682 - DNA, 16 bp, M. musculus
tgttctgcagtgtctg
